United States Patent 7,745,391 (HUMAN THROMBOSPONDIN POLYPEPTIDE) - sequence listing, part 209

SEQ ID NO: 509683 - DNA, 380 bp, Homo sapiens
gcggattcccctgtatgggatcatgtctacagattcagctgaccctattctagtggatgagcagtagattctagcctctaacagaggcacattgatggagctagggatctctcctatagtcacgtctggcctaataatgcaactctaggctggcgccaaaataattgaagtaggagacaccccaaaagaccgagctctcttacaacggagcccaaaagttatatggcatgatcattactatcggccagtctatcgtgtatgtaatgaccgggaatgtatggggacccttctgacatgggtgctgaaatttgcctgctactcaccattcagctctatgtatgctggcttaattgtcctacttaaggatgaactcctgcacg

SEQ ID NO: 509684 - DNA, 390 bp, Homo sapiens
actgatccaccttcctcagccagcgtgcactaccataccgggctatgttttaataaattgtttggtagagacaggttctcagttgttgcccagtctgatctcagactcccgcactcaatcctctcgcctcagcatcccaaagtgctaggattgcaaggcgtgagccactgagcctgatcaagacaaattctccaatcaggtgatatagggtggtatactataccaccccgggcacggaattcaagggtttgagacgagtgagcatgcctcacgaagcaattggaagtggttccaagaaaagcctctaagcttcagtcatacgagaccgtaccgcaaaccgacacaggtgggcgagatgagtattctaaggcgcaatgagagatttcgagc

SEQ ID NO: 509685 - DNA, 100 bp, Homo sapiens
ataaattttttccttcaaaagtatacacatgtatactttgatttcaactgccaccaaatgaaaaccatttgttttcctattttaacttggcccttatgag

SEQ ID NO: 509686 - DNA, 305 bp, Homo sapiens
gattcagttgtcaaaatccaagagtgcaatatcatgctgggtgcggtggcttatgcctgtaatcccagcactttgggaggcatggtgggtggatcacctgaggtcaggagttcgagtccagcctggacaacagggtgaaactctgactgtactaaaaacacaaaaattagccaggcatggtggtgtgcacctgtagtcctagctactcggggggccgagacaggagaatcgctcgaacctgggaggtggaggttgcagtgaaccgagatcatgccacctcactccagcatcagtaacagaatgga

SEQ ID NO: 509687 - DNA, 465 bp, Homo sapiens
  misc_feature (105)..(106): n is a, c, g, or t
  misc_feature (150)..(150): n is a, c, g, or t
  misc_feature (210)..(211): n is a, c, g, or t
  misc_feature (291)..(292): n is a, c, g, or t
ggggcgcttttttgggccagattttccttgtttcccgtggccaaggggttttggggggaaaaaattggcaaccccccccctttcccttcaaagggggagggcccnnggggttttttttgggggccccctttccctcccccccgggggggngggtttttttccccccctggccttaaaaaaagctttttttggggggggtttaaaaatttnnccccccccccccggggggggcttccccccctggggaatttttccagggcccccttttttgcctttttttaaaccccccannccctgcccccccccctttggggggggggggtttttccccggttccccctccgggggtttttttgccccccttttaaaacccccccccagttttccttccccggggcccgggccccccctgggggtccccccaggggtttttttcccaaaaaaaaaaattttttttggggggga

SEQ ID NO: 509688 - DNA, 692 bp, Homo sapiens
  misc_feature (7)..(7): n is a, c, g, or t
  misc_feature (61)..(61): n is a, c, g, or t
  misc_feature (77)..(77): n is a, c, g, or t
  misc_feature (87)..(87): n is a, c, g, or t
  misc_feature (92)..(92): n is a, c, g, or t
  misc_feature (95)..(96): n is a, c, g, or t
  misc_feature (99)..(100): n is a, c, g, or t
  misc_feature (102)..(102): n is a, c, g, or t
  misc_feature (119)..(119): n is a, c, g, or t
  misc_feature (123)..(124): n is a, c, g, or t
  misc_feature (132)..(132): n is a, c, g, or t
  misc_feature (182)..(182): n is a, c, g, or t
  misc_feature (185)..(185): n is a, c, g, or t
  misc_feature (208)..(208): n is a, c, g, or t
  misc_feature (230)..(230): n is a, c, g, or t
  misc_feature (238)..(238): n is a, c, g, or t
  misc_feature (240)..(240): n is a, c, g, or t
  misc_feature (245)..(245): n is a, c, g, or t
  misc_feature (248)..(248): n is a, c, g, or t
  misc_feature (271)..(271): n is a, c, g, or t
  misc_feature (285)..(285): n is a, c, g, or t
  misc_feature (297)..(297): n is a, c, g, or t
  misc_feature (301)..(301): n is a, c, g, or t
  misc_feature (315)..(315): n is a, c, g, or t
  misc_feature (319)..(319): n is a, c, g, or t
  misc_feature (337)..(339): n is a, c, g, or t
  misc_feature (343)..(343): n is a, c, g, or t
  misc_feature (348)..(348): n is a, c, g, or t
  misc_feature (350)..(350): n is a, c, g, or t
  misc_feature (361)..(361): n is a, c, g, or t
  misc_feature (363)..(363): n is a, c, g, or t
  misc_feature (371)..(371): n is a, c, g, or t
  misc_feature (374)..(374): n is a, c, g, or t
  misc_feature (389)..(389): n is a, c, g, or t
  misc_feature (394)..(394): n is a, c, g, or t
  misc_feature (397)..(397): n is a, c, g, or t
  misc_feature (403)..(403): n is a, c, g, or t
  misc_feature (405)..(406): n is a, c, g, or t
  misc_feature (413)..(413): n is a, c, g, or t
  misc_feature (415)..(415): n is a, c, g, or t
  misc_feature (418)..(418): n is a, c, g, or t
  misc_feature (424)..(424): n is a, c, g, or t
  misc_feature (462)..(462): n is a, c, g, or t
  misc_feature (496)..(496): n is a, c, g, or t
  misc_feature (520)..(520): n is a, c, g, or t
  misc_feature (522)..(522): n is a, c, g, or t
  misc_feature (533)..(533): n is a, c, g, or t
  misc_feature (536)..(536): n is a, c, g, or t
  misc_feature (558)..(558): n is a, c, g, or t
  misc_feature (560)..(560): n is a, c, g, or t
  misc_feature (563)..(563): n is a, c, g, or t
  misc_feature (576)..(576): n is a, c, g, or t
  misc_feature (591)..(591): n is a, c, g, or t
  misc_feature (615)..(615): n is a, c, g, or t
  misc_feature (692)..(692): n is a, c, g, or t
tacagancccaaatagttcttcctcttttgaaggttacacttgtaaatctacactcttggntcaatttatcactgtncaaataaggnggggnggnngtnnanactggtccacagaatgnggtnngcctgggnggggcaaaacaagtattttcaagacataacaggccattacatcttaatangcngccccaaattcaaatatattgtngacaataacaaatacagatgangacatttngngtaangcncaaacctttagcatctaacaagngcactctagttccngcatctatgggngggngggatcctccattnacanatacgacatgggtgggtnnncctnctctncngcttccataangntctctggnccngtgattacgtaatgngggtngtngggggngnngcttccncngtntcattngtccaaccggctccggctcaccttcactgggaattgtnatgatgcacattaccaacacagtgttcggggganatgggtgaacatacctttttttcncncttttcaaaanagnaccaataacaaaaccccataangngtnatgcgctggttcnacatcaataccagcnttctattatactgattataaactngatgtgtttggtgtcagcacaacttaaacaaaaagcaaaaaacaaaaccaaaacatcacaatgaaatcctagaaaan

SEQ ID NO: 509689 - DNA, 109 bp, Homo sapiens
tggtagtatataatgtgtgggacgatagttttagcattggagtaggtttaggttatgtacgtagtctaggccgtatgtgtggagatgaggctagtagggctaggctacg

SEQ ID NO: 509690 - DNA, 505 bp, Homo sapiens
tgcttctctcagatatcatcccatgtaaagaagattcccatccctttctcccgtctcacccccactatttaagagagtggtagtgtcactatggaaagcttcattgggtaaatcttcaacctttggaccaagggagtggtacattaactgagtaaatatgaataacagacttatctattttgatagttggtttaggaaaactgtcatgtgacaggatgtaatttttaaaaatattttggagtttttaggattataatttttagccataaatagctaattcattgattaaataaatcatctgaggtaaaatgttgtatcagcagataccgtgctctaaagacacgggcctgtcttcagaaaatatgttataatgaaaatattctattttcagtgactttctggctgatcaagctgcatgttatgttcaggcaatacagtggattttgcactattactatcatggagttcagtcctggagctggtgagagaataaaaacaaaaaaaa

SEQ ID NO: 509691 - DNA, 167 bp, Homo sapiens
gtaccttgggagaaaggaacatgacattttgtctcagcttcagaaaacttcaagtgtctccatcacagaaattatcagcccaggaaggacagagttagagattgaaggagcccgggctgacctcattgaggtggttatgaccattgaagatatgctttgtaaagtac

SEQ ID NO: 509692 - DNA, 173 bp, Homo sapiens
  misc_feature (29)..(29): n is a, c, g, or t
  misc_feature (130)..(130): n is a, c, g, or t
  misc_feature (162)..(162): n is a, c, g, or t
gaaataaagcatattcaaatagagaggangtcacagtatcttttgtttgcagatgacatgatcctatatctagaaaaccccatcatctcagcccaaaagctttttaagctgataagcaacttcagcaatntctcaggatacaaaatcaattgtgcaaaaccnctagcattcct

SEQ ID NO: 509693 - DNA, 541 bp, Homo sapiens
caaatttgttactaatttttatctgtatgaagaattaagtttgtttataatgatattcctgacaactacattgcaagctgctttcatagctttgttaacatgtaggccttcgttatactctttattattattataatttttaatcatttaaaatgtttatgattgtggataatacttctctaatagggaaatgtttacagcagaggagccattacagccaggaacttatgtgtgggctacataaaatttggtgttgagggagttttagatgatacttggtggctttctcaggatggtgtaacatgggctagatcagagtcttattaattcccaaatctgttcctaattaattcttcctccaccccacaaaaagccgataaggagataactttgtcaggaatctgtgtacttattgctgtgtcaatttaggctttcagtactgtactatataagggattccaagaggaaattttgtaatctctggattcagaattttcttttttttttttttcttcttttcttgagacagagtcttgctctg

SEQ ID NO: 509694 - DNA, 886 bp, Homo sapiens
agaagtgtgcctgcctctgatgctgtccccagtgccgcgcggctgctcctccatcctattgatacagtattgtgcatgctggtgttgtatttctatacggtagcttgacatttattaccttacactgtaggtgttatgtatcctatgacaaaaaaacttaagacttcaattttttttttaaacttcttttttttaatttaattttttcctttcaggggtaaagtttgctttaccaaatagtgattgtaacagattgatctgtttggatgttgctatagtgacatgcagttctatattttgtttttcaggggggaggggacaaaagaaacaccagtgttagcttactcttaataatgtctggtgttgtcatggtgaaactataactatcgcagtgcaggagaacgcgcggacgttctcagaacgcgcctctgtgctttcttgtcatgttatgcagtgaaaatatttttaaggtctaatcaagtgattttttcccccccaactccgtgtttcgctaaggaattatttcgcacacggaccattcttagcagtttcctcagtgatggaatattcatgaatgtgagtcattatgtagccgtcgtacattgagcaaaataaacttacaggatctgaaaacaaaaaacaactcaataaacatcacaaccacaaaaaaaaggggggggggcaaaaaattcccccggggggcccattagccttccccttttgggtaaaaaggggcccaagaggggggttaaagagagcacggggcggttaacaacgcggatgggaaacgcgactggctttgggaagaccctctctggggccatgtggaccaccacgagtgccgggaaaaaataggtttggtaaccgctttgggaatgtcgattaa

SEQ ID NO: 509695 - DNA, 150 bp, Homo sapiens
tggagggtcctcgtcgggggacagccggccccgggtagaaggggaggatgcgttaccacatgcgggcagaatgtccaggatggcccggcgactacctccgcgcaccgccaaggctgaacgctggctgaacactcacggaatgactgacac

SEQ ID NO: 509696 - DNA, 1031 bp, Homo sapiens
  misc_feature (366)..(366): n is a, c, g, or t
  misc_feature (462)..(462): n is a, c, g, or t
  misc_feature (472)..(472): n is a, c, g, or t
agcggattaccgccatatctccggatggggtatggcgtgtttgacgccaccgaggctgatccatattggagttctcgtctgctaccatacctctggatgcatgggtctagcgcattcccatatagtgtatccgatgaaccatctatctcacacagctggctgctgccacgcattcttcaccagtggtagtgtaccgagactgtgccacgtactgcggcgtgcttgtactgctcaaatgcaggcacagagtgtcaggactgtgaacaagccggccgcggccgaatccgcgtacatcgatgtcgtgtctcgcacatggagtccctatcatcgttctcattgatcccctcattgttacaggaaaagtcnacatcttccctgtcgaacatgcttattcaggaacaagtgtctactctttgtgtacttctccatggttctcgcgttcgctctctacaggccacaggnccgagaatgnaccacacggagtacctggatctgggtggcgcgattatccgcgcttgtggtaactcgctcggtttgtgctatagaaccgattgtgtttcactaccttgagagtaaaacctccgaagatgatactcgggaagagtaaatcccaccgcaacgcgattcgcactagaatcaccaattggcatgcgagcgtctttggtcgcgcatgtctattcctggagccgtgcgcctaagtacgttcacgcatggcacatgtctcaagtgcgttcattctatagattctcgtcccaaggtttgctgtgttggcgtaaaaaacctatacacgtgcgtacgccatggaataccctatctatgtgcagacacgcggacgtaaaccagggcgaccgtgtgcatgggcaccgaatctacctttgttgcaccgaatacttttacccaaccgtacaccgtttccctttatctaaacacagctcacagagccgtgtaaacctgtttacgccacctcccttgtgaggtttgttacttaaccaaaaattcccgtttgtctaggaatttccatctcaatggaa

SEQ ID NO: 509697 - DNA, 1010 bp, Homo sapiens
  misc_feature (865)..(865): n is a, c, g, or t
  misc_feature (867)..(867): n is a, c, g, or t
  misc_feature (917)..(917): n is a, c, g, or t
  misc_feature (946)..(949): n is a, c, g, or t
  misc_feature (962)..(962): n is a, c, g, or t
gccgccaggcacccggccggctgagagacgcaacatctgcccacaggcaaagctgccaaccctaagggggtcgacgaacacccatgcagcacccgcgtctgccctcaggcccaagccccgggggcggacccgggcgacaaggcggccggaacgaccagaccggagcccctgggcgagatggtgcggaacgagcactggcccagccggaccccctcgtggcctcccacccggactccatgcttttcccctgtggggatctaccgggtctgctcagaggaaaaatgtccacactgtgattatttcacttttagatgccgatgatttgtttttgtagttctaaatcgggggtagcagctggactacccacgttctcacacccacctgtccgccctgctccttccctggctgcccttggccctgaggtctgggggccatcgcagcatgttggcttgaggacgtgaggaatagttagagccctcaagtcctgaagaacgggctgggccagaccacggtccgggctcaaaggaaagggggtcccagtgggagggtgcaggctagacatctgtgtttcaagctggggctcgccatgccgcggggttcatacggtcactggctctccaagtgccagaggtgggcaggtggtggcactgagcccccccaacactgtgccctggtggagaaagcactgacctgtcatgcccccctcaaacctcctcttctgacgtgccttttgcacccctcccattaggacaatcagtcccctcccatctgggagtccccttttcttttctaccctagccattcctggtacccagccatctgcccaggggtgccccctcctctcccatccccctgccctcgtggncnagcccggctggttttgtaagatactgggttggtgcacagtgatttttttngttgtaatttaaacaggcccagcattgcnnnnttctatttaatgnacatgagataatgttacagggcctttgaagtgataagcacattgcagg

SEQ ID NO: 509698 - DNA, 179 bp, Homo sapiens
ccttcgcgttcttcgtcttcacaatatacccttatgaatgacgacgacgaaatgatttcacgagggtcgaactcatacgccataaattgcgtatcactgatggataggtcggtacccttgaatactttgatacgcttatagagccgttctttgctattagtgccattactgactggtat

SEQ ID NO: 509699 - DNA, 674 bp, Homo sapiens
tgatgcgggctggcctgctggagtgctgcacccggctggggcgctgatgcggcgcctggaccttcgctgcgcgacttcgggggcgtcggcctgagttgtggactcctgcgatgcagctcctgaatggcgctctgggcactggcagtgggcctgctgctcatgctgcttacctcgtcctaagtgatccacgctgcatgttcctacaaagaatggtcagctggtcctgacgtcaccatgtgagatttgtgaccttggacctgggacagcagccagcctcggaggacgatcgcccggcagaccgcctgctgtgcgtgtagaaagggtgcagatctgccgtgcaccacgagagcccgagccgcctgtgtggacgcaagaatcatcaagaccaagcagtggtgtgacatgcttccgtgtctaggagggggaaggctgcgacttgttaaatcaaccggtcaaggctgtgacagtgcactgcatgccggctgggaggataaagaccaccacggtctcctgacaaacacagcccctgaggggcccctgggagtggccttggctccctggagagcccacgtctcagcaccagttctccactcgcctcggacttcacccgttctctgacgaccgaccatccgtatcctgtggtccgtgaagacggctcaggcttggcatctgag

SEQ ID NO: 509700 - DNA, 176 bp, Homo sapiens
atagagatttattttttttaaaacattcccctcccccctcctttcccccagagtgttggattgttccaggccctccagtgggctgatgttgggccccttaggatggggctccccgctcctttttcctgtgaatggaggcaaagccccccaataaagtcccttttgggcttttttta

SEQ ID NO: 509701 - DNA, 192 bp, Homo sapiens
tatggcggccacacgcacggagaaggctctgggcagaatgagagcttcatcaggcagagctaggcatgtatgctgagctagcaaagtgcacaagccactgaaacatcctgagccacagtttcctcatatgtaaaatgtaaagattaggatatatacactaaaatatagtcaacccttctccggtggcgtggt

SEQ ID NO: 509702 - DNA, 346 bp, Homo sapiens
  misc_feature (7)..(7): n is a, c, g, or t
aggctanaaggatagagatatagcttacagctgaaagtatgtacatagagatgaaataaagtaggcaagggagagtctcaaacacagtgggtctcgtagttgtaatgggagtttagatcagtatcagctgggtacatgggacagagtatggccaaggactggagagagctggggtgtttggtgctggagtgtggacttcatttatggaaaacttcatctagaggaaaacaggaggaaaagcagaggaggacagagagtgggacctatgtaagaaggtcttaatttctacacccgggtgttgtgaaggtagtgcaaccaagagggaaagaagaaatgagtgacctgg

SEQ ID NO: 509703 - DNA, 414 bp, Homo sapiens
atgtgtccactctcttctgccccccgccatatttggcgaggacggacaactacaatcggtaagaaactgcacccggcagcctcactccccagcagagcctgtgtctcaccccctcacagcacagacctgcatctgcatagagctggcctcactgtggcgcaggctccggggcgagtccctgtcctgtcaggaagacggggtcctggtttgagggccaccactgcagtcctgctaggtccgcttcctgcccaggaaggtgcctgcacatcagaggagagaaatacacgtctgataagacttcatgaaataataattatagcacagaacagtctggtggtctcttctcttccactgatttttccgtcaatgacattatacctttattacctctttattctattacctctataataa

SEQ ID NO: 509704 - DNA, 681 bp, Homo sapiens
cagtggggcagtcatttcttaaagctctgaaatgatctcctttgactccatgtctcacatccaggtcatgcttatgcgagaggtgggctctagctatggccttgggcagctctgcccctgtggctttgcagggtacagcccccatcaaggggctttcacgggtttgtgtcgtgagtctgcggcttttccaggtgcacggtgcaagctgtccatggatctaccattctgcagtctggaggatggtggccctcttctcacagctccactaggcagtgtcccaatggggactgtatggggcctctggccccacatttgccttctgcactgccctagcagaggcctctccatgagagctccactgctgcagcaaacttctgcctggacacccaggcatttccatgcatcctctgaaatctaggtggaggttcccaatacttgattcttgactttagtccacaggctcaataccacatggaatctcctaaggctttgaggcttgcaccctctgatggcaccagcccgagcagcatttggcccctttaagccacagttgaagcaactgaacaaagtgtaccaactccctaggcagctacacagcaggagggccctgggcccggctatggaatcatttttcctcctagactctaggcctgtgatgggagcggctactgcacaggtctg

SEQ ID NO: 509705 - DNA, 739 bp, Homo sapiens
atggtgtaagaggagttcggtcttatgcccagacggagggcagggaggctatctcggtctcacggcaaccgttgcctcccaggttcgaagtgagttctcctggctcagcctcccaagtaggctgggattacaggcgtgcaccagcacgccgggctaaattttttggtatttttagttagagacggggatttctctatgtggtcaggctgatctcgaactcccgacctcaggtgatccgccagggctcagcctcccgaagtgctgggattacaggcgtgagccacttgtagccgggtctcagtggtctgacgccaccttctggacagtccctccttgagggcagaaaggagtcccaggcctggccctcagggacgagggcccagggaagagtgtatggggggagcaggggaggggagggtgtgagaaggctgaactggagtcaagcagccttcccatcaaatcagcaaaactgtggaagctctccagcgcaaaatgctgggagaaggagctggagggtgagtctttgcggacctctctctactctcaggcatgtctgttgtccttttggtccatctatggctgtctgtcgtcattctgcacggttctctgtctcaccttcatcagtctggggccggtccacgaatgcgtaatcttggaggtgggtaggcggggtgattccgtccccaggactgagagggggacagtggtaaggtcccaggaggtaaagcgggggtggcgg

SEQ ID NO: 509706 - DNA, 264 bp, Homo sapiens
  misc_feature (16)..(16): n is a, c, g, or t
  misc_feature (132)..(133): n is a, c, g, or t
  misc_feature (151)..(152): n is a, c, g, or t
tgtaggactatataanctactactgtagaactgccctttccattcttttaaatccggtgaaaaatggtaatatccacaatatatgatatataccccttaaatgaaaaaaatgcctctattgcagatatttgnngtagttttcttttttaanntaatcagaaaccccacttccattgtattgtctgacacatgctctcaatatataataaatgggaaatgtcgattttcaataatagacttatatggcaggttgtcgttccggtt

SEQ ID NO: 509707 - DNA, 142 bp, Homo sapiens
accgagcggtacagcgcttcgctctgctgcgcgtcggcggtggcggcgtcggcggtggaggcgacgcggccgaacaggtcggcctcgtaaggacaccgtgccttgcgcgcgccaggtggtcaccggctgcgtcgacgtgccg

SEQ ID NO: 509708 - DNA, 333 bp, Homo sapiens
cccccccccggggaaaaaagggggggggcgggggagcccctttttttgatggggggcccggtgttcccgtacccttttaaaactggggttagggcgttttggccccgcccggattaaggaacactttccgtaaacccccagggatttttttggggcccccccccttttccagggttggggtgggaatttttttcccccccctttttttctccccgggggggggttttgtacacattttccctttgggggggggcgggggaacaccaaccccctttttcggggggaaaagtttttttttgggtttttaacccccaaaatttgtttaagggggga

SEQ ID NO: 509709 - DNA, 720 bp, Homo sapiens
gtattttaatagagatttcagatgaatctgtagatagctttgggtagtatgatcattataaaaatatgaattcgttctattatgagcatgaaatgtctttctattggtttgtatccaatttgatttctttcatcagtgttttgtagttttccttatagtgttgctttcacctccgttggttaaatttattcctaggtcttcttttttccagtagctattgtaaagtgggatagccttcttgatttctttttaattagtttgctctttgtgtatagaaatgttactgattgtttatgtggattttgtatcctgcaacgtttaatgaatttatcacgttctaacaagttggtagagtctttagttgcttttcagtatataagattatgtctgcaaacggagatgatttgactttgctccttttcaatgcagatgccctttgatttctctcttgactagttgctctggctaggacttccagtgccagtgtggaataagagtgctgaaagtaggtatgcttgttaggtaccagtactgggaggcaaagcttacagttgttatccccatttagtataattgttcactgtcagttagtcatatataaccttaatcatgttgaggtactttcttgtctatcctaagttattgagaattcttattatgaagggatgatggaatgtcatcaaaatgctttacttggcatctatttagaggaatcatatg

SEQ ID NO: 509710 - DNA, 857 bp, Homo sapiens
  misc_feature (33)..(33): n is a, c, g, or t
  misc_feature (44)..(44): n is a, c, g, or t
  misc_feature (65)..(66): n is a, c, g, or t
  misc_feature (72)..(73): n is a, c, g, or t
  misc_feature (88)..(89): n is a, c, g, or t
  misc_feature (133)..(133): n is a, c, g, or t
  misc_feature (142)..(142): n is a, c, g, or t
  misc_feature (147)..(147): n is a, c, g, or t
  misc_feature (235)..(235): n is a, c, g, or t
  misc_feature (246)..(246): n is a, c, g, or t
  misc_feature (252)..(252): n is a, c, g, or t
  misc_feature (255)..(255): n is a, c, g, or t
  misc_feature (260)..(260): n is a, c, g, or t
  misc_feature (316)..(316): n is a, c, g, or t
  misc_feature (320)..(320): n is a, c, g, or t
  misc_feature (348)..(348): n is a, c, g, or t
  misc_feature (361)..(361): n is a, c, g, or t
  misc_feature (370)..(370): n is a, c, g, or t
  misc_feature (379)..(379): n is a, c, g, or t
  misc_feature (384)..(384): n is a, c, g, or t
  misc_feature (417)..(417): n is a, c, g, or t
  misc_feature (426)..(426): n is a, c, g, or t
  misc_feature (591)..(591): n is a, c, g, or t
  misc_feature (593)..(593): n is a, c, g, or t
  misc_feature (596)..(596): n is a, c, g, or t
  misc_feature (673)..(673): n is a, c, g, or t
  misc_feature (707)..(707): n is a, c, g, or t
  misc_feature (726)..(726): n is a, c, g, or t
  misc_feature (728)..(728): n is a, c, g, or t
  misc_feature (754)..(754): n is a, c, g, or t
  misc_feature (775)..(775): n is a, c, g, or t
  misc_feature (797)..(797): n is a, c, g, or t
  misc_feature (854)..(854): n is a, c, g, or t
tctcatttaacttttttaatgggtctcaaaaanctgtgaaaaanttttggtcaagttgtttccannaaaaannactgattttaaaaannaaaaacttaaaactgccacacgcaaaaaagaaaaccaaagtggnccacaaaanattcncctttccttctgaaggttttacgatgcattgttatcattaaccagtcttttactactaaacttaaatggccaattgaaacaaacagtnctgagaccgtncttccnccnctgantaagagtgggggggcagggattagggataatattcatttagccttctgagccttcngggnagacttggggaccttgccagccccagcngccttcttgtccnctgctttgntgacacccnccgcnactgtctgtctcaaatcacgaacagcaaagcgncccaaaggnggatagtctgagaagctctcaacacacatgggcttgccagggaccatatcaacaatggcagcctcaccagacttcaagaatttagggccatcttccagctttttaccagaacggcgatcaatcttttccttcagctcagccaacttgcatgcgatgtgagcgcgngnggnaatccaatacaggggcatagccggcgcttatttggcctggatggttcaggataatcacctgagccgtgaagccagcngcttccattggtgggtcatttttgctgttaccancaacgttgccacgacgaananccttgacagacacattcttgacattnaagcccacattgtccccaggnagagcttcactcaaagcttcanggtgcatttcgacagaatttacttccgttgtaacgttgactggagcaaaggtgaacncca

SEQ ID NO: 509711 - DNA, 237 bp, Homo sapiens
caggagaattgcttgaacccgggaggtggagtttgcggtgagccgagattgcgccactgcactccagcctgggcgacagagcaagactctgtctcaaatcaaaaaaaaaaaaaaaaggtcccccttggtgtttctttttacctttttctttaccctttaacttgtcgagggccctttagttggttcccatatcttggctatggaaaccggtgttgcggaaaacttggggtgcaggca

SEQ ID NO: 509712 - DNA, 291 bp, Homo sapiens
cagactcgtggtctttgatttctcatttagatgtgtgacgaagatactccacctgtaaggcaagtatgcaatgcacgaagccgtgtatttgcgagggctccagtttgggcatattgtaccgtgtgcgcgtaaagcttcacacagaggttcgggcagcggatgtaactgtgggatgcactgggtacaccacccagaaacagggcttttggcacatttggaggtttctacccgacactattggtttactcaacatgcaggtggcacttgggcagggcaaggtcatcttcttat

SEQ ID NO: 509713 - DNA, 640 bp, Homo sapiens
ggtgactggctgctctgaaaagccatctttgcattgttcctcatccgcctccttgctcgccgcagcgcctccgccggcgcctcctccgccgccgcggactccggcagctttatcgccagagtccctgaactctcgctttctttttaatcccctgcatcggatcaccggcgtgccccaccatgtcagacgcagccgtagacaccagctccgaaatcaccaccaaggacttaaacggagaagaaggaagttgtggaagaggcagaaacactggaacgagacgcccctgctacacgggaatgctaatgaggacacacctggggagcaggacgtgctgaaccaatgacggtagaccgaagaacgacggaaagacggtgggcgcaggacaccgacggaggacggaccacgacacgaccggtcgactggtgaggacaaaggattggcagatgcaagatgaggaagctgagtcagctacgggccaagcgggcagctgaagatgatgaggatgacgatgtcgataccaagaagcagaagaccgagaggcatgacttagacagccaacaagcggaacaagttcaacctaccaaacacaaaaggccgccgtaactattcacctccattcccgtctcaaaagtctaagcgt

SEQ ID NO: 509714 - DNA, 1026 bp, Homo sapiens
ggtgcatgcaataatgcccagctaattttttgtatttttggtagagatggggtttcagtatgttgcccaggctggtctttaacccttcccacctgagccgaggctcaaacaatcctcctgccttggcctccccaaatgctaggattatggacgtgagccaccacacttggcctttatatttttattttagagatgggatcttgctgtgttgcttaggctgggctcaaactcttgggctaaagtggtcttcttgccccagcttcctgagtagctggactacaggtgtgtaacaccatgtctggccttttttcttttttttgataattttttttttttaagagtgggggtctggctgtgttgcccaggctagtcttgaactccggggctcaagtgatcctccccttttgggctcccaaagtgcggggattgcaggcaggagccattgacccagcctggggttctccttaaattggggtatcttcaacactttcagatctttaaattgggggcatgggggcatattctagcaggctcctcctagaaaaagaagagcggaataaactttaaatcacattcagtggcttaactaatgtgggctattattaatttaggagcatattaataaaatggtgaacggggtgttcacaacccagatttcagggtagagggggggcactgggcgccaaggcggtatattcacagcttggggagggccggagggggggaccaccgcgagagaaagactacgaccacacggcgacatgtgggaccccgcgttcataaaagaacagcaatgtggcgccggcggtgggacaccctgtgatgaaccaccagggaggggggggagggaaaacaaaaccgcgcgagcagagtggcgagaagtatgctcaccgagcatgttaaaaaagagagtgatcaacagaacacagggcaacacaatagtgctgagtctgcactcaaacacgcatcttggtttcgtcttctctctttctgcttttctccttcttttttttttcttttcggtca

SEQ ID NO: 509715 - DNA, 93 bp, Homo sapiens
ggccataaatcgccagggtattactatggttcggggaggtattcggtccacttcgacccctggggccagggaaccctggtcaccgtctcccca

SEQ ID NO: 509716 - DNA, 371 bp, Homo sapiens
tccactagtgtaggcccattttggtaaatcacttggctagtttattcagagagctgtgggcatagtagtttttctttctaccttttttttttttaagacagagtttcactgtgtggcccaggctggagtgcaggggtgatctgggctcactgcaacctccgtctcccagttcaagcaattctttcacctcagctccctgagtagtccagcgcctgggactacaggcacgggccaccacgcctggcggttttggaattttttaatagagagggggtttaaccatcttggccaggctggtctcaaactcctgacccgaagggatcggcttgcctctgccttccaaagtgctgggataacaggggtgagccacc

SEQ ID NO: 509717 - DNA, 779 bp, Homo sapiens
gatggtactgaagagcccatgtatactacttctgcagttatccatgtcagaaaattttcagacatgcttgatgctggtttaccactagaaagtgctgagaaactagcatgaaatttacgttgcagggctagcttgcacataatgtgatttagatgaaagagctattgaagctttaaaagaattcaatgaagacaggtgcatggctagttcttcaatcagtttaaagacgagtgatctcttctcgatgttcagaacaaaagtgcctttttcatgtggagtcatgtaagacttacaggcgagagagaaaaacaagggaccaaagtagctagatactagtaaaggaccagatgaggcaaaaacttacaggcatttctgtgggaaagaacaggtctacacacttgatgtgaccactggacacgaggaagtatggaggaccatcctccagattccgtttacttcaggtcagcagggcttctgtagtgcactgagatatttgtgggaaagatcccaagagatctagtttgaggatgaatcttgttccatgtattccgaagaaagcgggacgcgtatatagggactctgtccgtcttaaatggatgtgatccaagttcactggtctcaaagtagaggttcatagcgttgtcactttttgtagcaaaaaaacgcacgtcagggaggctgtttaactgaatttaagtcgggaaattcgtccggaaacatattggggtctggcctcatgcccacaaaggctcgggggccaacccaaaataaccaggacc

SEQ ID NO: 509718 - DNA, 460 bp, Homo sapiens
ggttaccatgttatatggctccccagttatctgactcagtgtaatgtagagcctgagctctgttctatcttgtctgattgctaactcctggctcaaatgcccagtccttatgctctacctggagcaggtgattccagggtatagaggggattcctgatgggacgaatgaggaagaatcaggccttgccccacaattgaggtgagcctatgtatgatgctcacctacatgtgacgtggatcaggcctagatgcatgccattgttcgttccaaagtacctccctctaacttgtggattgtctctgccttggtggatgcctgtgagcagtgaagctatagcctagtaatgtccaaatcacagaaataggatgattgcttggttaaattgttgggtacttaaaggtaaggaagagacgtactgaggcgtcaattctactcatcttgtagaagtgtagcaataat

SEQ ID NO: 509719 - DNA, 476 bp, Homo sapiens
ccccgggggggggcccgttttaaaattaggggttcccccgggttccagaatttgggcccaaaatgaagtgtcctttcctttggaaaaaaaatgtgaatcggtcattatgggaagggcccaaatgggcccttgaaaaaaatgccccccttttgtgtgttttctttgagcccctttccttaaaggagcgggtgaaacccttcaaaaattggggtgccccggtgcccaatttgcccaaaatgggagcccccaattttggttgggggaaatttttttttgccaagccccccttgggagccagtgataataaaagttaaccctggggttattttcccaaaaccgggggggtgatttcctgggtcccaaagcaagggcatgcatgtggggttttcctttcccttttttaaaagtggtcccaaaccacccctttaggttttttgtttggccccttcccttcaaaaaaaaaaattggggcccca

SEQ ID NO: 509720 - DNA, 172 bp, Homo sapiens
ataacatcctggacagtacactccatgcaggtgatggggatccccatacaaggacaaatgccacggattagatcattctccccagatgagggaaagatgcagacaggtggagaatggacatgagatgagaaaacgctgagagaagtggcttaagatgttcaacaagaggcag

SEQ ID NO: 509721 - DNA, 126 bp, Homo sapiens
  misc_feature (20)..(20): n is a, c, g, or t
gagattggtaatcatagtcnaagggcttcccttggttcgccactcatctatttgtaacttggcttctttttttgttctgcttaaaaatttcaattctcgtggtattaccagagtagaaggagagag

SEQ ID NO: 509722 - DNA, 847 bp, Homo sapiens
ccactgcgacgccgctgcactcatacaccttatttcacgacctcactaatatctctgtcgcactacttgccgcctcacatcacatcaggtaagcttacagatgctttgcctgctaaagtggaaggctgaaaggagcataaccacaagagtgctggagagatggatgtgggcggcgtttgttttatgtacttacaaaagaagagctgcccgtagcatatgaatcttcggctcaattagacaaacttgtacagaataaaaagatctttctcaagatactgaccacccccctgaagcggttaataattgaccactcatcaactctcgattttaccacataaatactcacctcccaccagctaacaactgctactgagccctaactccgcattgcgtcgatgtgttatgagggcttagttcatctcctctatcactagcacagttgaatcggtttcatattcttatcgcaccccactgtatccaatcccccatcttctatcttcattatcctcctacctccctaccccgtccaactccaacttccaccccttagtttttgattgccgtctttttctttatttaagttacatcttcgcctttgtctctttccctgcgggttgctggttggagttcttttttctccccgccacctcccatcgatatacgtttgtcccccccccccctccctccattaacttaaatatacttaacacatcaagttacgccccccccgcaacccccctccatatctctagtgtgctgtatattctgttttccggtgatcctgcactttgtgtctcttaccacttactccttctttcctccccccgtatcttaacattttttatat

SEQ ID NO: 509723 - DNA, 247 bp, Homo sapiens
ggatcccccacacacctgagtcactaaaattattttctttaagcatcactaactgtatcagaaataatcacatgggaaaagctttaaaacacaacataggaattgattaaaattttttaaacaaaaactacttgggaggctgaggtagagaggatcacctgatgccctaggagtttgacggctacagctgagccatgatcatagccactcgtactccacgcctggtgcaacagtagcgagacctcat

SEQ ID NO: 509724 - DNA, 307 bp, Homo sapiens
gccggtccagtcggtctaccatactgaccgagatcactattaacgttcgtctttctccctaaactctatgtaaatgaaagaagaaacaaatatatgacatccatgagatagattcagtgtgatagaatcataagaatgtatgttttccctaagtgactaaaaagatacttttaaaaaataaagaattctggccaggccaggcatggtggctcacgcttgtaatcccagctgtttgggaagctgaagtatgtagatgacttgagcccaggagtttgagaccaggctgggaaacatggtagaaccgact

SEQ ID NO: 509725 - DNA, 177 bp, Homo sapiens
gtcgactgacgctgtaccggtaccccctgtatatagcctccacattgactctgtaccggtaccccctgtatatagcctccacattgactctgtaccggtaccccctgtatatagcctccacattgtctctgtactggtaccccctgtatatagcctccacattgactctgtactggg

SEQ ID NO: 509726 - DNA, 461 bp, Homo sapiens
cttatatttaggctgtataccttaccggtgttgtctgtcgttatgtttttactgtagtgtgttgagacaggatctgactccaggctggactgcagtggtgtcatctcagctcactgcaacctccacctcccaggcccaagcgactctcctgcctcagcctcccaagtagctggaactacatatgcatgccactatgcccagctaatatttttacgtgttttttgtggcgatgggttttcgccatgtagcccaggctgttcccaaactcgagctcacgaaatcggaccgacttagcctcccacaatgtggggattgcaggcgtgagccaccacacctggcctgtatctttaagtttatcagtacatcctgcgaaacattggtgttagagcaccccagtcctacaggctacttactattccttaattatctgatcaaacatgtgcctggtaaaggtatgctgt

SEQ ID NO: 509727 - DNA, 523 bp, Homo sapiens
gtggtaaagcctcactatgggtctggcagcatcaggatcacactgacagggggtctcagacaaagttgtattgcatgcaagctgatgcctgtaccattcggtgtcttagtcactaagtgctttccagtggtcatgagtgcgtccattaatatcaatggcaaagtccgtatctttacatgctgcattaaacgcagaatcatttacgggttttccatcaggaaccttataccttctaaacgagtgcacagtagtcttctaagtaggcaggattcagccgttcgacatcagtgatatcattataatcggtcgcatcaggatcatccacattaatggcaatgagttacgagtcggttgccgcttcgtcaatcatagcgcaatatgcctagaactttcacgccaattatttcacctcttgcagataccttgcgtccaagtttcacacacatcaattgggtcattgtcaccacaacagccagtatgtttatcattgtgccctgggtcttcccaagtctgagggatggac

SEQ ID NO: 509728 - DNA, 427 bp, Homo sapiens
  misc_feature (194)..(194): n is a, c, g, or t
ccttaaattctcaatctatccactctacaacatctccacctcacaaccactattgtctcacccaaattcatctccatatgtgctatgatttgaatgtttgtgtccccttcaaactttatatgaaaacatataaaatgtgacagttttaggaagaggacctcaaggaggggagtaggccgtgagagctctgtctncatgaatgggattaatgcccttataagagagcctgagggagtgaattcagcccctttttgccttttcatcccttctgccaggtgaggacacagcaatcctccagaggatgcagcaacaagacaccatcttggaagcagagcagccctcaccagacaccaaatcggccagcccattgatcttagacttcccagcctccagaactatgaaaaataaatttcttttgtttataaaa

SEQ ID NO: 509729 - DNA, 1018 bp, Homo sapiens
  misc_feature (521)..(521): n is a, c, g, or t
ggcctctggcacctggggcagaccgaagcccgtcggagttttccgaccgcgcgctgacggctgctgcgcccgcgggctccccagtgacccgagtgcccgcgctggtgccgcctgccgagctgggaggtggtgacgccatgaccccgtaggtcagagaccccacggctgccgcgccctgggactgcccagcggggcagagctctcgtctctcgcccaatcgatccctatttcggccgccatctgctgtcgctggaggtcccctggttggccatggctgtgtgtcgtggggcaagaggagcttaccgtgatacgtgcgaggttgccttgaggatctaatgatctaagccaatgatactaccactgggctatctcctccgtactgccatagtggactagcccatgcaagctagcagtcaaggtagagtaggtccgctgggagaagagttgactggactacacctccttccggcaccaacgatggctcactcggtcgtggcttggagtaactgtggactgcttantgcgtgggcaggttcaatccgcaggactatctctcgggaactggcggtcgaacatgtctgggacattcggaggagccaacatgcccaacctgtaccctgtgggcccctggggctggctagcacaccgagtgcccccatgtgcggctttgggcagacccgccatctgccctagcaatctgttccttcccgtatgggatgtatccaccacccagggaggaaaccgacgccgtccaggaatgccctcattatccggccatacccagggggcccctgtgccagggtcatgcccaatggcaggcggcccggataaggagtgcccaagggggccctagcctggggcagccatccagtgatctaaccctggtcaaaggctccagtgcacactcccttgggcaagaaggcaagccaagtagccgaagatacccaaggatacccgagggccgggactgtaaaaccccggttgtggcgccactcgccaggtggaaagcaggggacca

SEQ ID NO: 509730 - DNA, 1001 bp, Homo sapiens
  misc_feature (634)..(634): n is a, c, g, or t
gtattaagggtactggagcatatggcagggggcactgcttgagatctgcccatgtctctaccagggccttccagtcggcgaccgcattgagcgtcggtgctggagacagctgggaggctctggactgcacagaggatccaggacggggtcccgcaaacatctccaacccagctgtgcatttggcacggacatctcggcccaacacccggagctgcggactcatgcccaggccaagggctcgatcggatgggcagggtgccctgggactgtgctcagatcttctgcgctgacccaggcagcctgcgcgcatggaggctgccaaggcccgcttccaggacagggcgggacgctcgctgcggcaaacggcaacgggggcatcacggcagaggtgatgatgggcatcctcagagacaaggagagtggtatctgtatggactcgggaggctttcgcaccacggccagcatggtgtctgtcctgccccaggatcccacggcagcccatgcgtgcactttcattagccgcacacgtccagagccgcagtccaggtctagctgcttcaaacctcttcatacttcaggggtgaggggtaggcccaggcccagcgaggtgcatgtgcccccacttttggagcancaagatccctgtatcggactcctgccgccgattccagactcaggtagatcgtcggcataccctctaccgtggacaccaggcagcctggggctgatggagagagatcaggatcgggggcagcagctccagcagaaacagcaggatctggagcaggaaggcctcgaggccacaacaggggctgctggccggcgagtgggccccacgcctctgggagctgggcagcctcgtccaggccttcgtgaagagggagagccaggcttatgcgtaagcttcatagcttctgctggcatggggtggacccaggacccctggggcctgggtgtcctgagtggtggtaaagtggagcaataacttcacggtcatgaca

SEQ ID NO: 509731 - DNA, 189 bp, Homo sapiens
  misc_feature (189)..(189): n is a, c, g, or t
ccacctcagcttccagagtagctatgatcacagacacatgccaccactcgtctaatttttctatttttggtagagatgggggtctcactatgttgcccaggcgggtcttgaactgctggccttaagcagtcctcccgcctcggcctcccaaagggcggggattacaggtgtgagccacatccgtacggn

SEQ ID NO: 509732 - DNA, 119 bp, Homo sapiens
tactttccacagggtaaaagaagttgagttgagacgaaagatatattgaataaaggcagataatatttgtaaattgactaatagaaagtcgttaccatctttattagaagctgaacctg

SEQ ID NO: 509733 - DNA, 165 bp, Homo sapiens
agcaggtcaaccccccagaaggaaaagaatgtactcctgaggtggaggagggtgttcctcccacctcggatgaggagaggaggcaattcaggagcgagaactttcaggactgcagtaatttatcgaatcagattataaagtaactaaatatgtcccaagctgaca

SEQ ID NO: 509734 - DNA, 660 bp, Homo sapiens
atgggtcagaggggcgtccacttcgtatgtgctgtggccccccatcgtgtagggccctgtttcgttggccgggccccccccaccggaggggtcacacattttcagagtcgccctgcctgggggaattacactgtgggcggttctcccacgcacggacgtatacgcggtcgttaacaagtaagcaagataattttttatgcgagaggcctcacccactccctgtgggtctacgtcacacactcggagcaagtgtctccacccccccaagtgtcgctccactcacactccactactgttcctgtgtgcaccacgagtcgtctcggccgtgcatgtgtatatatagtcatgtgtcaccacacaagatatgatgtgtgggcacgtgaaatattacacaaggcatctcccacaaaaaggttctgtatgttctgtgtgtgacacacaatgagacctccacacacactttggtgtttgccgcacacacaactatcttgtcttccgccaactgtgaggaggattaacacccacgtgtggtggttataacgcgtggtagggagcgctaatagacggtgcggggagtacgccgttgcggtgttctatctatgacgccagagctacgcattacaggtctttatatagccgtcaaacaattagacaaaaaac

SEQ ID NO: 509735 - DNA, 990 bp, Homo sapiens
cgttttgtgtcgcacagcaagggtgcgcgtatccgcctcgccatgtgcccgttgttgttcacaggcgcacatgtggccctaattggggtgcggaaaaagggttcccccctcatccggttggtgtctcccgaggaattcctcgctttccccagagcggggtcctttctcaagaaagtgggggtcccccccctccgaagccccggccgtatgaacggcgtgacacccccggtttacgacgagaccactgtgtgttctggaaagaaagaagaaaaaatttggccttcaggaaagaccatgcgggcagggtgatttaacccgacttctgcgctggccaagaccacacacattacgtgtaaccagacagtggttctggttagcatgcccaagccaacgagcgtgcgcgtgaatatatttaaagggctatttcattgtatgtgagacaacaatattttcccccagaaggtctggatgggtgggccactcctctatagaagcgcactcctcgtcgtcgcccccgagaatgattggtcccacaatggcagtggcacttgtgaaaaacttatggtcacaccccgccggagggcctcttatccccccctgtacatagagcaggagcggaccgctgtagatacccttattgaagcatggggaaactgcgttatcatagggtgcgtactctcccaggcttgactcccgccccacgttacctttatatgggaagactatcgtgttgtggggggcaaaagtgagtcgcacacacagccccaccacggattctggcggcaattattccttttcggacgacgccccacaaatagttgtacagagctgacaagcacaacgaccaggcacattggggcaataattctaatataaattctaatttacgaatgtgcttcctgcatttctaggctaccatagaaaaaatttgtttcccccaaacatacacccctttgcaccccacaaaacaaaaaaaccggaacatagaaa

SEQ ID NO: 509736 - DNA, 118 bp, Homo sapiens
tggtgtctgatgcctaaaatagatctcaatacgtgggttttgtcgtggttttgtgtggagtgtattgggttttggtgttgttttttgagaccaggtcttatctgtcagacagctggag

SEQ ID NO: 509737 - DNA, 155 bp, Homo sapiens
tacccccattttctatttgccaataccttttctggaatgtgctttttttgtgtacacatttttatccattttacatcaaaagcagtgtaagtgtgaatattactgtttcttatgtacaaggaacacaataaataatatggaaattatatatttat

SEQ ID NO: 509738 - DNA, 87 bp, Homo sapiens
  misc_feature (55)..(55): n is a, c, g, or t
  misc_feature (68)..(68): n is a, c, g, or t
gaattcggcacgagtgcacccggtgagctgtgtcaccatgtgggtcccggttgtnttcctcaccctgnccgtgacgtggattggcgc

SEQ ID NO: 509739 - DNA, 276 bp, Homo sapiens
gcttgcaacttgaggcacccaagggtgatgcacgaaccaatgccggaagtcttctttacggcatttggtgccagcacgttggatcatgagctgcgtctgtatgtgcgtgaactgcgtgaccgtagtcgtactgtcgatgagctgaaccgtactatcgatcagctgtgccgtgaaaacgacatcaacattgcctttaaccagcttgaagtgcatctgcacaacgagaagggcgatgaggtgacggaagtaaaacgcgactacaaaggcgatgacccg

SEQ ID NO: 509740 - DNA, 258 bp, Homo sapiens
cgcatcggtaagagacaccaaaaaggaacgatgaaagatactagattactcaagttaaaactgttaattcattaagagttatacacatcgcagtgcactgacaccatcacttatagtaaacacgcaaaatatatttgttattcagcaactgtgtggtatactgtaaccacattcatggcaagcatttatggcatttccattatgttcactcagtagggcaacatttcatacaggcaaacaaagtatccaaattcatat

SEQ ID NO: 509741 - DNA, 117 bp, Homo sapiens
accaggatacgggggtcaggtacgaaggagaaatgtaggtcacatggtctcaaagagggaatgagtgggaaggcaagattcttagtttctaagtctgcattccagtctagaagagtt

SEQ ID NO: 509742 - DNA, 130 bp, Homo sapiens
  misc_feature (58)..(58): n is a, c, g, or t
acttcaatcccgtgagccatcatgaatgacaatgaagacacaaactggcatggtgagnaggtacccgatccctgagcctccgagcgctgccggcgttgtctcttcataattggctcaccgcagattcaat

SEQ ID NO: 509743 - DNA, 110 bp, Homo sapiens
tgctgcagctcgtgtactattccaggtaagggggtggtccgcgccccttggggccctgggagcctgatcccagagctcatatctggacttttccccatcgtcactggtcc

SEQ ID NO: 509744 - DNA, 145 bp, Homo sapiens
ggagacctttactgtcaccgcttactctttcctacccttatatccagaaacaatgacctccagtgcatacttgtgaatctttgctttatggcctttccaccatagttgcccactccctctccttcagacttcgggtaccgagctc

SEQ ID NO: 509745 - DNA, 168 bp, Homo sapiens
tctgcatctgaccaggcgctgtacctgcactactcctcaggcctggctacgtcgcgtttcgcgcagtcacatcgcatatgctctcttctctggctcacgtaatctctcacgctcgcagtctacacagatcgtgcacgtacgtctcgaggtacacgttagtagtcgacg

SEQ ID NO: 509746 - DNA, 535 bp, Homo sapiens
  misc_feature (168)..(168): n is a, c, g, or t
tttttggttgattttggcttcctaaatgacaaccatgagcccctcctaaagaggcaggtggcaagcgcccaatcaaaacccaagcgctttgggtcctaaaaatggaaggcttccttccttcccaatctccctgccagggcccacagtgtggccctagccctcccctcncgggaatgtagaacggagaccccgccagggttgggccggggccttatactcctgggcccctcccaaccgtgccctgtgtgttggctttgtggccgaccaagtcccaattggcttttcgcccaaaaaagggctggtatttctcctctgtccttggaggtgatttccccctgaccccctcccccaggtgagtgaccacctgggtgccagtccacggtgtttccccctcataaacaaatgtgtttgccccatagttcctctcacccgctgtgtgtatagggaatgaatgtgtgtatgaatggagcttgtcatgtgtgcatgagagtaagtttgcgttttgcataaaggactattggcgacctgttttaaa

SEQ ID NO: 509747 - DNA, 1156 bp, Homo sapiens
gaagaagaaccgagactagcctctggcctccaaggattcccagaagcagctgctctgtggggcagctgtgggcacccgtgaggatgacaaataccgtctggacctgctcacccaggcgggcgtcgacgtcatagtcttggactcgtcccaagggaattcggtgtatcagatcgccatggtgcattacatcaaacagaagtacccccacctccaggtgattggggggaacgtggtgacagcagcccaggccaagaacctgattgatgctggtgtggacgggctgcgcgtgggcatgggctgcggctccatctgcatcacccaggaagtgatggcctgtggtcggccccagggcactgctgtgtacaaggtggctgagtatgcccggcgctttggtgtgcccatcatagccgatggcggcatccagaccgtgggacacgtggtcaaggccctggcccttggagcctccacagtgatgatgggctccctgctggccgccactacggaggcccctggcgagtacttcttctcagacggggtgcggctcaagaagtaccggggcatgggctcactggatgccatggcagaagagcagagcagccagaaaacgaatatttcaggagggggcattaaccgggcagaattgcgccagggtggtgtccggggtcccatccggggcccaggtccccttcagcaattccggggcctaactcattaagaggcgttccacacggttgccacggcatccgggcccgcaactgtgtgtgcttcgggacacggttgtgtcaggggagtgccgatttgcaccgcgctgtctgggcccaatatagcggggggggcacaggcgcggaagcactcttcaacaagcaggggctacgtagggcaaccgggaggaggccaccgactggactgggtgggagtcgagcgcccacgaccaaacgtgtggaggagcccactcaacacagcagggtgcgacaacaagacacaacgctcgcaaccacctaactaaggaaaggagtaacggataaacacaccactacaccaataagagcgagaggcgagcgcgaagtgcatcaacctgaacaagcgagagttgtagctaataaacactgagcaactacgctcacatagctgccccggccgacgctcacggcgccca

SEQ ID NO: 509748 - DNA, 171 bp, Homo sapiens
tggcctttggttcagccctgcttggggggttcccccgtggacaccctgttgactttgcacttccctcccgggccccgcacccccgaaccgacccccgatcgaccggccccgctgttgccttgtaagccatagggcatgggcgctttcagaataaacaggccctgcctggga

SEQ ID NO: 509749 - DNA, 355 bp, Homo sapiens
cttgtggccatatgtgaatactcctcaactcacctataacccgtaaaccacattggtgtctggctcatcattctgtcacaggtttcccaaaagtccacaggtgaattttgaatggtcaccttatctatccccagaaaggccagcttttccttgcaaccacttcacctcaaaggtcagttagtagtcctgtgccttctatcctactcgacattaaaatgcacaaggaaaccaaatatagctacaactcagaggaaaatctggttgctctgggcacagttcagagctctcaacagtgctataggctctgtggttaactctgtcacttgtgaccctcactcgtgccgaattcctacag

SEQ ID NO: 509750 - DNA, 188 bp, Homo sapiens
tggggccccagcccttcctttgctcccccccccccaaagtttgtttggggggttatagggggaactgcagttcctcctttggaatgtagactggatatgtttaataactccccttttctatccttgctcaaaatgtgggataacgcgatggctgtgaccctgggtggaaattaaacttgttttatgca

SEQ ID NO: 509751 - DNA, 761 bp, Homo sapiens
ctggcagcgctccggctgcacctcctgtgtgcgcgccgctgcgtgtgccacaggcccctcgaccctttgaccaccgccctcgggcctgcgcgtccggcagccgggaccggtgatggctgcttggactgactggccgtctcctcccagacccctctgtccctgcctggggctcgctggggctgcggcgcctgcccgagctgcatgtggggctggttgctgctcccgagcccagagcgagcggccctcggtgcccccgaggcggtgccccgccgcgccagaggtacggaggaggagctggcgtggccgtggccaggctccccacgcgccgcaaggcctcggaggcacgggctccccggagggggaccttggggcgtcccagcccaggacggaaggacccggaaggcagaagcggagccgggagtcgaggccgagccaggtggccccccgcttgcccccggccgggcggccgtggttggcgtggtcccctggcggggctggccatggcgccagcgggccggactccgggggccggtcgggccgtgcggaactggcggcgaacgcgagcccagaagggccaccggggcaggacagcccgggaggggcgcaggccgggggccccccgagggaaggtctcgccagcagccgcctctgggccacaggttgggcagcctgcgggggggccaacccgcgtgaaggccaccctcgggagggccacccagggggcgggaaacaagcggcgccccggggcaggccgccacagg

SEQ ID NO: 509752 - DNA, 1241 bp, Homo sapiens
ggtcgccagccgagccacatcgctcagacaccatggtggaacggtgaaggtcggagtcaacggattaggtcgtatgtggtgcgccatggtcaccaggcctgcttgtaactctgtgtaaagtggctatttgttggccactcaatgatcccctgtcattgacctcgaaactacatggttagagcatgtatcgcagagtatgattccacacgcatggtcaaatgccatgggctaccgcgtcaaggctgtagaacgggaagcttgtcatcaacatggaaatcccatcagcgatctatccaggagcgagatccctccaaaagtcacgtggggcgatgctggcgcatgagatacgatcgttgggagatccacttggacgtcgtatcagccgacacagtggaagaacggctcgggagcatcactttattgcaagggcgtgtgatgccgaaacatgggtccactcagtactcgtgaaccccgtgctgccttgagtgacccgccagtgtaccgggtcacttggggtggtcgaaagcccatggaagtaacgtcatggagcaaaccacgcggctacaaaggcactacgatacgagacgagaattgcctcggtcccctggtcgaaccccacgcacaatgtgcactatgaggacactcccacctagtggagacgaagggatcgagccgagtggagcagaaccattaagggtgaatactgtctgtgcaaacgggaacttgcaattggacactcagcaggttaccaattgcaccagtttccactcttgggcctaggacactaaggaacatggaacttcgcttgggaaataggggcacagcgcctgcacctagtgcgtaagcaaatgtcggtcgacggcgagtatgaactctgggacaccacggcagcagtgcaggataccattcccaagcagaaaaccacatgagaattgcctcctcttagccccttttgtaagatttggagagcaggctatatgaccgaaacagaccgggcccatttgcgtccaagtggcaaaaaatgtgcgtcccaaccttcggcgcccgttgggatggcgattggagcagcctgtgggtgaacaagcgactccaccatgtgtggacgatttggaggcagccgttgacgcgaggttgagatcacccaggaacacttggggcacaacacgatgcgatagaccaaagctaggaggtctgacaagcctgtggagaccccttggaccacagtcctaacacacacaaag

SEQ ID NO: 509753 - DNA, 935 bp, Homo sapiens
  misc_feature (1)..(1): n is a, c, g, or t
  misc_feature (155)..(155): n is a, c, g, or t
ngcggttttgcgcggagtttccgcaccgctccggtggttgcgggggtgcccggtgcctccccccgccggttgggtggcccaatgtgatttcggccagggtatcccagtgttcagaggtcgtgggcctgggggccccgatggccgccgtggcggcngttcgccggtgttgtgtgcccccggcctgtgggccggttcccccgcggggtgccccggtcctccagagtcaagtcgtgtggccgcaggagacgtgttcggccctctgtggttgaagagccggcgcaggccccccccatttcctatagtgttttgcgtgggccgcccctcttgtcatgtggcgtctccggcggccccccctgtcttggagggcttcttgcaggaattcaccccgagcaggggcagccattctggtgttgcggtatttggccaccccctttctgtcggggggcttacccactcaccccggcgcaccaacaaggtgtcttggggacagttccagacgctcccacgcggtcttccccggtccgctgcgtaagaaggcgctccagcagcgatatgtgtttccccggctgggcagtgcttctccccccccctttctatccctctgtggtgggaagacctgtgtctcaaagctgtctgctattaacaggggcccgagtatacaacaaggtcgtgtcaacaaccaggccggtctatgggaacgagcacacgagtactgttcaactcctctgctcagacgagtcaatggagatgtcttttgtgcggacgccccatgtcgaggtttgtactgtatttggtggtccgcgatccagtgcgagacgggtccttatcaagcacgcccggtaccttttgcacgggcccaatcccttgccccccgacatttgcaccccgaagtttcgagcccccttacaaaatgttaaaaacaaaaaaacataaca

SEQ ID NO: 509754 - DNA, 869 bp, Homo sapiens
gctgcctttctgggtagacatgaattaaactcactagaagtttcagccagatttcttcctgaatggttcagacagttgcaaagaccagactataggctcgctttgtttagtgcatcttccaacaggcagtcattgttcatgtccctccagaaaaacttaaaatttttcagcaattggctgaccattacacttattcaatataaaacttttataaatattcccctacttctatataacagaaagaaaaacccaggcaaattttaaatgagccatatttgttgatataatttttagcccaattctaatgcaatgagaaaaattaattttactaaacttgattctgtagaaaagtaatagctgtttagcactcccttattcaaagaacaaatttcagtatttctctgaacatacttttcttcatgtagtcaaatcacatctacatactctcacggaaccgttgacctggttttcctaacgtacgtctatattactaggaacacgcatttagtctccatactttaaccatactctaagctgtaaatgtccaggagttggagctgtaagccaaacggacctcctcttggaaatgcctgttttaacaccatcaaatggtattgactcctttagcctcatgcagtgccatttatatggaatcatttcaaccatactgcacaggttaccgactattgatactcggttaggagaggaggtcgaacagtccgtactctcgtgctcaacgcattgcactcggctcactaacacccatgggcaagcgacacctgcaaagctctgtggcaaccagcggagtgcaccccgctgtcaacagcctcatcaaaacaagcgagaacaaaacgcccaactggcccaac

SEQ ID NO: 509755 - DNA, 1169 bp, Homo sapiens
  misc_feature (1127)..(1127): n is a, c, g, or t
  misc_feature (1160)..(1160): n is a, c, g, or t
ggacatgcttgggagaatcaaaaaggtcttcatctggattataagatagatcagcaagcccagctccagagtttacatattgaatggtgggtcagaaatgcagatgttcaagtgttcgaggaaacccacctgcgtacaagaggtgtaccagccccagcaataaccaggggaaggggaggagttacagccggccagttggagttgtagtacacgagggacgccaactcccagaggagtcctgtccacccgagggccagtgagtcggggaagaggacttctcactcccagagcaagaggagtccccccaactgggtacagacctccaccgccacccccgacacaagagacttatggagaatatgactatgatgatggatatggcactgcttatgatgaacagagttatgattcctatgataacagctatagcaccccagcccaaagtggtgctgattactatgattacggacatggactcagtgaggagacttatgattcctacgggcaagaagagtggactaactcaagacacaaggcaccttcagcgaggacagcaaagggcgtctacagagaccagccatatggcagatactgattgtactgtctgatgttgtgaaatagccaatctccaccagtcctgtatactgttcaaagtaatttttttctatgaacaatccctttttaaataaatcaaaatgcttaaaatctgaatggatggaacttaaaactactttgttgaaacatcaacctgggcagaaaaaaaaaaaaaaaagacatgtaaaattttgttatttccagtctgtatatgaaaaaataggtcatcaaaaggaaaaaaaataactttgattaactagtgttaaacaaaaaataggtttactaaatatgttaatctattcttttaacataagcctcacctttcattttaaaggtttccatagaatttagttattttatctttcagccatatgctagtttttttttctcttgccaacatgcgtaaaaagggaagccaattacaagtgcaaataatgtggtattcttttgtaactcaagtcttgaaatgttctgtagtgttaagcaaagtctcctcttgcttgatactaaataaacttttgaaagaattttgngtgtgtgagctaacaatttcatgggtttttttntattaaaaa

SEQ ID NO: 509756 - DNA, 861 bp, Homo sapiens
  misc_feature (37)..(37): n is a, c, g, or t
  misc_feature (41)..(41): n is a, c, g, or t
  misc_feature (44)..(44): n is a, c, g, or t
  misc_feature (819)..(819): n is a, c, g, or t
  misc_feature (852)..(852): n is a, c, g, or t
tgctcacaagtctcaacttaattacggtgctctcttnttanccnccgctacaggactatgatgatggatatggcactgcttatgatgaacagagttatgattcctatgataacagctatagcaccccagcccaaagtggtgctgattactatgattacggacatggactcagtgaggagacttatgattcctacgggcaagaagagtggactaactcaagacacaaggcaccttcagcgaggacagcaaagggcgtctacagagaccagccatatggcagatactgattgtactgtctgatgttgtgaaatagccaatctccaccagtcctgtatactgttcaaagtaatttttttctatgaacaatccctttttaaataaatcaaaatgcttaaaatctgaatggatggaacttaaaactactttgttgaaacatcaacctgggcagaaaaaaaaaaaaaaaagacatgtaaaattttgttatttccagtctgtatatgaaaaaataggtcatcaaaaggaaaaaaaataactttgattaactagtgttaaacaaaaaataggtttactaaatatgttaatctattcttttaacataagcctcacctttcattttaaaggtttccatagaatttagttattttatctttcagccatatgctagtttttttttctcttgccaacatgcgtaaaaagggaagccaattacaagtgcaaataatgtggtattcttttgtaactcaagtcttgaaatgttctgtagtgttaagcaaagtctcctcttgcttgatactaaataaacttttgaaagaattttgngtgtgtgagctaacaatttcatgggtttttttntattaaaaa

SEQ ID NO: 509757 - DNA, 432 bp, Homo sapiens
tgtcttctcagcatgactctgcaaacgacgggctttagcctcacccaggcaacatgattcccttcctcctctcccacattcactgtcccagtcagcagtgctgttttcttagcaggacgagtgtgaaatccagggcggcatttgatttcccttggatttttcattcgaatttaccctcaaggataagaagggaagcaaggagggagagaggccaagcttgggccacgcacagcgtgagcagtcctcagttccactcctgctcactgcatccagactgcagtcatcgtacgttgagctgggcttcacacataccagatgaccaatctggctgagccagcgtgagatccacatgtgggagggcacaggcccatgtgttggggccagggagtcactggaggctggtgcctggagcacccacagttccctgtactt

SEQ ID NO: 509758 - DNA, 887 bp, Homo sapiens
  misc_feature (173)..(173): n is a, c, g, or t
agcggatctgagactcgggtaatctggatgggagctgtggtcttgtatgctcagcgaggccgcgggagaagacccgggagagagctaggccgaggtccagccgacgcgagatctgcgtgcccgagcccgtcgttacagcactagaagacacgctcgtatcccgggcctggggntgaggcagagcagaccaccgtccggtgagcaagcgcgggcgaagacgcagcggtgcgcccactatgccccaacgagccaccacaagggcccccgcggcggacagccagaaaagcgcagcgaagagaaaagcgccaacccgcggaggcccggagtgcaagcgataagaggaaaccatctcgacacaagcatggaggcagcaggcaccggaggtgaagcagtggacgccgggcagacgcgccgagggggccagacgaagagcagttccagccggggcccccactgccgtgcatggacaccggggaccccgggcaccgctcaactgggcagcgccatgcacgccaacagacagacgtggagtgaggtgggtaggggcgaagcggggcgcacagttggtggcaaagaggagcgatgcacttgagttgaattccggtggttcaccaacatagaggggaccagaacgattacacccacgcagagataggttacccggtgagccccaaaccaggagactgtctgaaggacacgctaatggctgggacccagaagccactttggacgcggtcggaaccgggcgcaagcccaagggtgggaaggacctgagacaacctggtgagcgaaccaacagagacggggacccaagcgggcagtgaactagaccgaaacacaggcactggcagagaccggatcaatcacttaacacgcggaccacaccg

SEQ ID NO: 509759 - DNA, 889 bp, Homo sapiens
gcgttgttgcctgagatgaagttggcgcccttgtgttgacattggatcctatactgtgagagctggttatgctggtgaggacgtgcccaaggtggagttctcctacagctattggtatggtggtaagaaagagatgacggaagtcacattaatggtcatagatgtcgacaaggcaaacaaggcggtcccaccatactagcataggatactaatgctctgcgtgttccgacgggatgaatatggaggccatttcacctctaaaaaatgggatggttgaggactgggatagtttccaagctattttggatcatacctacaaaggtgcatgtcaaatcagaagccagtctccatcctgttctcatgtcagaggcaccgtgaatactagagcaaagagagagaaactgacagagttcactgtttgaacactacaagcatcccgtgcttcttcctttgcaaactgcagtttttgacagcatttgctactggtcgttctactgggctgattttggacagtggagccactcataccagtgcattccagtccagatggctatgtccttcaccaaggcattgtgaaatcccctctgctggggacttattactatgccggtgcggcagaactcttccaagaaaatgaatatgcatggccccgccatatatgatggctcaaagaaggggttcgtgaaggtctcccgcagggtggaaagaaaagagaggtggctcaggtaccggggctggcccctaccattggtctgggttgtccgcgattccacgtcggtctacagtgtccatcactctttgcacacgggggccgattcgcctgtggtttatccccaggtcacggggtggggggggccaaaccacaggatgtcccagataggtttgacaa

SEQ ID NO: 509760 - DNA, 506 bp, Homo sapiens
gagggaagaaagcggcgattgtcttttattggaattcctggaaacattggtttgttgttaattattattactgttactaatttcttagagggtgatgttattcattttatctggcagggtgctgtggccaagagtttttaggtgtagctgtagggcctcagtgggaaaatagttttaggttggggtggcttttctattacccaggtttttagaatccttaattctaacaagggccccctgggggtaaaggtgggccttacctaagaccacttttaccagttggggcaggagatttttgaggtgaacaacttgcctgtggaattgtggcaggaactgtttccactcacagcctgaaattttcctgtgtcccaaaccccagggggccccagcaggtttgaacctacacctgaggggtaccagcaggggggggtttgggtttgccctgcaaaaaatgggggccagcccccttttcccccaaataaagcccaataaagcctgagaagtga

SEQ ID NO: 509761 - DNA, 940 bp, Homo sapiens
  misc_feature (898)..(898): n is a, c, g, or t
  misc_feature (931)..(931): n is a, c, g, or t
caggctatggaaatacccgggggataccagtaatttttgccaaaaaggccttcccagttaattgtaacaagtcaaggttttgacacacagtctgaaattaggcgcagtgattttttaattacccccgctccggactatgatgatggatatggcactgcttatgatgaacagagttatgattcctatgataacagctatagcaccccagcccaaagtggtgctgattactatgattacggacatggactcagtgaggagacttatgattcctacgggcaagaagagtggactaactcaagacacaaggcaccttcagcgaggacagcaaagggcgtctacagagaccagccatatggcagatactgattgtactgtctgatgttgtgaaatagccaatctccaccagtcctgtatactgttcaaagtaatttttttctatgaacaatccctttttaaataaatcaaaatgcttaaaatctgaatggatggaacttaaaactactttgttgaaacatcaacctgggcagaaaaaaaaaaaaaaaagacatgtaaaattttgttatttccagtctgtatatgaaaaaataggtcatcaaaaggaaaaaaaataactttgattaactagtgttaaacaaaaaataggtttactaaatatgttaatctattcttttaacataagcctcacctttcattttaaaggtttccatagaatttagttattttatctttcagccatatgctagtttttttttctcttgccaacatgcgtaaaaagggaagccaattacaagtgcaaataatgtggtattcttttgtaactcaagtcttgaaatgttctgtagtgttaagcaaagtctcctcttgcttgatactaaataaacttttgaaagaattttgngtgtgtgagctaacaatttcatgggtttttttntattaaaaa

SEQ ID NO: 509762 - DNA, 354 bp, Homo sapiens
  misc_feature (250)..(250): n is a, c, g, or t
aaaattcgcggccgcgtcgactattctgtatgtctgaaatctgtatggcactgactttttttgtttttgttttgttttgagatggagtctcgctccgtcgcccaggctggggtgcagtggcgcaatctcggctcactgcaagctccgccttccgggttcacgccactctgcctcagcctcctgagtagccgggaccacaggcgcccgccacctcgcccagccaattttttgtatttttagtagagacggngctccaccgcattagccagggtggtctcaatctcctgacctcgtgatccgcccgcctcggccccccaaagtgctgtcgacgcggccgcgaatttagtagtagta

SEQ ID NO: 509763 - DNA, 821 bp, Homo sapiens
gagtgctgccaacgcccggtgaagaagctgaggtcttcatcagattgaaatatttagaagtggatacaaaaactatttcagcgaatgcagacaattaagtgtgtcgtgtgggcgagtggtgtctgttggtaaaacatgtctcctgatatcctacacaataaagcaaatgtccatcggaatatgtaccgactgtttatgaaaattagtgcagttcacagttatgagttgggggagaaccatatactcgtgggactttgttgatagctgcagggcaagaggattatgacagattaggaatcgatgagtgatccacaaaaagatgtatttgctagtctgtaggtcagtggtctctccatcttcattggaaaacgtgaccgatgagtgggtgcctgagataactcaccatgtgcaatagactccttgtctggctggtgggggactcaaattcgattctcagagatgacccctctagtattgagaaagttgccaagaacaaagagaagcctatcactcgagagactgtgaaaagcttggtcacgggatctgaaggctgtcaacttatgtggagtgttctggactttacacagacagggcctaatgagtgtatttggccgaatggaatattggctgccgtggagcatctagaatcgagaagagcggaggggtgggtgtattgactttctgaaggagttttggacaggtgggtcggatcaaagaaaggatggtaatgattacgtaaaaaaaatggtttgggatggaagcgataaataggtttgaccaaaacgaatttgtttttccctaaataaaatatgttaaaaaaa

SEQ ID NO: 509764 - DNA, 197 bp, Homo sapiens
  misc_feature (154)..(154): n is a, c, g, or t
tagctcggtcctgactccttacacttcgtcggggacttccggactaggccgacgacacgtgttgacggttgcggtctgttacgtacgtactacgtgactgccacgcacgctacggacctgggacgacgactacggacgacacgtacggacctgnctgctaacttacgcgaccggactacacgaccgacacgacgggg

SEQ ID NO: 509765 - DNA, 859 bp, Homo sapiens
  misc_feature (27)..(28): n is a, c, g, or t
  misc_feature (40)..(40): n is a, c, g, or t
  misc_feature (817)..(817): n is a, c, g, or t
  misc_feature (850)..(850): n is a, c, g, or t
tttattactatatttggcaaagtaacnnacaaaagaagcnacacgcctaaggactatgatgatggatatggcactgcttatgatgaacagagttatgattcctatgataacagctatagcaccccagcccaaagtggtgctgattactatgattacggacatggactcagtgaggagacttatgattcctacgggcaagaagagtggactaactcaagacacaaggcaccttcagcgaggacagcaaagggcgtctacagagaccagccatatggcagatactgattgtactgtctgatgttgtgaaatagccaatctccaccagtcctgtatactgttcaaagtaatttttttctatgaacaatccctttttaaataaatcaaaatgcttaaaatctgaatggatggaacttaaaactactttgttgaaacatcaacctgggcagaaaaaaaaaaaaaaaagacatgtaaaattttgttatttccagtctgtatatgaaaaaataggtcatcaaaaggaaaaaaaataactttgattaactagtgttaaacaaaaaataggtttactaaatatgttaatctattcttttaacataagcctcacctttcattttaaaggtttccatagaatttagttattttatctttcagccatatgctagtttttttttctcttgccaacatgcgtaaaaagggaagccaattacaagtgcaaataatgtggtattcttttgtaactcaagtcttgaaatgttctgtagtgttaagcaaagtctcctcttgcttgatactaaataaacttttgaaagaattttgngtgtgtgagctaacaatttcatgggtttttttntattaaaaa

SEQ ID NO: 509766 - DNA, 167 bp, Homo sapiens
  misc_feature (44)..(44): n is a, c, g, or t
  misc_feature (83)..(84): n is a, c, g, or t
ctctttccctaagcagcctgaggtgatctgtgaaaatggttcgntaattcacttgaacccggagaaaccccacgaaatcatgnnaaatcaaagaggttccaatcttcgtgttcacttttagaacactcgtgataactgctcaggccatacaagggtatgcatatacg

SEQ ID NO: 509767 - DNA, 1110 bp, Homo sapiens
  misc_feature (1068)..(1068): n is a, c, g, or t
  misc_feature (1101)..(1101): n is a, c, g, or t
ggacatgcttgggagaatcaaaaaggtcttcatctggattataagatagatcagcaagcccagctccagagtttacatattgaatggtgggtcagaaatgcagatgttcaagtgttcgaggaaacccacctgcgtacaagaggtgtaccagccccagcaataaccaggggaaggggaggagttacagccggccagttggagttgtagtacacgagggacgccaactcccagaggagtcctgtccacccgagggccagtgagtcggggaagaggacttctcactcccagagcaagaggagtccccccaactgggtacagacctccaccgccacccccgacacaagagacttatggagaatatgactatgatgatggatatggcactgcttatgatgaacagagttatgattcctatgataacagctatagcaccccagcccaaagggcaagaagagtggactaactcaagacacaaggcaccttcagcgaggacagcaaagggcgtctacagagaccagccatatggcagatactgattgtactgtctgatgttgtgaaatagccaatctccaccagtcctgtatactgttcaaagtaatttttttctatgaacaatccctttttaaataaatcaaaatgcttaaaatctgaatggatggaacttaaaactactttgttgaaacatcaacctgggcagaaaaaaaaaaaaaaaagacatgtaaaattttgttatttccagtctgtatatgaaaaaataggtcatcaaaaggaaaaaaaataactttgattaactagtgttaaacaaaaaataggtttactaaatatgttaatctattcttttaacataagcctcacctttcattttaaaggtttccatagaatttagttattttatctttcagccatatgctagtttttttttctcttgccaacatgcgtaaaaagggaagccaattacaagtgcaaataatgtggtattcttttgtaactcaagtcttgaaatgttctgtagtgttaagcaaagtctcctcttgcttgatactaaataaacttttgaaagaattttgngtgtgtgagctaacaatttcatgggtttttttntattaaaaa

SEQ ID NO: 509768 - DNA, 473 bp, Homo sapiens
gagctaagggctacccacaggatggtcatattgaaaactggggttttcatgctcggggaaggtggtggtagtgaaagggcacatacattcttgcccactgtgcaacaggcaggggcaagaggtgggatgggtcagtagtcacatgataaatcccccggggcctctgaaatcacattctggtaacttccactttgtgaaaaggagttagtttttactcctctcctttcccgtgtcttctccattttcaggtgggacagatctgcatgatatttgggcatctcaaaactgacgagcccaaaactgaccatgagtcacacccccagatgtgttctctaactactccctagctctgtgactttgtttccccagttgactgagccagaaacctgggactcatcctagatgagtcttctcttctcccttctctgtcccacgtccaatcaatgatcgaattccagggtagcccttaactg

SEQ ID NO: 509769 - DNA, 649 bp, Homo sapiens
agaaacccgttatcgaactatgagaagtgaaaggggatcaagttattagagttggcagtttgtgaaaaacacttatcctttgagcaaaatggaacttcggggcataaaggaggatgtctcgtccatttgaggtagtatgtttcagaggtgaatcatgtcttaataccggtaaatctcgtcaactatggtcgcacaccgaaaaaggttaggtgtcaccttgtgttcaagaagatttacttctatcaggttcttgttatgacacaagccatgcattatcccataggttcggcaaacataagaatatgtgcataatttgtcaccaacaagggtataaagtactgcgcagcaatttaaagctgtctgttcatcacacatgttttgggtaatcacgaaatcctggtaccaatttaagttatctataaatgacatgtgctgtatctactaagcacaggctttcggctggtaggctttcaatattattctcccaatctgttaacccatgaccagcctcactagggtgtgcatttcctagagtggcacccctgtaatgaacccagctaaagagtgatgttagcgcaataatggtcactcgctctatcgctctctctctctctctctctctctctctctcgtgccgaatttcctgcag

SEQ ID NO: 509770 - DNA, 899 bp, Homo sapiens
  misc_feature (857)..(857): n is a, c, g, or t
  misc_feature (890)..(890): n is a, c, g, or t
agtagaataattattcccccgaaaaggacgtacaaggtaactctcatcgtcagggtttttaaataaatataattatgagacaagtatttttttgtaaccacgtacagacttatagagaaaaaggcaccgctagaataccaggttaattttatttgtaccagtagggcccccagccaaaataggggtgattccactcatacggaatggactcagtaagggactatgattcctcgggcaagaagagtggactaactcaagacacaaggcaccttcagcgaggacagcaaagggcgtctacagagaccagccatatggcagatactgattgtactgtctgatgttgtgaaatagccaatctccaccagtcctgtatactgttcaaagtaatttttttctatgaacaatccctttttaaataaatcaaaatgcttaaaatctgaatggatggaacttaaaactactttgttgaaacatcaacctgggcagaaaaaaaaaaaaaaaagacatgtaaaattttgttatttccagtctgtatatgaaaaaataggtcatcaaaaggaaaaaaaataactttgattaactagtgttaaacaaaaaataggtttactaaatatgttaatctattcttttaacataagcctcacctttcattttaaaggtttccatagaatttagttattttatctttcagccatatgctagtttttttttctcttgccaacatgcgtaaaaagggaagccaattacaagtgcaaataatgtggtattcttttgtaactcaagtcttgaaatgttctgtagtgttaagcaaagtctcctcttgcttgatactaaataaacttttgaaagaattttgngtgtgtgagctaacaatttcatgggtttttttntattaaaaa

SEQ ID NO: 509771 - DNA, 220 bp, Homo sapiens
cttttgggtctttgctgtttgtttgctctcgttctttttcttgagacagccttggtctgttgctcaggctggtggtgcagtggcttgatctcatctcactgcaacctctgcctcccaggttcaagcgattctcctgactcagcctcccgagtagctgagaccacaggtgcctgccaccatccctcctaatttttgtattttttgtaaagctgagcaaaga

SEQ ID NO: 509772 - DNA, 113 bp, Homo sapiens
gccctactttatttctttttgcctaacttttatttttttgcgtgcaaagcctttaattagaatgttgtattttttacatcatgcataacttcacatttgtgattaattagtaa

SEQ ID NO: 509773 - DNA, 302 bp, Homo sapiens
  misc_feature (91)..(91): n is a, c, g, or t
  misc_feature (299)..(299): n is a, c, g, or t
ggtttcgcgccatgtcgtttgctgagagcgggtggcggtcggctctgcggcgccgcggtcccggcaccccgggccctgaggcttgctctcngattcctcctttactcagggggacagctggggtgatggctgacccgacgaggaggagggatgcgaccaagtggcccgcgacctgcgggcggagttctcggctggggcgtggtcagagcccagaaagcgctcggtgctcccgccggacgggaacgggtcgcccgttctgcccgtttagcgcaatggtatcttttcccgcggcgggggcngca

SEQ ID NO: 509774 - DNA, 458 bp, Homo sapiens
ttatccgcgtttcttttttgaagggggaagcctagctgcagacgatctcttaatttttccccgctacaggactatgatgatggatatggcactgcttatgatgaacagagttatgattcctatgataacagctatagcaccccagcccaaagtggtgctgattactatgattacggacatggactcagtgaggagacttatgattcctacgggcaagaagagtggactaactcaagacacaaggcaccttcagcgaggacagcaaagggcgtctacagagaccagccatatggcagatactgattgtactgtctgatgttgtgaaatagccaatctccaccagtcctgtatactgttcaaagtaatttttttctatgaacaatccctttttaaataaatcaggaatgcggccggcgaacatccgcgttgaccacaacgatcttctctcatcctacact

SEQ ID NO: 509775 - DNA, 338 bp, Homo sapiens
  misc_feature (250)..(250): n is a, c, g, or t
  misc_feature (283)..(283): n is a, c, g, or t
taagatgaagtcttgctctgttgcctaggctggagtgcagtggcgtgatctcggctcaccgcaacctccacctcccaggttcaagcaattctcctgcctcagcctcctgagtagctggactacaggcacccaccaccatgcctgactaatttttgtatttttagtagagacgggggtttcaccatgttggccaggctggtcttgaactcctgacctcaggtgatccatactcctcggcctcccaaagcgntgggattacaggcatcagccactgcgcctgggnctagggctttcttttttaaaaaacaagtccttaacaaaagggggtttttaccagc

SEQ ID NO: 509776 - DNA, 208 bp, Homo sapiens
tcgtactaagattagcgaggagcgttctgggcaaagctctcttagtgagccagaattagacccttgttgatgagcccaggccctgggcgtgagcgaaactggctgctggactagctatgggctgtgttgcttgcgtgagtgcaaaaaagagcctcctcccgcccttgctgtgaccctgttcccgagcatggtggatccatctagatgt

SEQ ID NO: 509777 - DNA, 852 bp, Homo sapiens
  misc_feature (810)..(810): n is a, c, g, or t
  misc_feature (843)..(843): n is a, c, g, or t
ctccatttacaattatatcttgataatattgtttttacttttgttacggtgattatttatggtatatgcaatcttttatgattatcgagttactattcctttggtttggtataagccgtccgcctaatatggttctgttggctaacattcggccatgtagtagtttggagtttatgttttttggtgggtgagggattgtaattattctaggcgcgaggttcttttagtgaggggtggcaaagggatttactagggccctgccatatggcagatactgattgtactgtctgatgttgtgaaatagccaatctccaccagtcctgtatactgttcaaagtaatttttttctatgaacaatccctttttaaataaatcaaaatgcttaaaatctgaatggatggaacttaaaactactttgttgaaacatcaacctgggcagaaaaaaaaaaaaaaaagacatgtaaaattttgttatttccagtctgtatatgaaaaaataggtcatcaaaaggaaaaaaaataactttgattaactagtgttaaacaaaaaataggtttactaaatatgttaatctattcttttaacataagcctcacctttcattttaaaggtttccatagaatttagttattttatctttcagccatatgctagtttttttttctcttgccaacatgcgtaaaaagggaagccaattacaagtgcaaataatgtggtattcttttgtaactcaagtcttgaaatgttctgtagtgttaagcaaagtctcctcttgcttgatactaaataaacttttgaaagaattttgngtgtgtgagctaacaatttcatgggtttttttntattaaaaa

SEQ ID NO: 509778 - DNA, 870 bp, Homo sapiens
  misc_feature (828)..(828): n is a, c, g, or t
  misc_feature (861)..(861): n is a, c, g, or t
gtcaatctgttatttggatccacaagtatacatcttatttaaggtacttatcttagaataatgactatgatgatggatatggcactgcttatgatgaacagagttatgattcctatgataacagctatagcaccccagcccaaagtggtgctgattactatgattacggacatggactcagtgaggagacttatgattcctacgggcaagaagagtggactaactcaagacacaaggcaccttcagcgaggacagcaaagggcgtctacagagaccagccatatggcagatactgattgtactgtctgatgttgtgaaatagccaatctccaccagtcctgtatactgttcaaagtaatttttttctatgaacaatccctttttaaataaatcaaaatgcttaaaatctgaatggatggaacttaaaactactttgttgaaacatcaacctgggcagaaaaaaaaaaaaaaaagacatgtaaaattttgttatttccagtctgtatatgaaaaaataggtcatcaaaaggaaaaaaaataactttgattaactagtgttaaacaaaaaataggtttactaaatatgttaatctattcttttaacataagcctcacctttcattttaaaggtttccatagaatttagttattttatctttcagccatatgctagtttttttttctcttgccaacatgcgtaaaaagggaagccaattacaagtgcaaataatgtggtattcttttgtaactcaagtcttgaaatgttctgtagtgttaagcaaagtctcctcttgcttgatactaaataaacttttgaaagaattttgngtgtgtgagctaacaatttcatgggtttttttntattaaaaa

SEQ ID NO: 509779 - DNA, 877 bp, Homo sapiens
  misc_feature (835)..(835): n is a, c, g, or t
  misc_feature (868)..(868): n is a, c, g, or t
ttatccgcgtttcttttttgaagggggaagcctagctgcagacgatctcttaatttttccccgctacaggactatgatgatggatatggcactgcttatgatgaacagagttatgattcctatgataacagctatagcaccccagcccaaagtggtgctgattactatgattacggacatggactcagtgaggagacttatgattcctacgggcaagaagagtggactaactcaagacacaaggcaccttcagcgaggacagcaaagggcgtctacagagaccagccatatggcagatactgattgtactgtctgatgttgtgaaatagccaatctccaccagtcctgtatactgttcaaagtaatttttttctatgaacaatccctttttaaataaatcaaaatgcttaaaatctgaatggatggaacttaaaactactttgttgaaacatcaacctgggcagaaaaaaaaaaaaaaaagacatgtaaaattttgttatttccagtctgtatatgaaaaaataggtcatcaaaaggaaaaaaaataactttgattaactagtgttaaacaaaaaataggtttactaaatatgttaatctattcttttaacataagcctcacctttcattttaaaggtttccatagaatttagttattttatctttcagccatatgctagtttttttttctcttgccaacatgcgtaaaaagggaagccaattacaagtgcaaataatgtggtattcttttgtaactcaagtcttgaaatgttctgtagtgttaagcaaagtctcctcttgcttgatactaaataaacttttgaaagaattttgngtgtgtgagctaacaatttcatgggtttttttntattaaaaa

SEQ ID NO: 509780 - DNA, 131 bp, Homo sapiens
cgatggtttattgtcggcacgaaacgtcagatctacgtgtatcaatatcatcagtgcacacatggcattttggcgtaggtttggactcagggtgtagcctgcagcaatagggggacatcagtgacatgaag

SEQ ID NO: 509781 - DNA, 439 bp, Homo sapiens
ggaggaaaaaaccttcttccgaaggaggttttctccaaaatggggttataaaggcccctgttagaaagatgctccatttgcccccggtttttacaaagtcaaggacatttcaaaggtggtccccccccggttcctttttttgggggggtgggtcccttttttgccccccaaacttgcaaggggtgttttgggggccccctttttgtttcccaaaaaagttgttttcttccagttgggggtatcccctgggggggggtgggtgtttgccaaaacccaggggggccaaaacgggggcctgtttccgcccggggtttttccctccccctttttttagggttgccctgggtgaagggggaactcccaaattggggtttgggtttttttttaggggttttcttttgggccgggggggggggtttttttttaaccgctgggccca

SEQ ID NO: 509782 - DNA, 133 bp, Homo sapiens
acctgtgtgctccacctgttgctcatccccacctgtgtgctccaagttgcccaggaggccgagggggccttgggctccatcttggaacgcgtcctcccggggctcaaggtccctcacgcacgcaagaccggga

SEQ ID NO: 509783 - DNA, 160 bp, Homo sapiens
gtgacatcgtctttaaaccctgcgtggcaatccctgacgcaccgccgtgatgcccaggaaggaaaggcgacctggaagtccaactatttcttagatcatccactattggatgattatccgaaatgtttcatgtgggagcagacaatgtggctccaagcag

SEQ ID NO: 509784 - DNA, 403 bp, Homo sapiens
  misc_feature (198)..(198): n is a, c, g, or t
tctagccaataacaatcacacaaaggagatcatgtctcattcacattcacagtattcactcataggtgaatatatataaacacagtaatcacatttgctgccggctttaatgaaatagtgtggaagtatgtgaaagctcaacaaatgtgctacaaactgtactacatatttcatttttgcaattgaacagacctttgntatattatgttattttacaaaatcattagtagggatagaagatgctaactaagtcactataaacagaaaagtcactgttgtgttcatgagcccattttagagctaagacaatttgtcaagaaaacagaacagggaggaaaataggagtagtaggttgctgttctgtgcttcagcaaatgcttcaatagcatttgaatctgtagta

SEQ ID NO: 509785 - DNA, 771 bp, Homo sapiens
  misc_feature (59)..(59): n is a, c, g, or t
  misc_feature (271)..(271): n is a, c, g, or t
  misc_feature (273)..(273): n is a, c, g, or t
gggcccactggttgatgaacagatcgcacgactccaacactaaagacacgacgtcagcngtctccgacgatgggaaccgagaacaagtgtgtccaatagcgtcttccgatacatcatacgggccggtggaaagacagggcgaagagcgcagccggccgccgcggctgggccgggggagccaagccggccgaagatcgtgaaaccccaagaagaaccggaatggcacatgcacacgtcctgagctgggaatcccagaacgctcgatcactcngntcagaatgctgcagacctgtgtccaggtacggcagacacaagtggagagggttggaaatcaagaccaggggctccgtgcgcgtccgagggacgataggtataatcagcacattccacgtgtttgaacttaatggagtgcccttctgcaagcaagtggggtcggccggcaagccaagtgaaacaactcgtttgaggcgtcttcatctgttaaatgggttggcaaggacgcagatgcagggttagcaaagcaggggctcgaaacgggggcccaagaaggttgtcaaggcccctcgttggcgcccaaggatgttgcttgcgttggggattcccctttgaaaaggcacaacgggaattccaagaacgcttgtggaaaaaccccaacttgggttattggaacactttgcgaacttttggggaaaggcccccggatggggcccaggaacgggggtccacttttcgaaacggtcagtggccatgggtcagcttggggcaaagagg

SEQ ID NO: 509786 - DNA, 201 bp, Homo sapiens
cacgagggctaacataatgcctattgcaacggtcacattcatcacacccttttacagttttggaaaatttgtgatcctctcacttgcccccactgcaaactcacttcccacatagaccaccagtaacatttcttatccgatgcattcattacccaccccaagctcctgtcctcacagataaaactccttggtgacacacat

SEQ ID NO: 509787 - DNA, 728 bp, Homo sapiens
gtacggttcctcgcttctggtgagggtgccagatggccgctcgccaagtgcataggatggccggacattgttggaatgcaaatggtgaagaatcaaggtcgcgtcagtgctgatggtcataccaagcactctttgggcacagatctatgggccaaggaaatacgatcgaagagacttcgataggtgccatatgagctggtgcattggtttcacgattttggagcatattaccgccttcaagtgcagcgcaaacaacagtatttgactgtttgactaccctcgtgaccacgagtataatcgtcaaaaatttcgtgggagggcaccaaggactggagtgactcgagagggtcactgctctgtggccaagatttaatctgactcaggtagggaccattgagaattgcattggcttggcattgatacctaggtgcccctgtgaatacacggaggtctgatgccgaatgatgtgacagagggtaatagtatggggctatcaggaactggataggaaatggtgtctgggacttactcacctgataactactcctaccaatgcttgacttgtgcaccggatacggccatatcgtacccgtgtgtccgttcgggggattcaaatggcacgcgatctgtggtgaaccataaattttttcgtgctgctcgaaaggcagacatgaatttacgcccccaggccaagcttttgcgagcggaggtgatatcaagtaaatacc

SEQ ID NO: 509788 - DNA, 115 bp, Homo sapiens
  misc_feature (48)..(48): n is a, c, g, or t
  misc_feature (72)..(72): n is a, c, g, or t
ccaaccaggtggtgtgagccgcgggggctgccagaagcgggaggggtncactgccggaagagcagctgcccnccgacccctcatttgtggcctttagtaaacactgtgctttgta

SEQ ID NO: 509789 - DNA, 288 bp, Homo sapiens
  misc_feature (213)..(213): n is a, c, g, or t
tgctgaagtttatcctttagtaggttttttgagaagggattggctaacattcatctgaattctcacctgtttaaaatgtttggctattggctgcatgtggtggcttatgcctgtagtcccagcactttggagcgcaaggcagaaagattgcttgaggctaggagtgcaagactagcctgggcaacatagcaagacatttgtgcatactaactnggtggtggtggtggtgcatatttgcagtctcagctacttgggaggctgaggcaggaggatcgcttgagcccagga

SEQ ID NO: 509790 - DNA, 704 bp, Homo sapiens
agcgggttgaacaagatgggtgcggtggatctgacttatgctccggtctcgatcctgaacacgcagacgcatctccccgctgttggcttcctccccacaacccgttcccgtctctcagactctctggttatatgcttttgccgctgctgctgctgttatccatgtgactgctgtccgtgcgtatgtgtcaggatgtcgcccggggtgtctgcccgtctgccacctcagtcatgttctaccgactgaaattcctgacctattctcctgtctggatcggttctgtccccatcctatattgacttccggtgcacgattactattgcgaactggctatcgactggactcgtgatggagcctgtgctgcggcgttgcgctgttccctcacattggccagcttcctgcgtgcatgcaagctgcgtggggcttataatgccccgtgttgatactcccctgtccagatccggagttcaaacgaaatgggtgcttctcgagcaactgacatggctgcaatgcgaatacgatggaactcaatatactagattcaaggctggctgtgcgatccttgctgaatagactactcatgactagagagcatgtaacgtggactcgcttaagggaagaaccacgtaactcacttgccgaaagagcatggatcggaatgatcaaccgcgcgaaagtgggttccgttcatgaaggaaaaatcc

SEQ ID NO: 509791 - DNA, 840 bp, Homo sapiens
gagcggaatggaccgatcgatccttacagctgaacaaagtcagccacaaatgcagactaccagccggttacaattggagtcagagtcccgaatgacatgggcttgttaagtgctgtgctcggcatgtctggtacggggcccgctttgctttccctggtggccacttggattgtagtcctcttgcgggtggcactgttctgtggctgcgtggacattgataggccctcagcgtggcacacgatacatacgcttccttgacgaccctagtttctcgcaaaactagcccaagactattgagtactccgtcattcaactgtgatccagtgtccttcgaagtatgtcatctagtggaactggcctctttcttctgtccctttactggggccctcgctgctgggctagagaggcgttctagcagacaaccggcgccaggtctagcgggccatgcactctttgcgtcgcactttacagatgatctcacgcaatccttgccggggccaaatgggggccctgagcctgtcaagtgagttatacaggggctggcccagaaaagccggcgaacggcgcggttcccaagaaagcccatatattgataacgctcaatttcctattgggaagccgcggttgctgctcgacttgcttgatgggcgaaaacttggcttaggaacattccgggatcaaagttccgtaggggcatcgcgctagtgtgccctgacgccgttgttcgtggcctccttgggtgtttggcctgcctctggatgtgcccttgtgtacgttttagcttccgaggcacccttggagcaccttgccagtctatttggctttccccagtcaagaccg

SEQ ID NO: 509792 - DNA, 119 bp, Homo sapiens
ccccagcttctttagccaaggagcatggacctgcctcacctgcacgttggatgcacctgcgcctcacctacatttcacctgcgagcactcatcgacagctcacaaccgcatcacccgtt

SEQ ID NO: 509793 - DNA, 248 bp, Homo sapiens
  misc_feature (7)..(7): n is a, c, g, or t
  misc_feature (75)..(75): n is a, c, g, or t
acgtganaatgacatcacctgctgaagtggcacactgcctcttctcccagacagtgtctccgtgtgctgccagcncgacgacgacttccccgcgggacactgtgtgccaccacaggctggggaagaccaagtacaacgccaacaagacccctgacaagctgcagaggagccctgccctcctgtccaatgccgaatgcaagaagtcctggggcaggaggatcaccgacgtgatgatctgtgccggggca

SEQ ID NO: 509794 - DNA, 621 bp, Homo sapiens
gatccagaatggcccattcttgaataggattcacagtttacgaccccaatggatcctcaccagcctaatatctaccttagggttaggtacgaggtccatacgcggtgtgatcataagtttcctgcccgaaattacgtcaacactcttgccacgcattgtctgtacacctttatgccgcttgatccgtaggtgtcgccaaaggacgctaagtgcaggctaaacgcacctatgaggcgccggcccaaatagcattacacctaacgtcacttgttgcctaggtaactacacgcgggtcaacacttgcacgtgtctgcgcggtctgcctatcatactttctctcacaccgttgacactctaaatctcgagggaagccctacctgtgtgcaccacacactttggtcaatacctcaccattgtggccacgtctctggcgacgtcccaacttccagagcacagcttcttccctacaaagtggcgccacaggtctgggaaacacccgagtacacaggtgtgcccatccacgggcgtagggctccccaagtcggcctttgtgatcacccaacctttccttagcaaccgggcacccattcttcaaaaccactcggcgggaaagaacatccc

SEQ ID NO: 509795 - DNA, 571 bp, Homo sapiens
atcccagcacttagggagaccaaagtgggcggatcacttgagtgccagggttccagaccagcctagccaatatggcaaaacccagtctccactaaaaatacaaaaattagttgggcgggttggtgcatgcctgtaatccaagctactcaggaggctgagacatgagaatcatttgcaccctgaaggcagaagttccagtgagccgagatcacaccactgcactccagcctcagcgacagagcgagactatgtctcaaaaaaaaaaaaaaaaaaaacttttgggggaaccgggggtttttacctctttcaaaggtccctccatattaacattatgttttcccaggggggaaaggctactttaccaaggggagaaacgtggggccaattatggccttaattcacagggatcaaaggcgcaacactcctgcactttgcaacgccccagttgacatttgttttcccattgcgatagcagcaggtcaccctccgggaatatccctgtcagaatatattacccacttgggaacacctcacacaatccaccttggcgaactcctcttacaacgctgcg

SEQ ID NO: 509796 - DNA, 147 bp, Homo sapiens
ggggtagtgggcgtggagtagggcttcttctcgtagccctgtagttcttcaggttcagggtcatctggcaggtctcgcaatggaagcatgctttatgccagaacttatccagacaagaaccacacgagaacacacgccagcacaaga

SEQ ID NO: 509797 - DNA, 418 bp, Homo sapiens
taatactctcgagcacatgtggtagtggttaccacactgaataatatcgatgaacttgaccatcatcacagaaagttcacctagacactgacctaggtgattgattgtgttcgtgtggaggtgtgggagacagaggtatggctctgtcatccaggctggagtgcaatggcacaatcttggcttactgcaacctctgcctcccatgttcccatgaggaatgctcgaaccttagcctccagaatagctggtactataggcatgcaccaccacgctcggctgatttcagtattccagtagagacagtttcaccatgttgcccaggctggggtcaaactcctgagctcaggcagtccacctgcatcggagtcccaaagtgctaggattacaggtgtgagccaccgtgcctgatcctaactga

SEQ ID NO: 509798 - DNA, 165 bp, Homo sapiens
tgtaccaggtcagtcgctttggccctccgaccaaggtgcatgcgccagggcacctggtgagccgggcatagcaaatgcctggattcaaggcgcgtccccgagcccgaatattcaaagttcagcgatgttgcccgaggggcacacggcagccgtggcgtgtgagtt

SEQ ID NO: 509799 - DNA, 267 bp, Homo sapiens
  misc_feature (44)..(45): n is a, c, g, or t
  misc_feature (88)..(88): n is a, c, g, or t
  misc_feature (93)..(93): n is a, c, g, or t
  misc_feature (97)..(97): n is a, c, g, or t
  misc_feature (114)..(114): n is a, c, g, or t
  misc_feature (159)..(159): n is a, c, g, or t
  misc_feature (161)..(161): n is a, c, g, or t
  misc_feature (214)..(214): n is a, c, g, or t
  misc_feature (243)..(243): n is a, c, g, or t
aaatttttaatctttaattttacatttcctaaatatattttttnncgaaacatttgttctatagcttttccctttttttaagtaaggnatttnattnttttctgaattattttntctcgtgagtatattgatccagaaagacaacttgtattatgtgtntntcaaaatgagaaatctaaaagacgaaaagtctccaaagtctctggaatttganacactttgcataacgtataatagcctgtntaagagacagccaactatggcctg

SEQ ID NO: 509800 - DNA, 794 bp, Homo sapiens
  misc_feature (1)..(1): n is a, c, g, or t
  misc_feature (75)..(76): n is a, c, g, or t
  misc_feature (78)..(78): n is a, c, g, or t
  misc_feature (101)..(101): n is a, c, g, or t
  misc_feature (231)..(231): n is a, c, g, or t
nctggggttctgttcatggctgctttcctcaatgagtgttagtgtcatttcttcagacctttcaccaggtttttnngncgattgggggtggataaaaaaanaaataacttaacaattttgcagagatacatgtgcttccaaaataccagctgttacttatcctaaaaatgagagtacacccccttctgaagagctagagttggataagtggaaaactaccatgaaatctantgtgcgaggggagggtgtttcaacaatctcaagcaggaaggatgaagatcctctagctgccaccagagagttcattgagatgtggagattgcttggcaaagaagtaccagaacacatcactgaagaagagctcaaaacccttatggaatgtggttctaacacagcaaaaaaaaaatatttaaaatatttatatacgaaggaaaaagggaaaaaagctaggcgaataaaaaaggaaatgaaagcagcagcaagggaagaagcaaaaaatatcaagctggtagaaaccactgagggggataaacagaaaaactttctatttttacgactttgggataggaatatggacatagcaatgggctgggagggggcccaggccatgcaggttggacaacctttgggttttgcatgggttacgaaaatatatgaaacgaaaagaattgggaatactggttccagcttttagagggggaggagggacagaagaatggtggtctttcatatttattttggatctaaaaagaggggctttcgcaagaggtagtaacgggtcagaaaaggggcat

SEQ ID NO: 509801 - DNA, 177 bp, Homo sapiens
ttaattatcacaagtgctacagaggtaggtccccaaactttacaatccctcatttgttgctctcaaaaagatctctttttttaagaaaaagaggcttaagaataccgacaccagtgtataaatatccgtgtaaggctattgtacgaacatctacaattaacattctggacaaatgag

SEQ ID NO: 509802 - DNA, 295 bp, Homo sapiens
  misc_feature (290)..(290): n is a, c, g, or t
ataagattaatgggtcttacagcagaagtgagaaagggatggggcatctttaaataattttaattctcattatgcatatcacagtcttctacacacatacatctagaagttgattaaatactcagggtgttcttcgctttacagccacttaattctaaactactgagtttttcttgagaaaaaaaaatgaacttccatatgcagaatcccacttccgttcaccacctctaatccacaaatggatttcaacgtccaagtttaaatgccaggctagtgagttcagttatatnttaag

SEQ ID NO: 509803 - DNA, 269 bp, Homo sapiens
  misc_feature (41)..(41): n is a, c, g, or t
ctgagcgggtcagaattataggggaaaaaaagcccccaaanattgttcccccccccagcaaccccccgaaataatgagatcgggatcagtggagatggcgttgggggtgggaaaaaaaaatggatttatctttaaaatttttgcttaaaatttaaaataccccccgctttttaaccctcagctgccagcggtgcgcggcgccccagaacaggtaaaaggcgttggctgcaaccgaaagggtgggagaaaatgttgaaatcaagaaatta

SEQ ID NO: 509804 - DNA, 484 bp, Homo sapiens
cttgagatcaggagttcgagaccagcttggccaacatggtgaaaccccgtctctactaaaaataaaaaaattagtcaggtgtggtggtgcgtgcctgtaatcccagctactcgagaggctgaggcaggagaattgctttaacctgagaggtggaagcttgtggaggctgcagtgaaccaacggcaccactgcactccagcctgggtgagaaaaagaaaaaactaaggccaagaggaaaactacataaggcaatggtgagcagagatctgctaagacttactggtaacatctaagatgttttaattgcttttccttatcaattctgaggaataagttgcatatagtaagtttcctccatttcaggtatacaattccagttagttttgaccgttgtataatctgtgaagctaccgctccattaaagatatagaacattaccatcatgtccaaaaggttccttgtacccctttgcaatctacacacc

SEQ ID NO: 509805 - DNA, 951 bp, Homo sapiens
ggacatgagagaactactctcagttgagcattgaggggtggatcgatgatcatgacatcaatcttttctgatgacgatggcccttgacaagaggcgggctaaatcccctacagctacctcgtcgatcagggcgctgcacggaataggtggagcgtcacccgcgcagaaccatggccaggcatggtggagcctcgaaggctagaaaataaccagagggcctcctgccccccagaggacccagcgactcaaggtgacttgcggacccaggggccaacgttccacatagccttctagcgtgccttacatccggtactatcggtcaggctacatcatccagttccagtctccacgaggcactgtagcacagagcagctaggcacaaggagccccctagcacaagtgtgaccatctaaccagtccaaggaggccgggcacgcgcctaggcgaccgccgagtgacgctcgggctatcagggaggccgtggccggaagccatgccgctagatcaaagggccagcccacacatgaagcgcctcgcgccattgtacgagctactctcaagccgctagctgcactaggctccgcaaccggagaacgaagctgcatcggggagaagcttgggctggccgaggtacaactcggacagccgaaactccgctcgctcagaacgggccctccccaagacaagcggggcagcgtacaagcttcccagtggctaggaaccctggataggccaagcaagccggtggggcaaaggtagctagcactaccagaggcacgccctggaggaagccccctagggctaaagccaagggtcctaaagaacaccgcaccgaaagccccccagagacaccccagggcccagcggcccaccggaggcgaacaccccgagcgaccccagcgccagacgcaagggcccaaacgcgtagagccgtgcagcaacaccacacag

SEQ ID NO: 509806 - DNA, 397 bp, Homo sapiens
cacaggactcacgtatcaaggaaaaaacttgcacacaaaaatgaatattcaaatacacactatgggaccgggaacagcatttctactgaaatggcatatggcagctatttaaagctaacacatttatgactagtatcaacccttattgcttgcgcatattaaagcagaaacaaatgccacagttcccaaactacacatttggccaacattcccagcaaccatttctccaacatctgtgtgtccctgtggagccataaatttatacatcgaatattatttgcccaagaaactggccgcacattctaaccattaccggaattacttttatgaaggatgacttctagagcacaccataatactgctatacatcttaaatgcattttttaaacaccgcaaa

SEQ ID NO: 509807 - DNA, 161 bp, Homo sapiens
cttgaggtcgattctgaggaccccccccgtatatggagataaccaatggattcaaaatcaacaccgatgagattatacttcactcaattctgttaatggacaaatagaaggcctcattagtcctgatggttctcgtacaaaccccgctagaaactgcagag

SEQ ID NO: 509808 - DNA, 264 bp, Homo sapiens
  misc_feature (217)..(219): n is a, c, g, or t
caaaaattagaatatctacatatatatccgtgcctgttaagttttacttttttaaatttagtaaggatccattccccttcaatgtaagcttaaaataataggccaactaatatgctgtttggccttcttctcctaaagctccctgtcccattatttggccttgattaatacaggggccagtagtcagaatccgtaaaattttaataatccccttggnnngaaaagggcccagaagccaaacctaaggaattcccccttggcaga

SEQ ID NO: 509809 - DNA, 302 bp, Homo sapiens
aattcacaaaaacataaaacaaaaaaaaattaaaaaaataaaaaccccacctcaccaagctcagccaccaatttaaaaaggactgggacaatactttaaccattttccccttactcaaaattcagggcctgtcctcggaaatgctacagggatacagcccattaggagcccctgtaatggatactccctttatggtcaaggccccaagtctcattcccgggacatctaagcaccactcttaagactggtagcccccccctacaacaacaaaacaaaatttggtacatcccctaactatattc

SEQ ID NO: 509810 - DNA, 748 bp, Homo sapiens
  misc_feature (45)..(45): n is a, c, g, or t
cctaagcataacattgtgtccggccgcagttactttgatgaaaanaccgaccgtgagtgcctcccacaacagaaaactatttttagcggggtcaacgctccggggctcctcggtgattaacaactggttgagcacgcaattatttctttggcgtaaattggtctctgtagaaccgtcacgacactctctctttacatgtggacatcggacaaatggaaaagattgtttgaagacaaaacatagcacatacccacgtttgggatcgagcgggaggccgcacaaatgtacgacacacatcacgcgccggggggagcgcagccaatacatagattaggaaccgcaccacgtgctctccgcggcgccaccctcgaagaaaaagcaggggccaaaaaatgggccgccgcgcccttatatgaccagccggccagtggtgggtaaccgctcgcgcgcgtagcacacgtgtgcccaaacacatggtgggtacaaataaaagtgtgcggccacgccgcgcaaggttccgtcgcgagcaggcctccccgggtatgttccgcgcccttctccagtttagtcgcgcgaaatgcttttgtggaaaaaaattgtgggtatcccggggccgaataaataaaacgggtaagagatctagctccgccgcttcgtactcaccctactgagtcggagtgacggttgctagcagagtcactcgtcctgcgcatggtcgcccccatcaacgagttttctcgcccccaca

SEQ ID NO: 509811 - DNA, 104 bp, Homo sapiens
gggatactggacttctcaccaggcagaagagctcaggtgagaaggggcaggtgggaggcagaataagcagggacagcccctggacctcagaaggtccaggtatg

SEQ ID NO: 509812 - DNA, 214 bp, Homo sapiens
  misc_feature (41)..(41): n is a, c, g, or t
  misc_feature (64)..(64): n is a, c, g, or t
  misc_feature (86)..(86): n is a, c, g, or t
  misc_feature (127)..(127): n is a, c, g, or t
  misc_feature (130)..(130): n is a, c, g, or t
  misc_feature (140)..(140): n is a, c, g, or t
  misc_feature (149)..(149): n is a, c, g, or t
  misc_feature (153)..(153): n is a, c, g, or t
  misc_feature (170)..(170): n is a, c, g, or t
  misc_feature (176)..(176): n is a, c, g, or t
  misc_feature (182)..(182): n is a, c, g, or t
  misc_feature (192)..(192): n is a, c, g, or t
  misc_feature (198)..(198): n is a, c, g, or t
acggggattggtgcataatattctaaaatgaagacattcangctatacaaattacttccaagtntacatgaggtatgggaagattncagtaggtgtattatatgcacggtaccaaatgctgaccagngtngctccatttnttaaatctngaanagggtttctgtacttanctggtnggccangtatgccagnggtagnggggtaccgagctcgg

SEQ ID NO: 509813 - DNA, 519 bp, Homo sapiens
  misc_feature (339)..(339): n is a, c, g, or t
acggtttgccgtgttttcacccttctttgttctccaccggtctgggcagggtctgaggactccggagagcaaggcatgggtccgcctcgtgccgcaggttcctggcccacgccagccgtacccagtagcacaatgggtgagctctgaggacttcacaggggccccatcccctcacctagatgagggctaaccttggaatccagacaaaggtggaagtgacctagatgtgacctgaatgagctaatcatctaatgagagccagccctttgtcctgcccacatgaagggctttgctctacgcactgacaagttggacggctttttattgctttgttgccanttatctgaacatgagaggctgtaaggtgtaatctgcgagccctgcgcccagactgaaccagggcctcccttgaacatgagtattagacaaatgaaataagaacttatcttgcccagactatataatggcttggaaatgcatagtttcctgaacgatctcaataaaatacttttaaaagta

SEQ ID NO: 509814 - DNA, 732 bp, Homo sapiens
  misc_feature (134)..(134): n is a, c, g, or t
  misc_feature (262)..(262): n is a, c, g, or t
  misc_feature (264)..(265): n is a, c, g, or t
  misc_feature (269)..(269): n is a, c, g, or t
agcgggcctcgcgcggcagcgactctggcaggcgctgcagtgaagctggacccgcaggcgggcgtgcgtggagcgggggccgcggccgcgccgcagagatgtgactcgggccgaaggccagctggagcgtcggngctgcggggccgcgggggtcgaatgttcgtggcatcagagagaaagatgagagctcaccaggtgctcaccttcctcctgctcttcgtgatcacctcggtggcctctgaaaacgccagcacatcccgangnntgtnaggctggactcctccctcagtacgtgtccctgtgcgacctggacgccatctggggcattgtggtggaggcggtggccgggggcgggcgccctgatcacactggtcctgatgctcatcctccttggtgcggttgcccttcatcaaggagacaggcgcaacgaagagccctgtgggcctccactttctgttcctcctggggacctgggggctctttgggggcttgacgttttgctttcatccatccaggaggacgagaaccatctgcgtctgtccgaccggttcctctgggggcgttctcttttgcgctctggtttctcctggctggtggagccaggcatggcgcgtgcgggaggcttgggtgcggcattggcacggggcccacgggctggcagttgggtgggcttggggctgtgcctgatgctggtgacacgtcatcatcgctgtgcagtgggtggtggtcacc

SEQ ID NO: 509815 - DNA, 680 bp, Homo sapiens
ggagcggaggtctctcgagctgctgacgatggtcggccgaacgttgtcgcgtgcccgggccagatatctctgctctaggagctgtggcccgtgggcaaccgtggatttctggagcgcgcgcccgtgacgacccccagttttggggcgcgcgctctgatatcgggtggcggtgctgcctcgagagcgcgtcaggaggcttctgctgagcacgtagggccgtgtcgcggctcgttgctgctgggaaggttcgaggattggggtcctttctggtctggtgacgttcccgggcatccgtgggctcggcctggagagaaatccaatcagctttgctgtctggcttgcggttcctgctcctctgtgaggggggcgagattgcccgttctcctcgaagaatgccgttacttgaggcccaagtacggtgcgggtgcttggaatattagaagtcttaagaactcaggagaagcacgcagaaatacatgcaacatggtgactggaaccctacggactctgctatatgagataattccctaggagaacagcatctacatttgaagagtacatccgacgtaaaggcacggtctgtcccagaacaagaggatgacaggaatgtctggactcactggactctaaaggggccagaagcccttcaggagttccagcagacagcaccaataccatgg

SEQ ID NO: 509816 - DNA, 144 bp, Homo sapiens
aatactgtatacatgtaggagaatactgtgtgagaatactgtaggagaatacatgtaggagcaatactgtaggatgaatactgtaggagaatacatgtacagtaggagaaatacatgtaggaggaatactgtagagacgggtac

SEQ ID NO: 509817 - DNA, 554 bp, Homo sapiens
tgctgagatgcataccttttaccagcagcgtgtcatgcaagctgctcaaaagagcaacttcatgggtctagaaatcatgagataaacccccaatggtgacaggccatttggttcttccattctcccaggttttcctaagcatttttttttaagagaaaggtactgcgcctttatcatacaggtacagcagttttaaagggacaaaattcaagtcaagacagttaccaactctaatcaatacgattaccaaagcacgacagaggattaacaagaagcacaatcgtcagagaaccacagcaggagtcgggcatggctatgctatgtgcgtaccaccagtctagagccagccttcggtggagagcctggactggattggctgaagatagccggtgtccctgtaccaaagcgcttggacagcagaggagaagtcttagtcacttaccctcagaggctacccctgaggtctggaccaggtgttggttacgctcacactcttacacctgaaggttcataacgattatcttatgaggatgcttcacatggacgcagaaact

SEQ ID NO: 509818 - DNA, 740 bp, Homo sapiens
  misc_feature (159)..(159): n is a, c, g, or t
  misc_feature (162)..(163): n is a, c, g, or t
  misc_feature (193)..(193): n is a, c, g, or t
  misc_feature (263)..(263): n is a, c, g, or t
  misc_feature (269)..(269): n is a, c, g, or t
  misc_feature (271)..(271): n is a, c, g, or t
  misc_feature (275)..(275): n is a, c, g, or t
  misc_feature (321)..(321): n is a, c, g, or t
  misc_feature (332)..(332): n is a, c, g, or t
gcttcgacagagtcctgctcaatgatggaggctattatgatccagagacaggcgtgttcacagcgccactggctggacgctacttgctgagcgcggtgctgactgggcacggcacgagaaagtggaggccgtgctgtcccgctccaaccaggcgtggcncgnntagactccggtggctacgagcctgagggcntggagaataagccggtgcctgagagcagcccagcccggcaccctggccgtcttcagcctcatcctgccgntgcagncngggnacacggtctgcgtcgacctggtcatggggcagctggcgcactcggnaggagccgctnaccatcttcagcggggccctgctctatggggacccagaagcttgaaacaacgcgtagaactggggtcccagccgatagtgtctacggtccggtgaagacgacatggtgggggtgctggcgggctcctggggagtcttagcctgaagaccgggggcacctatggacctgggcgatgcgcctgacaccctgggccccgcaggcgggacacacggcgccccaagaagacgggcttctccccacgcccccggggcgcgcccggcttcaaggaagggctcgcgggcccgccattggcagacttttcgcgcctgagtgcggatcccccacaagaaaaccgccgtcacaggggccggccctgccggagggacagcccgattccatcggaaacaccgtccaggttcccgtcacaat

SEQ ID NO: 509819 - DNA, 104 bp, Homo sapiens
cgctcttcggtggctcatggtgtggcccttcgtgtggctcgtggagggctctctgggatggctcgtcgcgtggctcgtggtgtggctcattgaggtggcgcaga

SEQ ID NO: 509820 - DNA, 109 bp, Homo sapiens
tctgcgttcatcagaccagcgtcattgtgtgacacttcgttggactgctgtttttgataaccaacaagaggtcaattatagaaatccgctgtatgggacgaagactgcg

SEQ ID NO: 509821 - DNA, 114 bp, Homo sapiens
cggggaaacctgaacacccggcttcggaagctggacgagcagcaggagttcagtgccatcatcctggcaacagctggcctgcagcgcatgggctggcacaaccgggtggggcag

SEQ ID NO: 509822 - DNA, 241 bp, Homo sapiens
taggtgtgaagcgacgtaacacgagaaagcacatatccaaggtgcacccatacactacctgtcaaaaaggcttcgatacgggattatcctatttattacctcagaagtttgttcttcgcaggatttcctctgagtcttttaccactccagccttgcccctaacccccaattaggagggcactgggccccaacaggcattaacccgcttaatccccttagaagtcccactccttaaacacat

SEQ ID NO: 509823 - DNA, 740 bp, Homo sapiens
tggaacacttcaaaatccctcaaaaacggtttattatccaagtgagtttgagagtcccaaggggcttatcggtaggattcctggtagcagagcgcgggacaccagtggcctccaaaatatttgggactcgcagcgaacgatgggtcagctaccagcagggtccggtcatactgggatgaggatgtctttagatctccttcttggaacgcctacatccacatattatctggtaataggccaccagggtcttgcggacgatgggacctggacgagatacgcataaactctggggccacgtagaccaccacccttatacacgggacacaggatagtctacaccagcaaatcagttcctatgcccgaaaacgcaagaactgggtcctccagcaaggtctttgatacctgaaaagcggggtcgacggattcaaatactattatccagggggcccgaccgcgggtaacaaccttgtgtagtgagaacccaatgtgccgcagtttgggacagaggacgccccacagaagtgtacgcatgatacattacttagtggcgcatcccagaaaagaaaccgcttgtaaccgcgaatcgttgcatgagcggagacacacccgtgtgagaccacagagaatagtgagactcccgaagttcacacactcggaaactcattaaaacgtgtgttccggggggaccagggtaaaccgcgggaaaaccccgggaggattcttggcacccatgataaccc

SEQ ID NO: 509824 - DNA, 112 bp, Homo sapiens
atttaattttttttttcctttgagttttgtacttcaaccagcctacaagctggcccttgctaacaaatcagaaatatgccaattaatgattaaagactgtgattgcccccca

SEQ ID NO: 509825 - DNA, 200 bp, Homo sapiens
attcgcggccgcgtcgacccaacatggtgaaaccccgtctctactaaaaatacaaaaattagccaggcatggtggtgcatacctgtagtcccagctactcaggaggctgaggcaggagaactgtgggagaacctgggaggtggaggttaaatccagaggggcccgggcacataaacagttggttgctcggccgtgtatta

SEQ ID NO: 509826 - DNA, 408 bp, Homo sapiens
tcgcgcacgtgtcatcgggtatgcaatcatggtgtggtggactcacatcgtggtaatctcatgcactttgggaaggctgagatagaaggattgtttgcgtcaagaggtttgagagcagtctaggcaacatagagccccaactctaccaaaaatttaacaattagccaggcatgatggtgtgcacctgcggtcccagacttacttgggaggctgaggtgggaagatcactagagcctgaggaggtcgaggcagccgtgagccgggatacatgcccctgcactcgagcctaggtgacagagagaaagcaaaccccagtctcaaagaccaaaacaaaacaaagacacaaggagccatataaggttcagggcagcagaactcaaagacaaccagcgcatctgaaccaaatct

SEQ ID NO: 509827 - DNA, 433 bp, Homo sapiens
  misc_feature (84)..(84): n is a, c, g, or t
  misc_feature (289)..(289): n is a, c, g, or t
  misc_feature (362)..(362): n is a, c, g, or t
gcacaaggggattgcagcactcggtccgatttccccttgaggcaggcttttgctgatccatattcgctggtgtgtgcgtgatgngagagtctaagaagtcaagcaacaagtactttacaggaaaagctgaacagaaattggagtaccctcagagtactaagaagacgaaagttggattttaaggcccacccaggaggagggactcttgtaaacacaagttctgcttgagaccatgagagatgaaggtaaaccagaagtagaccagccctgaccaaccaaacctaaagtntagcctgggaattcatgtctatgttgttctctccaaagacagaggacaatcccatcatcttaggattctctgncaattttttcatacagtgtttggggttttaaggccaaagtccttcagggcttcacaggttaaccgggttcc

SEQ ID NO: 509828 - DNA, 430 bp, Homo sapiens
  misc_feature (26)..(26): n is a, c, g, or t
tcacaaaatgtcatcctggcacattntccaggaggaacggttttatttataaacaaataatcggagcattttcatttcgctatgatgatcgctgtaattggcagaatcacagtcgcgctggggctcgaggctcccggaggccggggaggtaggcacggcgcggaccaccctaggatcgccgccagagggcgccacgcgctccgttcgcgtctgctgctgccctgatgaaaacgctcacagcgcacgcgatacagacggagcaaatcctatgaacttctccagcccagtttagaacaagggaaaggggagcgcgcggtaccggctgtccactccgcggtcctcctagctcaagtcaccctgagtcttcccccagctgacaaaggcgatcggacgcacagccaggacccagaaccgtggatggatcactttg

SEQ ID NO: 509829 - DNA, 898 bp, Homo sapiens
  misc_feature (348)..(348): n is a, c, g, or t
ccgagggggcttttttgcccctccgggttgtttctcccccccgccctctcccgtgtcagttatcggtggaagtccttccttgcaccaacagtcaggatctcttcttcttgggaccactcatgtgaacaagcacggcacccacaagtcgatactttcctggggggttcttcctctcaccggtggcattcaaccctttcgggggtctttctataaggagagtcaatcgggtatgctcgagtcatgtgattgccagcaaatagctcgccccccacattacgccgcagcacgcactcggctggcgccacgcacaaaatctccccggttggagtgaaggcttcttctcccggnggattcccttacatgggggggaacactaccatcaggacactacgcaagcacagagatccgtccgcgccacccgtgcccccatcgccgaccattaggtggtggctcgcggaagacgcaatcccccgggtaacatccccttgggggccacgccgctgcgcacgcatcccaccaccacccggtcggagtctccgcagttcctcagacaaagcctcccactcccctggggggggggcggcgtggagtgttcagagcgcacccctgtgcgcgttctgatcacccgaggtctcggcctgcggcttttggccaatgtattctgcactttcgttcatgcaccgcctgtttgcggggcgctccccgctgtttcatcacgcccccggcccctcccccctccagtaggtctttttacacacagggggcctgtggggtctggtgcgtgccccccaatattcagagcccgtatatatcatcacccacgccaggccctccggggggtccaccccctcctttgcaaaccaccccccccccgccgatcgcccccccgcccaacatc

SEQ ID NO: 509830 - DNA, 157 bp, Homo sapiens
cccagtagtatctgcatacgtcccttcctctatatgcagaagttgttcaaagtcacagcacaagttaatggcagagcccgattatataaattccctgtagagcatagagttggtgagtcactatatatctctacgatatatggggcacagcttgcaa

SEQ ID NO: 509831 - DNA, 603 bp, Homo sapiens
taacataaaataaacccttagcacacccgtccacggggaagcaaagcctaagctgaccccggccacggggctggggggaccacatccaaggcatgaagtactggcagcacggggagcttgcaaaaaacggggacatgaatgtggtgggctgtctctgggcacgcaatgttgtccggggacagagcatgcggaaacctacaggcttgaaaatgaggtgttggcttgatgggcaagatttcagctgctctggctcacactacctctccagcaatctgggcacaacgcaggcacctgggcacatcccagctatgccatactattatctggttgaacgccacaactcaacagttttacccgtggacttcaccctgtgagagaggccctcctgtgcatgtgaagccctgccaatgacacagccgggagagcccctaggagggcgtgtcctcctaaggggggaggaaggggggctaaggaggctgctggctgaacatgcgatctggcagtcaataacgcacaggtggggggcctgacctcaaattataggactcctgccagggctgtttgactaaagtggcaaggcaatccatatcaaggtcgctgtgc

SEQ ID NO: 509832 - DNA, 252 bp, Homo sapiens
ctgactgcacaccactgctctggaggcgtccagggcgctcacggaggagctcccgcggcatctggctgcccggcacctcattgagaagtcagtgcgtaagatcgtctccttgcttggccgcgctccgaggctgaggtggagcagcacctgtccgcgagagccccgctcacggggcacagctgctaaccaagagagaccatgcttgcacttccggaaccatctgcttggtgactctgtggcgctcctctaccc

SEQ ID NO: 509833 - DNA, 284 bp, Homo sapiens
tttcccaactgtgcattcacgacataaagatacactatgggaccatctggtgcataaataccacttcctgtcatatataggctgacatgcactgggcactacacaatgtgatgatacctgcagctccaaagttccttaagaggatctgaccctggcaactgatgagggcaaaacgttcatccaagctgtgggcaacagaatggaggccacatggaaagctttcaccaggtgaacaccaggttcatagaggctagtaacattctcctgcacaacacaacacacgt

SEQ ID NO: 509834 - DNA, 1349 bp, Homo sapiens
  misc_feature (1130)..(1130): n is a, c, g, or t
gtgttgttccaccccatcgggtggggccttcatgtagttgtggcgttatttctatgactccaccgtggtggtcggtttgtttggtcccaccccgccgtgtgtgatgttgggttatgcttccgtgatggatggcgcctcccctcactttgtggtgtggtgccctcacatacaggaggggtgttcttctcgtggacgaaaagtttgtcctccatgcggaagtgtgtggttctccccacaatatgcgtgtctctatggagattgtctctcctctgggggtagtttcttccactgctgcagacctctatcggggggagcaccactgtattgtctcccgcaccccctcttttctggggtaagcccctgtttatactcctttctcttctctcgatcacccttcttgacgttggggccacacatcgggttgggggtctaacatacacagggttgtatacctgttttctaacacgtgtggcacaacgcaaacagggggtgttggtggcagctgtgtggtgctccgccacccaccactctgtgtgaagagtctccctccccgacccccttctgggagattttgggggcgcacacactgttgtttgataacctgtgtgttacacacaaggcggggcacagacgactttccccaatcataggaggtgtgtggtccaacaacacacagagaggcgcgcttctggctgtccacaagttgtatatgggagcacattgagtgttgtcacagaaagaacctctgttcaaagccccactctaaaagaatatattgtgtgtggtacacaactcttgttgtggtctttgtagagggtctattataggccacctgcgtgattgtcccaacgcgtcactctcccacaatggtgtgtcccgcagcgcccaccgcgagatacttctggggggccacccatcggaggtgttatatgaggctctccctcttgggaatattttgggagagcaccacagtgtttaaagccaagtgttgggagcttctctcgaagagcctctcctcggggtgtttatagtgcacagtgtgaaatatgttggcacaccttcttaaggaatattcttaaagagtgtcccacttgtgaaaggaaatgctcttacacgtctacacagagacntcttgtgacaccgtaccaagaaatatatgggccactcgtgcccaatttctcttgtaagaacccggggcaatctcggggtggggtgaatataaaggaattaccaaaacctgcaccagggggaagattattataagaggctgtcacaagatcccaccccccctgtgaaatactcccccaggcgtcccctctctggttaagaacccaggtacccccgggaaa

SEQ ID NO: 509835 - DNA, 272 bp, Homo sapiens
tgcagcgcaggcgaccagaggaccccggcaccatgtgctggcggacacttcggtcacttatgaagcatgttaataaatgtcacgataaaaaaaaaaaaaaaaaaaaaaaaaaaaaaaaaaaaaaaaaaaaaaaaaaaccccccctttttttaggggggggggggggggggggggggggaaaaaaggggggcccgggggggggggaaaggggggggggggggggccccccacccaaaaagggcccacaagagggggggggggtgaaccacgac

SEQ ID NO: 509836 - DNA, 488 bp, Homo sapiens
tgcagattaagcggctggcacagcctggacagtgaaacaggaatccgcggcagcgctgtcaagtgcaatgattacatataaaaaacaaaatggaacctggcctaagaatgtggcacagcttgcccagccctttcctgataatattctgggagaaactgcaccaggcatgacccggatgttcccggcactactagccatgcatcagcaaggggaaatggggaacgggaagaacagaaatgaaggagcgcgtgcgatttcagattcgacgcaaggcaaaaacgctgcatttgtggatacgttaggcggaaagccttttttgcaggatcggcttgagattattgtggacaagcgcagacataagcttgcactgattagcggtaacacgattattcggaattacgaggtagggcttgggggagatcgcacgccagagggctcgtttgtaatctcagacaaggttgttaatccaaatggtcgctccaacggcg

SEQ ID NO: 509837 - DNA, 431 bp, Homo sapiens
  misc_feature (34)..(34): n is a, c, g, or t
  misc_feature (68)..(68): n is a, c, g, or t
  misc_feature (72)..(72): n is a, c, g, or t
  misc_feature (74)..(74): n is a, c, g, or t
  misc_feature (82)..(82): n is a, c, g, or t
  misc_feature (87)..(87): n is a, c, g, or t
  misc_feature (92)..(92): n is a, c, g, or t
  misc_feature (104)..(104): n is a, c, g, or t
  misc_feature (115)..(115): n is a, c, g, or t
  misc_feature (119)..(119): n is a, c, g, or t
  misc_feature (121)..(121): n is a, c, g, or t
  misc_feature (123)..(123): n is a, c, g, or t
  misc_feature (130)..(130): n is a, c, g, or t
  misc_feature (140)..(141): n is a, c, g, or t
  misc_feature (149)..(149): n is a, c, g, or t
  misc_feature (151)..(151): n is a, c, g, or t
  misc_feature (171)..(171): n is a, c, g, or t
  misc_feature (173)..(173): n is a, c, g, or t
  misc_feature (177)..(177): n is a, c, g, or t
  misc_feature (208)..(208): n is a, c, g, or t
  misc_feature (213)..(213): n is a, c, g, or t
  misc_feature (227)..(228): n is a, c, g, or t
  misc_feature (231)..(232): n is a, c, g, or t
  misc_feature (235)..(235): n is a, c, g, or t
  misc_feature (244)..(244): n is a, c, g, or t
  misc_feature (254)..(254): n is a, c, g, or t
  misc_feature (257)..(257): n is a, c, g, or t
  misc_feature (267)..(267): n is a, c, g, or t
  misc_feature (271)..(271): n is a, c, g, or t
  misc_feature (274)..(274): n is a, c, g, or t
  misc_feature (280)..(280): n is a, c, g, or t
  misc_feature (289)..(289): n is a, c, g, or t
  misc_feature (390)..(390): n is a, c, g, or t
  misc_feature (406)..(406): n is a, c, g, or t
  misc_feature (415)..(415): n is a, c, g, or t
  misc_feature (418)..(418): n is a, c, g, or t
  misc_feature (430)..(430): n is a, c, g, or t
ctggtccgcctcggcccgggggcggccatcagcnccctcggcctcggctcgaagggcggggagctgcncgcncncctcggtncgaangaaancctccccttaangcacgtacgcncgcncngngcgcggngcccgcagtnngcaccgcncnctccttgcagaggagccgancncgcncagggaccgcacgcacggagctgcaccgganctccnggaaagcataaagnngcnnggncacgcagcngccgcagcanggnagcgcaccgnagcngcngcagcngcaatgggntgcatcgggaaaagtaagaaggaggaccagcgcaacgaggagaaggggcaggtgaggccaacaaaaagatcgagaagcagctgcagaaggacaagcaggtntaaagggaaaagaaangaatgatgntgntgggtgctggana

SEQ ID NO: 509838 - DNA, 174 bp, Homo sapiens
tggttacgtgtagaccgagcatgctgtcatcatcctacaatgtgcgcgtcggattattccgtgattattcgtccaaaatatcaagaggaccaatgttgtgaaaccctaccctagatgtagccaggtattttacctatctgtgttttgtgagtttttctgttgttccaaataatt

SEQ ID NO: 509839 - DNA, 890 bp, Homo sapiens
gactagcacgtagacacacggagcatatttcacctccgctaccataatcatcgctatcccacaccggcgtcaaagtatttgagctgactcgccacactccacggaagcaatatgaaaatgatctgctgcaggtgcgtctgagccctaggattcatctttcttttcaccgtaggtggcctgactggcagtgtattacgcaaacgtcgatcactagacatcgtactgacacgacacgtagctacgttgtagctcagcttccacgtatgtcctatcaataggagctgtattagccagtcataggaggcttcattcacctgatttcccctattctcaggctacagcctagaccaaactacgccaaaatccatttcactatcatattcatcggcgtaaatctaactttcgttcccacaactacttatctcggcttatccggaatgcccgcgacgataacgtcggactaccccgatgcatacagccacatgaaacatctatcatctgttaggctcattcatgtctctaacagcagtaatatgaactaatttcaagattgagaagccttcggttcgaagagagaagtcctaatagtaagaacgaagccttcagtaaccgggagtgactatatggatgccccacctacagacatcgaagagccgttgctacatctggacacaacggaagattcgacccaaggggttaagcaaccaggctccagactttcagacacaaaaaaacaaaagttggcggcgccaaaaacttataacaccgggcgggcccattgacaggccgggcccgaccgggagggcggtcacaaaaccgggcacgggaaccaaggcgatgcaccgcacccaccgccggtaacaacgaccagcacacacacacacacccac

SEQ ID NO: 509840 - DNA, 332 bp, Homo sapiens
cccccccccggggggggggggttccccgcccccggggtttttttttaaaacgcccccccccttttttttggggccccccggttccccaaaatttttttcccccgggggccatggggggttggggggtccccctttaaaaaacccccctttttttttcaaaaaaattttttccccccccccccccgggcccccttttttttttaaaaaaaagggttttggggggggggaaattaccccccgggggggggggggtttttttttttttttttttttttggggttttcttttttttttttccccccccctttcccttttttttggggcttttttta

SEQ ID NO: 509841 - DNA, 93 bp, Homo sapiens
gcctggtttagtgctgtaattgtcttattattttttttatatatatatttcttggagtaaacattttaaataaacaacaacattgtctactgt

SEQ ID NO: 509842 - DNA, 1191 bp, Homo sapiens
  misc_feature (439)..(439): n is a, c, g, or t
agcggagtgggcagtagtaagatccttcgcactgcaatgcactataggggcgctctctcggtgtgggcccgttttagactgatcgtgtgatgcttgcaatagaggtagtctggaagcgtctaagcctagacgggcattgtctcgtgaggcatgagctgatcaattggtcagcccgacatgacttgagcaaacctgtcagatcgaggcgtaggaggtcacctcgagacacggtgctggacaagaagacaagctatagacctagtcagaggtaatgtgcctgtaaaagacagctatgtcgtaacattgtgcacaagatccccggtgtcttgatgactaacagatcttgcacatttaacctgattaaccgtagaaatagcggtagttgcatatactgccaagaggatacgacgtttgcatcaacaatcgctctgggaaggcnccgtttacaaagatcgtccatctatccacaggattgtcaccatttaagagcgaaggttgaagaactaaaagaggcttgagtgatctccttgggtatgtgtcttgctgaaagatagaattggatctttcactggacacaagatcgaatcaaaggagtggatttagacagagaatatggtatttcaagaattcgagaggtgcgctgtaccattatctcttaagactagagagaattgtacttcgaagtggattacattgtgtttctaatcattcacggattgacgtcattataaggcaaggagttagagatcggtcgtaccacagggtagacactatagtaggtggacatcccatgaagtgtattgtcttgggaaccaacgcgacataaccaagataggtaaccaatctattaattaaagaatattgggaagcattgttacaccttgggagagggctttagccttaggacattgccatttccatggctatggatgcaaatatccttaactctaggggctaagaggcgaattccgattgggggaattgtttaggcgaatttaaccctacttggaaaggttaacatgggaaagggaacgaggctggtcagacgcaatgccagagaatgtgaaactaggacatttttaaaccaatagagatttctcttcagaagggggtaaagcgtaccgttggccttaaaggcggtactagactaaaagttaggaaaacagtggaaggttcaaaaagaatttgggg

SEQ ID NO: 509843 - DNA, 100 bp, Homo sapiens
tctagcactgtgcctggcatataaaagatacttagtatatatttattccctgaggggctgcgccagccccgtgtgctgctatgaaacttctaaaactagg

SEQ ID NO: 509844 - DNA, 339 bp, Homo sapiens
gcaagtctcaggagagtactgtgatgtgggtcatgtcagtcaagtgtagggactagtggaggagcggctgcatttgaagagcaggtaggtgcagaccaggtcatttatcctaagaagttggccctgtagcatgtagattaagtatgccacgtaggttgcgggcaactgaactgggcttcctgtttctgtgtttggtttgaccatcacagtgttgaagaactgttgaagtgaataccttgcagtttgctacagtttcccccggtctcccacattactctggcctccttacctcatgtaggttgcctgaccctctgagacctgtgtttgcttgtaccgctg

SEQ ID NO: 509845 - DNA, 341 bp, Homo sapiens
agttgatgttatcggcagcttactgttatctcacagactgagggcggtggccagtgtctggggcactgaatataacaatcagaagatcagatatctacttcaggaaaattgtagaaaaagggagggatggtgggaagctttggtgaaattacttgttctgatttctgcatgccttttaagttgctcttttcccttggaaatcatgggagtaatgtgatcaggtttaacacttttataacctcattcgagggttcttcacagcccttcactgctgcgacttcactaaatgggagaattgagaaagagaaacatgttttaagccataggattgatgtcgacgc

SEQ ID NO: 509846 - DNA, 358 bp, Homo sapiens
gaaatgagaaccagggtcggtaggggaccacagagtagtacaggtccagcatctgcccccggaagggaactactagcgggcggcccccaccagccggctcctctgaaagggcactctccagtccttccgtctgacggaggcagcccaccttgaccgggtcgcaggaactcggcccaccagtacctgaagatagggaagcaagaccaaggaatatggtttcctgatatgtttggtgatcacagcatctaaaccaggactttatagaaaagtggaagggggtctaattcactggaaaacaagcataaacctggactgcccaggcgaaggacacgtggtcaccctactgataggtctcccc

SEQ ID NO: 509847 - DNA, 681 bp, Homo sapiens
atagcgttcagaggatctcagataagcaggagaagtgaatatgagctcagacttgaaaactgaggaggagcataccaagggacaaggaggagaaaacaataagtttccaagtaaagaaggtataaaaggttagaagtgtactgataaacttagataggctttgaggcctttattacagcccaactgggcttctgtccatgacctaaaagatatttaatgtcagtcagccttgaaatgtaggaataaaatggctggcatctaagcagctttagtacaagaggtttatacaaataagcgaaggattgtatagcttccttctctttttttttctttttctttcttcagtctgacatgaactcaagttatccctaacataggtctacctcaaagaaatttcaggattattcagataacatggatatgtgccaaatccttagagctgttaagatgataatttcctgcgagataagcaggagaaaaaagcaaagagacgaagaacaaaaactctggccctcaggactccagagaaccgggaaggaggaggatttaaaacttgattcctattattctaacaaatggcagcatgaccataagcaaaaccagctcggtcaaactgacagcatcagatggtgaccttatctgaacagtgtagttcacttttattgtggctctgaagagagg

SEQ ID NO: 509848 - DNA, 1347 bp, Homo sapiens
gagttcctggcagaagcaactactactgacgaagccattgacaacagatgatctgaccattaagtctggctgactcacaggtcactccttgcgaagctggcttcagctcagcgtggcaacaacacacttgacacttgactgctcactgagcgcgagcatcaactccctcaagacttcttaacactcctgacagccacactcgcaccacacgtatgcttcgctgcaacacctctgacacaaacgcacacacacgcacagaaacacgcaccacacacgacagaacaccaaacagaacaagccatcactgactgaaactacccactgctcctctcgcctcgctcactctcccctaccccttccatactcaactccattggagtgagtctcccgatgctgctacggcccattctcccacatctcccacttctatttccaacaactgaagctgttccctaccacacttaacaccttatccgcaactcttcctaccaccacaccaccacaacaacacgcaaccagaaaacccaccactctctgccaagagcaagcgcagccataggaccacccagagaaaacaaaacccctcctaccaccacccacacccccacccctgagcgaccccccgcacagcccccacccgaccacaccaacccgcgcgccccggctcgtcgacaccaacaccccgaccccaccaaagaccacaccacccggggacacacagcacaaccccagcaaacacaccgacactcctcaccccccaccgatcaaacccaaccgccccgcaggacaacacacacacagaccttactccgacaccaaaccccacagcgccgcacgcccgagagcgccccatccaaccggcgacccaccaccccaccgcgccgccccctccccgccacgatccaccacatcaaaactaggcccgcccccacacggacggacccaacagagagccacagacaacacgaccagcccacaaccgaccccaacacacgaagacgaagaccaccaacaccaccagaagaacgacataaaccaagcaccagacaacaaagaacgaagccaacaatccaaacaccaacagacaaccgcagcgacatgcacccaaactcctaaaccctacaaactcctcacacgacactcatactcttactctactagccacatcttctatccccgcctatcacatccaccaacactactatatcacaccgtcgcaccctaaccacaatactgtcacatactacacataatagctaagcagtcaaaaatcaaaaatcgcatatcaaatagactaacactctacatctcaataactacaaccgtacactatcaactacttaacat

SEQ ID NO: 509849 - DNA, 511 bp, Homo sapiens
atcccagctctcagggaggctaagaggcgggaggatagcttgagcccaggagttcgagacctgcctgggcaatatagcgagaccccgttctcccaaaaaaaaaaaaaaaaaaaaaaaaaaaacattgtgtcggcgccgcgcccgcgggcccctcggaagaagagttttcgaagacaccaatgcggtgggggcgcgcgcgcgggcgcccaagagggtaaggggaaatggggccacaaacgctgtggtatcaccaatagagagagagactccgggcgacatagagacaaaggggcggggagtttctcacccaccaaaaaaaaaaagcgccgcgcggggggggaacaaccgcgagagcgcggttctggagaaaacaaaatctcccagagatggggagagtctatcgaggagggcgatcaattacaggggaaactcatcaaaacagcgggggagatccacaacggagaaggaccgcaaatatctcaaaaattaacgccccccgcccgcgggtcgt

SEQ ID NO: 509850 - DNA, 797 bp, Homo sapiens
tagctggtgcggcctgctgtgtgtgctgctgtgatgtggctgcctggcactcctgtgtccccgccgctccccgtccccggtgctcctatcccctgcctgctgtccccgtgcgtgagctgggcatatgctgccaccctgctggctgcctgtgcctgtgtgacctgctgtcttcctgtgtgttgatgcctgctgttccccctgctgtgtggcctgtgtgttgtgtgctttgtgtgtccactagcatgtcttgccctgctttcacctgctgctgtgtgactgctgttgcatcttctcccgttcccactccttctgtgggcccaatgatgctgcttggagcagctttgcatgtgctgtgaagccgatgctgagctgcttctgctttgccctgtggcttacgatccatgttgcatgcacctgattgtgccacacggttctgtgtccactgtgccatgtgccattctgacggctaccttgtctgctttgcctgatgctcctttgagaccattcttgctcggaggtccattgcactgcttgctgttgatgtgtgccgtgcatgccttccatgtgactcttgcttgtgtgtgtgactgccccttggctgggtggccaaaccctatgaggcccccttgggactgtggatgtttgtggctttggcccttgctgtgtggtggctggctccctgtgggattccgccgagatagcccaatgccccccctcgggggtcccttgggggactggaccttgttgctcccgacccttggaagtggatgggccccttggtaggctttgaacttgag

SEQ ID NO: 509851 - DNA, 478 bp, Homo sapiens
tatcaaattcatcttcagtcagagtctcccaatccccttccgtcttgaaccttaaactacatctgcctgtgggtccccagatttccagggccctgtagcttttctcagtataaaggcttcttccatggctggggtgagcagcctgagacatctgcaggggaggctccctagaaagagctgggtctttaataatctcctcccagggtgagagaggactgaaaacttacaggaaattagctctgataacagacccccttttcccacaggtgccaccccaggattcccacccattcacaaacatacccataaattgatgtgtccacactcctcccaggactaggcaccaccctcaggtgatctacctgcctcggactcccaaagtgctgggattacaggtgtgagccactgcgtccagtgtctcagttttatttttttctttattcaggtagacatatcatttagaaggtgctagagcatc

SEQ ID NO: 509852 - DNA, 349 bp, Homo sapiens
ccacatgctttatattttctggggttacactgtaaatattcttcactgaggcataataaatttgctacctatattttaagaagcttacttacatatacatatgataaaacaaactcagtgttacaaatttttataggggcaattattaaactcaaactgctgtttacttaaactgttatatttaagagcacaaatatcctaaaaatgaacgattatcggttactataaatatcttagaaacaaagctggttatatgcaggtctatttaaaaggttgtaaacagtttgaaaccacaaaaccgttttactaccttcaaatactgtggataattttaaatagtgctttacca

SEQ ID NO: 509853 - DNA, 914 bp, Homo sapiens
  misc_feature (1)..(1): n is a, c, g, or t
  misc_feature (40)..(40): n is a, c, g, or t
ngctcctacagctggcgctcccccctccccggattgttgngtctcccccccccgcctggtaatggggccgcccaaaatggcccctttctgtaaaaggtttaatgatcaataatatgaaaggaggtgggtgcgggccctattttgtcacaccccccctgtctgtatccgaattggtggaagctttcgaaaagaagaccgtgtttataagggtcggaccctgttacaagatatattattattccgtacgacgccgcgagtagtctctttttcaagcagagagacgggttttctaacctccctcaagagggccggcccccttatcaagaagcccccccccgtgcgtaatacccctcgtaaccccccgcgtgtgaaaaatcctcgcctttacacttgtttaaacgccccctcttgttcaccgcggcccttttctaatattcgccacgctcaccctacatgggctacaacagtattactctgtggcgactgcgatatatagtcgttgaaaaccactatctgtggtgagaaaatatacaaagaatgttaggacttcgagtacaccaagtgactgacaccaccatggttcgcggagagcccgcgctaatacaaaggacatatacgacaaagactagcgcatactagaagaagagtcaataaaactctactcctctttggaaggagaaagcaaaggaaaagatgttagcgcctccgaaaaatgatggcgacgccgccaataatacataagcccaacccttttgggaccaccaccaagctcaaaggggccccacaagggcacccacccttcgtgaggcgaaagaagtggaagaaaagagcccgacggaggacaaaaaaaaattctccacaagcttccaaaaaacaagggaccccctcaaacaaaatcctgggcggacataaca

SEQ ID NO: 509854 - DNA, 531 bp, Homo sapiens
  misc_feature (10)..(10): n is a, c, g, or t
tttttgcctngcggatcatcataaaagctgctacccctacccaagggttagaaacaccttacggaagaaatacaggcacacatgagagagacacagcttggcagattgtgttcatggccaaaaaaatacttgtcagcatgcttctctgagttcgtggaaacttttttgacaaagaggttaatgtgagtcttctgccacgtgacaaactgttgtttgcgatcatcttataatcatatatgtcattttcatgcttttctgagttttcccagtttattgctgatgatagcttttaccaaaaactaatgaattgtaggaagtttatgtcgcatacataaagaaaggaaacaaacacttcttattgctcttggaagatgtatttaattcaaattttacaatttggattcagcatgaattgcaataaatggatcttcggcagagttactaatagaaaactgagctgtgccatcactggaaacatagactttaattcctgtacaactgtcaccaactttatctccgcaaggcaaaaag

SEQ ID NO: 509855 - DNA, 644 bp, Homo sapiens
tgtacctgcctccctggcctgccgccaccgtcccagccacgtcagacactgtgttttcccgggctgtgaaccacctccccgttttttctcaggctcatgccttcaggaaatgctccacctcccgcaagtccacccccgagtctgcaggaggcttgtggagcttgtcgctcctccgcggccgccacctcatggctggtggctctttgggcgttcgttcctaatgcagatagaaagttgcccatcagcaaaactcacgggacggaggtgagcacctcggccccccagcacaggagtgacacaccgctacattgtacgacgtgggctcgcattccacggatgtttgccgtccacgaacgggggccacgacggagcactgcgcaccgcctcccatcaagcagcaccgagccagtgcgcccctcaggcagaacttgctagggcgcgctactgatggccgagggccgcacctcccagcagacccgcagagacaccgcgggctatcaaaaacagtaggcgaggagtgccccacacccccactgcgagaaaggacttctgcggaggcacacagctctgctatcgcttcaccccccgggaaggaggggaaacaacaccccgccgggggggggaagttggcgccccacataaca

SEQ ID NO: 509856 - DNA, 473 bp, Homo sapiens
  misc_feature (105)..(105): n is a, c, g, or t
gctggtcatcataaagtgtacctaaccagtagaacctacgagatacgccctgaagagacccgtgaattgggtcatgcaaaaaatatgtcgctgttctcagtcggnaacttttgccaagagtaatgtgagtcttctgccacgtgacaaactgttgtttgcgatcatcttataatcatatatgtcattttcatgcttttctgagttttcccagtttattgctgatgatagcttttaccaaaaactaatgaattgtaggaagtttatgtcgcatacataaagaaaggaaacaaacacttcttattgctcttggaagatgtatttaattcaaattttacaatttggattcagcatgaattgcaataaatggatcttcggcagagttactaatagaaaactgagctgtgccatcactggaaacatagactttaattcctgtacaactgtcaccaactttatctccgcaaggcaaaaag

SEQ ID NO: 509857 - DNA, 1260 bp, Homo sapiens
cgggttacgggatcgctgagggggttcgtgctggctcccagtgaggcgtgaacctgcttgaccatgagcctgtgggcttcatcgcgggccggccagctggcctatgctctggcgctggggcttcacggcttgctggcatcctgtcggctcacaagataatagccagctccccagtaaatgaacctgcccacggtgtcctgcgctcaggaagatgggtgtgaacctgacacgcagtctaacaaggagacggtgaagcacagcgacgtcctgttatctggctagtgaagccacatatcatccccgttcatccttggatgagattggggccgactgtgcaaaggccaagacacatcgtaggatctccgtgatgccggctggtgtcgaccagtcagctctagatggagaaaagaacgcgtgatggacattaccagaccaggaccccaaatgcttgattcgcctgcagtgtaccaacaagcacctgatggtagatgcacggaaggccgcgaacaagtcgctaccggcccaaggcgcaaccccgaagtgccacctgcggaaggcgacgggaacaggagcacagcctcaccttgggcacaaagcatcccatagagcccagcaggcaaagaggcctaacctgagcaccagaagcgctcgcgcacagaacagcaacgaaccagtcggcaacggccgagaaaccaggggcacctcaagcaggacacaaccacagggcacaccagggaaccaagaagacagatatccagatgaggcaaccggcggacgacgccaactaagcgcccagaaacgacaaggcgggagcagccaagacatcgggacaccaacagccacagggagaccacacgcacccaacaccgacacgagcggaggggaacacgaagggccaaggagagacagcgaacaacacaccggcacaaaagacaagccacacacaaagaggcagcaacgggaaacagaacggaccacacgacgcgagcgcagagcgaaaagagggggacacacaggatgagtgaggacaacagcagccaggggagggagggaagacacagagcgaaacaccgaacgcgcacgacggaagccgacgaccgtcagaggacagccggagagcgtggaacaaccggggcaacacgggcacccagacacgagagacagacgaagggaaggcacaccgcaggaggccagcgaacagaacagggaccagccgaagcgagcgccaggagcagagcccgaccgacagctggaccgagc

SEQ ID NO: 509858 - DNA, 203 bp, Homo sapiens
ggcgggtgaaaaaggttagaagccagatacttaagagaagaaacccgaagccaagaagggtttattcttggttgcaagggtaaaaaggggaaccctaaagctaaaaagcccaagaaggggaagccccacttcagccgcaacccctctctttactagaggaatttgcaggatttccgacctgtccacgtatctcagagaggcca

SEQ ID NO: 509859 - DNA, 133 bp, Homo sapiens
taatcaaaacaaacaaaaacacaaaacacattctaaatactagagataactttacttaaattcttcattttagcagtcatgatatcataggtcctgtaggcttgtacctggggaatatccaccatattattgc

SEQ ID NO: 509860 - DNA, 449 bp, Homo sapiens
cgcttcgcgcttcttgctggaaatctgggccgcgatgcggtccagatcgcgctggccctggctggagagcttgcggccaccgtccgcgtgccgctcgatcatcttgatggcttcgagggcctggacggccttgcgggtggcgctaccgtcggcccggcagaagtgggacggtcgcacaccgtggcgctggcggccaccgtagatgcggcagatcgacccgatgccggccgggctgtggtggtacaggcggcgcaggatcgaggcacagcggacgtagaaccagtccgggtcggtcggggccagctccttgaacttggcggtcttgatcagatccacatactccggcaccttcagctttccagacttcttgaggaaaagggcaacaccctcaaccactttgtcttgatcaacgtcctttacggtgattccaggcatcttcactgcggccg

SEQ ID NO: 509861 - DNA, 165 bp, Homo sapiens
ccacgactggttttcatttaaggagtggtgttggtcggggctgattgctttcccctggccttttgccttggttggtgctgctgttgctgggtggttttcccgggatggactgtttactggtggttattgtttaaggtttactggggtttggtttttttgttcctc

SEQ ID NO: 509862 - DNA, 407 bp, Homo sapiens
tctgtgccgcagttacgtcgatccatgtatttggtatgtgaatagagctgcagtgaacatatttgtgcatgtgtctttatggtcagtaatgattaatattatgcataatccaaaactgtacttattaaacaataacctcccaagcccttctgcccacaagctctgcctcctgggttcaagtaattactcatgcctcaggctcctgattagctggaattacaggcgcaggccaccatgcttggctaacttttgtatctttatccagagactaggtttcaccatgttggcaggggtggtcttgaactctgtacctcaggtgatacatccgtcttagcctcccaaagttctggtattaccggcctgatccatggtgcctggccagtatcttgtctactcattctgtaaac

SEQ ID NO: 509863 - DNA, 182 bp, Homo sapiens
gggctggcgaagagagatcggggtgcatggtaagcagcgcctcaacagccaggacatgtaggcaacacgagcaggcacagctgcgtgcaccaactgtccacactgctcacacaagccaggcccgcagtgccttcggagagctagcaggttacattcaggcagatggccctcttcccaccagt

SEQ ID NO: 509864 - DNA, 164 bp, Homo sapiens
gtttcggtcgctcggaccatcgcgcgaaggtgtgtcgatctccacccgctgggtcagcctcttgtttaaggcctcaatctcctcgtcctccagggagtctgtcgttgggcggtggtcacactccctgaagatcttccggtgcatagtctgtcgtccgacgcgga

SEQ ID NO: 509865 - DNA, 173 bp, Homo sapiens
aacgcacacgttattttctctgtatctgagtacggagcgaaacgattgatttggcggctgggagttgcagttcaattctcagcattaagaagaacacgaagcggttcgcacgcgtgccggtttatttgatgtgtcgcatatgggcgaatttgaagtgaaaggacaagacagcc

SEQ ID NO: 509866 - DNA, 391 bp, Homo sapiens
  misc_feature (391)..(391): n is a, c, g, or t
actgtccaaggtgctgaagaattacaaataaatcaggttttatccattcctcaaagacaaaaccactgaagaaattattgaaagtgttatgatagaaataaggagaaccatgagggaataatataagtagtgaacaagtaatttatttttattaattttaattttaatacaaaatttagatttaagcaatcacttgtttcagcagtgaaatactctcatgggtcagactctcctgctagaatttaggtagtagctcattttacaactacagcaaaataagccaaacagtttgtgctgccaaataagaaatctatttcgattagtgtcaggcctagggctttttcatttacttgaactgcacatgcaaggattaagtctccaagtttggtgn

SEQ ID NO: 509867 - DNA, 225 bp, Homo sapiens
cctttccccctttttttttttaaaaccccccccccgcttaacccaatggttaataaagggaaggcccaaaaaaaccccgtttaagatttttttccaaaacccccccttttttgaaaaacccttggggcccttatttttggcttcaaacggggattttgggggggggccattccttttaattaaagggaaaatttcatggtccaaaaaaggaacccctttttccca

SEQ ID NO: 509868 - DNA, 125 bp, Homo sapiens
ttttgaggttgtggtgcgtcctgtagtccaagtagctgggatacaaacatgcgccacaacatccagctaatttgtgtatttggagtagagatcgatttcaccatgttgtcaggcttgtttcgact

SEQ ID NO: 509869 - DNA, 105 bp, Homo sapiens
tcctaaccagggtcgtacgatgtataacacagaaatgtgtttaagagaggtttagacacgatggatgatggattaaaaacaggatgtgcttgaacccggagggcg

SEQ ID NO: 509870 - DNA, 330 bp, Homo sapiens
ttcatctaagcctgagagtgctatagtagtaacaaataatagataaaatcacctgacaacacaccgaaagagacccacacactacatatccaaacacattacagcataacccatactagtcgttaatgccagcacagtaggccagaccaccccccaagatacaatacttaactatccccacacgctctatacttagacggcacacagataacagtatcaaataatgacactatccttgcccaaattaatgcactggtacacccagtggctcatatttaactacccccagcttcccaatacaaactggggggaacaacactaaatcatagg

SEQ ID NO: 509871 - DNA, 378 bp, Homo sapiens
  misc_feature (53)..(53): n is a, c, g, or t
  misc_feature (280)..(280): n is a, c, g, or t
  misc_feature (343)..(343): n is a, c, g, or t
tatgacacctttacccgggatgaaaaagtaggagaattgcttgggcccgggangtagaggttgcagtgagccaagatcgtgccactgcacactcccagcctgggcaacagagagagactccgtctcaaagaaagaaagaaattgcactaattccttaacatcatctaatatccagttcaatgtacacattttcctggttgtttcatgaataactttttacagttggttcgtttgaaccaggatccaaacaagatctgcctcagcctcctgcgtagtgggnattacaggcacttgccaccatgcccggccaatctttttgtatttttagtagagacggggtttncaccgtgttggggcaggctggtcttcggaacttct

SEQ ID NO: 509872 - DNA, 545 bp, Homo sapiens
cctagccagtaatatgagtctgtgtgctgaggatgagaaatggggtggtgggcagatgcctctcatttcccatactgctgcaaagctgggggacgtaagagtagaggggatatatgcggatatgttgtgtggctaggtgagaatggaaccgtgtatatgccccccaaaagcataaacagagccgtggtggttggataacaatgtagacacaaaagctatttaattaatcatgtatggcagagcaagagaggaatccgggacccatcttgtaaagaaagagaaataggttcaactattctttctttctcaagcgaataccaaggttctacgtgacgataccacctcatctctgtttagaagatgcacaattatcaatgctgaaaaccctcacatggaagtgacaaaatatgcaagaattagtcattggggctcagattactcacacttaacctgcgatgctaattatcctctgctcctccaggtctcctgagcagattaacatcctaagttccaaggaaagtcaaaaggctacaaggaagggcagg

SEQ ID NO: 509873 - DNA, 385 bp, Homo sapiens
tgcagggccttctgaatcggtccgagagctctctctctgccttcttggtcttctcctcgatagtcctgcaggctgtcggtgctcagcggtgtgggaacttcgtagcttgcttgcctgtgcgcgcttgcgcggaaatggcttcaagacgattatacccaagaagcaagccaaagctatggggcctaccccgagtagcctgacagggatattcccagcaaagcagtctgccctatggcgtgcctagtcccagtgttactagccagtccagggacacttcagggtatggccagagcagctatgctactaatggtcagagccagaacacaggctatggactgcagtcaagtccccaaggatatggggccacctgtcgggctagtcgggg

SEQ ID NO: 509874 - DNA, 149 bp, Homo sapiens
agccggtcccctagttagaagttcactagcagcatactcataaaagcccaaagcgaaacacctcaagtgtccatcaaccgatgaatggataaacaaaagtgtaatatatccacacaatagaatcttattcgtcaataaaaaggaatgaa

SEQ ID NO: 509875 - DNA, 1268 bp, Homo sapiens
gcgcagtgagtgaaacacgtacctgcgctggatgtgcctggtcttgcagtgatgctggtggtgactgctggtgtgtgctgtgggcttgtgtgtgtgacctgctggctggtggctggtggcctggtgtgctcagagtgggtgggctttggagatcagagtggtcgactgctgcttctgttgcctggactctggtttcctgccctggagcaatgcctggggcctggtctggcagctggtgcctgccatggatgtccactgctgggcgcgggcatctgtgatagcctgaggcgctacagaaccatgctagcctggcttggagaacgtgtggctctggatcacctttctggtgcgatcccaagatcctctttctgttctacttccccgcggcctactactgcctccctgcctgtgtgggcatcagcggtgctctggatcatgcctcatcaccgatgtggctcaacctcatcttcaatgtgtgtttctattatttggagacatggccctttttggttgggtccatgagtcttggttactacagtccaggctccagcccagtgttcaccagttccccctcttcttgtgaggactggtccaggcatgcccttctggacacctgcattgatcacagtgagcagtcctctggcccagtaattgacgtggccatgtcatacgcatggttgtccactctcggccccggagcccgatggagtaacgtgtgatagactacaccctggataatcgagcccttctttattggacgcgtatgcttgtttctagaatcttacctcttacggcacatttccttaacacgggttgcttgtgctgggccctaatcaaacctgtccacatcttacttgtgtgccggtgctgattaactcccacgaagatgcctaatgaccccggacaggctatgaccctactattgctgtgcacgacagtggtgcccatcattgttaggtagcccctcaccctcactggcataagtatcgacaacaacattctccgccacctacaccgcatatgaccagccacactcactaaagcactctctctttatccttccctcttcacacccaacaaaaattctcaacaccatccgatctattcaatcacaccaacacatcactccaatcttaccacccctcaaccaagatccgatagtcctcactccgactccatcctctctctcgatcttcactgatcagcaccaacacctacatctagatccacacaacattctcattactcactatcattactcccctcac

SEQ ID NO: 509876 - DNA, 147 bp, Homo sapiens
gcaccccacaacaggccccggtgtgttgtgttcccctttgctgtttagccttgatcttcacacaatgagaactgagttgggtttgttttcatgtcaaagtaaattgactaatcccttagatgcccaagagttctgctgtgtgctgtc

SEQ ID NO: 509877 - DNA, 309 bp, Homo sapiens
  misc_feature (196)..(196): n is a, c, g, or t
  misc_feature (251)..(251): n is a, c, g, or t
  misc_feature (270)..(270): n is a, c, g, or t
gttttcgtggctgctgttgggggcaaaaattaacgcccccggtctttgcctctgaacgggaaagtctgtgtgtatgtgttttccccggaatcacacaccaccccaccctcctcctgtcccgtggtttcatcatatctctttgcataccccatgttttccccagttgtcccctggagtttggggggacatccccccncaggcatccttttcaaggggaaaccaaaaaaggcatcaggatgggtgggtttttnattgtggcaacgtttgcanccgttcccgattcaataaatattggatgaatttaaccga

SEQ ID NO: 509878 - DNA, 276 bp, Homo sapiens
aaacggattttttttttttccccggctggtttcaggctcctgggctcaaatggtcctcctccctcagctttcaaaagcccaggcccagttttaactttttccccttccctcatgccccacaaaaggttttataccctttaataaaatgcccttcataaaattggttttgttggtgggccagtttttttaactggaaatttttaattcccccttaaatttttttttttcccgtttcccttaactaattttccaataaaagatggtttttggtgtcca

SEQ ID NO: 509879 - DNA, 165 bp, Homo sapiens
tcggcaaaattcgcatcacatttaactctgtttagtgatgagtggggaggggtgggaggacagggtttggtgccggcgtgcagggtgggctagcccaaggccacccttcctgggagactgtctgggtggaagacaccgcgcagtaggggccgtgttagcatgggg

SEQ ID NO: 509880 - DNA, 939 bp, Homo sapiens
  misc_feature (480)..(480): n is a, c, g, or t
  misc_feature (513)..(513): n is a, c, g, or t
  misc_feature (516)..(516): n is a, c, g, or t
  misc_feature (529)..(529): n is a, c, g, or t
  misc_feature (537)..(537): n is a, c, g, or t
  misc_feature (555)..(555): n is a, c, g, or t
  misc_feature (568)..(568): n is a, c, g, or t
  misc_feature (587)..(587): n is a, c, g, or t
  misc_feature (596)..(596): n is a, c, g, or t
  misc_feature (605)..(605): n is a, c, g, or t
  misc_feature (616)..(616): n is a, c, g, or t
  misc_feature (620)..(620): n is a, c, g, or t
  misc_feature (636)..(637): n is a, c, g, or t
  misc_feature (641)..(641): n is a, c, g, or t
  misc_feature (656)..(656): n is a, c, g, or t
  misc_feature (663)..(663): n is a, c, g, or t
  misc_feature (669)..(669): n is a, c, g, or t
  misc_feature (672)..(673): n is a, c, g, or t
  misc_feature (678)..(678): n is a, c, g, or t
  misc_feature (689)..(689): n is a, c, g, or t
  misc_feature (695)..(696): n is a, c, g, or t
  misc_feature (698)..(698): n is a, c, g, or t
  misc_feature (708)..(708): n is a, c, g, or t
gtgctggtggccagatggagaggcgctggccgcacttcccgtcggggagagagtgtaatatggcgaagacctacgattacctgttcaagctgctgctgatcggggactcgggggtggggaagacctgtgtcctgttccgcttctccgaggacgccttcaactccacttttatctccaccataggaattgactttaaaattaggaccatagagctcgatggcaagagaattaaactgcagatatgggacacagccggtcaggaacggtttcggacgatcacaacggcctactacaggggtgcaatgggcatcatgctggtctacgacatcaccaacgagaagtccttctgacaacatccggaattggattcggaacattgaagagcatgcctctgcagacgtggagaagatgatactggggaataagtgtgatgtgaatgacaagagacaggtgtccaaggaacggggagaaaagctggcnctcgactatgggatcaagttcatggagaccagngcnaaggccaacatcnatgtgganaatgcatttttcactctngccaggatatcanagcaaaaatggacaaaaanttggaaggnaacagcccncaggggagcanccanggagtcaaaatcacannggancagcagaaagaggancagcttnttccgntgnngtctnctgtgaggaanaccgcnnantctgagcctngctcagccagctgactgtgctgcccgggcagctccagctctgatgttgcacccggtggccggctcgattggaacatgttatttgtcagtaccggctggtctttccacttcgaaatggagaagtccacattgccggtccatgtctctgcagataggcaatggcctgctcttaggcgagggaaagtgggggggggccgaaggccaacagggtggccccacacaggacgaagga

SEQ ID NO: 509881 - DNA, 873 bp, Homo sapiens
  misc_feature (536)..(536): n is a, c, g, or t
  misc_feature (569)..(569): n is a, c, g, or t
  misc_feature (572)..(572): n is a, c, g, or t
  misc_feature (585)..(585): n is a, c, g, or t
  misc_feature (593)..(593): n is a, c, g, or t
  misc_feature (611)..(611): n is a, c, g, or t
  misc_feature (624)..(624): n is a, c, g, or t
  misc_feature (643)..(643): n is a, c, g, or t
  misc_feature (652)..(652): n is a, c, g, or t
  misc_feature (661)..(661): n is a, c, g, or t
  misc_feature (672)..(672): n is a, c, g, or t
  misc_feature (676)..(676): n is a, c, g, or t
  misc_feature (692)..(693): n is a, c, g, or t
  misc_feature (697)..(697): n is a, c, g, or t
  misc_feature (712)..(712): n is a, c, g, or t
  misc_feature (719)..(719): n is a, c, g, or t
  misc_feature (725)..(725): n is a, c, g, or t
  misc_feature (728)..(729): n is a, c, g, or t
  misc_feature (734)..(734): n is a, c, g, or t
  misc_feature (745)..(745): n is a, c, g, or t
  misc_feature (751)..(752): n is a, c, g, or t
  misc_feature (754)..(754): n is a, c, g, or t
  misc_feature (764)..(764): n is a, c, g, or t
gtgctggtggccagatggagaggcgctggccgcacttcccgtcggggagagagtgtaatatggcgaagacctacgattacctgttcaagctgctgctgatcggggactcgggggtggggaagacctgtgtcctgttccgcttctccgaggacgccttcaactccacttttatctccaccataggaattgactttaaaattaggaccatagagctcgatggcaagagaattaaactgcagatatgggacacagccggtcaggaacggtttcggacgatcacaacggcctactacaggggtgcaatgggcatcatgctggtctacgacatcaccaacgagaagtccttctgacgaaacatctctggagacatgtggttctccgacacttgttggagcaccgcgctcttgtgtgagagctgtgctgaaaaaagattattatattctccgcgggaaccccaggttggtgtggttggtggacttgggcccacggagaacccaagtgttccccagggaacgcggggagaaaaaaagctggcnctcgactatgggatcaagttcatggagaccagngcnaaggccaacatcnatgtgganaatgcatttttcactctngccaggatatcanagcaaaaatggacaaaaanttggaaggnaacagcccncaggggagcanccanggagtcaaaatcacannggancagcagaaagaggancagcttnttccgntgnngtctnctgtgaggaanaccgcnnantctgagcctngctcagccagctgactgtgcctgttctgagtgagcccctcactcagccggggagccttccacctccaaagccccgccacgccagggccacggggccccggccaccaaat

SEQ ID NO: 509882 - DNA, 192 bp, Homo sapiens
  misc_feature (32)..(32): n is a, c, g, or t
taaatattagttacacattcagacattccaantgatacaaagtacttggaaacagttacagacctcaccaagctaggttagggagacatgaagtccaacagacatctgaaatagctagtgaaggcaaacatatatacaaacatagcaatagataagcttacacgaacttgacctatatactacagaggtagg

SEQ ID NO: 509883 - DNA, 102 bp, Homo sapiens
attccaggggtttccttccagctcacattttatccatttccttagatattgttgtaaatttgccttggtttgggggggtcttttgggagggggggtttcact

SEQ ID NO: 509884 - DNA, 871 bp, Homo sapiens
  misc_feature (74)..(75): n is a, c, g, or t
  misc_feature (103)..(103): n is a, c, g, or t
cacttaaagggaaccagggaccacacttgtagggcacaaacccccgcgccagacagaaagaaaaggggcagganncttcacgcgcccaataaaaaaaagaccncaggaacgagacccccacagccccaccaacaaccccaaggaaggcgcacggaggggagggaagccagcccccggcccgcttggtcgggggccctccccccttcccgatgcccacactcactcaatttttacttataatttaattttttgttttaatagtaagttctatattaacgacttcctaaagcatcccaatacggagtccactctccacgaggaccccagcaaactcccaagtaggcacacgtacacaccataacagtgccccgtggaattgggggcagtggccccctaccttcccctctctccagccctcccactcaacccctaagatccccatatagtctcaccacgaacgtatcgaagattcgatagatataagggcgatccgatattttagacctttactgagtctactccccgctccgcgagtcagcaagattgcttatatacgtacctacgcaattttatgttgcggttagttatcagtttgattctcctcgtgttcccgtacgcgcctgcagatagtcgtagcggactgccgcgcctggcctcgcgcgcgaaccctcacttccccggaccgagcacgagccccagccccagcgctgcttctcgctgccacacatcacgcccagtattcctgatgcacaactataggtttctataaagtcaatttccccatgttactctttatgcggtcgcattaactactaaactctcgttccttttcgcactatagaacataccacaccgaccacgatccagaagg

SEQ ID NO: 509885 - DNA, 148 bp, Homo sapiens
ccagtagtttgtgatgggtccagtagtttgtgatggctccccagcagagacggaatattgatctagatcacacatcacaactacacctatcacacccatcacaaactactggggggaccgtgctgaaactccctatcatggtcctact

SEQ ID NO: 509886 - DNA, 761 bp, Homo sapiens
tattcccaaaactccgcacgtgtgcggacgcagagactcgtacccatgtccctggttaactcgttactctgaacgagtgcagtgcaggcggctcgatagatggatgagcgctgtgatcgcgcctgtcgctgaggtgcgctgttagtgaccactgtcgtctcttgagacgagctctagaatacagacagagcgtgacaccgtagagtacgtaagcgatcgtcgagagcggctgcaggagagagtagaagacggcgtgggtgagacgtaatcgcttgccgcggggatcaatcctaatgtgcttaattgggctcgccattcctcatacgcacttctttacagtaaggagacgaggtcaaacgactgcaatcccttaccatcaagatcaatttgtactaccaaatggtgactgacaaacctaacgaagttaacagacgatctagcgggggaacgtaagtacttcatacgtcctagcataggctttgccggcatgtatacatatcgctaggaaaccacggcgaaccatgcgaacttccttgtaccgttagatcaagtgcgagttagtacgtacccggattggatactcgccccattgcagtaataaataagatctatcagtcacaatggatcgtcattgactagcgtcgagtgaagcttagtgccccaacagtatagggcttataaaaaacgagtattggcctatttcccggatgctactatagtcagtagggtactttcattcgataggtgaccgggggtaatac

SEQ ID NO: 509887 - DNA, 115 bp, Homo sapiens
tttgggttaaaaatcttgaatttaaaacttctacctgtagatattaagtttagcttcttagtattttatgtgtgcacagtggccttaaaagtaacgatgaaaatcttggggtgtt

SEQ ID NO: 509888 - DNA, 682 bp, Homo sapiens
  misc_feature (49)..(49): n is a, c, g, or t
  misc_feature (98)..(98): n is a, c, g, or t
  misc_feature (100)..(101): n is a, c, g, or t
cccgggcgcgacgcgctgggtcaggacgcggttctagaaccgggtgatngaactaaaccttcgccgcaccgagtttgcagtacggccgtcacccgcancnntgcctgctgtgcggttggagaaatcaggccctacgggcctccgtagtcacctctctatagtgggcgtggccgaggccgggtgtgaccctgcgggagccttccgttgccagcgaacagtgttcaagctttcactctactcagttccctgagggtcaatcgaagtattgtggaggacggcagcggagccagttgtgaagaaaggcatctcacagctcggacacttatgtgcgagccaatacacaaactggttgtcagggaaagggtactcccaaaattaggcccaagatggcaaagttgggtccaagtggggggtcagaccagctatgaatatctccaaaaagtgcacctcgtggatttttttaccgagaaaactgtggtcgtaatgtgggttttggcgttggccttattgtgacttccctttgggctagagggtttcaaacattaaagaaagctaggtgtatccgcgtggtttcagtgggattaggttggctccttctattatccaaaaaaagcatccggtgttgtgcccaggtcaaggggggaaaagattatatggatgggggttaacagaggaatatata

SEQ ID NO: 509889 - DNA, 8672 bp, Homo sapiens
gcctccacacggctccgtcgggcgccgcgctcttccggcagcggtacgtttggagacgccgggaacccgcgttggcgtggttgactagtgcctcgcagcctcagcatgggggaacatggcctggagctggcttccatgatccccgccctgcgggagctgggcagtgccacaccagaggaatataatacagttgtacagaagccaagacaaattctgtgtcaattcattgaccggatacttacagatgtaaatgttgttgctgtagaacttgtaaagaaaactgactctcagccaacctccgtgatgttgcttgatttcatccagcatatcatgaaatcctccccacttatgtttgtaaatgtgagtggaagccatgagcgcaaaggcagttgtattgaattcagtaattggatcataacgagacttctgcggattgcagcaactccctcctgtcatttgttacacaagaaaatctgtgaagtcatctgttcattattatttctttttaaaagcaagagtcctgctatttttggggtactcacaaaagaattattacaactttttgaagacttggtttacctccatagaagaaatgtgatgggtcatgctgtggaatggccagtggtcatgagccgatttttaagtcaattagatgaacacatgggatatttacaatcagctcctttgcagttgatgagtatgcaaaatttagaatttattgaagtcactttattaatggttcttactcgtattattgcaattgtgttttttagaaggcaagaactcttactttggcagataggttgtgttctgctagagtatggtagtccaaaaattaaatccctagcaattagctttttaacagaactttttcagcttggaggactaccagcacaaccagctagcacttttttcagctcatttttggaattattaaaacaccttgtagaaatggatactgaccaattgaaactctatgaagagccattatcaaagctgataaagacactatttccctttgaagcagaagcttatagaaatattgaacctgtctatttaaatatgctgctggaaaaactctgtgtcatgtttgaagacggtgtgctcatgcggcttaagtctgatttgctaaaagcagctttgtgccatttactgcagtatttccttaaatttgtgccagctgggtatgaatctgctttacaagtcaggaaggtctatgtgagaaatatttgtaaagctcttttggatgtgcttggaattgaggtagatgcagagtacttgttgggcccactttatgcagctttgaaaatggaaagtatggaaatcattgaggagattcaatgccaaactcaacaggaaaacctcagcagtaatagtgatggaatatcacccaaaaggcgtcgtctcagctcgtctctaaacccttctaaaagagcaccaaaacagactgaggaaattaaacatgtggacatgaaccaaaagagcatattatggagtgcactgaaacagaaagctgaatcccttcagatttcccttgaatacagtggcctaaagaatcctgttattgagatgttagaaggaattgctgttgtcttacaactgactgctctgtgtactgttcattgttctcatcaaaacatgaactgccgtactttcaaggactgtcaacataaatccaagaagaaaccttctgtagtgataacttggatgtcattggatttttacacaaaagtgcttaagagctgtagaagtttgttagaatctgttcagaaactggacctggaggcaaccattgataaggtggtgaaaatttatgatgctttgatttatatgcaagtaaacagttcatttgaagatcatatcctggaagatttatgtggtatgctctcacttccatggatttattcccattctgatgatggctgtttaaagttgaccacatttgccgctaatcttctaacattaagctgtaggatttcagatagctattcaccacaggcacaatcacgatgtgtgtttcttctgactctgtttccaagaagaatattccttgagtggagaacagcagtttacaactgggccctgcagagctcccatgaagtaatccgggctagttgtgttagtggattttttatcttattgcagcagcagaattcttgtaacagagttcccaagattcttatagataaagtcaaagatgattctgacattgtcaagaaagaatttgcttctatacttggtcaacttgtctgtactcttcacggcatgttttatctgacaagttctttaacagaacctttctctgaacacggacatgtggacctcttctgtaggaacttgaaagccacttctcaacatgaatgttcatcttctcaactaaaagcttctgtctgcaagccattccttttcctactgaaaaaaaaaatacctagtccagtaaaacttgctttcatagataatctacatcatctttgtaagcatcttgattttagagaagatgaaacagatgtaaaagcagttcttggaactttattaaatttaatggaagatccagacaaagatgttagagtggcttttagtggaaatatcaagcacatattggaatccttggactctgaagatggatttataaaggagctttttgtcttaagaatgaaggaagcatatacacatgcccaaatatcaagaaataatgagctgaaggataccttgattcttacaacaggggatattggaagggccgcaaaaggagatttggtaccatttgcactcttacacttattgcattgtttgttatccaagtcagcatctgtctctggagcagcatacacagaaattagagctctggttgcagctaaaagtgttaaactgcaaagttttttcagccagtataagaaacccatctgtcagtttttggtagaatcccttcactctagtcagatgacagcacttccgaatactccatgccagaatgctgacgtgcgaaaacaagatgtggctcaccagagagaaatggctttaaatacgttgtctgaaattgccaacgttttcgactttcctgatcttaatcgttttcttactaggacattacaagttctactacctgatcttgctgccaaagcaagccctgcagcttctgctctcattcgaactttaggaaaacaattaaatgtcaatcgtagagagattttaataaacaacttcaaatatattttttctcatttggtctgttcttgttccaaagatgaattagaacgtgcccttcattatctgaagaatgaaacagaaattgaactggggagcctgttgagacaagatttccaaggattgcataatgaattattgctgcgtattggagaacactatcaacaggtttttaatggtttgtcaatacttgcctcatttgcatccagtgatgatccatatcagggcccgagagatatcatatcacctgaactgatggctgattatttacaacccaaattgttgggcattttggctttttttaacatgcagttactgagctctagtgttggcattgaagataagaaaatggccttgaacagtttgatgtctttgatgaagttaatgggacccaaacatgtcagttctgtgagggtgaagatgatgaccacactgagaactggccttcgattcaaggatgattttcctgaattgtgttgcagagcttgggactgctttgttcgctgcctggatcatgcttgtctgggctcccttctcagtcatgtaatagtagctttgttacctcttatacacatccagcctaaagaaactgcagctatcttccactacctcataattgaaaacagggatgctgtgcaagattttcttcatgaaatatattttttacctgatcatccagaattaaaaaagataaaagccgttctccaggaatacagaaaggagacctctgagagcactgatcttcagacaactcttcagctctctatgaaggccattcaacatgaaaatgtcgatgttcgtattcatgctcttacaagcttgaaggaaaccttgtataaaaatcaggaaaaactgataaagtatgcaacagacagtgaaacagtagaacctattatctcacagttggtgacagtgcttttgaaaggttgccaagatgcaaactctcaagctcggttgctctgtggggaatgtttaggggaattgggggcgatagatccaggtcgattagatttctcaacaactgaaactcaaggaaaagattttacatttgtgactggagtagaagattcaagctttgcctatggattattgatggagctaacaagagcttaccttgcgtatgctgataatagccgagctcaagattcagctgcctatgccattcaggagttgctttctatttatgactgtagagagatggagaccaacggcccaggtcaccaattgtggaggagatttcctgagcatgttcgggaaatactagaacctcatctaaataccagatacaagagttctcagaagtcaaccgattggtctggagtaaagaagccaatttacttaagtaaattgggtagtaactttgcagaatggtcagcatcttgggcaggttatcttattacaaaggttcgacatgatcttgccagtaaaattttcacctgctgtagcattatgatgaagcatgatttcaaagtgaccatctatcttcttccacatattctggtgtatgtcttactgggttgtaatcaagaagatcagcaggaggtttatgcagaaattatggcagttctaaagcatgacgatcagcataccataaatacccaagacattgcatctgatctgtgtcaactcagtacacagactgtgttctccatgcttgaccatctcacacagtgggcaaggcacaaatttcaggcactgaaagctgagaaatgtccacacagcaaatcaaacagaaataaggtagactcaatggtatctactgtggattatgaagactatcagagtgtaacccgttttctagacctcataccccaggatactctggcagtagcttcctttcgctccaaagcatacacacgagctgtaatgcactttgaatcatttattacagaaaagaagcaaaatattcaggaacatcttggatttttacagaaattgtatgctgctatgcatgaacctgatggagtggccggagtcagtgcaattagaaaggcagaaccatctctaaaagaacagatccttgaacatgaaagccttggcttgctgagggatgccactgcttgttatgacagggctattcagctagaaccagaccagatcattcattaccatggtgtagtaaagtccatgttaggtcttggtcagctgtctactgttatcactcaggtgaatggagtgcatgctaacaggtccgagtggacagatgaattaaacacgtacagagtggaagcagcttggaaattgtcacagtgggatttggtggaaaactatttggcagcagatggaaaatctacaacatggagtgtcagactgggacagctattattatcagccaaaaaaagagatatcacagctttttatgactcactgaaactagtgagagcagaacaaattgtacctctttcagctgcaagctttgaaagaggctcctaccaacgaggatatgaatatattgtgagattgcacatgttatgtgagttggagcatagcatcaaaccacttttccagcattctccaggtgacagttctcaagaagattctctaaactgggtagctcgactagaaatgacccagaattcctacagagccaaggagcctatcctggctctccggagggctttactaagcctcaacaaaagaccagattacaatgaaatggttggagaatgctggctgcagagtgccagggtagctagaaaggctggtcaccaccagacagcctacaatgctctccttaatgcaggggaatcacgactcgctgaactgtacgtggaaagggcaaagtggctctggtccaagggtgatgttcaccaggcactaattgttcttcaaaaaggtgttgaattatgttttcctgaaaatgaaaccccacctgagggtaagaacatgttaatccatggtcgagctatgctactagtgggccgatttatggaagaaacagctaactttgaaagcaatgcaattatgaaaaaatataaggatgtgaccgcgtgcctgccagaatgggaggatgggcatttttaccttgccaagtactatgacaaattgatgcccatggtcacagacaacaaaatggaaaagcaaggtgatctcatccggtatatagttcttcattttggcagatctctacaatatggaaatcagttcatatatcagtcaatgccacgaatgttaactctatggcttgattatggtacaaaggcatatgaatgggaaaaagctggccgctccgatcgtgtacaaatgaggaatgatttgggtaaaataaacaaggttatcacagagcatacaaactatttagctccatatcaatttttgactgctttttcacaattgatctctcgaatttgtcattctcacgatgaagtttttgttgtcttgatggaaataatagccaaagtatttctagcctatcctcaacaagcaatgtggatgatgacagctgtgtcaaagtcatcttatcccatgcgtgtgaacagatgcaaggaaatcctcaataaagctattcatatgaaaaaatccttagagaagtttgttggagatgcaactcgcctaacagataagcttctagaattgtgcaataaaccggttgatggaagtagttccacattaagcatgagcactcattttaaaatgcttaaaaagctggtagaagaagcaacatttagtgaaatcctcattcctctacaatcagtcatgatacctacacttccatcaattctgggtacccatgctaaccatgctagccatgaaccatttcctggacattgggcctatattgcagggtttgatgatatggtggaaattcttgcttctcttcagaaaccaaagaagatttctttaaaaggctcagatggaaagttctacatcatgatgtgtaagccaaaagatgacctgagaaaggattgtagactaatggaattcaattccttgattaataagtgcttaagaaaagatgcagagtctcgtagaagagaacttcatattcgaacatatgcagttattccactaaatgatgaatgtgggattattgaatgggtgaacaacactgctggtttgagacctattctgaccaaactatataaagaaaagggagtgtatatgacaggaaaagaacttcgccagtgtatgctaccaaagtcagcagctttatctgaaaaactcaaagtattccgagaatttctcctgcccaggcatcctcctatttttcatgagtggtttctgagaacattccctgatcctacatcatggtacagtagtagatcagcttactgccgttccactgcagtaatgtcaatggttggttatattctggggcttggagaccgtcatggtgaaaatattctctttgattctttgactggtgaatgcgtacatgtagatttcaattgtcttttcaataagggagaaacctttgaagttccagaaattgtgccatttcgcctgactcataatatggttaatggaatgggtcctatgggaacagagggtctttttcgaagagcatgtgaagttacaatgaggctgatgcgtgatcagcgagagcctttaatgagtgtcttaaagacttttctacatgatcctcttgtggaatggagtaaaccagtgaaagggcattccaaagcgccactgaatgaaactggagaagttgtcaatgaaaaggccaagacccatgttcttgacattgagcagcgactacaaggtgtaatcaagactcgaaatagagtgacaggactgccgttatctattgaaggacatgtgcattaccttatacaagaagctactgatgaaaacttactatgccagatgtatcttggttggactccatatatgtgaaatgaaattatgtaaaagaatatgttaataatctaaaagtaatgcatttggtatgaatctgtggttgtatctgttcaattctaaagtacaacataaatttacgttctcagcaactgttatttctctctgatcattaattatatgtaaaataatatacattcagttattaagaaataaactgctttcttaatacataaaaacaaagaaaacaaaatattttattactaacaaacaaaaaaaataaatatgtactgggccttctttagcctaaagcgggggagatttttggagcccctctccttttaatgggggttaattttatgatcctttatttcactaatttcctagatcttggtattctggtttcgggagagagggattactcctccctgaatgggggatattatgtttttcgcacaaaataagggataaacccaagaagaaaaacatgtgaccaaatagcccaccaaaaggcccctatacttaaatatgggcccactttgtgggattttttcaaataggtaccacccccttaccaagatattaaaaaatcagctttcaagtaatggtgaggaaaaccctaaaagaaaaaaaaataacgcgttatttcccggaaatttgtttttgttctt

SEQ ID NO: 509890 - DNA, 615 bp, Homo sapiens
ttagccacagatgacgcggagaaccctaataccaaaaccaggaaaggacataaccaaaaattatatccttgatgaacatagacgctaaaatgggtaacaaaatactatctaactgaatccaataacatatcaaaaagataatccaccatgatcaagtgagtttcataccagggatccaggaatggtttaacaaatgcaagtcaataaatgtgatacaccacactgacagaattaaaaacaaaaatcacatgatcatctcaatagatgcagcagaaaaagcattctacaaaatccagcatccctttatgattaaaactatcagcaaaattggcatacaagggacatatctcaatacaataaaagccatccctgacaaacccacagacccacaacataatactgattggggaaaaattgaaagtattccctctaagaactggaataagacaaggatgttcactctcaccactcctctttaacacagcactggaagtcctagccagagcaatcagagaagagaaagaaacaaagggcatccaaatcagtaaagaggaatttaaactgtcactgtttgatgctgatatgattgcttaccttgaaaccctaaagactctc

SEQ ID NO: 509891 - DNA, 8151 bp, Homo sapiens
gcctccacacggctccgtcgggcgccgcgctcttccggcagcggtacgtttggagacgccgggaacccgcgttggcgtggttgactagtgcctcgcagcctcagcatgggggaacatggcctggagctggcttccatgatccccgccctgcgggagctgggcagtgccacaccagaggaatataatacagttgtacagaagccaagacaaattctgtgtcaattcattgaccggatacttacagatgtaaatgttgttgctgtagaacttgtaaagaaaactgactctcagccaacctccgtgatgttgcttgatttcatccagcatatcatgaaatcctccccacttatgtttgtaaatgtgagtggaagccatgagcgcaaaggcagttgtattgaattcagtaattggatcataacgagacttctgcggattgcagcaactccctcctgtcatttgttacacaagaaaatctgtgaagtcatctgttcattattatttctttttaaaagcaagagtcctgctatttttggggtactcacaaaagaattattacaactttttgaagacttggtttacctccatagaagaaatgtgatgggtcatgctgtggaatggccagtggtcatgagccgatttttaagtcaattagatgaacacatgggatatttacaatcagctcctttgcagttgatgagtatgcaaaatttagaatttattgaagtcactttattaatggttcttactcgtattattgcaattgtgttttttagaaggcaagaactcttactttggcagataggttgtgttctgctagagtatggtagtccaaaaattaaatccctagcaattagctttttaacagaactttttcagcttggaggactaccagcacaaccagctagcacttttttcagctcatttttggaattattaaaacaccttgtagaaatggatactgaccaattgaaactctatgaagagccattatcaaagctgataaagacactatttccctttgaagcagaagcttatagaaatattgaacctgtctatttaaatatgctgctggaaaaactctgtgtcatgtttgaagacggtgtgctcatgcggcttaagtctgatttgctaaaagcagctttgtgccatttactgcagtatttccttaaatttgtgccagctgggtatgaatctgctttacaagtcaggaaggtctatgtgagaaatatttgtaaagctcttttggatgtgcttggaattgaggtagatgcagagtacttgttgggcccactttatgcagctttgaaaatggaaagtatggaaatcattgaggagattcaatgccaaactcaacaggaaaacctcagcagtaatagtgatggaatatcacccaaaaggcgtcgtctcagctcgtctctaaacccttctaaaagagcaccaaaacagactgaggaaattaaacatgtggacatgaaccaaaagagcatattatggagtgcactgaaacagaaagctgaatcccttcagatttcccttgaatacagtggcctaaagaatcctgttattgagatgttagaaggaattgctgttgtcttacaactgactgctctgtgtactgttcattgttctcatcaaaacatgaactgccgtactttcaaggactgtcaacataaatccaagaagaaaccttctgtagtgataacttggatgtcattggatttttacacaaaagtgcttaagagctgtagaagtttgttagaatctgttcagaaactggacctggaggcaaccattgataaggtggtgaaaatttatgatgctttgatttatatgcaagtaaacagttcatttgaagatcatatcctggaagatttatgtggtatgctctcacttccatggatttattcccattctgatgatggctgtttaaagttgaccacatttgccgctaatcttctaacattaagctgtaggatttcagatagctattcaccacaggcacaatcacgatgtgtgtttcttctgactctgtttccaagaagaatattccttgagtggagaacagcagtttacaactgggccctgcagagctcccatgaagtaatccgggctagttgtgttagtggattttttatcttattgcagcagcagaattcttgtaacagagttcccaagattcttatagataaagtcaaagatgattctgacattgtcaagaaagaatttgcttctatacttggtcaacttgtctgtactcttcacggcatgttttatctgacaagttctttaacagaacctttctctgaacacggacatgtggacctcttctgtaggaacttgaaagccacttctcaacatgaatgttcatcttctcaactaaaagcttctgtctgcaagccattccttttcctactgaaaaaaaaaatacctagtccagtaaaacttgctttcatagataatctacatcatctttgtaagcatcttgattttagagaagatgaaacagatgtaaaagcagttcttggaactttattaaatttaatggaagatccagacaaagatgttagagtggcttttagtggaaatatcaagcacatattggaatccttggactctgaagatggatttataaaggagctttttgtcttaagaatgaaggaagcatatacacatgcccaaatatcaagaaataatgagctgaaggataccttgattcttacaacaggggatattggaagggccgcaaaaggagatttggtaccatttgcactcttacacttattgcattgtttgttatccaagtcagcatctgtctctggagcagcatacacagaaattagagctctggttgcagctaaaagtgttaaactgcaaagttttttcagccagtataagaaacccatctgtcagtttttggtagaatcccttcactctagtcagatgacagcacttccgaatactccatgccagaatgctgacgtgcgaaaacaagatgtggctcaccagagagaaatggctttaaatacgttgtctgaaattgccaacgttttcgactttcctgatcttaatcgttttcttactaggacattacaagttctactacctgatcttgctgccaaagcaagccctgcagcttctgctctcattcgaactttaggaaaacaattaaatgtcaatcgtagagagattttaataaacaacttcaaatatattttttctcatttggtctgttcttgttccaaagatgaattagaacgtgcccttcattatctgaagaatgaaacagaaattgaactggggagcctgttgagacaagatttccaaggattgcataatgaattattgctgcgtattggagaacactatcaacaggtttttaatggtttgtcaatacttgcctcatttgcatccagtgatgatccatatcagggcccgagagatatcatatcacctgaactgatggctgattatttacaacccaaattgttgggcattttggctttttttaacatgcagttactgagctctagtgttggcattgaagataagaaaatggccttgaacagtttgatgtctttgatgaagttaatgggacccaaacatgtcagttctgtgagggtgaagatgatgaccacactgagaactggccttcgattcaaggatgattttcctgaattgtgttgcagagcttgggactgctttgttcgctgcctggatcatgcttgtctgggctcccttctcagtcatgtaatagtagctttgttacctcttatacacatccagcctaaagaaactgcagctatcttccactacctcataattgaaaacagggatgctgtgcaagattttcttcatgaaatatattttttacctgatcatccagaattaaaaaagataaaagccgttctccaggaatacagaaaggagacctctgagagcactgatcttcagacaactcttcagctctctatgaaggccattcaacatgaaaatgtcgatgttcgtattcatgctcttacaagcttgaaggaaaccttgtataaaaatcaggaaaaactgataaagtatgcaacagacagtgaaacagtagaacctattatctcacagttggtgacagtgcttttgaaaggttgccaagatgcaaactctcaagctcggttgctctgtggggaatgtttaggggaattgggggcgatagatccaggtcgattagatttctcaacaactgaaactcaaggaaaagattttacatttgtgactggagtagaagattcaagctttgcctatggattattgatggagctaacaagagcttaccttgcgtatgctgataatagccgagctcaagattcagctgcctatgccattcaggagttgctttctatttatgactgtagagagatggagaccaacggcccaggtcaccaattgtggaggagatttcctgagcatgttcgggaaatactagaacctcatctaaataccagatacaagagttctcagaagtcaaccgattggtctggagtaaagaagccaatttacttaagtaaattgggtagtaactttgcagaatggtcagcatcttgggcaggttatcttattacaaaggttcgacatgatcttgccagtaaaattttcacctgctgtagcattatgatgaagcatgatttcaaagtgaccatctatcttcttccacatattctggtgtatgtcttactgggttgtaatcaagaagatcagcaggaggtttatgcagaaattatggcagttctaaagcatgacgatcagcataccataaatacccaagacattgcatctgatctgtgtcaactcagtacacagactgtgttctccatgcttgaccatctcacacagtgggcaaggcacaaatttcaggcactgaaagctgagaaatgtccacacagcaaatcaaacagaaataaggtagactcaatggtatctactgtggattatgaagactatcagagtgtaacccgttttctagacctcataccccaggatactctggcagtagcttcctttcgctccaaagcatacacacgagctgtaatgcactttgaatcatttattacagaaaagaagcaaaatattcaggaacatcttggatttttacagaaattgtatgctgctatgcatgaacctgatggagtggccggagtcagtgcaattagaaaggcagaaccatctctaaaagaacagatccttgaacatgaaagccttggcttgctgagggatgccactgcttgttatgacagggctattcagctagaaccagaccagatcattcattaccatggtgtagtaaagtccatgttaggtcttggtcagctgtctactgttatcactcaggtgaatggagtgcatgctaacaggtccgagtggacagatgaattaaacacgtacagagtggaagcagcttggaaattgtcacagtgggatttggtggaaaactatttggcagcagatggaaaatctacaacatggagtgtcagactgggacagctattattatcagccaaaaaaagagatatcacagctttttatgactcactgaaactagtgagagcagaacaaattgtacctctttcagctgcaagctttgaaagaggctcctaccaacgaggatatgaatatattgtgagattgcacatgttatgtgagttggagcatagcatcaaaccacttttccagcattctccaggtgacagttctcaagaagattctctaaactgggtagctcgactagaaatgacccagaattcctacagagccaaggagcctatcctggctctccggagggctttactaagcctcaacaaaagaccagattacaatgaaatggttggagaatgctggctgcagagtgccagggtagctagaaaggctggtcaccaccagacagcctacaatgctctccttaatgcaggggaatcacgactcgctgaactgtacgtggaaagggcaaagtggctctggtccaagggtgatgttcaccaggcactaattgttcttcaaaaaggtgttgaattatgttttcctgaaaatgaaaccccacctgagggtaagaacatgttaatccatggtcgagctatgctactagtgggccgatttatggaagaaacagctaactttgaaagcaatgcaattatgaaaaaatataaggatgtgaccgcgtgcctgccagaatgggaggatgggcatttttaccttgccaagtactatgacaaattgatgcccatggtcacagacaacaaaatggaaaagcaaggtgatctcatccggtatatagttcttcattttggcagatctctacaatatggaaatcagttcatatatcagtcaatgccacgaatgttaactctatggcttgattatggtacaaaggcatatgaatgggaaaaagctggccgctccgatcgtgtacaaatgaggaatgatttgggtaaaataaacaaggttatcacagagcatacaaactatttagctccatatcaatttttgactgctttttcacaattgatctctcgaatttgtcattctcacgatgaagtttttgttgtcttgatggaaataatagccaaagtatttctagcctatcctcaacaagcaatgtggatgatgacagctgtgtcaaagtcatcttatcccatgcgtgtgaacagatgcaaggaaatcctcaataaagctattcatatgaaaaaatccttagagaagtttgttggagatgcaactcgcctaacagataagcttctagaattgtgcaataaaccggttgatggaagtagttccacattaagcatgagcactcattttaaaatgcttaaaaagctggtagaagaagcaacatttagtgaaatcctcattcctctacaatcagtcatgatacctacacttccatcaattctgggtacccatgctaaccatgctagccatgaaccatttcctggacattgggcctatattgcagggtttgatgatatggtggaaattcttgcttctcttcagaaaccaaagaagatttctttaaaaggctcagatggaaagttctacatcatgatgtgtaagccaaaagatgacctgagaaaggattgtagactaatggaattcaattccttgattaataagtgcttaagaaaagatgcagagtctcgtagaagagaacttcatattcgaacatatgcagttattccactaaatgatgaatgtgggattattgaatgggtgaacaacactgctggtttgagacctattctgaccaaactatataaagaaaagggagtgtatatgacaggaaaagaacttcgccagtgtatgctaccaaagtcagcagctttatctgaaaaactcaaagtattccgagaatttctcctgcccaggcatcctcctatttttcatgagtggtttctgagaacattccctgatcctacatcatggtacagtagtagatcagcttactgccgttccactgcagtaatgtcaatggttggttatattctggggcttggagaccgtcatggtgaaaatattctctttgattctttgactggtgaatgcgtacatgtagatttcaattgtcttttcaataagggagaaacctttgaagttccagaaattgtgccatttcgcctgactcataatatggttaatggaatgggtcctatgggaacagagggtctttttcgaagagcatgtgaagttacaatgaggctgatgcgtgatcagcgagagcctttaatgagtgtcttaaagacttttctacatgatcctcttgtggaatggagtaaaccagtgaaagggcattccaaagcgccactgaatgaaactggagaagttgtcaatgaaaaggccaagacccatgttcttgacattgagcagcgactacaaggtgtaatcaagactcgaaatagagtgacaggactgccgttatctattgaaggacatgtgcattaccttatacaagaagctactgatgaaaacttactatgccagatgtatcttggttggactccatatatgtgaaatgaaattatgtaaaagaatatgttaataatctaaaagtaatgcatttggtatgaatctgtggttgtatctgttcaattctaaagtacaacataaatttacgttctcagc

SEQ ID NO: 509892 - DNA, 461 bp, Homo sapiens
  misc_feature (48)..(48): n is a, c, g, or t
  misc_feature (83)..(83): n is a, c, g, or t
  misc_feature (86)..(86): n is a, c, g, or t
  misc_feature (93)..(94): n is a, c, g, or t
  misc_feature (194)..(194): n is a, c, g, or t
  misc_feature (205)..(205): n is a, c, g, or t
ggtagaattgaaggcctccccccgggagatgtttggggatcttctccnatgctaagattggagatatttatctgcttatcccngcnacccccnnacccctctgctttctacacaaggcccctcagatgcctgctttttacgagttcaggaaggacctgaggcttctttcctcttggtaaagaagacacagtgcntttgagtgaancggaggcctgcatgcagttcaccaggtagcgagccacgcctgacttggatattttatagggagaagatctgaaacaactgggtgattctgcagctctggagatattcattaagccatacttcttttaatatttttgtcaatcacgctcattcctttaggtgtgaggtgggcacagatagctggtcgcagtgcaatgacacacctgtgaagtttgctcgttttcctgtcactggattgatcgaaggtcgttcctata

SEQ ID NO: 509893 - DNA, 8290 bp, Homo sapiens
gcctccacacggctccgtcgggcgccgcgctcttccggcagcggtacgtttggagacgccgggaacccgcgttggcgtggttgactagtgcctcgcagcctcagcatgggggaacatggcctggagctggcttccatgatccccgccctgcgggagctgggcagtgccacaccagaggaatataatacagttgtacagaagccaagacaaattctgtgtcaattcattgaccggatacttacagatgtaaatgttgttgctgtagaacttgtaaagaaaactgactctcagccaacctccgtgatgttgcttgatttcatccagcatatcatgaaatcctccccacttatgtttgtaaatgtgagtggaagccatgagcgcaaaggcagttgtattgaattcagtaattggatcataacgagacttctgcggattgcagcaactccctcctgtcatttgttacacaagaaaatctgtgaagtcatctgttcattattatttctttttaaaagcaagagtcctgctatttttggggtactcacaaaagaattattacaactttttgaagacttggtttacctccatagaagaaatgtgatgggtcatgctgtggaatggccagtggtcatgagccgatttttaagtcaattagatgaacacatgggatatttacaatcagctcctttgcagttgatgagtatgcaaaatttagaatttattgaagtcactttattaatggttcttactcgtattattgcaattgtgttttttagaaggcaagaactcttactttggcagataggttgtgttctgctagagtatggtagtccaaaaattaaatccctagcaattagctttttaacagaactttttcagcttggaggactaccagcacaaccagctagcacttttttcagctcatttttggaattattaaaacaccttgtagaaatggatactgaccaattgaaactctatgaagagccattatcaaagctgataaagacactatttccctttgaagcagaagcttatagaaatattgaacctgtctatttaaatatgctgctggaaaaactctgtgtcatgtttgaagacggtgtgctcatgcggcttaagtctgatttgctaaaagcagctttgtgccatttactgcagtatttccttaaatttgtgccagctgggtatgaatctgctttacaagtcaggaaggtctatgtgagaaatatttgtaaagctcttttggatgtgcttggaattgaggtagatgcagagtacttgttgggcccactttatgcagctttgaaaatggaaagtatggaaatcattgaggagattcaatgccaaactcaacaggaaaacctcagcagtaatagtgatggaatatcacccaaaaggcgtcgtctcagctcgtctctaaacccttctaaaagagcaccaaaacagactgaggaaattaaacatgtggacatgaaccaaaagagcatattatggagtgcactgaaacagaaagctgaatcccttcagatttcccttgaatacagtggcctaaagaatcctgttattgagatgttagaaggaattgctgttgtcttacaactgactgctctgtgtactgttcattgttctcatcaaaacatgaactgccgtactttcaaggactgtcaacataaatccaagaagaaaccttctgtagtgataacttggatgtcattggatttttacacaaaagtgcttaagagctgtagaagtttgttagaatctgttcagaaactggacctggaggcaaccattgataaggtggtgaaaatttatgatgctttgatttatatgcaagtaaacagttcatttgaagatcatatcctggaagatttatgtggtatgctctcacttccatggatttattcccattctgatgatggctgtttaaagttgaccacatttgccgctaatcttctaacattaagctgtaggatttcagatagctattcaccacaggcacaatcacgatgtgtgtttcttctgactctgtttccaagaagaatattccttgagtggagaacagcagtttacaactgggccctgcagagctcccatgaagtaatccgggctagttgtgttagtggattttttatcttattgcagcagcagaattcttgtaacagagttcccaagattcttatagataaagtcaaagatgattctgacattgtcaagaaagaatttgcttctatacttggtcaacttgtctgtactcttcacggcatgttttatctgacaagttctttaacagaacctttctctgaacacggacatgtggacctcttctgtaggaacttgaaagccacttctcaacatgaatgttcatcttctcaactaaaagcttctgtctgcaagccattccttttcctactgaaaaaaaaaatacctagtccagtaaaacttgctttcatagataatctacatcatctttgtaagcatcttgattttagagaagatgaaacagatgtaaaagcagttcttggaactttattaaatttaatggaagatccagacaaagatgttagagtggcttttagtggaaatatcaagcacatattggaatccttggactctgaagatggatttataaaggagctttttgtcttaagaatgaaggaagcatatacacatgcccaaatatcaagaaataatgagctgaaggataccttgattcttacaacaggggatattggaagggccgcaaaaggagatttggtaccatttgcactcttacacttattgcattgtttgttatccaagtcagcatctgtctctggagcagcatacacagaaattagagctctggttgcagctaaaagtgttaaactgcaaagttttttcagccagtataagaaacccatctgtcagtttttggtagaatcccttcactctagtcagatgacagcacttccgaatactccatgccagaatgctgacgtgcgaaaacaagatgtggctcaccagagagaaatggctttaaatacgttgtctgaaattgccaacgttttcgactttcctgatcttaatcgttttcttactaggacattacaagttctactacctgatcttgctgccaaagcaagccctgcagcttctgctctcattcgaactttaggaaaacaattaaatgtcaatcgtagagagattttaataaacaacttcaaatatattttttctcatttggtctgttcttgttccaaagatgaattagaacgtgcccttcattatctgaagaatgaaacagaaattgaactggggagcctgttgagacaagatttccaaggattgcataatgaattattgctgcgtattggagaacactatcaacaggtttttaatggtttgtcaatacttgcctcatttgcatccagtgatgatccatatcagggcccgagagatatcatatcacctgaactgatggctgattatttacaacccaaattgttgggcattttggctttttttaacatgcagttactgagctctagtgttggcattgaagataagaaaatggccttgaacagtttgatgtctttgatgaagttaatgggacccaaacatgtcagttctgtgagggtgaagatgatgaccacactgagaactggccttcgattcaaggatgattttcctgaattgtgttgcagagcttgggactgctttgttcgctgcctggatcatgcttgtctgggctcccttctcagtcatgtaatagtagctttgttacctcttatacacatccagcctaaagaaactgcagctatcttccactacctcataattgaaaacagggatgctgtgcaagattttcttcatgaaatatattttttacctgatcatccagaattaaaaaagataaaagccgttctccaggaatacagaaaggagacctctgagagcactgatcttcagacaactcttcagctctctatgaaggccattcaacatgaaaatgtcgatgttcgtattcatgctcttacaagcttgaaggaaaccttgtataaaaatcaggaaaaactgataaagtatgcaacagacagtgaaacagtagaacctattatctcacagttggtgacagtgcttttgaaaggttgccaagatgcaaactctcaagctcggttgctctgtggggaatgtttaggggaattgggggcgatagatccaggtcgattagatttctcaacaactgaaactcaaggaaaagattttacatttgtgactggagtagaagattcaagctttgcctatggattattgatggagctaacaagagcttaccttgcgtatgctgataatagccgagctcaagattcagctgcctatgccattcaggagttgctttctatttatgactgtagagagatggagaccaacggcccaggtcaccaattgtggaggagatttcctgagcatgttcgggaaatactagaacctcatctaaataccagatacaagagttctcagaagtcaaccgattggtctggagtaaagaagccaatttacttaagtaaattgggtagtaactttgcagaatggtcagcatcttgggcaggttatcttattacaaaggttcgacatgatcttgccagtaaaattttcacctgctgtagcattatgatgaagcatgatttcaaagtgaccatctatcttcttccacatattctggtgtatgtcttactgggttgtaatcaagaagatcagcaggaggtttatgcagaaattatggcagttctaaagcatgacgatcagcataccataaatacccaagacattgcatctgatctgtgtcaactcagtacacagactgtgttctccatgcttgaccatctcacacagtgggcaaggcacaaatttcaggcactgaaagctgagaaatgtccacacagcaaatcaaacagaaataaggtagactcaatggtatctactgtggattatgaagactatcagagtgtaacccgttttctagacctcataccccaggatactctggcagtagcttcctttcgctccaaagcatacacacgagctgtaatgcactttgaatcatttattacagaaaagaagcaaaatattcaggaacatcttggatttttacagaaattgtatgctgctatgcatgaacctgatggagtggccggagtcagtgcaattagaaaggcagaaccatctctaaaagaacagatccttgaacatgaaagccttggcttgctgagggatgccactgcttgttatgacagggctattcagctagaaccagaccagatcattcattaccatggtgtagtaaagtccatgttaggtcttggtcagctgtctactgttatcactcaggtgaatggagtgcatgctaacaggtccgagtggacagatgaattaaacacgtacagagtggaagcagcttggaaattgtcacagtgggatttggtggaaaactatttggcagcagatggaaaatctacaacatggagtgtcagactgggacagctattattatcagccaaaaaaagagatatcacagctttttatgactcactgaaactagtgagagcagaacaaattgtacctctttcagctgcaagctttgaaagaggctcctaccaacgaggatatgaatatattgtgagattgcacatgttatgtgagttggagcatagcatcaaaccacttttccagcattctccaggtgacagttctcaagaagattctctaaactgggtagctcgactagaaatgacccagaattcctacagagccaaggagcctatcctggctctccggagggctttactaagcctcaacaaaagaccagattacaatgaaatggttggagaatgctggctgcagagtgccagggtagctagaaaggctggtcaccaccagacagcctacaatgctctccttaatgcaggggaatcacgactcgctgaactgtacgtggaaagggcaaagtggctctggtccaagggtgatgttcaccaggcactaattgttcttcaaaaaggtgttgaattatgttttcctgaaaatgaaaccccacctgagggtaagaacatgttaatccatggtcgagctatgctactagtgggccgatttatggaagaaacagctaactttgaaagcaatgcaattatgaaaaaatataaggatgtgaccgcgtgcctgccagaatgggaggatgggcatttttaccttgccaagtactatgacaaattgatgcccatggtcacagacaacaaaatggaaaagcaaggtgatctcatccggtatatagttcttcattttggcagatctctacaatatggaaatcagttcatatatcagtcaatgccacgaatgttaactctatggcttgattatggtacaaaggcatatgaatgggaaaaagctggccgctccgatcgtgtacaaatgaggaatgatttgggtaaaataaacaaggttatcacagagcatacaaactatttagctccatatcaatttttgactgctttttcacaattgatctctcgaatttgtcattctcacgatgaagtttttgttgtcttgatggaaataatagccaaagtatttctagcctatcctcaacaagcaatgtggatgatgacagctgtgtcaaagtcatcttatcccatgcgtgtgaacagatgcaaggaaatcctcaataaagctattcatatgaaaaaatccttagagaagtttgttggagatgcaactcgcctaacagataagcttctagaattgtgcaataaaccggttgatggaagtagttccacattaagcatgagcactcattttaaaatgcttaaaaagctggtagaagaagcaacatttagtgaaatcctcattcctctacaatcagtcatgatacctacacttccatcaattctgggtacccatgctaaccatgctagccatgaaccatttcctggacattgggcctatattgcagggtttgatgatatggtggaaattcttgcttctcttcagaaaccaaagaagatttctttaaaaggctcagatggaaagttctacatcatgatgtgtaagccaaaagatgacctgagaaaggattgtagactaatggaattcaattccttgattaataagtgcttaagaaaagatgcagagtctcgtagaagagaacttcatattcgaacatatgcagttattccactaaatgatgaatgtgggattattgaatgggtgaacaacactgctggtttgagacctattctgaccaaactatataaagaaaagggagtgtatatgacaggaaaagaacttcgccagtgtatgctaccaaagtcagcagctttatctgaaaaactcaaagtattccgagaatttctcctgcccaggcatcctcctatttttcatgagtggtttctgagaacattccctgatcctacatcatggtacagtagtagatcagcttactgccgttccactgcagtaatgtcaatggttggttatattctggggcttggagaccgtcatggtgaaaatattctctttgattctttgactggtgaatgcgtacatgtagatttcaattgtcttttcaataagggagaaacctttgaagttccagaaattgtgccatttcgcctgactcataatatggttaatggaatgggtcctatgggaacagagggtctttttcgaagagcatgtgaagttacaatgaggctgatgcgtgatcagcgagagcctttaatgagtgtcttaaagacttttctacatgatcctcttgtggaatggagtaaaccagtgaaagggcattccaaagcgccactgaatgaaactggagaagttgtcaatgaaaagatggcaagttcttcaaattcatttaagtaacgtgaagtttgtgcttcaaagggtacttcccttgatctgattttctggatatgagaaatagcctcacaaggatcctgatgaactctctctttagtggacctcattaaaggccaagacccatgttcttgacattgagcagcgactacaaggtgtaatcaagactcgaaatagagtgacaggactgccgttatctattgaaggacatgtgcattaccttatacaagaagctactgatgaaaacttactatgccagatgtatcttggttggactccatatatgtgaaatgaaattatgtaaaagaatatgttaataatctaaaagtaatgcatttggtatgaatctgtggttgtatctgttcaattctaaagtacaacataaatttacgttctcagc

SEQ ID NO: 509894 - DNA, 1484 bp, Homo sapiens
gcatttgcccacagactgcggaggacgaatcagtggcccagccagacgttaaagggctgcagcggttgaggtgagaggcacctctgctacttgttagggaggggtggctgcttggaaataggcccaggggctctagacagccatcggacctctccctcctgagcttgccttactagttaggtaggcttatctatacttagaacccacctgctgtaacagaggttcttcagattaccgtagggtattcccactcttgcacttcctgtacaactacgctccccagcagcacgaacttcgctgcggccctgcagcgtgcaacttcctgctcatatggcaggacagcacaccctcggcacacttacagctcatgcctggcacgctcctctgcacgctctccctagcacacggcatcagtccagcgcgccacgcccatctaaagctttagcgcgtacctccagaacccaaattcacacgcttgttagctcacctacacacaccacagcacaagccctaggtacgtcacttcaccttaaacctactccatcgtcgctccgttagacactagtcatccgcgcacacaatagtacactaggcggtccacacaataggccgcgatgcagcatatcgccataacagcggcgcctgccctagacggccttagccctcactgcgcacgccccacacacgcgcgcttagccccacttaacccacgacgcgacttgctcgggcccacaaaaccaaaagtggctaggccttcgggtacgacaaggattactctccctcagataagaagccactacccaaattaggggccagccatacacttaggcgcagcacttagcagcatgccaccccacttagggcactaccagcacgagtcgtggccccaccaccaacaagcaccttacgagcagcaatcatacatgtatacccacccacagcatctaccactctagaccattgagggcacacgagacgggcacgtctcgcgccaacaccgagcgcttccggcgtcgcacccgcccagtatccctcagtgtgcaatccataacgcccacccacaatcaacccccccccgaatttattattatcctctttctctgccatcagaccacccactcctacacaacgacgtttactacaccctagcccgcccgggacaactgactttccctatcacaccttatcatagcaggatcactccccttttagccaaaaaacgcaataccaacaaaaactgacttcctcgcaagaactagaagtagtcataccgacactattactaacatcccacattaatacactttacagctgcaaaacctttcaactcacccgccaccacacatccatataacttttccccatatcaggactctcatcgccacaagatatcccccatctacacgcaacacaaacgtgctcttctcatccccgctatcctccaacgcctatacacccccaacagataaacatcacaccacgtg

SEQ ID NO: 509895 - DNA, 428 bp, Homo sapiens
tggtctgttgttgcgatagagaagagacacgacacttaaacagtattttttacaaaatttttgctcagctgtatgtgggacccgcttaatcttcccaagtctgcttcaaatgccaaatgatcatagaatggtccacattgagtttttcagcaacttcttttatggttgtaagaggatcagcttctgtgattgatctcccaactggtcgttgtcaacttctgatggccggtcattgcactcctcatcttcaaggctctcgtctcctttgtaaaacttcttgaaccaacattgcactgtacgtttcattagcagctccttggccaaatgcgttgttgatgttgcgagttgtctccagtgctttacaatccattttgaccttgaataagaaaattgctcgaatttgctttttgtctaacatcattttcact

SEQ ID NO: 509896 - DNA, 2246 bp, Homo sapiens
ggtgacctcaggacttccggagacgactttacaagaagttagctattccttttccacatcaaagatgagtctgctttgactttgctctgcctagataaaggtcacatacttttgattccctaatcatctattcatattttacttcccagcatagcgtgggatttccttaggtaggtatcctatgttcttttttataggatgtgaccgcgtgcctgccagaatgggaggatgggcatttttaccttgccaagtactatgacaaattgatgcccatggtcacagacaacaaaatggaaaagcaaggtgatctcatccggtatatagttcttcattttggcagatctctacaatatggaaatcagttcatatatcagtcaatgccacgaatgttaactctatggcttgattatggtacaaaggcatatgaatgggaaaaagctggccgctccgatcgtgtacaaatgaggaatgatttgggtaaaataaacaaggttatcacagagcatacaaactatttagctccatatcaatttttgactgctttttcacaattgatctctcgaatttgtcattctcacgatgaagtttttgttgtcttgatggaaataatagccaaagtatttctagcctatcctcaacaagcaatgtggatgatgacagctgtgtcaaagtcatcttatcccatgcgtgtgaacagatgcaaggaaatcctcaataaagctattcatatgaaaaaatccttagagaagtttgttggagatgcaactcgcctaacagataagcttctagaattgtgcaataaaccggttgatggaagtagttccacattaagcatgagcactcattttaaaatgcttaaaaagctggtagaagaagcaacatttagtgaaatcctcattcctctacaatcagtcatgatacctacacttccatcaattctgggtacccatgctaaccatgctagccatgaaccatttcctggacattgggcctatattgcagggtttgatgatatggtggaaattcttgcttctcttcagaaaccaaagaagatttctttaaaaggctcagatggaaagttctacatcatgatgtgtaagccaaaagatgacctgagaaaggattgtagactaatggaattcaattccttgattaataagtgcttaagaaaagatgcagagtctcgtagaagagaacttcatattcgaacatatgcagttattccactaaatgatgaatgtgggattattgaatgggtgaacaacactgctggtttgagacctattctgaccaaactatataaagaaaagggagtgtatatgacaggaaaagaacttcgccagtgtatgctaccaaagtcagcagctttatctgaaaaactcaaagtattccgagaatttctcctgcccaggcatcctcctatttttcatgagtggtttctgagaacattccctgatcctacatcatggtacagtagtagatcagcttactgccgttccactgcagtaatgtcaatggttggttatattctggggcttggagaccgtcatggtgaaaatattctctttgattctttgactggtgaatgcgtacatgtagatttcaattgtcttttcaataagggagaaacctttgaagttccagaaattgtgccatttcgcctgactcataatatggttaatggaatgggtcctatgggaacagagggtctttttcgaagagcatgtgaagttacaatgaggctgatgcgtgatcagcgagagcctttaatgagtgtcttaaagacttttctacatgatcctcttgtggaatggagtaaaccagtgaaagggcattccaaagcgccactgaatgaaactggagaagttgtcaatgaaaaggccaagacccatgttcttgacattgagcagcgactacaaggtgtaatcaagactcgaaatagagtgacaggactgccgttatctattgaaggacatgtgcattaccttatacaagaagctactgatgaaaacttactatgccagatgtatcttggttggactccatatatgtgaaatgaaattatgtaaaagaatatgttaataatctaaaagtaatgcatttggtatgaatctgtggttgtatctgttcaattctaaagtacaacataaatttacgttctcagcaactgttatttctctctgatcattaattatatgtaaaataatatacattcagttattaagaaataaactgctttcttaata

SEQ ID NO: 509897 - DNA, 8581 bp, Homo sapiens
gcctccacacggctccgtcgggcgccgcgctcttccggcagcggtacgtttggagacgccgggaacccgcgttggcgtggttgactagtgcctcgcagcctcagcatgggggaacatggcctggagctggcttccatgatccccgccctgcgggagctgggcagtgccacaccagaggaatataatacagttgtacagaagccaagacaaattctgtgtcaattcattgaccggatacttacagatgtaaatgttgttgctgtagaacttgtaaagaaaactgactctcagccaacctccgtgatgttgcttgatttcatccagcatatcatgaaatcctccccacttatgtttgtaaatgtgagtggaagccatgagcgcaaaggcagttgtattgaattcagtaattggatcataacgagacttctgcggattgcagcaactccctcctgtcatttgttacacaagaaaatctgtgaagtcatctgttcattattatttctttttaaaagcaagagtcctgctatttttggggtactcacaaaagaattattacaactttttgaagacttggtttacctccatagaagaaatgtgatgggtcatgctgtggaatggccagtggtcatgagccgatttttaagtcaattagatgaacacatgggatatttacaatcagctcctttgcagttgatgagtatgcaaaatttagaatttattgaagtcactttattaatggttcttactcgtattattgcaattgtgttttttagaaggcaagaactcttactttggcagataggttgtgttctgctagagtatggtagtccaaaaattaaatccctagcaattagctttttaacagaactttttcagcttggaggactaccagcacaaccagctagcacttttttcagctcatttttggaattattaaaacaccttgtagaaatggatactgaccaattgaaactctatgaagagccattatcaaagctgataaagacactatttccctttgaagcagaagcttatagaaatattgaacctgtctatttaaatatgctgctggaaaaactctgtgtcatgtttgaagacggtgtgctcatgcggcttaagtctgatttgctaaaagcagctttgtgccatttactgcagtatttccttaaatttgtgccagctgggtatgaatctgctttacaagtcaggaaggtctatgtgagaaatatttgtaaagctcttttggatgtgcttggaattgaggtagatgcagagtacttgttgggcccactttatgcagctttgaaaatggaaagtatggaaatcattgaggagattcaatgccaaactcaacaggaaaacctcagcagtaatagtgatggaatatcacccaaaaggcgtcgtctcagctcgtctctaaacccttctaaaagagcaccaaaacagactgaggaaattaaacatgtggacatgaaccaaaagagcatattatggagtgcactgaaacagaaagctgaatcccttcagatttcccttgaatacagtggcctaaagaatcctgttattgagatgttagaaggaattgctgttgtcttacaactgactgctctgtgtactgttcattgttctcatcaaaacatgaactgccgtactttcaaggactgtcaacataaatccaagaagaaaccttctgtagtgataacttggatgtcattggatttttacacaaaagtgcttaagagctgtagaagtttgttagaatctgttcagaaactggacctggaggcaaccattgataaggtggtgaaaatttatgatgctttgatttatatgcaagtaaacagttcatttgaagatcatatcctggaagatttatgtggtatgctctcacttccatggatttattcccattctgatgatggctgtttaaagttgaccacatttgccgctaatcttctaacattaagctgtaggatttcagatagctattcaccacaggcacaatcacgatgtgtgtttcttctgactctgtttccaagaagaatattccttgagtggagaacagcagtttacaactgggccctgcagagctcccatgaagtaatccgggctagttgtgttagtggattttttatcttattgcagcagcagaattcttgtaacagagttcccaagattcttatagataaagtcaaagatgattctgacattgtcaagaaagaatttgcttctatacttggtcaacttgtctgtactcttcacggcatgttttatctgacaagttctttaacagaacctttctctgaacacggacatgtggacctcttctgtaggaacttgaaagccacttctcaacatgaatgttcatcttctcaactaaaagcttctgtctgcaagccattccttttcctactgaaaaaaaaaatacctagtccagtaaaacttgctttcatagataatctacatcatctttgtaagcatcttgattttagagaagatgaaacagatgtaaaagcagttcttggaactttattaaatttaatggaagatccagacaaagatgttagagtggcttttagtggaaatatcaagcacatattggaatccttggactctgaagatggatttataaaggagctttttgtcttaagaatgaaggaagcatatacacatgcccaaatatcaagaaataatgagctgaaggataccttgattcttacaacaggggatattggaagggccgcaaaaggagatttggtaccatttgcactcttacacttattgcattgtttgttatccaagtcagcatctgtctctggagcagcatacacagaaattagagctctggttgcagctaaaagtgttaaactgcaaagttttttcagccagtataagaaacccatctgtcagtttttggtagaatcccttcactctagtcagatgacagcacttccgaatactccatgccagaatgctgacgtgcgaaaacaagatgtggctcaccagagagaaatggctttaaatacgttgtctgaaattgccaacgttttcgactttcctgatcttaatcgttttcttactaggacattacaagttctactacctgatcttgctgccaaagcaagccctgcagcttctgctctcattcgaactttaggaaaacaattaaatgtcaatcgtagagagattttaataaacaacttcaaatatattttttctcatttggtctgttcttgttccaaagatgaattagaacgtgcccttcattatctgaagaatgaaacagaaattgaactggggagcctgttgagacaagatttccaaggattgcataatgaattattgctgcgtattggagaacactatcaacaggtttttaatggtttgtcaatacttgcctcatttgcatccagtgatgatccatatcagggcccgagagatatcatatcacctgaactgatggctgattatttacaacccaaattgttgggcattttggctttttttaacatgcagttactgagctctagtgttggcattgaagataagaaaatggccttgaacagtttgatgtctttgatgaagttaatgggacccaaacatgtcagttctgtgagggtgaagatgatgaccacactgagaactggccttcgattcaaggatgattttcctgaattgtgttgcagagcttgggactgctttgttcgctgcctggatcatgcttgtctgggctcccttctcagtcatgtaatagtagctttgttacctcttatacacatccagcctaaagaaactgcagctatcttccactacctcataattgaaaacagggatgctgtgcaagattttcttcatgaaatatattttttacctgatcatccagaattaaaaaagataaaagccgttctccaggaatacagaaaggagacctctgagagcactgatcttcagacaactcttcagctctctatgaaggccattcaacatgaaaatgtcgatgttcgtattcatgctcttacaagcttgaaggaaaccttgtataaaaatcaggaaaaactgataaagtatgcaacagacagtgaaacagtagaacctattatctcacagttggtgacagtgcttttgaaaggttgccaagatgcaaactctcaagctcggttgctctgtggggaatgtttaggggaattgggggcgatagatccaggtcgattagatttctcaacaactgaaactcaaggaaaagattttacatttgtgactggagtagaagattcaagctttgcctatggattattgatggagctaacaagagcttaccttgcgtatgctgataatagccgagctcaagattcagctgcctatgccattcaggagttgctttctatttatgactgtagagagatggagaccaacggcccaggtcaccaattgtggaggagatttcctgagcatgttcgggaaatactagaacctcatctaaataccagatacaagagttctcagaagtcaaccgattggtctggagtaaagaagccaatttacttaagtaaattgggtagtaactttgcagaatggtcagcatcttgggcaggttatcttattacaaaggttcgacatgatcttgccagtaaaattttcacctgctgtagcattatgatgaagcatgatttcaaagtgaccatctatcttcttccacatattctggtgtatgtcttactgggttgtaatcaagaagatcagcaggaggtttatgcagaaattatggcagttctaaagcatgacgatcagcataccataaatacccaagacattgcatctgatctgtgtcaactcagtacacagactgtgttctccatgcttgaccatctcacacagtgggcaaggcacaaatttcaggcactgaaagctgagaaatgtccacacagcaaatcaaacagaaataaggtagactcaatggtatctactgtggattatgaagactatcagagtgtaacccgttttctagacctcataccccaggatactctggcagtagcttcctttcgctccaaagcatacacacgagctgtaatgcactttgaatcatttattacagaaaagaagcaaaatattcaggaacatcttggatttttacagaaattgtatgctgctatgcatgaacctgatggagtggccggagtcagtgcaattagaaaggcagaaccatctctaaaagaacagatccttgaacatgaaagccttggcttgctgagggatgccactgcttgttatgacagggctattcagctagaaccagaccagatcattcattaccatggtgtagtaaagtccatgttaggtcttggtcagctgtctactgttatcactcaggtgaatggagtgcatgctaacaggtccgagtggacagatgaattaaacacgtacagagtggaagcagcttggaaattgtcacagtgggatttggtggaaaactatttggcagcagatggaaaatctacaacatggagtgtcagactgggacagctattattatcagccaaaaaaagagatatcacagctttttatgactcactgaaactagtgagagcagaacaaattgtacctctttcagctgcaagctttgaaagaggctcctaccaacgaggatatgaatatattgtgagattgcacatgttatgtgagttggagcatagcatcaaaccacttttccagcattctccaggtgacagttctcaagaagattctctaaactgggtagctcgactagaaatgacccagaattcctacagagccaaggagcctatcctggctctccggagggctttactaagcctcaacaaaagaccagattacaatgaaatggttggagaatgctggctgcagagtgccagggtagctagaaaggctggtcaccaccagacagcctacaatgctctccttaatgcaggggaatcacgactcgctgaactgtacgtggaaagggcaaagtggctctggtccaagggtgatgttcaccaggcactaattgttcttcaaaaaggtgttgaattatgttttcctgaaaatgaaaccccacctgagggtaagaacatgttaatccatggtcgagctatgctactagtgggccgatttatggaagaaacagctaactttgaaagcaatgcaattatgaaaaaatataaggatgtgaccgcgtgcctgccagaatgggaggatgggcatttttaccttgccaagtactatgacaaattgatgcccatggtcacagacaacaaaatggaaaagcaaggtgatctcatccggtatatagttcttcattttggcagatctctacaatatggaaatcagttcatatatcagtcaatgccacgaatgttaactctatggcttgattatggtacaaaggcatatgaatgggaaaaagctggccgctccgatcgtgtacaaatgaggaatgatttgggtaaaataaacaaggttatcacagagcatacaaactatttagctccatatcaatttttgactgctttttcacaattgatctctcgaatttgtcattctcacgatgaagtttttgttgtcttgatggaaataatagccaaagtatttctagcctatcctcaacaagcaatgtggatgatgacagctgtgtcaaagtcatcttatcccatgcgtgtgaacagatgcaaggaaatcctcaataaagctattcatatgaaaaaatccttagagaagtttgttggagatgcaactcgcctaacagataagcttctagaattgtgcaataaaccggttgatggaagtagttccacattaagcatgagcactcattttaaaatgcttaaaaagctggtagaagaagcaacatttagtgaaatcctcattcctctacaatcagtcatgatacctacacttccatcaattctgggtacccatgctaaccatgctagccatgaaccatttcctggacattgggcctatattgcagggtttgatgatatggtggaaattcttgcttctcttcagaaaccaaagaagatttctttaaaaggctcagatggaaagttctacatcatgatgtgtaagccaaaagatgacctgagaaaggattgtagactaatggaattcaattccttgattaataagtgcttaagaaaagatgcagagtctcgtagaagagaacttcatattcgaacatatgcagttattccactaaatgatgaatgtgggattattgaatgggtgaacaacactgctggtttgagacctattctgaccaaactatataaagaaaagggagtgtatatgacaggaaaagaacttcgccagtgtatgctaccaaagtcagcagctttatctgaaaaactcaaagtattccgagaatttctcctgcccaggcatcctcctatttttcatgagtggtttctgagaacattccctgatcctacatcatggtacagtagtagatcagcttactgccgttccactgcagtaatgtcaatggttggttatattctggggcttggagaccgtcatggtgaaaatattctctttgattctttgactggtgaatgcgtacatgtagatttcaattgtcttttcaataagggagaaacctttgaagttccagaaattgtgccatttcgcctgactcataatatggttaatggaatgggtcctatgggaacagagggtctttttcgaagagcatgtgaagttacaatgaggctgatgcgtgatcagcgagagcctttaatgagtgtcttaaagacttttctacatgatcctcttgtggaatggagtaaaccagtgaaagggcattccaaagcgccactgaatgaaactggagaagttgtcaatgaaaagatggcaagttcttcaaattcatttaagtaacgtgaagtttgtgcttcaaagggtacttcccttgatctgattttctggatatgagaaatagcctcacaaggatcctgatgaactctctctttagtggacctcattaagtgagtaatagctctgtggtgatgtagtctcaatgagctaaacttgtcacaagtgaaagaagacagcagccccattttgataaaggtctggcaaagtaacttaaacacctgtcttgaatgaactgggtttggttcacgcacatggctcaagtgcttcaccaaagaaataagcggcagctggtttgcaactgcaaaagggaaagttggctgttgtaggggttattttaatacctggagttctgctggaacataagtcatatttggagtccaggctcttggcggaaaagtcgatggcagatggcacagcaacagtctccaccccgtggccctcctctttgtgctcgtgggctgcagcgcagcccaccagcccacccagcaccacctctgagaattattcttctaataacgttattcttccttttgcattcagatatgcttaagaaattgtacagttccaagtagctcacttagaacacccatttgcatgtactaacataatgtaaatattaggcagtacagcattgttatttgaatattcattgaaatgtttaagtcctaaacacttccaaagcagattt

SEQ ID NO: 509898 - DNA, 239 bp, Homo sapiens
gtgcagtcaaggtatacatcagaggcagccgtaagatccatctggctattatcctctgttgtgtccagtcagtcgtctcccagcaatgtgctactttccagcccaaagtggctctccttagctccactgtcataatctctttcgatcttacttgcccttccatactttctcacatgtggctccccctgaatttggcttcctttgtgagctcattcttttcgccaaggatcagatgctcc

SEQ ID NO: 509899 - DNA, 422 bp, Homo sapiens
cggccacacgagcgcccaccccccgcaccccaacccccaaaaaaaaaaaaacctaggccaagacccatgttcttgacattgagcagcgactacaaggtgtaatcaagactcgaaatagagtgacaggactgccgttatctattgaaggacatgtgcattaccttatacaagaagctactgatgaaaacttactatgccagatgtatcttggttggactccatatatgtgaaatgaaattatgtaaaagaatatgttaataatctaaaagtaatgcatttggtatgaatctgtggttgtatctgttcaattctaaagtacaacataaatttacgttctcagcaactgttatttctctctgatcattaattatatgtaaaataatatacattcagttattaagaaataaactgctttcttaata

SEQ ID NO: 509900 - DNA, 449 bp, Homo sapiens
gcagtatgaccgtcctctcagaactcactagtggtatcttctctgacgagatagatacctggaattgggacactcacccaggacacactatggtgcttcagccacagtgaaaggcactatctgagattggaaccacagtaagatgtgccttgcttcccacttcgccttctgccatgattgtaagtttcctagagacctaccccagacatgcagaactagctcggaccatggtgcagtcccactttttcccctgcccccctactcctgtgagactggctgcggggagggatcataggatacttgtctgccggctatctggaacccacgcaagtaagcctgctgtcaatggaggaggacatagatacccgcaaaatcaacaacagtatcctgcgcgaccacagctaatgcgaccgaagctgacattatctctacggtagaattcaaccacc

SEQ ID NO: 509901 - DNA, 5406 bp, Homo sapiens
  misc_feature (5312)..(5312): n is a, c, g, or t
  misc_feature (5317)..(5317): n is a, c, g, or t
  misc_feature (5319)..(5319): n is a, c, g, or t
  misc_feature (5323)..(5324): n is a, c, g, or t
  misc_feature (5329)..(5329): n is a, c, g, or t
  misc_feature (5375)..(5375): n is a, c, g, or t
  misc_feature (5380)..(5380): n is a, c, g, or t
gcctccacacggctccgtcgggcgccgcgctcttccggcagcggtacgtttggagacgccgggaacccgcgttggcgtggttgactagtgcctcgcagcctcagcatgggggaacatggcctggagctggcttccatgatccccgccctgcgggagctgggcagtgccacaccagaggaatataatacagttgtacagaagccaagacaaattctgtgtcaattcattgaccggatacttacagatgtaaatgttgttgctgtagaacttgtaaagaaaactgactctcagccaacctccgtgatgttgcttgatttcatccagcatatcatgaaatcctccccacttatgtttgtaaatgtgagtggaagccatgagcgcaaaggcagttgtattgaattcagtaattggatcataacgagacttctgcggattgcagcaactccctcctgtcatttgttacacaagaaaatctgtgaagtcatctgttcattattatttctttttaaaagcaagagtcctgctatttttggggtactcacaaaagaattattacaactttttgaagacttggtttacctccatagaagaaatgtgatgggtcatgctgtggaatggccagtggtcatgagccgatttttaagtcaattagatgaacacatgggatatttacaatcagctcctttgcagttgatgagtatgcaaaatttagaatttattgaagtcactttattaatggttcttactcgtattattgcaattgtgttttttagaaggcaagaactcttactttggcagataggttgtgttctgctagagtatggtagtccaaaaattaaatccctagcaattagctttttaacagaactttttcagcttggaggactaccagcacaaccagctagcacttttttcagctcatttttggaattattaaaacaccttgtagaaatggatactgaccaattgaaactctatgaagagccattatcaaagctgataaagacactatttccctttgaagcagaagcttatagaaatattgaacctgtctatttaaatatgctgctggaaaaactctgtgtcatgtttgaagacggtgtgctcatgcggcttaagtctgatttgctaaaagcagctttgtgccatttactgcagtatttccttaaatttgtgccagctgggtatgaatctgctttacaagtcaggaaggtctatgtgagaaatatttgtaaagctcttttggatgtgcttggaattgaggtagatgcagagtacttgttgggcccactttatgcagctttgaaaatggaaagtatggaaatcattgaggagattcaatgccaaactcaacaggaaaacctcagcagtaatagtgatggaatatcacccaaaaggcgtcgtctcagctcgtctctaaacccttctaaaagagcaccaaaacagactgaggaaattaaacatgtggacatgaaccaaaagagcatattatggagtgcactgaaacagaaagctgaatcccttcagatttcccttgaatacagtggcctaaagaatcctgttattgagatgttagaaggaattgctgttgtcttacaactgactgctctgtgtactgttcattgttctcatcaaaacatgaactgccgtactttcaaggactgtcaacataaatccaagaagaaaccttctgtagtgataacttggatgtcattggatttttacacaaaagtgcttaagagctgtagaagtttgttagaatctgttcagaaactggacctggaggcaaccattgataaggtggtgaaaatttatgatgctttgatttatatgcaagtaaacagttcatttgaagatcatatcctggaagatttatgtggtatgctctcacttccatggatttattcccattctgatgatggctgtttaaagttgaccacatttgccgctaatcttctaacattaagctgtaggatttcagatagctattcaccacaggcacaatcacgatgtgtgtttcttctgactctgtttccaagaagaatattccttgagtggagaacagcagtttacaactgggccctgcagagctcccatgaagtaatccgggctagttgtgttagtggattttttatcttattgcagcagcagaattcttgtaacagagttcccaagattcttatagataaagtcaaagatgattctgacattgtcaagaaagaatttgcttctatacttggtcaacttgtctgtactcttcacggcatgttttatctgacaagttctttaacagaacctttctctgaacacggacatgtggacctcttctgtaggaacttgaaagccacttctcaacatgaatgttcatcttctcaactaaaagcttctgtctgcaagccattccttttcctactgaaaaaaaaaatacctagtccagtaaaacttgctttcatagataatctacatcatctttgtaagcatcttgattttagagaagatgaaacagatgtaaaagcagttcttggaactttattaaatttaatggaagatccagacaaagatgttagagtggcttttagtggaaatatcaagcacatattggaatccttggactctgaagatggatttataaaggagctttttgtcttaagaatgaaggaagcatatacacatgcccaaatatcaagaaataatgagctgaaggataccttgattcttacaacaggggatattggaagggccgcaaaaggagatttggtaccatttgcactcttacacttattgcattgtttgttatccaagtcagcatctgtctctggagcagcatacacagaaattagagctctggttgcagctaaaagtgttaaactgcaaagttttttcagccagtataagaaacccatctgtcagtttttggtagaatcccttcactctagtcagatgacagcacttccgaatactccatgccagaatgctgacgtgcgaaaacaagatgtggctcaccagagagaaatggctttaaatacgttgtctgaaattgccaacgttttcgactttcctgatcttaatcgttttcttactaggacattacaagttctactacctgatcttgctgccaaagcaagccctgcagcttctgctctcattcgaactttaggaaaacaattaaatgtcaatcgtagagagattttaataaacaacttcaaatatattttttctcatttggtctgttcttgttccaaagatgaattagaacgtgcccttcattatctgaagaatgaaacagaaattgaactggggagcctgttgagacaagatttccaaggattgcataatgaattattgctgcgtattggagaacactatcaacaggtttttaatggtttgtcaatacttgcctcatttgcatccagtgatgatccatatcagggcccgagagatatcatatcacctgaactgatggctgattatttacaacccaaattgttgggcattttggctttttttaacatgcagttactgagctctagtgttggcattgaagataagaaaatggccttgaacagtttgatgtctttgatgaagttaatgggacccaaacatgtcagttctgtgagggtgaagatgatgaccacactgagaactggccttcgattcaaggatgattttcctgaattgtgttgcagagcttgggactgctttgttcgctgcctggatcatgcttgtctgggctcccttctcagtcatgtaatagtagctttgttacctcttatacacatccagcctaaagaaactgcagctatcttccactacctcataattgaaaacagggatgctgtgcaagattttcttcatgaaatatattttttacctgatcatccagaattaaaaaagataaaagccgttctccaggaatacagaaaggagacctctgagagcactgatcttcagacaactcttcagctctctatgaaggccattcaacatgaaaatgtcgatgttcgtattcatgctcttacaagcttgaaggaaaccttgtataaaaatcaggaaaaactgataaagtatgcaacagacagtgaaacagtagaacctattatctcacagttggtgacagtgcttttgaaaggttgccaagatgcaaactctcaagctcggttgctctgtggggaatgtttaggggaattgggggcgatagatccaggtcgattagatttctcaacaactgaaactcaaggaaaagattttacatttgtgactggagtagaagattcaagctttgcctatggattattgatggagctaacaagagcttaccttgcgtatgctgataatagccgagctcaagattcagctgcctatgccattcaggagttgctttctatttatgactgtagagagatggagaccaacggcccaggtcaccaattgtggaggagatttcctgagcatgttcgggaaatactagaacctcatctaaataccagatacaagagttctcagaagtcaaccgattggtctggagtaaagaagccaatttacttaagtaaattgggtagtaactttgcagaatggtcagcatcttgggcaggttatcttattacaaaggttcgacatgatcttgccagtaaaattttcacctgctgtagcattatgatgaagcatgatttcaaagtgaccatctatcttcttccacatattctggtgtatgtcttactgggttgtaatcaagaagatcagcaggaggtttatgcagaaattatggcagttctaaagcatgacgatcagcataccataaatacccaagacattgcatctgatctgtgtcaactcagtacacagactgtgttctccatgcttgaccatctcacacagtgggcaaggcacaaatttcaggcactgaaagctgagaaatgtccacacagcaaatcaaacagaaataaggtagactcaatggtatctactgtggattatgaagactatcagagtgtaacccgttttctagacctcataccccaggatactctggcagtagcttcctttcgctccaaagcatacacacgagctgtaatgcactttgaatcatttattacagaaaagaagcaaaatattcaggaacatcttggatttttacaggtctgaagttaatatagtgaatttaataatgaaaattaatgtggccagtcttttatgtttatgttgttcattttattgaatgttttatatgctatgcttagaagcttatagattagtggggagagataaacatcaatttggtataatattttaagtacagtaacacacatgtaccntgagnangganncttanctcatccatgtggaatagggtgggagatggaagcggatgagccagnggtcnggaatggcttcttggagatggtgtct

SEQ ID NO: 509902 - DNA, 1003 bp, Homo sapiens
agcgggttaacgtcaaaggacagaccgcctatttgcgtagcgcgtggtctccataaggttcgtaatggcagctgaaaaattctctgcgctgtcataccgactgtcttgtatacctgtgactcctgtgttaccgtgcctaggatgagaccccttcgcgtcctcttttcctggctgtcattctgtaggccctgctgcattacccgtcatcacctcgtggctatgacacaatatgtgagctttggaacgcgatgcatgcctaggctacagcagcgtacttgtccggggctgggtgcacacgaggcattctacccaatcatagctctctgccttggaagacattgcatgaacgttcatcatctcgcttttacctccgtggtacttcgcgttcatctgccaaacaccggttctctgtctcgaaaacgacacagttggatatatccatatgcgtagagtattagttcaaaccagtcattgatcccagttgaagggaaacacttttcatgacacgatagttccagtggaacgcttctaatatgatggtctcagaagaaagggctaccatctctatcgtgcatatgaatagacgatttaaaccatgacgtttccacaagaaatttttataatgatctctacaaatatgagggaacttcagtcgtgttcagctcggatacttgccttaccacacaacgtcatggcatacttactggccccggtatattttaagatattgaccaaaagctcgctgaggggggggaaaggctgataaataacacgttcgtctgggagaaaccaagtactgaggacctgcatcctgcacacgccgcttacaggctttacgaattcaaggcttaaacttaaaaccaattctcctatcgattaaattgccacagccaaagtagcttataaccccttacctagtcttgctttacattaccatacgtgtggctctacacctggaagtgactttgaacacggtgggatgcctactttcctggacactaat

SEQ ID NO: 509903 - DNA, 152 bp, Homo sapiens
gaggcccaatgctgggcgtgttgtggagcccccgacggcgcgttctcattgagacctgtgagctgcccgccaattgtgcctgcagggtggaagagaaatgagcactcatcatttctggcccaccagagactgccagtaagtgctgcctggtg

SEQ ID NO: 509904 - DNA, 1597 bp, Homo sapiens
  misc_feature (975)..(975): n is a, c, g, or t
gcagtacgtgtggtttgtgacgaagcacgcctacatgagattggatgtaggtattttgtagaaaatgttgtgtctgctgtcagccaagctggttggctcccccatgttgtgtgttgaggtcgtcccctctggccgctgaaaaactctctctgcagaagggggtctctcagcacgtgcccccgaccgagagagtgcgcttactctatacattccgtggggggtgttggagaaaaacaagaactttctgcttattaggcgccccccaggagcaaattattgtgggaggaattctgtggtgcagaacccctcccactacggagaatgaggtggtgacactttttctcgtgcccatctgcgttgtgggtgtttggctgtggccttatccccgcccggggccgttgtttttgctcacaaaagaaaccaaatgggggttaatttagcgcgagccgccaattctcgttggtgtgaagatgcgttgagttgtgaagccccacaaggaaggggattacctctggggggggaaatatttgtgctggcctgcaccgttgtgtactccctgtttgtggtcttgtgttgtgtgccttggcgaaagtatattgttgctccattgggggggtggtagcaaaaaaggtagtgggttctataatttgtaagaaggacattttcttggttgcccgcgtttcccgtgtcccccgcagatgggccaacaaagtgtgtcccacccccccaaggagtggtaggcacacagcccctggtttaggtttaccattaagagttctttctctgtgtcaacacgttcttctaatatgcgccctgggtctccccactgcgtttctgaagacactgtggtttgttctttgttgcgattgggggaacaaaatggggccctcttccataaatactgtggtttttttctgcacaaaagtccacagggagagccttgagcccacaggagggcacacacactataaaggnttgttggtacaatggcaacatgcacatataggccacacacacattgcacactccacatcttcgggagacaattctctgtataagaaaacacactgtgtaatatacatgtcactgtgttcacagcacagtgaggtgaactcttggtgaaaagtggtgttgagagagagtgtgttacacacgagagcttctcttggaacacaaacgcccgagtgtcttgaagtgtctgttacacacaaattataagggagaacacacagactgccagatttgtgggaagattataccagaagaatagggatatccaaacacccaggataccttctgtgtgccacaagatatgtaatagtggccacatggaacattaataccaggccagggaaaaaagaccccagacccacttgttctcacagatatgttttttgtataattgtagccaaaatcctgaaaccaataggggtgccttcccagtctcatcataaccaaataggccaattttggctgggtggcggtgggttcatagcctataataccccagtgctttacaaggctgaggcaggaggctcttttgagaataggagttcaagaccagcctgggcaacatagcaagatcctgtctctccca

SEQ ID NO: 509905 - DNA, 315 bp, Homo sapiens
cactgtatggcggatagaaggattcattgccctgggaggttttgcctggcattctgcagaagcattgctgtatcttaccagacaggaatacagatgaagacccccaggcccagggaattcgatcactggctgagaactcacagctaaggagggggagcctgggattccttcctggtgctcacacccgagacccttttgtcactgtgttcaaaggcactgctgcacagacgtgattcttctttcaacgaacatctccaggacttctcccggggtctgtgacctcatctataattaaagggaaagagatcttcctga

SEQ ID NO: 509906 - DNA, 917 bp, Homo sapiens
gtgagactccgtctcagaaaaaaaaaaaaaaagaacaaatttataggggatcatgggtaacgataaggcattattatatgaatgaatatacggctttaaatggttttacccatgggcacaaaaggaaaatatttaaaatactttggtagtcaacaaggctttaacatctttaagggggaataactactattagaagcaggtttgtcacagaaatgttgtcaactccattctaaccttatcttcgtggttttatgaggtaacacataattttcaccatggtggtctagggttcaaaaaaaaaaaaacaaatatcttcaggtggaccagggggctttggtttacaggtggttccaatggtttggtaaggtcgagaatgggttaataataatgtgtgggcctggttataaccgggtcccagaaactcgggtgccaggtgtcccattaatacaaagcaccgacgcaacaaatctgggtggggagcccgtgggtgggctactactcttcaaacaaaaactctgtccagtggctaggacaaccggggtggtaactcaatataagacaggtgtggcgtctggacgagaaccctgttatccgtggtatttgggcccacaaaccaccccagcggtgcaatatctggccattggagggcaagagacgaccttcccattttacctgtggaaaacatctcgtggccaaagggggatttagacctcaggagagcggcaggcaactttcaagagacattcgtgggcagcgcaaggtatatatatactcgcgggcgccacaaaattaactgctggaaaacctcgaggacgaaatcccgtggggggtcgaaacacggggctacaaaaaatttattatccccaaaattttttagaccgttgcggggaacctgggctcaaattaacccaccaaga

SEQ ID NO: 509907 - DNA, 749 bp, Homo sapiens
tccgcgtcgcctctgtcgcccgcgctggctaccgtggactcccggctgcacgctctgttggcctcgccatgccggtggacctcagcaagtggtccgggcccttgagcctgcaagaagtggacgagcagcgcgagacccggtgatgtcacctacgccgggttcggctggtggacgatgcgtgggcaaagtgctgacgcccacccaggttaagaatagacccaccagcatttcgtgggatggtcttgattcagggaagctctacaccttggtccttgaccagacccggatgctcccagcaggaaggatcccaaatacagcagaatggccatcattctcctgggtggtcaacattgaacggcgcaagtgacattcacgcatgtgcgcacaagtccttctccgatatatgtgggctcggggcctcccaagggcacaaggcctttccaacccgcataatgtctggccttggttaaaccgagcatggacaggccgctaaagttgtgacctgagcccatccttcagcgaaccgatcttggagaccaccgtggcaaattcaaggttggcgtccttccgttaaaacgtatgacgctcaggggcccggtggctgaccacgtgttaccaggccgagttgggatgactatgtgcccgaagctgtaccgagcagctgtctggcgaacgtaacgcggtcagcttggggacctgacctgttctggaaggccccaatgccatgtccccagttcagcggtggctgt

SEQ ID NO: 509908 - DNA, 539 bp, Homo sapiens
  misc_feature (103)..(103): n is a, c, g, or t
ctagggaaggccttgcaggaggccccagtgcgttccctgaagacctgctcactcacctctcagctcctgcacgtccccgttcctccagctgaaccttccaccncactcccttccattctgtttcagctactggcttagagctcccacctccagaaggcctttctccgtacggcctatccagccaccaccacctcacaccctgcctcctgcactgtaatccatctgccctgatagactggaaaacaccttcaacgcaggaattactccccatggatccgcagcacttagcccagtgcccagcacagagaaggggctcgatgatagtagctgaatgactaaattctatacatcagtcacttgtgaattcattgtccatcctccgccctgctcccgcaaccactccacctgagcacacagatcttcgtccagccaccatggactccacagcccatccagctaggagctcagccaagtctctggtgcagaacagacaccatctcaatgtccagctgcagaattcctgaaatcgctgtcgacgc

SEQ ID NO: 509909 - DNA, 440 bp, Homo sapiens
acaggggtacccgttccaccgccatcgatcacccccccccggaatctttccaaacgcccccgcaagtgaatttctctgtaagactgttaaaccaggtggggaataataatatcaacgtgggacccgcaacattcctcttgcttcattggaatgggtgtctcctcccccgttacctcccgcccgaagtggtcatgtggcacacctcacgagggttagtcggttagtgacagcactagttggaagcggcccgaggtgctcccccccgttcaaaggcagatgtggtacagatgcttacgacaaagcatgtgtgcccctaggcatcgtgtgttcggagccctgtttcgtgggtggtcaacagcccctctgtctgctggctacagggatgagcacgctgagtgatccccatcacagcattctgcagccccgcaccaaacataaca

SEQ ID NO: 509910 - DNA, 323 bp, Homo sapiens
tttcaaatttgggtatagacaataaagaactgaagtgctcactactcagtgatttggaaattttgatgcttgtataaatgtcagataattaatttccaaaggcgtatgtattaagtaaatgctggaaaaattggcctcattaacatatttacagacttttacttaatacatacgcctttggaaatatgttaatgaggccaatttttccagcatttataattatttttttcacttgttaggaagcttttgttatgtattttctgttaatagtacctaaaattgcaacttctaaacccaaataaaaagaaaatatttataggaaa

SEQ ID NO: 509911 - DNA, 239 bp, Homo sapiens
gctggctgtctttccacgacgagaacacacaatcacacgatcactatgagacaccagagacgataaggtgggaagaacaacacacacgacacacacggaagacaaaacacacacaagatacacaagcagcacaacacacaaccacacaacattcagtgaccacacaacacagtggacacaaacattgcacacacaacacacaacccaacacacaaccacacggtgaccatatcgcgtca

SEQ ID NO: 509912 - DNA, 902 bp, Homo sapiens
gatacagtcaacaaaccactgaacaggtatcctttaaaaggaatgtcatgctgtcttcatatctaagtgagcaggaagatgatacctatctggaaacaataggcgagacctggaaatggaacctgtgatctggggatataccatgtagttttgcttgcatgtttcactggtggaggcacagagcttcacttgtatgatgctcgagtactgtctggccgaattatcccgtgccctcgtttgactactctgatgtagaatgcactgcctattagagtctggagtgagtgacgagttcaccccacagagttctcagggagggaagagtttagaggtgagtcgtgctgcgagaattcgagtagtctctggcaaggacagcgtgttgcgtgtcctggaacgtatcctcgacgactgagaaggaaatcctaggtggcgacatggaggagcatgccgtccgtcgtgcatattccctggcgataagaagacgtaggaaagcatatcgccagacagagtggaactctggaacagaattttctagtccagttatggagatgcgccgagagggttaaggatcgggggcgccagtgcatacaaaggactatcccgaatttacacgatcgggttccggacagaaaaaatcggctgacagtggcggctcacaggacttttggcataccgtggccgaaattctaggacattgaacaaaagctatccttttcatccgaggacaggacggagcactcaatggggtgacattgttgcgctatggatattgctgtgcgtttctctggtgatattcccgatttgagtggaaattctagaagttggagtggggccatatggcatcgcccgatctaaaatgcatagacagacatggcccattggggcttgatggcaggtgggtc

SEQ ID NO: 509913 - DNA, 423 bp, Homo sapiens
  misc_feature (55)..(55): n is a, c, g, or t
  misc_feature (73)..(73): n is a, c, g, or t
  misc_feature (77)..(77): n is a, c, g, or t
  misc_feature (80)..(80): n is a, c, g, or t
  misc_feature (93)..(93): n is a, c, g, or t
  misc_feature (107)..(107): n is a, c, g, or t
  misc_feature (111)..(111): n is a, c, g, or t
  misc_feature (141)..(141): n is a, c, g, or t
ctagttttagaagtatcatagcattctcaaaaaaaaaaaaaaaatttctcttctnccggtaatgggtagtccngaangtnagatatttttttnccagggggtcaaanggtncctaagtatatgatggcgagtggaaaaatnggggacagaaatcaggtatgggcagtttctccatttccattggggtgtgaatttttaatataaaggcggagacgtaaagcataatggcaagtcaaaaggttccagtgaccaagttccagcggtccacctttatactcttcataaataacccggtaaaattttccgggacaaggccagcattgggattttttaaaaacacgtaatttccttatggatggcacctaatgggtgttggtagcattttcatcatacagtagatcccatccattcactatacttttc

SEQ ID NO: 509914 - DNA, 328 bp, Homo sapiens
cacgtctgtatgtcctggaaggagacgctgagatatctgttcacactgtactgactcggacattgacggcgcatcactctggacgagtatcgaaatgtggtcgaggagctgctgacgggaaaccctcacatcgagaaggagtccgatcgatccatcgccgacggggccaatgataggaggcggccagcgtgtgcatggggcagatggagcctgatcaggtgtaagaggggatcaccttcgaggacttcctgaagatctggcagtgtgatcgacattgagaccaagatgcacgaccgcttacttaccattggaaaccatggacctctga

SEQ ID NO: 509915 - DNA, 285 bp, Homo sapiens
  misc_feature (223)..(223): n is a, c, g, or t
  misc_feature (236)..(236): n is a, c, g, or t
ggaggtcgcagtgagccgagaccgggccactgcactccagcctgggagacagagcgagactctgtctcaagaaaaaaaaaaaatcaatttgtaccattccttgccccaccctgccgaacttattgaaagagcatcgctttcctcacttttctcctctaacagaaaagcacttagatgaggctacagggagccagagttcttttgacttggtgggtaccggagnttggaagagtctngattgagtattccttggcctttggggagcttgctctatgcaaagtcacc

SEQ ID NO: 509916 - DNA, 444 bp, Homo sapiens
ggagagggtaaatgaatgtggatcatgtaacaaggaggcgtcatcttgtgtgctgggagacgctcagtactgggggatctatttgtatcgtgaaatccctgtacagatgccagatctttatccattgctctctttatccaagggtagagagtctcgaggaagtgctttctagatcccttgcatgttcaccttcggagttttgcttcacagcgtttcacagactctatttgagaactctcaaaagttctgtctctgtctctgtccctgtccctttcaacagaatcagaaattagtctctctctttccctatccaagtctctccttttgtctcgttctctctctcgttctcgttctcgcaatctatctcgatccctgttgcgtggccaatctttatcagcatctcggtcccattctctctgcctcgtatctctcctctctctctcg

SEQ ID NO: 509917 - DNA, 155 bp, Homo sapiens
catcaaacctgccagcgattgaaatggaacatcgagaagtcgtggtgattggcgcgggcccttccggcgccatcgccgccgccttgctcaacgcctcgattgcactgatcgcacactgctcatcgatatccgaagtagggtttagggtttgatga

SEQ ID NO: 509918 - DNA, 95 bp, Homo sapiens
  misc_feature (86)..(86): n is a, c, g, or t
  misc_feature (88)..(88): n is a, c, g, or t
aaaacaggagtcccactgattactgtagaattatttttgaaatgggctattggtggaattacagaaccaaggagctttagggctgnanagagatc

SEQ ID NO: 509919 - DNA, 210 bp, Homo sapiens
ggcgcatggctggtcacggcagcaggcctgtgcatggggctctgctagtgctggatcgatcgagcgggaagcacggggtggtggaacggtacacggacgccgtcaaactctccccgtaacttgataccgcatattaccgatgtctctgtatcctgatttccaccttgccagggtccacggcgcacagctttcagtcatcctggatcactt

SEQ ID NO: 509920 - DNA, 259 bp, Homo sapiens
  misc_feature (96)..(96): n is a, c, g, or t
aaaaatttttttaaaaaagggttatttttcccacagaattcaaaaataagttcctaaggggcgggaaattaaaactcccccctgtgtcagtcaaantgaaagggctcatttcaaaaccccccatttttagtttgtcaaaactgccctgggggcttattgctggtttttaaaggggtttttaactcaaaagaaaaatgtttaggaaaagttttttttttcaaaattgggggtctttacaactgattaaccagtagtttta

SEQ ID NO: 509921 - DNA, 276 bp, Homo sapiens
aggataaatgagtagtataatctatcatttaaattagggaagtccgttggagtagacctatagctatcttacatattataattagtagctataaaccatatggtgaaccttctcctctaattctatgagaataaagacccagatttaaaacatgtcctaagctgcttactctgatccctacctacttctcatcctggcgtctaatctgccttttatttaattttcttccccccatcccccattctttgtacttgctcattcactctatcccctttt

SEQ ID NO: 509922 - DNA, 880 bp, Homo sapiens
ggcttgttctctatggaatacgacaatgtgtgtcgcaggatcagtcattcacatgtcgctcatcgaaatgtgtatattccggggtaaaacttattatcgtggtgtgaggagtgcatgatatcagtggcagagcttggcctgacaatggctgtttctcctagtccaggcaaactattttatgatcgacaaatgcatgcatcctgtatcgtcgaatgtctgctaattctttaagattttccaaatgtcccacttaatgccattggagatgtaatttaccagtgtgtttcaacccctgtgataacgatgtatcgattgaggagaacgctattatcatttgatcatcagtatggattaaaatatagggaatgactgattacagggacgagtgatgggtgggcgggtggaagaccactatgggaatcgtgtaatgtggggataagatttttttaataagagttactcattagtccctgagttatttaagtcttttgtgcctattgaaaattatcatggtctttcatggtggacttgggtatcttgtaaggtgaggtaaaatgtgtatatacaatacaagtaggcaggatggcaagtatgcaggttcgagatgtttcgctgaactgtatattatacattgttacctatcgactggtagctctgagtatttgcattgagtcctcgttaaatattgtcatggtaaacactatgtggtgactatttctgacagtcggtggctgacctacttcattgtcttgactgctgtttacctcgtgatggaccgtttgactgacctttacggagatcaaaatgcagaggcttcaaaaaaattgacgaacccggggaaaaaacgccagagataagggaaacaagcaaagcatacaag

SEQ ID NO: 509923 - DNA, 140 bp, Homo sapiens
aaatggattaatgagttataaatgtaacctctgcaaatgtataagtatcagaagaagagataagggataagctctgtgacattggtctgggcaatgaatataaggatttgacctcaaaagcacggtgctcgatgcggggc

SEQ ID NO: 509924 - DNA, 354 bp, Homo sapiens
ccccgcgtccgcgcgaggactcggcggctgagcgcgcccgacagcagctaaaggcgctgctcaacaagactatgggcatttgcatgacagatggacggacactggtcggctgcttcctctgcactgcccgtgactgcaatgtcatcctgggctcggggcaggagttcctcaagccgtcggattccttttttgccggggacgccccgtgtgttgggcctggccatggtgaccccgcacaccaccattgttctccattgaaggtgcagaggaagaagtttgacccgggcctccggtatttcttgaccacgatggcggcttacctttatagactctcattaaacttattgccccaga

SEQ ID NO: 509925 - DNA, 1202 bp, Homo sapiens
  misc_feature (613)..(613): n is a, c, g, or t
acctcctccctgggtgcgcgggtttcttatatatattgatgccgcaagctgcgttgtctgcttttgttatgttgtccctcgcgttctacgcagttttgtgcactcctgttgtggtactgccgcctacctttctcatcactctcttttgtgttggtggtggtgtcgcccttcctcctcttgttgatgaggggtctactccctgggggggtcgcggtagttctccactagcgtctttcgctcgggagcctgtttttatgcctctatttgggcgcccgccggggtgagcttcgtgatttaactccgaatgttggtctgcaactcacggggggagatccacgcctatatgggtctcactcttatgggccccctatattttatgggggggacaccatacctatgtgagtggaaccaaacatgttgggtgagccaaacccaacatatagccacgcgtctgtggggtgaagccaccgcgtttcgctgcgagagtttttccccgcgcgagaattggctacagacccactatttacgctctttttttcgggcactttcacagtggcgcgcccctgttcaggaagacccccgtctgttgggagaggaggcccccacagagtgncgtggttcctcacagacagagggtagaatccacacgtatatgtgtttatataccgcgtcacaccacgctcactgagcgccgacatatgttggtctcacaaaattatagcgcggtaaaaatctgtggtcagtgagtagccgcacgagagggcacatgtttagcacacacacgggtgtttctctatgaaagatttcataggggccacagagtatttgagatggcccccaccacattgtggtgtatatggtagaatgccaccccactgatatattccaaaggcacacagctgcccacgtgggctttccgcgagagtttttcctcggtgcccacccaacgttcgacggaggcttggagaatggcttgcgtggatgtgccaccacaattttttgtcgtgtcccgcaagagttcgcttcaccacaagtgtttcctccccacgaaccgcccaaaccacctttgtggaaaagagactgccccactgggcctcagagtctccccacccccatgcccgggtgggcccgtgtaagaaaaatggagtaggccagcttatgtgcaccttttttgttttaaaaaaagttaaaactgtgcccca

SEQ ID NO: 509926 - DNA, 142 bp, Homo sapiens
gtgcagccactacggtcagctctaggcgctcggcctcctcctgtgcccgcttcctctcctcctccagctgcaggggccgctgaatctgctccgagagctctctctctgccttctttgtcttctcctgtcgggctagtcgggg

SEQ ID NO: 509927 - DNA, 1152 bp, Homo sapiens
cccacgcgtcgcccacgcgtcgcccacgcgtcgctacttcacagctcacaggggcaggaggggtcctgtgagctgcgaaggacccgggaagcacgaaggcagacaagaggaggcatgaagggacaggaagagagccccagcaatcatgacacagaacagggcgatgacgacgaaccagcctcgaaccaacacgagcatggaccagacgataaacaaaagcagaagcacacgcaagccacgactctagaacagcaggacacagacacaaaaaacaaatgagacaaataaagaaacagaagaaagacaataccaagggcacagcaacgaactcgacgagaacaacagaaagaacaaaccaaaggacacagacatgacacaagcacaggcgacaaacaaacgcagggatgacacagagacgaaaaaaagacaaccaagacacacaccaaagaactgcaaaccaagcgaagaacaaacacagcaagaacagtgaacagaagaacaccaacaaccaccgacgcgcaaaaaaaaggcagacacacacaaagaaaaaagacaagaaaaacaaacacaacaaataaaaaacaacaaggacgaaaaaaaaaacaacacaaaactcaacaacaaccaaaagacaagacaaacacggacaaaaaaaaagaaaaaacgccacaaacgaaaagagacagccacacgtcagcaggcacgccaacaacaaaacaagacagacacgacaacaaagaaaaaggcacaccgacatagagcaaaacaaaacacgacaccaacgaaccgcaccagcaccatgccacacacacagcgaaaacacagccgacaaacgggaccaaacggaaccaacacacacaccgaacaacaccgagacgcggcaacggaaacgcagacggaaagagtaacataaactaagcgatagcagcaggacaaggagcacaccacccggaggacaacgtacaggggaatagaacaagcacgcacacaatcagaggaaacggaacaaacacaacaaacacaaacacacgaaggaagagtcaggacagacaacaataaaaacaaagcaaccaaagaaggagcgaaacaacaacagaacgagaacaagtagacgacacggaaaaagagacagacacaaaccgcacacaagca

SEQ ID NO: 509928 - DNA, 417 bp, Homo sapiens
atgactctagaggtatcccctcgaatcgacggtttctcaaaaataaaataataattaatctgtccagaacagtgggttgtgcctataatcctagcacttggggaggctgaagggggcggattacctgagatcaggagtcaggatcagcttgaccaacgtgatgaaaccccatctctactaaaaatacaaaaaaattgccaggcatggtggcgggcgcctgtattcccagctacttgggaggctgaggcaggagaatcacttgaatccaggaggtagaggttccattgagctgagattgcaccactgcacttcagcctgggtgacagagcaagactcagtctccaaaaaaaaaaacccaaaaaaaccccatttcctggtggggcgcgggggttcacacttgtatccccaacattcggg

SEQ ID NO: 509929 - DNA, 496 bp, Homo sapiens
  misc_feature (4)..(4): n is a, c, g, or t
ttgnatcttcattaagttggtattttggttaaagtgagattcagagaagaaagatccctgctttttgggaatgtaaactcgtgcaacagtgtggcagacagtacggagattccttaaaaaaccaaaagtggaactaccattcgatccagtaattccattgctgggtatctacccaaaggaaaataagtcattacatgaaaaagacacatgcacatgcatttttgtggcagcacaatttgcaatttcaaaaatatgtactcaacataaatgcttatcaaccaatgactgaataaggaaaacatgggatatatacaccatggaatgctactcagccataaaacaaataaaattatggtctttgcagaaacttggatggccattattgtaagtgaagtaactcagaaatggaaatccaattatcatatattctcacttataagtgggaggtaaagctataaggatgcaaaggcatataatggaatgatataatggactt

SEQ ID NO: 509930 - DNA, 397 bp, Homo sapiens
ggggcctgggctgcgctggagccccctaggtgtccccagcaagccccttcaggcactgtcacctggactccagcaccacccctcgtcatgttgtcacttcctgtggtggcgggagcgcaggatgtgagggacaatttgggtgacaggtcagtagctgtggccgtgcagtgttcaaggccttgccccctagggacctggcatggggctggaaggggggatcaacagcgccttccagcgtcccagtagcctcccctaacgtccttctgggtcctcctctgggtgcagagctcgggcaggtcttctgggcacacaggagatctggggggcctcccaacgaccgttctcttggcatcggatcagcggcagattgcgctgggccagtccttcccggcaccgg

SEQ ID NO: 509931 - DNA, 150 bp, Homo sapiens
tggtcagaggccgggtgtcaatcttggcatctgggcgtgggcgcatgcacctgcagctggctgccttactctcggggcctcagtttcctcttctgtaaacacagggcagtgcttaagtgtcctgggacaggagaggaggcatcacttgag

SEQ ID NO: 509932 - DNA, 326 bp, Homo sapiens
gagggactttgttcgggcagcatttctggttggcgcgaaatctttctcgccgtgtccgccctgagtgtgatcgcctttatctggcgcctgatctatgtgccgcaggacatcacacaccacaagccgctctcactgctgcaacacctgctattgtagaagcaaccgcgtctgctgctggtgtatgccatgaccgccgtcggttatggcggcacctttatcgcctatacctttctggcgcccagtccttcaggagatctcccgctttcagctcggcaccgtcagacttgtactgctgtatctacggtatctcggttatcctctagaga

SEQ ID NO: 509933 - DNA, 366 bp, Homo sapiens
cgagctatacttcaaattaatcagtagcttctttctcagtcgaccccgcttgccttgccttaaataacagtacttattgagtctcttctgtgtgccaaatactgtgtaagtaagtctggaaacttgaagcaagccaagagggacaataaccttctgttctacggggaaatgggtgggtcttcctaccagcgtcatgcctgagcttatatattaataacattaaattgaaatttagatgttattataagtagttgtggccattatggtgattctctgggtataaaaatagatacaatttcataaagatacgtgaggaagtaattaccaatactttcctaatactttctaaagtcaaaaagtaactct

SEQ ID NO: 509934 - DNA, 148 bp, Homo sapiens
agagcgtgtggagcccaggagtctgaagggcctgcaaagtaatagggcttcgtgcctaagcctcgccctccagccaataggcaggtttcttaactatcctaacaagccttggaccaaatggaaataaagcttattggatgctggacga

SEQ ID NO: 509935 - DNA, 1067 bp, Homo sapiens
gggatggaaagtccacccgtatggatggcaatgccagtggaagcacgctgcttgagggtctgggactgtatactaccaacaactcgttcaactgacaagcaccttgcagccgtgcacatctcccaggatgtctacaaagattggtggctatgggtacatgttcgctgttggtcagagtggcagactggtgtctctcaagtacccggtatggtggtcacctcttgctccaggtacaacgttacaacggaacgtaagatctgtcgagaatgcgaccatgaagcttcgagtgaacgctcgttcctggggaccaactgtggggtcttcaactgtccctgaatggtgtctgtcacgggaatgtaccggtgggtagggcacacccggtttggtgtgggtgaaccaagcgacacatggattggaaccccaacgaatggggacaggcatgcgtagggacctttccaggttggttccacgggtggatggagatcccttggaaaggcaatttccaaagggtcaaatattaaagcgccccgggggaaatggcccccgtggtattgggcattggccacaccaagggggttttcagacatgtgcgccaattggcaaaggagttcgggctagatggcttaggagggggcaacaaagaatttggaatcgggacagggacgccgtggggttcaaaaataggttgcgggaacaagatgttggggcggttttaaaaatttcccttgtagaaaggtttccggagaggagaattgcgtttgccatttttgtgtggagaatatggggggtttcccatgggaagaatagtgccccccattggtggtggtgcgtttcggacacgaacgctccatctcaaaggaagattaactgcacaccgcgttgtaggggactccgcctatggggacctagggcccaggcgaatcgtggctcacccacgaagaagtcgtcgccggcgggggagttcgtcatcaaaacagtgcgggtgagcaccaaccaacggcggtctgatggaaaacctgtgggacaagtggtcaaccaaaacgtacggccctaagaaagggcaccac

SEQ ID NO: 509936 - DNA, 128 bp, Homo sapiens
ctggtttgacctgataattagttgcttgagagggatggcggatcagtgaacagtacaattatagtgagcagaagtggagaggatgaatcactacacgaggtccaccgtgagaggtccactcttccgga

SEQ ID NO: 509937 - DNA, 106 bp, Homo sapiens
ctttgcagttctggtttcttgccgaaagacgtatccgttgtcccgcatacactgaccctccggagggctcggcgggggttacacaggactcggagtccggagggga

SEQ ID NO: 509938 - DNA, 311 bp, Homo sapiens
tctagcggatcctgggttgttggtcacctggtctggcttgcttcagtgtgtcggacacatttacgcacagagaaaaataggcaatccaaatggtccaactctatggatattctctatgctgctttcattcactcaataatgtgtagctgagcacttttctgtgtcaatgaatatagttccacattatcctgggcttgaaggatgtgtcatcaaatattttactaaccccccactgatgcatctagcaggatctgtccatgccctgcccatatctctaacatttctatgtgctccaaccaagcaacccctgg

SEQ ID NO: 509939 - DNA, 415 bp, Homo sapiens
atcgttctgtaatgatgaatgacaatactgaggcgagctcgctcactcatctccattctatcacagtagacgataggttatcagagggaagagcttcccttactgtcatagctgtggccttactcactcacgtctttataccagactcaacttatcaggcagtgtaaccacagccctttattgcagtcctcccccatttttttatctgtattttttttactaactatatcatgtttacaaatgtggctgctcttcctaaagcctagaaaatacttttaaagtaggggctcggctcacgtcacacaacggaaatctttaaaatggtgcttttaggaatttaatctgctttggtaaatgtaaccttaaatggtatctttgaggccaggcactgtgactcacacccataaacccagcc

SEQ ID NO: 509940 - DNA, 354 bp, Homo sapiens
ccttaacagtattttctttttctttccttttttttgagatggagtctcgctctgtcgccaggctggagtgcatggtgcgatctcagctcactgcaacctctgcctcccgggttcaagagattctcctgcctcagcctcccaagtagttgggactacaggcatgtgccaccacgcccagctaattttgtatttttagtagacacggggtttcaccatgttgtccaggatggtctcaatctcttgtcctcgtgatccacgtgcctcggcctcccaaagtgctggagttaacaggcgtgagccactgcgtccagccaacagcaatttcgtagtgtcaactatctagactgggttcaa

SEQ ID NO: 509941 - DNA, 414 bp, Homo sapiens
aaacacctgggttgagtatttatatcccagccttaaatcctaaaagccttgccgttttatagtcctttcggggaaatacaggaactacattaatacttgttagtgtaaaagttaatgcattgctggaaaagccttgtaaaaaatcagaaaattatgcaaaaaatgaagggaagattaaaaagggtagtgtttgaccagcagttataggtttagggatgtatttttttagaatatatttttaggaatgtatccttcaaattttagggtttgggggcataatgagaagattcactggaataaaattctaaatcttatatgtaaatgagcatttttgttcatagtaatatttaatggaatgtggctaagagtcctatctaatggtgaaacaaaaatgaacaaaatattctcctcaaa

SEQ ID NO: 509942 - DNA, 218 bp, Homo sapiens
  misc_feature (167)..(167): n is a, c, g, or t
cagacggatccttcagaggcacaaggaggaagatcaacgcctcactggaaacatgggctggggtttggcagcctggtctagtggggacagcccagagccgggctgcccatcatggtggccccacccaatcaagggaagaaggaggaatgtgggacgggaggcccctngaagccagaagggcaaggagggggacagtttccttttcctggtgtgtactc

SEQ ID NO: 509943 - DNA, 144 bp, Homo sapiens
tggcacgcacgttccaaaaatagtgttctagggtgggcttggggctcatgcctgtaatcccagcactttgggaggccaaggcgagtggatcacttgaggtcaggagtttgagaccaacctggccaacacggtgcgttggcccaa

SEQ ID NO: 509944 - DNA, 1395 bp, Homo sapiens
  misc_feature (230)..(230): n is a, c, g, or t
  misc_feature (919)..(919): n is a, c, g, or t
gcacgatgcctatcatatagtaaaacccagccgcatgactccctagacagggggccctctcgagcccatcctagatgacctccggtccgtagcgcagtgtgatttgcacttccacgtgccgagtacatcgcgtcctcatagctaggccgtactaacgcgaacacagcgtaaccatataaccacatgatggacgcgatgtaatcacgagcaaagcactatatcactaaggncacacgcatgataccaccgtgtccaaaagaggccttctgatacggggcatcaatcctcatttattcacctccagcaagttattgttgtacgtgtcggcacggcatttatgcatgatgccttattaccacgtcctagcctaagccccttacccccggaatgtaggaagggcacttgtggccacacaatcaggagtcattcagtcgcgcggactaatatccgccctaggaacgtccgcatacgtcctgaaaagatcactcctgtacttaccttcgcattgcacgagatgtagtcaatctcaacgctcgacgcttcaacctagtgagatactaagattaggacaagagcaaaagcagaaaactcgaacatgagacttcgaaagcatcctggttcatgtacagattctatgagctaggggtgcttcttatcttgaactcctgcactcacaaatggcgctccaggagtcacctgtcgaagtcatccctctcaagcagtattgccgaacggtcgatctgagcgggtcaacattggttggtagccacaaggcttgcacggactgcacagtcgattgataaggctcaagctttcctcagctatctggcttcaatccggcgaactaatatttacacgttagaacattccaaaagcatcactctgggcttccgaagccccgccgccctgattacttggncatttcgctacgactggtgggcttgaactatttcctggactggtctcccaatctcatcagattgacggggtccttaacagaacaaccacaacaagcaggcacgcagcagcaaacaacacacgacagacacacaaagcacacacaacgaagcacgtacaacacgaagagacagacacgacgagacatcacaacgaacacaaacgacgacacggacaacaaaccgagccaaggagacaacgaccaagaggaaaaagaaagaacaaaacgaacagaaatacgaagacaccgagaacagaagaccacaacacccgacgcaaagcacaacaaaacaacgaggacccgaactacacacgcaacaacagacaaagccgaccacgacgaggagaccaaccgaacagagatacacacgaccaaaaggacgcagcaaaaaccagatgagcgagaaagcgtgagggagacaaaggaaggagaaacgc

SEQ ID NO: 509945 - DNA, 1173 bp, Homo sapiens
gtggctgaaggaagccgaggtggccctacgttgtagcggggtgtggtggcaggcaggatccagtctccggcagtggcggcatgcaacgtttccagagtatgagcttcccgagctaaatacgcgcgctttccatgtgggcgcctttggaggagctgtgcgcgtgtggcctgtcttgcgctgggggcctgtgggactttgtccgctcgagtggatgccgcctggcatcctgcgtctgccatgtggagccatggcaagactgacgtccagaccgggatggatgccagctggtggccaggggatcttggactgcagcctggaggcggtggcttgagctgagggcggtgtgcggccttgataaagctgaaatgccttgagtgacggtgaggatccatgaacgtcattccggagaatactgacctggtgactttgggggttaggaaaacgggttcttggaacatcgggaagaaaccattacaatagatcgagcctgcagacgagaacacagttacgttagtgagatggagtcacatgccataggaaaaaggcctgaaaattcagcagacatgattgcagaaggggagcttatcctatctgtgaatatcttgtaccctgttatatttcataagcacagaagaacacgagacataccaaaacaatgctggtgttgggcagtcaaaaagttcacacaatgagggattcagttcggatgtgtcaggtgacctccagaattgggtggtgcacattcagcgaaatcttgaccagggcactgaggcaaaattaggcataagagctatagcaaatccaggcttacatgttaattttggaaggaaacatttaataatgataaaaagattaccgagaaatgggaagattgaagcagaagtaatcattgagtggtcaggagtcgcgttataagagggtaataggaaaggtttcaagaactagtttagacttggaagagattgagagctttcaaataaggttgtgtattaaacgatggttataccataagagataatggcatacagagagaactgagacaagttggtaattggcagagacttagactaaagggtatgagcgtaagtaagagtggatgaatagagagatggtgatgcccgtactatagaaaagagattggattagacacacaaagtcattgtagtaagaaga

SEQ ID NO: 509946 - DNA, 1081 bp, Homo sapiens
  misc_feature (57)..(57): n is a, c, g, or t
  misc_feature (112)..(112): n is a, c, g, or t
  misc_feature (218)..(218): n is a, c, g, or t
  misc_feature (222)..(222): n is a, c, g, or t
  misc_feature (308)..(308): n is a, c, g, or t
  misc_feature (530)..(530): n is a, c, g, or t
  misc_feature (547)..(547): n is a, c, g, or t
  misc_feature (571)..(571): n is a, c, g, or t
  misc_feature (658)..(658): n is a, c, g, or t
  misc_feature (675)..(675): n is a, c, g, or t
  misc_feature (720)..(720): n is a, c, g, or t
  misc_feature (1048)..(1048): n is a, c, g, or t
  misc_feature (1050)..(1050): n is a, c, g, or t
  misc_feature (1055)..(1056): n is a, c, g, or t
  misc_feature (1059)..(1059): n is a, c, g, or t
agataatccaatgagtgtgggcatttctatttctactgtaaaggcatatcaaataangaaaaaagtctaataattgcataaaggaatataaaactatttattaaccactgtncaccagtatttacaataaagtaaacaatatacagttggataacattttgattactacaaagttgttcttcctggcttttgctgaaccagtaaagcaaactcaagantggncctccatgtaatgaattggggtaaagaaaaaacatgcaggtcaataggttaggttacaaaaggttgttcacacatttatgacagcnggtcctaaactgccaacacctctaaccatctgattaggtttctatgagccaagtcttacatattccattcatcatgaccttttagtcaatgtagcaacagggattccaacattttgctaaggaatggcccgctaggaaacttttaaatgttcatttaacttagttttgtttagctagttaaaacacactagcatttgtctagtttcctcatctgggtggggnaacctgctgtggtggcngtgataaaatttttccttttaggnattttgcaaataaaccactgcaattatagacactttaaaattatccaatttaaattgtcctatctagaattacttatttcacttganatgtatggtttcagganaattttcaatttaacttgaaggggttatctcttattttgcttggnataatggcatctcagaaacatgggtttacctgtggtttttttgtttgggtgaatgcttaaaaacaaaaaaaaatttacatatgcattttatggatacacacacacacacacacacacacacacacaaaaaacacgtaataaatctagaatggtccttaggctcatgagaacacaagttttgactgagtaatgactatggacatttcccccaacatttagaaaagctgttctttaatgaagaggaaatgatataccatggtatcaaatgttcttttctgataaaggaagcaactacagaaagcttttatttatttgttcaaagtaccantnctatnnatncaaaaaacccgaacaactctcc

SEQ ID NO: 509947 - DNA, 747 bp, Homo sapiens
caaaaacacagaaaaatgttttgtgcatcaactctacaatatttgagatcgcttatcgaaatataaatttaggggaagttaaaaatcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacgaggagagggggcgccgccgcccaaactatagctcctctcaccagcgccaggagcaccaactcacccgaaccgacaccacccccttctattcagcaaagagcgcccgcctacgtcactcagtacgcgagtccatatacatacactaccaacagcgcgccgccgcccctacaacaaccacacccgccgatccgcccacacaagctccaccgcccacgccacacacatcctcgggcaagacaacccccccccccccaccgcgggggcccgcgagcaccaaaccacgcgcccgacacccaactcccaccccccagcaaccgaatcatacacgcgcccaggccgccgagccaaaccaacacacccactcccgcccacgagcacacgccgccaccggcgaccacacacacgcaccgaccccctgcccccgccgcgccccgaaccacaaacaccagctcagcgcgcacgcaacgcaagagccctcatcagctcaaaaaacccacacccaccaccacagcccgcgcgcacgccaccacccgacaccccacacacccgcaggaat

SEQ ID NO: 509948 - DNA, 171 bp, Homo sapiens
tgttctggagagtgctgtgaagtctgtggcccaatattaggaggattcactggtgaggccttacccttgcagctttacaggccagtaacgccacctctaggtagtagaatgtctcttgactcaacgtgtcaactgccattgaacagatccatacgagtagcacagccatgc

SEQ ID NO: 509949 - DNA, 224 bp, Homo sapiens
tgggttataaaaccttagggactaaaattaatataaaaatgggcataatgtgggatggaatctacattttgtggcaaaagttataaaaatttcccacatataatgtgtcaaaatttatacattcagtccagttcgtgttataatatggtaagtaataattaggtttgtgttttggagccgtgggcagacagaagcgaaacatctgtctcaaagaaaaaaaaaaa

SEQ ID NO: 509950 - DNA, 642 bp, Homo sapiens
agcggatcagcccacctcggcctcccaaagtgctgggaatacaggtgagagccactgcacctggcctaaataattcattactacagttaagttcatacacaatctgagaacgactaatataaaatattctgaaaccaacatgctatccaatatgcatattatttttaggtttacccactaacttcttggagtacgctaatgattatgatttactttcgttttctattgcgtctctgggggaagaagtggggagtcctcaaccttcgtgtggtccaccccccaaggggctttggagagctctgcgccatgtgggcgcgcgcgcgtgcccctcggggttctcacgccgtggggggaacccctcctctaggcggcgctcttcacccgggtgatgtctccaagggcgccacagaattctccacctctggggggcccctccttacgaaagcgcagcctcgtcctcccgcgaaaaaagatgttgggggccacattgtggcgacaaacttgcgcggacccatggccagatggtggacactaccccctaggggtatatttacaccacaaataacgccgccccatattgggggacccgataaaaacagctttgttcctaaacaagcagggcgtgctcaatgttttttcctc

SEQ ID NO: 509951 - DNA, 269 bp, Homo sapiens
cattcgcgggtgagaatagacccaagacaagagtgcagcgcgccaccacggcatattcagcgagagtacgtgtaagtcgggaccagagcagaccggtaagagagagaaatcgagggtatcaaataggacgagggcagtccaactacgtctcttcgcagatgacttaattctatatctaatagacccatagtctcagcccaaaagctccttcagactgataaacttcagcaaagtgtcaggatacacaatcagtatacaaaaatcactat

SEQ ID NO: 509952 - DNA, 458 bp, Homo sapiens
tatctgttgccttctggttgatagcacaacctagatgtcaagacaggctgaccagtgatgtcacacgtgggactgtacgccattattgaactaggcttggggaccacaatgagtgaaaacaaaaacccttcctcttccattgtgtgttctaagagtgagcagaccaatgagtggtggtttaagcactttctatcagaatggtgattgcttcagtgttttcgaggagatggcaacatcatggaagggcagcaacgtgagtcagcaacgtggtatatgggtcccaatcagcatctgcttctgatttgtttttgaaagaaaatccttagtcggttttcatttgaagcctgctgcagatcacagcgtcagggaaacattccaccttgctcctgggccagagcattccttggcaagaaagatctatttaaagatgaacgaccgagatcggatcgtgccttccc

SEQ ID NO: 509953 - DNA, 1139 bp, Homo sapiens
ctaagcgagtgagtaggttaagcacaagtacaaccatagaaaacatcgagattactattaagtctccagagaaaatcgaagaagtcctgtcacctgaaggctccccttcaaaatcgccatccaagacaacagaagaaattccgcactccttcgttttctgcaacacaagaacaaacaaacaaggcagaaagttgaggccatacaatacaagtctcttttataactcattattatacacaatgtgacattgcacatctacaatcaccacatttaagttgatcattcaatcatgccaatggtcagatcagaattgcggggcatgtcagcacaactggactttcaagcacactggcacaagcaggccttccacacagaaggacaacacacctttcagcatctcatcatctccatcttccatattgtcccagcaacatggcccttctgcacacttcctcacagcgcaattcactaaggtcttctcaatctcagcctctgccccatccattgcaagtcatctcatccattcaatttccaccccataaacacaaagctcatctgctcctgcacattgtaccttccagggcctttctcgccatacatcatcctgtccaagcacacagcaaatttgccccagctggcagcccacgttgcagcacatcttgccatttctcccaataccctcgccttccactctgcatcacatcccatatttcaatacattattacgctcatccccatgcattcctttgaagcttcattaattctccacataggcagaggctacccccaattgtggctcatccacgctgagtgccaatttctaagcccaggacactgggctttactcacacataccactacttcttctctactaggaacacaagtcgcaaacttcctcaagttacagccccgtctcacaggttacattacccaccgtgggtccacaccacttcaagcttctagtcgtccaccaacgacacgggcgtctactccaaagggaaaccacagaggattcgccaaatctgtagggggaaacatcgtctgagccagtttcaccaacgcaggcttatctacacagacacttcatcccactctccagccccgtgggcacagcatacagcacttactggcaacatggc

SEQ ID NO: 509954 - DNA, 317 bp, Homo sapiens
attaggaggtgacacagcacacacagtaaaaacggagaggagctgatcaggaactaagaatttagcgtatagaggagtcattgtgcctcagggcataaagagagaagctctaaagcatgcttctcaaagtgtaatatatatccagaactcctaggagtctaatgaaaacccggattctgatttgggaggtcagagataagtcctggaactctacatttcttcttcttcttcttcttcttcttcttcttcttcttcttcttcttcttcttcctcttcctcttcctcttcttcttcctcttcttcttcctcttcctctt

SEQ ID NO: 509955 - DNA, 550 bp, Homo sapiens
acccactcttttgtgtttcccacgctccccccctctatgcctggagccctggtccccctggatgagcaccaaatttttgttcaggggtcttttggggccccccaccttttccacgtgggggggggggctggggaaacccccggcttaaaaaataaagccttgggtttatggcaggggtccaatggcctctccccacggtttttcccatggggtcctccactttttccaaccacagggggggggccgagttccattaaattggggttctttgcagccccctttttggctcccccttttttttttggcccccccccccgggggcgggcctggatgtttttgggcccccccccaaggcccccttgggttgttgggtttggcccccagccctttacaagggagggtggttttccccccccttaccccccgcccccccctgtttttggtccccctgggtttaaaatgggtgaaggggtttttggccgcttgctttttttgcccctgtttccgttgtttccctcccctgttaaaaaataaaaatgccccgggggga

SEQ ID NO: 509956 - DNA, 237 bp, Homo sapiens
gactgacgagtctgtgaagagtaatgtttacaaattacaacatttctctgtgttaaagtgtggttgatggaaatcctcaacctgtcaggtctgattagagattaagctgaatctggccaggtgtggtggctcacgccggtaatcccagcaccttgagaggccaaggtgagcagatcgcctgaggccaggagccagagaccagcccggccaagactgcgaaactccatccccacggct

SEQ ID NO: 509957 - DNA, 104 bp, Homo sapiens
tagagtcaattcgtgatagtggtacactggataagttgcgttggcttgcagtgattgtagaggggtaggagtcaggtagttggtattacggaggggagttagtt

SEQ ID NO: 509958 - DNA, 635 bp, Homo sapiens
acattctgatcagtgaatttggttgtatgatttattctttagtgaaggtcttgaaattttatttgtgttctagtatggggtcactttatataggtagttggttatcatttacaaatgtagaattctttggcatagaattgagtactttgttcatcactaaatctagcttatgttttatttacgttattcaagttctttatggtctctttttttttttaaatctgctttatctggtaaattctggttctaattttgtcaatttcatttttctaacagttcttgatatatgtactttatgtatggtcaaggtttttttactattatcatcttgaaatagtatttttttttcttatattttgtttcctgttcgttgtgctgcttttctttccttttttttttttgtaatttagaagttccttattgtcaagaatcctttgttatgctcctctctgccttttaaatttaacgatattttcattttcagcaactgtaattaactgtagttttttactgctcttatttctgacccattcatggtatactgtcacttcccttttttaattgattctgcgtcattcttgtttgctttagtggtttctcacttttcatacatacttttatctttggtttcggcc

SEQ ID NO: 509959 - DNA, 257 bp, Homo sapiens
actgcacgagagcagacgtaacgcgattataatcgtgactgtgaatctcacacaatgtaggctataaggctagaggactaaaggtgccagggacctgggaaatcttaacccggctgtgcacagaccttgagaacacatgatgccaatatcgagcaggctggaaaggacccttagagagctcttgtgggaaacaggctttccggacaatattgcaccccgcgctctattatccacatatccggagcatactctggcgg

SEQ ID NO: 509960 - DNA, 163 bp, Homo sapiens
tgagagtgatctagagtatccccctatctgacccactgcgaccctacgtctataagggctatcgtaggttttctgcggtagaatatgtagcccatgtcttgctacctcaagggctacaccttgaactaacgtctttacatgtgtacttgcgcttactttgtaa

SEQ ID NO: 509961 - DNA, 105 bp, Homo sapiens
gcagcaacagaaaaaggcaaacgagaagaaagaggaacccaagtagctatgtggcttcgtgtcaaccactcttgccctatcgcctgtgtgccatggagccagtcc

SEQ ID NO: 509962 - DNA, 151 bp, Homo sapiens
caccgtctactcagaaataaccaactttatggggttccgttgtgaacatttaatctcaggcaataaagtacttcacacttgtgaatgcccagaaaatgtcagcaattatcatcatctcccccttgctagggaaaagttgacaaaatgtaac

SEQ ID NO: 509963 - DNA, 101 bp, Homo sapiens
tgacctgcccggcgagtaacggaacttaattttttagtacatttacacgttgtttaaaacgttcagtgagcattacagaaatagacacgtgtgtccaacgt

SEQ ID NO: 509964 - DNA, 317 bp, Homo sapiens
aggatcaccgttgtcggtgcaaactcagccaaattaaatatctacaaaatgctccttatgatggagcttgacctggcagccccagttagctcctacctactggccttaaaatttgtgaatgtactgatccctatcagataaaaatgttgaatggcaattttgtatttcatacatcctcactctaaataaaattatgtccatttctactctgtgcctttgatcacatttcattttccttctggaatgccctctcttctttcacctatccaatttcactgtggccttaaggcctagcccagtgctttctggacctgccc

SEQ ID NO: 509965 - DNA, 440 bp, Homo sapiens
  misc_feature (5)..(6): n is a, c, g, or t
  misc_feature (25)..(25): n is a, c, g, or t
  misc_feature (60)..(60): n is a, c, g, or t
  misc_feature (73)..(73): n is a, c, g, or t
  misc_feature (75)..(75): n is a, c, g, or t
  misc_feature (102)..(102): n is a, c, g, or t
  misc_feature (104)..(104): n is a, c, g, or t
  misc_feature (131)..(131): n is a, c, g, or t
  misc_feature (133)..(133): n is a, c, g, or t
  misc_feature (165)..(165): n is a, c, g, or t
  misc_feature (179)..(179): n is a, c, g, or t
  misc_feature (186)..(186): n is a, c, g, or t
  misc_feature (224)..(224): n is a, c, g, or t
  misc_feature (238)..(238): n is a, c, g, or t
  misc_feature (274)..(274): n is a, c, g, or t
  misc_feature (359)..(359): n is a, c, g, or t
  misc_feature (361)..(361): n is a, c, g, or t
  misc_feature (381)..(381): n is a, c, g, or t
  misc_feature (421)..(421): n is a, c, g, or t
  misc_feature (425)..(425): n is a, c, g, or t
cagtnnattcaggggggtcagttangtgacggattctgttgtggtttgaatgcagtaccngtgttctcttcgngnaaagtagacctgggtcactgtagcatngncttggattcttcagatggttgctgtanantttctcttttctttcctgggacttgttccatnaaatgagagtaatnaaaagcncttgtaaatgagggcatacaagcatttgcaaaaaatantcaaatagaggctnacagcggcataagctggactttgtcgccactagatnacaagatgttataactaagttaaaccacatctgtgtatctcaagggacttaattcagctgtctgtagtgaataaaagtgggaaantntcaaaagtttctcctgctgnaaataaggtataatttgtattttgcagacaattcagtaangttnctggctttcttagtt

SEQ ID NO: 509966 - DNA, 343 bp, Homo sapiens
ggggggggggggggggggggggggggggtttaaaacccaagcctttttttttccccccccctcttccggggggcccccccccccggtttttttcccccccaaaaaaccccgggggccccccccccccccggttttttcccgggggggggggggggggccctttttcccccgggggcccgtttgcccccttgggcccttttgggggcccccccaaaccaatttttttcaaaaaaaggggggggggggggcggggtttccccggggtttttgccccccccgggggggggggggttttttttggcccccggtttttttttttgaaaaaattgtttccccccttcca

SEQ ID NO: 509967 - DNA, 855 bp, Homo sapiens
  misc_feature (612)..(612): n is a, c, g, or t
agacgtgctgtgttgtgatcacgtgggcaggtccgggcgcggcgctggtttggtttccttctaacttgccccacggaagcttcggggtgagcgagttttcctgctaccagctgccgcgcctgctcacatcctgacctcggtttgcgggctctctgagactccgcatgtgtccgcagagcccctggggctgggctccatgcgcatgcctgttatgctccggtacatgggaaggtggtcatcctcgggataccgctgtgtagggagagacatgctttggtcaacatcaattcgtggaacggcgagtgtctcgaaaggctacgatcctacagtggagaatacttacagtgagatagtgactcttggcgaaagattgacgtttgcaccatagcatcatggtggagcacagcagggggaggactgagtacagcatgctgccctatgtcattcatcatttggggtccatggttatgtgcttgtgtatgctgtcagcctctctgcatagcttccaacgtcgcttgagagtctgtaccaaaaagctacatgaaggccatgggaaaacccgggtggcagttggtgctagctggggaacaagggcagatctctctccagagnagagaggtacagggcaggttgaaggaaacgaagcgtggaagcagtcctggggtgccgcccttgatggaggtcctctgctcgaggagaattcaagctgactcagggatcttcccaaagtcatcagggagaatggccggtggagaagtctatgggaagaggtggcggcacactctgtgagccgggtgtggggaagcgtggtttggccgggggcaggtcacggggggaacccccccccaggggggc

SEQ ID NO: 509968 - DNA, 584 bp, Homo sapiens
tttagttttacaaaggccatttggaaaacataggtttaaaaaaaaaaaaattttatggttcacaagggattgggaatgagtgtcccacccccgctaatattaaattcttccctggtcccagttgttcacatttggctaacaaggtccttgattgtcacagtattttcaataaatgagctattatgaactgcctggtgatattttcagcaagagcaactaaaatgtgtatggcctgtgctatatagccatggaggagatgggactgtgctaaagccagccagaaatgtggatggcagtgtgggaacccagcagctccatagccatcaaaaaacggtcatagaaagaagtctctcaagggcctattcttggattcagtgttccctcagaagcaatcctttaaatgtaaatagtgaatacttgcatgtctttggacaaaagctgagctacaatctattaaaatgcacaatttttgataaaatataaagtgccctctaacaaaatgtggtggaaggtgtgtgttaagaatactatacctgtttaacaataccatatgctaaataaaaatagtttggaattaaaaaaaa

SEQ ID NO: 509969 - DNA, 171 bp, Homo sapiens
cgaatcttgaagaaccccggcttgcactccggggaagaacagccccggtggcagctctttaggcctcaaaggaagaagggcgctgaaggtctgcggtttggttacattaacttttcatttcatgggggcctccttatcttccttttgcaccttcactattaccaaaccctc

SEQ ID NO: 509970 - DNA, 101 bp, Homo sapiens
agtcatgctcggctcccaaagtgctggattacaggcgtgagccacatgcccagctcactcagcttcttaggcctgataactatccattaactcttaagtat

SEQ ID NO: 509971 - DNA, 368 bp, Homo sapiens
  misc_feature (262)..(262): n is a, c, g, or t
cacagctctggcacagagaagtgggtaacctttatttgccttctatttcactagagctcggcctattgcacgggtgttgcatcgcttgaagcacacaccagtgaggttgctcatcggcttaaagcattgggagacgcatttgaagatcatgttaaattagtgaatgaagttactgatgttgcaacaacatgtgtggctgatgcgtcagctgaagattgagacagatcactgcataccctttttggagacaaattatgcacangcggaacactacgtgaaacctatggtgtgcctgactgaagtgcagaacaagatcctgagagatatggatgcttcttgcaacacatagatgacgaccctccttcccg

SEQ ID NO: 509972 - DNA, 884 bp, Homo sapiens
gagaccacctgttatgcccaccttggttatcatcacccgatgaggtatccagcaagaacgcctgaactgcaggcgcaatacgttccctattctacattcctagtaggctcgcctttcccagtactgatctgcactaatttaaactcacaagaaccctaaggcatcatataaagtattcatacttacgtacactcctcgagagtggccgaaagaaacgtatcgaaaatctctgtgccagacaatctataactattgaacctagactctgacacacataggctctttactgacgtccccatgtatacctcttatgaacggaggtccacttaatgagtcccttaaagctcaatgtcgataggcgcccacatacgtgtgtggctcgaaatagttactgtgtccgcaagaactactggaggaactagagcggctatgtgtataacatacgtcctccacattcattctaaaaacccacgtgagaaacatgccacaatacgtctacggcctgtccttgtacatgaatccactacttggagggcaggaaagtccataactacggctttcaatccatggtcaaactgaaaaaagaaggatctctagaaatccgttgcaaattggaataactaccttccaacagtccatgccacacattacgcaccgtcggttagtacacgcaaggcgcatttactgccatccaaaaagcccctaggaagggcattacaaccccgcgggcaggacaattacctcccactgaatccgcgcccacgtgacgcttttatcagtccctgccaattactaattgcttggcttaggccaaattggccatctaacgataagcctcccaaagacggattcaagaatcctcgcccgagggaatccaatattac

SEQ ID NO: 509973 - DNA, 367 bp, Homo sapiens
aggaaaaaggaccttcctagaggagggactctctccaactttgctcatgctggccctaagcaatctccaaaaatacatcgttaaaagccaaagtggaaaaaaaaccgcactattttccacttacaacaccctaggctcaccaaacattctactactcactctcactgcccgggagctataaaactcctgagccaacaacggaatatgtcttgcttactcaatagcaaaaatagtatagatacctgtgtacgggctccacttatgactccctacagcccatgtggaagcccccatcgctggatcactagtactcgccggagtactcccaccactaggcggctagtggataaccctcctcacactcctt

SEQ ID NO: 509974 - DNA, 448 bp, Homo sapiens
caattcatctcgatactccaatcggtcacatctccagggaggactcacctcccgtggcacaaaagggcaaacgctcgcttgatctttccatattacattagctgaataagaccgtgcaaagcggggtctcgcgataccttctgacctataccgggttgtcaacgcaggatgtgtcagaaaagttaccacagggcattactggctcgtggccgtcacgcgttcatatcgacgtcgctttttgatcattcgatgtcggctcttcctatcattgtgaagcagaattcaccaagcgttggattgttcacccactaatagggaacgtgagctgggattagaccgtcgtgagacaggttagttttaccctactgatgatgtgttgttgccatggtaatcctgctcagtacgagaggaaccgcaggttcagacatttggtgtatgtgcttggctg

SEQ ID NO: 509975 - DNA, 188 bp, Homo sapiens
ctaccccccataaaggccctagaggcatattttttttttaagacggtctcaatctgttgcccaggctgtattgcagtgtacagatcatgggttcactgcagccatgatttcctcaggctcacctgatcctcccacctcagcctcccaagtaactggaactgcaggtatgcgccaccatgcctggctaa

SEQ ID NO: 509976 - DNA, 684 bp, Homo sapiens
tattcctgctctgaagatgtggatacagaattagtcactcttgtcactttatttatttattggttttttttttaccatctgtgtacattcctttcatagggtagagttctagttctagaagttcttatttggttttggttggtaatgtttggaatactatttaatatccggttttaatattgctggattggctaccttgggttactgtgtgcagtgttaaaagtaatccactttctggtttaatataccagatacatagcaaaagcagctgtggaataattatagctgtttattgggctgtgctcagcttactatattaagatctggtcctgtgtaacagtaactcttttttggctcttccagctcaatttaatatgttcacttaacaaaatacgaacttggagatgcactaaagttctggttctcagcaggtggctcaaaaaattcacagaaattactttcgtaacattcattggcaattaatggtgtcttttatcttacaagtcgtcttaagaccgtgtgatctttcattctccccagctaaagagttccttcaaataacatttacaggaacatacccaaaaaaacaaaccacaccaacccgcccacacccccacacacttttgcgggccgcgcctcgggcccccgcggacaaagctctccttaacaacccatcacgcgagg

SEQ ID NO: 509977 - DNA, 304 bp, Homo sapiens
aattatgagtgcgtattataccatcgcgcgcctagctcttcatgagtactgcggctagtactattgacccagcgataggcgcgtcgacatgggctttagaggagtcataattggagcccgtaaagaggtatctttactataaacgctattgtgtaagctcgtcataccgaagctcgtcataccgaagctcgtcataccgaagctcgtcataccgaagctcgtaataccgaagctcgtcattccaagctcgtcataccgaagctcgtacataccgaagctcgtcataccgaagctcgtcataccg

SEQ ID NO: 509978 - DNA, 212 bp, Homo sapiens
gtgaggtgactctaaggatccctgtgctcagtgatcctccctgccctcagtctcccgagcagctgggattgcaggcgcccgccacacacatggctaatttttgtatttttagtagagatagggttttgccatgttggccaggttggtctcgaactcctgacttttttttttttttgaaaaaaaattttgcttttgtgccccgggtggaataa

SEQ ID NO: 509979 - DNA, 146 bp, Homo sapiens
ctcaccagtcttggtgtttatgttgcaaatctatcaaagtatgaaataatttgtgctgtatacaaattacatggggaacatataggagtgagatgagaaacttataaaaatcatgtttttcaaattttcaagtttttggtcgacgc

SEQ ID NO: 509980 - DNA, 288 bp, Homo sapiens
  misc_feature (82)..(82): n is a, c, g, or t
  misc_feature (104)..(104): n is a, c, g, or t
  misc_feature (282)..(282): n is a, c, g, or t
cctgtaatcctagcacttgggaggccaaggtgagcagatcccttgaggtcaggggttcgagaccagcctggccaatatggcnaaccctatctctactaaaagtntaaaaaaattagctgggtgtgggtgcacgcctgtaatccagctactcaggaggctgatgaaagagaattgcttgaacccaggaggcagaggttgcagtgagccaagatcacgctcctgcactctagcctgagactctgtcccaaaaaaaaaacaatgcggccgcaattcgagctcctnggcctt

SEQ ID NO: 509981 - DNA, 117 bp, Homo sapiens
atcagcctgaacgcctgatgcttcaccggcgcatcttctcatatcacccacgggcttacatcctcattactattctgcctagcaactctcactacgactgcctcatccgcgcttgct

SEQ ID NO: 509982 - DNA, 189 bp, Homo sapiens
  misc_feature (1)..(1): n is a, c, g, or t
ncaggtatctacagaacattttatcctaaaacaaaaggatacaccttattctcagtgccaaatggtaccttctccaaaattgaccatataattagtcacaaagtaggcctcaacagatacaaaaatattgaaattgtcccatgcatcctatcagatcaccatggactaaggctgatcttcagtcgacgc

SEQ ID NO: 509983 - DNA, 377 bp, Homo sapiens
tcgcgaacgttatccacgcgggagacaagattgagccgaggggacatagtgagaagtgaccagaagactagagtgcgagccttctgttatgcccgaacagggccaccggagggctccttggtctagcggtgatgccagcatctgggaagacgcccgtcaccaagaggatcgtggtccagcagtagcaaaaggtgtcaagaaacaacacccgctacttagcagaccgggaaagccggcggcggggggggggcctttccccgggggagtttagagaagactctgctcctccacctcttgtggagggcctgacatcagtcaggctcgcccgcagttatccggaggcctaaccgtctccctgtggataacacgttcgcgag

SEQ ID NO: 509984 - DNA, 112 bp, Homo sapiens
ctctgatccagtctgtgagttcaatctacaggcccagatgttggccaggcatggtggctcacacgtgtgattccagcactttgggaggccagggcgggcggatcatgaggtc

SEQ ID NO: 509985 - DNA, 841 bp, Homo sapiens
  misc_feature (4)..(4): n is a, c, g, or t
  misc_feature (68)..(68): n is a, c, g, or t
  misc_feature (151)..(151): n is a, c, g, or t
  misc_feature (162)..(162): n is a, c, g, or t
  misc_feature (197)..(197): n is a, c, g, or t
  misc_feature (292)..(292): n is a, c, g, or t
  misc_feature (401)..(401): n is a, c, g, or t
  misc_feature (404)..(404): n is a, c, g, or t
  misc_feature (423)..(423): n is a, c, g, or t
  misc_feature (511)..(511): n is a, c, g, or t
  misc_feature (624)..(625): n is a, c, g, or t
  misc_feature (633)..(633): n is a, c, g, or t
  misc_feature (665)..(665): n is a, c, g, or t
  misc_feature (674)..(674): n is a, c, g, or t
  misc_feature (700)..(700): n is a, c, g, or t
  misc_feature (724)..(724): n is a, c, g, or t
  misc_feature (735)..(735): n is a, c, g, or t
  misc_feature (754)..(754): n is a, c, g, or t
  misc_feature (766)..(766): n is a, c, g, or t
  misc_feature (841)..(841): n is a, c, g, or t
cggntgcccaacacgcagccaggctgcaagggcgggcccagaaactgctcccggggtaaactcggaancggagctcccagaaggcggattctaaggcgacatacccacagggcaagccacagaataagcagtaagggattagttaagaagngcttaagcccnaccccggagcgcaagaggggaggggaaaaggaggngggaaagaggttagaggagacagaaaacaaagcccagctcttccaagctcacgcacctagccaagggcgtcgaattccggagggaacccaggacnggaggcggggcggaaggaaggcagcattcccgggagggtccaagttctgggcagggggacagagctgttgcgggggtggggggggggggaagggagaggctccagagcnacnttcattcacataatcaacnattctccctcccacttgcatgttcaacacaccaatcctgacccagccagccccccatcaccgagtactgctgccgccgccgaaccccncccccccaaaaccacctgcccactgtccaccggcatccagccccccctccagccacacccacacacactcatccccttcctcacaatgaccgcacccaaaagacactgtactnnggaaccgncttcgtcactcggatgttaactaaaggcccangggaatatnctggaaaaggtccccccacccccaanaccaaggaccctaggttttccttnccctggagggngccagacagaggaacaggngagagggtgganatggggtaacagtccacatgtcttcaatcctcaaaaaaaaaacccctacatacaactctcagaacatcaaataan

SEQ ID NO: 509986 - DNA, 246 bp, Homo sapiens
tccccgtccccttcctctgttctcttctttctcctcttcttcttctcgtttctttttgggataagatctcaccctgtcatccaggctggagtgaagaggcacgatcaaggctcactgcagccttgaccttctgggaggatcgcttgagcctaggagtttgaggctgtagtgagttatgatcataccactgcactccagcctggcaataatatctcatctcttaaaacccaaaaaaaccaaaaaaaa

SEQ ID NO: 509987 - DNA, 810 bp, Homo sapiens
aacattttaacaagatccccagtgattcacttgcttattaaagtttgagaaacgttgcttttggctctcctctgaggagtggggggcctagcagatgtgcccatctggagcccaagccagtgcttctagagcatgcttcaggtaaacaggactatggaattttccagatggctctgagagagattttcctagtaactgcttgaacttctctgggtctgttctcctgaaaggagacagttttactgggtgcgcacagctctgtgttgaaggggtggccaagagggaagctgtttgtgatggggatagggtaggaagggttggaacttgtacctatggggccaggatgtacacacacacacacgcacacacacacacactagcacatgaggctactggtgtaagacagggttgggggtaggaagagaagagagtagtttgtggctgggatttctatttgtaccgttgcccctgggctccaaaatagttagggggcaaactaacagagatactcttttccagtctttctggtggaattttgctagagattgattgcattgaatttatagatcaatgtgaaaagaatagctatcttgacaatattgagtctttcaatccatgaatatgaaatgtctttccatttaggtcttcttcaatttttttcaatgatgttttatagttgtcagttgtaaactcttgtatttcttctgtatttcattctcttcaccgtcattgtgaaggaaatgttttcttaatttccatttatgattgtttattattacatagaaatacaattaatttttgtctattgaa

SEQ ID NO: 509988 - DNA, 479 bp, Homo sapiens
  misc_feature (73)..(73): n is a, c, g, or t
tgcccatgttttcagaacagggaactttagatctaaaagattggaaaaaattggcaaagaattaaaacaagcnaatagggaaggtaaaatcatcccacttacagtatggaatgattgggccattattaaagcaactttagaaccatttcaaacaggagaagatattgtttcagtttctgatgcccctaaaagctgtgtaacagattgtgaagaagaggcagggacagaatcccagcaaggaacggaaagttcacattgtaaatatgtagcagagtctgtaatggctcagtcaacgcaaaatgttgactacagtcaattacaggagataatataccctgaatcatcaaaattgggggaaggaggtccagaatcattggggccatcagagcctaaaccacgatcgccatcaactcctcctcccgtggttcagatgcctgtaacaatttcagttttcgcagaacattcaggtattaaaagga

SEQ ID NO: 509989 - DNA, 1053 bp, Homo sapiens
agatttcccctacgccgggctcactctcctttgggttttgcctctcagggcgctactccctccgtggtgttgacgtaaatgtgcccacggtttgtctggtcttcgtgttcttctgtgtctttcccggtctgtctttgctacaacgtcgcttgcttcgtatgggttgttgtatctgtgttgggtttggcccatggctttcctccttcgtttctctgaagggaagtatggtcacccctcggccttgtcactgcgggggggggtcccccactgcgattgactaccactcattgatgtggtccccttgtcgtggcactgttttctcagtaacctcatctgccttgtgcaatcgtggggcattcttccctccaagcgtaaacgaggtattgttgtttgatgaccattttgttaacgtgccatgcgtcaatccctttatggtgaagtaactgccctgtactgcctggcgttcgatctacgtgactaaagagactttggtgcacactgtgatcctatcgctgtgtcctctgggttcactaattctgaatacgactgctctccttggaaagcctatttcccaacgtcgtgagcgcccacatccagatcttgtagtgactgattcaagaagacttggatgaagcgtgagatgtgaagagatgtctccgcttgcgtcagggccctcactggggacgcccccgcttccaggcgctcgctccaggaccttcatcaccaagatgacttgctccgctgtgacctgcttccccagtctttttctgaataaactacaatactctatgggtgggaaaagctctgtagtctgagcaacgggtcatatttgatgctactaggacgcgttattcgatctcgtatcttagccatgttcagatatctaagggagctaggaagctcatgggggcttctgtagcccctctcaataaggagtcttgattctgagaaatttgaccgtctagaaacctcagttaaatccccacgaaggacttttaatgaagagggccgcaagccccaaatgggaaaactgtttttagaaaataggagata

SEQ ID NO: 509990 - DNA, 804 bp, Homo sapiens
  misc_feature (545)..(545): n is a, c, g, or t
  misc_feature (610)..(610): n is a, c, g, or t
ggcagttcggtggtcccgtgggctctgtctcttgcgtatcaacagtgttaggtacggagacagatccggggtactctcttccagcctccgaccgtcctccgatttcctctccgcattgcatagccttccgggaccattcattctctggtccatctcctgtcttctggtgaaccatgccaagcaccgtatattatgctgggtgtagcatccttccttgccagccaaaccatgagacatcccaagaattcgtcatgaagttattccatccgaacgtggtaggcagctcgatcaactagcctggtcaatttgtacctgcagtgcctcctaacgcctacctctcttctgggccttctaattatcgagcgctgatgattgttggcatcgtgtgataggacgatgacgccatactttcttttcgcgacgaaaccatggtccgaaggagtaaaggcgccgaaggggcctatcaatgcggtcctcctgagatgaatgcaaacataacccagtcggttggtcggcccgcgacctctcctatgccagtgtacatncacaggtaaagcccatgactgaaagtagtgatgtgggcgcgatgatacatcgcctctaggaacgngccatggagatagcgtggcctgattggtcttcaccttggagaggacataagagacttgaagacactatgggcaccctttttttgaggatcctttcagtggccccgtggcgatttcatagtcgctcgtcctacgggaaacctcgccaattgcctcctgattgatctttcccttgggaagaacttctagcttttcc

SEQ ID NO: 509991 - DNA, 381 bp, Homo sapiens
cgaaaggagatccgtaatatccttatgtgatattggatgttgcacacaggaacttcctggatgattcacaatgaggtgagatcattctaccatgctggcatgacaaactcctctcgttcctatgaactcttctctaaagcaggtcacagggaaaaaaagggtttaaagagaaataacttctccgggcaaaaactgaggttagcgggcctatcagctgtttcttctcactccaccactgctgctgactggaggagcagcctggaaagcagccgccctcccgcaaacaggtaaaccacattacctattcctgtggcggaggcaaatggatggtcaaacctaacggggtagtgctgaagttcggggacaaaagcccatcgggga

SEQ ID NO: 509992 - DNA, 757 bp, Homo sapiens
tagagagctgctctatggagtagcttatgtttctcctgtaataaacttgcattcactttactctgaattagccttccattcttgaacaagatccaagaaccctctcttggggtctggattgggacccatttccagtaacatcttcctggcaaaccaccaagggcacaaccactggcagcaaccccgacccaaaagaatagactgcagcactacattggccaaactttgccactacggcaacatgcaccattcagcaccaaacaagcaaaatcttgcagcggcatttctcgtaatccaaacgttcagacacatggagtccatcaacagccagtgcgcagaaccaaattacggccaacccatacgcaccacatagccacttcccgcgacgccaagggacaccttcgcttcccatgcgacactaggaccaagtagcgccacaccggccagtgcggacatccacaccccacacgcatacacagcggccaaacccgccgacagccaccacaacccacgccccactcgggcaaacgcaactggaacgcgcaaggacaaacagcgcatagaggacccacggacacccaagataccaaggaacacagagcataacgaaccccacaaaccggaaacaccaaccgcgacatggcaacacccaggcaccaggaaatccacgggcatacgccacacggggccgccaggcagaatacgacagataccagtacaaaacgcccaacacgccctagtacacacacccgcgcac

SEQ ID NO: 509993 - DNA, 774 bp, Homo sapiens
ccacctactgttcaaatcctactgattaagaacaatcattgatcgatttttcctgggacataaattaggctttttcctgaagcgtggacaagaaataaataatcggatgtcaaagaatgaagatggctgtgttttatgcaggaaaatgtttatgcagttgccatggaaaacaaacatgtaggctattcaaaaacaggagcttatgatatctcgtgtattggtccaaattataatatcaagaatatgcagtggcattcattctggtacctgggttaaaatttagtctgacacatcattggttcatggtacaaatatgctctctgcttatagtatattggggcttaatatttggcaagatatctagcacatacagctggttgccagtgtttttaaaatcatatagttgaaggcacagaaataaactaggggaaagcatttctcagcaaataattcctgaaagatagacagcacaatcacatgggtgactttcataattaacaggggtaattaatttttgcttaatgtgaaaacaatattccacaatgtggggccttagttaattgtgtaccaggctaaattgtgagtgatgtcaaatgtgaatatgcatagtggatagttcttaatttaatatatgtgattccattcataagtagagaaggacaataggcgggttctgactggaggttatacttcctgttggacagacataagttggattcaattcatgtgtaataagggaggatggatgaatttcaaaaaagcaaatggatgaga

SEQ ID NO: 509994 - DNA, 645 bp, Homo sapiens
agggcggcattatcggacgggcgccgagaaggcgctgtttgttagcgagcagctcctgaccggactgaccagactttgggagaagtgccggacgccccccagcgagtatattattttgaagaagcctgacggtcgaaccaaacccattccaaagaaaggtactgcggagggctttgagcccgcagacaacaagggtccgttaagagctaccgatgggaagaagaaaatcaccactgtggggagctccaaggaagcgaataagctgcaaatggctcattcaaacctccctagagctaacatggacgggccgaagaagagagacaaaaggacaaaactaagaagaccaaagcagcaggagcagcacagcagcagccacctggcgcaacaaccacagcagcaacaacaagcagcaccaacagcagcaacagcagcacaggaaagggcaaacatcccctgccttcaccaataaaccactgaatggctattcttctctttgcgccacaaagcatggctactgggtcccccaaagagggggattcacacaagaccaagggcccctcggaaagaaaaggtgcaccggttccgcgccgaacgggcactacacaccccgggacaacagaataacaaggccccgaagaccacacc

SEQ ID NO: 509995 - DNA, 945 bp, Homo sapiens
  misc_feature (36)..(37): n is a, c, g, or t
  misc_feature (41)..(41): n is a, c, g, or t
  misc_feature (44)..(44): n is a, c, g, or t
  misc_feature (47)..(47): n is a, c, g, or t
  misc_feature (51)..(52): n is a, c, g, or t
  misc_feature (55)..(56): n is a, c, g, or t
  misc_feature (61)..(61): n is a, c, g, or t
  misc_feature (63)..(63): n is a, c, g, or t
  misc_feature (80)..(80): n is a, c, g, or t
  misc_feature (83)..(83): n is a, c, g, or t
  misc_feature (105)..(105): n is a, c, g, or t
  misc_feature (114)..(114): n is a, c, g, or t
  misc_feature (151)..(151): n is a, c, g, or t
  misc_feature (153)..(153): n is a, c, g, or t
  misc_feature (173)..(173): n is a, c, g, or t
  misc_feature (183)..(183): n is a, c, g, or t
  misc_feature (186)..(186): n is a, c, g, or t
  misc_feature (188)..(188): n is a, c, g, or t
  misc_feature (215)..(215): n is a, c, g, or t
  misc_feature (220)..(220): n is a, c, g, or t
  misc_feature (222)..(223): n is a, c, g, or t
  misc_feature (244)..(244): n is a, c, g, or t
  misc_feature (270)..(270): n is a, c, g, or t
  misc_feature (288)..(288): n is a, c, g, or t
  misc_feature (330)..(330): n is a, c, g, or t
  misc_feature (377)..(377): n is a, c, g, or t
  misc_feature (482)..(482): n is a, c, g, or t
gtattgcacacgcgcgtcttcacgaggtgcaaacannatgnagnatncggnntcnnctcgntngcttctgcagccgctantgnaacctccacctcgatccagcgncccgaaganggaagcagctggataaagaacaggttagaaaggcagngnacgctctcttgacgcatgcnagtccagganaancnattatgggttgctttgaatgagaatgnagtantnnagtggtggtatatggaaaatnccaagtaaagaactgagggtcagatngaccttgctcatagtatncgatcagattcagaagatatctgtcatttacgaaggatgaanccaattcaactcctgaaaagacagaacagtttatagaaagcttttanacaagcatggaattaaaaccgttctcagattatctccctccaaactctaaagaaggaatataaatcctatgaagccaagctccgccttctgagcagttttgattncttccttactgatgccagaattaggcggtcttaccctcactcattgggagacatttctatcaaagcaaagaaagtccagtatctgtaaaccttctgtccaagaaattatcacgagagatcactgactgtataggtggaacggcttaaccattctaaagtggtctgcagtgctatacgtatggtcccgttggatgccacatttgcgccctcatttgaaaaccttgttgctgtccccaaggactttcgaaaaattggccagaagtggggagcgtgaactcctgttgggaacacgtgaactcgcgggcctccactttctccgttggcccattgggtgagcccccagatttggtattataggaaacacaggggacacagaccacatttgaccacgcgacgaaaacgaaggagacacctaaaaatgcggaggggcaactacaaagcctgaaatggacaaaaacacacg

SEQ ID NO: 509996 - DNA, 393 bp, Homo sapiens
aaataatgaaaatcagccattttagaattctggcaattaagcaggagtatgaattgaaaatcatctgtccaagagaaaactagtgaatcttgggaagaccagtggggtctgcgatattttaacttggggttattctcatctctctctccagcttagtggtgtagctaaaagctggcagtattgcagacaatggagagagctgaccacttctggagccccattgaaggcactatccccagagcacagttaatattttgtcccaacttgcagctccctgggaaaactcttttcagagagagtggctggatatttgatttgactctgaactcagctcagttgggggaagaaaaagcttacccccagggcattactgaacaatagcaaacttgtttg

SEQ ID NO: 509997 - DNA, 490 bp, Homo sapiens
  misc_feature (32)..(32): n is a, c, g, or t
gcagtccacagaaactaaaaatataatcttcntgcatctttctgtcttggagctggccataaagaaattctctgacccatcttgcctgattgtaggtcataagacctccccgttttagaaggtgtcctataccataccctgggggaaagaacgctgcacagagaggccaggaaggatctgaacagacaggccttgctgcgtttccccactcagactgttagtattacatcatactctttttgtccagtctcatttctacacagttgtccatgctttagtcatgcctatccaatgaagtctccatagaaggcccaagaggagcttccagataggtgaacaattggaggttcctggagggtgtcacacccggggaggccacagaggctccataccctttcccacatacctcaccctatgcgtctcttcttctgtatcctttgtactatccttataataaactgggaaatgtgtttccctgcgttctgtgagc

SEQ ID NO: 509998 - DNA, 270 bp, Homo sapiens
  misc_feature (13)..(13): n is a, c, g, or t
ccccttttttttncccccccttttccccgggggccccccccccccgtttttttccccctttaaaaaacccgggggggccccccccccccggttttttttttgggggggggggggggttttttttttccccggggacaccttttgcccccgggccctttttgggggccccttttaccccttttttttccaaaaaggggggggggggggggggggttttcccgggtttttttcccccccccgccccggggtttttttttttttttctctcta

SEQ ID NO: 509999 - DNA, 628 bp, Homo sapiens
gccttatagaaacagttgtagtgcttttgcttagtactttgtgaggttttgaagataggagaaaagaacctattgcttgacatttaaaagatgagctgtcctgagttacagcactggctgccatggttggtttatgatgtagttgttgttgtttgttagtatattgtttaacaaaggtatatcgcacatgggccaatgaagaaaaaattagtttctcagactccactgctttttccaagactaggcaataatcagatgacaggtcatagtgatgatagccgctagtgctccttggcactccatgttggggaggccctgtgctgatgctacaggcactaaaagtaagacccattttctgccttacagaattttctaggcatagttacaataagggacattaatacgcttccctgtcacctatattcactggccccatgtctacccactgggaatcgaatgaaacaaatcaagttataacaagtgtaagctctttgaagtatttaaacataagctatcaagaacccaggtctccaacacacttacttattaacatactagggaactccagccatctaagtaaggtatggttcatgtctcctcctagtaggtcacgttgctttgaaactct

SEQ ID NO: 510000 - DNA, 268 bp, Homo sapiens
atcctcgtcatgccatggcttccccgcattccggtccggcgcaggcaaactggcaccccgggcgagtgcggcatgcgcttcgggcaagaagatatcacaagagacaggttcaggataaatatccccccggatattgacttgaccgtagccgccgcgccacgatctgtacagttggttaaccaatctgccgcagcatttattgcctttttcaagaactctttgatttgacagccgtaatgccgttcggggcctgcaaggatattggcat

SEQ ID NO: 510001 - DNA, 696 bp, Homo sapiens
cctttccgaaggtgtctggacaactttgtaaacatcgttgacgtaaacagtatagaatgtcttaacctctccaggattgcgtccacgtaactgacattctgtttatcattactctggttctgactaaagtgaattttgacatggacatgtcatgtcatgtcatacccacacaagggtctaggtctatgctaagcctttgctctctaaagcattccaccttgagagacgttttcactctgtaatgtctggcacaacttttgtaaaaatattagctgtgaaatttttctgtgatcgctttttttttttctcctcagtaagcataatatttatccttctaaaaaagtatccaaagctccttaggatggttcacctttctctttctctctagtcctggtgttactttgcttccaacacttttccctctcaataatacaggtgcttccactgaaagaccacttttcagcaaggactggctctgaaattgacacctggattctatggcctttccctccactttgggaagctcttaagtcagacaggtactgtaggcgccaggagaaaaaagctaattattacttgtgggagtctcgtctcaggcatgctgtggggctgtgcaagattcgctgctctgctgctgtagtcatctggatgctacaattacagagaggcggttcagcacccagccgatcggtgtgg

SEQ ID NO: 510002 - DNA, 942 bp, Homo sapiens
acatcactcgagacgtaaattatggctgaatcatccggtagcttcacgccaatggcgcctcaatattctttatctgcctcttcctacggcatcgggcgaggtcgctatattacggatgcatttctctatccgtcagaaggacctgagagacatcggcattatcctccgtggcttgcaactaagtagcaaccgagccgttcagtaggctatgtcctccactatgaggccagaatatcattgctgaggggccacgagttcaattagcaagactatacttatccgccatcccatacagtgggacagacgctagttcaatgaatctagaggaggcggtactcagtagacagtgcccacacctcacacgatttgctttacctttgcactatcatgcttgcccattacactgtgaatatggcagcctcgcataaggcagagcgaactccatccattccgtaatgtgcttggcgacgacataccgggaatcgaagagcgaaacgcgccgctagtgcaagtcgacctaccgccagtgtgccgatgaaagatcaccttcgcacccttgactacagaatcaaaggacgccctcggacttacttctcttccttctctccttaatgacgttgaacagctattctcagcagacactgctaggcgaccagacaattgtacccctagtccgagccctgtgaaacgagcccgcctccacgatcaagccgaatgatattgcgctattcggctacacaattcgtcggatccggtccctaacaaactgaggagggcgtccttgccctattatatcatcctcatctagcaatatgcccatgctccaattattcaacaaaaggttaatatttcgccataaagcaacaattttatgtgccctagccgagactctcatttaactgaatcggggcaccaggagctacctttccaccttggcacgtc

SEQ ID NO: 510003 - DNA, 307 bp, Homo sapiens
agcatttcctgtaggtcgtctctagcaggtatcccctgtcatttcccgggtacggactatcagatcaccgtcaatgggtaccgttctcagctccagtggaacccggtttgctgtgaactttcagactggcttccgctggaaatgacattgccttccacttcaaccctcggtttgaagatagagggtacgtggtgtgcaccacgaggcagaacgcgagctggggagaccaacaagaaggaaaaacacacattcctttccagaaagggatgccctttgacctctgcttcctggtgcagagctcccactt

SEQ ID NO: 510004 - DNA, 346 bp, Homo sapiens
  misc_feature (74)..(74): n is a, c, g, or t
  misc_feature (76)..(76): n is a, c, g, or t
  misc_feature (111)..(111): n is a, c, g, or t
ctatgggccggctgccacttcatccacaacgcggacgagcggcgccccgccgtcggggggcgctaccggggtancnctctttggcacggcgatgcgttgcacctgggcatnttcgggagccgcggcccaagctgcaccacagcctcagcttctcgggcttcccgtcgggccaccatcatcccccgggcggcctcgagtcgccgctgctgctcgacagcccacacgtcgcgcacgccgccgccgccctcctgctcttcggcctcgtcctgctcctcctccgcctcctcctgttctcacctccgcggcctccaccccgggcgccccgacatgctgctccgcggcggcc

SEQ ID NO: 510005 - DNA, 722 bp, Homo sapiens
gattcccttgctcttttgatccctccaggctcgctccttcaggctcctcctccctcatctgttccctgatgtcacattccctgtgcaatcttcccttgcccgtggtctgtgctatctctttcctatgtgggttttctttgtcttccccaagggtgagtgtcccaggttttatctcgctccgtgcagactgatgccagatacccaaatctaatctgatttacaaggtccaacgaagctgatgggggagcgtggggcttaccctgttatgtttggaggggccaccagtgggggtgccagagaccactgggtatctgagaccccaggggatggaaattggcaggtgaagtctgattggggctgagaagttctgatcttgcacggggcgaggcgcacactcctttttttccccttggcttctcctccttctctatcccagagaaaccccttgagagccctctggctatgttcactctgggctgactccccatgtccccagatatgctggagagatgctggaacactagcgtaaccatgttgccacaacccaatggttgccagagagggaaatactagcgctctaactggcgacttccacctgaaggaagcctcgggaacacttgctcggtagaaagttatgtcaaagactgtctaacaggccccaagctcgggaatccaaaacagcgtcatggccacagtcacttggcttgggtcccctgctggaa

SEQ ID NO: 510006 - DNA, 256 bp, Homo sapiens
ggcagactggggactgtgcggtgtgtgactgctagggtgacatccgagtatgttggagaaataaaatgtgatagtggggatttacttttaagtttgtggttaggtagttgaggtctagggctgttagaacgtcctaggaaacgtgaccagagacgggctgtgacgttttacggtagacgggggacttgttgctttggaacgggggactagcgggggacaactgttgttacgtaactgacgaaactcctgcgacact

SEQ ID NO: 510007 - DNA, 859 bp, Homo sapiens
  misc_feature (262)..(262): n is a, c, g, or t
cgggctttgtatcatagcgggcgagttctaatattggaacgtctcgttgtcagattgtttgtaagtatttcccgcgcacttgttgcgacgtttgtggactgtgtattcatcccctgagcagtgcatttggacgcggaggagaggcttgatgcttctttgtgagaggggcgcgttgcgggttgcgccgccccgtggcggtggaggtagcgctattacttgtttttagacgccgcgcggggttgtcgagttggttggcgccgantggccttttctgcccgagtcgggttagctagtgcttgacgcggggttgttgttgttgctggttgtcactgttagtctcggattgattggtagaaccgtgtgtgtgggagggtctcttcctttgcctgtgacggtgtttaggtcttgtatgtgggcctatggtctcgatcctgtggcgagccggtggttgggggttgtggaaggaggggccgtgtgcttcactccggtggaacgaagatcgcaagataggtgtctagccattgttagtgtctagagcgtgggtgtcgctgctgttttcagccgtgcagagggagggtgtgtttgcgtactttggcgcccctccttttgtggcgactggcggtggggctttctttgttctgtgtggcgaagctcattagtgtgcagaatttttttctacttaagcgtggagcggtgccggtatgtctcatgctgcggcgcggaggagtcattattttatatatatgttcgtggccccgggcgggttgcgtctcccattttggttagtcttgccctctcagtgacattacaaacttgtgccagcatacaaatatgacacgtttgtctcttgaaaagagaa

SEQ ID NO: 510008 - DNA, 396 bp, Homo sapiens
taacggtcgagtcagttgaggagcagctgggacatcatcttatatttcagttggagcagtggtctagtctggtgaaggaaacagaatctctgggctgtggtaagataatccatatatgtactggtagagtaagagagaggagagtgaagataaccagtacaacagtctcacatacactaactaatgatactcccattgttcctgtgagtagtatataatcactgatgtcgttttattcatacatcctttaactgtcttcatataggtatggaaagagtcaacataaaagccacatccattttctaaatttgtgaaccaatagctttagaggggaaaaaaaaaaactaatatcttctcatattttaggtccttggcttctgtctcatgagttcccaa

SEQ ID NO: 510009 - DNA, 849 bp, Homo sapiens
atcttattagatgtcgccatgcgaggccacactcgctgagacgacgatggggaaggtgaaggtcggagtcaacgggagtatggtcgtatcgggcgcgtggtgaccaggactgcttttaactcatggtacaactggatgtcgtagccgatcaggagaccccttcagttcgatctcaagactaacattggtcttagcagtgtttccatatatgagattgcgcatcggcactgagtaagagttgccagatggccatccgctgcgacggcctgaagagaacgggaaaggcttggtcagtcacgctggggaagtccacgaatgcagccatgtcttctcagggcacggcgacgcaatagcacacctaacaccagacctaataccaaaggttccgaggcgtagcgaaattggctagagaccgaccctgggcaagctcagcgctgcgatcggggaagatccacagctaggtagcgtaactagaagcaagcgcatcccaatgggcatgaaaggggtagggagagcactacatgaggtcaggggagagcggagaaccaggagagggtgcatgatctgagtgtatgcccgtcgtggcctgaagggcccccgcaagaggtctcggtgcatatggcgctagtgagagccaacgcacgaggagtgatgaacaagacgaggccgtcggcagaatcaatctgcgcaaggaccctcgcgtgggagcgcatccgaagcatgctcttacgtcaaaacgcacatgggctggaaggtggcaatccgcagagaacaacctccggggtaatctggtggaaaaaggagctccaggaacaagcgacgtacgaatggcgggtgcaacttgggcag

SEQ ID NO: 510010 - DNA, 155 bp, Homo sapiens
  misc_feature (33)..(33): n is a, c, g, or t
  misc_feature (46)..(46): n is a, c, g, or t
  misc_feature (50)..(50): n is a, c, g, or t
  misc_feature (60)..(60): n is a, c, g, or t
gtgggggtatctatcttctccaccccctgtctnccccgctccctgncttnacctggcttntgtccatcactgggctagctactcacggttaagtgcttgcaggcccttgaaggagcttgacaagaatcccaaagccccccaagactccacgtccg

SEQ ID NO: 510011 - DNA, 422 bp, Homo sapiens
gccggcgcgcggcgtaggggactggatgtatggccatatcgtcatgccgcgattgctctgggaagattcgctgttgaacaaccgatacgcaaactgatttacgccgcctatgctaatgcctcgttatttgcgtgcgctcggcgtcccataagctgctcaactacgcacaaaatgcccgggaatatctcgacttccgctatcaggggctgacggtcgcctttgacgcgctggaactgaatattacgcgtctggaagaggacatggcgatgatgcagacgcgccagcgggtggtgagcgatgaggtgaaacatgaagttgagcaggcgctgaatgccactgcggactttatgggggcccaaaaaacagcgcttcaccaggcgattggtcacgtgtttagcgctcgcaatatccttgatttagcc

SEQ ID NO: 510012 - DNA, 405 bp, Homo sapiens
taccttgcttccaaagtgctgtgatttacaggtgtgaaccaactgtgcccagccaatagagtgctttttatttaaggtatataagttttttatttttaaattaatgttattgcacacttaataaactacagtttaggtgttttacataacttttattatgtgtactggaaaaccaaagattattgtgatatttgttgtatggtggtgatgtggaacttgcagtatctcctgggtatgtccatctggttttgtaaagtgaattatgggtagccttccccagctctttcaatttataaaaaataagtaattacttccaatgcaggtatatacaaacaataacctcaaatgtggaacaatacttgtcttagctaagcaagcagagatgtatagtttaaatagaattag

SEQ ID NO: 510013 - DNA, 1570 bp, Homo sapiens
ccacagatgggactagccaggactgagggagaaatgccctttttggcaattgttggagctggctaggtacgttttataagggagtacattttgacatgagacccttagaggcatcaggaacagatgctacttactggatgaggtagactgggagaggtggtgtaacttagcttcttgaatgatcccacatatcactgatatccactctgcattggagatataccagaacgtttaccaacaagctgtctctaagcacagactatacatcctgaagactattcacatcctgcatgcatatctcccagagcactctatctacctatgggcaggagcatgtgggtgatgcgtgatagccaacaagaattttccacgctcaactacgctatacacatgagcatacgattcacaatttccaattcacagatgggcctacaatcaccatacaccatcatagccatataagcgctcgacagggtatgcaggcaacgcacggaccttgcaaacgcaatcggacatggacccaaacggcacaacacgaataacagacggatcgaaaacggaatcccacgcatccacacggccacacgcatcatacaggagacacaacaacaactgagagcgaatggagaccaggggacacccgagactaacaccctaaaaacaacctaccaacaataaaaccaggaaacaactcaaggaccaaaagacccatccacaaatacccacagcgcgatgggatggcaagggggaaaaataaagcgagagcgaccgagcgggccaagcgcccaagcacacagcacacgcacgcaggcagaaagcagacgatacacgagacaggggacagccatacgacgccgaacgggaatcggcacagtacaaaccgctctacaagcacagaacagcaagttccaccacaggccacagccgaacagcaaggcaacccacgcatacaatcccactaaacaacagagagacactaagagacagcacccataagactacagacactaccaacggcaaacaatcacatacacaatgagctacaaacggcgacaacaatctggcacacgatcgagcaaacatcagagaaagtgacgaaagacaacagaacaaacgaacacacagaccatagagaacaaaacacagaagcaacgtacacgaaaaccaataccccgagccaacaccacaaaacaacacgcacggacaacaatacaacgagacccacgaacactgcaaaccttgcccacaacgaggatggagcaccccgacagcaccaaagccgccgacgccaaaacaagcaacagcacaccaccagacagacgcgcccgacaaagccagcaacaacaaacacgcatgtgcagccaaacaacagggacagcgacaacaacaaaacaggcaaacaagcatgcgacaacacacagacagaccaaatcaacaccagcagacgaccaaccaacgtacaatacaaacaacgaacaacacaacgaagaagacgccacaaaacacaacgagacaacgcgcagcgaggacccaaagcagacaaaccaccaagacaggagcaaacagaacg

SEQ ID NO: 510014 - DNA, 1017 bp, Homo sapiens
  misc_feature (211)..(211): n is a, c, g, or t
  misc_feature (380)..(380): n is a, c, g, or t
  misc_feature (412)..(412): n is a, c, g, or t
  misc_feature (416)..(416): n is a, c, g, or t
  misc_feature (423)..(423): n is a, c, g, or t
  misc_feature (479)..(479): n is a, c, g, or t
  misc_feature (523)..(523): n is a, c, g, or t
  misc_feature (534)..(534): n is a, c, g, or t
  misc_feature (603)..(603): n is a, c, g, or t
  misc_feature (648)..(648): n is a, c, g, or t
  misc_feature (697)..(697): n is a, c, g, or t
  misc_feature (700)..(700): n is a, c, g, or t
  misc_feature (734)..(734): n is a, c, g, or t
  misc_feature (748)..(748): n is a, c, g, or t
tggcgaattcggcacgagggggaagcgacgagtccgggacgcccagcgcgggcccggagcaggtgtaagggaagtgcggctcggtcggcgcgggtggagggggcgtgaggccgccctacggtggccgtcgagggacggcgctacggctcccacgctaggccaaacgcctccggctggcctgcgcccgagagccccttcacctgcagtggcnaacccagccggctgacgcgtgaaccacgccctcagccgccttgccagcgcccccagccgcgcgccccagcaccatgcggccgccctgctgcacggagccccgagggacatggggcaccctgcaggccctggcccctagcaccgccggcctggcccagaggtccgggacngccggcgccgccgcggagagggcaccgggccngacngcctccnccccagggtcatgctgcgggctcccaggcctaggcgcccatgacccctacgccaanccgccggctggacaccggcgaccgccacatgcgacctagcgccngccgcccgccnggggcccaatgccggtcatgcccattccgcggctgggtgcgctccttccacggcccgcacaccacctgnctgcatgcggcctgcgggcccgtgcgcgcctcccacatggcccgnaccaagtacaacaacttcgacgtgtacatcaagacgcgctggctgtacnggnttcatccgcttcctactctactttagctgcaagnctgttcactgcggngctctgggggtgcgctggccgcctcttctgcctacagtacctgggcgtcgcgtactgctgcgcttccagagcaagctgtcggtgctgctgtgctgctgggccgccggcggcgtggacttccgcctggtgaacgagctgctcacgtatggcatcaggataccaatgatgtgatcgggggctgggctggtgctcatggactacagggacatttgagggccggggagcaaagttgatgaacagccaggccgagggtgggtctacccaggatg

SEQ ID NO: 510015 - DNA, 320 bp, Homo sapiens
aaacagttacaaataatttttctactttttttgtttggagacggggggtcactctctggccaggcgggagtgcaggggtatgatcagggctggcggcagcctcaacctccggggctcaggtgatcctctcacctcagtctcccacatagcgggaaatacgggtgcgcgcggccgaactgggctgatattgggtagagagggggtctcactatgtggcccaggcgggtctccaactcggggactcaagcaatcggcccacctgggccttctaaaatacggagatcacgggtgtgagccaccacaccgggccccaaataaaa

SEQ ID NO: 510016 - DNA, 264 bp, Homo sapiens
tggggataaacacatgatccctagtactacatcttaaggaggacaccaggctcaccatatgttagacaactttgaatctcatagtactcacaacaatgagcagcatcgtcaagttgtgatgcattcattctggattggaacctactcaatcagtccttccactctaagtaaatatttgtttctcacagaccacaaggcagttcaaagggcctctagtcagagatatataggtgtctgaatgggaaacatcatacaagcagtgaa

SEQ ID NO: 510017 - DNA, 2037 bp, Homo sapiens
gaacacgcgtaactgaaagatctcaaggagtaagaggattactgcatcttcatatggacttatatggcatatagtattattccaaaaatggccacaacaatatttactggtaccatatgctgttccagaacttggatacacctccccttaaaaggtggtgtctaatgcacttccctttgcatataggccatcaatattaactttaagtaagtatgtatagtagtttgttagtttgagacagagtctcgctcgggcaccaggctggagtgcagtggcacggtactcggcttactacaacactccgccttccggattcaagtgattactgctgcctcagcctcccgaatagctgggattacagtgtttcagaatcacctgggatgatctgcatgaagattcctggactccaccaaagacttactgcactcagaaaaggaggcaagaggatgaggacatgcttaaccactctgccattaacaaactgtacacactgactctttacaaaatacagaagcatgaaactactgctcaagggattatctcaacttgagttaacacataggacactgctgactaccttaaaatgtcacactaggctactctaagggaccgggaagattgtcgggaggccaagacaacaagaaagtggaagcagtccctaaaaaaacccacaaagtagcccaggtaccacactcacggagcactgggacacgagactaaggaaccaacgagcacaactcgaaacacaggacggcgtcggcgacctccaaacggagcacgagactacacatacaagcaaccaccattacagtacacaacaacagacatgctcaacacacacacacaagcgccgcaggggagaacatcaacatccaccgtaaccacgatcaatcgcgatggcgagagaggagacagaagcgacggcggccaggagagaggcagcagagaggaccggacgaaggaggagagagaggaggagcaagaagaatgtagaaaagaggcgagaaaggtgagagaagggaggacgaggcgaggcgaggggagccgaaggcgcgcgaagagagaagggacgagggaggggagcagaggagaaggaggagagaagaaggaagcagagcaagagagcaaagaagaggtgaggaaaaaaaaaacaacgaaagcagaaaagaaaaaaaggaaaaagggaaaagagagggaaacgaggagaagcaggaagaagagaaaaaggagagaagacagagagaagaggacgaaaggcaaagagacggaggaaagcgaggaaagcagcagtaaggagaggcagaacaaagacgagaagacggcgggaggtgagaagagcacgacgagacgagcaaagcaaggacgaagaagagaagaagagaggaacgggatacaaaaagagaaacagcagaagacagagccaacgacagaacgagcgaaaaagcagaaagaaaagaagaacgagaaaagcgaaacaaacagcaggaaagagagagggacaaagagcagaagaaggagagaacgaaaggaaaagaagcagccagacagaacacagagagaacaaagagacgagaaaaaacagaacaacagaaaaaacacaaagaaagcagaacagaagcacagaacaaagaagaacagaagaacaaacagcggagagcgcgaacagaagagaagatagaataaatacaagaagaaacaaagagagaaagcagagaggtaacaacaaaagagaaaaaggaaagacagagaaaaagaagaagagacagacacgaaggcaaacaagaagaagataaagcacgaacgaagcaccgcgaccaggtcagagagagaaaagagaacaagagacaaacggacagagagaagaaagaaggcgacaaggcggcggacaaagagaagaaacaacaggcaagagaagaaagaaagaaagagaacaaagaaaagagacgagaagacaaggaagagaacaaaaacagaagccacgcaagtaagcgagagaagaagagacagaagagacacagcagaaacacgaagcaaagg

SEQ ID NO: 510018 - DNA, 606 bp, Homo sapiens
  misc_feature (316)..(316): n is a, c, g, or t
  misc_feature (561)..(561): n is a, c, g, or t
  misc_feature (565)..(565): n is a, c, g, or t
  misc_feature (569)..(569): n is a, c, g, or t
ctaaggccatatctaagttgaaagccaggattaacggattgaaaaaaagttagtatgcccacgggcctcgccccccaagccacgaatgtatttctcatgcgccaagtggagcccccaccaaagagccagccaccccagcagaggaatgacgaggatgatgacattgccctgtttggcagtgacaatgaggaggaggccaaggaggcggcacagctgcggaaggagcggctacggcagtacccggagaagaaggccaaaaagcctgcactggtggccaagtcctccatcctgctggatgtcaagccttgggatgatnaaacggacatggctcagctggaggcctgtgtgcgctttatccagctggacgggctggtttggggggcttccaaactggtgcccgtgggctacggtatccggaagctacaaattcagtgtgtggtggaggacgccaaggtggggacaaacttgctggaggaggagatccccaagttttaggagcacgtgcaaagtgtcgatatcgcagctttcaacaaaattttaagcctgagtgtgtgtacgtgngggngtgngtgaggccctcccccgattaaagactgagcccggcca

SEQ ID NO: 510019 - DNA, 987 bp, Homo sapiens
  misc_feature (1)..(1): n is a, c, g, or t
  misc_feature (770)..(770): n is a, c, g, or t
nctctgttctgattgtgtcgatgctactctatctcatttgtatcgacctaccgatacctggcccaggggttgtgctccattgaatatatttctggcgaatgcgtgtccttcctgatcccaaattactggtgtcctggacggcttcccccgatgataaacattttggcgtcctggagaggagttgccccccggggcggaagctggcacacaccggggggctcgccctacacaaaccgggggttcaccagcacccgcgtgaactgtccgctccccgctgtgacctgggggcagcacccacccctgattcttggaggggggttccgcccgttcgtctttgcggcccagtggttggtctccgccccccccccattgccggcggactcgtgtttgtcccaagggtcagtcatgcttcataaacggcgtgttgttccaccgcctcggttagttaaactcgccgcgtggttcgccccaccatttgtgttggagccgccggccctcagacaccactgggcgcaccattgtccctcaattttcccgctgggggccaccatgtatgagtgattgggccgaacatccaccccagcagggtcccaccgtcctcgtgtaaattcccctgctggaccccacacgctggagttcggtgagccccccttcccccgtgtcaaagtctcccacccaacaaggtttgtgcgtctgcgcatctcctcacagggggagccaaagaacttcctccaacgggggaaattttggatggcacccgcgttgctccncacagagagagggccccaacgcacatgtttcccccagggcatgaaggtctaggcccaccagagatacaaggcccgggggtgctacacccacagggggtaacacaccaaaatgcggggcccgggtcattaaagcccccccaaggcgggccgccagagcaagacccccgcggcctcgcccgttttaaacccccaaaggcccgctccccaaaaacataaa

SEQ ID NO: 510020 - DNA, 1277 bp, Homo sapiens
tctgggacccctggaggacatgtgtcaccatatcggccgtggtccgcggctcgtggatttcctccggatttttgttgtgaccccagctgctcgcatgcaaccacccgtggtttcgtggttcccacgaggaccctttgtaaccggggggtacgattctccaaagcacccttggatccctgggaataaaattttgccgcgtgtttgtttttgttcctctttgttccattcccacctcgggtcccgcgccgcaatgttgatgggaggagtggttcttcgcccgccctcagtaccgtttttccccgaaggggaccagaaccttgtagtaatggccccttgcccacgggagtatggacagttaaagaaagatttgtcccgcaggcagaccgggttcccattttgcaaattcctattgggctcaaaggggtgcccgcgaaccttggatgtagtgtatcctgaccctgcgcttgggagtttccatcgggaagaggtcactgacaggcaccttgggccccaagaccgggggaggatggaacttttcccccgtcttggaatttctaattgaccccccccagggttccgccctcttgtgctgtaaacactgtcgtattgtaaccacccctgaggggaggcccccaaggtatacaacattgggtggcgcacaaaaggtgggagaacaggatttcttttgttgggggcaccacaaaagagagaatgtccctccaatttctgggtggagactccacttgattgtccccgccaccccgttccgcgctattcccccgatttctccctctcacttccaagagtgtaaatttgataccccactttcacgatttgaatcttatagaggatctggcccaagagttatctgagatttgcactcccaagtgtctgaccaccttgggtaaaccccgtgttaatgcgggacctggagaggttgcctaaccctaaggaaagaaattggtgtgagtcaccccacccgagaagagggcacccctggattcttttgaacctggttcaccctgaaagaatggcccaatggccacacacagcttttgccacactcgagactttccacaccacattcttctgttattggccagggccaccaaaccctggatttctctttccccgaggaaagggtatccccctcacccattgctgtaagagagagaccaacaagactggcggccccaaccagagccagtgggtgtaaatgggttccctgggtgaccaggtcagatctttgtacgtaatttaaaatattgtggccggga

SEQ ID NO: 510021 - DNA, 319 bp, Homo sapiens
  misc_feature (16)..(16): n is a, c, g, or t
  misc_feature (274)..(274): n is a, c, g, or t
  misc_feature (278)..(278): n is a, c, g, or t
  misc_feature (282)..(282): n is a, c, g, or t
ccaagttcaaatatgncgacgcaaaaaggagatttttcgagcaaatgaacgggcctgtgtgcgctttatccagctggacgggctggtttggggggcttccaaactggtgcccgtgggctacggtatccggaagctacaaattcagtgtgtggtggaggacgccaaggtggggacaaacttgctggaggaggagatccccaagttttaggagcacgtgcaaagtgtcgatatcgcagctttcaacaaaattttaagcctgagtgtgtgtacgtgngggngtgngtgaggccctcccccgattaaagactgagcccggcca

SEQ ID NO: 510022 - DNA, 102 bp, Homo sapiens
tgttatcgattgccactcatacctcagaggacgaggaggagaaaggacaacaggggccaggtggcttgggcgagagggaggaaaaggtggcatcgataaaca

SEQ ID NO: 510023 - DNA, 844 bp, Homo sapiens
  misc_feature (355)..(355): n is a, c, g, or t
gttaaattttctttaagtaatttaacaacagatttgctaatttaaaaaaaaatgaaaaaaaaatcttaccagcagtttgtaaaggtctggaatcacagttggcatcctttattcaggtctcttctctccaacgtacacttaaaattggtgccgagcagggatataacctgcagttaagtgaaaagaaaatccagcctccccctccaaaaaaaaaaaaaaaaatttaatttttaaaaattaggggtatggcaataagacacttcagaggctatcttaacctcgtgaatacccatcttctagttttaaagacagagacattcccattcgtcgaaacttgttaacctggtgttggccnatctcgtgtgccggaagtaagtagaccttaagacagagctttaagaacgtaaacactttagaacaaatttggaggcgtcacaagtgagataaatttttagaattatttactattccaagtgattaaatgaggatcttgaaattaaatttctgaagttcttccaatttttacattttatgggaggggtcccgtgagttcgtgtcaacttttttattgaagtctctggccctaatttggggcataacttgtttaaaccttccaaaatgtgaaatgttagcttcctttctttaacttgtttattaacttttattagaaattttgacctgagttagttaacaaagtatttgggcattattggcagtacagatgtctctaagcactggtcaaggggcacattttaaaacttcagttctgggctgaaagaattggctagtttcacagaaagattgggctatcttaaaactcaagcgggtttaactggtcccatga

SEQ ID NO: 510024 - DNA, 425 bp, Homo sapiens
ccgcgcaacaggaggataacaagtcccagaactgatggacacccagggctgagtcaactataaccaccctgccactctctcacctgtcccaccaccggctaacgtttggccacactttttacttcactgtctggagtgtttgtcattaggtcgatcagaggcctgctttcatatcctacagccacgtgtgcttctggggtatcgcataactcgatcagaggaaggtccatgatcgggctggcttgtctagcatctggagtgaccgctattggttccagtttgatatctaccacaatagcctgggttccataaccaacggttaagagcttagtccagcatctttctggctaccatcttgggagaatgtgagctttgctcatgttccatgtaggctggcggtttgtaaagccatggaatcaggcggg

SEQ ID NO: 510025 - DNA, 443 bp, Homo sapiens
actggggcaggacggtagcttgacaggtgcttcccggctgacttcattgatcaggttgatcatgtagcgatacaccgcctgataggcaaagtctgcctgtcgctctcccctcaggttcatcgctgatcaccagtttccataggtgaatacacgcgactagcgtcccgacatttgagtgatacgagccttggaccgcttgaaacgaggttcacatacacgcgcactgcgtttgcccggcagcgggcatttgcggtacaggtgctgcaacaacggcagcgacaacccgccgatatccatcagccactggtgcagcatgtccgcgacgggcttgccctgcagggccttgtggagctcggggagcgctaccagcatgccgggatggcattgacgcaagtaaccctccaggcgttcgccatgctgaacgaacggacgcggatgaactt

SEQ ID NO: 510026 - DNA, 375 bp, Homo sapiens
atctaagatcccagcggcgccttaattaaaacttggtcccttttctgtgccaacttaatgtttgtttttgtacttgttttggtattgagaatggagtctcgctctgtagcccaggctggagtgcggtggcgcgaatctcagctcactccaacctctgcctcctgggttcaagcgattctcctgcctcagcctcctgagtagctgggattacaggcgtgcaccaccacgcctggataattttttttgtaacttaagtagagatggggcttcaccatattggtctgaaactcctgacctcgtgatccgcctgcctcgacctcccagagttgctgggattgcagatgttagccaccgatcctggcccccccaaaaaaa

SEQ ID NO: 510027 - DNA, 955 bp, Homo sapiens
taaggctagtagaggctggtgttaatcatgtcagcgacatagtcgatgactcatgatgaacctgttctactggctccacattgacgaacatgatctcatatcacgcacttgttcgcgccttccttagttcacggcatgccttttatttctggtatcggtatcgaagcattacaaacataaacattctgactatcttacaggggtgacctatgttttcagaagtcatgcgtatattctcgacctcggcctacggtgatgctgccgattgtcatcattattttttctaaaatattaggcatgaaagcaagcgatagctttaaagcggcgtctgcgaatatcgcgattggcttgtgttggcattggcctatgtagatctggcttcaatagctcggattccattcggcccggcggcgaaagcgatggcggaaaattgcgacctgaatctgcatgtggtcgatgttgcgctggccgggctcttcaccaagtgagcctgggcgcttcgcaacatttgcgctggtggcgcattgccgcattgcgattctggttccacgtgccgatgtttatctgacccgtatgacgcgcgtggtaaactgttgcatgtctggaaatatctggcatatgaccttcaccggcgcgttgctgcatctggcaccggtctcatggatgcattagcggactggcacggtgtggttattccacgcggcgtgttgttgataggctcgtgtggctggtttgccccgcgatacccgaggagtttcttgagctggcaggtattagctcatccggccggcccgtgcgggtattttgtggcccatgcggtgctgggccccggttatcgtggaggaaatccatgcgttaccggccttaatttaggccgggacttcccggcaattcgggccttgggcgcccgtcccgcgggggtaggagggggcacaaggggccaccgggaatacca

SEQ ID NO: 510028 - DNA, 373 bp, Homo sapiens
cagttcgctaaccaaggtcctcactggtgaatgatgcaaaatatggaatccatgtatgaatgttaccctaaaagagtggagtgctggtacatgctcaacatggatgaatcatgaaacattatgtaatgaaagaaccagaccaaaagccacatatgtcaatgccatttatgtaaagtgtccatcaggcaatctatagagagaaaaggtaggttagtggttgctttctgttagtagttaggagctggaagtagtgggaaatagggagtgctgctaatgatgatggttttgattttggggtcatgaaatgttctgaaaattaggtagtggtgatgcttacaatcttgtgaattccctaaaaaaccacagaattgta

SEQ ID NO: 510029 - DNA, 114 bp, Homo sapiens
cccacgcgtccgtgaaatctagagtaaaaccaagctggcccaaggggtacctagaagggagacaaagccaggcctgctgcccagttgagctctgggaagaagaggagcaggccg

SEQ ID NO: 510030 - DNA, 107 bp, Homo sapiens
gaaaaattgatgttgcaagaaatgaggtctcaaaaatgggattgtgcctcctcactctgcgtcacatggggaataatccctgaggccacgttcaccagtggggtaga

SEQ ID NO: 510031 - DNA, 357 bp, Homo sapiens
tatatagtgtacactacaaacaggatagggacatcagacagccccagaaacccttccagatctgatatgggactattaattaccatgctgtaaataggctattcattcacaatgcagcttgaagggggaaggctccactgcattctttggctaaggcctgaatgctagctcatctgtaagatctatactcgcaggtttcgttttccttttaaaatactttagggagagaggcatggtttctgaggggttctgcaagtatgattcaatgtgcaacatacaggtaggtcttcagcataagctgcaatatatgcatgtcaaaactttgacatcttcctcctcaatttaccactttcttct

SEQ ID NO: 510032 - DNA, 383 bp, Homo sapiens
cagcaggatcttcaaacaccgcaatctaaagaaaagaaaactgtgaggctgggcgcagtggctcacgcctataatcccagaggctgaggcaggcggatcacctgaggtcaggagttcaagatcagcctgaccaacatggagaaaccctactaaaaatacaaagttagccaggcatggtggtgcatgcctgtagtcccagctgctcaggagcctggcaacaagagcaaaactccagctcaaaaaaaaaaaaggaaaaaaaagaaggtggaagtggggggttaaggcaattaaccctttccttgggttgaaacttatggaacagacccttttggaaattgtgccttgtggttgcttgggaaaattgtggtgtaggggctctaagc

SEQ ID NO: 510033 - DNA, 150 bp, Homo sapiens
agacacaagaattcgagaggagacaacaggagagagaagaagcccaaaggcagtacacaaagaggacaatggaagtgtttcgaatactgaacacaaagattaacaggggccaaccaaacttgattgtacacatggagtaccttcttcaca

SEQ ID NO: 510034 - DNA, 358 bp, Homo sapiens
accacaactatatgtgccacgctcaagtgtgagaggttatatgcagtctatatttaacaagaggtctaaacacatcttagatctaagcagaagaaattacagtactatagattacataaacaagtacctctatcaaatctcgatctctatgcgtagctatattggattacttaaaaagttctaaggtccctttcccccacgccccatatgggttaatttgggtaaactaggcacattttacaaggaaatctgtgtcaaaacagataacagtgcataaatcaatccaaatttagaccctggcaaccaagttcgcccaattgggcctcagtactacgaggactcggtcaaacaataaata

SEQ ID NO: 510035 - DNA, 93 bp, Homo sapiens
ttttggatatttggtagaggcagggtttccactaaaaatacaattgtgccactgcactccagcctgggcaaaagagcgagaactccgtctcat

SEQ ID NO: 510036 - DNA, 379 bp, Homo sapiens
gtcaagatgaagaaccatttgcttttcttgggagtccctgcggtttttattaaggctgttcatgttaaagcccaagagagatgaaaggattgttctttgttgacaacacatgtaagtgtgtccccgattactttcagagatcataccgctctttccgcagagactcatgaggacaaatgtagagagagacaaacgcgttattgtgtctctgtacaacagggagagtatctctgatcccaccatcaccactgagaaccaaaaatgtgtaccacatgtcttcatctctgtaaaaaatgtgatcctacagaagtagagcgagataatcagatagttactgctacccaccgcgatatctgtgttggagagagggctacagaga

SEQ ID NO: 510037 - DNA, 1015 bp, Homo sapiens
agcgggccaccgtgccgccctgccgccctgcggccctgccgccctgccgccctgccgccctgccgccggtggtccctgcccgtggtgctccgtcgcccccgccacctcacgtcctcccgtgcgtcgtggagcgtctcggctacaacatgttgggcatgatcaagaatctcgctgttcggaagcgtacgagacgtggccttggcaggtcctaacgcaaaggggacaacggaagaagttgcctatgacagaaagggcctgtgaaggcggcaacatttgccacagtaggaagtgacagataagcctgtgcgcatgaggctctacgggcaagcaatgcccaatggtcgcaaagtatgcgcgggggcaccaatgacaacgggcaattggcgatggccgatgacagtccctattctcattagctgtgttccccaactgaacgatggctctctgcctcaagaacttaccagtctggttccggattccacaaccaactttcacacacgcgacccaccagctcccagtgacaacaagcgttcaagcatcgaggcaacgggaaggccatcacctgtctatcccactgccagcaccgcgcgctcacatgccacagcgaacccgacccacgatagccaccaagccacccgtcctgcgtgccagccctgcgagcgccacagccacctaccgggggccacatccacctccgcaccgccaaacgaccctccccatgaacgccccaacgagacaggcgcaccggagcaaccggctggccgaacgacaccagcgacccaatgaaccaacaacacaccgggaaccagcagcctccagtgtccccaacacacagccggcacgcacgcgcaccggccctcccacgcccccgcacgccacaaacacccccacccaccgcccctcaacgcacgcacccgccacccccccgaccaccgcctcgcccccccgacgccccccctccgccaccccaccacccgccaccacgacgcacaccccccaccgccccacacccgcc

SEQ ID NO: 510038 - DNA, 861 bp, Homo sapiens
tatacaaactatggcaaacacttgtggcaaatctgtctgatataaaggaaaagcaaaatctgtataacattattactacttgaatgcctctgtgactgattttttttttccatttcaaaatataaacttttttggtgaaaagtatgctcaaggttttttttccctttccccattccctgggaaatacactttgggtctatgtgactgggttgggcaatagttaactgggtactgggcattgggattaaataacaaaagtaggttagccgggaaatgagaattaacaattcaccaaagtggggtggtctttatttcagtacccaaacctcttccttcacccctaatatttggggcggctggcaataatggtagtcaccattaccatttccattcctctaattaggggaagacacttacatctctgggtataccggaacacaggatatcaataccacttcttggttctttccaaatgattttattccatggtgttggccccaagagggttggcagcttccacctgtgaaaccttgggattgggctgtgagacggacagcgttggcgacgacaacttggttagacacaacgcaagaaaaacacactcctgcgaagcgacagttccaaactgtggctataaacggtggtgtctttgacttactggtgttcaacgactggggggcgcggaaattcttttaacattcactcctattagaagggccttgggggctctgtacaatattgggccccacaacgggggggtgtacctccggaaccaccatgtgggttggctggcattccacacggtggtgttgtaccttcgtccttgggcaaaaaaccctttagggggcctcggcacataag

SEQ ID NO: 510039 - DNA, 755 bp, Homo sapiens
  misc_feature (24)..(24): n is a, c, g, or t
  misc_feature (66)..(66): n is a, c, g, or t
  misc_feature (68)..(68): n is a, c, g, or t
  misc_feature (81)..(81): n is a, c, g, or t
  misc_feature (94)..(94): n is a, c, g, or t
  misc_feature (123)..(123): n is a, c, g, or t
  misc_feature (126)..(126): n is a, c, g, or t
  misc_feature (149)..(150): n is a, c, g, or t
  misc_feature (156)..(157): n is a, c, g, or t
  misc_feature (160)..(161): n is a, c, g, or t
  misc_feature (204)..(204): n is a, c, g, or t
  misc_feature (217)..(217): n is a, c, g, or t
  misc_feature (219)..(219): n is a, c, g, or t
  misc_feature (221)..(221): n is a, c, g, or t
  misc_feature (223)..(223): n is a, c, g, or t
  misc_feature (231)..(231): n is a, c, g, or t
  misc_feature (234)..(234): n is a, c, g, or t
  misc_feature (255)..(255): n is a, c, g, or t
  misc_feature (258)..(258): n is a, c, g, or t
  misc_feature (261)..(262): n is a, c, g, or t
  misc_feature (264)..(264): n is a, c, g, or t
  misc_feature (268)..(268): n is a, c, g, or t
  misc_feature (271)..(271): n is a, c, g, or t
  misc_feature (273)..(273): n is a, c, g, or t
  misc_feature (277)..(277): n is a, c, g, or t
  misc_feature (280)..(280): n is a, c, g, or t
  misc_feature (285)..(285): n is a, c, g, or t
  misc_feature (294)..(294): n is a, c, g, or t
  misc_feature (306)..(307): n is a, c, g, or t
  misc_feature (313)..(313): n is a, c, g, or t
  misc_feature (321)..(321): n is a, c, g, or t
  misc_feature (325)..(325): n is a, c, g, or t
  misc_feature (334)..(334): n is a, c, g, or t
  misc_feature (336)..(337): n is a, c, g, or t
  misc_feature (343)..(343): n is a, c, g, or t
  misc_feature (345)..(346): n is a, c, g, or t
  misc_feature (349)..(349): n is a, c, g, or t
  misc_feature (352)..(352): n is a, c, g, or t
  misc_feature (354)..(354): n is a, c, g, or t
  misc_feature (357)..(357): n is a, c, g, or t
  misc_feature (359)..(359): n is a, c, g, or t
  misc_feature (363)..(363): n is a, c, g, or t
  misc_feature (385)..(385): n is a, c, g, or t
  misc_feature (421)..(421): n is a, c, g, or t
  misc_feature (423)..(423): n is a, c, g, or t
  misc_feature (451)..(452): n is a, c, g, or t
  misc_feature (455)..(455): n is a, c, g, or t
  misc_feature (457)..(458): n is a, c, g, or t
  misc_feature (460)..(460): n is a, c, g, or t
  misc_feature (464)..(465): n is a, c, g, or t
  misc_feature (467)..(467): n is a, c, g, or t
  misc_feature (476)..(476): n is a, c, g, or t
  misc_feature (484)..(484): n is a, c, g, or t
  misc_feature (492)..(492): n is a, c, g, or t
  misc_feature (514)..(514): n is a, c, g, or t
  misc_feature (528)..(528): n is a, c, g, or t
  misc_feature (534)..(534): n is a, c, g, or t
  misc_feature (536)..(536): n is a, c, g, or t
  misc_feature (540)..(540): n is a, c, g, or t
  misc_feature (576)..(576): n is a, c, g, or t
  misc_feature (582)..(582): n is a, c, g, or t
  misc_feature (596)..(596): n is a, c, g, or t
  misc_feature (600)..(600): n is a, c, g, or t
  misc_feature (605)..(605): n is a, c, g, or t
  misc_feature (607)..(607): n is a, c, g, or t
  misc_feature (628)..(628): n is a, c, g, or t
  misc_feature (636)..(636): n is a, c, g, or t
  misc_feature (646)..(646): n is a, c, g, or t
  misc_feature (688)..(688): n is a, c, g, or t
  misc_feature (705)..(705): n is a, c, g, or t
atttttttataaatatttcaaatnttacattgatgtcatcaatattacaaaaaaggaaaaaaaaantnacaggcaacattnaagagcaccaganacccagcgcacacctaaagtagaccatgnttntttccttccactgccagtttatnntcccgnnaanncccccaccccctcgttttcctcctccgctttccctaacccgtntcgcgggggcatntncncntctttttnttnctcttcttttttgttttcccnttnttnntnggcngtngngtcntgntattnttggtattnggataccaggtnntttatnttgctctnggcntcggtgaantnnattttntnnatnttntngcncntttnccagtgtaggaagggtttgggngggaacatggccgtgaactgctcggagatgcgcttnancagctcctggatggccgtgctttttttnnttntnntngttnntnttttcaggncgcggggngggatgtngcacacggccgttttcacgttnttggggatccattncacgantngttntttttttttttttttacttttatctttttttttttnactttntttatggacatttngttncggantntggcagccaccgtcagtagcngccgtggngcgggtcgcnggcggccatcatgttcttggagtcgaacatctgctgggtganctcgggcaccgtgagcncccggtactgctggctgccccggctggtcaggggcgcgaccggggcatga

SEQ ID NO: 510040 - DNA, 1053 bp, Homo sapiens
aagccccacccagcccggacgtgctgcaggctgccacccacagagtcgtggacgctcaggcccccttcccggtcccgctccacatccagctcccgcagcaggaagaaggccaagaggaagagggtgtccagggacgcacggactggacgcgctctggtgacgcgctctgaatccagtggacagtgagctcgagtgtcatgcgtcaccatcagtgtggtgaggagctgccccagtgaggcatgcgtgtccaatggccaagatgccgtgcgtgtcctccatgtgaccgctccagcagccgagagcgagctaacgaggaagaaagccaatggacaagagcagggagcacatggcggggcccctggtggccacagaccggaggactgtaccggtcgcggtacggggagccctggcaagctcttcctatgagcactatgagagtaggaagacgaacgacccggacgatcaaggtgcagaacatacggggaagggagatgaacacaacaagaagacagccagggcaacggctcagacagagcacaagccaatcacaagcgaaccaccagccacgagcggaccaaaacagaagcgcagagagcagcgaatgaacccgaaaacggaccgcaacgaaacgcacacagccaccaaaaacacaaccccgggcacggccagcacaagcgagcactcaacacccgtgaccaccggaccgaccaccagaccacacaccccacaaagaacaggccgagagaacagaagaaacaaacagacacagacacgagcacacaagccggagaaccaacccacgagcagggacgcgagaagacaatctgacagaccgggcaccggccgacagagccaggagaaagaggcagcgccggagacaagagagagaacgacagaaaagagagaaggggagcagaggaaggcagacatacacccgggaacgaacggcgagaaagaggcgagcaacgggaggacagcagacgagggaacccgagcaggtcagagacgaaaacaaggaaacgacgagacggcacgagtaggacgctggtataa

SEQ ID NO: 510041 - DNA, 217 bp, Homo sapiens
ttttctaattgtgtgagaagtcatattggtatttttacagaaattacattgactctttagattgctttgagtagtatggtcattttcatgatatcgattcttccaatccatgagtatgggaagtatttccatttgtttgtgtcatatatgatttccctcagcaatgttttatactcctccttgtagagctctttcaccttattggttaaggtcgacg

SEQ ID NO: 510042 - DNA, 653 bp, Homo sapiens
gacagagagtggaaaacagcagaggtgacagagcagccgtgctcgaagcgttcctggagcccaagctctcctccacaggtgaagacagggccagcaggagacaccatggggcacctctcagccccacttcacagagtgcgtgtaccctggcaggggcttctgctcacaagcccttcaacttttctaacccttcctgggaaaccccggcccacaccactgccagtcatatgaatccagccatcaagtgcaaggggaaggaggtctctcttgtcaaatctgcccagaatttggctacagtggtacaaggggaaagagtgatggaacgtcaattgtagaatgcaataggaatcaaaagtacccaggcccgaaacagcggtcgagagacaatataccccaatgcatcccgctgatccagaacgtcacccgaatgacacaggattctacaccctacaagtcataagtcagatctgtgaatgaagaagcaactggacagttccatgtatacccggagtgccaagcctccatctccagaaaatccaacctgtggaggacaagatgctgtggctcactggaactgaatcaggaacactactggggataacatcagagctcggtcagcccagtgagtgcatggaaggctcatctatcggcca

SEQ ID NO: 510043 - DNA, 215 bp, Homo sapiens
  misc_feature (174)..(174): n is a, c, g, or t
cactgggagatgccatcaacaagtacgatgtgctcctcagcatttgcacaatgccccagctggcttgctatgagcggtgaccgtgcgctccaagaccaccatgcgtctcttctacgctgactctggccgcttcgaccccgcgtagaaccaccagacaactctcgtctgctggcntcaggcctgggttccttgcttggacccctcgtgaaacgcgc

SEQ ID NO: 510044 - DNA, 274 bp, Homo sapiens
  misc_feature (244)..(244): n is a, c, g, or t
taagcacgctggagtccaaggcggagtggatcacttgaggtcaggagttcaagaccagcctgggcaacatggcgaaaccctgtctctactaaaaatacaaaaattagccgggtgtggtggcacttctactgtaatctcatgcttctctaggaggctagagaccaggagaatctgcttgaacccgtggaggcagcaggttgcacgtgacgctgacgctcatgcccactgcactccggtcctaggntgacacgcgggaacactccgatctccatgg

SEQ ID NO: 510045 - DNA, 380 bp, Homo sapiens
  misc_feature (47)..(48): n is a, c, g, or t
  misc_feature (61)..(61): n is a, c, g, or t
  misc_feature (120)..(120): n is a, c, g, or t
  misc_feature (139)..(139): n is a, c, g, or t
  misc_feature (152)..(152): n is a, c, g, or t
  misc_feature (161)..(161): n is a, c, g, or t
  misc_feature (166)..(166): n is a, c, g, or t
  misc_feature (169)..(169): n is a, c, g, or t
  misc_feature (177)..(177): n is a, c, g, or t
  misc_feature (182)..(182): n is a, c, g, or t
  misc_feature (191)..(191): n is a, c, g, or t
  misc_feature (193)..(193): n is a, c, g, or t
  misc_feature (215)..(215): n is a, c, g, or t
  misc_feature (262)..(262): n is a, c, g, or t
  misc_feature (288)..(288): n is a, c, g, or t
  misc_feature (301)..(301): n is a, c, g, or t
  misc_feature (307)..(307): n is a, c, g, or t
  misc_feature (311)..(311): n is a, c, g, or t
  misc_feature (331)..(331): n is a, c, g, or t
  misc_feature (337)..(337): n is a, c, g, or t
  misc_feature (344)..(344): n is a, c, g, or t
  misc_feature (348)..(348): n is a, c, g, or t
  misc_feature (371)..(371): n is a, c, g, or t
  misc_feature (373)..(373): n is a, c, g, or t
agccctttccggccctccccagggccccccgccccctcctttgcctnntgggtggaggcanccatgggaaggagcccaggggagctggcctgggggaacgaagcccatgttcgcttcctnacttaaaactggggggggnggggggtggggcntgttccccngcagnatntgttctgngaagnttgttaaangnaaggaaagcttaaattcttggntctttaaaaaagaaaatcttatttaacccctttggggtttagatttncttacccccatagcctagaggtcagntttagttttaacnttgtgnaaanattaaaagaatcttggaacnttattnttttttntccngctgaaaaaaaaaatttaacccntnggatgga

SEQ ID NO: 510046 - DNA, 255 bp, Homo sapiens
  misc_feature (227)..(227): n is a, c, g, or t
  misc_feature (243)..(243): n is a, c, g, or t
tggtgtgtctccttgtgctatcatagcctaggcttgtccatcactacttgcagagccattgcgacgctggtgtaaagtagcccagtatacgtgtgtcctcctcatttgatatgtgggcatagcactcatgtctgtactcgatctattaaagttcctgagcactgattacagcatctgggcaccttaacaagatgctgtgcttgaaaatgcatactgcaactatcacntaacgaacatcttacntccatatcctag

SEQ ID NO: 510047 - DNA, 131 bp, Homo sapiens
  misc_feature (3)..(3): n is a, c, g, or t
gcnttacttttaaaaaaataacacactcttggcaggtgcggtggctcacgtctgtaatgccagcactttggaaggcgaggcaggcgaataacaaggtcaggcgatcacaaccatcctgagggtttcgatga

SEQ ID NO: 510048 - DNA, 123 bp, Homo sapiens
caagaaaggggccctattgagtctctaaaaaggaaagtcatataaaaccaattagacttccccgtaaaagaagaaaaataagatagcctcctagtggttcactgtattaactataactcctag

SEQ ID NO: 510049 - DNA, 284 bp, Homo sapiens
cgcaccgtccctgtagcctctttcagaaggtcactagtcctgtttgtgagggttccatcctcatgccctaatgacctcccaaaggcctcaactcatttgcgattaggtttccacataggaattttgtggggacataatattcagatcatagcatttagaaagcaaaaaaacaggctgggcatggtggctcacgcctgtaattccagcactttgggaggctgaagcgggtggatcacaaggtcaggagatcaagaccatcctggctaacacggtgcgttggccca

SEQ ID NO: 510050 - DNA, 270 bp, Homo sapiens
ttgatcgaggattccaaagatctttgagcatcaccaaaatacctatagaatggctaaaacaaaacaaaactgagaatacctaacactggtgaggatgccaatcaactatactcccatacactgttggtgggaattttaaagttacagccattctgaggaacagctgagcagtatctcataaagttaaacacttaccatatgacccagcaatcttactctgagatacatgccctagagaaatgaaaacatatgtccacacaaaaacttgta

SEQ ID NO: 510051 - DNA, 455 bp, Homo sapiens
  misc_feature (218)..(218): n is a, c, g, or t
aaactagcccttatagaaattttgctggcgctgggcaaagattgggccccccggccggccccaccggccccggggggatagaaaacggggccagcaccgaaatttttccttgcccccgtggggggccccccgacctaggggatgaaagctccaaccctggcagggtgggcagtccggatcagttgcccctggcctgttccccccattatttaagggantgctttctccacgccgacgcccgcccggattgctccccaaaccccgggacccctttggacctcgggacctggaccccgtcctggttgcccaggaggggcccctggcatggattaaaaaatccttaccccaaaaagggcccctcgctttttttggcagggcaccagggggacttaaggctggaacggagggactttctgggggttggattgggggtaataaacccggccggaagcgga

SEQ ID NO: 510052 - DNA, 812 bp, Homo sapiens
gatcggtcggttccacgctggtgcctgtggcgcgggggagaggcggttctgttcccgggatctgcaatgtccttgttagcgggaggactgggatcccggccgcggctgctgttaagcgtcgaagctcagcggggccgctggacactgacctgtgcttagaactcatcctggccctgcagagcctgcctgcgagtccctgtgcgtcccctgtggcgggctcttggagccactttccctgagcggaagtcagcccgcggctcggactccgtgcgggacctgctcgcgaggaatggctgccgccgggttcaagcactgtcattcctgtatggcccttgacaatcatagccagacaccatgggctcgtgacgcccacatcactaccgtcaccgaatgcatttgacggttggagaacgacgtagacacaggcctcggcgtggactcgaccccgtttcaccaaaaagtttgcgcacagtccttgcgctttactacatccaaatccgatagagagaaacattcaaggcgcaaaggcccttatggaggtatgccttccaacgggttgacccaatggcatttggccataaaacggcaaaacaggccaattggttaagcgccgtaaacacattcacaggcaaattcgttaatacgcagcaattattggaaacatcacgccgaaaagggccaagaagtttggcttggggcgaactatgacccgcacaaatcgattattaccttactccagaccacatagagcccaccaaagaagggcccaaagagggccacaaaaggagcgacgccacgtatactcattcgca

SEQ ID NO: 510053 - DNA, 284 bp, Homo sapiens
acccgatgtgagtcgccaagacccatatacgctattaaatcggcgggcacggacttaaaaagacgagcaattacttcgcattgaatttcccgagcgttcctggcgcgtaggtcaactttccttgaaaaatggggcccacagttaaaaattcctctatcccataatcgcaatcatggggcggctgaagggcgtatctaagcgggcttccaattggttgagcaacctgccgagcaattatttgccaggctgcaagccatggccaatgagtgcgaaaccctcaccga

SEQ ID NO: 510054 - DNA, 907 bp, Homo sapiens
atggcacatgcagcgcaagtaggtctacaagacgctactgtcccctatcatagaagagctgatcacgctttcatgatcacgccctcataatcatttccttatctgctctcctagtcctgtatgcccttttccgtaacactcacaacgaaaagtaactaatactaacatctcagacgctcaggaagtagaaaccgtcgtgaactatcctgcccgccatctatccataagtcctcgatctgccctcccaattccctacgcatcctttacataagcaagacgaggtcaactgatccctcccttaccatcaaatcaagttggccaccaatggttacatgagatcctacgaggtacacgcgatcatacgtgcgggaatctgaattctgtccaagcatccttactatatcgtttccccccgattattccatagaagccagggacgaccctgcagacctcccgtttgaacggttggaccagatcgatgtagatacgtctccgattgaagccccccccattcgtataataaattcacattcacatagacgttctgtggcaccctcgatgacgccttgtccccaccaattacggccttagcaacacgagatgcaatttccccggacgtataaaaccaaatccatttcaaccgctaccacgaaccgggggctctactaacggtccactgctcctgagcatctgtggagtcaaaaccacaggttcatggcccatcggtgcatagaatttaattcccctaggaaatcttgagaagggcccgatataacgctaataggaccccttttacccctttagaggccgagataaacaagatgtcatacacaagagaccttttgcccccgctccttgcaaagatctaacacacgggggggcgcccgagaaggacagaacgcgcgag

SEQ ID NO: 510055 - DNA, 1578 bp, Homo sapiens
  misc_feature (257)..(257): n is a, c, g, or t
  misc_feature (505)..(505): n is a, c, g, or t
  misc_feature (1117)..(1117): n is a, c, g, or t
  misc_feature (1154)..(1154): n is a, c, g, or t
  misc_feature (1208)..(1209): n is a, c, g, or t
  misc_feature (1373)..(1373): n is a, c, g, or t
cttcagtcgctcgtgtttcgcgttctcgttgctgttctctcgcttcctctgtctggctttctctgcgctctgtcgcttcgtcgttgtcgtgttagcgtagtcgtgttgtgtgtcttggggtgactttgctctcgtgtgcgtgcggcgcatcgtgctgctccctctgtttctggcgtgtgtttgtcgacgttcgccggctcgtgtgatcgtgcggcggtacctgcctcggcttgttctgggctgttcttcgtgcttcntctctactgctgttgctttgtgagtcgctctgtctgtagtagcttgtgtgttgtgtcgagtcagcgtctgctgctgtcgtgtgttctgcagccgtagtcttccgtcagttctactagcgtgttcgtttgtagtgtccttcgttgtttccccccccagttgtttttttagcaccactctctcccgtcgcgggctcatcacaactcacttcgggatctattacccacgggggttttgcccgcccccggcnttctcacgcaccgggggtctgcgcacaaacattccaccccaaggggggttttttctccccaaagtcctttttctttcgcggaagtgccccccttaattctcgtgccggtaggggaccccccccccccgccgcgccctttttttatgtggtgaacctttgttcttttaagggcctttttggggaaaccaaggaaaaccccgcagatgtgtaagggccacccgcggcgtaattgttgattgggctccacagaggaagcctgttaattgtggtggcaaccaactatcttgttcctttttggggaaaattataaaccatgtggtgggtttcccactggtttgtccttgtaatggccccaaaggtaaagtgctttctttggagggacctccccgtatccccgaatggtatgtacccccctgggctaattatcctcgcagtaatatagagcaaaatatagtgcggagataacccccgtgggtgaataatatactgtatgcctggcctgggccccctttgagggaaacatcgtgtgtgaaccagaaaaggcaccccaatgatttttaggaatataggcgcccagaaatagcctcaaatattccccagatgtgtttcttnggggatatttaaaataagagtggtttcacaaagaaanagactctcccagaaatataggccctctcccagaatatatctctggagagttgtnnggggactcccgatcacgcagatccgcacaaaagattcccacgtatatggagactcgggtatatcccacaccacgagatttctcactacagtatggtccactgtaccacactctaatgagtccccacgaaatgggttccacgagaagagaatgagatgctataanatgctcggagagatttttcacgagaaaaagagaggttgttctgcttctttggttaaaacttgcctcttctcggaagaaggatgtacccatgtgtgaaactcggaaactttcttcactgcctcataataccaccggaccacgaggcaccctgtttaagtgactcttgccacccaaagagttgagaaattataaactgagaaaaagc

SEQ ID NO: 510056 - DNA, 651 bp, Homo sapiens
cggccttagaaaatcggtccaccaggccaaacggatcgctgtgggtccgtgtgtatccaaatttcttagggcttgtgttgaaagggtaatcagcaaccccttctccatgggcgacttagaggagttggttaagacttttttacggccactagcactattctatggatttacagcaaggtcgtgattattaatgtttctgtcaaagatttttttaaatcgggactcggtagaacacatagttcactttccatgttgcaggtttagtcaattccaacggtgagacttgcagtgatatgtgttccaaatcgacacctatgtggacagttgaatgggcactgtctgggtaatgggcctctgacagttgattgatggaaatagcatgacaggatatggtgggaggtctagtgggagagttggtgaatgtagaaggactcacctctgagctcctgttaaaccacaggtgttgcagctttcttcacacgcaaggatctgcgttatgccgcctctctcagtcatagattgaatgggaggtaactgttttgggacctgagataatctaccagacaaagtccgatacggagtacatggtttcccctgtcaagcacaatagtgtggtctgactgtatttattgtttaataaaatgaggttct

SEQ ID NO: 510057 - DNA, 239 bp, Homo sapiens
  misc_feature (130)..(130): n is a, c, g, or t
tttgcagtcctcatggaagatcttgacaagtgtcgcacagaacagctccctcgtccgccacctcaatcatcaagttctcatacaagagtcaactgagctatgttctgagattcagtattctcttttcgtncctgtaatatattcttggaggatcaggtagagatccttcctccatcagccgtcggtaggggccacccgccaacagcgcacagtgagtaggatcacagcctcagtgcagc

SEQ ID NO: 510058 - DNA, 157 bp, Homo sapiens
gggactgctcttgacatatcatacgaactgttgttatcgcacctcttcaccttattcaagcccatatctccagcggtgcatgataggggcaggataagtgggaaagcgggctaccacttttccctatcttttccagaagcctgttaagagcaacggt

SEQ ID NO: 510059 - DNA, 142 bp, Homo sapiens
cccaaatgtgtgtgaatatatatatatcatatgagagtgtataatcatgtatatataataatttctatatattttatataacattacatatatatatctatatataaataagatactttctgtcgccatgggtagtcacaga

SEQ ID NO: 510060 - DNA, 211 bp, Homo sapiens
gattcgactcgagttcggtaccatgctcatccctccttaggtaggcaacagctcaagattcaggcaatatacaaagaactcctacaagtattctacacaagaccatcctcaagacacataaacatcaggttttccaaggtcaaaatgagggaaagaatgttaaaggcagccagagagaaaggggcaggccatctacaaagggaaccccgtg

SEQ ID NO: 510061 - DNA, 531 bp, Homo sapiens
  misc_feature (333)..(333): n is a, c, g, or t
  misc_feature (388)..(388): n is a, c, g, or t
ttcgaatcagacggtgcacaagcttactcatcgtgtgtggagctgtagcatgggggagatcccgtgagccggtgtgcaggtgtccgccagtcctccctcaagcgctcactcatgcgctatttccttctgactcaagctgtcagtgacaggaaatctagccgttgttcaacaacaggtcctggatcaggtgttggggaggaatgttgcaacgtcgatgattggggactcgtacgacccgtaggttcatcctgtgcctcgacagggcccatccaacaaccagaatgggaagtttttaacatgcaaccatgcggttgttaactgcgattggactcnacgacacttcgtacctaattaccactgtaatctcccttggtgttgcatgttcagncccccagcaaggctttggccaaagaatttatgggggaattttaaggccctcccccgggaacaatgttgaatttggcttcagcaaggattttcccaaattttgtttttgtcccaaaaggggccctgtttcgccggggtaattgg

SEQ ID NO: 510062 - DNA, 278 bp, Homo sapiens
tcagccggtaccgaaactgactagaggcaggagaatcgctgaactgggaggcggaggttgcagtgagccgagatcgcgccactgcacttctgcctggcaacagagcgagactgcgtctcaaaaaaaaaaaaaaaaaaaaaatttcaccccaatacctcaaacaatgggtaaatttctaaatgattaccttcgtttaaaaaatgccacatgattgaaatatgaggtatttgtcttcctgtgtcttattttggctaacattgatatcctcaggtttactc

SEQ ID NO: 510063 - DNA, 644 bp, Homo sapiens
gcgagggagcggcgtcctcccccagcacctccgggacgcgccagtactctgcggtcgcgggtggacgtcgccctgccgctcgcctgcccggcctgcccatcacccggcctgccgcgctccagccagccggcgcgggtttgcaacgctccaagtcggattgagcgagcgcttctagggcagctgtgatctcgagcgctttaactctgggctggacccggaggaggcgagagggttgggtgtggcccacctggcacgggccagctcggatatcgtgtccctggcaggccagtgctgggccgtgcagctctgaagggggctgtcccgccgcagctcggtgactgttgaggagcgggcccgggagcgcgttccctatggcgtgtcggtggtggagcgcaatgcccgctgtgatcaagtggttgtatgggctagggcaggctcgagagaagcccagcagctgaaggactaggcggccactgggcctggaatccgcgcaaaggacggatcttacagacgcaagtggtccctggacttctcttgcatccattctctagacaggccgtgtcagagagtaccacccatgtgtaaacttggtattggaggcaaaggcttaagaggctggaccagacttctttggggcaaggaag

SEQ ID NO: 510064 - DNA, 310 bp, Homo sapiens
tccaactgcagtacagaactatatagatgagtatcacgcttaggtttcccacgcccacccccatctgttaagtctaacagcctgtagtcgataccagaagagacacagtttgtacatcacaaaagacaagcaagtccccaaactaattatagcagccactttagagggagagcaaatgacaggagacattctgggcaatgaattaccctaagtctcagcatcaagcctagactcatctcctgggtccccaaataactcatcactggtaagaaggatggatgggcccttccaaatcacagcctgggctgtc

SEQ ID NO: 510065 - DNA, 123 bp, Homo sapiens
gctcctgcccccactcccaacgtgctcccccccccgagcccctgcctctgccggccctgcctgggacgtcccccccgacctttcgacgtctgcgtccttccgcccgagaggcgccctgttggg

SEQ ID NO: 510066 - DNA, 334 bp, Homo sapiens
  misc_feature (36)..(36): n is a, c, g, or t
  misc_feature (86)..(86): n is a, c, g, or t
  misc_feature (134)..(134): n is a, c, g, or t
  misc_feature (147)..(147): n is a, c, g, or t
  misc_feature (189)..(189): n is a, c, g, or t
  misc_feature (204)..(204): n is a, c, g, or t
  misc_feature (223)..(223): n is a, c, g, or t
  misc_feature (292)..(292): n is a, c, g, or t
acaacctgaaccccacatggaagcgtttctcactcnccgttcagcatttctctggtgggaaccccagcacccccatccaggtgaantgccccgattatgacagtgacgcgtcacatgatctcatcggcaccttncacaccagcttgncccagctgcaggcagtcccggctgagtttgaatgcatccacnctgagaagcagcagnaaaagaaaagctacaaganctctggaactatccgtgtcaagatttgtcgggtagaaacagagtactcctttctggactatgttgatgnggaggctgttcagattaacttcactgtgggcgtggactttca

SEQ ID NO: 510067 - DNA, 512 bp, Homo sapiens
gtgcacctttgtctgacatctggctaccctcaagggcagaagtgccttctctcctgcacaccctgaccctttccatgggatcacccaccagcgcacagatctgccatttctttattttgaaacagaatctcgctctgtcacccaggctggagtgcagtggcatgatctaggctcactgcaacctccgtctcccaggctcaagcgatcctcctaccttagcctcctgagtagctgggactacagatgcctgccaccatgcctgactaactttttgtatttttagtagagacggggtttcactatgttggccaggctggtctcgaactcctgaccttttgatccgcccgcctcggactcccaaagtgctgggattacaggtatgagccactgcgcctggccgatttttttttttaattagcaatatgtgatggtcatctttcaatagagacctgatactgcatttggtgtgatgcttttctaagactcaccccaggtggaagtctttccctttc

SEQ ID NO: 510068 - DNA, 980 bp, Homo sapiens
gggaagccctcaagctcatggttctggaaaccccgttataagtgtgtcaacctgtctgacagcatccagtcacctcaatgaactgtgtactcgctgagtgtggaccctaacacctggcagactctgctccatgagaggcacctgcgtgcatgcctagaacacaaagtcctgcagcacgctgcgcagccgcggggacaacgtgtacgtggtgactgaggtgctgcagacaccagaaggaggtggaagtcacgcgcacccacaagcgggagggctcgtggccggttttccctgcccggagccactgtgcttgcgagggtgatgggccagggccatctgagcccagaagaacgacggatcacgcatcccctcaaggcagaaccactcgtcatttccagggtggcccaggctggttattgactctgacttgagacgtccttctcttcccggataagaagcacgaggaccttccagacagcacgcgacaaggacacgaagcgttccacgagcgaaaggcgcctggccacagttgaccctctggcctctccactgatgaggtgctccacaacttcctgaccagattggggtccctgacggagggggcggttacactgaaagactttccagggcctacgggcagaggtggagaccatctccaaggaacctggagctaattggcacaagagaagctgtgccagctgcatgctggcgggccctggacgctggttgcttgcgggacccagatggccctggagccttggatgaggcgctggacgcaggcccagagcctttgggcggtggaggccctggacgctccagcacgcgtgatggcacatgaatgccctggtggtacgacctcccggacatgctggtgccggcacatcgcttataaacggcggctacatggtgggagacactaccatgctgacgtaaacgcagaacaagtgctacaggaagcactggactgcgacccgtggggccac

SEQ ID NO: 510069 - DNA, 396 bp, Homo sapiens
atgacgagttcacgaacaacgcagcacagccccatcaggttcccatggtggccggctcccctctcggggcaacccagacgtgcaacaaagtgcgatgcgtcgtcccccagactacagtaatactcaacaatgatcggcagaacgccattgtagccaagatggaagaccccttgagcaacagggcaccggatttccctggaaaatgtcattagcaacgctgtgcctgggcgtcggcagaacaccattgtggtgaaggtgccgggccaagaagacagccaccacgaggacggggagagcggctcggaggccagcgactctgtgtcccgctgtgggctggcgggccgtcagagcatcgggagcacgtcacgctcatcacccggaactcggtcagaggtg

SEQ ID NO: 510070 - DNA, 390 bp, Homo sapiens
cgctatattgctcatcccttctgcgtggatgtatgcgggacgtggacattactgtcccaactgcagagttctcctgggcacctacaagcgtatgtaggactcagccagacgtggagggagccgggtgccgcaggaagtacttttcacctctcatccagcttcacgcctggtggaggttctgccctggtggtctcacctctccagggggcccaccttcatgtcttcttttggggggaatatgtcgcaaaactaacaaatctccaaaccctagaaattgctgcttggagtcgtgcctaggacttgcaaagacattccccttgagtgtcagtaccacggtttcctgcctccctgagaccctgagtcctgccatctaactgtgatcatttgccc

SEQ ID NO: 510071 - DNA, 328 bp, Homo sapiens
ggcgaagcagatgtatttgttggagatgaacatctggccagggatgtgcaccttgttgaacggcgtccacagggtgcagcttgggtggccgtttaaccgctcatccatgggcagctttaacgaggctcggaagcactcattcttggctcgggcgtccaggactcgcttcagggctgaaatgttcctgtgtggccggatgggcctaagaagggcctagccctccaccaatccctcactgtccagcagctgccgcatggccaggtcgggcaactgctccttgaccttaacagtctgtccggcatttagaaaaccccccccggccatattt

SEQ ID NO: 510072 - DNA, 289 bp, Homo sapiens
gagagagagagagagagagagagagagagagagagagagagagacagagagagccacagagacacatttatactctctcacccttattctctcattcttactttttttcctcctccccttgccttccctctcttcctttttcctctcttctccctccttctcttctccccctctttcctctcctctctctttccttccttccccccttctctccttctttttcccctctctttcttctcctctctcttcctcccttctctccctctccccctctcccttcctttcttct

SEQ ID NO: 510073 - DNA, 465 bp, Homo sapiens
  misc_feature (364)..(364): n is a, c, g, or t
  misc_feature (386)..(386): n is a, c, g, or t
ctctatgaccctcctgcgcttttcctggaacccaaagctctgacttcgtcaaacttacacaattaaaggcaggcggaagaacgcgggctgggaagcaagcgggaagattctagaatggaagggagcccgccgagcgccgcgagccgcgcccaggcacgggtccgatggagcaggcggggaattccatcccccaggcgggacccccgcacaccatgccctgccgggaggctcgcggcactgcggagcagcccggggctggccagctcaccagcccgcattcaccccaagcgaatcgacatcggggaagggctccaggaggcacatcatggtgcatgacgggttcacaaccagacaggtaccacanttgcaagggacaaaaataaganaatttaggaaacgaaaaaagacggtactgggtgcgagggggcgcggggcgcggcagacagacggggcacggggtgcaca

SEQ ID NO: 510074 - DNA, 964 bp, Homo sapiens
  misc_feature (45)..(45): n is a, c, g, or t
  misc_feature (50)..(50): n is a, c, g, or t
  misc_feature (52)..(53): n is a, c, g, or t
  misc_feature (56)..(56): n is a, c, g, or t
  misc_feature (468)..(469): n is a, c, g, or t
  misc_feature (684)..(684): n is a, c, g, or t
  misc_feature (763)..(764): n is a, c, g, or t
  misc_feature (786)..(786): n is a, c, g, or t
  misc_feature (852)..(852): n is a, c, g, or t
  misc_feature (860)..(860): n is a, c, g, or t
acacctcacaggctggacttctgtggcttcctcctgagccaagtnctctncnntcntgtctcagcggctgccaacagatcatgagccatcagctcctctggggccagctataggacaacagaactctcaccaaaggaccagacacagtgggcaccatgggacagtgtcggtcagccaacgcagaggatgctcaggaattcagtgatgtggagagggccattgagaccctcatcaagaactttcaccagtactccgtggagggtgggaaggagacgctgaccccttctgagctacgggacctggtcacccagcagctgccccatctcatgccgagcaactgtggcctggaagagaaaattgccaacctgggcagctgcaatgactctaaactggagttcaggagtttctgggagctgattggagaagcggccaagagtgtgaagctggagaggcctgtccgggagcgtnntttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttctctcttttttttttnttttttttttttttatttttttttttttttttttttttttttttttttttttttttttttttttttttttttttttttnntttttttttttttttttttttntttttttttttttttttttttttttttttttttttttttttttttttttttttttttttttttttntttttttnttttttatttttttttttttttttttttttttttttttttttttttttttttttttttttttatttttttttttttttttttttttatatttctcttcccctcc

SEQ ID NO: 510075 - DNA, 367 bp, Homo sapiens
  misc_feature (340)..(340): n is a, c, g, or t
  misc_feature (354)..(354): n is a, c, g, or t
ttaacttttgtatatggtgagaagtaggagtccagtttcattcttctgcatatagatatccagttatcccagcactatttattgaataggaagtccttttcctattgcctcttttgtcaagtggatatccagttatcccagtgctatttattgaatatggagttctcttctcattgcttatttttgtcaactttgtagaagatcagttcattgtaggcgtgctaccttatttctgggttctccagtctgttcccacgctctatgtgtctgttttcgtaccagtaccctcctgttttgattactgtagtcttgtagtacagtttgaatttaggtaatgtgngtacctcggctctngtccttttgctta

SEQ ID NO: 510076 - DNA, 723 bp, Homo sapiens
aaaggaaagaccgacagtgcctggatcaggccacgccgaggacaaggaggcggagaacgtagacaagaaacccagtgggtgccctcggttctgagtcgtataagtcatctggaggaagcgctgatcagacggggccaggagacagcacagggtacataggaagtgctctggactaccctggatctccgatgtcaaagcgcaattctgtcgtcatcataagcacgaagggttgtgtcaacggtccagatgtgctgtgagcacacgacggcgctccagggaagatgctctctctgcagctgccgggatggataacaccgatagagtcgcatgagatcattcacacgggtccaataaccagtgcatggctacagatagcgtggaccatgagattgggccggtgcaacaagacagcgtggttcaagttatgatgctgatgcgccgctccaacaagggcccgctcctcgatgctgtgtgaagaccaccgggggcgcatggtgaagcaccagtgctgtcctggctgtggctacttctgcacagcgggtaattttatgcgagtgtctcgcccgagagcagcatctctcaccgtttgcacgaagactgtgcctctcgagtcaataacgccagcgtattagtgcccactgtgggggaagagagagctccaaggggcaaagaggtgacgatagctaaagcacgacacgactcgaccgtgatgaccagttccgg

SEQ ID NO: 510077 - DNA, 376 bp, Homo sapiens
tgttatccacaaatacacattcttattttctgtagaaaccgatggattgagtagaaagtctacattgagcagatgccataaatagccatgactgaagagatagactacaccttatctgaattcacaatcaattcaaaaactgactgaggaagaatgcacgggtctcttatgtgcggtcggggctgccgtcccaacaatgtcctgtgttcggaagcgacacacagatgcaattcacggattccacaaactagttgtaactgaccgtggtgaccactatgtcctcgtgactttattattgctacccctcctggctaggtgacagagatgggagccgagtgggtgttttcaaagattcgctttggagctgagtggagaa

SEQ ID NO: 510078 - DNA, 178 bp, Homo sapiens
atgtcagagctgacccacagcagcactctgcctgtcttatcttatacttcccagtattagggagaaaaagttacagtatggaaagtaatcttattgtgcttttaaactatattgctctcgttatttataagagcacacatatttttctatccattatttgtctagacccatactctta

SEQ ID NO: 510079 - DNA, 387 bp, Homo sapiens
tatgaacacaaaggatctatcatcagaaaccgggcaggctagaacaaagtgaccaataatcatcaagtaccgaacgaaaagaactgtgaacccagaatcctatacccattttctgtcatttgacaatgtcattatccctttcattatgaatgaaaacaattttttttggctaaaaatctgatgctagcagtatggctaaaggaagttctctaaacagaaagggaatgattataacaaaaataagaaatctaaaaatgtgcgtaaatacgatagacttcccttctctttcaaagagttttctgaaatatgtttggtggttgacagaaaagttgtaacactgtctaacgtgattctaaatatatgtagaagaaatatttaagaatgata

SEQ ID NO: 510080 - DNA, 678 bp, Homo sapiens
  misc_feature (678)..(678): n is a, c, g, or t
gtgttcgctgccctgggctaccgcatcggcagcaaaagtaacacgtggtggatatactgaaccgacatgcccagccataatggacataaagaaatcatcggtctgaacgatcctggccttcccctgaaaagcaccatgggcagtcgatctatctcctgacatgcgtgtcttatgcgctgcttcgtcctgagggcactgatcacggatctttacatccacgcacctaacgaatggaccttccttcgaattcgttacaagaaagatgactttatggatgcgccaaattaagactcttcattgagtgtgatttagaatccatccgaatatgtcactctgttggctacctgcgtcattccttaatgtagtgcccgcaaagaatgtgaatgctaatcatgtctgtggactatcacatggcaggcgtttggaacccactcacaccagtacagtgaccttgtgtgggctggcggctgtactccctcaccaacggaaccgctgtgtgctccaaccttatccagagctgccgagcgctctatgctcactatcaggtgttggatcatgagcttgcacgaagccctgcacgagctatgttctgacctcagttaactatgatcgccttggagaagctgttttctttaactgcataaccaaaatgctgaaaaaataaataaaaataactcn

SEQ ID NO: 510081 - DNA, 1182 bp, Homo sapiens
ggcggattcccgagtttgagaaacagctctttgccccgtcatgccacaacgtaggaacagtgaccttcccaacggcgtgtggatgatgagcgacgtgatagaggatcgaaatccattcgtcccctaagaagaagctggtggaccctgtggcgtaggtgtcagcgcggtcctgggagcctgctcttcaataggctacaacactcttctggatcagcgatggaggacgcgaggatcgatgattgatggaggtggtcctagcaaaatattgagcgatctttgtgcctcacgaaggacttgtacgaaagagtccaggacgagccacgacaggactcacgccaagcgaaggtgggggtcgttcagtgcatcgaggacccattctaaccgtggcacggaagcgatcactggatgcgcaaggcccactgtgagcattcgccgagatggcgaaatctacgctatccatgagacgccgggagatgacctcagagaggttccagaagaaaaggtcttgagcttagggagcaagggcaattcggacgtggagcggtggaaaggaagtcccgggcgcagtccgggccagccatgggaccagggcggcccagggtcccatcacgaaagcttcggaaggcgcagggacgggaaccaggcagttgggggaccacgaaccgtcggaatttgagggttggccccataaggccccctacgtaggggcagtgcgaacggtctcacggcaggcatcgcctattttggccataagaaagaagaaccagaagcgcactgaggggacaaccctttgggagcgaccagattccatggtaaggggtgcgccccgggagcagaacgtgaaagcgacaaacgcagcgcgggaaggccaaagctgggcagccactggtgcgagcagaagtcccccgaacaattatgcgcccgcgttaccgagcctcggcccttggggacaccccggaaaggcccacgcccgcagcgatattggcgccccgaaaaggccaagaaagctgggctggcgacccccaggatggacgcaaacacgcgcgattgaggaggggcacggaaaccccaggggcgaaccaccagaagcgggcaaacacgagcatgggagctacattgccggccatggaaagcgcgatacaggggcagaaaggctccaaggaagccacctaagggaaacac

SEQ ID NO: 510082 - DNA, 493 bp, Homo sapiens
agcacatcctcctgtaaactttaaatcatctctaggttactcagaatagctattataataccacacatcacctcatttgtgtggattcaatgaaatacttggtggggggccaattcaagtttagctttttggaactttgtggaatttttgcaccctgaatattttcaacctgtggttggttgaatccatggatgcagagggctgactgtactaacactgctgaaagactgaaccagtacaacaccatttgaagaaaaaagagcaatagattttaagaccagatttctttgtgctatttttagtcagtcctccctccctctgacaggactaaaaccaggccgctgtactgaatgactaattcaccaaattattgagactgtttgggtacttttagttggttttgttctgactttgccagggttgttgtttctcagatttgcaatttctgcaacattttatatattaaacgaatgggttttctcttaaaaaaaaa

SEQ ID NO: 510083 - DNA, 724 bp, Homo sapiens
agcacatcctcctgtaaactttaaatcatctctaggttactcagaatagctattataataccacacatcacctcatttgtgtggattcaatgaaatacttggtggggggccaattcaagtttagctttttggaactttgtggaatttttgcaccctgaatattttcaacctgtggttggttgaatccatggatgcagagggctgactgtactaacactgctgaaagactgaaccagtacaacaccatttgaagaaaaaagagcaatagattttaagaccagatttctttgtgctatttttagtcagtcctccctccctctgacaggactaaaaccaggccgctgtactgaatgactaattcaccaaattattgagactgtttgggtacttttagttggttttgttctgactttgccaggcctcgctcgtctcctcacacttcgccacttcctgcacacacttctccactactattaacacgcacactgccgctcctctcttaccaaactaccaccctacctccctcaccaaagcccataaaacatccaaaccacttcataacaaaccctgagaaccaacaatgcaacgaacatctgttcgcttcattcattgccccccacaatcctaggcctacccgccgcacctactgatcattctatttcccccctctattcgatcccctactccacctatctcatcaccaaccgactaatcacacccaaca

SEQ ID NO: 510084 - DNA, 838 bp, Homo sapiens
  misc_feature (354)..(354): n is a, c, g, or t
gctgttcatctacttcaggaatcatgaaaaggatcgaactctggactttcatgcctcgaggtaataccttgaaatcctctgttagaaacagataccgtctgcctagatgagaggtgaagccagctggacttctgggtcgggtagggaccttgcagacacttctttcttgtcttacggagacgtgtttccgtaatattcagccaagtcagtgctctgtagaaataaacgaacaccgagattggctacttctgtgtgcttagaagtagtagtgttcgtaaagatggacgtaatcagcacatcatgtagagatggagcgagtcctacacttctgtagataatggaccatgtcgaatnggctctttgggtattattggaaccaatctagacaaggtaacatagggccgggggatcatatagttaaagggtgcagatatccatacctccttgggcacaacctctctaagactcatgccaaggcaagtcatactcacgactacagtgtttggggctcttttccaccatggcctgggttggggaaagacctttttggtatcctttttttgactcctgttacaactaaattaaacatgctgtggtctaggtattgacttacccacttctcttccgcggagattcgctaagtggacccataccttattttaggaggagacttgttagaccactttcgaagctagtaggataggcattctcggcgggcatttccatttccctggggacaggttccaagttggaaaggggccaacggaaaacaccccaatgcgaggaataggggaaacgaaaacttcctggggtagcgactacttcaggaattttggac

SEQ ID NO: 510085 - DNA, 188 bp, Homo sapiens
atcgttatgacatttagtggatacatttcctctaaacacaacaggtcacagcaaatacgagcttcatttggcttcgagttccccaggcgcctgtagacacacacagaatcgtggctctctgtctctctcacttagtggagctcgacgtcctgtgtggtggagaacagtgagtaaacaacgggtaccga

SEQ ID NO: 510086 - DNA, 863 bp, Homo sapiens
  misc_feature (764)..(764): n is a, c, g, or t
  misc_feature (835)..(835): n is a, c, g, or t
  misc_feature (846)..(846): n is a, c, g, or t
gcccctcaatactcccaggtgattgacagtgcggagaccaatgggaggcactcttggccgacctacccagcggcgccggggcgtctgtgattgggaaggtgaggaaagcgctgcaggaagagttctctgcaggatgctgggtgagatcaaagggagagcttctgccaccacctcctacttggtgtgtgcgggggccggcacaaagaccatctctgcctctgccttcccctgctcctagccagggtcagctcttctctctgacgcggaatacagagctggacaacctctgcctcggccctctccatccgtaaataaagactagaaccacccccactctgcactctccccctctatggatcaggaatatttgttttttctgctcctctcaatatggactgggcccgctcctgattcctcccacccttacctctcaacacccagtacctcctcttcttttgcatctcatcctcaagggacactactgaaaacctgtgtggaatcaaagctcaccggagacagctgtggccattgtgcctataacgccaacaccaggcatatcctggagcctcagctggagaatttacctgtcttggacaacctgccacaaaactgtgcccacatctagttccatctggtcatcagggcgtctctctttcttacacccataacacacaatccccacttccgcgccagtgttcatgagaagtgaaaaggaagagggaagagagggcttgttgggaggacagaggggatggggcagagtngggattcctagcaggttctggctggttgacaagctctttcccccagccccctttgccatacccagtttttnggaacagtttncttattacagggagggg

SEQ ID NO: 510087 - DNA, 139 bp, Homo sapiens
ggagctatcccgggtctgggtatgacagcagagttgcagaacagcaaatattgctgcctgttccttcctctggaagcttcgtcccagaggggcacccaccagatgcctgtatgaggtgtctgccagtcaggaggcatga

SEQ ID NO: 510088 - DNA, 104 bp, Homo sapiens
atagtcacgctcggtcctacgtttacacgtgctatatgacttactgatgaataagcgattaaggattttaggtcggtttgacgtaagcagatagagctggttat

SEQ ID NO: 510089 - DNA, 511 bp, Homo sapiens
gcccctcaatactcccaggtgattgacagtgcggagaccaatgggaggcactcttggccgacctacccagcggcgccggggcgtctgtgattgggaaggtgaggaaagcgctgcaggaagagttctctgcaggatgctgggtgagatcaaagggagagcttctgccaccacctcctacttggtgtgtgcgggggccggcacaaagaccatctctgcctctgccttcccctgctcctagccagggtcagctcttctctctgacgcggaatacagagctggacaacctctgcctcggccctctccatccgtaaataaagactagaaccacccccactctgcactctccccctctatggatcaggaatatttgttttttctgctcctctcaatatggactgggcccgctcctgattcctcccacccttacctctcaacacccagtacctcctcttcttttgcatctcatcctcaagggacactactgaacgcccaccaggcatatcctgggcct

SEQ ID NO: 510090 - DNA, 198 bp, Homo sapiens
cgtaagctggagcacaatttcaagccagtgtttcttagctgctggaaccagcaagctaagagtgggagtgggacctgctgagtgagaccacttggctccttggcttcagccccctttccgggggtgtgaacgattctgtctcgctggggtttcaggcgctcctggggtacgaaaaataaacccctgcagcttgctcag

SEQ ID NO: 510091 - DNA, 314 bp, Homo sapiens
caggggtgggggtggaggcggctctgcgatcgaaggggacttgagactcaccggccgcacgcatgagggccctgtggtgcctgggctctgctgcgtcctgctgaccttcggtcggtacagagctgacgatgaagttgatgtagatggtacagtagaagaggatctgggataaagtagagaaggatcaaggacggatgatgaagtagtacagagagaggaagacgctattcagttggatggattaaatccatcacaataagagaccttagagagaagtcggaaaagtttcccttccaagccgaagataacagatt

SEQ ID NO: 510092 - DNA, 333 bp, Homo sapiens
gacaaatgtagcaagcagcaagcaaacacagattgggcaattatagactaggagagagaatttcaagcatagacatataactcgcaacgtactacctttttcccttacgtggaaataatatgaaaaacacttattagatatactggacaacaagagcactaagtactccaactctactgcagcattacaaaacaaaacatgccttcaccacagtgtaagatttaagggcacactgcccaaggatgcatgttatatcaaacacagcaagattgctgctgccctgacaagtacttccaatccctacccaggtcctactgaaatacgggtggtccc

SEQ ID NO: 510093 - DNA, 917 bp, Homo sapiens
  misc_feature (818)..(818): n is a, c, g, or t
  misc_feature (889)..(889): n is a, c, g, or t
  misc_feature (900)..(900): n is a, c, g, or t
gcccctcaatactcccaggtgattgacagtgcggagaccaatgggaggcactcttggccgacctacccagcggcgccggggcgtctgtgattgggaaggtgaggaaagcgctgcaggaagagttctctgcaggatgctgggtgagatcaaagggagagcttctgccaccacctcctacttggtgtgtgcgggggccggcacaaagaccatctctgcctctgccttcccctgctcctagccagggtcagctcttctctctgacgcggaatacagagctgaccctggctaggagcaggggtcagctcttctctctgacgcggaatacagagctggacaacctctgcctcggccctctccatccgtaaataaagactagaaccacccccactctgcactctccccctctatggatcaggaatatttgttttttctgctcctctcaatatggactgggcccgctcctgattcctcccacccttacctctcaacacccagtacctcctcttcttttgcatctcatcctcaagggacactactgaaaacctgtgtggaatcaaagctcaccggagacagctgtggccattgtgcctataacgccaacaccaggcatatcctggagcctcagctggagaatttacctgtcttggacaacctgccacaaaactgtgcccacatctagttccatctggtcatcagggcgtctctctttcttacacccataacacacaatccccacttccgcgccagtgttcatgagaagtgaaaaggaagagggaagagagggcttgttgggaggacagaggggatggggcagagtngggattcctagcaggttctggctggttgacaagctctttcccccagccccctttgccatacccagtttttnggaacagtttncttattacagggagggg

SEQ ID NO: 510094 - DNA, 783 bp, Homo sapiens
gtggatcgccgctgccggagcagcccgatagggagctgcggatcgcgaggccagtaccgaccgcgcccgtctcgcgcgtcaccggtcctcctcgtccgtcatggtcccgggactacttagcacctcttcggctgctcatcatcggcgacagtggtgtgggtcatgagtccgtttactgttgcgtattgcagacaagcactttctcatgcatgactacatcaccacgactcggatgctggatttcaatgcatccaggaccgtggacgatcaacggggagaaggtgaagctgcagatctgggacacagcggggcaggagcgcttccgcaccatcacctccacgtattatcgggggacccacggggtcattgtggtttacgacgtcaccagtgccgatgtcctttgtcaacgtcaagcggtggcttcacgaaatcaaccagaactgtgatgatgtgtgccgaagtattagtgggctacataagaagtgacgaccctgagcggaacggtggtggagacggaagatgcctacaaattcgccgggcagatgggcatccagcttgttcgagaccagcgccaaggagaatgtcaaccgtggaagagatgttcaactgcatcacggagcttggtcctccgagccaaagacagacaacctgtgcataaccatgcatgcatgggacaatcagaacggatgtggtgaagctcacgaaggaacaggtaaacgaaaagaagagctgctgctaatgggaacccattccactgcagagactgcactgaggttccctccg

SEQ ID NO: 510095 - DNA, 403 bp, Homo sapiens
tgcaagctctcactcgtggaatttaaaaagctgatcttatagaaatacaaaatagaacagtagttaccagagactggggaggggagggaggagggtatcatggagagagattggtcagtgggtacaaagttacaattaggtaggtgggataagttctggtgtcctattggcacagtaggatgactgtagttgtatatttcaaaatagctagaagagaggattttgaatgtttttactacaaagaaaagataaatgtttgagatgatgggaatgctaattaccctgatttgatcattgcacaatgtatacatgtattgaaatatcacattgtaccccataaatatgtacaattgtgtgtcaaatttttttaaataaaataaatatttttagacctatctaaaaa

SEQ ID NO: 510096 - DNA, 347 bp, Homo sapiens
gacaagtttcaaggaccaactttgatgagatggacacactccccgggagattgtgcacacagctcatcgatgagtacccactgcggccaccccggccacgagctacattctcctggggacccccgagcacgtgagtcccccacggaaccgggagccctcattctgccttactggttggccccagccctgcctgactgaccacccccctcacgagcaccagatcagggacctcacgcatctctttttcaataataacactggagactctctgttggcctgccaaacaccacttaacttctcctcttatgagactatttatctttaataaacccctggatataaatcca

SEQ ID NO: 510097 - DNA, 117 bp, Homo sapiens
gcaggctagtaaatcccgcgatttttagtctttgacattgcaaattaaaccatccacccgggcacagagtaaattagctctctgcatctagttctagcccctcctgcgaacctatga

SEQ ID NO: 510098 - DNA, 761 bp, Homo sapiens
gggagctccagccagggaccgacggattcgcctgacacgtcactggatactcaaacccaagcacgatcccgaaagcggtattttctgcgtctggagaggttattgcatcctcagttcccaccgcatggggactggcgggacgaacaactcgacagacctgatcgcagaccagagagctgatacattatacagataccgggattcagaattgatccagtccgacagacggagggggacaacatcccagacataccgagctgactgagtgatctcatggctggaacacatagtatttcaaaatctactgcagaggctgcaaattaacatcttcattctgtatctggctccatacaggctttgtcaggatcgcgagtgacgtgcgaccgacgtatgggctctctgcacttgcttcacatgcttggcaataggaatcatggtaatccaggaggtcctaaacattaagtaacagtaaacgaactcttacctgtctctgactacctaacaccaacgtaaccctagtaaccaaggaaacggagaccagagagcttgggcaagaaccagccgacgcacccgggacgatgaaacgaagcaacacagacccacacgcaactcttacacaccacggaccaacaacacgacaccccaggaactgcaaacacccaacacatacataacacccacaacctcacaccgcacgaacctacccaacctccaccacactcaccacagctaccacaaacgaccaacatgacaccagaaac

SEQ ID NO: 510099 - DNA, 90 bp, Homo sapiens
  misc_feature (89)..(90): n is a, c, g, or t
gcggccgcctactactactactgctcgaattcaagcttctaacgatgtacggggacatggagggagtttcataattcgctaactacttnn

SEQ ID NO: 510100 - DNA, 109 bp, Homo sapiens
gtgtggtcatccgggtattgtacaaagtgcataggatcgattcacgccggtcacgcaggagcggttttaccattaaagttgagataggttggatcgtttcggcccaaga

SEQ ID NO: 510101 - DNA, 722 bp, Homo sapiens
taacttagagcttttttttttttaatttggtctgccccaagtttggtgaaatttttcatattttaatttcaagcttatttgggagagataggaaggtcatttccatgtatgcataataatcctgcaaagtacaggtacttggtctaagaaacatgggaagcaggttaaatgtttggtaaactttgaaatatatggtctaatgtttaagcagaatgggaaaagactaagatcggttaacaaataataacttttttttcttttttctttggttttggaagtgtgggggttgggtttggtttggagtctttttttttaaagtgaaatttatggaggaaaaatttgtgaagggaccttcactctaagatgttatatttttcttaaaaagtaactcctagtaggggtaccactgattctgtacagagccgtaaaaactgaagttctgcctctgatgtatttggggagttggttcttggaatttccattttacagttacttttcctgtgcttacaaacaagctttataaaagggccaacaaatggcacttgatttcccaatttttaacaaggtcttttaacaaggtttggccaaactttactgtggattcctagtgatttatcctgggaatgtttacgtattggaaaaccgaaatgggtaccttgcacacattcatctgtaagctgttggtttaaaatctgtggattattacccaggttaatgacctt

SEQ ID NO: 510102 - DNA, 184 bp, Homo sapiens
catctagaggatcccgtcagtgcattgtgtgggatgagagcagattgttcctgccttccctttgtgattgaagaaacctgacttcgtttctgcaaggcactgcatgtgtctgtgttcgtgtaagcataatgtgaggaggtggggagagcaccccaaccccatgttcacaatggcacgtggatcg

SEQ ID NO: 510103 - DNA, 1467 bp, Homo sapiens
tgtcgtgaaaactacccctaaaagccacaatggagaaaggaaaagactcatatcaacattgtcgtcattggaccacgtcagcattcgggccacagtccaccactactggccatctgcatctcatcaaatgcggtggccatcgcacaaacagcaacctattgacacaacattcgcagaaggcaggctgctgcagcatgggcaacaggcgctcacttcaaagctcatgcactgggatctcgtgcatcaacactgcacacagctagcagccgtgcacacgtggatcatcaccaattgccatccatctaccatctgtggcaacatttgcagcacccagacaagatcactcatgtgcacataatccattgcatgcccccaggcacacaagcaggacgtttcatacaacaacaccatgcaattacccgggcacatctcaagagctgactagttgcatgatacctgcattgtaagcctgcatcggtgtacaggtgcaacacttctgacagcctggatatctccacaggaactggggacagacacacgagacgcctgccctctctggaccttaccacaccatggagtgttgaacacaacaccttaactacgatcggatgtaacacacaaaacatggacttcacacatgcaggcccacaccctacacagcaccaagaaaacgaagaatacattgcacgggaacaaatcggtacacaggcgcaacgctcacagacaacgtgaccagtcgacccgcaacacacgttggcactaccacacccccccgaaggcaccagcagacgccaataacgggcaccaaataaccgcgcgatcgcgcacatcgcgtcgaacaaacactgactggaaagcaccaacgaagactaaccatagacctagggatcacacgggcattgcgacacggtcacaccagtcacgggatgagacaacgccaagacgggaacaaccacagcgggataatgaaacaaacaccaggaacctggcaaatcaccacacaaccacaacagagaacacacgagacaaaccccacagaccatgagccacctaactcacaggacgatgtcataaccaacaaactggaagggaacacaggcgcacaggagatacgcaggccaatcaccagactgtaacacccgcatgctccccgacaccgcgcaagacgaagaacacaccattgaccacccaacaacacaaccaacgaaaaaaacacacacggcaacacctgagacaacgaagacgatgcgaaacagcacactcgcggacaaacgtcgccacaaggaacaacaagcgaacgaaaccaagccaacacgcaacgccacctgccaacaaacaccacacgaaacgagacaagaagagaaaacaaacaagcaaaagatcagacatacacgaaccaacagaacagacacaacaacacagcagaacgagaactactcataggtgggccgatccacgaacgccacg

SEQ ID NO: 510104 - DNA, 1670 bp, Homo sapiens
ccttttatattgtattatttggtcatgggaaaagttttatggaaaaaaaaagatgtacaaataggtcctgggagtggaaagcaagaataggggccaggtggccccgctaaccgtccccaattcttagaaaaacaacaacaaaggagaaacaacaaaagaaaaaagaaacacccccaaacagcgcaagaaaacggaggccttctgcgacccagaagctggcacacagaaacgcccccatcgcgtgggaagacaatccatctcaatcaagctcgcggccctacacgggcggcacgaggctacactaccgtgggggagtgcccgaggtaaccacgaaggggggaaagatagaaagcaccacctaacaatatcaaatacggtgtggacagacagggtggcggaatacacgcaccagtgcgggcgacgcgccccgccagtccagagggtgctgtacacaggtgtctcgcagacacacagagagggcagtcgcgctgtgacacgcaccacggcgtcagacctcacacagtgcgggcacgatcacacaagagggtgtgccacacataggcgcctcacaccgtgacgagaataaagcagaacactcagctgccacacaccagcgtgggaacttgtagcgacgcgcggaggccgctctgatgaaactacaagaggaacgacacatacttgaagcaggggcggcccacgcgccagcgacaaaatcgcacacactaaggtgagccacaccggagaggaagcacacagacgaggacaagtggagaggacacgaatcacccggggggacacacacagcaccactaacatgggagcaaacctcagtagggcgagcccccccaacaatggtacgccacaacgtaggaggaggccgcaaaaagtcgaaaagacagctgggcaaaaacgtggaccaggagcacgagagggcgcaacactgcgggagaaaaaccacccagaggaaaaagcagacgtaagagcaaccgcagccaccaccacgacaacgcccaaacaaggcaaagcgaataccagacaatagggcgaaccatcagaacagaccaaaccacaacaggccagacgagaccagcgacacgccgcacgcagggcaaacgcacccgaaggctaggcagaagcaacagcaacgaggagtcccaccagcgaaccagtaacccagagacgggggcacgagaaagcgggctgagacaaagcccccggaacggacgggcgctcggaaccagccggagcacggcaaggtgaggaacaccaccgggggcaaccatcagacagcgccacacgcgaccacgcacggccggagcaccgacgccggcgaacacacaaggaccgtggagagcgcacgaaaacatcaggccgcgcactacggccacgcacagcgacaaagccgcgaagacacaccagccaagcgcgggggatcagccgacgcgcgcgcaccaacaccgaacgcgagagagccacccacgacccaaagacgccacacagcgccgcgcggcgaccgagaaaggagcaggacaacgaggggagggctacccgacaagaaacacacaacacaaaagacacgcgcgagagaagccacaccaaacaggaagaagacaagcacagaacacgagcacacgcgcacgcgagagaggagacgacaccaacgaacatag

SEQ ID NO: 510105 - DNA, 235 bp, Homo sapiens
  misc_feature (90)..(90): n is a, c, g, or t
  misc_feature (171)..(172): n is a, c, g, or t
cgttcaaggaaaggaaccctgaagattctcactctcccggatcagctgcttcctgggaaagatactgattggcctggatgcactcaaagnctgtgccgagtctctgtcatccatggacaagaggcccaagattatggaggagaaatccccgtcccttcttcagtgtccaannaggctctcttctttcccttatggtgaagtcaaatgaagtttgtcccaagaacttttctacaac

SEQ ID NO: 510106 - DNA, 226 bp, Homo sapiens
agcactttgggaggctggggtgggcagatcacatgaggccaaaagttggagaccagccttgccaacatgttaaaccctgtctctgctaaaaatacaaaattagctgggcgtggtggtgcatgtctgtagtccactgtagtccagctaattgagaggccgaggctcacttgaaccccggaggtggaggttcagttagcccaggttgtccactcactccagcttgggt

SEQ ID NO: 510107 - DNA, 549 bp, Homo sapiens
gcgggtactactctgtccttttttccaaacgtgcaccctccaaaagggatggactgcctcacaccaataaatacacgtcaccttgtttcagaggggctggcctgacttaccttattctgaaagaaagcaatctgatgttcacactaattattatatgaatggccggcaactccttcaacccacacatttagaaagatgtgtgttaactaagtggaactcatgcatgggaagtccagcagagcaacaacaattaaaaaacaaagcagggcagaacagaagcgtatcaagagcacacaattgggagtagaggtcagccatatgggctatggtcgcaggccggaagatctggacatagagctttctctaattacacgcagtttggggcagtttattagtttcctctagctgaaagtcaaactcattcttcaaaagctctgagattatcagaatactcttatacagtaggtgtcctggaaagagtcaggccagctgtctataggtgtgggccagtcgtaaacgggggtccataccatatggacccaccattcc

SEQ ID NO: 510108 - DNA, 100 bp, Homo sapiens
cttctccatggaggaggcggtgcgaacggcttcagccccggaatgctcgcatctcccactgggacggcgacgaaggcggtggccgtgcgagcgcaggact

SEQ ID NO: 510109 - DNA, 314 bp, Homo sapiens
ggcgaaacccaagccgccgcgtaggagcgtgcgtttcgggcccctctttctcccacctgtttcgacttccccattccccaggatgtcaaccctcaagtccctcaaggccatacctggaccccaacgggtaaagaaagacgatgaggaggaggacccgctggaccagctgatctccgctctggctgtctgcctccactttgcagtacaggagtacatgcccaacaccaggactggcggcaatccaaccacaaggtgcaggcttcaaggatttcattatcacacaggcgagcgccagaggacctccagaggaggca

SEQ ID NO: 510110 - DNA, 93 bp, Homo sapiens
gggatggatgttttgggaaggccaaaaatccccctggagactccagcctacactgggcagccatggcattgccagcattgttttctcttataa

SEQ ID NO: 510111 - DNA, 842 bp, Homo sapiens
tatgttgttgcatgtatcagtacttaagcattctgttgtatggctataccacattttatttatccatgaatcagctgatgggcatttggatttccacttcttgcctattatgagtcatgctgttttttgaacattttgtacaagtttttatgtggacattaatttctccttaagatatatacctaggagttgaattgctgggtcacgtggtaactgtttaaccttttgaggcacaaacagtttttcaaagtggctgcactgttttacaatcccatcagcagtgtatgagagttccaaatttctcaacttcctcattaacacttgttatctgctctggattacagccatcctagtgggtgtgaactggtatctccttatggctttgatttgcatttccttgatggctaatgatgtcgaccaaattttaatgtgtctattggcagtttgtatctcttctttggagaaatgtttatttggatcctttgcccatttttaaattgagttgtcttaattactgagttttaagggttctatatataccagtacaaattccttatcagatacgtggtttgcaatttttttctcccaattccgtgagctgtattttcacttcatggtgtactttgaagcataaaagttcgattctgatgaactccaatttcttatttccttccgtgcttaggtatcatatctaagacagcattggctaaatccaggtccccacgatttcccacctttttcatagaggccaccggctctcagcccctacattggggcctcgcacactccgacgtcatctcggtccttatgaggtacgcacttaggcccaacctgtgcctatg

SEQ ID NO: 510112 - DNA, 227 bp, Homo sapiens
cacacagcgaaaccgaaatacctgatatgacttgcggctttggatctaatttcttcggaaataggcaatggacacatcaagctccttatgctgaagcagattgaagacggaatggagattggacctcaacatccattgcttgctgaagtaagcaaactgattaatgaattaactggtaacgagcgttcacgcgttttgtaacactggctctgaagctgtactcgttt

SEQ ID NO: 510113 - DNA, 330 bp, Homo sapiens
aacggtcatactcccatcatggacttgatacaaacattagttagactgctattagcaggtggcaggagcaccttcaatgaatcttcaattggaaaatactggttcaccacctgttggggataagttgccaatggaataatttagtatggtttggagctattttgatgacccactcgcctggataccttcccataaacactctgctggtcaccacctcttccacgagctcttcctggcaatcctcctcttaatcccactgttgctgttgctgatattgttccttcgacatggctacttttatttcacatttactaagaccaacattggtgg

SEQ ID NO: 510114 - DNA, 701 bp, Homo sapiens
cgaagatccgccattccccagaagaagggggaccacccccgccgtgtttagaggccggaatacattgccttattttgctcactgttgcaaagccacgagaatttttttaacttataaaagaagcgggatgtgtttgaagttaaacgcggtttggccataggcctgaaaaaaggcctcaaggtgagtttaaggcaggtttttggcccaacagcctttaaatagagtggcaattcacgaccgggctcgccaaaaggttaaaatttcaacttaaattacagggcaattgggcctaatattgcagaaaaatgtcttccaaaataaggtttctttggtttatgtttctaaaaaagaggaagccaattggctttcaagttatgtcataaaattctgaataaatgaaactggaaaactttatagggcgacttataatcgtgggtgtatggggttattcaaatgcggaccatatttccttcaacctcgtgttcctaaggaaacaaaaacagaaagcgtaccaatcaaaactcaattttttttgcaagtataaatgctcagtaggtctgtttaaggggagcacagatatttatttataaccaactttccattgcctgtgcaaattaaggaaaattctcgtgtggagaatcaagacataagcgaataaaatttttgcatgcccccctagaggagaaaaaatagcgattcta

SEQ ID NO: 510115 - DNA, 1095 bp, Homo sapiens
gacagttgatctctgcaagaagtgagtagctggaggcgccagtggatagcagccacgcctacaggataaagtcgaatcctctggacatgagtgttctgatttccaatgctaatgaacgtgcacagaagctcttccaaataccaattgcaacatgccaagagattgactggaccagagcaatgggcctcttcacttccagagcaaattctaaaggtccacagctggtacacatatacacagacgctcttttcaaccaattcgttgccctaccgtgcttatcatttcatgccataattctcaattaggactgacacggaaagtgccggctgcatctcgtgtggagcaagtctgcatgacacttaccacgcacttgacggaaggacctgcggtttctcgacaattgccgtgcaaggtacagcatgcattgcgctgacggcctgggtcttcgcttctctagcaccccgccaggggaccttccttagactgcagttaccagaagcaaggaaagcagatggtcagaaaagggacaaaaggcgatttggcccctggagtcaaccaagccccatttctccaccttggggccccttcctttccgccgccgtttggcagaggcatacctcttctctaacaaccaggttctgcttttaacccacattatctatttatgccacaccaatgctacattctgcctaagaccaacatttctcagtcttctatgccttatacggttactttcccatgcttccctaacctcccgtatcaccatttcttccagtaacacattacacttggccactatacttccactccaaacacgtaccctccagtatccaccctattccaacaccatacctccttattaacccggcccttttgtacccccaattaccttaacacacttcagctcacatcaccacacttctccaccaaacccaccctctgctcacccatcgctaccaccttctataccctgctataccaacccatccataactttcatcaccccccaagcatccacacctccttactcactctaaatcgccgtcacacccacttcccttcaggtgccaataacccccataaacacccactttg

SEQ ID NO: 510116 - DNA, 368 bp, Homo sapiens
aaaagacaccctcacctcattcaccatgagcctcatgaagaagaagagagcccacattctacaagcacaatccaggcaactcctactagtacaacggaagaaacagtctacccagcaaggaacacgtggtttggcaacagactggcattgaaggatatcgccacaacacccagagcaagactcccattcgcacaacagcggacagctgcagacctcagcgtcatatccagccatccagatgcaacggaaggacacacaccatagcccagtaggacagttcctggtactgcatttcttcaacaccaatctcacaccccaatgggacgagcgtcatcaagacagggaagaacggatggatatgtgactcc

SEQ ID NO: 510117 - DNA, 577 bp, Homo sapiens
ggcctcgtcgtgagcaagtgctgttgagcatggggtaccgctcgtttggtgccgttggctcggtttaccggcgatcggcgtgtgatgggtcagtgggcgaatgggcgcgtcatggctggcattgcgtggatcgttgtggcggcaatctcggctctcaacgtggccctcgtcgtcgagaccgtcatgggtgcatgatccctgagtgaaattctgtggcgacaatcgtgagatgagtgacaaactcaggcgggtgacgacgtcgaaccccacaccgacccctgcccacgagttggccaacgatttggccactgcatttcgaggacatcctgccggagtggcgatcctcaccacgatgggggtggctggaccggaaggcttgacggtctcttccttggcgtcggtgtcagtcgtgccggctgtcgtatcggtgtcgttggggcatgacctcgacgactctggacgctcttaccgagggatcgcgcgtcatcgtccacatgcttgacgcggatcgcgctggcctcgctgatgacttcgctgtgccaggggccggtcactttgcgggctcgggtgggggccg

SEQ ID NO: 510118 - DNA, 205 bp, Homo sapiens
aggatagaattggcagaagctcagctctgtgaactagctcccgttttatacttgggaccctactataagtcccttgggctccaatagagagctgattaattactgccaatcagaacccatccctatcaaatcagatgatagtggctttgacctagggaagaagaggttagaacgaaagaacccccaccatgtatggttagagagt

SEQ ID NO: 510119 - DNA, 396 bp, Homo sapiens
tctatcaaatagaatgtggtggaaatgacagtgtgactttcaagactaggccataaaaggccctgtggtctcatggtctctcttggatcactcattttggggtcagcatatgccttgttgtggggacactcaagcagtcaaatggagaagttgatatggtgaggaactgaggcctccaaccaacagccagcactgaccagccagctgtgcaagtgaaccaccctagaagcaggtcctccagcctcagtcaaaccttcagattactaaatccctgcccatttcttaaatgcaacctcatgaggaacctcaagccagaactcaccagctaagctattccaaatttcttcacccttgcaaactgtatgaaataataaatatttattgtcatattaaaaa

SEQ ID NO: 510120 - DNA, 142 bp, Homo sapiens
tctaggactaatgcaatagaccgcggttctatttcgttggtaatcggaactgaggccactcattaatcagggacggccggggcgcatacgtattgcgccgcaagaggtgacattctcggaccggcgtaagacataaccgcgg

SEQ ID NO: 510121 - DNA, 720 bp, Homo sapiens
  misc_feature (489)..(489): n is a, c, g, or t
gccaaaccatttgacccaaataaattataggcgagtagaaagtgaaagccctggcgcaatagatatagtaccgcgagggaaagatgaaaaagttataaccaagcataatatagcaaggactaacccctataccttctgcataactgaagttaacgtagacaactaacctttgcaatgggagacgccagaagctacagaccccctgaaaccagtacgacgctaccgtaagcaatcagcctaagaagagcatcagcccgatctatgctaggcaaagatagatggcgaagcatttagtaggctagaggtcgcacaaagccctacacgatccctggatgatgagactggctctggtcctagagcataggcaatcgttaggttgcaactattcacaagttctgacccaacagtaaaccgctctcaaatcctcctctgatacacattctacactgtgtagctccagaaggaggcaaccagcttccttgtgcgacnagcgtagtgcaagagaaacctttgctagtagcagtcagtctcaagaaaatttgaacgacccgactacggtagagccatcacatgacgcaagccaagcaagtgataagaagaggcgcttcaatgcgtcaaacacgcgcaccataccctacaagacaagtccccaatatcatagtaaagctgaacctcctcggcacccaaatttggagccaatctatcagcctgatagaagaa

SEQ ID NO: 510122 - DNA, 384 bp, Homo sapiens
cttttggggtctttgctcaggatgtcaagggaacccaggaccagatgcataaagtgataaaacaatctaattgtatcacaaatgtataaaacaaccacagcgatggggtggatgaaattgttgtggacctaagtaattttggaaatagagtctataaaattaaaggcaaaagaaactgtatataagtactgcactctagttgaaaagttgtttcctgtgggatatgggttaacaattatgatactgctgtacaggtatgctgggactgaacaaataaatgcaaagatggtggatggtggaagccaggttttttactcttagaggggagtgcatagatatgcaagaggaggatgctagaatgatctacatgataatgggttcgag

SEQ ID NO: 510123 - DNA, 1408 bp, Homo sapiens
  misc_feature (307)..(307): n is a, c, g, or t
gatgagattgagagagatggcggtcacgatcggaaggctaccggtgtcattgagcacgacgtgccattctatgatcttccaaccgaacggacgcaagctggccaatgggtgaaaggggaaggcgggtcggggagaattaggcacagtgaagcaggggcaggatagattggccattgctgtggttactaattcagtagtatagtacatcatgatttattcagacgagagcacagggaccaagcgaacgtgcatagttgttctctgatgagcaagtgcagttatggggctgtggtgtgtgactaaacangtgaatcaggctctagcaatcactcttacgcaacactgcatgtctctcggtatgtcacaacctctggcgcacaatggaaaaccgtactcgcaatggctcgatccctctatggactcgagatgtcaccaaataaatctgacggactggtgagacactgactcgcggcgtagccctgtattgccagagtcggtcatgaccactatggagtcagtcctcttgacccgctgaggggggggcccaattgacgatcaacatgatacttataggtcatcggttacagattgacacccaggaggcacctcctgtggggaactgtcatccagtgtctttcacatgtacactgacgtgaaaagcccacttgggaaaaggatagttcatgctccgggtctacttcgaatagggagggaagcctctcccatcaggggaaagcacaaccgctcggcaagaaggacactctttcatacgtacaccacatcccaaatgcggcaattaaccgatgacgtagctacgtgcccaatggttccatcttgggatagcagacatggtggtcatgtgccaaacacggaaaagagaggggtactctatggtccccggcatagatagagaggcttgggcaacatacacatgttgaggcatgccattcaaaacaccgttctcgaggaattgttgaaccagcttgttcctacgcaaggaagaaatggatgttccaggattttgggaaaacctttgggaacagaggagtcctccagtaaatttttttggagtggcgcaattggcgtgctccggttaggatccggataggcgcgacagcgaatacctaagaggagacgacccaaaggtttacacgcccctaggtttggtgcgagaggactgcaacagccattgagagaagttcgggggtcccttcagcgaaccttaatgtcccttgggccacaaggcacactccaataattagggggtgaaccaagcactttcttcattcttaggcttcctctttgtgactaggggcacccacgcaaagtatggcgcacttgagaacacacttgagatggttccaacacaactactgtgggttttccaataaatccaccactttgatgg

SEQ ID NO: 510124 - DNA, 345 bp, Homo sapiens
gccgcgttccagcagccgtcactcccgccgccggcccccgtgcccgacccgcctgcccctacccatccgcgcgggcacgggcacctggccagacgaacggtcctaggggcacccgagcagctgtcatctgtctcaggcattcatctcggcccactgagtctcattcgtctctgcagtactaaggctcagatccgtatcgctcggatccctcgataacccgccggagctctaaaccggaccgatctggatggcccgacggatggacggacgagagactgaggcagacgaggagaagacgaaaagacgacgaggcgacactgaaaacagaggacgatacagatagag

SEQ ID NO: 510125 - DNA, 1463 bp, Homo sapiens
  misc_feature (601)..(601): n is a, c, g, or t
tggcagaaaagccagttttttttttatttggtaaagctctgccataaatcttctagcgtgtgtgccaatgtggttcacctgtgccacaacttcgcaccaggtgtgtgttccggtgttagccagcaaacagaagttctgtggccattcagcgagaaccgaggccagggagaggtgtgcacgtggggtgtggttcgtgcctttgcgtggcgtggtatagcgtgatataacttctctgtgtgtcttctacgagtgtctcatctctataacaatgtgatctctttctccgctctctataaatctccacaaatctcttgtgatgtgactgtgagaggctctgtgtgtggccagagcacacgaccgagcacagtatagcgcgcgtgttagagaggctgtgtaacagacacacagaggggggcgtgtgtgagagtgacagtgtctctcccacaccacatctctagcgcgtgtgtgtacagaggtgtgtgtgtgtgcgcttctgcgtgtgtgagagaaactctcctaattaacaagtgtggcgctgtggcgccactctctcttgtggcctctctcagagaaaagcccacagagagaggggagactcccnactctgtggagagagagacacagagtctcacaccgcggtgtgtctccgagactatgagccctgtgtgtgtgtgtgccccaaagtggtggtgtgtgggctcttctcgaggctgtgtgccagaggtgtttgaggcgccgagagtgtttccacactcacgctctgtgcagacccgaggctgtttggtgtctcccaaagcccacccagaggagagacaaccgacagtgaaatgaaggggggttgttggccgtggctgtgtgtggggcggcggacagaaaaaaggcgggggaacccaccagagaaaacagcccgcgactctccctagaaaagtgtggggagtttcttactaatccgctgggggaacacgaagtgtgtcttctctttggggccaccaacacaacccccccaggggggtgttaatttcccccatttaaaggcgtttaggaaacagggggcttcatacattacctcgcgcaaagaaatccgcccagaaagacacccactttcttggccccgggtgtttggttaccacaacaggtgcgaacaaacagggggcgccaacagactctagctagggaaccacattccccttgtgggtgtaaatttgtggcgcccccaaacaaacaaattcgggccactctgttgtgggtgttcgttgcccccccggtgcttgtgtaataagaattcccacccaggacagagcggaccaagaggtgtatttcacccactacccgagaggggagagctcgcctctagtatagagcgtgggcgaacacactagtggtgacgccaacttcgtgatgacgacagaattaaccccaccactttaccatattaccaacaccgggtcgggagtgcgttcgct

SEQ ID NO: 510126 - DNA, 2127 bp, Homo sapiens
  misc_feature (1767)..(1772): n is a, c, g, or t
gaattccgagctttttattcctaagaggagaaaatcagtaacgggagaagcaggaggatgtccagaagaaatttcatcccttgctctcgcccctactctttctggtgttagatcgagcaaccctctaaaagcagtttagagtggtaaaaaaaaaaaaaaacacaccaaacgctcgcagccacaaaagggatgaaatttcttctggacatcctcctgcttctcccgttactgatcgtctgctccctagagtccttcgtgaagctttttattcctaagaggagaaaatcagtcaccggcgaaatcgtgctgattacaggagctgggcatggaattgggagactgactgcctatgaatttgctaaacttaaaagcaagctggttctctgggatataaataagcatggactggaggaaacagctgccaaatgcaagggactgggtgccaaggttcatacctttgtggtagactgcagcaaccgagaagatatttacagctctgcaaagaaggtgaaggcagaaattggagatgttagtattttagtaaataatgctggtgtagtctatacatcagatttgtttgctacacaagatcctcagattgaaaagacttttgaagttaatgtacttgcacatttctggactacaaaggcatttcttcctgcaatgacgaagaataaccatggccatattgtcactgtggcttcggcagctggacatgtctcggtccccttcttactggcttactgttcaagcaagtttgctgctgttggatttcataaaactttgacagatgaactggctgccttacaaataactggagtcaaaacaacatgtctgtgtcctaatttcgtaaacactggcttcatcaaaaatccaagtacaagtttgggacccactctggaacctgaggaagtggtaaacaggctgatgcatgggattctgactgagcagaagatgatttttattccatcttctatagcttttttaacaacattggaaaggatccttcctgagcgtttcctggcagttttaaaacgaaaaatcagtgttaagtttgatgcagttattggatataaaatgaaagcgcaataagcacctagttttctgaaaactgatttaccaggtttaggttgatgtcatctaatagtgccagaattttaatgtttgaacttctgttttttctaattatccccatttcttcaatatcatttttgaggctttggcagtcttcatttactaccacttgttctttagccaaaagctgattacatatgatataaacagagaaatacctttagaggtgactttaaggaaaatgaagaaaaagaaccaaaatgactttattaaaataatttccaagattatttgtggctcacctgaaggctttgcaaaatttgtaccataaccgtttatttaacatatatttttatttttgattgcacttaaattttgtataatttgtgtttctttttctgttctacataaaatcagaaacttcaagctctctaaataaaatgaaggactatatctagtggtatttcacaatgaatatcatgaactctcaatgggtaggtttcatcctacccattgccactctgtttcctgagagatacctcacattccaatgccaaacatttctgcacagggaagctagaggtggatacacgtgttgcaagtataaaagcatcactgggatttaaggagaattgagagaatgtacccacaaatggcagcaataataaatggatcacacttaaaaaaaaaacnnnnnnaaacaaaaaaaaaaaaaaaaaagggggggccctcacaaaagtatacccctacgagggggcccaaaggtaaacgaggaccccagtcttctcgtggcaccaacgggggccccacaatagggactcgcgattaaacagacaaggacacgggccggagctgtcataaacacggtcgtctgaccggggaaaaaccgggtaacccttgcgagacaccctcggagaaaagaggacccccataaacaaagccagagggggggcaccacacatggggggcaccaaagcgcagccccacacaagaaactcttaaaggcccccaaggggggaccatacagacaacttccacgaacgcgccctaata

SEQ ID NO: 510127 - DNA, 1493 bp, Homo sapiens
gaaggaacggtttcggagttgtttttctttgatacgggagttcctccttgctctcgcccctactctttctggtgttagatcgagcaaccctctaaaagcagtttagagtggtaaaaaaaaaaaaaaacacaccaaacgctcgcagccacaaaagggatgaaatttcttctggacatcctcctgcttctcccgttactgatcgtctgctccctagagtccttcgtgaagctttttattcctaagaggagaaaatcagtcaccggcgaaatcgtgctgattacaggagctgggcatggaattgggagactgactgcctatgaatttgctaaacttaaaagcaagctggttctctgggatataaataagcatggactggaggaaacagctgccaaatgcaagggactgggtgccaaggttcatacctttgtggtagactgcagcaaccgagaagatatttacagctctgcaaagaaggtgaaggcagaaattggagatgttagtattttagtaaataatgctggtgtagtctatacatcagatttgtttgctacacaagatcctcagattgaaaagacttttgaagttaatgtacttgcacatttctggactacaaaggcatttcttcctgcaatgacgaagaataaccatggccatattgtcactgtggcttcggcagctggacatgtctcggtccccttcttactggcttactgttcaagcaagtttgctgctgttggatttcataaaactttgacagatgaactggctgccttacaaataactggagtcaaaacaacatgtctgtgtcctaatttcgtaaacactggcttcatcaaaaatccaagtacaagtttgggacccactctggaacctgaggaagtggtaaacaggctgatgcatgggattctgactgagcagaagatgatttttattccatcttctatagcttttttaacaacattggaaaggatccttcctgagcgtttcctggcagttttaaaacgaaaaatcagtgttaagtttgatgcagttattggatataaaatgaaagcgcaataagcacctagttttctgaaaactgatttaccaggtttaggttgatgtcatctaatagtgccagaattttaatgtttgaacttctgttttttctaattatccccatttcttcaatatcatttttgaggctttggcagtcttcatttactaccacttgttctttagccaaaagctgattacatatgatataaacagagaaatacctttagaggtgactttaaggaaaatgaagaaaaagaaccaaaatgactttattaaaataatttccaagattatttgtggctcacctgaaggctttgcaaaatttgtaccataaccgtttatttaacatatatttttatttttgattgcacttaaattttgtataatttgtgtttctttttctgttctacataaaatcagaaacttcaagctctctaaataaaatgaaggactat

SEQ ID NO: 510128 - DNA, 847 bp, Homo sapiens
gggagtcttgctctgtcgcccaggctggagtgcagtggcacaatctcggctcactgcaagctccgcctcccaggttcatgccattctcctgcctcagcctcctgagtagctgggactacaggcgcccgccacacgcctggctaattttttgtagttttacgtagagacagggtttcaccatgttagccaggatggtctcgatctcctgacccctcgtgatccacccgcctcggcctcccaaagtgctgggattacaggcgtgagccatccaacccccgtgcttgttagtttacttttaaaaaaaatttcatgaggtacacgtgcagctttgttgtacgatacattgtgtagtgctgcggttcacgcttcagttgaacctgtcactcaaacggtgaacaaaatacctcataggtagagtctagcctttacacccctctccctcccctgctcttggaatgcgcaggtgtgccagcttcccatctttatgcctgattattcacattgtctagctacctatgtatacttgagaacacgtggtatctcaatttaccgtttctgtgtgaattcaccttacggatacacggcctccagctgccatctgtgttgctgctaaccaccattgattcatccttaccatggctctatactattctacgcgatatctgcagcaactacattcccttcatcccacgcacatacattgctgcgacaacctggggctgcttcccctcattggcttccacgattgactccgcgacagacctcacctcccgaacagcactcattgtctgaccacgtcttggcattggcatcgcacttcccagaacccttccatccccaaccaccc

SEQ ID NO: 510129 - DNA, 2094 bp, Homo sapiens
  misc_feature (1734)..(1739): n is a, c, g, or t
gaaggaacggtttcggagttgtttttctttgatacgggagttcctccttgctctcgcccctactctttctggtgttagatcgagcaaccctctaaaagcagtttagagtggtaaaaaaaaaaaaaaacacaccaaacgctcgcagccacaaaagggatgaaatttcttctggacatcctcctgcttctcccgttactgatcgtctgctccctagagtccttcgtgaagctttttattcctaagaggagaaaatcagtcaccggcgaaatcgtgctgattacaggagctgggcatggaattgggagactgactgcctatgaatttgctaaacttaaaagcaagctggttctctgggatataaataagcatggactggaggaaacagctgccaaatgcaagggactgggtgccaaggttcatacctttgtggtagactgcagcaaccgagaagatatttacagctctgcaaagaaggtgaaggcagaaattggagatgttagtattttagtaaataatgctggtgtagtctatacatcagatttgtttgctacacaagatcctcagattgaaaagacttttgaagttaatgtacttgcacatttctggactacaaaggcatttcttcctgcaatgacgaagaataaccatggccatattgtcactgtggcttcggcagctggacatgtctcggtccccttcttactggcttactgttcaagcaagtttgctgctgttggatttcataaaactttgacagatgaactggctgccttacaaataactggagtcaaaacaacatgtctgtgtcctaatttcgtaaacactggcttcatcaaaaatccaagtacaagtttgggacccactctggaacctgaggaagtggtaaacaggctgatgcatgggattctgactgagcagaagatgatttttattccatcttctatagcttttttaacaacattggaaaggatccttcctgagcgtttcctggcagttttaaaacgaaaaatcagtgttaagtttgatgcagttattggatataaaatgaaagcgcaataagcacctagttttctgaaaactgatttaccaggtttaggttgatgtcatctaatagtgccagaattttaatgtttgaacttctgttttttctaattatccccatttcttcaatatcatttttgaggctttggcagtcttcatttactaccacttgttctttagccaaaagctgattacatatgatataaacagagaaatacctttagaggtgactttaaggaaaatgaagaaaaagaaccaaaatgactttattaaaataatttccaagattatttgtggctcacctgaaggctttgcaaaatttgtaccataaccgtttatttaacatatatttttatttttgattgcacttaaattttgtataatttgtgtttctttttctgttctacataaaatcagaaacttcaagctctctaaataaaatgaaggactatatctagtggtatttcacaatgaatatcatgaactctcaatgggtaggtttcatcctacccattgccactctgtttcctgagagatacctcacattccaatgccaaacatttctgcacagggaagctagaggtggatacacgtgttgcaagtataaaagcatcactgggatttaaggagaattgagagaatgtacccacaaatggcagcaataataaatggatcacacttaaaaaaaaaacnnnnnnaaacaaaaaaaaaaaaaaaaaagggggggccctcacaaaagtatacccctacgagggggcccaaaggtaaacgaggaccccagtcttctcgtggcaccaacgggggccccacaatagggactcgcgattaaacagacaaggacacgggccggagctgtcataaacacggtcgtctgaccggggaaaaaccgggtaacccttgcgagacaccctcggagaaaagaggacccccataaacaaagccagagggggggcaccacacatggggggcaccaaagcgcagccccacacaagaaactcttaaaggcccccaaggggggaccatacagacaacttccacgaacgcgccctaata

SEQ ID NO: 510130 - DNA, 301 bp, Homo sapiens
gacaatcagctcagccctgccggtgcgcggatcatggacagtacagactcccagacggaagaaacccacctctgcggcttaagccacccggcttgaggtcttttgctcttccacctcattagatgccgggcaacaaaccaacccatatgccttccattgggttggtatgatagcccggcatctaatgcgatgacaaaacaaacaacccctcgttacctggacttgcactgacccctcaggatcatggaccttgagcctgaggagtggggccccgcctggcttggattccctggggcccccc

SEQ ID NO: 510131 - DNA, 641 bp, Homo sapiens
  misc_feature (596)..(596): n is a, c, g, or t
gcacgaggtacagcctgacatcattataaggcacaaaccaattaacaatattaattttatgatgaaaatatgtatgcatatattaatgaatgagaaaatattcaataaatctgaaaatagcaaatcatattattaaattcacatgggcaggatccatgtcttttgttcaccactgcatcacaaaggcccaacatcgtcctggtatatggcaggtacttaatgagtattagttgaatgaatgaatgaatgaatgagaaaagccaggattcagtagaccagatgaagagggattgtttatctttacaaggagtatctgattcgtctactttttgctctacccagatctgaactccttagcaattacttctttattcattcatacatttcaaaaggttcagccacggtaatttatgaaatgttgccaggattgaggagaaaatggagaactagcctaggatgcagactttgtgtgtttctttgtttctctcttgcctgaggttctggtttcccatttttaaaagtctaaaaccctcgtgactttactgtgtgccttattctagcattgggctcccactttttcctttcatcaaaactgntgatggataggatatattaaaagaaacccaaaggttaggacatta

SEQ ID NO: 510132 - DNA, 1945 bp, Homo sapiens
gaaggaacggtttcggagttgtttttctttgatacgggagttcctccttgctctcgcccctactctttctggtgttagatcgagcaaccctctaaaagcagtttagagtggtaaaaaaaaaaaaaaacacaccaaacgctcgcagccacaaaagggatgaaatttcttctggacatcctcctgcttctcccgttactgatcgtctgctccctagagtccttcgtgaagctttttattcctaagaggagaaaatcagtcaccggcgaaatcgtgctgattacaggagctgggcatggaattgggagactgactgcctatgaatttgctaaacttaaaagcaagctggttctctgggatataaataagcatggactggaggaaacagctgccaaatgcaagggactgggtgccaaggttcatacctttgtggtagactgcagcaaccgagaagatatttacagctctgcaaagaaggtgaaggcagaaattggagatgttagtattttagtaaataatgctggtgtagtctatacatcagatttgtttgctacacaagatcctcagattgaaaagacttttgaagttaatgtacttgcacatttctggactacaaaggcatttcttcctgcaatgacgaagaataaccatggccatattgtcactgtggcttcggcagctggacatgtctcggtccccttcttactggcttactgttcaagcaagtttgctgctgttggatttcataaaactttgacagatgaactggctgccttacaaataactggagtcaaaacaacatgtctgtgtcctaatttcgtaaacactggcttcatcaaaaatccaagtacaagtttgggacccactctggaacctgaggaagtggtaaacaggctgatgcatgggattctgactgagcagaagatgatttttattccatcttctatagcttttttaacaacattggaaaggatccttcctgagcgtttcctggcagttttaaaacgaaaaatcagtgttaagtttgatgcagttattggatataaaatgaaagcgcaataagcacctagttttctgaaaactgatttaccaggtttaggttgatgtcatctaatagtgccagaattttaatgtttgaacttctgttttttctaattatccccatttcttcaatatcatttttgaggctttggcagtcttcatttactaccacttgttctttagccaaaagctgattacatatgatataaacagagaaatacctttagaggtgactttaaggaaaatgaagaaaaagaaccaaaatgactttattaaaataatttccaagattatttgtggctcacctgaaggctttgcaaaatttgtaccataaccgtttatttaacatatatttttatttttgattgcacttaaattttgtataatttgtgtttctttttctgttctacataaaatcagaaacttcaagctctctaaataaaatgaaggactatatctagtggtatttcacaatgaatatcatgaactctcaatgggtaggtttcatcctacccattgccactctgtttcctgagagatacctcacattccaatgccaaacatttctgcacagggaagctagaggtggatacacgtgttgcaagtataaaagcatcactgggatttaaggagaattgagagaatgtacccacaaatggcagcaataataaatggtaccccttaaaaaaaaagggggcgggtaagtacccgaggggccagtaagcgtgccaggtttgtgcagggcgctagggggttataaacagcacggcggtaacaaggatggaaaatgactggtttgcgagagcctctttgggatcggaaccaaggagcgagaataagtttgtgacgtctgttgttggtttagtaatagcttcaaagggatgatgaggtagaactttatgaagac

SEQ ID NO: 510133 - DNA, 530 bp, Homo sapiens
cacgaggccggtgcgggcgtacatcgccgccatgccggactggaaacgcccgattggcgcgcgactggatgccctgatcgaacgggccgtacccggcgtgcacaaggcggtgaagtggaactcgccgatgtatgcggtggccgtcggcgcgggctggtttctcagcttccattgcttcacccgctacatcaaggtggcctttttccgcggcgctgcactgacgccgccgccaccggagccgtccaagagcggcgacacgcgctacctgcacatccacgaatccggcctgttggatgaagcgcagttcctggactgggtgcgccaggccgccgcgttgcccggcgagcgcatgtaagcccggcattccgattcccttcccgacgagagtccctgatggccacgcatgctccgaactctgccgatgctggaaccccggcggccgaactgatcgatgcacgcatcgccgagctgggggactggcgcggcgaaacgctggcacgcgtgcgtgcattgatccatgaagcactgcc

SEQ ID NO: 510134 - DNA, 2073 bp, Homo sapiens
  misc_feature (1713)..(1718): n is a, c, g, or t
gaattccgagctttttattcctaagaggagaaaatcagtaacgggagaagcaggaggatgtccagaagaaatttcatcccttgctctcgcccctactctttctggtgttagatcgagcaaccctctaaaagcagtttagagtggtaaaaaaaaaaaaaaacacaccaaacgctcgcagccacaaaagggatgaaatttcttctggacatcctcctgcttctcccgttactgatcgtctgctccctagagtccttcgtgaagctttttattcctaagaggagaaaatcagtcaccggcgaaatcgtgctgattacaggagctgggcatggaattgggagactgactgcctatgaatttgctaaacttgccaaatgcaagggactgggtgccaaggttcatacctttgtggtagactgcagcaaccgagaagatatttacagctctgcaaagaaggtgaaggcagaaattggagatgttagtattttagtaaataatgctggtgtagtctatacatcagatttgtttgctacacaagatcctcagattgaaaagacttttgaagttaatgtacttgcacatttctggactacaaaggcatttcttcctgcaatgacgaagaataaccatggccatattgtcactgtggcttcggcagctggacatgtctcggtccccttcttactggcttactgttcaagcaagtttgctgctgttggatttcataaaactttgacagatgaactggctgccttacaaataactggagtcaaaacaacatgtctgtgtcctaatttcgtaaacactggcttcatcaaaaatccaagtacaagtttgggacccactctggaacctgaggaagtggtaaacaggctgatgcatgggattctgactgagcagaagatgatttttattccatcttctatagcttttttaacaacattggaaaggatccttcctgagcgtttcctggcagttttaaaacgaaaaatcagtgttaagtttgatgcagttattggatataaaatgaaagcgcaataagcacctagttttctgaaaactgatttaccaggtttaggttgatgtcatctaatagtgccagaattttaatgtttgaacttctgttttttctaattatccccatttcttcaatatcatttttgaggctttggcagtcttcatttactaccacttgttctttagccaaaagctgattacatatgatataaacagagaaatacctttagaggtgactttaaggaaaatgaagaaaaagaaccaaaatgactttattaaaataatttccaagattatttgtggctcacctgaaggctttgcaaaatttgtaccataaccgtttatttaacatatatttttatttttgattgcacttaaattttgtataatttgtgtttctttttctgttctacataaaatcagaaacttcaagctctctaaataaaatgaaggactatatctagtggtatttcacaatgaatatcatgaactctcaatgggtaggtttcatcctacccattgccactctgtttcctgagagatacctcacattccaatgccaaacatttctgcacagggaagctagaggtggatacacgtgttgcaagtataaaagcatcactgggatttaaggagaattgagagaatgtacccacaaatggcagcaataataaatggatcacacttaaaaaaaaaacnnnnnnaaacaaaaaaaaaaaaaaaaaagggggggccctcacaaaagtatacccctacgagggggcccaaaggtaaacgaggaccccagtcttctcgtggcaccaacgggggccccacaatagggactcgcgattaaacagacaaggacacgggccggagctgtcataaacacggtcgtctgaccggggaaaaaccgggtaacccttgcgagacaccctcggagaaaagaggacccccataaacaaagccagagggggggcaccacacatggggggcaccaaagcgcagccccacacaagaaactcttaaaggcccccaaggggggaccatacagacaacttccacgaacgcgccctaata

SEQ ID NO: 510135 - DNA, 2019 bp, Homo sapiens
  misc_feature (1659)..(1664): n is a, c, g, or t
gaattccgagctttttattcctaagaggagaaaatcagtaacgggagaagcaggaggatgtccagaagaaatttcatcccttgctctcgcccctactctttctggtgttagatcgagcaaccctctaaaagcagtttagagtggtaaaaaaaaaaaaaaacacaccaaacgctcgcagccacaaaagggatgaaatttcttctggacatcctcctgcttctcccgttactgatcgtctgctccctagagtccttcgtgaagctttttattcctaagaggagaaaatcagtcaccggcgaaatcgtgctgattacaggagctgggcatggaattgggagactgactgcctatgaatttgctaaacttaaaagcaagctggttctctgggatataaataaggtgaaggcagaaattggagatgttagtattttagtaaataatgctggtgtagtctatacatcagatttgtttgctacacaagatcctcagattgaaaagacttttgaagttaatgtacttgcacatttctggactacaaaggcatttcttcctgcaatgacgaagaataaccatggccatattgtcactgtggcttcggcagctggacatgtctcggtccccttcttactggcttactgttcaagcaagtttgctgctgttggatttcataaaactttgacagatgaactggctgccttacaaataactggagtcaaaacaacatgtctgtgtcctaatttcgtaaacactggcttcatcaaaaatccaagtacaagtttgggacccactctggaacctgaggaagtggtaaacaggctgatgcatgggattctgactgagcagaagatgatttttattccatcttctatagcttttttaacaacattggaaaggatccttcctgagcgtttcctggcagttttaaaacgaaaaatcagtgttaagtttgatgcagttattggatataaaatgaaagcgcaataagcacctagttttctgaaaactgatttaccaggtttaggttgatgtcatctaatagtgccagaattttaatgtttgaacttctgttttttctaattatccccatttcttcaatatcatttttgaggctttggcagtcttcatttactaccacttgttctttagccaaaagctgattacatatgatataaacagagaaatacctttagaggtgactttaaggaaaatgaagaaaaagaaccaaaatgactttattaaaataatttccaagattatttgtggctcacctgaaggctttgcaaaatttgtaccataaccgtttatttaacatatatttttatttttgattgcacttaaattttgtataatttgtgtttctttttctgttctacataaaatcagaaacttcaagctctctaaataaaatgaaggactatatctagtggtatttcacaatgaatatcatgaactctcaatgggtaggtttcatcctacccattgccactctgtttcctgagagatacctcacattccaatgccaaacatttctgcacagggaagctagaggtggatacacgtgttgcaagtataaaagcatcactgggatttaaggagaattgagagaatgtacccacaaatggcagcaataataaatggatcacacttaaaaaaaaaacnnnnnnaaacaaaaaaaaaaaaaaaaaagggggggccctcacaaaagtatacccctacgagggggcccaaaggtaaacgaggaccccagtcttctcgtggcaccaacgggggccccacaatagggactcgcgattaaacagacaaggacacgggccggagctgtcataaacacggtcgtctgaccggggaaaaaccgggtaacccttgcgagacaccctcggagaaaagaggacccccataaacaaagccagagggggggcaccacacatggggggcaccaaagcgcagccccacacaagaaactcttaaaggcccccaaggggggaccatacagacaacttccacgaacgcgccctaata

SEQ ID NO: 510136 - DNA, 366 bp, Homo sapiens
ttgcgtcaggacactatgccctcattgtggtcattgggtgagggagtgtccttttgtcaaaggagtctgcaagagatagttggtcttatttctgtatgccaaagtgatcaacacaccatagtctcttccataaagaatgtggcttccttgcattctccatcctgttactctgggcccagtaatttgatgtctctgtctgattgtactagagacaggagtataccctgcttattcattatcaagtaaagagactcagattatatttgattttttagcctcctctagagcccatcaggcatttctgagttttctaggagaagggtttggtcacaaaccctaccattatctggagattacttgtctgct

SEQ ID NO: 510137 - DNA, 1816 bp, Homo sapiens
  misc_feature (1456)..(1461): n is a, c, g, or t
ctgttgcgaggaatgctgaggccagagaatggcatgaaccccggaggccgagcttgcagtgagctgagatcacgccactgcactgcagcctgggccaccgagccagaatccgtctccaaaaaaaaaatagccattgtgtataaacttaccctcatacctcttaatgaatttacttttcttattttattttttgaaggtgaaggcagaaattggagatgttagtattttagtaaataatgctggtgtagtctatacatcagatttgtttgctacacaagatcctcagattgaaaagacttttgaagttaatgtacttgcacatttctggactacaaaggcatttcttcctgcaatgacgaagaataaccatggccatattgtcactgtggcttcggcagctggacatgtctcggtccccttcttactggcttactgttcaagcaagtttgctgctgttggatttcataaaactttgacagatgaactggctgccttacaaataactggagtcaaaacaacatgtctgtgtcctaatttcgtaaacactggcttcatcaaaaatccaagtacaagtttgggacccactctggaacctgaggaagtggtaaacaggctgatgcatgggattctgactgagcagaagatgatttttattccatcttctatagcttttttaacaacattggaaaggatccttcctgagcgtttcctggcagttttaaaacgaaaaatcagtgttaagtttgatgcagttattggatataaaatgaaagcgcaataagcacctagttttctgaaaactgatttaccaggtttaggttgatgtcatctaatagtgccagaattttaatgtttgaacttctgttttttctaattatccccatttcttcaatatcatttttgaggctttggcagtcttcatttactaccacttgttctttagccaaaagctgattacatatgatataaacagagaaatacctttagaggtgactttaaggaaaatgaagaaaaagaaccaaaatgactttattaaaataatttccaagattatttgtggctcacctgaaggctttgcaaaatttgtaccataaccgtttatttaacatatatttttatttttgattgcacttaaattttgtataatttgtgtttctttttctgttctacataaaatcagaaacttcaagctctctaaataaaatgaaggactatatctagtggtatttcacaatgaatatcatgaactctcaatgggtaggtttcatcctacccattgccactctgtttcctgagagatacctcacattccaatgccaaacatttctgcacagggaagctagaggtggatacacgtgttgcaagtataaaagcatcactgggatttaaggagaattgagagaatgtacccacaaatggcagcaataataaatggatcacacttaaaaaaaaaacnnnnnnaaacaaaaaaaaaaaaaaaaaagggggggccctcacaaaagtatacccctacgagggggcccaaaggtaaacgaggaccccagtcttctcgtggcaccaacgggggccccacaatagggactcgcgattaaacagacaaggacacgggccggagctgtcataaacacggtcgtctgaccggggaaaaaccgggtaacccttgcgagacaccctcggagaaaagaggacccccataaacaaagccagagggggggcaccacacatggggggcaccaaagcgcagccccacacaagaaactcttaaaggcccccaaggggggaccatacagacaacttccacgaacgcgccctaata

SEQ ID NO: 510138 - DNA, 399 bp, Homo sapiens
  misc_feature (79)..(79): n is a, c, g, or t
  misc_feature (117)..(117): n is a, c, g, or t
ccttttttacatgccccctcccttccaggggggaaaaaaattttccccccccaaccccagccccctggggggcccatgntgaggggtccccttttttgttccctcctgcccagggangcttttttttttaaccccagggggggggggcgggcccccccccccagggttttgggaaccccgctttttccctcccctttctaggggcccctggggtttttgcccccttttcccttccccaaaggatggtccccccccaccccttttttcattttttgggccccaggaaggggtttccggtggggggccccaagtccccggcccccggggttttttttggggggggcctttttttcccctgcttttgggcggggggggcttaataaagggccccggccccca

SEQ ID NO: 510139 - DNA, 2199 bp, Homo sapiens
  misc_feature (1839)..(1844): n is a, c, g, or t
gaaggaacggtttcggagttgtttttctttgatacgggagttcctccttgctctcgcccctactctttctggtgttagatcgagcaaccctctaaaagcagtttagagtggtaaaaaaaaaaaaaaacacaccaaacgctcgcagccacaaaagggatgaaatttcttctggacatcctcctgcttctcccgttactgatcgtctgctccctagagtccttcgtgaagctttttattcctaagaggagaaaatcagtcaccggcgaaatcgtgctgattacaggagctgggcatggaattgggagactgactgcctatgaatttgctaaacttaaaagcaagctggttctctgggatataaataagcatggactggaggaaacagctgccaaatgcaagggactgggtgccaaggttcatacctttgtggtagactgcagcaaccgagaagatatttacagctctgcaaagaaggtgaaggcagaaattggagatgttagtattttagtaaataatgctggtgtagtctatacatcagatttgtttgctacacaagatcctcagattgaaaagacttttgaagttccatgtgaccttgccccattttcgtgggctggagcccagtggcgtgatctggggctcaatggaacctctgcctcccgggttcaagtgattctcctgcctcagcctccccagtagctgggattacagactacaaaggcatttcttcctgcaatgacgaagaataaccatggccatattgtcactgtggcttcggcagctggacatgtctcggtccccttcttactggcttactgttcaagcaagtttgctgctgttggatttcataaaactttgacagatgaactggctgccttacaaataactggagtcaaaacaacatgtctgtgtcctaatttcgtaaacactggcttcatcaaaaatccaagtacaagtttgggacccactctggaacctgaggaagtggtaaacaggctgatgcatgggattctgactgagcagaagatgatttttattccatcttctatagcttttttaacaacattggaaaggatccttcctgagcgtttcctggcagttttaaaacgaaaaatcagtgttaagtttgatgcagttattggatataaaatgaaagcgcaataagcacctagttttctgaaaactgatttaccaggtttaggttgatgtcatctaatagtgccagaattttaatgtttgaacttctgttttttctaattatccccatttcttcaatatcatttttgaggctttggcagtcttcatttactaccacttgttctttagccaaaagctgattacatatgatataaacagagaaatacctttagaggtgactttaaggaaaatgaagaaaaagaaccaaaatgactttattaaaataatttccaagattatttgtggctcacctgaaggctttgcaaaatttgtaccataaccgtttatttaacatatatttttatttttgattgcacttaaattttgtataatttgtgtttctttttctgttctacataaaatcagaaacttcaagctctctaaataaaatgaaggactatatctagtggtatttcacaatgaatatcatgaactctcaatgggtaggtttcatcctacccattgccactctgtttcctgagagatacctcacattccaatgccaaacatttctgcacagggaagctagaggtggatacacgtgttgcaagtataaaagcatcactgggatttaaggagaattgagagaatgtacccacaaatggcagcaataataaatggatcacacttaaaaaaaaaacnnnnnnaaacaaaaaaaaaaaaaaaaaagggggggccctcacaaaagtatacccctacgagggggcccaaaggtaaacgaggaccccagtcttctcgtggcaccaacgggggccccacaatagggactcgcgattaaacagacaaggacacgggccggagctgtcataaacacggtcgtctgaccggggaaaaaccgggtaacccttgcgagacaccctcggagaaaagaggacccccataaacaaagccagagggggggcaccacacatggggggcaccaaagcgcagccccacacaagaaactcttaaaggcccccaaggggggaccatacagacaacttccacgaacgcgccctaata

SEQ ID NO: 510140 - DNA, 157 bp, Homo sapiens
tggtccggtcgttaacaaccgtcgctgactgtgagagtccacatagcaggtccacaaaaggtggctccgattcctccctttctgagccagggccaggtcagtccggccgcggtttcctgttcagaaagggaggaatcggagccacctttttgtgcca

SEQ ID NO: 510141 - DNA, 2074 bp, Homo sapiens
  misc_feature (1714)..(1719): n is a, c, g, or t
gaaggaacggtttcggagttgtttttctttgatacgggagttcctccttgctctcgcccctactctttctggtgttagatcgagcaaccctctaaaagcagtttagagtggtaaaaaaaaaaaaaaacacaccaaacgctcgcagccacaaaagggatgaaatttcttctggacatcctcctgcttctcccgttactgatcgtctgctccctagagtccttcgtgaagctttttattcctaagaggagaaaatcagtcaccggcgaaatcgtgctgattacaggagctgggcatggaattgggagactgactgcctatgaatttgctaaacttaaaagcaagctggttctctgggatataaataagcatggactggaggaaacagctgccaaatgcaagggactgggtgccaaggttcatacctttgtggtagactgcagcaaccgagaagatatttacagctctgcaaagaaggtgaaggcagaaattggagatgttagtattttagtaaataatgctggtgtagtctatacatcagatttgtttgctacacaagatcctcagattgaaaagacttttgaagttgactacaaaggcatttcttcctgcaatgacgaagaataaccatggccatattgtcactgtggcttcggcagctggacatgtctcggtccccttcttactggcttactgttcaagcaagtttgctgctgttggatttcataaaactttgacagatgaactggctgccttacaaataactggagtcaaaacaacatgtctgtgtcctaatttcgtaaacactggcttcatcaaaaatccaagtacaagtttgggacccactctggaacctgaggaagtggtaaacaggctgatgcatgggattctgactgagcagaagatgatttttattccatcttctatagcttttttaacaacattggaaaggatccttcctgagcgtttcctggcagttttaaaacgaaaaatcagtgttaagtttgatgcagttattggatataaaatgaaagcgcaataagcacctagttttctgaaaactgatttaccaggtttaggttgatgtcatctaatagtgccagaattttaatgtttgaacttctgttttttctaattatccccatttcttcaatatcatttttgaggctttggcagtcttcatttactaccacttgttctttagccaaaagctgattacatatgatataaacagagaaatacctttagaggtgactttaaggaaaatgaagaaaaagaaccaaaatgactttattaaaataatttccaagattatttgtggctcacctgaaggctttgcaaaatttgtaccataaccgtttatttaacatatatttttatttttgattgcacttaaattttgtataatttgtgtttctttttctgttctacataaaatcagaaacttcaagctctctaaataaaatgaaggactatatctagtggtatttcacaatgaatatcatgaactctcaatgggtaggtttcatcctacccattgccactctgtttcctgagagatacctcacattccaatgccaaacatttctgcacagggaagctagaggtggatacacgtgttgcaagtataaaagcatcactgggatttaaggagaattgagagaatgtacccacaaatggcagcaataataaatggatcacacttaaaaaaaaaacnnnnnnaaacaaaaaaaaaaaaaaaaaagggggggccctcacaaaagtatacccctacgagggggcccaaaggtaaacgaggaccccagtcttctcgtggcaccaacgggggccccacaatagggactcgcgattaaacagacaaggacacgggccggagctgtcataaacacggtcgtctgaccggggaaaaaccgggtaacccttgcgagacaccctcggagaaaagaggacccccataaacaaagccagagggggggcaccacacatggggggcaccaaagcgcagccccacacaagaaactcttaaaggcccccaaggggggaccatacagacaacttccacgaacgcgccctaata

SEQ ID NO: 510142 - DNA, 333 bp, Homo sapiens
agggctgtaaaaaatatttcacccaaacagaaatcaaaagtgtgcaagagtagctataataatattataccaaatagcctttaagttaaaaatatataaaaagagataaagaaagccattatataatgataagaggatcaattctgcgtgagggtataacagtagtaaatataaatgcactcagcactggagaatccagatatatagagcaaatattattagagctaaacagatagactccaatacagtactagctagggacttcagcaatctcactgtaagcactggaaagatcatctagagtgaaaatcagcaaagtaacataggacttac

SEQ ID NO: 510143 - DNA, 1545 bp, Homo sapiens
  misc_feature (20)..(20): n is a, c, g, or t
  misc_feature (23)..(23): n is a, c, g, or t
  misc_feature (50)..(50): n is a, c, g, or t
  misc_feature (1185)..(1190): n is a, c, g, or t
tggagataaagaaaggagtnggngaccatccgagtcatcgtctgtgattntataaagactacaaaggcatttcttcctgcaatgacgaagaataaccatggccatattgtcactgtggcttcggcagctggacatgtctcggtccccttcttactggcttactgttcaagcaagtttgctgctgttggatttcataaaactttgacagatgaactggctgccttacaaataactggagtcaaaacaacatgtctgtgtcctaatttcgtaaacactggcttcatcaaaaatccaagtacaagtttgggacccactctggaacctgaggaagtggtaaacaggctgatgcatgggattctgactgagcagaagatgatttttattccatcttctatagcttttttaacaacattggaaaggatccttcctgagcgtttcctggcagttttaaaacgaaaaatcagtgttaagtttgatgcagttattggatataaaatgaaagcgcaataagcacctagttttctgaaaactgatttaccaggtttaggttgatgtcatctaatagtgccagaattttaatgtttgaacttctgttttttctaattatccccatttcttcaatatcatttttgaggctttggcagtcttcatttactaccacttgttctttagccaaaagctgattacatatgatataaacagagaaatacctttagaggtgactttaaggaaaatgaagaaaaagaaccaaaatgactttattaaaataatttccaagattatttgtggctcacctgaaggctttgcaaaatttgtaccataaccgtttatttaacatatatttttatttttgattgcacttaaattttgtataatttgtgtttctttttctgttctacataaaatcagaaacttcaagctctctaaataaaatgaaggactatatctagtggtatttcacaatgaatatcatgaactctcaatgggtaggtttcatcctacccattgccactctgtttcctgagagatacctcacattccaatgccaaacatttctgcacagggaagctagaggtggatacacgtgttgcaagtataaaagcatcactgggatttaaggagaattgagagaatgtacccacaaatggcagcaataataaatggatcacacttaaaaaaaaaacnnnnnnaaacaaaaaaaaaaaaaaaaaagggggggccctcacaaaagtatacccctacgagggggcccaaaggtaaacgaggaccccagtcttctcgtggcaccaacgggggccccacaatagggactcgcgattaaacagacaaggacacgggccggagctgtcataaacacggtcgtctgaccggggaaaaaccgggtaacccttgcgagacaccctcggagaaaagaggacccccataaacaaagccagagggggggcaccacacatggggggcaccaaagcgcagccccacacaagaaactcttaaaggcccccaaggggggaccatacagacaacttccacgaacgcgccctaata

SEQ ID NO: 510144 - DNA, 87 bp, Homo sapiens
gcggccgcctactactactactgctcgaattcaagcttctaacgatgtacggggacatgaattgatgaagttttcaactgagttacc

SEQ ID NO: 510145 - DNA, 103 bp, Homo sapiens
caatacaagtcgaacttcacattcttccgtgacatcccagtgcaagtactcagcaaaatgagggccttgtttcctgagaaattctaagtgattgttccccgct

SEQ ID NO: 510146 - DNA, 412 bp, Homo sapiens
agatcgaggggacgaaccgcaggatgatgggagccgtggacgctgccatgacgggcctgaaccagcgggagctagcctatcagagcaatgtgctcggagcgagtcgacttaggggcgccgagatgacgatctctctgttgccgacagcaggcttagcgtacttgcagatcagtgcagcacactgcagagattcggcatgacgagagcgaaggaggaacccagggacactcgaggctatgtgaacaacccttatagcccttcggctgtgctcctgaagccagtgacaacatgttcgagttaactactgtagcgctcacaggtcccaggaccgatggcaggaccttagccctgagtgtggctagattccgtttggtgctcttacagtcaggtagactgtctgcctctgggccct

SEQ ID NO: 510147 - DNA, 298 bp, Homo sapiens
actgcatccaacgccgcgcagcaggaggggacgtgtggaatttttttttttggatggctggttttcctggaaaggtgcgtgggggggggcggggcgtggaagtgatgggtagctttttctagcctgaaagatgaagacctgggtaaaatatacgggatcattaagggggtacaaataaaaggagaccggccttaatgtagtagatgggaaacttcaataatttttttttcttctaaagagataggtagcatgtttccaacttagaagggtgaaggcgggggcgtgggatgcagtcggg

SEQ ID NO: 510148 - DNA, 194 bp, Homo sapiens
ggtaatgttgtactctgctgttgtctctctgtccagcggtttttgtgttaatagggtgtaaaagttttccccagaaagccttaggaagaacggctgatcgtcttggatggaacaagttatttttccattttttcctgaaaactaaatcacgacacggtttaaaactggcaccatttttttcccgtgaaattccg

SEQ ID NO: 510149 - DNA, 159 bp, Homo sapiens
gcctgggtgtctgctcggacactagaggatcccctatctgccggtgcctctactagtgaaccatgtttatttcagcttagcaaactctaaattgagggaaatatataatctagagaacacacagaaaaatatattcgcaaaaccagatagagaattatt

SEQ ID NO: 510150 - DNA, 497 bp, Homo sapiens
  misc_feature (401)..(401): n is a, c, g, or t
tctgcaggacctcgtactggcatttgggctgaatgattcttgtggtggggtggaagtagagggtgggagttcctgtgtgttggagatgttctgcagcatccctgactgtattagtctgttctcatgccactaataaagacatatgcaagcctgggtaatttatacagcaaagagatttaactgactcacaatttggcatggctgtggaggtctcaggaaacttacaatcatggtggaagggaaagcaaacatgtctttcttcaaacggcagcaggaaggagaggtgccaagcaaaggaggaaaagcatcgtataaaaccatcaaatcttgtgagaactcactccctaccatgaaaacatcatgggggtaactgcacacatgattcaatcacctcccactgngtccctcccatgacacgtggggattatgagaactacaactcaagatgagatttgggtggggacacagccgaaccctatcactaacccctacccacc

SEQ ID NO: 510151 - DNA, 101 bp, Homo sapiens
gccctaagtaccccatcagttttccgtgagatataaactcaccattagacctatgaatcaaatttatctttagcaccacttgcattagagagatgcttaat

SEQ ID NO: 510152 - DNA, 1077 bp, Homo sapiens
  misc_feature (10)..(10): n is a, c, g, or t
  misc_feature (15)..(15): n is a, c, g, or t
  misc_feature (19)..(19): n is a, c, g, or t
  misc_feature (25)..(25): n is a, c, g, or t
  misc_feature (79)..(79): n is a, c, g, or t
  misc_feature (151)..(152): n is a, c, g, or t
  misc_feature (178)..(178): n is a, c, g, or t
  misc_feature (205)..(205): n is a, c, g, or t
  misc_feature (234)..(234): n is a, c, g, or t
  misc_feature (322)..(322): n is a, c, g, or t
  misc_feature (346)..(346): n is a, c, g, or t
  misc_feature (776)..(776): n is a, c, g, or t
  misc_feature (809)..(809): n is a, c, g, or t
  misc_feature (1064)..(1064): n is a, c, g, or t
  misc_feature (1077)..(1077): n is a, c, g, or t
tagtttaagngattnttantgaatntaaaatattctaggtaattaaactttactttcgtttgtatactcaaccaatgtnatttagtatatgtatggatggtaatgtataaatttaaatatttaatagagttagttgaatgaggtgtaaggnnagaaaaaataaataacgaatagaganaaaagtcattggaagtatgtagatgangaaaatttacaaaacaaagaatatgatancacgaagatggtatggtgcggagtgagtgcccagaggtttccgagttctacttcgtcttcatttccattcttatttggtatgaagttntatgtgagttcacattatcattcngaatttggatagacgtgataccacatccgcattggttaatctaaatgaggaagagccccaccggtcgtccgagagccattttcggtcgacgcccagcgtcgtttctctctcctccgacctccctctcttcctgcctccgcggtcgtctctcacccgctgctatccgctctcgtgctgagatcaattatcaccatctatctcctcatctttttctcctcatactcgacctcctcccctctctttatcattatcttctcactctctcttcctcttctcatctctttcattaaccatccacctatgttttctagttccatgccactcattctcgtctataactctatacttcactatataaaatatactcgtcccacttattttccttcgtatgcccacgataatctagcatgtatgacagctccttccgcanccaatgatcgcgccaaaaaaacgctgcttcccncttttattaaatttcttatctctttactctactctgaaaagcctcaccgcgcctatgcatctctatcttcctttcttttcccccctatcatgtccaccaagtttaccacttctcactttctatcctattaccacctggtatgcacgtgttgttacacctacacaaccttcactattaatcgtcagatgtgtaccacctctacctataatctattatttacatcaatatatcgacacctataatgacatctgaggnccctgtaatcatn

SEQ ID NO: 510153 - DNA, 291 bp, Homo sapiens
ctatggcttttagttttacctgccttctggttttttttctgactctatgacatggcttctatttctctccctgtttttgtgtgttgtataccatggctttgttgtctgctcctggcctggtgtggtggctctttgcctgttatccctgctctttgggtggtcgctggtggttctcctgtggcctggtgttcttgttcttcctgggcttctttgtgtgacccctgtccctactagttttttaataattttgctggaactggttgcttgctcctgtgtcttggctacttgggt

SEQ ID NO: 510154 - DNA, 200 bp, Homo sapiens
tggcccgggtatagtcaagacgtctgtaggttcacagttggtctatcaaaataaaagctattcctatcgtggcaaacaaaacttggtatctggtacaaataccatatatatcaccagactcatgaactaccattctcatcgatgattagaggtgcatggaatactttatcatgccacataacatttctaatccgttctcc

SEQ ID NO: 510155 - DNA, 181 bp, Homo sapiens
  misc_feature (68)..(68): n is a, c, g, or t
  misc_feature (109)..(109): n is a, c, g, or t
  misc_feature (179)..(179): n is a, c, g, or t
gtccgatttccgcaaagagttctacgaggtggtccagagccagagggtccttctcttcgtggcctcgnacgtggatgctctgtgtgcgtgcaagacccttcaggccttnttccagtgtgaccacgtgcaatatacgatggttccagtttctgggtggcaagaccttgaaactgcatttntt

SEQ ID NO: 510156 - DNA, 418 bp, Homo sapiens
  misc_feature (218)..(218): n is a, c, g, or t
  misc_feature (230)..(230): n is a, c, g, or t
  misc_feature (257)..(257): n is a, c, g, or t
  misc_feature (259)..(259): n is a, c, g, or t
  misc_feature (308)..(308): n is a, c, g, or t
caagaggatccccttgttctgtttacattgaaaggctgtgttgcgagggtcacaatgagctccaggaggctgaggctgcagtgagccgatatcacaccaccgcactccagcctcggtaacagatgtgggacctatctcaaataaaaagaaagtggctagtctttgccacttttgtgcagaaaagtacagaaagcaagtttctttttgttcactgtttncttatgtaagcnagaaaatactctctttctgtctctttntntctttctgtctttctctctttctgtctctccatctttccgtctttcttnctctccgtctctccatctctactaaaaatacaaaaattggctgggcgtggtagcggacgcctgtaagcccagctacttgggaggctgaggcaggagaatctccagaacct

SEQ ID NO: 510157 - DNA, 1675 bp, Homo sapiens
  misc_feature (1395)..(1395): n is a, c, g, or t
cctgtattgttgagtgttgggctccagactacactcgtgttttggttgcttttgttgctccctcttttgtggtggtgtgtggatagatacacccccacttgcctgccgtttgttttgtggtgcggggctgcctccccctcgtgttgtggaattttgttttcttgtgtgtgggagtggtcgcccccccccacacacggtgggtggggttgggtgctcacactcaacataaatatattcctgcctgctgtgtcgtgtctgtgtttgttaattaatctgcgtgtcgtgtggctctccccccctcgtgtttgtttttttgttaccccgggcggcgttttccttataagtggggtgtttctatgacgtctccttcttcttttggtgtggggtgttgcgacaatatattttttttggcgcccccctcttattcgggggggggcctaccctcctcttgtgtgttccgcatctaggatgttccttatcactcactgtgtttgttctggcggtctgtgttggtgttattaattttgtgttttggttggtccactcttctttctgctgtgtgttgtgcgcgcgtggtggtggtgttctgctccgcctgcgcacacacccacgcggggtgtgggttcaccctacaaccctctccgcgctggtgttgtgtggtgctgcggtggtagggtgttgtgtcgcagcagaagatagttttgttgtgtaggagtatgtgtcggcgctcacgtcgtggttgagagagtataagtcctcccctgcgcggtgttctcccgcttcttcgggaggtaattattctccccctgcgcgcgctgtgctgcctccaggttacacctcgcgtggtgtgtgctctccccgggagttctctcctctctccgcgcgcgcgtgtgtgtgtgtgatgtagagagagcgcgcgcgcggctgcgccctccctctcctccttgttgtgctgctgccctcctggtgggtccacttctctcgcccccttcctctctgtgtgtcctctgtgtgtgtgtgtgtgtgtgactgttgtgtgtgtgttgtgtgtctctgtgtgtgtgactctctgtgtgtgatgagagagagacctcacacacagagagtgtggtgagtctcacacactgtgtgtgagaagagagcgcgctgtgtgtgtgctccccgctgtgtcaccgctctctcacagtagatgtgtgctgctgtctctccccacaagggctccccgccgctccctctctgtgtgtctccactgcgctgtgtgtgtgtgtgtgtgtgtgtgtgtgcgcgcgctctctcacgcgagagagaagagatataatacactctgtctcacactgcgtgtgtggtgaagaagagaagataaaggtggtgggtgagatacatatatgtgggggnggggggagaccacaccacgcgtaataggtgtgtaggtgagggagagaacacacacccacacgggggccccaccagcaagggtgtgctcctccacacagcgcgcggagtaagaccacacgctgtgtgatacacaccacacgacgacccccctgtgtgtgtgtgtgtgtgtgtgtgtgtctcacagagggatgtgtgtgtatatgtgtgtgtggagaaaccccccagtgtgtgtgttttaatatatccccaaatataaaggtgtgtgtaaaccgtgtttata

SEQ ID NO: 510158 - DNA, 885 bp, Homo sapiens
ggtttgtgttatatcctcccccccctcctttgggggccggccgctattatagaaagggcgtttgtccgatctatgtttgggtgttttcgtcttttcttgttagagcgagatccaccccgccctcgggtcgagacacgcatgttgggtgcacactcgtgcccacgcaagagagaggtggtttggtcccacaagagagatattactcgcgctcgccgcgctgctatgtatggtgctgctatatgttcctcacgcagggtggtattatctgtcggacaatatatttgtgttttatataggggcggagctgctccccccagctagttctccgctgagaggtgttttatagaagaacccatcatatataagtaggggttgcaccacacccactgtttgtattgttgaaaagagagatactctctctggaatattaccacctctcttttttgttgtatagatatcgagcaataattttcttggagaatcaactgtgtgcgtgtttttggtgtagacaagtacagtcagataatacgtcggcggagtatagtgcagtcccggggctcttataacacaccacacccctcttttatcactctatgtatagagagagagagagaacaatatatcatcactcattattttcccccctattgagaggcgcacatagactcactctttttattttattcaacgaaaggttgttcttcaccacactgttttttccgcataatttgtgaatgcttccttataataaatacggcggtttccccacaccaaacaacccaaagtaggaggttctccgggggccccccactgaaatcatatttccccttttttttttttccacagcgctaaaaacacattaaacccaatttttccatttaaata

SEQ ID NO: 510159 - DNA, 290 bp, Homo sapiens
gtcgtatgtgcaccccccttggtgtcctattaacgcagcaacaatattggggctcctcttctcgcggcgagaaaaatatcctcccaggattattgtcctcacagagcgccaaattcttccgaaagaggactattccaccacaaaaagctcctttttggtgaaaacccgctcccccgtgggggcacagatgttctccaaccaggacgatggtcgacaaaccacggggagggggccttcacacaccgctgggggtgagctctgcgggaacttatttctgtggtgggaacccc

SEQ ID NO: 510160 - DNA, 299 bp, Homo sapiens
  misc_feature (236)..(236): n is a, c, g, or t
ggcagtgcaacgcgtgacatacctgcaagctgactcctagagtatccccccgcggctacgtcttacgggtcagcactagccaggacagcttccgggaacttggcttgctgtgcacttccttgggcagatccacacttagggtcctttcagactgctccatgagggctctcgtcacctgggctgtcagagccagagtatgcagccagaacatcccctctccatgcgctcagacactntaccgcggtgggtaccgaggctcgaccttcgtaaatcttggctcactagctattctcctgctg

SEQ ID NO: 510161 - DNA, 304 bp, Homo sapiens
acgccacgcccgggtcgagcgaccctccggcctcagcctcccaagtagcggaattacaggcacgcgtaccacgcccagccaatttttggtattttcaatagagacgtggtttcaccatactggtcaggcgggtctcaaactcctgacctcaaatgatcccccaactcaggctcccaaagcacggggattacaggcgtcagccacctcaccgggcccgggccactttgtgtgtgtgtgtgtgcgtgtgtgtgtgtgtatgcttgaaacaaggactgaatctgttgcccaggctgggcgtgcgtgg

SEQ ID NO: 510162 - DNA, 1091 bp, Homo sapiens
ggggtgcggtggctcaagcctgtaatcccggcactttaggaggccaaggcgggctgggccatctgaggtcagggcgttcgaaaccagcctggccaacatggtgaaaccccgtctctatggcaaaatacaacaatcagccagcgcgctgcctggcacatgcctgtcactctcagcatactcaggaggctgacagcaagcgcagaatcgcttgcaacctgggaggcagcacggtctacacgcgagccaaacatcgcaccactggcactccagccctgggcaaccaacgacgtgaaactccgctcaaacacaccacacacaccaccccccaccacacacaccacacccacaccatcccccccggccaccaggcgccccgcgccgcacaaacgccccactacacaacacaaacacgaacaggcccccaccggcccccacacacgcccacggccgccccggcggcaccaacgccagcccccccgaggcgacacccccggcccaccacccaacatacactcacctcacaactatctcccccccacaatataaaaacaccacactccatcgcccaccacaatctcattacccattacttccaccacacccttctcccacaacttcccctctctaatcacctacaataacaagccgaacaccacatacacacccagagtacccccaaccgccacgcccacaacaacccaaacaccaaaaccccaccacgaccggggcacacccaccgcccacccagccaccgcgaccacccaccacccacacgcaacacacacacctcacacaccccacaccccacccaccacccaaacacacgcatctacccacaccacgtcccttcccccactcccaacccatcactatcctctaccatcccaaaacacatccccccccacactccaacaaccgtgggcgcaagcggcagggacaacgcaagagccccgcacccccacaccgcgccctgacccgcccccccagcgcccacacaccccccctcccgccgcccaccacagcggacaccccccaaccgcccacaccccacgcacccaccgcgccgcccgggcgccccccgagcccccacc

SEQ ID NO: 510163 - DNA, 402 bp, Homo sapiens
ttatcagtggatggagaatatatgcactgtgtacagtccagatggcctcgaattgtaggatgcgctagaggaccaaccggtgatcctgcctgtgtggttttgacctgcacgcattcagcggccaggacgtagttcagtatctgacgtctttgtcgttgtgtctagggtgtctgtttgcttgctgtatattcactgagcacagcgggcttctccactggcacagggcacgcctgggcctgtgccctccctgccccgctgggtcagtggttgacgtcaggatatctgtcactgggcatctaactgggtggggcgggctggtgtgctcagcgtctgtctgtccactttctcccatgcttgttctctggaaggttccctgtcctgcgcccagcctgcaggacccca

SEQ ID NO: 510164 - DNA, 215 bp, Homo sapiens
  misc_feature (3)..(3): n is a, c, g, or t
ggncgactctagttgatcccccaaacaccgcaatctggacctggatagcatcatcgctgaggtcaaggcccaatatgaggagattgctcagaggagcagggctgagggtgagtcttggtaccagacaaagtacgaggagctgcaggtcacagcaggcagacatggggacgacctgcgcaacaccaagcaggagattgcggagattgcggtgtttg

SEQ ID NO: 510165 - DNA, 389 bp, Homo sapiens
aattatgaatctaaattcatttaaagaccatataattttctaatatgccaactatatttattagtcccagtatgaaatgaggaattggatgggctgagcaggtaaaaacctttgataaaaagccctattcttaccatttggacctggaccattgtgacaaggttttaatttctctcaggatctacttcaccttttaaaaaatcccacctaatggtattttataaaaatgaaactctttttaaatgtttgacatgtatatattagaactagagtagttgccaaaataataataaaatgtccatgctttaaactctatacttcataatattggcttagccaattttcttttttcagtgtaatggatccctggcagcttaaccaattattga

SEQ ID NO: 510166 - DNA, 449 bp, Homo sapiens
tctttgaaatattaagcattttgatttctcgaaaaggtgtaaaagatcttacttttagaatagtacaatgaatgaatggccagtaaaatttgccaatactcctggtaagagaatacgcagtgaagtacaaaagaaatccacacgtcggttatgatacaaaacacgagggtgtgaaataaagtgatcaatttgggacttgtttgttcgtgtggtggtaaactgtgttacaccaattttgccctttctcagtgaaaagagttaccaccgagaacgaaggtgtccctcaagattacaaaaagaaatgggcgtatcggcgggctattcttcgaagaacctttgactatgttgtgggtattaatccttgtgccgcaccagttatgttttaaagcgccgtggaccgtggaggaatctctagaacctcaaaagaggctctaggtgtggtttgtaca

SEQ ID NO: 510167 - DNA, 395 bp, Homo sapiens
  misc_feature (7)..(7): n is a, c, g, or t
gattttncatacttaaaactaccccaaactgctggggttacaggcgtgagccaccacacctggctaccctttcagttttaagccataataaaaattacatgaaattgggctgggcacgatggctcgctcctgttatcccagtgctttgggaggctgaggcaagaggatcacttgaggccaggagttccagaccagcctgggtaatgtagcgagaccctgtctctacaagaagataaaaaaattagctgggtgtcgtggtgcgtgcctgtgatcctagctactcaggtggcggaggtgagaggattgcccgaacccgggagtcaaaagctgcagtgagctactgtgatcatgcctctctactccagcctgggcaatagggtaagatcctgtctctg

SEQ ID NO: 510168 - DNA, 123 bp, Homo sapiens
cggaatcctgccagatgacgcttcatgcggcgcagtccagcgtgcctgctgcgcagtcaaggaggcaggcataagggagcagtgcgtcctttctgaagaacagatccggaagaagaaaatgat

SEQ ID NO: 510169 - DNA, 326 bp, Homo sapiens
gagacagctacaaacaagagagaccgatcaccccaccgctactctcagacggtggctcacacgagggagaccgaggaccccacgggctactctccgacggcggctcacacgagggagaccgaggaccccaccgctactctccgacgtcggctcacacgagggagaccgaggaccccaccgctactctccgacgtcggctcacacgagggagaccgaggaccccaccgctactctccgaggtcggctcacacgagggagaccgaggaccccaccgctactctccgatgttggctcacacgagggagaccgaggaccccaccgctact

SEQ ID NO: 510170 - DNA, 598 bp, Homo sapiens
  misc_feature (235)..(235): n is a, c, g, or t
  misc_feature (237)..(237): n is a, c, g, or t
gctcgaccgttccgccggatacgcgccctcctcctgtggataactcaacacaccacgcagcgtaccgatcggcagatacggcttctgcggcaggaacaaataacgctcggccggcaaacgaatgttgccatggccgtttggcacaaattgcccatggccctcagcaaggttgatttgccgctgccggaacgaccgctgagcatcaggcgctcaccttcggcaaccgtcagttgcncncgttcgagcagatgacgaccatccgccagatccaggctgaggttgttcacctgcaaaccgccgccctggcctggcaactcgatgcccatgttgcggccttcgttttcttccatcgcctcgccgaagctcagcagacgatcacaggtcgcacgccagctggccaacacggtgtacgcgtcgacaaaccaactgaggctgccctgcacactgccataagcctggggcacttgcatcagtacgcccaattcgatcttgccggaaaagtaacgcggcgctgccaccacaaacgggaagatgatcgcgatctgcgagtaaccgctggtaaagaaattcaggggttcttgagctgcatgatgctcca

SEQ ID NO: 510171 - DNA, 113 bp, Homo sapiens
ggctctatcaatgtgtggtatggtggaggggcatcatatgtcactccaggtatatggatgggttcgttctactattaggacttttcgcttcgcgtaacacgataatccgacgg

SEQ ID NO: 510172 - DNA, 532 bp, Homo sapiens
tagattttgggggatctagattctagtttagacatcactgcttactgtaagatttaagtcccattatttatttttcagtttcctaaattataacaataggcatagctgctacacctgcctcacatgaaagtgcttttttttaatgttaattttaattttatttttgagacagggttttgctcttgtcactccagtctgtgcgacagagcgagactccatctaaaaagaaaaaaacaaaaaaaaaagaaaaataatacatttatatagaattacctacaggtgtgttaaataaaaacacttcatacctagattttgggggatctagattctagtttagacatcactgcttactgtaagatttaagtcccattatttatttttcagtttcctaaattataacaataggcatagctgctacacctgcctcacatgaaagtgcttttttttaatgttaattttaattttatttttgagacagggttttgctccagtctgtgcgacagagcgagactccatctaaaaagaaaagaac

SEQ ID NO: 510173 - DNA, 1558 bp, Homo sapiens
gaattccggaacgttgaagcacaagactttgcggccattatgaatgaccccgttggtcaccatttgcagtatacgcagtggttccaacttgctaaacaagtcaaccaaacgttgtttgacttacgttcgtcggctggaattattttcccagctgaccagaaagaaatgtaatttatgccaattaaaccagcgctacaagcgcaatttgaacaacaatttaaagcccaaacacccattcaagctgctgtttgggagaagttagcgcagggcgacaatattttcggcctagcgccaactggaacagggaaaacgttagcttttttgctgccaattcttagccgaattgatcccaaagttaagcagacacaagtcttgattttggcgccaagtcaagaactcgccatgcaaacgactgctgttgcacgggaatggggcgctttggtcgatgtctcggtgacgagtttgattggtggtgccaatggccgccgtcaagcagataaactcaaaaaagataagccacatattgtggtggggacattaggtcgtgtattgacaatgcttgatggtggcgccctaaaacttaatggcttgcaaaccgttattttcgatgaagcagacgctatgttgtcagatgaacggcgtgacagtttgcaagcattagcagcgcaattaccaacagacgttcaacttggcctgttttcagcaacttctggggttgatttgaaatatgtcgccgacacttttggccaagaagtccgacccgtatcagttggcacggatgcgccagcagcgattacgcatgaatttcaatatgttgaccaaaaggccaaggctagtttgttgattcaactagcccgtaataagcaacaagctttggtgttctttaatacgattagtggcttggttaatatgcaggcgacgctacgtcacgcgcatgctagtgtgatgagtattggcagcaatgacaagcgacaagtgcagcgtgcagatgcgttacgtttattcaaaaaaggcgaagtatcgctgcttttggtgacagatgtcgccgcacgtggcttggatattgaagatctaccattagtcgtgaacgcacagttaccacaacggaaaaaaacatatattcatcgcgctggccgtacaggacgaatgggtaaaccaggccgcgtgttaaacttgggtaatgaccatgatattcgtgatttgaaacgcgaattaggggatgattttgttttggtgaaagccgctaatacgtttgccgatgcgaagcaggcgacaccgcaaaaaagtaccgctgcggtcaaggctgcacgcgcaactgcgccaactgatcaggcaggacaccaagcgtcgggccaagcggccaaaccagtgacgcaacgtccgacaactcaggcgaagacagtaccggttgttgaaaagcctaagaagaaaaaacgcttaaaggcatccaaagataagggaaagccaaaatgggctaaaaagtcggccgagtaagccacatatcaaaagggtcacagctaatcatcaagctgtgacccttttttaatatccggaattc

SEQ ID NO: 510174 - DNA, 1601 bp, Homo sapiens
gagcagttcggcggtcccgcgggtctgtctctatgcttcaacagtgtatggacggaacagatctcggggtactctcttccacgcctctcgaaccagtcccttccgatttactctcgtcctgccttagtaaccgtcctgggacctatcttctcggctcatcatccctgctctcatggtgcactctgtcacaggtactcgttatcgccgtggttaagcttcccattctttgccagaccaaccatgcagctcccaagattcgtcagcacatttatttcgcactcgacagttgggatgagccagctcgttcaaacaggtccctgggtccagagtttgtaacccatgtcaagggccctcccattcaaccttaaccttctttcttcgtggggctatcttagttacgaacccggcgattgaattgtctggctctgtgaccaggggcgcttgaggaccctacttgttcctatcctccgactgaaacaatttgcgtgcagcacgccgcagtaacaaggctgtccggaaggggaagcctaaacgcgaaggcaggctctttccgcaatgcatacgaacttgcacagcaagatagccacagacaggctcggcgccggtgacgcctgaccgtccatcccttcatattccccaaggtggacccaccttccaacagaacacagctccacagccactggtataatgcaattagcacacgttgggcgcgagcttatacacaagcgcgcgcaccaatgcacaactcgggcaccatccatgcgatagaccggcctaggcacctagtaggggtccccccttgcgcgacagcaacaccgaatatggccttggaagaatccacacggtgcgcccccagtattctttagggggaacttcacattgtaccaacgtaggccccccacttgaagcgttgtccttcggaccaccggatgacaggggacgaccctcaacacaacttcattacgttgggtaggaaaccatggttccccttggggaagcaaccctacgacacggtttccgccgctcaagacacctgacacgcggaaaactgtcactgcaaagagggccatctacattcggaacgcaaatacggacaattgtgtgtcgtgataacccccaacccttgtggaagcccacactcactctgtcgcccaaccatcaggcacctggcgcgctagggactccaccggagccagcgtcattggcgtcgcctgcgcagccgtgacagtaatcactccctccatctcgcgcgacagcacggcggccctaccaatctcccatcgccaaacgcccaccggcaacgctttaacagcaaaggcccctctgcatttgaatcgaccccacagtcacggcacgcttcctggacagggtggtccccacgttgtgcctaaaaagcgtacaacttaccggggcatgttcccggccgatgtaaagacccttgagttcgactgttcacactgccccacaccataggggcaacgccttatgtcgtctgacacctgtagtcccgtacacacacgctcgtattggtcatcaccaccagtgtgcgcaatcacaacaggctcgttcttattcgaatgtcacacaaccactacgcgcat

SEQ ID NO: 510175 - DNA, 241 bp, Homo sapiens
gtgggttgaccgtggcttgtagggttgaccgtggcttcggtcgctggctcgggtccagcccagcctccagcatactcctccagcacctgtaacgtaggctacttaccacttgcctagagggctagtaggcctccttagctgacccagggccggctacaacactagagcctagggctatccgggcaaggcctactcggtaggccaaaacaccaaccaggtacccaacaactatcaggccact

SEQ ID NO: 510176 - DNA, 568 bp, Homo sapiens
gtatcaacgcagagtggcattatggccgggggggggcaaaaaaaaaaaaaaaaaaaaaaaaaaaaaacttttttgggccccctggcctcgaaaaaattttctaaaaaccaacctacgtgggggggcgaccggaccccagaaaggattaaagtgccaaacgtgggcccaaaaggagtgtagtcccaacgagacaaaacctcgtgggacacgtcaccaccagcgtgcgtgtgagatacccctgcacccagaataaaaaaacgcccccgcgggaaacaaccgcgaggcggttccgtgagacaacaaagccccacaagatggagcagccaaaggaggagcaaactcaaggggggtcttcaatcacaaaaggggggaggcacaacacgcaaggaggcgagatatacacaaaagatgacagcgcccgcgaactggtgatgaagcaacaagacagaacaccacagagtacacaaacacgacgacaaagtcaaccgaagaacacgaaacaggaaacaagcagaaacagcaaggacgacagaaagacgagcatacaaaggacaagagaacgagaaag

SEQ ID NO: 510177 - DNA, 855 bp, Homo sapiens
atcccagcactttgagaggctgaggtgggcggatcacgaggtcaggagattgagaccatcctgcctaacatggtgaaaccccatctctactaaaaatacaaaaaattagccaggcatggtgtgggtgcctgtagtcccagctactcgggaggctgaggcaggagaatggcgtgaacccaggaggcggagcttgcgtgagcggagatcacaccactgcatccagcctgggtgacacagcaagactccgtctcaaaaaatactactaaacatttaacaataaataaataaataaattacccagtctcaggtgtatctttataccagtgtgagaacacgactaatacagaaaattgctaccaggaatggggtattgctataaagttacctgacacatgtggaacgcaccttcggcactgggtaacggggtaacgggtagaggctgcaatagttggagggctcaggaagaagataggacgatgagggaccgttcgccacttcctagcagactcgtcgccctggtcgtgaccaaaaatgctgatagtgatatgggacagcgaactccaggctgaggtggtctcagacggagatcaggacttcattgggcccggagtaaaggtcactcccgctacgcttaccaacgagacctgtcagcctttgtgccccctcccggggatctgccgaacctcgcactgccagcgatgccttcgcgatcgccgcaacatcctacacgcaggcctcacaggcgccggctctccgcatggctctaccgacgacgacttctgacgggccactacagcgcccacccccccgcggcccgccccccgccccgccgccccgccgcacccggcgcctccc

SEQ ID NO: 510178 - DNA, 1209 bp, Homo sapiens
gtgtcgtcagattgttctcattagtatgcgctgtggctcttttactccgcctatgttttgtgtcgtctctctctatactgctcctctttctaccttgtgttcgcctctgcccgcggccgttgtgggtcccgcgaccctttgggtcagtgtcctagcttctttcgttgcactgtctttgggttctgtctggccatctcggctccgcgcgtctggagttcctcttgggtttcactgatctttgttgcataacgcttcctggagctcactctgatctcccgggatttggacagtattgggatccccggctgatagctctggctttttggttggtggcattggcctgtcttcatgcggttttgcctctgtcgcgcacggtgtatatttgcggtcctgtcttgtgtcgagggttgtctttgccccgttctgcgtccctttccttttgtggcgctgtatgcgcccttcggcgcttcgtgtacgctattttccttcattccatggcgcatcgcctcggtctctgtattggtggtccttgtgcctttggatgcctgtggatggcaagtcctcggtccgtcctgtgccccctctgctcctcagccctccattgcttcatctgctccgggcagaatctgtgtggcccctgcctgtgccagccattgggctctgggatggactccctgggccccacccatttgccaagtccaggaatggcagctttcgcttgttcctgcctcgggacagccccgggtttcctccagcatgcctgatgtgtcccctctccccagcttcagaggccagcccagctcagcaccatccggcctggccttgcctgcagagctattaaatctataaccactagtctcgacaccagtctgcagtaccaggtcgtgtggagccgcctcccggcttcggggaggtccctcggtggctgggaacgcctgtgccttcgctgcgctcgaagccaacgccccctctgtccttcgcctggccctgtctgccgatccaggagctgcccagctctgtgggtcggtctggccttccctccttcgctccttttttatattagtgattttaaaggggactcttcagggacttgtgtactggttatgaggggtgccagaggcactaggacttgcggtggggagtcccgtgttctattataatgccaccccatataatagagccactgctcgtttttttctgggttgtttt

SEQ ID NO: 510179 - DNA, 567 bp, Homo sapiens
  misc_feature (544)..(545): n is a, c, g, or t
ctaggaacagtgtcatgaaatctgggttgaagcagaatacagtatatatgagaacacttaaagttcaaatagaaatcatttctgaagacaaaagcagaggaatattgtcagtgccaagtaatggaagaataagggcggcatttacactgtgcaagtattgagaagagtgcataaagacagggaactactctcatggagacagtttctctcttataatcaagtaactagaaggggaaaaatcatctaagttatgaaatccaacataggcgctatattacaaactgtgccggattatgcaaattgtagttgttactgatcaaagtttaattgcttcattctttgtttaaaaagcggatactgagtgtcagcaaaatcctgtaaatatgttttattccacaaaagatggtaagataatggtatacacgactctggtaatgtgagtggggatggcgaaaatattttaaattctctaagtggttgttttttttttgtaaacgaaagaaactccacatgtctctataccgaaagaaaatggaataaatannaaatacgaatatggcccatgaa

SEQ ID NO: 510180 - DNA, 457 bp, Homo sapiens
  misc_feature (118)..(118): n is a, c, g, or t
aacagccccagctcctgtgctggcctcttcattgcttcacacatcgggtttgactggcccggggtctgggtccacctggacatcgctgctccagtgcatgctggcgagcgagcacagntttggggtggctctcctactggctctttttggccgtgctccgaggacccgctgctgaacctggtatccccgctggactgtgaggtggatgcccaggaaggcgacaacatggggcgtgactccaagagacggaggctcgtgtgagggctacttcccagctggtgacacagggttccttacctcattttgcactgactgattttaagcaattgaaagattaactaactcttaagatgagtttggcttctccttccgtgcccagtggtgacaggagtgagccattcttctcttagaagcagcttaggggcttggtggggtctggagaaaattgtcacagact

SEQ ID NO: 510181 - DNA, 832 bp, Homo sapiens
  misc_feature (189)..(189): n is a, c, g, or t
  misc_feature (237)..(237): n is a, c, g, or t
  misc_feature (282)..(282): n is a, c, g, or t
  misc_feature (407)..(407): n is a, c, g, or t
  misc_feature (658)..(658): n is a, c, g, or t
gcttcaactcttatatactaagtctgcgactgacatactatgcgtatgtcattgtgcgcgccgtcactgtaggctgcgtacgtccgtaccgtcctggctgcttatcgtcctccgtgtagtacggacgcccggatgctgcgtggccaagcaccaagcctgaccatatctgagcgctcatacgtatcgaanacttgtactgaggcgcatctcctgcggtctcctagccacgcatggcgncttcgcatacgtgaattcctctagtctgcacgtagtgtatcatancctgcactcgagtatatactggagagccatctagagaaaacatgaaacgtaagttgcgccgctacactaacacgagatgcctgcgcacgtgaataagtgatcattgtatcggacccgtctgtganaactaactagtgacgacttttcctagcacatcatatactcatcacactcatacggcctttacgtacgcatgcgtcgtctgtattgatttatcagttgtgggtggtcgcccatcaatgtgtaacggtggtttggaagcaatgtacgtgaccacgtccccgggttgaacccaagtgtgtaaactgactaccgcagcaccctgaggaactcgtgcgcgtgtggtagccattagaactcgattgctttgcgtccntgtgaacaccgttagctagggttgttctcccgtcataatgcttaagtgggggcacatcgaacttcttcggatcactagatcgatatttgattcaataaataggaaacaccctctgaagcattaacctcccaagtgaaccagataactgtcctcccatccattgcgtttctagat

SEQ ID NO: 510182 - DNA, 438 bp, Homo sapiens
cacagtcctggaagggacactcatcattttatattcataatttggtgttcttttaaaaaagaggttcacacattacctatgctttagaccctgcaacacctcgctgtgctccacttggcatgtatagctcctttatgcaaatttcacaacatggccaggcatggtcactcacgcctgcaatcccagcactttgggaggccaaggtgggtggatcagttgagctcaggactttgagaccagcctgggcaacatggtgaaaccctgtctgtacaaaaaatacaaaagttagccaggcatgatggtgtaggcctgtagtcccagctatttaaggggctgaggcaggagggtcgcttgggcccggaaggcaaaggttgcagtgagctgagataatcgtgccactgtactgcagcctgggcaaaagaacgagaccctgtatca

SEQ ID NO: 510183 - DNA, 1483 bp, Homo sapiens
  misc_feature (106)..(106): n is a, c, g, or t
tcacccaaacaaattaaacacaacaacatgcaacattcaactccagcaaccagcacaactcatgtggcacaattgcaatcaaccatgacttgtgcaatgcactccntgtggtcaaatcactgcaacattacaggccatcagcatccaagcacacattcatcttgcacacactcacatcaagcacatcaacagcacaccaagttgtcacccagcacatcttcttgcggcatgctcagctcaaaagcacagtgttcgaagcaccagcacacattcaatcagcaactacacatgccccaccatcgaccaaaaagcgtagcacacagcatcttcaacagattcacaccaaccatccaccacacgtcaacacatcagcagcaaaccgcaagaaacagaaaacccccaaacagcttaagccagcaatcaccacagcaaacatcaagcatctagcagccagcaaaatccaaggcagcaccaagcagcacaataaaaacacattctttccacaacacatattaaacaaatattccaggcaggccgtaggtatttatgcagacaacaatacatatcaatccagactggctcaacatcagcacatcaatcaccagcaaggcaccacagcagcagccaagcaatcccaaacaacaattccagcaccacatcgactcacacagggggcgacttcatccaacccaagttgaatccccccacaaggcaatatttcacaacggccacagccaactcccggaagacacttatttattacaaacaaccttacttctggcaacaattacaaatacaggaaaaaactctaaggacaaaaactgacgacattccaacttttcctgggacaaccattacaagccccgttcctataaggggatgaaaaacccaggggcaaggaccccatgggcactcccgtgtgaaattaggagccacacgaaacggcacatttccgtgaacacttcgaccgccaggcaaaaatacaggtctacaccaaaaacaagaacagaagcacacaacatataaaaacaccacagacacacacgacaaaaaaaatatccagaagtaatccccaccgagcatgataaaacaaacgcgcggcgacaacatcatccgcgcacaatttctcacaaaatgtaaaacaggaggcacaccgcaaaaaatactaaagacgaccacactcaacagacaacaaggcgggagaagcatagagacaccaacaacacggcggcaagagagacaaagaaaacacaccaacagagaggcgagatacaataaatgcagctacaaaaggttgaccaaacgcgacagatcaaacaaaatctaaaatgacagaaactaataacgacgaaaacagacatcaagagtgagcacattccatgccgcacccctaccacttctatacgacaatataggagaagatgaaaattaatatatgaagtaacaagcaaactaaaagacgacaaaagagagacgacagatt

SEQ ID NO: 510184 - DNA, 203 bp, Homo sapiens
gtgtgaggggtagttcctaggcttagggtcatagctatccgcgtgtgttaacaaaagtggagtctgtaactaaagagggtacccgaggatgtgaacagttttatgttcgtcaggacattggaattgcattcgtgtcttgacccgatcacatttcatcacgactgccaacttcagtactctcccactgcaaccccgtaacacgg

SEQ ID NO: 510185 - DNA, 324 bp, Homo sapiens
gagagctttctgcatgtatctatccaacatacgaagggcctggtcgctattttaatacttttttctaaagacaaggtcttgctctatcacacaggctggagtatggtggcacaatcatagctcactgcagcctcaacttcctgggcttaagtcatcttctcaccgcagcctctcgagtacctgggactagcggatatgtgccaccacacacctagctaatttttctattttttttgtagagaggaagtctcactatgttgcataggctggtctctaactcctggggtcaagtgatcttcctgccttggcctcccaaagtgctgg

SEQ ID NO: 510186 - DNA, 1654 bp, Homo sapiens
tgtgggtggtaacagtgttttatggatgatgatgtccagggttcttgttgaagcctggggggggaggggcacaaagcgcgaagaagtgggggcgtaagggaaatgtcttgaagaggttgtctcgcggtgatagtgtgcgggtgcggaagccttccagaactaagggcgaagggcagggttggaggcctgcgggacaacacagcgcgggcgccccgagtccaccgcgtggccacagattagtgggaggtggcgtgtcgcggtgccctcgtggcgttcagggactatctgtgtcccagaggtgtggtctccaacatctcacagcgcacaacatctcgcgccagcgcgagatatctccagagggcgcgtgtctccacaacatatctccacaaccacagtgtggcatatgtgaatctataaggtgcgcacatatttaaatattcacaaaagagggtgaagcggggggggacaaaaccagagagctcgcgggggagagaggtcttgagaaatattctctctccgagaaacaaagagggaaaagaagcgagtgaaaagagctcctctaagtaaaacacacagagaaagaactcgagaaagagggtgtgttggcacaacatagcagagaaatacacagagacgcgggagagagtgtgcgcgtgcgggggaaagcggggcagtctcaaactcgcgcgggcgtgtgatgcgggaaagcctcttcacagccccccgtgggcgcaagtgacaagtgtgtggggggtggcgcgtggggggtgggtcctcccacacgcgcggtgcttccgcgcgcgcgtccacggggggggtggtgttgtgggccccccgttgtgcacactacactagttgcggaaagttttcctccacgcggggtgtgatccgacgtggatgtgtggggtttgaactatgacgagtgtctccgccagctgtgccgttgttactcccccgaaaagttgggggggatgcacttcctatgtgggggaacggactgtcgtcgtggcggcgcccattgacacaactgaaaaggggcctcctgtggcggatctcccacctacctgtgcggcgctactctcaacaccccttctttcccgcaaggaacaacgcgcccgagaaatattacccccggtggtaccgcactacacaggggtactccacgtgctgccaccacacgaggtgggtgggctatttgatttacaccaagcgggtctgggccgacgcgcaatataacttttcactacatttactcacgccccaacacgggccacaacaaaaggggaggtatacagaggcgagtgccaccacggcagtactctccccaagaggggcgcccccaacggcgtcgttgtacacagcagtggtggtaggacacgacacccccaacaatttccccattaaccaacgagggaagggggaggaggagaacgtacgcggcggaggaacacccccaaagtatgggtgggacagccccacataatgggttgttggccccagacacacccccgggtggggagggacgacggcgtactacatagcgcacagaacagagcacccccagggcatttctgtggtgcagcgacacgacggccccacacaccaaccgcccataaagcgtcgtctcatcacatcaaggagccatgatccaatg

SEQ ID NO: 510187 - DNA, 162 bp, Homo sapiens
aacctgggacgaatattcataaccagttgtaaagtagaacataacaggttatggcaagcagcatcaccaccactcatcatcaccatcatcatcactatcaacaccaccaccatcagcagcatcatcaccatcatcatcatcaccaccaccatcatcaacatc

SEQ ID NO: 510188 - DNA, 402 bp, Homo sapiens
gaactcctgagcgtcaggtgatccactcgcggccatcggactcccaaagtgctggagattacaggctatgagcccccgtgcccatgcatcaaaatgctttttattgtctgcactatgttggaagtactcttttacacatttaaaaaaaatgatctgtttatgaagtgcaaagatgtgtcaatatcttggagaactttcaatgaaacgcgccaaaacaacacaaatgggtcaaacaacgggcaagttcgagaaaacttatgagaaatctaagggtacttcgggcgaacgtggaagcactggcaagcgtaagtttgcaattaagagttcagcaagagcgtttgtgatactctgttctggtatattacagttgttgtgtgatcttttagagaacaaagcgaacta

SEQ ID NO: 510189 - DNA, 152 bp, Homo sapiens
cttaatcggcagtcacaccataggaagagaatgggctgtccctctgaggtgtccccagtagaaggaaacgggcatcacccgctttcttgctggttgtcatttttgcagtagagtcatctccatcagctgtaagaagagactgggaaaatagg

SEQ ID NO: 510190 - DNA, 148 bp, Homo sapiens
gaaaggtgagaaatgtttattgaatacagtgcaggtttataaataaaacgtatttacaatttcatagagttggtccatagagaggtggttaaatctcaaacagtttatctaagatttacagaaagtcaagtacatctcttttaaatag

SEQ ID NO: 510191 - DNA, 1095 bp, Homo sapiens
ggtgaagtccgtgccatgtgacctgaggcgagtgggggacaagaggttccttgtgggctacaacgaatcctcgcaacactgtctcgtcacatccatctctcgaatgacttatgaaagggttatgcataagagttaagtctcatgagctcaataccgagtctttgttcttgacaagggccacatgtacaatgtccagacatagttcatgtcgcgaccaggcattcatgcttcctaatcgcgcatgcacgcaaatgtataagtcatcatatgaccacgtactgaaactcacatgaagacgtctcatcagagtaatcagttggagcgggcatgaaggtcttatattcgatacgaaaaaagcaaaaataaacagttagctaaaactagtttgtgacactaggtcgaagtatctcatcgggttgtcaccccacctttttacaggtcggccgggggtcacttactttttggattacgaggtcctaaagggtccctccgaggcggttacccttaacctcaacaacgcctcgtactacctgatgaagatattgtggtgatgcgtgacaggaacgttcttatgcgttgtgatgaacacccaaatgaaagttgacccctgtcccaggtaaagtgaccacaagctgggggatgtgaaaacgaacactcgtggtgttgcgcccacgtcaggaacttggtgtgtagcgagcactgtccattggaaattttaaagatgggttccgcaacccatcgcagaaagttggacattgcaacgtctacatatgaagagaccacagtttgtgggcactatatgatagtaggtggctaggcaaaagcaacaaccgaattactgaaccgaccaccgtgaaaatcctcctggaatcgtccggaacaggacataccattgaatgtgcctctccgatttgtgggggacagacctgttgggaaaccggttgagaatataagcccctagagtgtgagccacattttagcacgctggtgtaccatacatagggcgacaccgttggaggagaaagcggacacttgccattagttggtggaaatcaactcaacacatgcgcgttatgaggaagacaacagtacacc

SEQ ID NO: 510192 - DNA, 307 bp, Homo sapiens
  misc_feature (50)..(50): n is a, c, g, or t
  misc_feature (52)..(52): n is a, c, g, or t
  misc_feature (278)..(278): n is a, c, g, or t
tggataaccctcaaagaacctcgtgaaagctgtggttacagctgggcacngngtgtcacgcctgtaatctcagcactttgggaggctgagaggccccggatcacccgaggtcaggagttcaagaccagcctggccaacgtggtgaaaccccatctctactaaaaatacaaaaattagctgggcgtggtggtgcacacctgtggtcccagctactcaggaggctgaggtaggagaatcacttgaacccaggacagaggtcgcagtgagccaagattacnccactgcaccccagcattggcgacaaacg

SEQ ID NO: 510193 - DNA, 167 bp, Homo sapiens
ctacaggatccccccggacagtgagatgatgcatcatgcattttcttccggcgcgccttgccctggtacttgacgcgccttcttgcgtgtccgacacgggccctctccacactcgtctcactcgtcgtgttccagccattgtagctcaatcctagtacactcatctc

SEQ ID NO: 510194 - DNA, 382 bp, Homo sapiens
cccctaggcagccaaagcatctgactcgctctcgcctggtctcgtctcaacatcagatacctggcggacactttatccaagcaaacattaccgagtccagccagcaggaaatacagcatattgtgactcggcacggtcctgcggcagacaggcatttattacgctgtctattttcgcatgtggattccagcggcgatggtacacgcagcggcaacgatttccatcagactcagcttctgatccagccagtgtgccgttgctgatatacaaagccaaactttctatctcgaccgctgtccctactgccattgactactcccattgcaactatccagcagagttttacagccctgcaccccccactttattttgcccacgcttt

SEQ ID NO: 510195 - DNA, 245 bp, Homo sapiens
cccttatcatagaacaccgggggcgagatcggggtcgaaatgcattatattctttaagtacacgctagatacaactgtctggcctggtcctaacgctcgcaacgaacctaactaatactaacatctcagacgctcaggaaatagaaaccgtctgaactatcctgtccgtcatcatcctagttctgaaccccctgccatacctacccatactttacataacagacgatgtcaacgatccctccctt

SEQ ID NO: 510196 - DNA, 1656 bp, Homo sapiens
cgaggcgccgacgccgccggcgcagccgccggagccgcaatgcctaaaggaggaagaaagggaggccacaaaggccggcgcgaggcacgtatacaaggccctgaggagatcgacgcgcagctgcacggctgagaacgcaccaaggccacgggaagaaggaggacgcacatagaagaaggtggagatgtgggctgcaggtgaccccaaaaaggagacagacatctctagcactctatgatgatgacgtgatggattgactggaagatgactcaccagacaaaagcgcaaagcgcgttgacagggtctcatctgacgatctgagaacccctaaccgggtggcacagacactatgtttgaggaggactgggaggtcgggagagaccatgagggagaagagggatacggactgacataatcgtattgaagaacaggaaaacgaatgaccggaacaaggtggtatgacatgtaattgataaggccgattctgaacttagtgagttgtgcattgctatattctgaaaggatatctgcgagaaggtcacacttgtggattgggggtgggaagatgaccatgggtggaggaacttgggggggtaagatgagatgcatggcatttaacagtagatcaggtaagttgggtacggattgatgatgacgccattgtgaaaagggaggggatcgggataaggtacacgcaaggggagggggcaaagccattgcgatataggaaacccacgggagtgaagacgcatatacaacacatcaacatgtagcgcactgggaacacccattggtgtctctggccacattggagaggtgtggccatcaagtctttccaacattaaccgcaatgcgggcgcttgaaattccaaccagcattgggaggaagcaccactagagatgataccacatatagaggtgtcacctctaggcatacgggcgctaacagatggaatagtatggatcgccgcactgggggtctacaggagccactcggtcatttcgacctttgggacacacatacgaggggaagaagcattccaacgcgttcatttcgtaggacacaccttataccgttaggccccgacgggtgagcccacgatagtacaaacgaggtgtgggagatacaaggggcagcaatgctatgacaccaagttgtagcgcaaagaccagctacgtcacctatatgtgagaacacacatatcgcaaagagaaaatagccgctagctgtacgagaaagtaatgatcatagtggcagaactgagagcgagcaacaaatgtcggcgcacgcagagagagcacccagcgagtgcgcaaactatttggggagaacaactaggcaagcgggcacaccctagctgcgcgacggcaagcaatagtaaaccggtgggccgccggcgacagaatgagccacacagcagagccgacgaagacaaggacgacgcgacgaacagtagagtcaaagaggaggcacaaaaaggcaaggacaaaacacagacgcgcaagcgcgaaaaacaagaggagggaacgaaaggaggagcgagggcggaccacgcttgggagaagcgaccacacgcaacgcgggcaaacatagatggagacactcgagcgctaggaagacagaggagcgagcgagcgagcacaaactccggtcgg

SEQ ID NO: 510197 - DNA, 414 bp, Homo sapiens
ggccttcacaagaccgccggtgagccgctgacctggccgtgttctgggtggagttgtgatgaggcacaagggcgcgccacacctgcgccccgagccagacctcacctggtaccagtaccattccttgacgtgattggtttcctcttggccgtcgtgctgacagtggccttcatcacctttaaatgttgtgcttatggctaaccggaaatgcttggggaaaaaaagggcgagttaagaaagccccacaaattccaaggacccattgagaagtggggtgggaaaaataaggtaacaaatttttgaaccatttccctagttcatttccaaattgaaaacagatcagtgtaaattcattttatcttataagggaaatactttgcataaattatcagcccagagtgctttaaaaaatct

SEQ ID NO: 510198 - DNA, 449 bp, Homo sapiens
  misc_feature (24)..(24): n is a, c, g, or t
  misc_feature (50)..(50): n is a, c, g, or t
  misc_feature (58)..(58): n is a, c, g, or t
  misc_feature (80)..(80): n is a, c, g, or t
  misc_feature (222)..(222): n is a, c, g, or t
  misc_feature (344)..(344): n is a, c, g, or t
  misc_feature (389)..(389): n is a, c, g, or t
  misc_feature (401)..(401): n is a, c, g, or t
  misc_feature (417)..(417): n is a, c, g, or t
  misc_feature (429)..(429): n is a, c, g, or t
tctgcttgagatggccagggtgtntcaatgtcagagtaacgccataacanaagaaatnagactaagaggctgggcatggnggctcatgcttgtaatcccagcacttcgggaagcagaggtgggtggattacttgaggtcaggagttcaagactagcctggccaacatggcaaaaccctgtctctaccaaaaatacaaaaattaccctgaggccaggtgcggnggctcatgcctgtaatcccagctctttgggaggctgaggtgggcagaccacctgaggtcaggagtttgagaccatcctggccaacatggcaaaacccaatctctactaaaaaatacaaagcnttagccaggcatggtagtgagcacctgtaatcccaggtactcggnaggctgaggcanaattgcttgaacctgngtaggtggaggntgcagtgagccgagatggtg

SEQ ID NO: 510199 - DNA, 496 bp, Homo sapiens
agaacacatcttacccagccaagggtttaatctttcccgacggcctaagagggattcagtacccagcggtaacaccctacttagccctatcccagggctatcccctatcagcaaggggtacaatggctggaatggtgggtctgacttccttatggagtggtaagatctctaaagataggaatttggtaatagcgtacactattccatcctcaggggcttaacagattctaaaaggtagtcacagttctaaaattgtatagacaaaatcttggatccaccatccaattccccctatatataatcccattaccagaagtcaggagtccactcaacaagccaggaaacaaacacttactcggagggcatctctagtagtttatccaaaagacaggaaactttctcctaaaaacagaaaaatccccacctataaaaggagggctgctctgggcacaaaacattccgaatcctaccctttcaaagtcttcagatagatggg

SEQ ID NO: 510200 - DNA, 153 bp, Homo sapiens
gatgagctggtcccagtatagaaagggctcgcaaggagcccttttcttgccgctatcaggggatcagcaggctggagccgctggtgctgcgactttccagcacctggtgcgcccgctgggcgtcggccagcgcaaatttctgctcgtctctca

SEQ ID NO: 510201 - DNA, 439 bp, Homo sapiens
agataatctggattagctgtgttacacattcgcaagcgcatgtttgttttctttgtacaccaagctttattaaaccttgccctaagagaaattaggaaatgttcatgttttgattaatccgttttaatcaaatattgtctttctccttgctagttggtatgttttgattaaaaaggcagaggattagatgtaacctaattgaaataggctttatttgtttgcgcaagaacagacttgaataagacaaccatagcaaaatactcatgctttcctctaagagctgttgctcataacagaagtgatgattatacgtaaacatctatattttggcttgtttgggtttaagcctgtttgaaatcattcttctttctcggaataaagcacatgtggtgttttattttgaagtgcaaataaaatttataagaaattttgatctgca

SEQ ID NO: 510202 - DNA, 381 bp, Homo sapiens
  misc_feature (318)..(318): n is a, c, g, or t
  misc_feature (323)..(323): n is a, c, g, or t
  misc_feature (357)..(357): n is a, c, g, or t
  misc_feature (364)..(364): n is a, c, g, or t
agaaacaacagaaattttacttcttacagttctgaaggctgggaagtccagcatcaaggcaccagcagattcaatgtctgataagggcttgctcaaagatggtccttaggctgggtgtggtggctcatacctgtaatcccagcactttgggaggccaaggtcgggggatcccttgagcccagggagttcgacaccagcctggggcaacacagggagacctcatcttaaaaaaagatgggcaccttatttgcagtgtccttcacgtgggcaaaaggggcactcatcttcatttcatggacacaaggagccctcgtgganttcanttccttaaagggccccaacctttttaattacccnttcacantggggtattttagggtt

SEQ ID NO: 510203 - DNA, 591 bp, Homo sapiens
cgcggtggctcacgcctgtaatcccagctctcagggaggctaagaggcgggaggatagcttgagcccaggagttcgagacctgcctgggcaatatagcgagaccccgttctccccaggaaacacaggaaacaaacaaacaaaacaaaacaccaaaggcacaaaacaaaaaacaaaaaacacacaaaaaaaaaatctgtgtggggcgcgcgcgcccggggtctctaaaaaaggggcgcccccggagaagttttttaaaaacacattagcgggggggcgcgcaggggcccccaagagaggaaaggcggacaccggggagcaaacaggggtgaccaagagagaacccggggcgaaaagcacaagggcgggggagttcccacacagtaacaaaaaacaccgggggggggaccacaccggcacgggttttcgaggaacaaaacgccccaggaggggagacacaggaggggccaaaaagaggggggagaccaaaccaaaaggggaagcgcccacacaggggagcccgcgcaaaaacaacaaattacaaccccccgcagcttcgcgggggggcactcgacaagaaagacagcccactg

SEQ ID NO: 510204 - DNA, 483 bp, Homo sapiens
ggtcctagttatgcaggaggcagaggtgggaggattgcttgggcccaggaggtggaggttgcggtgagctgtgattgcgccactgcattccagcctgggcaacagagtgagaccctatctcaaaaaaaaaaaaaaaaaaaaaaaaaaacacactgtggtgggcgcgcggcctggggccctcggaaaaagttttctaaacaccatatccggttggggcgcgcggggggcccaagtagggtaataggggacactggggccaaagagcgggtgcccatagaggagagaaccgggggccagtgaaaagaggggcggggattcccacacccaattaaaaaagcgccgcgggggggaacacgcggagggtttctggaacaaaacctccgagagagggggagttccgggggggcccaaagaggggaactcttattaaaggggggagttcaaggggaaccccgaatttcaaattaccccggggggggggcc

SEQ ID NO: 510205 - DNA, 349 bp, Homo sapiens
aggttgaattccaatgcttggtagttgagcccgatgtacttgtcgagcagctgtcgccctctacgtagcacaggttgtagccgatcagttcgtcgcagtgccagtagcagaacacccgcccgttgctggcggcgtcctgcaacaagctgcggaaaaacgccggggtcagcaggtcaaagtggatctcgctctggtcgtacaccgccttgtacaggccgtacaactgcgcaagccaggcctcatcgttgaagcgcgcatcgccagtgtccaggacttccacccgcaacgcctcgcggctgcgcagtttgcgtcggatattgcgtcgacgggtgtgggacaaacgcgccag

SEQ ID NO: 510206 - DNA, 309 bp, Homo sapiens
acactatcatacgatgcggccttaacgaactaggaggcgcccttgtcatactagtattcatcctcatcctagctatattccccctcctccgtatatcctaacgccaactcatcctatcacgcccacgacgccaatcagtataccgactcatagtcgccggcctcgtcagtctaccctgaagcggcggacaacccgtcagcggccctgttaccatcgttgtacacgtagcatccgtcctatacttaacaccaattctaatcctaatagcaactatcttcctaattggggcccaaatactcaaatgggccc

SEQ ID NO: 510207 - DNA, 398 bp, Homo sapiens
  misc_feature (23)..(23): n is a, c, g, or t
gatagtttttaaaatcccctttnctgaagtataatttatatccaataaagcataaagtttgaattttgatagttgtgttaatgccagtcaaaatataaaacattttcgggccaggcgcggtggctcacgcctgtaatcccagccctttgggaggccgaggcgggtggatcatgaggtcaggagatcgagcccatcctggctaacaaggtgaaaccccgtttttactaaaaatacaaaaaaattagccaggcgcggtggcgggcgcctgtagtcccagctactcgggaggctgaggcaggagaatggcgtgaacccaggaagcggagcttgcagtgagccgagattgcgcccctgcagtccccagtccggcctgggcgacagagcgagaccccgtctca

SEQ ID NO: 510208 - DNA, 729 bp, Homo sapiens
tcggcttcttcatctataatgtgaagggttgaataagcatgagtccccaagctcctctggctgtgggagcacagatgagtctttcagaggcaggatccattgttgcagatagctatgatctgtgtggcaatcaggcttcgtagcttggggaggtagagttacattgactatgtatcatgtaataacagcctttgagacttggtacaaatatggtgctgagaatgaaaatctagagatgattgaagtttgtaggtcggaagtaggagtaggtttgtttggccgttgtttgataaattgctgttatgtcacagagtttgcagattgctctggataccttcaaatcctagctctcagctgtgggattcttgatctcagaggtgtttattttgcagcagtcagcataggcttgtgccactgactcctccttcagtcggctttgcccaaaacaaatgtgaggtattactggtattaagtttagtccaggggactcagaaggatagattcagtagcaacagacacatcatgaaattatattccattcccagtagagagaatgcgcttttggatccgtttagtccatctggattaacagagtattttctcttcctgccgagaactaggtgactcaggcaattgatggcatatgcaaaggcctggtcatagatgcacttacaggatgcctcatagacgatgaggggtctgaaagggcaatccgaggttggagaatcg

SEQ ID NO: 510209 - DNA, 845 bp, Homo sapiens
  misc_feature (1)..(1): n is a, c, g, or t
nctggccgatctgggtttattcctcattccttttccctactcatgtttattctccatggaccatggttctgttcatttcagtgatcaaacaatcctttctgcatagcaattgattcacacttgcctttcttttgcctccttagctaagcaaggtatcacatgtctctttcccttcagctgcaaagatgaagccagaggcccttttttgccatagtcacaacaccttccacaaaggccaactggactcattactatgactctgatctacggacaagagccatgtatttggtacaaggtcacaaggagacagttctccatggttctcttctgtttcttcattggcagccttttgtttcagactaaccttccaaggatatttttgtagtgatgtctccttgaggacaaaggttgggtaggtttgcttgcaacccactcttaggattaaagtttcttaagctcagtgtgcttctcctgtagcacaatccacagcatagacaggtgtctgtctcttagcccttgtcacatggcactgtgggcaatggggcttggaaactgcataaatgataattatttggttactgctatggctggaagtaataaactgtgttttggcatctttattcttctgccacctccatgaatcggtggcaggctaacttgataagcttgggggcagggtgaaagctcaaagccttaccggtcttgggacactttgggtccatcatactggtcaagccggctggaaaagttcatcaaatatcatgggcttcatagagagggggaaccactcccagtaaatagatctgaaggaaactcggaatggataaaaggggcaaattaatctg

SEQ ID NO: 510210 - DNA, 432 bp, Homo sapiens
tctcatgtgtcacgtgtctaccctacctttctctttgtcttggactgtccctcccactttatgtcaggtacactataatcttatatactgccagagttgatagcattatattttttcctattgtagaaccaagtctccatgtaagtataatgatcaaatcaggataattaggacgtctatccccttaaacttttatcatttctttatcctgggaacatacagaatcctctcctatctatttgaacatatgcaataaatgatagttaactagagtcactctacagtgctgtagaatactagaacttattcctcctatctagctgcagttgcgtgtcggtgaaccaatctttagttattcctctgcccgccgtacgttatttctacctctggtaggcaccattctactatcaattacttcgagacagcatatca

SEQ ID NO: 510211 - DNA, 659 bp, Homo sapiens
ggcgcttctgaaactcatctttcctgatggagcgtttgaaagtgagaatcgagcattgatcaatgtccaaatgctgaacaattcaggattcgctaggggaattattgaagagttccaaaataataatgaccttgagttacaacaaaaatgtattaatgtactaagcacatatgctatgattcagggacaaattgatgcaaataaggagattgggcagttcttcatacaaactttaacacagttgaatgttcgccctgaaattttgatagaaatgacaaattcgcttttccaaatttacggggatgcctcttacgactataatgaaccaatatttgtaaggggtggatttttatctattctaaaagaccaagttgtaccaaatttgaggcagcaattcaaaatggttgataaaaacaaaaatcccgaactaaaagaaagatgccatgattgctttactacgttggatagtttcattcactacaaaatgaatgaaaattctactaaccaatagatttattaaagtgtatatagttgccatacttatagaaaatggtacaaaaaatatctttctatttacttagcataagaaacaaagagcaaaaaattatttttgagaatttgtaaataatgttattttgctctatttttgttaaaaaaaa

SEQ ID NO: 510212 - DNA, 952 bp, Homo sapiens
cgcggtagctcacgcctgtaatcccagcactttgggaggccgaggcgggtggatcacgaggtcaggagatcgagaccatcctggctaacacggtgaaaccctgtctctactaaaaatacaaaaaattagccgggcgtggtggcgggcgcctgtagtcccagctactcgggaggctgaggcaggagaatggtgtgaacccgggaggcggagcttgcagtgagccgagatcgcgccattgcactccaacctgggagacggagggagactccgtctcaaaaaaacaaaaacaaacaaacaaaaaaacatgcaaacaatccagcaatattgcacccctaggcatttatcctagagcaatgaagacttatgcccacacaaaaagctgcacacaaatgttcatagcagctttattcatggtagccaacaattagaaacaatctagatgtccttcaactggtgaatgattacatccataccacgaaatactttttcagccactaacaaaggatgaatcatagtacacagcagaacctggatgatctccaggaattatgctgaggtgaaacagaccgccatctcaaaaggtaatatctgtattaatccattatatcacatgcttaaaataactaactatcgacatggacgaacagatgagtgatggcaaggggtaacggggccacgatggcgcggggacgggtatggcacaacaagcaccacccttttgcccgcgaacgtcagattcggatgtgcaagggagcacggggggagataggcccgatcgcaagaaccaccagcaccgggaaacgcgcatcgaaccgggacaaccaacgcagacgaacagccacagacgatacgagccggcacaagacacgcgacagcgaagaggacaggaccagcagacccagacaaggcggacaagcaagggcgagacggccacccgccacacgtccgtcga

SEQ ID NO: 510213 - DNA, 186 bp, Homo sapiens
  misc_feature (118)..(118): n is a, c, g, or t
ctggccgatcgtattttattttgttttattttattccagattcacgcagggccctctgcagactgttggcacataaaaggtgtccgggggcgacatgcataatctggacttttcccanaatgctgcagcagaactaccctccagatagacactagcctgcgggccacagtgctacgtgagtcttgc

SEQ ID NO: 510214 - DNA, 829 bp, Homo sapiens
gggattctgtgagatgtagtgtacttggtatctctaaatctaaagatagttttttaaaatcccaaagaaaatctgtctcctttctgatctaaaactcatttgggggtaaagagttaagtgtccaaaggttgtcacagttcatgaggtcagagggagctagcctggacctggactctgccccatccacagtgacagattccaacagaagtgtatttaaattctccagtagacaatgctgggtaagggagggggtagggctggttattaagatacaggctgctgtattttacattggtcgtggcggacggggagcctgagaaaacaaagtcactattcccttttttgaaacaggacccacacacatatttttgtctcagtaaaactggtagagaattcccactgtccctagccacaaagggaccagttccactgagaagtgaacagtggaactccaaccattccagaaacatcgggggcagggaaaatcggcttctcttactgggagatgttccagtggggggggggcgcccccgctccgccggcatgcgtacggttggattggtccgcagtattttgacgggagcttgtgccttcattagggttcccaaccacgtatgggcacaatccgtgggttcgtaacattatctcaaataaacgccccgtggacgtaacaaatcacactcaagcatacaaactagttgtcgggcctggcctcaacaagttcaaaactctttgggcggggcatgaagaccgggcatcggccaggaaccgctcataggtgttccaaaaacggggcggtgcaacagtgcggacggtccgccactcacgc

SEQ ID NO: 510215 - DNA, 160 bp, Homo sapiens
gctgcgcctacgctgcctcgtgccactgcctgccgcgtgctggagccggagcccgagcctgagtggctgccggtgcccgactgtggtggctcctgtggcctgctggctgggctggtgcgggcgatgctccacgagtgcctgatccatgtccatgtgaggc

SEQ ID NO: 510216 - DNA, 318 bp, Homo sapiens
atgtcatacaccatattctgaaatgtctggctaaacagcatcagccggaccgagaacgtgcgctcgactcaaacaaggccactgcaagatctaaaacagttttatcatctgcagcggccttgattcgtcgaaccatgcctcggatcagcgggtgtctgggatacattacaactgtttgctactgactcgcatagtagcttggtacgacgatgtcctatgactcgtctggtacgctggtgctttcatagattcatctgcatgtttccagaccatccgtactgcccggcgttaaaaacacacggagatcctgttggctgg

SEQ ID NO: 510217 - DNA, 331 bp, Homo sapiens
ccaagaattcatctacgatttctattttatcttttaaaaaaagagatgcacatggaaatatcccagcagtaacacatcacagtagctctcagaataagatggtggtaccattgcttattgagaaaggaaaaaaaacacacgagtatattaccaggggcaaagaagggatgtgatttctcatgattgaaagcttgatttagattggatacaggttttgctaaccaagaccaagcggctctggcaagacagggtggttttccaaatgccagaccgaggtggcttatgaaggcagctggcgatggttccagatgtagagagtctccgtcgaact

SEQ ID NO: 510218 - DNA, 230 bp, Homo sapiens
tacagcagaaagcaggctatgactagtgatcagtgcttcaggggacaccaagtataactatctgactaatatacagagcctgtcctgggggagcacaccaagtcagcagggacatgaaacataggcaatggaaacattatagcacataatacgataatcaaccagcacactgtcctatacggtctgtgcacatggtgacatattgactgtagatgccacaggaactcaga

SEQ ID NO: 510219 - DNA, 107 bp, Homo sapiens
gctgggacttacaggcacgtaccactataccctgctaaaatttgtatttttacgtagagacagggttttgccatattggccaggctagtcgtaatgtctctttttaa

SEQ ID NO: 510220 - DNA, 423 bp, Homo sapiens
aaatgtccatccacagttgaagctacagtgaagtcacagggtcgaatactactgcacagcaacgaatatgaatgaaaatatcgctatgcacagcaacatggataaatttcacagacatgaggtcaagcaaaagaggtcagatgtcctcatcatcaagagagagattcattagtatgatctctcgttcctacaaaagagtacagaaatagagcacaacatgatccactggtgtgtagaagaccaggtggaacagtgtaacagcgggagtggactactgagggaggcggcatacctggacgtgctgtgtctgacctctatctgtggtgtgtgatattacatgagtgatatgacagtttgctcttccagaactccctgactggaccctgtggaatataaaagtcctctctaaacataaaaaataaa

SEQ ID NO: 510221 - DNA, 242 bp, Homo sapiens
atttgttaattgttatatagtgggaagccttgacactcttacataaatatttggggtttctgctatccaagtccctctgctataattctcctcaagagttgtttagatatatcaacttcgttgatgatacatctgcaataaaaaggggaaaaaaactggcatgggacccagatgagggtctatgaccagagaaacatgagtaagattctacctttttaaggatctgacaatattctggtttc

SEQ ID NO: 510222 - DNA, 363 bp, Homo sapiens
aaaccgagttcccattcttgcagcaaaattggtcctataaacccttttgtaccagattatcatagtcttctttcacagagaaaaattccatatcgcagttaagagttttctcaaaagtttcaccattatattgctcatttttatttaaccctttaagatttttatccatgctgtgtaatataagcgcaaaagaaagcgcagaaaagccttcttggtatgaaacttaatttttaattttagtttctctcttttttttttttttgacacagtctcgtgctcgtgtcgcacagtctagagtactgtggcactatatcagctctgtgcaacctgtgtctctcgtgttcctcgtgccgttttcctaca

SEQ ID NO: 510223 - DNA, 660 bp, Homo sapiens
ggcatcattaacaaaggataaaagtatcaattcttgaaagaaattggttttaaggaaacttcggagaaaggcattagatctggaaagcttgagcctccttgggttcgtctacaaattggaaggaaatatgaatgaagccctggagtactatgagcgggccctgagactggctgctgactttgagaactctgtgagacaaggtccttaggcacccagatatcagccactttcacatttcatttcattttatgctaacatttactaatcatcttttctgcttactgttagcataaaatgaaatgaaatatgaatgaagccctggagtactatgagcgggccctgagactggctgctgactttgagaactctgtgagacaaggtccttaggcacccagatatcagccactttcacatttcatttcattttatgctaacatttactaatcatcttttctgcttactgttttcagaaacattataattcactgtaatgatgtaattcttgaataataaatctgacaaaatattagttgtgttcaacaattagtgaaacagaatgtgtgtatgcatgtaagaaagagaaatcatttgtatgagtgctatgtagtagagaaaaaatgttagttaactttgtaggaaataaaacataggacttacact

SEQ ID NO: 510224 - DNA, 494 bp, Homo sapiens
  misc_feature (347)..(349): n is a, c, g, or t
tcctccccccccctttccgcccccgggtggtgttgtggcaaaggtggccctggtggcattcggggagaaaaaggtgccctcatggtttgtggtggtcccggtggaatgttcaaaggtgcccgtggtggaaccaaaggtggcttccttggtggccggggcatggccccaggtggctttggtggaggaaaaaaagggggccctggggggccccccggcccttttttggacccaatggggggaaaaaagggggggcgggggggccctggaaaaatggataaaggcgggccccgtccggggggcagggatgggcccctttaaatgcaaagcccccccaggggtgctttgtnnnccccaatttttttttttaccccgaaaatgttttaaatttataattccctttttttaatgttggcccccccctttttttttttccttgtttggcctttggtttttttccccctttgtgaagaaccctttaacccagtttaatggga

SEQ ID NO: 510225 - DNA, 298 bp, Homo sapiens
aaaaaaaaaaaaaatagggccgggcgcagtggctccgctgttatccagaccttttgggggggccaaggtgggcagatccaaggtcaggagacagcccatctgggcttaccagggtgaaaccccgtctctactaaaaatacaaaaaaattagccgggcgtggtggcaggtgcctgtggtcccagctacttaggaggctgaggcaggagaatggcgtgaacctgggaggcggagcttgcaatgagcagagattgtgccactgcgctccagcctgggcgacagagcaagactccttctcta

SEQ ID NO: 510226 - DNA, 2278 bp, Homo sapiens
acgaccactacatgtacttgaaccatggacagcagacgatcccgaacggactgggtatgggggggcagcacaattactttgggctttgggtggatgttgattttgggaaaggacacagcagagccaagcccacgtgcaccacgtacaacagcccgcagctgtcggctcaggagaacttccagtttgataagatggaggtgtgggcggttggagacccctcagaggagcagttggccaagggcaacaagagcatcctggatgcggaccctgaggcccaggccctgctggagatcagtgggcattcgcgccacagcgaagggctccgggaagtcccggacgatgaatgaggagccgcctgagccttcctggagccaggacctggattcctctgggtagagggcaccgcctgcagcccctcttccctcccacatggtttaactgtaatagcgtaccgcacgggtcacagcctggtagtcccacatgtgccaagaagacgccctctgaagccatgtcctgactcatgggtggatctcccagaaatagatgttttttaagttttcttttttgccctacagggtcaccctcaggatctctccaagaaatcttgtgtcaaattagtaactcagtcttatactttgttcttttttaccaacgaaatcctaagcagctgagacctttcagacccccgctggcattagggaattccgctggcattagggaattccgctggcattagggaattccgctggcattagggaattccgctggcattagggaattccgctggcattagggaattccgctggcattagggaattccgctggcattagggaattccgctggcattagggaattccgctggcattagggaattccgctggcattagggaattccgctggcattagggaattccgctggcattagggaattccgctggcattagcattgctgggatctcaacttctctattgaggagggggttcctcccgctggggttcatatggcctcactcaggccatccctgttagaaggtggtacctgatggtctgttctgacgggtgagggacagaggcatctggatgaaaatctcgacgctttctgggaacagcttccaatggcatgggagttctgtatttaaaagcatgaactgtgtataaaatggggaaatggaggcaggagactttgaggtaacatggtctggtggtggcatgagtcctcagaaggtatttgtaataaggttccacacccagctctctcagctgtttttaaatgaatgtgtgtgaggaacagatgggaaagttgggagatctgtctacagagaagcaaagttgtggttctcttgctaacttcaaggtgagggacattgggcaccctaagtttgggaacttggttgataaatacgtatatggtccattccataaatcagtggtgagtgactggcctgggttctagacctctgggaaccagcacctgagtcacagctgtctaggcctcggtgctggcctgggttctagatctctgggaaccagtgcctgagtcacagctgtcagtgcagccatttgcccagggctgctcccgagggggatgatgggaaattcagcagtgtagactcactttaaacaagctccggtgatcctgaaatgctgaagatcgtgtaggtgggttgtggggtcagcagagctgccatctgcccacgtctggaaaacaacacacggtgagtcaccggttggccatgagatctccccacttaaaggtgctgtgagcttgtctctaagatatatacctcttccttttgtcttttgctgtaagctttgaccttttgcagatctgatgaaaatacaacctcttattgtatagtttgccttgattataagccatagtaaatcgagctgttcgcatttttgcaggccttgcattttttactgggaggttcatcaaaccttccatttagcaatagccctgactcaggcagaatgcctcataaattagccttcgaaagaaaagtgcacgctcagacagtgtgtggaggggcaggagcgtgatgcagacaaggacttagtcatgactgattttccttagccagtttgtaatggcttatggggaacattgtgagcttcctacctgacatgttggcagaagtagaatattaggatcctcaagcatctctaccgtaagtccaaagaatttaggtccctattgtcactttgttttgcaatgttttttataaaaatgcaattaaatacctcactattaaactgccatgatgccttcagttt

SEQ ID NO: 510227 - DNA, 797 bp, Homo sapiens
agcggaggcaggcgcggacgtgccttgcatgcctctccctcgtgcgagtattgggcctggttcctttacacttgccttcatctggtggctgttgggatatttccgacgtgccttgggcccggcgcgctactgcgagcacatcgctatcttggaagcggccggccggcgccatagatggcatgcatttcgcacagcaagattacgagtttggtccattattgaaaagaatagaagtgtatgtcagaataaataggaaactacagtgttagcaatgcagaactggaaataacgggagaatcaagcgcggatcagacaacgacgacatagactctgcggaagttctgaagtcaaggaggagagatggggtctgtactgtgttgggcaggctgggcgtcaaactccgtggcctcaaggcagtcctcccgccttggactcccaattgctgggaatacagaatgaatgagagccataagtctgaatttatagagctgaggaagtgggtgaaagctaggaagtttcaagattcaaagttagcgccgtgttgttttccaggtacaggaagagggctgatgagtcaaatattccgtgcaggagggagcagatgatgatttcgtagccgtgagagttgcgtgctcacctacggacactagtgattgcgaagctacttaggggcatacattactaagtggaagccttctcgcatctactctgatgggctgtgacctttgagtttcagaaaagcatgctggggacagatctctatggaaggcttactggagattttaaccaagggtata

SEQ ID NO: 510228 - DNA, 2239 bp, Homo sapiens
acgaccactacatgtacttgaaccatggacagcagacgatcccgaacggactgggtatgggggggcagcacaattactttgggctttgggtggatgttgattttgggaaaggacacagcagagccaagcccacgtgcaccacgtacaacagcccgcagctgtcggctcaggagaacttccagtttgataagatggaggtgtgggcggttggagacccctcagaggagcagttggccaagggcaacaagagcatcctggatgcggaccctgaggcccaggccctgctggagatcagtgggcattcgcgccacagcgaagggctccgggaagtcccggacgatgaatgaggagccgcctgagccttcctggagccaggacctggattcctctgggtagagggcaccgcctgcagcccctcttccctcccacatggtttaactgtaatagcgtaccgcacgggtcacagcctggtagtcccacatgtgccaagaagacgccctctgaagccatgtcctgactcatgggtggatctcccagaaatagatgttttttaagttttcttttttgccctacagggtcaccctcaggatctctccaagaaatcttgtgtcaaattagtaactcagtcttatactttgttcttttttaccaacgaaatcctaagcagctgagacctttcagacccccgctggcattagggaattccgctggcattagggaattccgctggcattagggaattccgctggcattagggaattccgctggcattagggaattccgctggcattagggaattccgctggcattagggaattccgctggcattagggaattccgtggcattagggaattccgctggcattagggaattccgctggcattagggaattccgctggcattagcattgctgggatctcaacttctctattgaggagggggttcctcccgctggggttcatatggcctcactcaggccatccctgttagaaggtggtacctgatggtctgttctgacgggtgagggacagaggcatctggatgaaaatctcgacgctttctgggaacagcttccaatggcatgggagttctgtatttaaaagcatgaactgtgtataaaatggggaaatggaggcaggagactttgaggtaacatggtctggtggtggcatgagtcctcagaaggtatttgtaataaggttccacacccagctctctcagctgtttttaaatgaatgtgtgtgaggaacagatgggaaagttgggagatctgtctacagagaagcaaagttgtggttctcttgctaacttcaaggtgagggacattgggcaccctaagtttgggaacttggttgataaatacgtatatggtccattccataaatcagtggtgagtgactggcctgggttctagacctctgggaaccagcacctgagtcacagctgtctaggcctcggtgctggcctgggttctagatctctgggaaccagtgcctgagtcacagctgtcagtgcagccatttgcccagggctgctcccgagggggatgatgggaaattcagcagtgtagactcactttaaacaagctccggtgatcctgaaatgctgaagatcgtgtaggtgggttgtggggtcagcagagctgccatctgcccacgtctggaaaacaacacacggtgagtcaccggttggccatgagatctccccacttaaaggtgctgtgagcttgtctctaagatatatacctcttccttttgtcttttgctgtaagctttgaccttttgcagatctgatgaaaatacaacctcttattgtatagtttgccttgattataagccatagtaaatcgagctgttcgcatttttgcaggccttgcattttttactgggaggttcatcaaaccttccatttagcaatagccctgactcaggcagaatgcctcataaattagccttcgaaagaaaagtgcacgctcagacagtgtgtggaggggcaggagcgtgatgcagacaaggacttagtcatgactgattttccttagccagtttgtaatggcttatggggaacattgtgagcttcctacctgacatgttggcagaagtagaatattaggatcctcaagcatctctaccgtaagtccaaagaatttaggtccctattgtcactttgttttgcaatgttttttataaaaatgcaattaaatacctcactattaaactgccatgatgccttcagttt

SEQ ID NO: 510229 - DNA, 269 bp, Homo sapiens
caggagcgtgttgctgcgggtcgttctagaggatcccgtgtgtacgagtaacggctgaggaggagaatcacctgaacccagatagcggccgttgcagtgagtcatcattgcaccactgtactccagcctcggtaacagagcgagactccatctcaaaaaaaaagaaaagaaaatgatcaagtcatagaatgaagaaaaggaaagtttttttaatcagtttcgcaacagagttagctggtgacttttaccaacataggtagacgagtaat

SEQ ID NO: 510230 - DNA, 233 bp, Homo sapiens
ttctgtggcaggggctgcagtcctgccttgggtggagcatggggaagtcccactgggctgctatccatactagatccatgaggctctccctggtctctgccttctgatcttctgctcagattacctgtcttcatgctggctctctcatctcctgttagaaacaggttcctccttcttggaggctcccagggtctctatttgaacgggcccgtgtgatatgagctgtaatcagt

SEQ ID NO: 510231 - DNA, 239 bp, Homo sapiens
catgaactccagtctgcttgatactcggcttagataaggggggcatgggagcatgacctgcatatatattacagagaacaggaaagacaaattgttcaattataaatttgtttgtcttctgtacattattgcattagggagccacaaaattatgtagcatcattacaaatgaaaacaggttagaaatgaagaagatacttatatagaaatacatggattcatgaaacattcgccatcgg

SEQ ID NO: 510232 - DNA, 682 bp, Homo sapiens
tacctgcacttggtttactggacgcatttgtccagatgcttgaccagtatgagaagttggcatagaagaaccgcaaggattccgaggatggttctcatcttgacagaggatttgaaccgcgagtgtggccaccgacagcgagctggtgcagagcggcaagagcgagatctcggagctccggcgcaccactgcagaaacctggacgactagagcttgcaagtcacaagctacagcatatgaaacgcatcccactggatgaaacagccatggaggagaccaaaggtcgctactgcatgcagctggcccagatccaggagactgacttggcagcgctggaggagcagctggcccagctccgctgcgagatggagcagcagaaccaggagtacaagatacctagctaggacagagaagacgcggctggagcaggagatcgccacctaccgccgcctgctggagggcgaggacgacccacctctcctcctcccagttctcctctggatacgcagtcatgcacacgcgtgtggccgcctccagccgccatccgcaccaggtcatggtggcacgagggcaggtggtgtccacccacgagcaggtcctcgcaccagacgaggcgcccagcccgctcaggcggggggccccccggtggcacaggcccacggagtcccctcccgcccgctat

SEQ ID NO: 510233 - DNA, 1732 bp, Homo sapiens
gattgacgtatccttccactttcactctcggggctcacggcgcgcagtgacatgtgcgtggacgcgctcacgtgcgcgactcgatgagactactcctgatgaccagttactctaccatctgctactccatgtcccggacgactcattctacatgtcgtgggtgctcgagctgctcgtgcttatgctcagaaccttcgtcggcttgacgagacgactcatcgtgctcagttccgagtgcggatgagactagtcgatcctaggacccttgagaaacctactggagctccagtcggaacaagtatgaggaagctcagtgaccttgctacactggagtatcaccggtatgtgacgtctaggtgcagatgttgcataactgaggttcctgaatgcgaggtagtaacggaatcgcagggatagggtcagagggaccaggacaaaatgtagagtccgggcaagttcaaccgggattcctgttcttggggcccctagcgaaggtaaaggcacagagacaagtcaacctttaagcccgatggcagtatcgaagataaacacacggacttctgtccaaacaaggagacgcctgcagagagaaacaaatttgacccggctcggaatagcggcacagcacaagcggcgcgatccgtttgcaacggggacaccccattagagagtatcaaattctggcggcacttgcctccgtagtcacaatcacttctgtacggctcgggtaccattaggctagcggctatcacataggcaagacagttgtttggtcccagagaactttaattacccaacgaccgcaactccgaggaggcaaatgggcggccccctagtttgcttggacaggggacgatcaccgtgaacccccgtttgaaacggaactgcgtatgcacccccaattataccgttaccgccttggctcggcaacacttgctcacaacaagcagtttatggcaaaagcctatccagattttccccccgtggcatgtcggcccatgctggcaattaaagccccctgtgatgatgtgagcactaacatccaggatcatcgcaacgcgctaacaaaggcaccattcacctggcacgctcgcacagcaattggaacattttgccccgctaacttcgccgttgagcctctacgcatggctgggttcccagttgtcccacaagagggcggttacacactacacaacgcgaagcattcccattcgcccacaaggatctagtaacctaacgcatcaccacttaaaccccacaagtgatgtcacccctatggcacacataacgaacaacaggcaagccacagcacagtgagacaagtcaagaagcgaccacacgtacagacacagattgcagaatcttcgggtcacacagacatcttcacacgcacatacaagacaacaacaagaaccacaacacagccaacgcagaaagcgacgcctaatatatgtctacacacgactcatccgaaaggcaacccagcacgcaaggcaacacaatacgacacacaacgcgacaacacactgagacgctcgaccaacaccaagcgatcacaccacgcatccgcgaccgcacacccacttaaccttagacgaacagaaagcaggagccaacaccactactacgcgcagcggaccactacccaccagaaatagaagcagaacgccccacctcaaactcacatcaccagctaacaactgcgacacacggctatcacacccgccacgta

SEQ ID NO: 510234 - DNA, 330 bp, Homo sapiens
ccagctacttcagctataagagcagcatgcttgcggcgcctgttgacacaagctagagagaagcaccaggtatatatggaacccatgaatgtcacatgccagtccataggatactgacttcattgcttaataagtctagctgaaaacgacagattgagatcatccaaaaagtgcgtgatgcgagtagtttgcggtaagatcttatagggctgacactaaactcttaaaaccaaatggccaagaactcccttccatggacaaagccccatactgataacatgctgtgaatataatccacagctgttgtaacaattgttgggggatcctcta

SEQ ID NO: 510235 - DNA, 241 bp, Homo sapiens
tttgaaattccctcccccccaggttagggggatgggcccttttccccttccttttcccctttggatggtttttctggtccttcgatatgctaaccggtttcagccctgggccctggggagggggggggggccgccctccggccggttttgggggtggaactctttaatgctttgggtattttttccattaggtctcttttccgaaggggttataggaccataaaaatttttttcttttgga

SEQ ID NO: 510236 - DNA, 156 bp, Homo sapiens
agatttaaacctagtaattggggcatggattccaccacagtgaccatgagggtggcaatgtaagtacccataccagccatttggtgggcagttcccttaccgacccttaacctcgtcctttgacagcagccatgaacgggctggcaggcctctcca

SEQ ID NO: 510237 - DNA, 201 bp, Homo sapiens
gcgtctcagtgactacacgaagacgtctggcagaaagttctcatcgaagcggcctgcgagtggcagtgctgaccctgctcagtatgaccgctatgtcaacaaggatatgtgcatccaggagctggcggtcttggtatctgggcagaagtaggcacaggtcttgaaactcttcgtaacggcagatgcttggcctctcctacg

SEQ ID NO: 510238 - DNA, 447 bp, Homo sapiens
tcatacttcagacctgtgagcagaaagagaaaactatctgattttaatcatgtgattaggtcaggccactctgataatttttctgaaggtcaactgtgccatttaacataacctaatcgtgggagcaaactccaacacattcacagtcgtgggattatccaggttatgcagtacagcagaagcaggaaatctggggatcatcttagaattctgcctaccacactattctgtgtatccttcatgaagctgttgacattcgttaaaggaagctgcttatcacaaccaacaagcattatgcctagtcagtgctaggccctatggaagatataaaatgcacataggaataagcccatctctgaccctttacagttttcaaagcacttttatagctgtgatctcattttctcttttaaaaaccaaaaaacatgctcatcatcactggccatc

SEQ ID NO: 510239 - DNA, 316 bp, Homo sapiens
gatcacaccagccatgcttaacatctgcccaatgcctcttaatggtgcgactcattttcccagggatatagatccctttgggaccaccagatgtacaagactcccagattaacaggggcccaccttgagtcttggaggactacacccccggcgtcataggctgcttatgtggggtgcggagtctaagtgagcagatccccaaacccagagaagcccccttaccacctgtttgtccttttgcggggagacctataagtagtttgaaaagctgtgatcctctttggctgggcgcagtggatcacgcctgtaatccagc

SEQ ID NO: 510240 - DNA, 390 bp, Homo sapiens
agagaatctagcaggatccccgttacgtggcataaacccatgatcataacccagaatagcaagaaaatcacatgatagtacattcccaagtacaccagccattccagacccacaagtcactctgctcttataattcacagaactgctgaacaagtagacatatctatctaaaagtagaaaaaaaggttagtatagaaggtatatctgttatacaagtatattacacagcttgaggtagtaacaggtccgaaaagctctactcaaccactgatactttaagctcaaataggagagaaaacaaacaagcaagcaaagaaggttaatctacttacagaaatttaacagtcacgtgtatcacaacattaattagcaaaatgccaagtaacgaga

SEQ ID NO: 510241 - DNA, 240 bp, Homo sapiens
ggtgacctagaggatcccactctcactattatcagagaaatgcagatacaataataatgtgatatttctctttatccaccagatcggtgataatgaaaggataggatagtattaagtattggagaatttgggtcacggctattactgtccattgtcgatcagggtctacgcttggcggggaatttagcacattgggcgtagctgaacctccacatattaccagcgatccctctttctagc

SEQ ID NO: 510242 - DNA, 359 bp, Homo sapiens
  misc_feature (35)..(35): n is a, c, g, or t
  misc_feature (140)..(140): n is a, c, g, or t
  misc_feature (268)..(268): n is a, c, g, or t
  misc_feature (331)..(331): n is a, c, g, or t
  misc_feature (341)..(341): n is a, c, g, or t
tttctccaagctgatcaaggtggggccctatgggnatgttaatgcacacgggaggttgtgtataagactgagacagtggccgggtgcgagggctcaggcctgtaatctcagaactttgggaggccgaggcaggtggatcncccgagatcaggagttcaagaccagcctgaccaacattgtgaaactccatctctattaaaaatacaaaaatcagccagatgtggtggcatgcatctgtaatcccagctactcaggaggctgaggcagnagaactgcttgaacccgggaggtggaggttgcagtgagccgagattgtgccactacactccancctgggcaanagagcaagaatccgtctc

SEQ ID NO: 510243 - DNA, 324 bp, Homo sapiens
tgagactccgtctcaaaagaaaagaaaaaaattacgggaatcgttgtgcctctacatctggtcatgcgggagcttattgtataataggcatctttggggagaagtgtgctactgttgactaattctttgaattcaggaaatggattttcagtttgaatgccaaagtctgatcaattcaagtgtgttgagaggaacacaaggacaggtgcagtggctcatgtctgtaatcccagcagtttgggaggttgaggcaggaggactgtttgaggccacgtgttcaaaaccagcctgggtgagatagcaagaccctgtcttgatctttta

SEQ ID NO: 510244 - DNA, 549 bp, Homo sapiens
aacataataaggccagaacgtatcgacggcccgcagtgaattgctcaatccaatgacatgcatcagggcggtgcacatccggaacgaaagctttacacagcgtcttgtcaccatgaaagcaactatggtttgtaagagccgcctttttcatctacggcccacaattaacaatggatgtggctaacagtacaccttctgaagcaaacttaaacattactgtaaatgctcaagagccttatcatttggcaaacaatcaagattagtgacatgcagtttatacccacttctcttcagacacctcccgagtcaagtacagtagaccaggctaagagagctggaagaaatcagtctccgccagtgggttatatgtctcagcccaagtccttgcagcttttaaagccatccatattgagttctttggtaccgcctccagtttctgagtcatctccaagtaggactcccacttgtaaaaagtcaccaataatcacaacatgtaattcagcaaaacttcagccaacatctagtcaaacaaatcttgcaaataatcag

SEQ ID NO: 510245 - DNA, 130 bp, Homo sapiens
tcaatcaaaataagggtaaaccagacttgcataccacattgccaaattagacaaacagcatcaattttcaaacaagcggtaacccaagtcacaaatcatcctagtaatacagtgatttgttcccccggta

SEQ ID NO: 510246 - DNA, 110 bp, Homo sapiens
tcaattgtttttattatgtcctacaagcattaattaattaacacactttagttagtatgttcgcctgtaatattgaacgtagtttttataaataataaataaataaaaaa

SEQ ID NO: 510247 - DNA, 231 bp, Homo sapiens
gtcgaccgatctggctgcgacatctgtcaccccattgatcgccagggttgattcggctgatctggctggctaggcgggtgtccccttcctcccccaccgctccatgtgcgtccctcccgaagctgcgcgctcggtcgaagaggacgaccatccccgatagaggaggaccggtcttcggtcaagggtatacgagtagctgcgctcccctgctagaacctccaaacaagctct

SEQ ID NO: 510248 - DNA, 185 bp, Homo sapiens
  misc_feature (110)..(110): n is a, c, g, or t
gtttctgtgtggacactgaagaactgaactcagtgagtcagacaccagtactgttattccaggcaataacccagaaaacaccaccagcatcatgctgagatctcctgatngccagcttggatggactacacattcccccaaagaacagaagaaagcatgtctgccccaatcctgattcttactct

SEQ ID NO: 510249 - DNA, 695 bp, Homo sapiens
tgacggagtctcgctctgtcgcccaggctggagtgcagtggcgggatctcggctcactgcaagctccgcctcccgggttcacgccattctcctgcctcagcctcccaagagtcttttgtatttgagatttctttcttctagcccaccttcatttaattctatttaaccttttatctttccatatctgcctagatattgtctcttctggatgccttctcaaacctgcccccagccccaacacatggttagtgctcctttggctgccaaacacccttgtgtttacccttgtgataaaatttaagctccttgaagtaagagattatgttccattctgcattctatcactggatcacaatatactcctcagcatgttgttagtatttcaacatttgataatttttaaaaatctgaataaatcactcttttctctgtcctctactctttttacttgtacttttgtcatggaacttattagctatcactacttttgtaaattgttttctctcccacaaaaactggtagcttctactaatctttggattcctttgattgacaagcattgtgcattgcacaaagtaagtatttactgaatatatgctgtattaaatgtcaccaacctcctaaaagtaattataatgttgtaaaactgattttgtgggtgggctttaaaccggctctgaagaatttttaaaaat

SEQ ID NO: 510250 - DNA, 1569 bp, Homo sapiens
gcagcatcagtaactttgaggaggccagaaccagctatggcacagatgaggacatcctctttgtctacttggacagaatgacagcagtgagcctggtgctgcctaggcccatcggaccccatcacccaccaccagaccgtggccctgctcatgtgactgccctgtgacccagtgcttgggtgctgcttggtgtgtttggaaatgtggaacatgcaagccaatcagacccaatcatggacagaagtcccacggaacatccggaggactggcacagcttgctttgtcttgccagattgccgtgtgttcgctcactgtcacatcaccaccaatgcaacttgcatgcgctgctggacacgcataccaccaaagaggcccacagccttgacgtccacgctgctaccccaccacgtgcaatgtcccaagctccctgacaagtggcccttgttcgccctcttgacgcaccagcatccaatgcgcaactggtactcccccgcaacaagacgcaggcaaggcacgtgcacgcactggcagcaagcaggaccgctacgctatggaccggactggccacctcggtcagctgaccagttactcgctgagctgatactgggacgacacagcactatagctggcccccccagatcctcactatcgcctcgtcctgacccaccctccccaggcgccacactgatactagcgattggcaacgactcgacatgaagcttcttgcccgcattggatgaaccctggaaggcatcggcacgacataccccaacctaccgacactgtaccataacacacaattcgtcgtcccaacggactaccttagagctccacacacaaccggcaggacctactagggagtacattgcaatcaacacaacaccctaaacagaaatcttaacacaattatttcccctttgcatcttatcagaatcacatctgcacccctctgcgcaaaacacatcatcacaccactcccactaaatccaccttccacttacgctctcccaaccatctactcatcatcattaatcacgaccttatcaacaactaacataccactcttccttctcgactcccctcctacattacaccactatcagctaacgcacaacaacaaccacactcgcccacaccccaacctctcctcctaccaactacacctcccaccaccacccaccaccttcactcccctgattccctaccaacctcatcccaaacacaactccataacatcgcacacccaccaacatcaccatcacacccatcgacaacaacaacacaccacgtacaccacacaccagatatgcacatcatactaaaccaccacaccaccatcctacacatctactacttcttcatccacaagctacaatcaccaacatcccaaccgacttcacataccaccaccccaccctcctactccgacacctaccaccccccacgaccatcaacaacgacatcacaccgcgtcacgaaccaactccacctccacatctaccgtcacacacctaacctacaccccacatcccccacccacctcacatcacccctcaaaccctcacacac

SEQ ID NO: 510251 - DNA, 547 bp, Homo sapiens
ggtgcttatcaataagctccatgcgtctggatccactgacaaggaagcaggacccaaatgattaaaccctgtttgcaacagtccttctaagagaagacttctggttttttgtttgttttgttttgttttctgtctagaatgccttcttctcttcttctgctaatggaactacttttttatggggaatcccccactttccagagaagttagcatgtgatctaagttcagtcaatcagataaatctattcctttggaatgggaagaggcagaaaaccctagaaaagccaatcagattcttccttgagatttgatgtttaaatgcggagagagagagagaaacggctcttttttcagtattggatcacaagattgtaaagatgatatagaccagagttgctttctgtcacctttcctggatacctggggaaagccatccatagtgagagacaatgaatctaaacattaagagagaatcacaaatgaagagagatgagagatggatggaaagagacagagtcctgaggacattacttgggaccccgaaatc

SEQ ID NO: 510252 - DNA, 642 bp, Homo sapiens
gtattcattcatgctatttttttgtacctattaattgtccccagctttccccaccccacctctcactactcttcccagcctccagtaaccatccttctactctgtatctccatgggttcaatcgtttggattttaatgatgtcgacaaataaggagtattttggtccttgaaaaagtgttcttatatatattttttaacttaatataacattaaaaacatgatcatgctattacctgtactcgtttcttgagctcttttctgttgggattcagccttctatgttttgcaagtcggacagattgaaatctcctttttagcaagagtggtaaaagtttgcatctgtagagttgactactactatttgtgtttatcttacctgaggcctagagaggactgtctgtatttttcaatgaatatgtagccacgtaatatcagtagaattgttagcgtcagtattgtagtaaattgtttgagagaaagtaaagcagcttctagaattttggtcttatatgactggttgttgtaaactttgactctgtacataaatttgtatttaatgactgaaccaatgaagatcttaggacgttgatctctttccaggtaaaggaaggtggtttcgaccgatggccaaatatccccgg

SEQ ID NO: 510253 - DNA, 961 bp, Homo sapiens
  misc_feature (3)..(3): n is a, c, g, or t
  misc_feature (826)..(826): n is a, c, g, or t
ccnggacgtcggattctccccagacgccgagatgcgggtcatggcgccccgaaccctcatcctgctgctctcgggagccctggccctgaccgagacctgggccggctcccactccatgaggtatttctccacatccgtgtcctggcccggccgcggggagccccgcttcatcgcagtgggctacgtggacgacacgcagttcgtgcggttcgacagcgacgccgcgagtccaagaggggagccgcgggagccgtgggtggagcaggaggggccggagtattgggaccgggagacacagaagtacaagcgccaggcacaggctgaccgagtgaacctgcggaaactgcgcggctactacaaccagagcgaggacgggtctcacaccctccagaggatgtttggctgcgacctggggccggacgggcgcctcctccgcgggtataaccagttcgcctacgacggcaaggattacatcgccctgaacgaggatctgcgctcctggaccgccgcggacacggcggctcagatcacccagcgcaagtgggaggcggcccgtgaggcggagcagcggagagcctacctggagggcacgtgcgtggagtggctccgcagaatacctggagaacgggaaggagacgctgcagcgcgcggaacacccaaagacacacgtgacccaccatcccgtctctgaccatgaggccaccctgaggtgctgggccctgggcttctaccctgcggagatcacactgacctggcagtgggatgggggaggaccaaactcagggacaccgagcttgtggagaccaaggccagcaggagatggaanccttcccagaagttgggccagctgtggtgggtgccttctgggacaagagccagagatacacgtgccatatgtcagcacggagtgctgccgggatccctcacactgaaatggaagccggtttccaggccacaatcc

SEQ ID NO: 510254 - DNA, 500 bp, Homo sapiens
  misc_feature (153)..(153): n is a, c, g, or t
  misc_feature (375)..(375): n is a, c, g, or t
  misc_feature (397)..(397): n is a, c, g, or t
  misc_feature (430)..(430): n is a, c, g, or t
  misc_feature (466)..(466): n is a, c, g, or t
aaagccgctgtagcaaagaagccctaaatacagtggctcgaataagacagaagtttatttctctctcgtgtaatagtttagacctcaacaatggctctgctctaaaattccagaattgggatttctatcttgtagctctaccagcccctaggnagtagctcagagttcaaaatgcacatgagtaccctgggtggtttcattaaattgcaggttccagggccaggcacggtggctcatgcctgtaatcccagcactttgggaggcaaaggtaggaggattgcttgaggccaggaatttgagaccagtctggacaacatagcaagacctgtctcgacaacaattaacaacaacagaaattagccaggtgtggtggtncacgcctgttagttcccagctnactggggtaggggtaggcttcaggttcggaggnttcgtttgaggcacaggagtttggaggttaacagtncagcttttgatttgcattcagtggcattccagtc

SEQ ID NO: 510255 - DNA, 473 bp, Homo sapiens
acatggaataattagagaatggactttcaggtctagctctctaacctccagggaggggcaaggggctgacaattgagctaatcacaagtggccagagatttaatcagccatgcctacttaatgaaagctccagataactgggcacaggttcctggagagtgggctgcctggagaggcgatagaagctccttgcgccatgtcccatagctcggcggtaatgcacctctatccaaatgggccgctcatctgtgtccttgcataagtattccttaaaatagttgtacctagaagtgttcccttgagtgctgtgatctgctctagaatcttcactggaaccaaggatagtgagggatgggcagtgagctggtgcctgtgagaagtcctaatcaatcagccggttggtcagaagcacgaggtcacacctgtgtttgaaactgtgctctgcagtgacgggcagtcttctgggactgagc

SEQ ID NO: 510256 - DNA, 871 bp, Homo sapiens
  misc_feature (46)..(46): n is a, c, g, or t
  misc_feature (131)..(131): n is a, c, g, or t
  misc_feature (147)..(147): n is a, c, g, or t
  misc_feature (175)..(175): n is a, c, g, or t
  misc_feature (203)..(203): n is a, c, g, or t
  misc_feature (305)..(305): n is a, c, g, or t
  misc_feature (321)..(322): n is a, c, g, or t
  misc_feature (346)..(347): n is a, c, g, or t
  misc_feature (356)..(356): n is a, c, g, or t
  misc_feature (361)..(362): n is a, c, g, or t
  misc_feature (375)..(376): n is a, c, g, or t
  misc_feature (383)..(383): n is a, c, g, or t
  misc_feature (499)..(499): n is a, c, g, or t
  misc_feature (506)..(506): n is a, c, g, or t
  misc_feature (519)..(519): n is a, c, g, or t
  misc_feature (522)..(522): n is a, c, g, or t
  misc_feature (538)..(538): n is a, c, g, or t
  misc_feature (547)..(547): n is a, c, g, or t
  misc_feature (554)..(554): n is a, c, g, or t
gagtctgagcctccggcaccggccgcgcagctggaggcggcggagnggaagccccaccatggttgcaatccgaaagaagctggtgatcgtggggatggtgcctgtgggaagacctgcctcctcatcgtctncagcaaggatcagttnccggaggtctacgtccctactgtcttgnagaactatatgcggacattgaggtggancggcaagcaggtggagctggctctgtgggacacagcaggcaggaagactatgatcgatgcggcctctctcataccggacactgatgtcatcctcatgtgctnctccatcgaagccctnnaagcctgaaaacattcctgagaanntggaccccnagagnntgaagcacttctnnccccaangtgcccatcatcctggtggggaaataagagggacctgaggcaagaacgagcacaccaggagagagctgccaaagatgaagcaggagcccgttcgtctgaggaaggccgggaaatgngaaccgnatcagtgccttgngtnaccttgagtgctcagncaagaccanggagggngtgcggcgcggtgtttcggcgatgccactccgggctggcctccagggtccgaagaacaagcgttggagggctgccattctctgagatcccaaggctttctaattgcccctcccttcaaggggtcagaatttttcccttaagccaggtctggggctcatgtgaggccctttcagcctctgccggactgtgtttctgccccggtgggggggccccctccgggtggagcgcttcggcttgtaggccggttgcccttgctccggtggcaccgtttattgccgggttggggcgcccccgtgtggcgctatcaggggagagcc

SEQ ID NO: 510257 - DNA, 191 bp, Homo sapiens
ttccgaggattcagcttgatagccagcgtggcgtacagtatatacgatcccggtcactgcaaactccgctcccaggttcaagcgattccccacctcagcctcccgagtagctgggaccacaggcatgcgccaccatgcctggctaagttttgcatttttaatcagagacagggtttcacctgtgtatggcc

SEQ ID NO: 510258 - DNA, 423 bp, Homo sapiens
tatggattgtgtcaggtcctgccgggcaaaatgatgtctgtcatattacgactcatcaggactgtagttctatcacttgcagaaatggagatcttctctagcatggatacatatagctgtaggatctggagaaaaggaatctgctaagcctatcatgaagtgaggtcttctttgttatactgtccaaacttttgacacagtcggatgatttgtcggtccataccaccggaccacatcggccccctcctctgactccgctcggaacaccccaagccgtgccatcaacactgccgcagtcctcctgtgtcaaatgctgcttctatgtgcctgagctgactctgtacatctgcccaatttcgggcgatggtggtcacgcggatgcgtctctgggtgctggagtgctgataatgcgtgacaaactgg

SEQ ID NO: 510259 - DNA, 1588 bp, Homo sapiens
  misc_feature (1)..(1): n is a, c, g, or t
  misc_feature (279)..(279): n is a, c, g, or t
  misc_feature (552)..(552): n is a, c, g, or t
  misc_feature (814)..(814): n is a, c, g, or t
  misc_feature (985)..(985): n is a, c, g, or t
  misc_feature (1050)..(1050): n is a, c, g, or t
  misc_feature (1133)..(1133): n is a, c, g, or t
  misc_feature (1241)..(1241): n is a, c, g, or t
  misc_feature (1268)..(1268): n is a, c, g, or t
  misc_feature (1275)..(1275): n is a, c, g, or t
  misc_feature (1292)..(1293): n is a, c, g, or t
  misc_feature (1348)..(1348): n is a, c, g, or t
  misc_feature (1350)..(1350): n is a, c, g, or t
  misc_feature (1446)..(1446): n is a, c, g, or t
ntcatgccgcctctccctcgtcactgtgggtggaatcctctgccctcgcggtgggttgttgagcccctcactcgttgtggtggatgtgtcctccccgacggtgttgctttttccgggggggttcactacaccccgacgagttgtgtgttagaatgaaaaaggtgggttattacatctccccccctcagagatggcgccacccagcgttgtgtgcccccttcttttccaaggaggccttctcctctgggtgagaattgtgggaaccccccttgccccgcnctcccttctttggggggatgtcttttcacccaaagaccgggggccacccaccacaccccagcggaaggcccagaattttttttgttggggaccctacataacgaccccacagaggaaaatgttgttgtctttgaagagagtttggtggcggccccgtttttttccccctcttctgggacccaatcccgcgcgccgcagaatttggtttcttctctggaggattctctctttcgggagatatttttttcccctttttccccagtctttatgggnagaatataaaccccctcggggttgttggtcgcgcccaaaagaaacccacccgtgggtctccccgcgaattgtgagagacccccaccgtcccccgggagattggggttgttttcctctggtggtgcccgccgcttttgtgtcgcgccctctaccagctccagtcccatcccctctatgtcatgtcgctgtctctcctcttggggccttggggggaaacacaacaactcggggtgctcacaagagatgtattagggggaaaccnctcgcggctctttaatcttgtgcccacacagctctcgagagagacgcccccacccccaccacttctgggggcacaacacaccacgcggcttattttctcgagacacaccgcggctggagaactcggtgtctctctctcccacagcagtggggagtctcccctctctcgtgnggctctttctcgggagagcgccccacgagagtttggcccacacgcgcgcccactcgtgttatatnggggagattctctcacacacgagaaaggggcacacacaacacacactctttacacacccgcgctatagagatgggttgtgggnacacacatcatcacttcacacaccgcccccctcgttggggctctttcacagccaacgctcataacccgcgctatatctcggctcttgttgctcgccacacacaggccncccacagcactccaggaagattctgtnggagatntttatagagagggagannaagagattcacatctgttatagagatgagacactcgagagccacaccagagaagntntatatacacagtatccaccgccacagcccaagcgccacagaaccccacccccacgtggcaccctctccctcggcctcggttctcgctcgatggccnacgacttctcgtttgtctcggctatacccggagcacacacctcggtgcgaagtgtggccacaggtggagccacttggcaccacccctatgaaagttttttggcacgagcctttaccaataaaaaaaaaactggcttttttga

SEQ ID NO: 510260 - DNA, 393 bp, Homo sapiens
gcaacgccgctctttggacccccagcgcatagatattaccggaaaatatgcttttcaagagcccttctttgggaatccttcctagggagaaaaaaaaaggaggtggttaccaattgggaatcccatttcttatttaagtttctgctgcagaattgggttcccacccattttaattcccagcatttatgttctgtggttttctccctttagcccaggaccatttttatttaatccccaattcccaaagtttggagacagatggcccccctactaattatgggcctctagttgaattttaaaaggggaaattttggctttgcagccggagggagctgcaaatctggtaaagggggagtgtggggttaatggggagttttttaataaagggaaact

SEQ ID NO: 510261 - DNA, 168 bp, Homo sapiens
gcagaccacttctgcgtctcctctgccgtcttggcaatgcagacaaaccacttattcttggccgtgtagtggatcttccagacacgaaggtgacggtatagccgtggctatggtaatccgctgtcccatcttccacattctccacctccatgccttcagtgttgattc

SEQ ID NO: 510262 - DNA, 106 bp, Homo sapiens
attttattattgccaaaaccatttactccaaccctttaattttcctttttctcactattcttgaccctattaaaagaggaaaaagcaaccatgttgggcccccata

SEQ ID NO: 510263 - DNA, 244 bp, Homo sapiens
gcacagcagcggacccaggtagccctggacatggctaatgcttacaggggacaggaggaacaggccaaccaggaacttgacgaacttatccagagggtgaaggacttcctcaaccgtgagcctaccacgggtgccaggccatgtgcatggcccgtttgccacactcccggtggcctgcatctcccttgcatcatacgttgagcctgagggactacactgggttaggagcttatgattcctagac

SEQ ID NO: 510264 - DNA, 760 bp, Homo sapiens
ctcatccaaaccccctggaagcttcaacgggcgcagtcattctcataatcgcccacgggacttacatcctcattactattctggctaacaaactcaaactacgaacgcactcacagtcgcatcataatcctctctcaagggacttcaaactctaactcccaactaatagctttttgatgacttctaagcaagcctcggctaaccttcggcttaaccccccaactaattaacctaactggggagaaactctctggtggctagtaaaccaacggttctcctgaatctcaatattcactcttcctaacttatcaggaactcaaacatatctaggtcacaaggcctaatacttccctctaacatatttaccacacacacaatgggggctcactcaaccaacacattaacaacataaaaacctcattcacacgagaaaacaccctcatggttcatacacctaattccccaattctctcctattcctcaaacccgacatctattaccggggttttctccttaaaaaaaacaaaaaaaaaaaacaaaattcactggccggccgttaaaacgtcgggatgggaaaacctggggtacccaagtaaaggcgggagacaatccccttgccacgggggaaacgagaaggcgacgaatgccccccaagtgccgccctaggcgagggcaggagcgcaaaatgtaaaacgggaatgtgacacccgatacgcagagcgaacgccacacacccgcggggtgcacccggcgcccacgc

SEQ ID NO: 510265 - DNA, 1336 bp, Homo sapiens
  misc_feature (262)..(262): n is a, c, g, or t
  misc_feature (640)..(640): n is a, c, g, or t
  misc_feature (847)..(847): n is a, c, g, or t
caggactggaacatgagatccggagtacgttacttcagcgccttggctgcgccggcatgctgagtgttagtcacactcggctactgacaacttggttgtgcatcaccacgcggcgtgttatgtcgtcgacactggctgctgccgataacaatgttctcgtgcaccacgtggggtgtctccgctcgcagctctttataaacggctctgtcgagttgtgaatatggttgttactgtgttctgaaatattatcttttgcgtgccncacaatcttgttgagacctcctggcgaatttcgcgcctgaaattgggtggcccgcacgactttgtggtgtaaaaaacaccctgtgctggtcttcaaaggaaggtccccttaattgtctggggacacccaaaccagggtgtaccccggggctgtgtttatatgtttaaggataattgtgaaaaccggggcggtttctcccggcccccggaatatggattcgtaatttaggagtggaccccttagaatgttgattattgattgagtgtaagcgaaggttctccgggtcctatgatgctaccagacacccgtgtgtgagacaatttaggcaccccaactggaggacccggcgcccattggacccaccatggactcttcgcncttgggccatgttatgggtaaattctgtgttgacgtctccacgccctttataagtacgtcgccctggaggttcacgcggctcaccctgcactgtcacgcacccacttattcactaagagggctcccctcggagcacctgagaccctcctaaaagggagaaaaggttctacccctcggaagccccgcgagcactccacgcggttgtgnctctgggaggcccttgaggagaggtgaagacccaacgggctataggacactcgggcccccaggccccgcgcacgcacactggctaactctgggagaggagagccacactctcacccccttgtatattaagttatattataaaacaatataaatttgggctcgggcgccacgctgggctcaccgccctcgtatattccccgccacctcttgggaggtccgaggccacttcggagttcacacttgaggtctcacggaggttttcgaagaccacccctcgggcccaatattggtgagaaccccactctctacttaaaataccaccaagttatgccgggcgtggtggcacaggcgtctgtaatcccacagctgcttgggaggctgaggcacggagaactcaccttgaaaccctggaaggtggcggttgccacgtgagcacccgatcatgcccctgcactcccgcctgggccaccaaaccagacttcgtttcca

SEQ ID NO: 510266 - DNA, 129 bp, Homo sapiens
  misc_feature (22)..(22): n is a, c, g, or t
  misc_feature (24)..(24): n is a, c, g, or t
  misc_feature (89)..(89): n is a, c, g, or t
  misc_feature (95)..(95): n is a, c, g, or t
taaggtatactcacatgctctnantcaccacactggagtgcacacacgtaccccgcacccagtatttcctgacagaaagctcctcccancccccngggccaggacccagcatgatcctgaaatctgccg

SEQ ID NO: 510267 - DNA, 538 bp, Homo sapiens
tctgagcagctggcaggaacatgttaagtccgctgaagctgtgcccacagttgccccttcccccaggtgctctgtcctagggagatgggagttttatctaaaaacccctggctggggctgctgcctttctttcagagatgccctgcccagtgaggaggagtctagagaggcagtctggccatagccactttcccgcactgtggtgagttctgcccagtctaaactgcctggcctccttagcactgtcaggggaaaactgcctactcaagcctcagtaatggcagatgcccctgcccccaccaagcttgatcgtcccagatcaacttcagactgctgtgctggcagtgagaatttcaacccagtggttcttagcttgctgggctctgtgggagtgggacccactgagcgagaccacttggctccctggcctcagccccctttccaggggagtgaacggttttgtctcgctggggttccaggcaccactggggtacaaaaacaaaaacaaaaacctcctgcagcttgctcagccgggtac

SEQ ID NO: 510268 - DNA, 270 bp, Homo sapiens
gggcccccagggtccccgggggtttgggggttttttttccccgccggacccccaattttggggggttttttcgccccccgaaaaaatggggccggggccctttttttttttcccccccctccgggccccttttttttgtttttttggggggggggggtttttttccccgggaaccctttccttggtcccccccccccccgtcccccccgttttccagtttagggcccaagggtttttagggggtttccctaaagggttttttgggcccca

SEQ ID NO: 510269 - DNA, 330 bp, Homo sapiens
  misc_feature (124)..(124): n is a, c, g, or t
gagacggaatctcactctgttgtccaggctggagtgcagtagcgtgatctcggctcactgcaagctctgccacccaggttcatgccattttcctgcctcaacctccagagtagctgggactacnggcgcccgccaccacgcctggctaattttttgtatttttttttgtagagacagggtttcactgtgttagccaggatggtcttgatctcctgacctcgtgatccgcccgcctcggcctcccaaagtgctgggattacaggcgtgagccactgtgcccgggctgcttatacgtttttcaattcagagtttcccttctgtcgtcttctc

SEQ ID NO: 510270 - DNA, 323 bp, Homo sapiens
gagatgggacccacgcaatgcaacatagaacgccaagtgcaacatacctgggcccattatagcgcaccccagtctaccgcatgtgcagatgcaaagcactggctacgctgggctaatggcatcatcgtgctggggaggacacatgacctggatggctggcccaatgagaacctggtgtgcatggccaatgcgcattaccactgcaaaacaggattattgccccaagctatcccaattcagggcaggaagactatcacaaggatggaataggtaatgcctgtgatgatcacgatgacaataataaaattccagatgacagggac

SEQ ID NO: 510271 - DNA, 304 bp, Homo sapiens
gacgtaaatcatccgctgcgtaggctatatgccgcggccagggccagcgtctgcgcaaagtggctcatgcgtatgacgtgcaggccggtctcgttgtccttgaactcggccgccgtgcccaggcgctggatgatctgcaagcgtgtatcgcgcactcctgtgcctgcacgagcgacaagtgggtgcgcacgcgggctttgacgataccgggatggtagggcttgctatgtagtcgaccgcgcccagttccaggccgcgtgtctcgttgtcgacctcgctcaggcggtgacgaagatcacggggt

SEQ ID NO: 510272 - DNA, 364 bp, Homo sapiens
cagagacagacaaagcgttaggagaagaggagaggcagggagcccccaggcccggaggacgaggactccaccctggatgaatctgacctgtatagcctggcccattcctacctcggaggtggaggccggaaaggtcgctccactagagaagctgctgccaacaccaaccgccctagccctggcgggcacgagaggctggtgaccaagctgcagaattcagagaggaagaatcaaggggcacggcgctgagacagacctggagatgatgccagaccatggacactacacccagcaatatagacggtactgcggatgtgaggacccatgacaggatccaggccggcttgccacaccttacagccct

SEQ ID NO: 510273 - DNA, 192 bp, Homo sapiens
ggtcccagtttctgaggtctctccagaagcagatgctggtaccgcacttcctgtcagccgcagaaccacaagcctattaaacctcttttctaattacccagtctcaggtgttcctttacagcaacgcaaacggactaacagcacgtggaagtgtgtggggcggagcactgtgtgctgggaaggcacctgggg

SEQ ID NO: 510274 - DNA, 419 bp, Homo sapiens
gatccccattcggcgaggcagtctcgaaaagctctggttataactggcctggttctgattttgctgtgttaaagtttctggtggggaacagtaggaactggggcattcatcttgaacaccgtttgcatggattggaatggagctgcatttacattgattccactgctatgtaaaggtttgcttgtcccagcctgaaatacttgaggctgagacgcagcaggaagggatgatgatgctgtagtctggtctgtatttaaagagattgttgcctgaatctgatcaattggttccttctgtggttgttgctctgtagcatgagaaggctggtacaagggttgagatgctgtgtacccctcacttgtggatgataccaaaggaacctgtgtcgcttctggttgtacaggaacttgattaggctg

SEQ ID NO: 510275 - DNA, 601 bp, Homo sapiens
gagctgctcccagtgttccctccccacgaccgcctagtgagaccactatttggcagggtgaggaatgtactggtgaagaggagaggaaggggagccggacacgactacccagcacagagccggtgcacatgggtttgtgtgtgacctcagtatagggagcatttgacaagaaagctgggcactacacgataagcatcgcagagcgacaccatcgagaggcatacaacatagcagaacgagacgcgacacagcaacaaacacaaaaagagcacaacacagcaacaacagacacaacaaccaaacaaaacacaccacaacaaacaacccaaagacgacacacagacgcagagacgcacgagcgaagaggacaagacacagagcaagagaaggcagaacctacaccgcgcaaaccccagacccaccacacgaaaccgacgctagatggggaaggagacacagaagagagggaaaaaacagaacggaacccaagcacgcgaccgacgcgagacaggagagaaaaacagatgcagggagaaagcagacagaagcagaagcacgatcacgcccccaacgccccaaaccgcgcacccaccacacacaa

SEQ ID NO: 510276 - DNA, 890 bp, Homo sapiens
cgagctaggagagactgcgatgttaatcggccgaggctccgctgcaggcctctcagccccaggagcagtactcgctcttcagtgcctgccctggaatcctggaggctacacagctgcccactcctcctggggaggctgcctgtggaggccatggagatccctgcccctgtgagccctgagaagacagctctttcctctcagtgatcctgctctttccctgaaagagaatctcgatggatatatctgtggttgttgtgtcttccctgaatgccatggtccaatggaatctggtgagtttcaatggatgtagggcttgtggacttcacccagtggatggagtgggtgtcaactagactcccctcagatggggccttgtaccggtgatgtgatgttggagaactaccagaaccttcttgccctagtgacctccacttgcacaagccagatgtgatctctcatctgggaacgagggcgacggagccattggatgcatgcagatgggaagtccccagagggccctgtccagaatgtggagcttgatgtgctggtgccctctccaacagcagtggccatatgcaaatgaagaaccggcccaggagcccatcagtggagcgggccatcggacggagcagcagagcgaagggggcgccaggcagcgtagatctgccagaaggagtcaaggctagcgacaccaggggcggcacgcaccatgccatggcctgcgacgtccctgggagaggaatcccccctcaggggtcccccatacgccaaaaagggaaccgagggtgcccctgcatgggaacagaccaaaaagagccaacaatgggacaaaaaggccgggaaacagggagagaaaagacaaccacgaacacaggaccagtggccacacc

SEQ ID NO: 510277 - DNA, 523 bp, Homo sapiens
atccttaggatcattctttgacacggagcccgtagaacctccctgggggggggccatgcgtcaaccactcagcgtggtgaagcggcgacccaagtgcatctgtgtttcacactgcggtagaggcgagtgtgttggaggtgggagacaacacaagatggcggggggtgggccatcacacccctgcggacggaccctggctcttggtgcgtggccgcatacgccaacagacgaaggtgggtttcgatggacagatgcgttggcactcctgcagttgagggacgactgcacgcaccgccccaccagctgggacccaggtcagtctctttaccggcacgcctggggcgacgaaaaaaacagccaatgtccctgtgggggcccgcggaagaagcgaagtccagggacaggcccgaagaggaacaacaaaggggcctgtgtaggccgcaagagagcaccagacatgtgatgaccaggccgcggggggcctcaacaaaaaaaaggttatgatgcccccccaacaagacaa

SEQ ID NO: 510278 - DNA, 195 bp, Homo sapiens
  misc_feature (27)..(27): n is a, c, g, or t
  misc_feature (30)..(30): n is a, c, g, or t
  misc_feature (83)..(83): n is a, c, g, or t
  misc_feature (175)..(175): n is a, c, g, or t
  misc_feature (178)..(178): n is a, c, g, or t
gtaccattcgcgttcttcggcctccantcnccgcagctgctccggcgacggccataacgatacggggaccaccccggaggcgngccgtaacgcgcgaactgctatatgcgtagcgcggtcccagctgccaccgcgggtcaggaggtcctcggggtctggccaccggtagatacgnacnggcgcgggggcggtcca

SEQ ID NO: 510279 - DNA, 1475 bp, Homo sapiens
  misc_feature (450)..(450): n is a, c, g, or t
  misc_feature (509)..(509): n is a, c, g, or t
gcactgacacatccccaaagatcgctttgtcctggacgtagctgcatcatggtgttatatagatgttgccaattagatgcttgaaatcttagctatgacccggtgtacctgagtaggtacaaaggactcgaagaaagaggtgtcactgagcatagtaggaagcatcatggctcattgcttgccggtgggctcagagggagagcgagtgatcggtggatgtcgatccgagatatgtagttgagtcgttcaacggacgcagtatggatcatccgtgagaccaaggaacagcaatcggcacgagctgtgttcacacaaaaattctcagtcgtagtataggactggagattgcatccagcgtccatgggaccactgcgaggagcagtgtaccataaggaaactcagaaggggaaacatgtcaaccccacctgaacatggggtagtcagcaaaangggggaaaggtaacgggaagtttcccgcgtggtgggcaaaccctacatgatttacttcncatctctcgcgtgtaaaaggaacattcactttgaaaagcctgtacattggggcttagtacatactgcattcttcctagtcaaataggtgtatcgtaggaagttcgcgtaccaattcttggtacggataccaggtggcgctatcaaggcaagaagtctagtcccattgaacgggaagttgatgcaatttatgcatgtctttcatactagcctcgagaggtactggaggtatcttatcgctgagggccaaggatgcattgcacatatttcgcggctagacttttcccaggactaagagggaaaaggtaggggtctgtaccgcaatgtcctgtaacaccagttgagctgaagataaactgggatttcccatgggaaaaggagaatgggcaaaaccccgggaatggccgtgaggtttcacaaaggaggtaacctttaactcgttcgaggaaaggggcgagcgccttcacccaacggcaattcgttgggtggcaagaaaagcccttgtccaaagacggcgagggacagcggaaatccttggcaggggatggacacccattgcgtccatttggccgcatctaggggttaaagttatggcccttagagaggtcgttggcgcgcgttccaaggggctaagccatggcggggcgctccactttaaaaccggggcacaacccatggatggccgtttgtttactgagatgaaacccacatgaatttctttgagccaggtgcgggtggcaaacttgtaaatatagtgggcgatggtgtgttaaaacaaacgatgaggtgtgtggaaaaaagagagcggtcaaaggagacacagagatgtgggggtaggcgaggactgcacaggtgccacatggttgtaacgcggacgtgcgtaaatctgtccgcgaagagcaccacgatgagtgagagatggggtaatgagaatagccacaaacaggcgcaggggtatacgcgcgata

SEQ ID NO: 510280 - DNA, 745 bp, Homo sapiens
ggctgatagcatgtacggctgacacgtagacggcaccttggcactacggcctcagcctcgcaactggcacagctctgcagtgagaatgcctcccaactaccgcctgttggacgaactcgctgaaggcctgaactgcgtgagttatggcccagctagctcgtgtctacaaacactaagacttgaccctttctgatggaccggatgatagtctggccacctagaacatttataacactgcattacatgcttaacatgtaatgcgtcctaattaccctatgcaacgcccttggtgagatttgtaacaatcattgatattgatggagtaactcgtgctaacggagtggtggacccaagatccatgtcaatgctacccaatttgcagaatgcttcttgcttcgaattgagctgctacatcttctgcacctactgatgtcttaaaaatatcttagcctttcttaaccatcctacggacattgctacctcattttattcagtaactaattaccattgggtcctttcggcaggcttccaattttgtccaatccccttttcttttataccttctcctatatttatttcatccttttctctcactctctaaacatcttactgggatcttccgtaacgttccgaaattcttctttcaacttcttgttgatcggttcctgattttttgggcaatctctaaatttctcttgtcgtgttactcatcttatcattatttcctaaatgttcatgctcttaa

SEQ ID NO: 510281 - DNA, 447 bp, Homo sapiens
aattcggcacaagggggccattgagccaagccttcctgacctcccgatggagagggggaagagagaacaggacctccacttatccacctacccgctgctgagtccctttagcccttggcatggtaattaacggtcaggaagttatgcatcagcctcagcaagctaacatggcaggagatccctcctgacagcagagctaataagaaatttgctaatgcaatttatcactttaaaaagccatatgtcggtggggatgagcacttctctgcagcagctagtgtaattgtcagaacagagcagcgagcagctctgagaagggggtgaggatgatgtcttcactaaatcagtggtgcaatgcagcaggcgagggggctgggaggaggggtgtggtgctgggtggagggctcccagctctcaaactcccaggaagccagtgctgcagacctg

SEQ ID NO: 510282 - DNA, 905 bp, Homo sapiens
atataacctgggatgtgtagcatgtactcatccgtttaatgggtttcttatcacacacgatgactttgaaagttcaccaggtctgcagggtatcagtagctatatgccttttattgctgaggtagtgtcccatgtatgtggaatatgccatcattagatttattctgtacttcacgcatgtagatgtgacctgtgggattgtatccagtcggggctacttgtgaataaaactgtcaggaactttgtgtacaagcctactgtgtagagataggtttccttgctctggggtcaagtaccgtaccaggtaaaatggtagggtcgcagtggcagatttatgtttcataaagtaactgccaaagtgttgttcaccgaaaggggctagtaccctttatattcgccacacagggttgtaataagagttaccaatgtgtccaaccactcaggttgtgtcacgccattctgattgggaatcatagtggtcatcctcaatgagtggtttgattctgcatatcccccgggtgactaatgctggcaagcaatgtctaaggtacttttggccagggtgtgttgtctgtgaacgtgggttggtccaaaatcctttggggccatcctaaagtgggaagtgttggcgtcatcgagtcgtaagacgtacttagcatatagggataaaggcctgtggacgaccaagatatgacccctttttaaattggatgggatgcaacaatgttgggggggtcgggcaccggaaatttcagcgcactcacggtggggggggaccatttattggagattgtccccgtttcgtgagaacctgccttctctggtggtttcacaaaaggcggggaagcgtttacctggggtgcgttgtgttaagccgctcacagcggcgcggaaaagtgcgcgac

SEQ ID NO: 510283 - DNA, 342 bp, Homo sapiens
acttcttcgggccctgtcatctcagcaaaggtctccttggagttaatgcgatacaactcgacttcctcatccatggagaggctgctccaggaggccttcgccttctccttccgtgccttctgtctggcagacaggtgcttgacatggtccagctccggcaagtggtggtcacgccgatccatataagctgggagcgaaaagtcttcgctcgtcacaacactttcatgagctcgtacacacacagaggtggaaattgcacgcttgccaactagggtaaataccttggtagccaacattctgcggccactgcccgccgcgaacgccctctacaaccggtgttcc

SEQ ID NO: 510284 - DNA, 655 bp, Homo sapiens
  misc_feature (552)..(552): n is a, c, g, or t
cgagggggaggaggagagggggagagaggggagaggaaagaaaaaggaagaggagaagagggaagaagaaagggaaagagagagaaagagggggaaggaaagagaaaggaaagagaagaggggaaaagagaagggagggtggggaagaagaggagagagagagggaaaagaggaaaggaaggaaggaaagaaggaagaagaaaagaggagggggagaggaaaagaggaaagaggggaaagaagaagagggaagaagaaggaaggagagaaatagggaaaggagagaaagagggaagggagaaaaagagggaggaaaaaaggagagaagggaaaaagggaggaagaaagaggaagagggaaaggagagaaggagaggaagagggaaagaggaggaaggaaaaagagaagaagagaaaggagaaagaagaaaagaggaaaaagggaagaagtaaagaagggaggaaaggggaggaaagaaggagggggaaggaagagagggaaaaagaggaaagagaggagaaaagggagaaaggagaggggaaagaagaaggnaagaagaggaatgagaagatgataaatagatatcaagcgctcactctctctctctctctctctctctctctctctctctaaacgtgccgaattcctgcagccc

SEQ ID NO: 510285 - DNA, 253 bp, Homo sapiens
  misc_feature (204)..(204): n is a, c, g, or t
  misc_feature (211)..(211): n is a, c, g, or t
gagatgaagctccgcctcccgggttcacgccattctcctggctcagcctcccgagtagctgggactacaggtgtggctaattttttgtatttttagtagaaacggggtttcaccatgttagccaggatggtctcgatctcctgacctcgtgatccgcccacctcggcctcccaaagagttgggattacaggcgtgagcacttgngcctggnctacattcattatttcattaactctttacacagacctgagag

SEQ ID NO: 510286 - DNA, 645 bp, Homo sapiens
atgctgacggactgctgcccacaggcccacccaccgcacgcatgacatccgacggccagcctgccagctcgcccggccctgccaaccccacgggcaggctacgagcctgcctgccggaacaccactcataacacgcgtccccacggccaggcggctcccggccatcccggtcccagccccacggtccacctcagccacggacggcctacaccgcactgcgacatggaaagcccaactcaaagcgagatcacccttcaaaccaaaatacccatgagcacccaagacacgcgccggtccgcaccagcacgtaacggcactgcaccacccaaacgaccacaacgagaatccagagtagcacggacctggcgccttggtcgccacccacagctgctggcccggacccgaggacaccgttcgacaactgtccgcacgcaggaacggtggcatcccacacaccgggcgacgccggtccccaaaggtcacccgggcacgaggcgcggacaggcctagccccccgtcgcgcaccgcagggattgcgactcaagcaagaacacgcgtgccaccctgaccacgcgtcagacaacggcagaagcccaagggccattgacaccccccagcgcgcacacgccgtacgacggcccccag

SEQ ID NO: 510287 - DNA, 123 bp, Homo sapiens
agaagttgtctagccttccgttccagaaaattcagcacagcatcaacgcgcaagaccatcagcccactccagatagctgcatcatcagcatggatgtgggccagcttaaggcggatgaagacc

SEQ ID NO: 510288 - DNA, 424 bp, Homo sapiens
  misc_feature (237)..(237): n is a, c, g, or t
  misc_feature (390)..(390): n is a, c, g, or t
ccctcacaatctcatcacagcacgttgcatgttctctctatatgtgtgaacacgtgattgcgtgtcatctgctgtctccggatgccaacacaaggcagctcagctttgtgtcagaaataaggatattgatcgggactccgatcagaacttgagtacctggggctgctggcactgtccaagatcctgaagatccaccccaagtccgtgcagtcgcacaaggacctcatcctgcagtgnctggacgacaaggacgagtccatccggctgcggcgcctggacctgctctatgggatggtgtccaagaagaacctgatggagatcgtgaaagaagctgatgacccacgtagaccaggcagagggtaccacctaccgtgacgagctgctcaccangatcattgacatctgcgggcagtccaactaccag

SEQ ID NO: 510289 - DNA, 514 bp, Homo sapiens
cttaaaaatataatcaaagccttaagaactgaaccaaaatggcttaggtgaaaataaaataccatactctgctctaagaaaaggaaagaacattcactgaattataccttcagcaataagcacgtaatggaacttgtttcatttaaaatgcatcacaatcctgtaaattgataatcatcataccgcaattttatagatgagcaaggtattaggcggacctttttcaaaaggtcatacagctagtgacaaatatttccaaatttttcataacatttctttttttgagacggagtcttgctctgtcatccaggctggagtgcagtggcacaatcaaggctcactgtagccttgacctcctgggcttaggtgatccatctcagcctcctgagtagctgggactacaggcacacgcctccacacccagctaattattttttttttccttaatcggagatggggtctcactgtgttgcccaagctggtcttgaactcctgggttcaagcagtcatcctg

SEQ ID NO: 510290 - DNA, 104 bp, Homo sapiens
tgtgtgtcttgtctgggctgcttgtccttcctcaggaccagctcagagggtcttctggaaccagctgtctgtggagatgaatggggtgctttcgtcagggactg

SEQ ID NO: 510291 - DNA, 959 bp, Homo sapiens
  misc_feature (11)..(11): n is a, c, g, or t
  misc_feature (329)..(329): n is a, c, g, or t
  misc_feature (837)..(837): n is a, c, g, or t
  misc_feature (945)..(945): n is a, c, g, or t
aggggaagganagaagaagtgtgtagaaaaaaggagggtgggaggggtggggaattggggggatgagggtgggagagggatagggttggggggggggggattggggtggagtaggaagagaaagtgaaggggtaggagttgtggggggtttggggtgtgggggagggagagggtggtgggggaggagggtggtgggaaaagtaagaggtaggtggtaggggattgatgtggttagtgatagtgggggggatgagtggagtgtggggaggtggttgaggaagtggtgtgtgaaatgggagggaggtgaaaggagaagggggatgtgtaanagggggtggggaaggagaatgggtggggtggtgggagggggttgaaagtggtagaagtggataaggaattggaagtgttggaaggggtgagagggggagttgaggtgtgtgtagggggagggaggtggagggaggtggtgagggagaagatggggggggaagggtggggggaggtggtgggtgtggaggtggagggtatgggtggagtaggaggtgtggtagagatggagggggagatgagggaggtgtggagtgggaaggagatgatggaggagtttaaggggtgcggtggggaggtagtggtgtgtgaggggggtggtgatgtaaggggtgtggatgatgttgatgagtatatggagggggaggtggtggtaggtggtgtgaagattggtagagatgtggtgaagggaggggggtggtttgtggggaagatattgggagggggggatgtgagggtggtgtagagggaggtggaggtgttgttgtggagggtggtgtgtgggaaggnaggaggagggggaagtgtaggatggaggggttgggtgtgtgtgaggggtatgagggtggggaggggttgatgggggaggtgaggaaaggggtggtggaggattgttangagggagatttgaa

SEQ ID NO: 510292 - DNA, 337 bp, Homo sapiens
gagtgagactcggtctcaaaaaaaaaaaaaaaaaaaaaagcctgtagggtcccatttcttcatttatccaattaagtgaaataaacagctgctgcctagggtggctgagctgggagtgccaaggtgcttttggaaagccgtgggacggtgcgcatctggaattgccaatgtcttcactcctttcatccagcaatcacattcatgagaatctatccttccaattctaattatggaaaaagctatgcacccaaaaatatgcatcggggcataatttaatagaaattgtaagtgacccaaatacctcatacgaagttaaatacataatgatatttccata

SEQ ID NO: 510293 - DNA, 203 bp, Homo sapiens
  misc_feature (51)..(51): n is a, c, g, or t
caaatggacgaacactcttatatcttttttatttctgtgaattagtagcangttgccacttcacttatattttagtaatttgagtttcttctttttttcttagtctagaatctagcttaaggctggtcaattctgttatcttttcaaagaaccaacttttgttgtcattgattttctctattatctgtctgttcgttccattt

SEQ ID NO: 510294 - DNA, 127 bp, Homo sapiens
tactcgtccattgggaatgcgtcagtcatggccctgaaatactaatcgggattgatggatggaaggctccatcatctttaataaattcaggtctggtcatctcctataagacagaagaaaagcccat

SEQ ID NO: 510295 - DNA, 105 bp, Homo sapiens
acgcatgccaagctctgggaagtcatcacagaggaaggagacccaggtgatactacttgacacacctggcattatcagtcctggtaaacagaagacggcatcacc

SEQ ID NO: 510296 - DNA, 132 bp, Homo sapiens
ttgtggtgaccgtgtgctgcttgattgtgatattgacgcagtcatgcacaaagttgttctggtagctgtactcatccatgggcctgtagtgcacttggaaggggtaacggtgcatgtattcacgatagaaac

SEQ ID NO: 510297 - DNA, 965 bp, Homo sapiens
ggtgagcgcaaagcctcaggcccggtccctcctgagctgcgccgtgccaggccgccgcggatgcagtgggccgtggccggcgtgggctggtgggccgcgcttgctccgtggcttgtcgcaagcggggtgttgacccaggtcgtcgtggctcttggctggggtaccgccggacgtttcgttttccagcgcgtaaggagtatacgcgcaagtttggccgcgcggaggttacgctgggggctttgtgcccaggagcgctggccatttcctcttcggtcgggctcgtggacaccttgcgcggcggtttgcaacccccaagtggccagccgttttgctttgtccccggacggaaggactcgctagcaggtgggctgctcctgtggacactttgcctagggatgagcattggcacattggccgccccacttgggtccactttcctgtgacgggccatcgggcggccaccgaacgattatggtgcgagtggccacttccggggccaccggcctttttggggtactttccctgcgcgccaaactccggggcgccgcgcacatctcgtgcggggcgtggcagacatccctgcgggcattccccaaatccaattcgttcaggtggacacaaaccgattttgcaccagccgagggtttggaaacaacacaggtgacaaccccaccccaaaaagacgagttgacaagtgctatcttatgaaataaccccccaatggtgcgtaacagaaccggagtctagacctacccacagcgtggcccccatgtgcggttggaagcgcggcagaacccatgcctggtgctgcaaactctgctcgggaccccaaaacacaccacgtgtgagctctggagtgcagaccatcacgtcgcacgacgagtgacatacatcccaactcccaccatatctcgacaaccccccttgggcaccatctcgccgcgctcatgtaccaccgccaacac

SEQ ID NO: 510298 - DNA, 738 bp, Homo sapiens
tggccgggtccgaggccgcagacctgattaaggcaaggcctgggataatcagcggatgacggtcaccaagctggaccgattgcacaaggacatgatgatcaagttactgatgagtaactatctcttgtccgtgcctatgaatgaatcaacgagcattggtaacttcctactgacctctgtaaaggatgcgggattgatgatcatgccagtgcataagcagagccgtggctgacagcgcaccaggttcaaggcatacgttgctatcagctactacaatgttcacgtgaatctggtacataagggctgcatgcatgtggacatcgtcatctcttagacatgatcttgggcaagctctacatcagtcctgctcgcacagtatactagaggctacagagcgtatagcctgacgctagcccattgatgatttcgggctactacagctactacgctgctacgtatcagccatgccatacattgtaacagaatcagttcaccgaatgtgcctagatacttattatacagctcgccatgacgagtgtttaacctagcactggatctgactttcaatcatggcagactttagcaagagccaccttgttagtattggtaacgaaccaacgcaaaccaggaccctaggctctagctggaatccggatttaacaacgttccctattagtattcaatcaccctgtcaggtacctcaccatggtctcttccttatggacataagtcttttcg

SEQ ID NO: 510299 - DNA, 360 bp, Homo sapiens
  misc_feature (4)..(4): n is a, c, g, or t
acgntggtctagcactcatcaatggtccagcgtttgacataccgacgttggctttcctacaatacacgcctctaagcaagacactaggctgtcccgaacccctggtaatagaattgtttacctttataccaagaagagttgggaaagcaccaaaatctgcatgttgtgtgtgcccaggcatacttctatgggttcgtgctgtatgacctatagttcttatgagattgtccatcaacaaagaaacatgtcagcagggtcctatggtggctccagtgtgtgctaaatgtgttcgtgacacggatcaacctttttgtgcttatcgaggagcagaaaatcgttgtgaaagtgttgaagccacgt

SEQ ID NO: 510300 - DNA, 113 bp, Homo sapiens
gagccaggctacatccagcaaccatgtccaagggacctgcagttgggtattgatctgggcaccacctactcttgtgtgggtgttgtcagcacggaaagtcgagataattgcca

SEQ ID NO: 510301 - DNA, 523 bp, Homo sapiens
  misc_feature (513)..(513): n is a, c, g, or t
cgcggggccgggctgaggtggcgtgtgggtggccgtgcccctctgcctggagccgcctcaaatcaactttattgacagtaggcggtgaccgacaggcggggtgcacgctgggcacacgtgcctggtcggtgttacttgaagcgtggggactagaagtcagaccctgaggagcatgatctctggaagctggagagaccttaagagttaggccaacctgttgtgggtgctggaatcctttgggcaccaagaagtgcttgcacacgctctattgatggggaacttaacacttcatgagtgagtctagtcttccctggacagtgctgtctgttgattccttataatgcacatcatagctttcattgattgtattaagcacctactgtgagccaagcattgagatatgtgctgtatagctcattctcacagtaccccacttgggtaattagtgttattattatctccattttgaagacggttaaactgaagcagaaattgattaaatgagccgatatnttaatttaaa

SEQ ID NO: 510302 - DNA, 405 bp, Homo sapiens
  misc_feature (16)..(16): n is a, c, g, or t
ccacatgcctggctanatttttgatttggtagagatggggtttcaccatgttggtcaggctggtctcaaacgcctgacctcgtgatccactcgcctcggcctcccaaagtgctgggattacaggcatgagccaccgcacctggccctcattgtggttttgatttgcatttctccagtgattagtgatgtagagcattttttcatatatttgttggtcacttgtatgtcttcttttgagaagtgtcttttcatgtcttttgcccattttctaatggggttatttgtttttttcttttgtcgcttatgtttttagtgtcaaattgatgactttataaaacatcactatgaacacctggatttgggcatacgtgaagggcgcctgtctactgcagcccctatgcttac

SEQ ID NO: 510303 - DNA, 646 bp, Homo sapiens
  misc_feature (381)..(381): n is a, c, g, or t
  misc_feature (408)..(409): n is a, c, g, or t
  misc_feature (411)..(411): n is a, c, g, or t
  misc_feature (416)..(416): n is a, c, g, or t
  misc_feature (424)..(424): n is a, c, g, or t
  misc_feature (445)..(445): n is a, c, g, or t
gccctgatccttcagctaacattagtctggatggtgtagactgtgcctctagggaccgggatttcatctggtgtgaatgaccacctctctactatataacgagtacattgtctatgatattgctcaggtaaatctgaagtatctgctgaaactgaaattcaattttaagacctccctgtggtaattgggagaggtagccgagtcacacccggtggctctggtatgaattcacccgaagcgcttctgcaccaactcacctggccgctaagttgctgatgggtagtacctgtactaaaccacctcagaaaggattttacagaacacgtgttaaaggttttctctaacttctcaagtcccttgttttgtgttgtgtctgtgggnaggggttgctgggggttgtattggtcnntnctctnccaggtanataaaactgacatagagaaanggctggagagagattctgttgcatagactagtcctatggaaaaaaccaagcttcgttagaatgtctgccttactggtttccccagggaaggaaaaatacacttccacccttttttctaagtgttcgtctttagttttgattttggaaagatgttaagcatttatttttagttaaaaataaaaactaatttcatactaaaaa

SEQ ID NO: 510304 - DNA, 163 bp, Homo sapiens
gttgaactcctggcctcaagctgtgctctctgcctcgggcctcccaaagtgttagggattatagggtgtgaggccaccagccagactaatagcaggtgccaatcatgggattttaggtcagtcaccacacagttgaggtgtcccttgttttctctctcacagg

SEQ ID NO: 510305 - DNA, 506 bp, Homo sapiens
  misc_feature (22)..(22): n is a, c, g, or t
  misc_feature (76)..(76): n is a, c, g, or t
  misc_feature (100)..(100): n is a, c, g, or t
  misc_feature (102)..(102): n is a, c, g, or t
  misc_feature (113)..(113): n is a, c, g, or t
  misc_feature (118)..(118): n is a, c, g, or t
  misc_feature (133)..(133): n is a, c, g, or t
  misc_feature (163)..(163): n is a, c, g, or t
  misc_feature (178)..(178): n is a, c, g, or t
  misc_feature (241)..(241): n is a, c, g, or t
  misc_feature (265)..(265): n is a, c, g, or t
  misc_feature (273)..(273): n is a, c, g, or t
  misc_feature (306)..(306): n is a, c, g, or t
  misc_feature (317)..(317): n is a, c, g, or t
  misc_feature (355)..(355): n is a, c, g, or t
  misc_feature (365)..(365): n is a, c, g, or t
  misc_feature (402)..(402): n is a, c, g, or t
  misc_feature (428)..(429): n is a, c, g, or t
  misc_feature (443)..(443): n is a, c, g, or t
  misc_feature (452)..(452): n is a, c, g, or t
ggaaggggtagtagcggcagtnggccggtgggaccagcgccatcacctccgtacggatgttctccctccggaagcnggcctccagcagcgcgggcacctncnttttctcaaanatganggtgatgtttgagtncttggacttcatcagcgccccccaggaggngagggtgcagtgggngaggacgcccccgggcttcagcaggggaaaggcgtggtttttgatgaagtgtgaactggtgtnttttccagggctcctccgagagtnggttcgtnttgtacaggatcccatcaaagttaccgttaggnaggtgtgggtnccacaccctcccacaggccttttaaggggatgaccttnttttttttcngtggggcccagttccggagccgctggaagacgccgtnatttcacttgatgatccaatgctcannaatgggcgccttcngcacctttnacgctgcgatggccatgccaaagcccacctccaggacccggccccctttggagg

SEQ ID NO: 510306 - DNA, 254 bp, Homo sapiens
gacataaaaaattgccaccagctatataaaaaaacatatttaagatcactaatcatcaagaaaatgcaaactaaaactacaatgagttgtcatctcaccccagttagcctattttcaaaaatgtgaaagataacaagtgctggcaaggatgtagagaaaagaaaacccttgcacactgttggtagaaatgtaaattagcatagccactataaaaaacagtatggattttcactaagaaaaaaaaaaaagtcgac

SEQ ID NO: 510307 - DNA, 384 bp, Homo sapiens
ggcgcacagttctcaggagcaaagcaacaggaaacaattcaatgctgtggcttcgattctgagtagctagatttttccagacatgtctttcagtgatgaccctcaacttagctcaggtttgaaggccctaaatgaaactgattatcactcatagggacaaaccgagggggttcggttacatcttggtgatgatgcagttgtctcatacttatatcagattctttcacatttcagtttgctgtgatagggttgggttagtgtttcttctgttgtgaacctttcccctgggttctccattagggtagttccttgacatgaatttcatttgtctctgagtgcctaccttcccagggcaggtgtgcactgggttctgttcccctccaa

SEQ ID NO: 510308 - DNA, 992 bp, Homo sapiens
  misc_feature (1)..(1): n is a, c, g, or t
  misc_feature (87)..(88): n is a, c, g, or t
  misc_feature (101)..(101): n is a, c, g, or t
  misc_feature (125)..(125): n is a, c, g, or t
  misc_feature (128)..(128): n is a, c, g, or t
  misc_feature (133)..(133): n is a, c, g, or t
  misc_feature (138)..(138): n is a, c, g, or t
  misc_feature (150)..(150): n is a, c, g, or t
  misc_feature (194)..(194): n is a, c, g, or t
  misc_feature (197)..(197): n is a, c, g, or t
  misc_feature (199)..(199): n is a, c, g, or t
  misc_feature (218)..(218): n is a, c, g, or t
  misc_feature (265)..(265): n is a, c, g, or t
  misc_feature (316)..(316): n is a, c, g, or t
  misc_feature (318)..(318): n is a, c, g, or t
  misc_feature (436)..(436): n is a, c, g, or t
  misc_feature (450)..(450): n is a, c, g, or t
  misc_feature (462)..(462): n is a, c, g, or t
  misc_feature (467)..(467): n is a, c, g, or t
  misc_feature (469)..(469): n is a, c, g, or t
  misc_feature (493)..(493): n is a, c, g, or t
  misc_feature (515)..(515): n is a, c, g, or t
  misc_feature (567)..(567): n is a, c, g, or t
  misc_feature (569)..(569): n is a, c, g, or t
  misc_feature (591)..(591): n is a, c, g, or t
  misc_feature (598)..(598): n is a, c, g, or t
  misc_feature (619)..(619): n is a, c, g, or t
  misc_feature (654)..(654): n is a, c, g, or t
  misc_feature (745)..(745): n is a, c, g, or t
  misc_feature (756)..(756): n is a, c, g, or t
  misc_feature (795)..(795): n is a, c, g, or t
  misc_feature (831)..(832): n is a, c, g, or t
  misc_feature (849)..(849): n is a, c, g, or t
  misc_feature (887)..(887): n is a, c, g, or t
  misc_feature (899)..(899): n is a, c, g, or t
  misc_feature (908)..(908): n is a, c, g, or t
  misc_feature (912)..(912): n is a, c, g, or t
  misc_feature (920)..(920): n is a, c, g, or t
  misc_feature (977)..(977): n is a, c, g, or t
nttttttttaattttgatttacttattattcacagacgacaccacacaccactgtcacgagggaagaaagagcgcgggcaatccagnnttgagtccccgangagtgtcggcctcctcttcaaganttntaggnggcanggccttgtagtnttggtgggtatccttggaatacctccgcttaataggcgttgttnganantaagatggtgactcgctgncattcatctccagcctttaccgctcggagtgtactttccttgtacangcaaggctgttggccagggctcgctttacatactcctctctgcgcaccttnangttctccttcttcccgccccaggccttcagggcagaggcctgcagggctcggccgtagagaaggtcagggcccagggcttctagcagggggcactttttaatggcattgaggttgatngacgcctcctcctnactctggcctcnattanantgtataggtgatcccagttacagngggggggcactgtgcggcgcangctgttgacggttcgccatggcaatctcctcatgagaaaacttctgagtgcnancatggcctggggtgaccatgtngggcttnagcaaggtgccttccaggtanatgtggtggtcactcagagccttgtagacagcagncagcaccttctcggtcacatactggcagcgcttcaagtcatggtccccatcagggaggatctcaggctccacgatgggcacaatgccattntgctggcaganactggcataacgggccagaacattggcattttccatganggcgagggctgagggggtgtgttccccaatcttcannacacatttttttttggngaagtcagccccgtccttcttgtactgggcacagcgcncagacagcccanccaaccctngggnggtagtcncgccatttgtccctgccagggggaccacgcccttgtctaccttgatgccacaacacntccttggattttata

SEQ ID NO: 510309 - DNA, 208 bp, Homo sapiens
  misc_feature (15)..(15): n is a, c, g, or t
  misc_feature (185)..(185): n is a, c, g, or t
caatttaattctaangcagaaaaagaagtacaaatgtttagtatgacagaaataagagacaagggccagatgcagtggctcccacctgtaatcccatcactttgggaagctgaggtgaaaggatcgcttgaggccaggagttcaagtgatccacctcctcggcctcccaaagtgctgggattacnaggtgcgccgtcgtacccggtgg

SEQ ID NO: 510310 - DNA, 213 bp, Homo sapiens
  misc_feature (43)..(43): n is a, c, g, or t
  misc_feature (58)..(58): n is a, c, g, or t
  misc_feature (85)..(85): n is a, c, g, or t
  misc_feature (97)..(97): n is a, c, g, or t
  misc_feature (99)..(99): n is a, c, g, or t
  misc_feature (122)..(122): n is a, c, g, or t
  misc_feature (125)..(125): n is a, c, g, or t
  misc_feature (141)..(141): n is a, c, g, or t
  misc_feature (167)..(167): n is a, c, g, or t
tgtgtaggtgtcaaggaaccccaaactggtgttgctttggggnctctaaaggagattncgctgacaccaccatttcccccacganccagattctctnanggaggttcgtttctttagagtanganccagagtgtcaagggnctgttagatcctggaatcccttcttncatccatccctccctggtagctaggtcccgatatactcctgtcttg

SEQ ID NO: 510311 - DNA, 348 bp, Homo sapiens
gtgatccgaggattctggcaggtggaaatcaggaccatcctggccagtacaatgaaaccccgtctctaccaaaacacaaaaaaccagccaggctatgtcggcacgcgctgtaggaggctaaggcagggggactacctgaacccgggaggtggaggctgcagtgagccaagatcgcgccactacacttcagcctggcgacagagcaagactcagtctcaaaaacaaaagaaaacaaacaaaaatcttttttttaacttcattttcctgtagacggctaaaacatttcaacttcctctgctctgctgttagcaggatttacctcccttcctcctgatttccaccttgcca

SEQ ID NO: 510312 - DNA, 394 bp, Homo sapiens
  misc_feature (155)..(155): n is a, c, g, or t
acgcttcttgacggcgactgtacaccggccgaggcacctgtagatatgatagtgccagaatatgttcgagatttgtggagccagcgtagtgagaacaccctagctcctaccgctgcacaccagcctgtgaccctggctatcagcccacgccaggnggcgcatgccaggatgtgaacgagtgtgaaacactacagggtgtatgtggagctgcccggtgtgaaaatgtcgaaggctccttcctctgtgtctgccccaacagcccggaagagtttgagcccatgagtggatgctgtgtccccgcacgaacttctgctggcacgtacccatgctcgcagccccaggcacctgctagccccgttctgcccgccaggccacctccggcacccctgccccg

SEQ ID NO: 510313 - DNA, 177 bp, Homo sapiens
gtacttgttcgtgactgggatacctggggcgtcggcaccgcgaacaacccgccgaggccgcagcagcgagccggtcgccttcagcgagcaggagatcgaggcccgcgtggcgcacatccgcgcgctgatgcaggacgaccagcaggaagacgccgtgacggcgctgcacgaattgca

SEQ ID NO: 510314 - DNA, 164 bp, Homo sapiens
cggtccaaatatattctttgcagccaggtatggtaactgtagtccgaacactttgggaggccaaggcaggcagatcactcgaactcctgacctcagatgatccgcctgtctcggcctcccagagtgctgggattacaggcgtgagccaccgtgcttatctcaat

SEQ ID NO: 510315 - DNA, 373 bp, Homo sapiens
cctgtaattccgacacttgggaggcagacgcaggaggatctctgagttcgaggccagcctggtctattatagctagagttccagaacagccagggctacacagagaaatcctgctttgaccaaaccaaaccaaaccaaatcgacaaacacacctaaacaaaacaaaatagagggacatttctgtgagtttgtgtttcaagggtttgaggtaccacctcaagcttcttgcagtgactggcttgagctgaccaaatttgtggttgttctacatggtataaatgtgtgggatgtgtggcttttgtttcttgtcttctgttcatatggtggttctgcaggtagccatggaccagcatcatatctttgccgtcgacgc

SEQ ID NO: 510316 - DNA, 206 bp, Homo sapiens
  misc_feature (30)..(30): n is a, c, g, or t
ggaacttttgtggggaaaaaagcttttaanaaaggaggggggccttttaagagggattaaaattagccctgggagggaggaagggaccaggaggggtggctgcctttttccgtcccccccctctccccccgtggagggtggggccgtttttagggaggaagtccccttctgttccgcccccaaataaaggggccgttccctgggtc

SEQ ID NO: 510317 - DNA, 255 bp, Homo sapiens
  misc_feature (176)..(176): n is a, c, g, or t
  misc_feature (250)..(250): n is a, c, g, or t
agtgaactcccattcacaattgcttcaaagagaataaaatacctaggaatccaacttacaagggatgtgaaggacctcttcaaggagaactacaaaccactgctcaatgaaatagccaggtgtgatggcaggcgcctgtggtcccagctactcaggaggctgaggtagggaaggangatgcgctactgattcgagggaccatacatggttgttttcattcacagacatctggaatttagcaaagcatttncaaag

SEQ ID NO: 510318 - DNA, 843 bp, Homo sapiens
  misc_feature (560)..(560): n is a, c, g, or t
  misc_feature (843)..(843): n is a, c, g, or t
aaattaggtcctaggtgcgaggctggtggtgctggaccagagagccctgagcatgccaccgctgcgcggctagttaccatcacaccccgggaggagccgcagctgcctgcagccggccccagtcaccatcacctgcaaccatgagcatgcgaggccgagacccagcagccgccgcgccccgcgcacgctcacgcgccgccgacaccaagccctggacacataagggagcagcggagcaacggatgctggttggcccggcgctgaccatcaaaagtcagtaagtactcacatgtcacttctgtgtctacaagcaaaggtcactcaacaaccgaaaagtatatgggaaacacgtcaatatagactacaaagtgtaagagaacagacaataatgaatctcccaacacaacaaggaacatgcacacacccaaaggaaacgaccagatagtacgcaaacaccacagaacacgaccaaaaaaacagaacaccaccatacacaacccagctcaagatcaccactatcacacagtgcaaatagcacacaactggaaaaagcacgagcngagacaggatagagaagatgtaagggatagagagaagagaagcataaaaaagcgcgtagaagacgaggagcaataagaaaaaggttagacaaaggagattccaaagagatagtgatagaaaccaaagaatttacaaaacttactaagaagagaacagaaattgaaaaacaagaagaagagaaatagcaaagtttaataaaaaagcatataaatacaaataagattctataatgagttttaatcaaaaagatagaagtaaactaaagagaaaacaatatatcan

SEQ ID NO: 510319 - DNA, 417 bp, Homo sapiens
agaaagagcaagctgcctccatcttctgctgcccttcaggttggcaagaggctccctcactaggatctcagggcggaagagcgcatcacataccctcacttcaacgttcgaggtggtgctctcacaccaaccctgtttcacctaactccatcattcctcccgttattctgacggaaagaataagatcttagtccacactggtcagctgtagaccatggtcttggtgcttgtgtaggtgtgtttggggaacagagcacgccatgccaagagctcttatttcattctgaatgtaatcaaatatatccttactctatgtgggttgtataagtctatattcaaccattcccagatggaaaatatattttaaaaagcatatgtagtaaaaatgcccagaatttttacaaaaagaaaaaaaaa

SEQ ID NO: 510320 - DNA, 347 bp, Homo sapiens
  misc_feature (10)..(10): n is a, c, g, or t
  misc_feature (64)..(64): n is a, c, g, or t
  misc_feature (120)..(120): n is a, c, g, or t
  misc_feature (164)..(164): n is a, c, g, or t
ccccgccatntacccagttcagccagtacgtgtgtcagcaagacaggcctgcagataccccagntcccagcccctccaaagatttactttcccatccgtgagtcctggaatgcaggcatnatgacggtgatgtcagctctgtcggtggccccctccaaggcccncgagtactccaaggagggctgggagtatgtgaaggcgcgcaccaagtagcgagtcagcagggccgcctgccccggccagaacgggcagggctgccactgacctgaagactccggactgggaccccactccgagggcagctttcccgttgccggcccaataaaggacttcagaagtgaaaaaaa

SEQ ID NO: 510321 - DNA, 366 bp, Homo sapiens
gctgttctatattctacaagatttaatctattttttattccaggatttctattaatttatgtttatttttattcagctataacttgcataacctaaagtgcaaaaattttaagtatacacctacagattaagttataaaagatatccagtatcctagtagatgcctttctggttctaccagttgatggttctaaaggtaactactgtcctggcttttgtcaccagagattagttttgcctattttaaactccatataaattgaatcatagtgtacaaggcggaataatgccctttttcccaccccaaataaagatgctcaagtcctaatctttgaaacctgtgactatattgccttacatgggaaa

SEQ ID NO: 510322 - DNA, 467 bp, Homo sapiens
acatgatatagccatttgattaggctaaggctgtagatcatttagccccttttataatttgtcaacatatggaaagtttgtggatccatcagcatctgccataaggatcttttctcctcgagaagtgaatatacacattgtaatcgctccacgttttcgaggattcttcaacagtgttatcacatgtgctcagtcacttgtatatatctggcaataattagaagccaccttagaggtttgatgtcccctgccatcatcaaggactatcacttcataagtggacgcatggatatcgttctccgttttttttcattgtatgaaggcgccaagacagagcagttgtttggtaggtcagtcccatatgttgggtaaagtttctttttggccctgtgcatttaagaaatatgtctcttattcatgtggatggagagcaggcatatttgtagcagttgtacatgcagggactg

SEQ ID NO: 510323 - DNA, 1023 bp, Homo sapiens
ggagacagtatggctgctgcatttctggccctcgaatcgagttctcctgcaggcgctgcatgatttttggttgtatcctggggtgggatgtgctccggctctgtcagctgccgctgccctctcggagctaaaagatacctacttacagataatgtggtgaaattaaaagaatttcaacaaaagaaagtgagctgtatgcatgtaatctattctggcactaaatgaaacgtattttacgaaaacttgaaaaatgaaacttgagaccagaacaagctcatacttgaatgggggagttgataaccttactacatatgtagtgagtctacggtgaccatgtggaacttggctaaaaatgtcatttacagtgtaccatgcagagaacaaaaattatcactttgggggagtataaatttggaccgctatactgagaggttgtgtaacgagttggatctcgaggaatcttgagtgtagctcatgaaagaccagcattaacgaggtttcttctcaagactccacatcattcaatataacgatggatatgatataatcacaggcaaatataaaagtgcttagcaagtatagatagagcatgacaaaacaaggatgtgaagtacacaaaatgaatactatgtaccatgattctgaaatttgatacaagatgtatagccatgaagtatatcgaaaagcctgacgcaccttcagcagacgcaagaccacgcacagggacacaaccatccaaggcaacaatcatgtccgcatggggcatacgacagaccagaacggaacgcagacctggccagcgacccaagcagtagtcgaaagagaaaaaagaagaagaaaaaaagaacaagacagaaaaattagaagacagaacgtatacagtgtgtcggagaaaaaaagggagaaatggccaagagcgaaaaaaagaagtactatgagtaggataaagagaagagaaaagagagtattacagaaagcaaaaagacacagaggggaataggaactcctcgcttagaagtagaa

SEQ ID NO: 510324 - DNA, 419 bp, Homo sapiens
ggtaacaaatcagtgattctcaacttctaaagtgcatatgcatgtgtatgctatttccaactagatgtctaggctgggcacagtgactcacacctataatcccagtacttttgggaggccgaggcgggtggatcacttgaggtcaggagctggagaccagcctgaccaacatagtgaaatcctgtgtctgctaaaaatacaaaaattagccgggcctgttggtgtgtgcctgtagtcccagctactggggaggctgaggcaggaaactcgctgaaacctgggaggcagagggctgcagtgagctgagatcctgctactgcactgcagccttggcgacagtgtctcaattgaaagaaagagagagagagaagagagagagaaagaagaaagaaaagaaaagaaaaagaaaggaaggaagg

SEQ ID NO: 510325 - DNA, 654 bp, Homo sapiens
gcatgagacattgcaggaggtggcaagagcaggaggtttagggttctggcaccacagggaacttgcgaggagagtatcttgttcctccccagccctgacatctggaaaacggccttgtttctttccttccttcccattcccagtagttggagtggcctcaggtcaccaggccccactgtgtttctttctctggtttgctccccgcttgccagggcagcctccagtgggctgctttcacctcggtccagctgccccaggctcagaggagtcacggtccagcagagccgggcagtaaggagtgtgggagcagagggacaagctttgttgttcacagggtctgtgtcccacctcgaggcaggtgcctggatatccgctgttcctcttcctcctgcagcaactcagccaagtaggcaggcccaccacataaggctgggcatctgtgcactactcaaaggctcctggctgtggtggcagaggttaggtcccacgtcctagaggtggtaggtgtgaaggtggggcctatggctgtctggtcccacagtcagcatggtcatgtagtgaccgatgtagatttccagggccggtggctcccggggcgcaagaccttagcttggtgcactggcttaatctcgcccgaccttggttttctctgac

SEQ ID NO: 510326 - DNA, 359 bp, Homo sapiens
tgactcagcctctggagcagctggactacaggcgccgccaccacgcccggagaatttttggtatttttagtggagacgaggtttcaccgtgttagccaggatggtctggatctcctgacctcacgtgatctgcctccctcacgggtatgagccatcacacgtggccttccttagttttttttttttggagggggagtctgggctcggtcacccagggctgggaatggcgggggcataatctcgggctcactggcaaccttcctcctgggtttcaaacatattctcctggcctacagctcttccagggtacgctggagactatagggcctctggccaccaaggcccgggctaattttttg

SEQ ID NO: 510327 - DNA, 171 bp, Homo sapiens
accggatcttatgaggaacgtcactgggatgcggaacgttatgggatgaggaacgtcactgggatgaggaacgtcactgggatgaggaacgtcactgggatgaggaacgtcactatgagagggagcaggctgccctcacgtggaaccattctactcctctgcactgttccc

SEQ ID NO: 510328 - DNA, 182 bp, Homo sapiens
acggcccagctgtggagaccatccagacccaaggcactttcagcgtccagttccgcggcaagatgtgcagtgttgactacgcggatttgctgcagactttccaggttttcatattggatgagctgacagcccgcgttttttcgcagatccaggtgaagccttttggcaccctggttcccatt

SEQ ID NO: 510329 - DNA, 174 bp, Homo sapiens
tgttagcggcgcctttttttggtagagatagtgtgcactgtgttgctcaatgttggtctcaaactcctgggctcaagcaatcttcctgcctcagcctctcaaagtgctgggattacaagagtgagccaccgcctgcagcctcagagtctgattttctttctttctttttttttt

SEQ ID NO: 510330 - DNA, 1878 bp, Homo sapiens
  misc_feature (883)..(883): n is a, c, g, or t
tataacattattagtataaaatggggaaataggtagaagttagcggtggaaagggcgaatgcaggtggtggggaggaaagtgggggtgggtttgggtagtgttctccaacacgtggtctattttcattttccacgtgtgtgagaataagtggggacagatcagtggtgacatgtggagggtggaagatcagacattacggcggtgtcaggtatagacaagttagacagggttcacagagagagggtctgccagtggcgtggccctatcgaagtggcgcgggcgcattgaagtgacaggtctctcatgtgggttctcttgcggtgcaaactctttctctccgccaaatcaaagtggggcgcccccatctgtgtgggcccaacacacagccgcggtgtcacaaggaggcggggacgcagggccgctctcctcaaagagggacagcaaagagagagaggcgtggcgcagtgcggcactctcaccagaggcgtgtgtcttcacagccccccaggtgtgtcacagccccctgcagcgtcatcccagagcggcgtggcgcacaccaacaacaccagccatcagactagaggaggcgaccccccgcgggggccgccgcccgtgcagagcacgtctcaccacacagacgaagtcgggagacgtctcccacgccgtccaggcgaaacaagtagaccgcgcggccaccacgcccccccgcactcctccgacggcgcctactacaccactccactccaccaccacacgacggctcatcccaccaatacctctcaacgagcgccacacagtgcgcgcctccacccactcacgcctcccacagagcgcgcgtgctccttgaccccagccgcgggacccaccgacacacacactcgncgctgcctaacacctatactacgtactgcaccaccaacccctcaacagtcggtcgtcaggcagccgactcacaccacttgccccgacacagccacagaaagcttactactgtgagcccccaacacaccagacacactacatcctagccggcgccgcgctcaccacacctcatcacgggcagcacagtcagcagccggcttactctcacacttcacgtcacccccccaatcgccctccccaacactcggtcgcgcacccccgcgccacctaacatagaaacacggagccacacaacacaccaccctgcggccacgccaacccaaaacgtgccccggcgccacgcacaacagcggcccctccacaccgagcacaacccacgccatggacgcagggccaacacacacccacactagggcgagagacgcaccaaacgcaagcaccacgagagcaacacaacactggccgagagccgccaccagcagcccacgcgaggcgcaacacacagcgagacgcgacatccaaacacgagcgcccacccccagtggccccccgagacaaagctcgatcctcacacgcagagacacgggatctgtcaccccactacgtgaggagcacctaccccccacccacccagtgagcaccaccgccaacctcaacaccggtagcacacacaaggcgggcggcgcgcacaacgactcactcgatagagaagcgtacacagcgacggaggtgaacagacgccagcccgcacttactagctgcgacgacagtaagacacacacgagaccacgacagacaacaacatgagagcaaagcagcaccctccacagcccagcgccaagcaccacgtccgccaaccccgacggctcacgcccgtccacacgaagcaactacccactcgcctacgcagcgatcaggcgcccaccgcacgcgcactgtcacgcgcgtccacgccacggcgctcacctaccgactgccacaacaaggggccccac

SEQ ID NO: 510331 - DNA, 387 bp, Homo sapiens
aatgattcgccaagggacacttctgttcctcaattttatgctccaaggtgaatgtttcttggtaataactcattctttaagccattgcacaacagttctgtcatattttctccattcattccaccaaagcctttaaatttctccaaattgcaacacatgagttttctcatattttccaaatgtgatattgtgacctatagcagccctttcagagctttagaaccaagtctctgggaagaatagttgctctctgaagcccttcttgaagattggccatttggtttgtcctctaaaatgttctcggaaaggtaggtggaggaaaaggagctccacgtgtatagcgcgtaggggaaaaggccgctctcgggcgccacagccacagctgcg

SEQ ID NO: 510332 - DNA, 662 bp, Homo sapiens
cagagcaacagcgggctatggcgccccggcgcttgcaccaaacatcaccatgggtgtcgtctgcaagcttcctcgtgctgagcagagcagttctccccatcagcgcttccagagaacccagcggccctgggtggtggtgctgatggcggtgctgctgctcctggccttgcttgaccgcaagcctcatcctttaccggaggctgccagaagcaatcgaggcgcggggcttttgagggtgccccgtaaagcggcaggaagtttccagccccaacgaggccactgagaagaacatcctggtgtcagaccatggcacactgattgagcagcaagaatagagcccaggcgcgtgggcaagtggccatggcgggaaaggaagcttgggaagcttgggggcccttggggtcagtctggcccccaaccaagtgtgctgtccagttggcctatgggaggggtgccttggggagtccgctgttgggagccggaagctggggcaggagccttgggtggtgtgggggttgcaacctttcccactagggtctgggtgtggagacccagtttgagttgcagcgttggtgtgtcccctttttctggggggggcctgaggtctggtccacctggttccttgttgcccccacgagggaacccagaggtcggttggcagc

SEQ ID NO: 510333 - DNA, 121 bp, Homo sapiens
attgtgtgatgcaacgatggaagatgtgaatgactggctgactgacctgtgagtactgtgtacgtgactcggtcattaaaacactgccctcttgtctgtgtgctagcagttcctcatcctt

SEQ ID NO: 510334 - DNA, 560 bp, Homo sapiens
ggtgtctagaggtctggatgaggagtcactcaggagtggggaacagagagagcagaggatagagttttctgcccatcccaaacagaagtggagagggttggtttgctgccctctccctactggccattcactgagtcttctcagcagacatttcaaattattaataaatgggccactccctcttcttcaaggagcatccgtgatgctcagtgttcaaaaccacaggcacttagtgatcagctccctaaaaccatgcctaagtacaggcggattagctatcttccaacaatgctgaccaccagacaattactgcatttttccagaagcccactataggctttgtagtgctttcggcccagttctgggctcagcctcaaagtgcaccgactagttgcttgcctatacctggcacctcattaagatgctgggcagcagtataacaggaggaagagatccctctcctttgggcagattattatgtgctcagttctctctccctggtaaccctttctctgcagatagatagacactggcattatccctttaggaagagggggggg

SEQ ID NO: 510335 - DNA, 1410 bp, Homo sapiens
atctgtggggcgccttttttgtgctatacctgcttctcttgtgtctccctatttgggggccctttggggggttctcccccgccttattaataggggggccccatgccgcctgtttgtatatctggcgcgtccccgtttttttccatcttgccttggtggcgccacccacagggtggtgccccacattggacggcgggtctcttgcgccccccggggtgctcctccccccgcctcccgaccttttcgtgggcagagcccacatgggggggtctcacactgtgcaagccctttgtcccccgagattgtgcccctaggtgccgctgatcttagagtttgggatcccaacccccccctttggtttatcccgggaaagccccgggaagagggttgatattcccgccctagctcccccgtggtgtcagctgttggggcccacagaggcccccccttgggcccctcccgccccctgggggaatttctggaggtgtaccagaatatggttgggtttgattgggtagaatagccccctgcacacctttagtttttggtgcacacacggttggaaaggccccccacaagagggcccccctgtggggcccccccccaaacacctgaagagtgttgtggcattttggggcatggcgtttctcccccgttgaccccctctaacgtttttgccgtttctcgcgcccaccgtcaaagcgccatggtttgccccccccctcctgtcacagagatgggggccacccccagtgtacacacaagggaggcgtctacaccccactgcgccccgcgtttctcacatactcccgcctttccgtggcgttctccttcccctggcgccccccccccacaggtttctctgggtgtcccccacggtgtgttcccccctctgggttgcacccacagactagacgctttctggagccacgcttgtgtggttgtgttttttttgggtgtccaagggtgtcccactcttcttttgagacactccgcgttcacttgtgctcgcctgggctaacccggcgcgcccacaatgttcactcctccacttgcctccccgtgttctggcccccgcgttccccttcccccccgatatattctcttttggggaaagaaggggtcttgggcctggccgcgcctgggtgaccccagcttacccccgcttccccgcggaagattggggccctgccccttggatagctgccagcccgagtgagccccgggggcccgaatcgacccttaaagaggttttagagggccccctctcccccctcgtttcttttgggggaggggttagaccctcgaaattgtccccccccggggctccctctctggtttcctatttcccgattaccttgtaattaaaacaaatatcccttttttggtaaaaaaaaagaaaaaataaac

SEQ ID NO: 510336 - DNA, 726 bp, Homo sapiens
ggttcagagcagcagaagccggcgtcgtcggatgctgtgttgcccgccaccatgagctatcacaggcttggtccaggtatctgagaaccactttgcagtcgacgaggtactcggtataccagacgctcaggccacgcatgtgattatggatatggaacttggaactctggttgacaaatagaggctacgaggggctatggctatggctatggctatggccaggatagcaccagcaaatatgggtatgggtatggccagttcacactcttgcggaaatgcctagacatctgactacaagaatgcaagacacatagtgcctcgggtagcgccgtgccgattaccgttttatccagaaattaaccagcgcttagatatggtgccgcatttggagacagagcatgatgcacaaggaggcgtgtacggctcaggtggcagaagaggtatgactgcttatgagtacctaggactcgagggccgtgctgagtgagcgcgagctgtaccggtcaggctatgactaccatgcgagcttgaggcctgaagatggaaatgcgcctatgagggacaatacgatgaactaccgggagcagttctcgcaatgcgtggtagacaggagcagccttcggtcccaggggacagggcatgggcccgggatgcccggagcggccggcacaaggcctcaggctatgggcgcaatgtgggaagaccccatgggggcccggggcccga

SEQ ID NO: 510337 - DNA, 165 bp, Homo sapiens
tcgcgcacacgtctcgcgcacacatcctatgtaaacgtatgtatgtgaatctctgttgtgagagcctataaatgtcaaaaggttggtatccaggtttatatgcgatgatccaggtgcacgtgtgtgtgtgtgtgtgtgtgtgtgtgtgtatgtaaaggatgtgtg

SEQ ID NO: 510338 - DNA, 515 bp, Homo sapiens
  misc_feature (60)..(60): n is a, c, g, or t
  misc_feature (83)..(83): n is a, c, g, or t
  misc_feature (352)..(352): n is a, c, g, or t
  misc_feature (377)..(377): n is a, c, g, or t
gggtacaatatatattaaataagcacacatacaacaaaagtaggtgttggaagcttacanaaatgtgaccagtagcttgctgnaacctaactttttatttgttcatggaactttctagaccgtaactacactgaataatgagaatctgctgtaatctttttaggtgctgtagatgagccattggattaaattattacagtatgtttcagactgctctatgttgaaccctagtgaaatgcctctcaaaccctcctaaggatcacaatctcatgtccttttttttgttattaaatgcccagtatgtgttagtgatttaaacaaaattcaaattttttttttttttttttttttnggagacagggcgagatcctttctcnaaaaaaaaaaaaaaaaggcacaaggagccaaatggaggccctgggaaggtgccatagggggggacacccgtgtgtgtgtgacccccaagttagttgtcccccccaaaacccgtggttccttgtgccccaggaggggcg

SEQ ID NO: 510339 - DNA, 1089 bp, Homo sapiens
cactcttagaagtttccgaaacactttgatgggtggccaaaagatttttttaaaatttgcaacgcagaatctctaaacatgaagcggtccacattggtaagtattggtctaataatttcacaatcaaggtttttatgacctgatttcctatatccctgaattccaattcgaatccttggaatgcaaacttcgaggcctccataaaaagtgatggaataaggccaatagaggtcagaaagatgtgggctgatgaaaattaagaagttcggaagcattaaatatctcaaaggattctccaagcaataagaaagagcatccaaagacttctttagagtacagcaggccagactatccatcgatttggtaaatacttactcagatgatgagtacaattggcataatccagaagcgccttgaagaagatgtcttttgcacgagagcaaaagggagaaaagtcgccggaaaattgttaatggtaccagttaatgagcccacgtaagcacaagtaggaggcttcatcgggaggaacagctgattaaccggctgatgcggcagtcccagcaggagcgctaggattgccgtgcagctcatgcatgttcggcatgaaaaggaagtttgtatggcataaacagaattcttcagagaccaaacaacatgaggaaagacgacttacaagatttccaggatgctcttgatcgagaagcggctttggcaaaacaagccaagattgactcttgaagaacaattccttaaagaaaagagatttcatgatcagattgctgtggaaagagctcaagctcgttatgaaaagcatgattcagtatcgtgcagacaatctttggtatcacaatagttgactttgtccactaaagtggctagactatcgaatgttgacaaataatctgagttccgtactagagcttgatgacatgactgggtaaggtaactacttttttaatgctaaaagcccatatatgaacaagccctatgttaagacatctacctgcttacccctcaagagacaacttacagaaactggagaaaagggacttgctaaataccaatgattatacgtcataggggtaccta

SEQ ID NO: 510340 - DNA, 1457 bp, Homo sapiens
agcggctgcatctcaggctgaccacagggcaggtgccaagttacgtgttctcatgcactccctctctcaccacctgaggaggcaggtatgattaaccaccctagcagcaaaaactacacagctgggcgacagcggctgccaggacacaccaaagtccacggctaccaactaccctcggacggtgaccatagctcagcacagacccgagaggtacacgcactgacacaatagctaggccacgcaatacttcacttatgcatagccctacccaacacactacaaccgaaccttggaagacgactagcatacccacatgcagacaacacataaactacgagcctcacacagcccactcactgccctggatcggatatggcccaaaagcgctatccccggaaacggacataggacagacacagaccatgcacctgtcgcaacacagttggcaacacacgcaactcggcacagactacccaagcaatcttcacgtcaacaaataatgggctaacgtaggtacgacgccaccacactcggagccaccacacactaggccgcgttattacccccctaagagtgcaatcgcacgcgcttccgcaggcgaccaccgcgcaccccaaccgcgactggcagacgaagaacaagcaaataagcacgcgacgcacacgccacaacactggcccgcttcgggtctaacaaccacagagcgcagataccaaacaccgacaacaaacccgagaaaactcgaacatgtgcaacagccacacacagagaccagaacgaaacaacgagaggcacaaacaccggcagaacaacagacaaccacacaacgaatcaccgcaccaatatacagcacacacacaccaacacagatatcaccgaaccaaccaaccatgtgcaccgacataaaaagccaagagaactacacggatccgcaacaaaaagaagcaacaacatacacaccgcacgagagcacaagacacgaaatcagtcacagcaacccaaagcaaataatagcgaaacacccacaccgacagggaggactcaccggaaagaccaaacaaacacaccacgaccgacacgaccaccagccacgaaagcagaacgaagcgagacaccaaaacacaacgcgcgaaaacacaagaactattacagaccaagacacaagtcaaatcacacaaacaaactcacaaacaaatcaatatctaacaccacacgaaataaagtaacccaactaaatacacccatcgaaaacaaacactaaaagacatcactacaactacacaatcgacactagaatcaaacactactacaaacacacaataagcaactattacaactatatagtaccacaacggaacacaactatcatataagacaaacaacacttagacacgacaaaaactaacacaatcaacataaccataaacaacattacagaacgataaaaatctaaaaca

SEQ ID NO: 510341 - DNA, 374 bp, Homo sapiens
aggattcataaccagtctcgtcagatctcgtaaatcaggtgtctcatgaccattgtacatgaagctagattgaaaacatgcttagaataatgcgcacagaacttatcttagtgtcgagttgcaaaagcctcctacacaagttaacctctagcttcagaagtgaactgtacatcactgtgcgtcaatcaagatgaaaaattcattcaagtaaagttgacaccactcagaagcattttcaagtatggctatatagtcaacctgatattcctatattagcaaattgtagatctgctttccattcattctaactgaggcaggttttatatttacaattatagatctgatatttacaatatgccactcaatttcttctc

SEQ ID NO: 510342 - DNA, 719 bp, Homo sapiens
tgtcggtccgcagttatggatttgtgaccagcgtcggtgtagctctggcgtttctagttctttaatcgtgatgttagggtgtcaaacatagatctttcctgcttgctcttgtgggcatgtagtgctataaaatttccctctacacactgctttgaatgcatcccagagattctggtatgttgtgtcttgttcttatcggtttcaaagaacatctttatttctgccttcatttcgtatgtacccagtagtcattcaggagcaggttgttcagtttccatgtagttgagcggtttgagtgagtttcttaatcctgagttctagtttgattgcactgtggtctgagagacagttctgttcttttacatttgctgtggagtggtttacttccaactatgtggtcaatttgggataggtgtggtgtggtgctgaaaaagctgtatattctgttgatttggggtggagagttctgtagatgtctattaggtccgcttgatgccgagctgagttcaatttctgggtatccttgttaactttctgtctcgttgatcctgtctaatgttgacagtggggtgtcaaagtctcccattatattgtgtggggagtctaagtctctttcaaggtcactgaggacttgcttttatgaatctgggtgctcctgtattggatgcatattatatctaggaacgaaggtctctctttgttagcattgatcccttaac

SEQ ID NO: 510343 - DNA, 104 bp, Homo sapiens
ctcaggattctgcgaaccttaggacagtcatgctggctcctttgcacaatgggccagctgacttgtgattgagtaggtgcttaaggtgtcgcaaaactaccttg

SEQ ID NO: 510344 - DNA, 120 bp, Homo sapiens
gtcgactcgcgcacaaatgcactgaactagaagaacacccgctaaacccacaaactaagccaataaacgaactaaacagacccgtacgaagcaaacagggacaagttatcccactcagaa

SEQ ID NO: 510345 - DNA, 183 bp, Homo sapiens
acacacgtcgagtactctcatatctgcgcttccacgtgtgcgtcattcacacttatagctatctgcttgaccgatctctgatagtgctgagcactgctgcgtacacgtacgcacattatgcgatgagttcatgacggacgtcaacgtgcggcgagtccgatttgcggaccgtttgggctttag

SEQ ID NO: 510346 - DNA, 195 bp, Homo sapiens
cacaggatattgagctgaagctgggcaccaaagggaatcagctagatcgccctctgctgcaagcatgagatacgctgcataggctgaatcgaagaagggaaagataccagaaacaaagagacagaaggatgaaaatgaagaagagggaggtggggttgacggcgtcatcccgctggaggatctcagctctgggat

SEQ ID NO: 510347 - DNA, 323 bp, Homo sapiens
atcccccgcacgacacatactcgaagatactgagtaaaagatatacctaccatcttaccaggcaatgtgctcttggaggaaagtcattattcatacccagccaaatctagcatcagattgtggaaccaacatctcacaaaacaccatatgcatcaatgcacaaagttcagatcatgttccatgatcaggcagagttacataacatgcttcgaggaacacaccatgtctgctagatcatgccagttctgctattgcttcaagctccatctctcacagcatcagctcttgacgtcacaggggagaggggcattactcctcctcat

SEQ ID NO: 510348 - DNA, 919 bp, Homo sapiens
  misc_feature (1)..(1): n is a, c, g, or t
  misc_feature (3)..(3): n is a, c, g, or t
  misc_feature (8)..(8): n is a, c, g, or t
ntnctccncccagaagaaatacagagcttgaagcaggaggcgacaaggagaaggtcagtagtcacttgtgacgagcgcccgctagggagggtaaacacctgtggagggtcgggtagacaccgccggggccggccgccccaagggggttacctgtccgggaagaaaatgttggtgccggaaacaaggttgcgggccgaccgggggggggcacagcacccagcacaaaccggggcgcacgtgggacccccccaagccgggtcgattcgggacgcccgccaggtggtgagtgccgccgcgcgcgcgagggggccgctttgtcccggcccacaaaaaggacgtcccgaagagagcagccccggggtggggaaaaaaagctggttcaagcagggggggtgcacacgcgccgccgcgcaggcatgtgcccggccgaaaaaaaagcactggccgaagatatttcccaacagggacacaaaaaaggagtcttgtcagcgcacctctgaggggacaacacttgtgggggagaaagcaactaattcctgggggaaccgcaggaggatacgacaactcaattagagcggtttgtttttattgaccgcccccgcgtttccccagtggggttcgatgaccaagacacaatgctctttgtgggtctttatagtacgaggcgaatgaacgcccacgacacatccgtgagtgagcgatcttatggtgctgaccaataagcacccgctttgtagacacaagaaagaaacaagagaggacgaaaaatatacctggtggggatagaattgattcccgattgaccacccaggtcaatactattttactgcagtgccgggtgcccctgactcctagtgttttggaaacgaacccacttgatgaacttaaaaaatcaaaaaaaaaaccgcccacaaaaaca

SEQ ID NO: 510349 - DNA, 486 bp, Homo sapiens
tctcccctccccccctttcaccatttcccctcggaggcgcttccccgggcaggggcaagagccgggtctcacccccggtccatctcccaggagaccccaggaaggacactataggcgaaagggacgccgcctacccaaacaggggctcagagtcaggtgagaggccatccaggcacaggggggatcatacacggagaaacaaaaagaatcggcatagactcggtaccccaagtgaggacaaggaaaagcacggtatgagtgttcaccacggctctcagaaagcaggctaagagaacacgggaggcacaaacgagcgtacacacacaacgaaggaaacacagacaggcgccgcgaaaaaagagcgcgacacaaaaaagaggaggaaccagatgctcagaccaccgtggagaatgagagacagaaacaccacgagagtccgccaaaaatacagaaaactgaaaagaaaggaaaaccggggaaacccat

SEQ ID NO: 510350 - DNA, 542 bp, Homo sapiens
aaaagggaaggaaaaaaaaagaaaaaaatcagagacctgtaaacatttaagagtgaattggacatccccacaggctaaacctagagttgtcagctttcattccattctgctgtgatagagtgttctgcccagtatgtatccacatggagcctggaaagtaacaagtctggtcatgtgacaactggctttggtgctttgctttcagcccctcagaattagttcctaatggctcacatagctccctgccagcatcccgtcactggcacgttaaaccttttcaaataattcctcagaatagagattcttaggagagcactaaatttctccattctttgtgtttaattaaactgttcttgcattttaatatttgccagataagcgcttaagacattacgatacaggttgagtatccttaatctgaaaatctgaaatccgaaactttttgagccctgacatgacgctcaaaggaaatgctcattttcgattttggattttcagatttgggatgctcaaccagtaagtataatgcaaacttagtccaa

SEQ ID NO: 510351 - DNA, 944 bp, Homo sapiens
  misc_feature (130)..(130): n is a, c, g, or t
  misc_feature (161)..(161): n is a, c, g, or t
  misc_feature (186)..(186): n is a, c, g, or t
gtccatataaaccataattgtgatttaccttaagtaggtataactcttatgggatatacagtatagtttttgtgaatctttacatgatagcattatctttttataattttttttcctaagataaacaaangcatagttttcttctatgggtgatagaaacngctttttgaagtaatgaaaacctcnaaagatcatgttgattcttaatttttgccttttgcataagcctctttataacatgtatctttaaaacaattaagtctttaggaatgtgtaaccagaactatgttagtattgcttataaaactttagttaggttcaatatatacatatatacatctctatataggtatatagatttgcattttgtcttgtaaaattttatttgaataaattcttcctgtaggtaatgggaaacaaaattaatagttcatatgtcactcatagcatttctatatttgaaagtagcccaatataaaacttttgattctaaaattaaaccagcagcctattacaagcacattctttgattgagtcattggttataaacttactaaatgcagagaaagcagccaatttaggaaactctgagttggtgggacactgttgattaataatgtactgtatgaattaagtgatgctttaatttgactttaccattttacacgtctacacatgtgggcattatgtcagcaaactttaaggcatatgtcaggcagctaacacattttttcctgtgctttaatgtatttctttacatgatcgagaagatccgttgctagaaatagcgcgggcaccggggacccctggaggagtggcccatgggatggaatagcttaaactaaggatccggtaatgtagcttaattaattagaaccgtctgtcacgaatatttttacattgacaggtgactcatatgggaagaacatcatctttcaaaggaa

SEQ ID NO: 510352 - DNA, 699 bp, Homo sapiens
tctcaatgacaaatgtctttttaatgaatctatttatcttgtgttatttctgtctattaaccaaacttgatgtatgtctctttctaaaggggtcagaacactgtcacccccagatttatgtgttcttgcgtattgattattttgagctggtagacacttgagaatcacggtcagatacagaaatatacgctttgaacaccttttatctaaaagcagggcataaacatttccagtgaaaaagatgcccttcttgtaccaggactgagaagagcatctttatcactggagacttggacgttgacacgcaagaatcaatgcggtacaaacaaatcgattataatagtccttgatcttccagtgagtctctcccatatatttcgctagtcactgtcccagatttactggcctttggcccaaggcctctttgttgtcacatcctcacaatgtatggtggttgtttaacccagactatactagactattgaggcctaattaacttcttcagggtcttaaatttgccttcatgaagacgtcccgtgtcacattattgtaaacaaacgcttaacactttgtatgtctttctcttgacaactgaaacacgggcagatcatgtactattatgtttctgggggcgagttcgggcccaaaaatggactgatgccactttttttgggcaggggccccaattttggcaacgtg

SEQ ID NO: 510353 - DNA, 108 bp, Homo sapiens
gatgatggaattggacgactatagaaaacaaacatcaaaacaagtgtagaatgtgagtatttttagtttaataatgtgtattttataaactatttattttgtatttga

SEQ ID NO: 510354 - DNA, 785 bp, Homo sapiens
agcggggtagagaactgctccggcaggggcacgggctccgtatgcaccatctgctaggacccctccccctgcgggcgctcccgatggcacagtacgtgatcgagagtgacctgcactcgctagttcagctggtattgcaccctatcccctagagtgcgtcctccgcctgctgctgctgggcatggtctcatagctttgagtgaagccgcgaggctcgggccccttcatctgtgcgggccgcgccgactcgatcgctctgcgccgggaacggcactcctgtggcctgaagtcttgtgctgatcctgttcccatgttttcatgaccacgtaccttacgcaacacgcgtggtcggtgacccgctatatcccgaccatcgcagtgctgcccatatgtaaggtgggcagcgttccttcctgatgcaatggaggaaccgagcctgaagacgagccaggacggctcactcaggaaggaactatcataccaggcttgtggggctttttgaaaccccgttgaagctcagagttctcgagtgtcagcaagggacaatgccgaccagaatcccttgccggccttccacgtggggagaaaaagcaagctaacataggtgcgccaggaagggggttaacgcaagaacccaggtagcttgcatacacggtaaacgtccttaagtcaagggcccaaaaaacaaagggggcccaaaatttctccaccttttgggcaccttctcccaggagcccccgttcaaaaaggaaacccttggcccgaggctcaaacaattttcccat

SEQ ID NO: 510355 - DNA, 128 bp, Homo sapiens
agagggggtggccgccggccccccgtttcccaagaaggggggcggttttttttttagggggggggggcggttttttaaccccccccccccccccttttaaaacccaaaaaaattttttttccccccca

SEQ ID NO: 510356 - DNA, 140 bp, Homo sapiens
tgtataggaagatgacgaaaaagagtcatgagatccatgctatatcccgagcatctacgtcactgagataagaaagggcagccgccatatcttccctcccacccctcatagtgtctcttgcccatcttgcatttatagag

SEQ ID NO: 510357 - DNA, 339 bp, Homo sapiens
  misc_feature (52)..(52): n is a, c, g, or t
  misc_feature (76)..(76): n is a, c, g, or t
  misc_feature (152)..(152): n is a, c, g, or t
  misc_feature (163)..(163): n is a, c, g, or t
caagcagttatacagactcaccttaattttacagtccatggacaagacagcnataaatggccagagagaggaaacnatctgactgcactgacgccctataaaaaggtattacagttatcaaccagaagcattcaaaagatcagctcaaatgnagcatcaaganaagacagttattaagcagctattgctatttttcttcattcccaaaatctcaccccagataactttcattagcattccaagagcaggccttattgacactaagcttttgaagattttttttttaacctttaatattgagttcctcacccaatgggatcctgagtctgataactgctt

SEQ ID NO: 510358 - DNA, 499 bp, Homo sapiens
agcgggaacaatcacttataataaactttaatttttttttttccctcggaacaggggtctgggcctggcagggactccaaatcccataatccttccagtggtcccctccactaagtaaatttcaaaaaaaaaaggacagtttaataataaggtgatggacggaatccagacaaatatggcagcggagtaaagacttcatctaagtagggacacactggggtcggacaaagaggagtccggggggtggcggtaggggaggtagtagacctcttaggaggttctccctttagggtagtcccagcaatagaggagggggggacataaactctcatgggggtggtcttttaaggtctaaagtggtccatttcatctaaggacctcagggggccaagcgtctcagcccaggcccaacttttttcattttcctttttcctttttttggagatggacttcactcttttcggcccgggtggaggtccaagggccagggtctcagctc

SEQ ID NO: 510359 - DNA, 594 bp, Homo sapiens
aaacctgttgctgctgcttgctcaggtggcctgcttttattcccttatctggccccacccacatcctactgattggtccattttgacagggtgctgattggtgcatttatgaaccttgagctagatacaaaagttctccaagtccctactagattacctagacacagagcactgattggtgcatttacaaaccttgagctagacacagagtgctgattggtgcatttacaaacttcgagctagacacacagtgctgattggtgtatttacaaacctttagctagacagagagtgctgtttggtgcctttacaatccttcagcttacaatccttcagctagacacaaaagttctccaagtccccaccggattagctagacacagagcactgattggtgcatttacaaacctttagttagacacagagtgctgattggcacgtttacaaacctctagctagacacaaaagtgctgattggtgcggttacaatcctttagctagacacaaaagttttcaagtccccaccccacccaaaagcagctcttaatggcacttggcttgccggactttggtcactaacccgggccttggcag

SEQ ID NO: 510360 - DNA, 230 bp, Homo sapiens
tgaaagctggtcatacactacatttgtgtcatctgtgtgggtgatgctgttgggggcagtgccctcctaattggggtggtaggggctaggctggagtggtccaaggctcagcaggaatcctgcgaagaacaaaaacttctgcaggtaatcaactaggattatccctgtatcgacaggccgttttttggacagtgtggggtgatccatctagcatgtcgaccgtgtcaggc

SEQ ID NO: 510361 - DNA, 384 bp, Homo sapiens
  misc_feature (169)..(169): n is a, c, g, or t
  misc_feature (228)..(228): n is a, c, g, or t
  misc_feature (239)..(239): n is a, c, g, or t
  misc_feature (287)..(287): n is a, c, g, or t
  misc_feature (306)..(306): n is a, c, g, or t
  misc_feature (335)..(335): n is a, c, g, or t
  misc_feature (357)..(357): n is a, c, g, or t
  misc_feature (363)..(363): n is a, c, g, or t
catgctttcaaaagattgaattggagtagtcgccctcctcctctctacgtggtgaatttttattggtttttcaagacccacttcattgatcccattcttaacttcccggagcttccagttcatgagtctactatagcacttgttgcactgaactgcattctaaagctgnactatccaatatgatagccactggccacctgcgactatttgaacacttaaaatggtggncagtgcagctnaaggacagaaattttcttcattattggcattacttacattttaagtgntactcagtatcaggaaccntttcaggatatttggagaacttggtatgngaatttactttttcaacccagnattttnttaaagctaacccggggacga

SEQ ID NO: 510362 - DNA, 296 bp, Homo sapiens
acaccagctatgcccccgtgggcaccgcctccagcttgccaccaaagacctgtgactttgttcaggactcctcctattttgaggacttttccaacatatccatattttcctcttccgcggactccctgtgggacatatgggacacacccgactttttgccgggtgacagcctcaaccaggggtgcaccatctgggacaataaccctgccccctccacccacaataagctgttccagctcaacaggccgtttgcaggctcttaggactttctgtcctcccggcactgttggactttg

SEQ ID NO: 510363 - DNA, 274 bp, Homo sapiens
atatatagtttgtcccgattagctttcctttggggaatgaagttttgaaatatttaaacccgtttcctcctccattgaaaagtcccccaaaaaaagaactattgggaaaccctggtgtggtggtggaaaaaaaaagccccccccgttttttggagggaataacttaaaaaaatacttaaatggctaagttttcttggggcagttaaaaattaaccttgtccattttacccttgctgttccctctgaaataaacttatgtgatgttttggtagta

SEQ ID NO: 510364 - DNA, 304 bp, Homo sapiens
acggggtggcagggaattttgtatgatagcatttgaattaagttttctttcctcaaaattccgtctttattctgatgtttaatacaatttaaaatgtaatgttcaagagcccctgtcattcctgtaaacatttttattaatatagaatgtttaaagatcttgtgttctaagtccattatactttaatctttttaaagcattttaattcattgttctttgtgtcatttatagggaatcacagggcctcagattcgccctggtatgaccgtgattagaacaccactcccgtaccagtagtaccgag

SEQ ID NO: 510365 - DNA, 327 bp, Homo sapiens
  misc_feature (14)..(14): n is a, c, g, or t
taaatttgcaagtnctatataaaagtaaatcttttttggaagaaacaacattttcaagttactatttttgttgtttagaagacttgaattggcaagaattcatttttttaaaaaaaatattatgagtacatagtaggtattaatggggtagatgagatattttgatacaggcatacagtgtgtaataatcacatcgtggtaaatgcagcatccaccacaagcttttatcatttctttgtgttacaaacattctatttttagctatttttaaatgtacagtaaatttttgttcactctagtcactgtgttatgctatcaaatactagg

SEQ ID NO: 510366 - DNA, 313 bp, Homo sapiens
  misc_feature (25)..(25): n is a, c, g, or t
cacaataaggaagggtccccagggntggggagagccccaagttgagaacaataatgaacaattatagtatgaacaattgttagagacagctaatcacaaacaacctgcgggcacaatgacctcattccacacgtagcacccttcagcaggaccctataaaactttcctccagcccttgcctctttgcaggtagccccttctctgctgagctgcccactgcaacatattttcacaatttctctaataaatctgtccttctttacctacaactatcttggtaaatggcgttaccacctgcaaaactgaccctagg

SEQ ID NO: 510367 - DNA, 241 bp, Homo sapiens
aatgaattctagcgacactatgtactgaggcggtgcggaacgtctgcacgggaaccagcgcaagcccccggggttcctggagacggtgagagtagcagatcagcttgaagaactatgatccccagaatgacaagcgcttctcgggcaccgtcaggataaagtaccactccgcgcccataaagttctctgtgtgtgtacctggggcaccacaacagcactgtgacgagactacagggcgtga

SEQ ID NO: 510368 - DNA, 695 bp, Homo sapiens
ggcacatcctgcaactataccaaaaaatagaggaggagggcaatacttctaacatacattatatgaatgtattaccctgagtactcaaagcagacaaagacacgttccaaaaagaaaactacaggccaatatctctgatgactgttgaaacaaaaaccctcaacaaaatacaagcaaacaaaattcaagaatacattaaaaaaaaaaattcatcatggccaattaggacttatccctgggatgaaaggctggttcaacatatgcaaatcaatgcgatacatcatatcaacagaatgaaggcacaaaaactatgatcatttcaattggggcagaaaaagccctggcaaagttggacatcccttcatgattaaaaaaaaaaattcttaactaattaaatacggaaggcatgtacctcaacaccctcaaaagaataaagcgcatatacaacaagcccacagttgacatcatactcgagggtgaaaagttgaatgtttttcccctaagatcggaaaaaagagaaggatccccaaatcaattccattcaacccagtaatagaagtcctagacacagcagatagtccagagacagaattatatagctctcaattggcgaggaacatttaatcctcgcattggggatgactgtctataatagaaacttagatctccaaaatttgataacattgttagtaatg

SEQ ID NO: 510369 - DNA, 110 bp, Homo sapiens
aggattcgtgccgaaccacactcaaacgcttaagtatgcatataaatatgtcatatggaaggtaaactgttattctactttattgaatctagctaaactaaacaattcca

SEQ ID NO: 510370 - DNA, 848 bp, Homo sapiens
gtgagtgtctcctccagtacagcaacggccagagctgacctgccagctccgggcgtggggtgaaatctcttgattcctaatctctcgatatggcacctcgcggtacagctctttgccgaggttccgcaggcccagcctgtcctggtcttcaagctcacatgccgacttcagggaggatccggacccccgcaaggtcaacctgggagtgggagcatatcgcacggatgactgccatcccttgggtttagccagctagtgaagaaagtggagcagaagattgctaatgacaatagacctaaagtcacgagtatctgaccaatcctgggccctggctagagtggcctggatgctgatgcttctcgtcttgcccttgggagatgactagcgccagcactcacggagaagcgggtaggaggtgtgcaaacttaggggggaacaggtgcacttcgaataggagctgatttcttagcgcgttggtacactggaacaagacgatcaagaacgcacctgtctatgtgtcctcagccaagctgggacaatcacaaggctgtgtttaccggctgggtcggtttgaagacagttcggtcctattcgcttactgggaatgcaccaggaagcagaacgaatgtgcgacctcccagggggctttcctagaaattgagtcttggacgaacatggtcccttgaagttcctaccagttgttcgttcctcccaagcgctggtgctacgacaacctcaaaattggggaatttgaccgcaacatccgggagccacgggcaatgccccattggcttcctggcccttgaaagcccccggttattgatccccttctttgacttaggcatata

SEQ ID NO: 510371 - DNA, 167 bp, Homo sapiens
gttgcccgtaggaatgatgtagtggtgagggtgtcagcagcgtggctacgctggctcccacttagtctccagtcttgatcagcttcaggccgtttgtcacatagcattaacacatattagaaaacttgtgtacgtgtcaacagggataggtaaccaccacgcattca

SEQ ID NO: 510372 - DNA, 339 bp, Homo sapiens
gtcgacatggcatggaaaatcaggatttgttgcagtaggctttgcagtgggcaggccagggtgctgcttacagcccatctgtgcacttgctgggttcccagggcccagctccactcactggtccagggtacccagcatttctcatgctacacatttttttttaaacaatttgtttgtgtgaatgttttctgcatggatacatgtttgcctctagaagtgagaagaggatgttggatgccgtaaactgaagttagggatgattcctctgcaagagcagcaagtgttcgaaccctgaagtgtctccccggcctcaccttacttttcagacagagtcgacgc

SEQ ID NO: 510373 - DNA, 231 bp, Homo sapiens
cccgatagcccgacaggcggggtgagggtcacagtgaagggccaggcggggtgagggtcagaggaagggacaggcggggtgagggtcagaggaagggccagtacgggctgagtggtcagagaaaagggacaggcggggtgagtggtcagaggcagggtcatgcggggtgataggacacatcgaagtgcactaggtcggtggtcagtgtctgtgtcgtggcgtagatcgggg

SEQ ID NO: 510374 - DNA, 406 bp, Homo sapiens
cactctgccccaggagtattcctagactccattctctccaaacctgagtatagtgcacacatctatgactcctaaggtaccctatgccagctctaccatatcaatataccactgtgctgtcatctattaactcactgtcatcaccaccaaaccattgtctcttatttccacagcaaaagtccaaggcagtttccaccacgtagtacatacttaaaaatagagttgctggattgtggagggcaggtcagggtctctggaggtggtcattgcagctgtggatcctgttcagtactgtagattggcttctgccctggacccggtcaggctgaaggaggcctatctctggctgtgcttctccctgggaatgcttctgactatggacacaaggagagtgctaaattttcta

SEQ ID NO: 510375 - DNA, 928 bp, Homo sapiens
gtaggttgggagtggaaggtggtggctgctgctccgcagtgtggggaagatggcgccgccggtggcagagagggggctaaagagcgtcgtgtggcagagtgagtgcggtggggtaggggttgagagagggaaggccgggaggctgccgtgccgggcctcgttttgcagccccaacctagcggtctgttgaggagccgccgcgagcacttgttgctttgggacctgtgtgaggacttcttcctgctttcctgccctgccttattccttgccagcaccagggatgggcggggtgcgacgggacgcgtgcttctcgttggcgtcgggcaccccctcgcctcggccgcgctctggccgcgaagctccgccccgggtgagccgcccggcccggctttccctcccgcggagcccgtgcgtgccctcggccggctccccagtcttctccgctcccgtccgcgctccccacatcttctccgctcccgtccgcgctccaccagttggggatgtctctccatccgagacaatccgggcgctgtttattccggccccatctccagcccacactggagtttgcaaggactgtttattctgcttattcgtgttagtatcaacccgtgcttttcaaaaaacctcactgtttaacagactcatcttcccctattccgagaggagcctactttctgaaaagttcttgagaagagaccattgggaatgacccggtgtccagccgtgaccatcttcctgcataggcctgggcaagagcctgtccttccggttttacctactctcgggggcccattcctgcttgtagcgaccggactccttatggattactgatgttcttgaggaatcatccaacaaatttcataaacattggctcccaaactaggtctgacaggtagagaaagtattgaacccaccaacaggaata

SEQ ID NO: 510376 - DNA, 580 bp, Homo sapiens
  misc_feature (547)..(547): n is a, c, g, or t
aaggacaagcccacctatgatgagatcttctacacactgtctcctgtcaacggcaagatcacaggtgctaatgccaagaaggagatggtgaagtccaagctgcccaacacagtgctggggaagatctggaagttggcagatgtggacaaggatggcctgctggatgacgaggagtttgccctggccaaccaccttatcaaggtgaagctagagggccacgagctgcccgctgaccttcctccacatctcattccaccctccaaacggaggcacgagtgacttccatgcctgagataccctacaacccccagggctgctgccactttctacccaccagctccttgtctgcccaggtgggctggggcctggaggggcagaaattgggggagggaaagggtcaccatttttcaaggtccataaagactgagcggtgtttcctcagctcttgaataggaaaaccaccatctttcttttaaagctgttctggggttcagcgggaggcatgggtgatgcttggatatgaacagtgggattttgtgcacagganaccatgatatttttaatatataacattagaggc

SEQ ID NO: 510377 - DNA, 593 bp, Homo sapiens
cgccattctacaccttgcggtttgaaacagctgttttttccacatttgctgcaggcatggctgtcttctgcccctgcctgtccatctggcctataccccagccgtggggcccgcggtccctgtcgcagccccctacccttctgatgcctctgcttgactatggaccaaacagctctggcctcgggattgggccaccctacccaggatcttcaccctggggacacggcgaaggggaaagccttcatcttggcgaaccgtgcccaccaaccccttctacccggggcttcgtgcacagatgggctatctgtgtcagacccctgctgtctgtctgtgggagaaggacattgtgcccatctcccgggcctctgctgtcactctgcttgttgcagctgaattcttgcattctggctgtccacccccggacagaaccctggagctgtgcttgtttcagaccagtgccagaaaccagcacttcatgaagatctctgggtccggccaccagcaggacctgtcgacctgaggtgaccctgggtctgcccccagacctggggccccagctttcctccttgactttgggggtcacattccttcct

SEQ ID NO: 510378 - DNA, 248 bp, Homo sapiens
tagtggggtgcaggccatagtgtctttgtagctggccaagctatggaatgtggtagtattctccctgtacgggttgtagtagccggcaggggtacagtgttgtgtgtggcgatctgcggctgctgtggtacgggcgtagatgcttcaaggagtcctgaggctgtggtgttgtcaggtaagagtgttgtttcagtggagcctgggctgctgtggaaggtagtatattctggaccaaggcctggcatggg

SEQ ID NO: 510379 - DNA, 350 bp, Homo sapiens
gtataggcagtatagaatgatgtcagctcctttgattcaaatctaacacctgcgaccaatctatagaagcatggtcttatcaagatcaaagtcgagatgaccatagtaatgacctcgaacaaattcttgaatcatagcacacaagccgtttggagtaagtacatcagcctttctattcagcatatgttcagcttctatagcagttatgtcatagtccatggtcaacacgtgagtccaatgaataaaagctcgctccatgcagtaacggtggtaaatctgcctttcaacagtctctctgtcattgttaaactgatcaagatggttgtagaactcaatactctctgcacagt

SEQ ID NO: 510380 - DNA, 1354 bp, Homo sapiens
  misc_feature (509)..(509): n is a, c, g, or t
tggtattctggccagaacagtatatggtttttctaccccaattacatacggggtttggtaccacatcactaaaggcccaaatcattggaagatacaaaaccggtacatcgcaggctgggttggtctgggtatagtacaatgggctggatttggcttcaactggtctagtatggtatggtgcacgcctgaaatctgggctccttaaaaggaaacgccggtgtcagtcatcttgaaacatatgacatgtgataacaaggtaaactcgaataagtggtttggaagaagacgggatcacattgtttaaacagggtgggcctaaaggcttccagataacattggctcatttgggtgcacctttgggtggctcaacacctgtgtagtaccctataacctgtgacagggaattttaccataccgggttaatcaatgggtgggcgcaaaagagcaaaaacctggggtgtctgggtgcacattataactccatagagtggtccataagcgcacagggntataggtgcagacaagaaacccacgaacacccaaaagttgcatgtcgcaatggggtgcaaatacatgtgtgtggtaagaccaaacgccataacttataatacacaatctactgtgctccccgatgtagtaacaacacatctttggggcagggacaaagtaatacacccttcccctatgtggggggggctcatagacaggtgtggacagcagccactaaactaaggggggggaggacacacacttggaagacatgggcgcagaacacgaaacaggcgagtagactccacagggggaggtgggaggacaaccaacagtgaagcaccacccggtgggcaaaactaccaaacttatctccccaaggaggaggccatacaccaaacctagggtaggcacaaaggcatacaccaaaaactacccccgggaggggagcgtggctgtgatgaccccaataggccgcagcacgcgagagtagcgacaaacaacattgagagcaaacgagcattaaaagaattcacccatcaagaagaaacgaaaagatagggccaaggtgaagacaatccaagcccgtccagacaaaaaatatcccgtggatagaacgaggaaccgcccaaacaccgaggaggggaacaatatgcgaacaagacgcttgattgatcaacgacagcaccgaaaagagtggatcaacacacgtactcacagagacggggggacggacacaacccagagcagacgaccaaattctggatcgagacgcacaacggagtgaacacgggggcggagactctccgaacgcgaaaacaccacaaaaagatgggggagacaactcgcacacgaatcatagaac

SEQ ID NO: 510381 - DNA, 179 bp, Homo sapiens
tacaggatcttccggtagactaacctatatcagaaaggtgttgtaagagcttctctgtgtgtacgcatgaactttggtctgtaggtgttaaatggaacctctccatgtgtatatagtatttccttgtataaagcactttactacctaccacttgtgttgtgaacgttaggtctacctgg

SEQ ID NO: 510382 - DNA, 890 bp, Homo sapiens
aaaggagtgctgctggcgatcggatcttttctccagcaattgggggaaagaaggctttttctctgaattcgcttagtgtaaccagcggcgtatattttttacggcgccttttcgaaaacctagtagttgactagttcactttggtcttaacatcttagttctcagttgtctaaggcttcaagacttgccttaagaattagccttaattctccattacatgtgatgactacatgtgttgcaccagggggctttccttcgtatttggacgctgtgtcttatgttcttatccaccgatcatgttctaacatcctgtaaaatcgcaactcagtctccgatcatggatgagtgttccaagaaggatcaagctcgttttgatggtggtctttaacgtaccctgaacaaggtgtactggctagtggccgagaacggtggctggccgggtgatagtggaggtgtgtgcaagtaactcgtgtcaaagccgcttaggactcctggcttgcggagctggcgtaaagtgctgttggatgcagggatcccgagcgagatggcgaatacaggactatcggcagtacctggcgctatgcaagacacggcttcttctggtaagagccatgccacatgaggttgcagaagtgaggactggtgtatcatgagatcctggacaatcaaattatgagtacaacgtttcggcttttgagcttcctcaggggtcctcttgggaaccaatcctttcacatgcgcaaaatatgcgcgtggtgatagcacttaacgtggtgttgaccgggcttcgtacttgtaaccagaccgaatccaagaccaacgtcccagcaagactacaggaacaacccttttgaaggtcccgtggatcttggtgacactggtccctcacc

SEQ ID NO: 510383 - DNA, 1129 bp, Homo sapiens
  misc_feature (299)..(299): n is a, c, g, or t
ggaagaggacactaggaaaaaagatgcttccaaacccagccttcagaaacaaaagaagtggagccagagccaacctgacggaccaaggactttggaacgctgatgaacgaggacacctacggaaaaacagactgcttctgactgactctagactgaccttgacacttctttaatcaaacagaaaaacgacagacaacaacaacctaacacaacgatactttgactacttcgactgacacgctgaacgaacggtgtacaacggactcttaacgacttgacacagtgactgttccaagaancccaactgacaccacgacggactgacccattgacacttactgctatggcaactaacaacagacacgacaacaacgacacgaactgttaacgttacccaagactgacggactgacaactacctacgacgaacacgactgacacgctctacgacacgactgaacgaccaaccaacaaaacgactgactgagtatctcaatatcagctaattcagaccaggcccttgcttggcgcaggcttcagacacgagactatcacatacgacggacgctgctgaatcgagtgttcaaccatcactgagggaacacagactccagcatatggattgctgggcgagacaacggaacatctgtccatgaaaccctccacaagtcgtccgagtaggaaccaaagaaaacttctttagtcaactttacagatatctgtcaactatcacatcgtcagccaaacatctccttgcatttcagtggctgactctgggtacaagtggttctatagactggtaataaccaactagtacatcacggaagactccacagacacgcatagaacagcttgagaggatatatcaggcattatgttactggtcacacattgcggatcaccgaacaccatctgcgacaggacccagacttatttcttaacaggcgaacatagtaaccacaagtccggagcgaaataaaagggtcacagcagtaccgggcacgagcacgacctgccaagcacaataggacaagaatctgaacggaggaatgccagaacgccacaagcgcccggacaccagaccacccatcgagcggagcaccaatacaacacccccaccaacgacacg

SEQ ID NO: 510384 - DNA, 390 bp, Homo sapiens
tttagttcaggccttattaataggaatacaaaaataattattttaagccttactgaagagaaatatactgacttatctagttagctgcattgtattttagagagtgaagatcttgatagccatatattttaggacagccatcacctaatgaagtagaaagtataaaagatactctcactgggaaaccagcatcagtttacaagatttctatttactgtgagaagctcagtcctagagtgtacaaagcttgaaccagaactgttgaggtagaaatggacagaatacttgaggaattattcactcactctttaaacttttgtctttaattggagattaaataaagaatgaataaaaacaggaaataagctactcagattttcttttttattg

SEQ ID NO: 510385 - DNA, 121 bp, Homo sapiens
gttcaggatcttgtcgggcgacggaaacttacgcagcggaggatatgatgctaaagtcccgagttagagagtgagatcttgaacgaggacacattgtttagccagccgatccccgggtacc

SEQ ID NO: 510386 - DNA, 304 bp, Homo sapiens
gtagcgactctccctacgtatctaaatttctactcctggattttaaccaagagaaatgaaaatatatgtccacacaaagatctatgttgcaaatattcagaggagatttattcgtaatagccaaaaactgggccgggcgtggtggctcatgcctgtaatcccagcactttgggaggttgaggtgggcggatcacgagctcaagagatcagaccaacccggctaacaaggtgaaactccgtctctactaaaaatacaaaaaattagccgagtgcggtggcatgcgcctaggatacagtagggaga

SEQ ID NO: 510387 - DNA, 216 bp, Homo sapiens
gacctacgatgtccgtgcatgtgttaagagagatattaaagcaccatattttaagggttattgaaagataaacggtgaaatgaacatattgatgatctggaacttccattggtaagaatcccaatagtttcatcttctaagtattagaggaagacacttagatctgatgtcttattacaaactggatcttcaaaatggtccgtttttaagatggtc

SEQ ID NO: 510388 - DNA, 220 bp, Homo sapiens
  misc_feature (26)..(26): n is a, c, g, or t
  misc_feature (92)..(92): n is a, c, g, or t
  misc_feature (161)..(161): n is a, c, g, or t
  misc_feature (205)..(205): n is a, c, g, or t
  misc_feature (212)..(213): n is a, c, g, or t
ctcctaagcagttagttctatcttcncttacagctgatgcttcttgaggggaaaggccaccttgtgtcttttgttagagataggatgttgcnaagggtagggcaaccaggagggtatcccttagcatgtaactttgaagaatcaagattggtgctccacanaaagttcggttcaaaaatgtttctcttaagaaacttaaaaaccntactccnntgatgga

SEQ ID NO: 510389 - DNA, 348 bp, Homo sapiens
aagcgcaaaatgtggttttggaatcataaacattgggcttgtcgggagctggtcctggaagcctcacgtgagtccctgttccaaaggaccggacgctgaatccccgttatgctagaggatgttagaatttaagttgacactattttatttacacataccgaatatgaattcctacgattttcttagcaaaaaactgatagactttctaacattgagcctgcattccaacactgcaacaatcaagtgtaactgacataagtacaaggggcttacagtcaccatatcactactacatgcatttaggttactattctagcctttaaacacatcagaatttgtagttcttgg

SEQ ID NO: 510390 - DNA, 295 bp, Homo sapiens
ccccaggaagccctcggcccccaagaagggagacagtttttctgaagaactgaaactggccccccagctgaccgggccggtcattcccgtccgggacgtttttaagaaggggaaagctcgggtcctccctgggggagggaagaatttcaaagccttcgcttgtttccgtttggcccgttccaacgcccggcttttcggcatacgggcaaaaagggccaaggaagcccccgaaccgggttttgaaaagaaaaaataaagccctcctgggggcttggaatccgtcggccgtcttgga

SEQ ID NO: 510391 - DNA, 189 bp, Homo sapiens
acacgtagtttagtagaatgcgggcgcttgggttagccatgggtgctaaagaggaaaccctctatgaattagcgggtatcgggacttaatcgtcaccggtatgtcacccatttcgcgcaactatcgcggggatatgggtactttggcaaggcaaaacacttgccccagtcacccaggacatggcatggt

SEQ ID NO: 510392 - DNA, 220 bp, Homo sapiens
  misc_feature (8)..(8): n is a, c, g, or t
  misc_feature (44)..(44): n is a, c, g, or t
  misc_feature (52)..(52): n is a, c, g, or t
  misc_feature (58)..(58): n is a, c, g, or t
  misc_feature (77)..(77): n is a, c, g, or t
  misc_feature (81)..(81): n is a, c, g, or t
  misc_feature (87)..(87): n is a, c, g, or t
  misc_feature (89)..(90): n is a, c, g, or t
  misc_feature (93)..(93): n is a, c, g, or t
  misc_feature (107)..(107): n is a, c, g, or t
  misc_feature (122)..(122): n is a, c, g, or t
  misc_feature (146)..(146): n is a, c, g, or t
  misc_feature (157)..(157): n is a, c, g, or t
  misc_feature (166)..(166): n is a, c, g, or t
  misc_feature (183)..(183): n is a, c, g, or t
  misc_feature (192)..(192): n is a, c, g, or t
  misc_feature (194)..(194): n is a, c, g, or t
gagaaagntgagaagccagatactaaagagaagaaacccgaagncaagaagnttgatnctggtggcaaggtgaaaangggnaccctnannggnaaaaagcccaaganggggaagccccattngcagccgtaaccctcgtccttcgncagaggcattngcgaggtgnttcccggtctgccatgnaattccagnanggccatgtgacaagagggaagtaact

SEQ ID NO: 510393 - DNA, 583 bp, Homo sapiens
agagagagatgggtaatgtgagatgtgatcacagatataaagttcagtagggcaggaggaataagttttaatgatctatagttccacttggtgactacagttaatgtattgcatatttcgaaatgctaagagatttttagcattctcaccacaaaaaatgctaagttggtgagggaatagatatgttaacttgcttgattgactctttctacaatgtatacataaatcaaaacatcacactgtaccccactaatatctacaattattatttgtaagttaaaacaaataccctgaagattgttggacctgcaagcattgttggtggggcccttcaggggagagatgggtaatgtgcagatgttgatccacagatataaagtttcagttgggcaggaggaataagttttaatgatctattgttccacttggtgactacagttaatgtatagcatatttcgacatcgctaagagattattcgacatactcaccacaaaaaatgctaagatggtgcgggaatagatatgtaaacttgcttgatagactctttctacactgtatacataaatcaaaacatcacacagt

SEQ ID NO: 510394 - DNA, 1184 bp, Homo sapiens
ggtcagacgcatcttcttttgcgtcgccagccgagccacatcgctcagacaccatggcgcaaggtgaagtgtcggagtcaacggattaaggtacgtatagggcgcctggtcaccagggactgctataaaactctggtaaagtggatattgttgccatacaatgaccaccttcattgacctcaactacatggttatacatgtaccaatatgattccagcccatggcaaattccatgagcaccgtcaaggctgagaacagggacagcttgtcaatcaatggaaatccacatacacatacttccaggacgcgagatcaccataccaaaatcaagtagagggcgatgctaggaaggctgagatacagtcgaggaagataccaataggcgatactatcaccaaccagtgggagaagggcatggaggctcaattatgcaagtggagggagaccaaaaagaggatcactccatcatcatgaccccatacatgactgatgaaacaccatgtacagtacattggagtgtagaaccattgagaagtatgacaacagacctcaagatcatcagcaatgcctaccttgcaccaccaaatggttaggaaccacctggaacaaggtacatacacatgaacaagcttatggatactcagtgggaacaggactacatgagcacaaggatccaatgccaatcacatgacacaccaaaaagactgtaggaatggacccatcagggcaaccttgtgaacgataatggccagcgaggatcatcccagaaaaataatcccatgacacaaacaggcagacatgccaaggacctgagggccaagggcaaaccatgagcaagaacgagaagaacaaagggaatggacatacacgagaacccaagtgccaacgatgaagggaagaacctagacaggacgacaaaaaaacagaacaaaatgagaaccacaaaggtggtgacacagagtatagagggcacaacaagaaaccgggaaacaggaaaacaagaggacacacgagcaaaagaagacaaagagacaactagacaagaggacatcaaaaaaacatgaagaagccgagaacaagtaacacagaggacaaacaagcaaagacaggaccaaaagaaagaaaaaggagacaaaacacgacagcagagagcgcaaaaaaagaattcagagagcaaagaaaaa

SEQ ID NO: 510395 - DNA, 219 bp, Homo sapiens
  misc_feature (176)..(176): n is a, c, g, or t
agatgtcaagcaatagattgtgggccctgaaggaaataaaagtattttagccccaaaatctattcttgacatattttgaaatggccctgcaaaaccatattttgtggaggaaaattgcatctgtggagaatctccttctgtttccaggtctttttctgatccagaagagatttaanctaagagtctggacatcttaatctgggggcccaatgcctggct

SEQ ID NO: 510396 - DNA, 902 bp, Homo sapiens
  misc_feature (495)..(495): n is a, c, g, or t
  misc_feature (670)..(671): n is a, c, g, or t
  misc_feature (681)..(682): n is a, c, g, or t
  misc_feature (689)..(690): n is a, c, g, or t
  misc_feature (692)..(692): n is a, c, g, or t
  misc_feature (694)..(694): n is a, c, g, or t
  misc_feature (705)..(705): n is a, c, g, or t
  misc_feature (713)..(713): n is a, c, g, or t
  misc_feature (719)..(719): n is a, c, g, or t
  misc_feature (740)..(740): n is a, c, g, or t
  misc_feature (792)..(792): n is a, c, g, or t
  misc_feature (810)..(810): n is a, c, g, or t
  misc_feature (825)..(825): n is a, c, g, or t
  misc_feature (854)..(855): n is a, c, g, or t
  misc_feature (857)..(857): n is a, c, g, or t
  misc_feature (859)..(859): n is a, c, g, or t
  misc_feature (861)..(861): n is a, c, g, or t
  misc_feature (865)..(867): n is a, c, g, or t
  misc_feature (869)..(869): n is a, c, g, or t
ggggcgcccgagcacctcctcgccagcagccgtccggagccagccaacgagcggaaaatggcagacaatttttcgctccatgatgcgttatctgggtctggaaacccaaaccctcaaggatggcctggcgcatgggggaaccagcctgctggggcagggggctacccaggggcttcctatcctggggcctaccccgggcaggcacccccagggcttatcctggacaggcacctccaggcgcctaccctggagcacctggagcttatcccggagcacctgcacctggagtctacccagggccacccagcggccctggggggcctacccaatcttcttgggacagccaaagtgccaccggagcctaccttgccaattggcccctatggcggccctgttgggccactgatttgtgccttatataacctgcctttggctggggagagtggtggcctcgaatgcgtgataaccaattcttgggcagcggtgaagccccangtgcaacagaattgctttagatttcccaaagagggaattgatgttggccttccactttaaacccacggcttcaatgagaacaaccaggagagtcattgtttgcaatacaaagctggataataactggggaaggggaagaacagacagtcggttttcccattttgaaagtgggaanncattcaaaannacaagtnntngnttgaacctgancacttcanggttgnagtgaatgatgctcacttgtngcagtacatcatcgggttaaagaaatcaatgaaatcagcaaactgggaattnctggtgacatagactcancagtgctccatatancatgatataatctgaaaggggcagattannanananagannncnattacgtgtgtaaaggtcaaggtagggaaggaa

SEQ ID NO: 510397 - DNA, 174 bp, Homo sapiens
ggcaggaaggggagcactgcagaggaagtatgggagcaaggtgggacacaaggagcaagaggcatacggtgccctattcatagacttcccaaagggcatggaaggatggaccaaagagggcatctcctgtgtaaatgcctggagaacgatgtcccagttgcagtcctagactcc

SEQ ID NO: 510398 - DNA, 961 bp, Homo sapiens
gactctttcatggtgttcagcatcgagcaaccctctcaacacagccagtttagcagtggtcaacacacacacacacacaaacacacacaccaccacccaacacgctcgccaccccacaaaacagggtatgcaacatttcttcttgtggaacaattccttccgtgtcatttcctccgcgatttcactgtgaatctagatcgtgcgacccaatagagagattccttcgaggaatcagcctttataattctcctttaagacaggagaaaaaaattcagactacaccggtcgaaaccatctcgaggccgtgacatctacccaggcacgcgtggagcaatgtggacacttgtggggaacacccgtggcacgtggccttatattacacttgtgggcatcaaacctttcaacaacgccaacgcgggggatctccctatgtggagacaatatttcctctataaaccaaattgcgaccactgcgggcacgcgggccaccacaccagaagcgagccacaaacagagcggacaaacaggagaacacggtgagagagtggccccaaacgggatgtccacaaaaaccaccctgagaggatgcgacaagaaaatgtgtcgagcaaacaacacgcgagacagacaaagaacactaactataaccacgaggcacacagcgtgccgcaaaccagccaaaccgtgtttagaaaacgccgccctagcacccaacgttgtggagcgacaaacctagtctaaaagacatattatttagagataaagagataacaacagtacatacactcgcacagctgctgagttgaatagacgactcacttataatatccacacaatcccccagcaacatgctaggggtctaggacggcaatacacaacgcaaaaaacgacagctcccacattcaacacgtaaatagtcggaaacaacagagacaaccatagtatctggaaaaacgctaac

SEQ ID NO: 510399 - DNA, 329 bp, Homo sapiens
agggagcgatctccaggggggcaggtctggtaatgaatgaaggagctgaggccgggcatggtggcgcacacctgtaatcccagcactttgggaggccgaggctggcggatcacatgaagtcaggagttcgagaccagcctgaccaatatgatgaaaccccatctctactaaaaatacaaaaattagctggtcgtggtggcaggcacctgtaatcccaggtacttgggaggctgagacaggagattcacttgaaccctggaggcggaggttgcagggagccgagattgcaccattgcactccggcctgggcaagaatgaaacgctgtctc

SEQ ID NO: 510400 - DNA, 761 bp, Homo sapiens
  misc_feature (4)..(4): n is a, c, g, or t
  misc_feature (68)..(68): n is a, c, g, or t
  misc_feature (165)..(165): n is a, c, g, or t
  misc_feature (186)..(186): n is a, c, g, or t
  misc_feature (246)..(246): n is a, c, g, or t
  misc_feature (250)..(250): n is a, c, g, or t
  misc_feature (259)..(259): n is a, c, g, or t
  misc_feature (268)..(268): n is a, c, g, or t
  misc_feature (291)..(291): n is a, c, g, or t
  misc_feature (314)..(314): n is a, c, g, or t
  misc_feature (318)..(318): n is a, c, g, or t
  misc_feature (320)..(320): n is a, c, g, or t
  misc_feature (379)..(379): n is a, c, g, or t
  misc_feature (415)..(415): n is a, c, g, or t
  misc_feature (418)..(418): n is a, c, g, or t
  misc_feature (524)..(524): n is a, c, g, or t
  misc_feature (526)..(527): n is a, c, g, or t
  misc_feature (538)..(538): n is a, c, g, or t
  misc_feature (549)..(549): n is a, c, g, or t
  misc_feature (582)..(582): n is a, c, g, or t
  misc_feature (603)..(603): n is a, c, g, or t
  misc_feature (608)..(608): n is a, c, g, or t
  misc_feature (639)..(639): n is a, c, g, or t
  misc_feature (641)..(641): n is a, c, g, or t
  misc_feature (643)..(643): n is a, c, g, or t
  misc_feature (690)..(690): n is a, c, g, or t
  misc_feature (726)..(726): n is a, c, g, or t
gganaagcccgcagcgcagggagctgtctgcagaggccagggtgcgcctgcaacgaatccccaggcancggtggccgccgcggcccgagtagctcggcgggtaaacatggccgcactgacgacggttgtggtagcggctgcggccaccgcggtagccggggctgnggaaggggcgggcgcggccancgggaccggcgtgggagcgaagccagcgcctcaacagagtgatggctgttttagtacttnaggnggaattcgnccttttcancttcagaactggaagcagaaagnaaatcagactaagaaagcagaantggnangcacagcagaaaaatttaaaaatcaagtaataaaaatggaaaaagaaaaaaaaagacanatcaacaaccaaaaaagtgacttcagaattgagcanagnatgctagaagaattggaaaataaattgatacaaagcaggaaaaaagaaagagcaaaaatccagcaacaattggccaaaatacataataatgtaaagaaacttcagnannaattaaaagangtgaagcctanaactgattttgttgagaagctaagagaaatganggaagaaattgaaatgcaatnaacanttttaaagaagagcagaggttgatatatgtngngntaattatagaagagaagacaactaataatgagttgagtgccatatcnagaaaaattgacacatgggctttgggtaattcaganacagagaaagctttcagagcattctcaagcacagt

SEQ ID NO: 510401 - DNA, 513 bp, Homo sapiens
  misc_feature (188)..(188): n is a, c, g, or t
gcatttaacaggacttcgcactgtgcttcctgatttcctcttgttacaacaggaccctgccaaccactgggaccgccgttccgcaccaataaccgtgaagtaaggacggaccacgggtacatcatacgaaaagtactacacgcgcctgggcaacgacttccaccacgaagcagagcgcgtgtagcganggagatccgccactatccgccatgcgaaaaagctccgcaagcaagatacgcaggttgacgtccacgcagtctgatgaagcgaattcagagaggcccagctaagaggaatctccatcaagctgctgcgagtgaggagagatgaaaggacgagacaacttatgttctctgaggtcgtcaggcattggactccaggagacttatatgaagtagatcctgacactaacggttaatgctgatagcttttggaattcggcagtatgtccaaccttcaggttattcagcctacatttgggatgaatatccacaccgcctgcgggaccctcga

SEQ ID NO: 510402 - DNA, 183 bp, Homo sapiens
acttcatataggcagagtcccaaattccctcacaaacaacacattgcaccatgcagggtcaacatcatacaacatcaagcaggtctcatcatgctcaaaatcccaattgcattcttgcatcatattttttgcacgtgtgtgtgtgtgtgtgtgacggagcaacatctcggggatcctctcaga

SEQ ID NO: 510403 - DNA, 446 bp, Homo sapiens
tacatcttgtgctaggagagagtcatattctgtatcggcaccctaaatcccatttacaccatggtcctcaatctgttccccagtgaaccagagggctctgccaaatcatttcagagttccacaaagaacagaatatttctgccaagcagagaagattggaacatcgtaaggaattcatccttctatgtcggtgttttatttatgggcattctgaagattatttcatttgggaaaagaatattgttactaaaaattattgaaaaatcactggtggtttggccttgagagaaaagtcaaagagttacaaaacgttcagtgataatttcagaaccaggcatggtgctcatgcctataatcccagcactattttgggaggctgatgtgggaggacagatcaagcccaggagttcaagatcagcctgggcaacatagcaagaacgcatctc

SEQ ID NO: 510404 - DNA, 401 bp, Homo sapiens
  misc_feature (52)..(52): n is a, c, g, or t
  misc_feature (56)..(56): n is a, c, g, or t
  misc_feature (120)..(120): n is a, c, g, or t
  misc_feature (125)..(125): n is a, c, g, or t
  misc_feature (177)..(177): n is a, c, g, or t
aaacaagtcgcccacatggtgaaaaaaacaccgcgtaattttggcccacagngcantcctaacatcacattacacgtactacccagagacgtttatgtgagcattacctttcaaaaatcnttacnttctatttcctggtggagcagccacttgtggagtgtgattcctaattcttcntgagtttggcaataggacttgatgctggataggttgtcttttgtttttatgtctcagaccatcttgtgagattgtttgcctatctcataatacagttttatgcagaaaggttgaaactatgtaaatggtttttatggaaattatcagttacaatattttaaaggtgtagaatggcatctttgtttataggagaacatttgtaaataaagttaaatttctaagcc

SEQ ID NO: 510405 - DNA, 935 bp, Homo sapiens
gacagtgctgacactacaaggctcggagctccgggcactcagacatcgtgagtggtccttgcgggcccccgtgaatccaatcactgctagttctatgtctaacttattattgtctcatcttcgaaccatgtgtagcatatgttggcctacacagagaccaactcgcgtggcttcttagcatgaaagattcggtagttattgtccaacgtaccatgtaggcagttgctacatttacctgtctaacattatctaaaccgaggtatgacacaggatctactagtcttgggacagacatcgttacttcaagttgtaaaccataacgatcacaaagtcgtaacaggctggtaaaagcaatccatactcatctgtatcaagtccctgtatgaatcatcaaaatccaagatatgatagaacgctgctactttgaattgtccgaagagaggtgttagaacgaacttctgactgtatgacgcgatcgattatagcacatgaatcaagtattcgatatttgcacggaaatatataatccatatgatcagcagatgttgaactgtaccagatgaaggtagacccagtcttgaagcacagagccaggagtctttgcaaagagactgtgcacatccatgatctcacgtgggaaaagatgtcacgacattgtccacataaggggagctaaaacagaggccgggctttgactttatgtacacctctgatggctaaaccagcaatgacttgagtctacctgtgaaactccgatggggtctgggaacttggatggctctgcgtttcaagaccgagcacttgataggcagtgtcagactcccagataaattggcctcgattatagccgaaggttttggcctctgcctcctactggcacaaccgaatttgggttgcgactgagaagattctttccgctatgcccacagtctcca

SEQ ID NO: 510406 - DNA, 324 bp, Homo sapiens
  misc_feature (4)..(4): n is a, c, g, or t
  misc_feature (12)..(12): n is a, c, g, or t
  misc_feature (95)..(95): n is a, c, g, or t
  misc_feature (107)..(107): n is a, c, g, or t
  misc_feature (242)..(242): n is a, c, g, or t
cagnaaaataantcccacgcacaaagagtcagtgtaaagaaggccttggctgggccacagtggctcatgctgtaatcccagcagggaggctgagnccgggtggatcntgaggtcaggagaccgagcccatcctggctaacacgctgaaaccccgtctctactaaaagtacaaaaattcagccaggcatggtaacacatgccctgtaatcccagctactcaagaggctgaggcaggagaactncttgaacccaggaggtggaagttgcagtgagctgagatcgcaccactgcactccagcctaggcgacagagtgagactccgct

SEQ ID NO: 510407 - DNA, 530 bp, Homo sapiens
  misc_feature (343)..(343): n is a, c, g, or t
  misc_feature (352)..(352): n is a, c, g, or t
  misc_feature (359)..(359): n is a, c, g, or t
  misc_feature (514)..(514): n is a, c, g, or t
catgaagccggccactgctctgctctgctcctgctcctgctgggcctggctggacccaggggagccacggctggggtgcggaccgtcatcactgcagaaacgtgcaggcagagcgattcagaactacaattacaaccagcatgcgtatcccactgcctatggtgggaagtactcagtcaagacccctgcaaaggggggagtctcaccttcttcctcggcttcccgggtgcaacctggcctgctgcagtgggtgaagttttggtaggcaatttcttgcaaccaccacccgaggcccccgaaaaagcactggtcgtcagggaagctcctccccttggcccccaanctgtgccanccctggncccggctgccacacctctgtttcctaaggctggggaccaagtttgtctctccttgtttcttcccacttgcactgtggtgcttcagttggcaacagcttcgtcacatacaccagattttctgtaactcctccctttgtgacctgaagtaatgtganagttttcaagaaagaa

SEQ ID NO: 510408 - DNA, 376 bp, Homo sapiens
  misc_feature (138)..(138): n is a, c, g, or t
  misc_feature (182)..(182): n is a, c, g, or t
  misc_feature (214)..(214): n is a, c, g, or t
  misc_feature (282)..(282): n is a, c, g, or t
gcagacgcgcaccctgtcgccgcgaagcggtcgcgcgcagtcgtcccggccctggccgccgcaaacgaggatccgctgcgctcggggaacgcgacagcgctcgtggccccggacctgaagaccttcagcatgccagangaaagttccccaggcggaccccgagagcattccctaccaggacntcctcacctggtcaatgcagacggacagtacntcttctgcaggtactggaaacccacaaggcacacccaaggccctcatctttgtgtcccatggaagccngaagagaacagtggccgctatgaagaacttggctcggaatgctgattgggggctggaccttgctgggttgtttggcccaacgaacaatgtttgg

SEQ ID NO: 510409 - DNA, 182 bp, Homo sapiens
ctagagtgatcccccgcgccgaggcgaacaactgtcaccgaactcaggctggcccgccggagtacggctggccctgatgggtatcgaggagtcaagcgccccgccgtcgaccacgccaacaaccgccgggtggcggagtatctgctggaggaaatactcgaacgcctggaaccgagagaccg

SEQ ID NO: 510410 - DNA, 569 bp, Homo sapiens
  misc_feature (273)..(273): n is a, c, g, or t
  misc_feature (281)..(281): n is a, c, g, or t
  misc_feature (382)..(382): n is a, c, g, or t
  misc_feature (391)..(391): n is a, c, g, or t
  misc_feature (398)..(398): n is a, c, g, or t
  misc_feature (553)..(553): n is a, c, g, or t
catgaagccggccactgctctgctctgctcctgctcctgctgggcctggctggacccaggggagccacggctggggtgcggaccgtcatcactgcagaaacgtgcaggcagagcgattcagaactacaattacaaccagcatgcgtatcccactgcctatggtgggaagtactcagtcaagacccctgcaaaggggggagtctcaccttcttcctcggcttcccgggtgcaacctggcctgctgcagtgggtgaagttttggtaggcggcaanaaagtganggggcaccacaaggccgaacaaggcaatttcttgcaaccaccacccgaggcccccgaaaaagcactggtcgtcagggaagctcctccccttggcccccaanctgtgccanccctggncccggctgccacacctctgtttcctaaggctggggaccaagtttgtctctccttgtttcttcccacttgcactgtggtgcttcagttggcaacagcttcgtcacatacaccagattttctgtaactcctccctttgtgacctgaagtaatgtganagttttcaagaaagaa

SEQ ID NO: 510411 - DNA, 378 bp, Homo sapiens
tcctgatgctttgtgctgttgcgtgtgttctcatatacctgttggccaattttatttttttagaaatctctactcaggtactttgcccattttttaattaggttatttgcttacttgctattggaagttgtctgagttccttatatatatgggatattaaccccttattgtacatatggttggcatatattttctcccattctacaggtagtctcctcattctgttgattgtttcctttgctgtgtagaagctgtatagcgtgatataattccattggtttgtaaatggggttgttgcctgtgcttttgaggtcacattcaaaaaattattgtccaaactaatgccacagagcttttcctctgtggcatcgatacaca

SEQ ID NO: 510412 - DNA, 900 bp, Homo sapiens
ggacgcgtgggtcgacccacgcgtccggtaattctggaatcaaagactatggatacattgtggcatgggctgagtgtggtggctcatgcctgtaatcccagcacttggggaggctgagacaggcggatcatctgaagtcaggagttaaagaccagcctgggcaacatggcaaaaccccatctctaccaaaaatacaaaaattaaccatgcgtggtggtacacgtctgtcatcccagcagctcttaaggctgaggcacaagaattgcttgaacccgggaggcggaggctgtagtgagccaagatagcaccactgcactccagcctgggagacagagtgagactccgtctcaaaaaaaaaaaattgggaggccgagggaattcctgacctcaggtgatccacccacctcggcctctcaaagtgctgggatacacaggttggaaccactgcacccggccagtaaaaagaaatttgacggccattgcagatattggacggctggtatatcaaggtgttccttagttaaagaggaaaccataacacggaaaaaagctggaaatcacgcgatgtgacacgtcaatggacaagttcatcatactcagcacgcagccaggctcagacactacaagtggattagttgatcagaactaaaatcgtagaggggactaaaattctgagagtcgtggtatcggagcatactatgggacatttttcggctgtgtgcacactctaccattgtcatttcgtagcatcaaaacggcctcgccgtcgattagacaagaacccaacagtcatgggtgtccccacacagtacactcttccggatgaaaatacaacttatattatacacgtactcaatatgaagacgtaacggcagaaatgtaccaaatggacatcacaaa

SEQ ID NO: 510413 - DNA, 322 bp, Homo sapiens
  misc_feature (70)..(70): n is a, c, g, or t
tttcccccagtttttaaaaatcctcattcctaaaagggcccccctggggttaaagttgggcctcccctangccccctttccccagtgggggcaggggtttttttgggtgaacaacttgcctgtggaattggggcggtaactgtttccccccccagcctaaatttttcttgtgtcccaaaccccagggggccccaccagttttgaacctacccttggggggtccccccggggggggttttggttttgccctgcaaaaattgggggcccccccccttttcccccaaataaagcccattaaagccttggaagtgggggaacccca

SEQ ID NO: 510414 - DNA, 483 bp, Homo sapiens
ggctgctgtaggcgccgacggagcgagcgggcgtgcggagcgggcgacagtggcgtgggatctgcctctctgcaagcagctgggagcggcggcggcggcaccatgagcgggggcaccccttacatcagcaacaagatcaacctcatctccaaagcggagatccgctacaagggcatcctctacaccatcaacaccaaaaactccaccgtagcccttgccaaagttcaatcctttggtacaaaaaacaaaccgacaaatcatccaataccacctcaaaataaagtctttaaatacattatattccatgggagtaacattaaagaccttactgtttgtaaaccaccaaaaccacaatattctttacctcaaaacccagctattgttcaatcctcactaagctcatcaacttcttcattccaatccatggattcttatagacctttccacaagatacccacatacaatcaattcagtccgagttcc

SEQ ID NO: 510415 - DNA, 126 bp, Homo sapiens
ggtcgtgaagttacgtatggcatgggaaagaagtcacattagcacaacgaaaaatagcatttcagctggcaaagcaggagcttcctgcttctgcctgcttctgcaaaatggctgcttcctgcttct

SEQ ID NO: 510416 - DNA, 352 bp, Homo sapiens
cacacttcgatcgcggagaatggcactcgattggggaggaggtcccgtatcagagaaccgcgaggatgagtgtgcatcagcacggagtgccctggttcacagtgcatgcttgtggatcgtgtacatcttgacacgtggatcttcctcgacatcacgactggggtctcgaagaggacgggggtaggaaatcctccaggatcttaggaaatttcactccgcttctcctgctcaatggtctctttggtcggcagggtgttcttctcctgcgtctccgtgtgcttcagcttggccttgcggagaatcgggcagtccgatcgggggggggtcccttcagagacccacaggccgtttg

SEQ ID NO: 510417 - DNA, 843 bp, Homo sapiens
gctagaatggtgggctgctctgtccatagagggcttgccttcgttcagtcatgttaatgagaggaaatgcccgggttgctgtcagcaggagcagacatggcggaagtgatgctggccaaggattttatagatattaacgctggcttgcggtagtgctgaaagctgaaccgaggaaaaagcaggagttgtgaaacgagctgccagaggaacatgttgcgggtcctctttgactgggccttaatgactttctaacgggactagttatgataggaatgtacggttacccagacagcggtgtaccgtccgtcctcctcctatagcgcggtgcgtgtacgtgcccatccgaaagacgtcaggcgtgtattcacggaagatcagatctcatcgaagcggggcacaatacgtggctgtcagatgctaagagtgtgcagcggcggggatctgccaagtctggagaggttgaaagggggatgagcttctagggcttgacgaaggagctgacccagtgtattagataaagaaggggattctctcctggaaaatctggatagaaattgatcggaacggaggatacgaaggatgtatgttgatgacgaggtgctaagttcgaagaggagcagagatgcgagttccgtgaggaaagatgagactattgtgacgatggggtctgagggggggtgcaggttgactctgatgaggagggggcctactgggatgtggtgatatgacgatccggggggtgacccgctgggttgtcccaggttttgaaaagaggtcggaaggaaagttccgggacagggcatgggggaaatcttggcatggggttgaatttcaccgttctgc

SEQ ID NO: 510418 - DNA, 165 bp, Homo sapiens
gatgcatttgggtttgaatttttggtcacatactggaatgttaggcagcccttaattattaaaacaccttaatttaatttttctttttttaattaggaactttctgaagaaaaagtggtgtgtaaaacatctgatatttaagacaataaagtttttatcataaga

SEQ ID NO: 510419 - DNA, 124 bp, Homo sapiens
atatattaaaatatataaaagggtagggatacattgtatcatagttgataatgttgagattgttattatacagcagggtacaatggtagtgctaatgcaacagggaccatggaagttagtctaa

SEQ ID NO: 510420 - DNA, 138 bp, Homo sapiens
actcaggatcagctgctggctgctggccatgattctgtgttttttctcagccctcacaaatcacctctattcctagttacctatgaccaacagattcctggactaccatgaacttcatctattttccaatctaatctg

SEQ ID NO: 510421 - DNA, 1141 bp, Homo sapiens
gccagcgtcgatcctcccctcatccccaatttctcacatatccaaacccacacccttggtgttcttacattagaaaaaaaaacggcatatgaacaattcaatgggatggaagagggacgggcgagagcgcatagatactaatacgactcactatagggaacacttggacaagaaggggggtacacgcctagagggccctcgggggagccctagtcgccgcgccagaggatgaacagcgagcgggaccaaaaacagacatagtgagtaagacccacgctcgcgcagcacaaacaggagatgaagacaacacaagagacaacagacagagtcaacaacaaacggcaccgaggaacagaggaagaactggctagcagaaagatgaaggcgacacaacagcagacacccaactgtaaatgctggggactcaccgcagcgaaaaaacatggagccagaacaagagcagcagaaagcgacgcacgcacgccacagcagcgaggacacaataacggaagaagagagagcccaaagtgcccgcaccaaccacataaccaaaaggacaaacatgcacgcggcaaagaaatgccgataacataagaagttcacgaccaagacaggcagcaccgcagggaatgacaacgagacgcccacacccaacgagagggacgaagaaccaaccacacaatggacaaacaactgccatgcagacaacccaccgcagcaagagccacacaccgcatagcagagcacaccaagacagcaagcacacagcacagagcaagagatagccgcacagcacgaaaaacagagcaccagagaacagaagaagcacaccgaaaagcgggatgcaccacgatgagccgagcaaccaacaatacaccagccagaacggacagtcaaccagacacagagcacgcagacggacccgacgacaacaggcagacgcacgcgcaccaagcaacagaccaccacacgcgacaaaaacaatcttgttactatccactatacctcgagccaacgaaaaggagaagagaacaccataaagacagcgcgaacagagaagccagcagaagacagcgaagaacacagaacaaagaccacgagagaaacacggaagcgacacgacgaaactaagcgcgacaca

SEQ ID NO: 510422 - DNA, 409 bp, Homo sapiens
ggatggctaaaatcaaaaggtctgaaaataagtgttaacaagatgtggagaaattggaaccctcttctgctcttgggaatgtaaaatggtacagccactttggaaaacattctggcagtttctcaaatagttaagcatagagttgacatgtgacctagcagttctatccctaagtatgtatacctaagagaaataaaaacataaatccacatgaaaccttgtacatgaatgtttatagcaacattattcttaattgctataaggtggaaacaaaccaactgtacatcaattgctgaaaacaaattttattatatccatatgatggaatattattctgccataaaaaggaatacggtactgatacatgctacaacatagatgaaccttgtatgctaagtgagtcggtcac

SEQ ID NO: 510423 - DNA, 264 bp, Homo sapiens
  misc_feature (20)..(20): n is a, c, g, or t
  misc_feature (111)..(111): n is a, c, g, or t
  misc_feature (118)..(118): n is a, c, g, or t
  misc_feature (244)..(244): n is a, c, g, or t
aggatcccctgtctgtcggnagccacatggccgtctcatgctgctcgcttcgccgagcgcggcttcgtcgacacgcctatcagctgacgacgaaggggctacgagtacttnaagctgntccgcaggggcttcgagatgttctctgtactgccaggatcgaggacttgctgcaggagcgtggcagcgaagtttcacacatagtcaaccatgccatgcaggttgccctggagggcgatgccgagcnggctgctcagctgatcagcc

SEQ ID NO: 510424 - DNA, 258 bp, Homo sapiens
tgggcaacctccctttggccccggggccctttgtggaccttggctccctccgtggacctgggctttgtggtgaacactgcagcctccctgggcattccctccagggccagcacccctgcaacatataaacctgagggctattgtattttggcttgggggggaagcttttcaatggggaaaaatgctgtttttttgacaatttaagggattgttttgtttactgtaagtttgaaaataaaaattaagaaaaaaattccc

SEQ ID NO: 510425 - DNA, 144 bp, Homo sapiens
ttgcctccgttgtgatcctcccacctacagctcccaaagtgctgggattataggcgtgagccaccgtgaccatcctaaactatagctcagttttaatgctactctaccatttctattatgtatatgtttagcatgtaagaataa

SEQ ID NO: 510426 - DNA, 1680 bp, Homo sapiens
  misc_feature (391)..(391): n is a, c, g, or t
  misc_feature (457)..(457): n is a, c, g, or t
  misc_feature (634)..(634): n is a, c, g, or t
tggaaatggagtcttgatctgtcgcccaggctggagtgcagtgacgggatctcggctcactgtgcaaccttctgtgcctctcccgggtttcaagtgtgatttctccgtgcccagccctccgtgagttagcgtgggaattataggcgtgcgccaccacaccgtggctaattttggatatctcttagtagagctcagggttttcaccgggtgttgggctcaagcgcgtggctctctcgaaacctcctgtgaacctctcgtgtgaattgtgccctctcctgtgggggcctctccccaagagtgtgctgtggggatatatacgagcgcgtgtgaagccaagcaagtgcctgtggccccgaggggggactcctatataatgtgtgagtacgccctntgaggaagaggatgtgcccgcgtggtgtgtacagatctcatctccattctcagtgtggccacacanaactttgtgacaaagcgtcttctcacacgcgtcgttataaacgtgtgtatatctccctctctgtgtggcaatatatatttaaacttaagagggccaaatttattctttctctgagggccccaaaggggtctctctccacctgtggagggggggaacgccagtgctccgtgtgtctcnactcctctttataagagtttacacactataaaatttacctctttatataagccgattttgttgcgaagaacgaggcgcctttaaaaaatatttatcgtggaaagggggggtgggggttgtggcccctttcccaaaaaacctgtgtgggggggggtggttcccctgcgataacaggggtggcgggacccagagagaggaaccttgggggggacaacgcaaaacaagcaccaccaaggcggttattacgacgcaaagacggaccactaccaggcggggcaccccccggtgggaaaaaacgcaaaggggggttccaacgccattattggtggaggggaaatcccctgtggcacagaggcccctccattgaaagggtttccccccctataatggtatatttatcatacttcaacagcaccacattttggggggggggagggtgggtttctcctccgaaaaaacagggcgggggaacattcgtcggtctcacgggggcgtccgccacagcggaaacacacctgtcgttggggggcgcgacagcggggtgtgtcatgctgagaagaacaaaaccctctcttgcacacacaacggcggctctgtggggtcgttcaacatataaaccacagctgggtcaaccgcggagaataacagcgcggcggggcgcctcgtcaaacatatgtgtcctttctcacgcatataaacagcctctcctagttggtgtggttctaaaaagcacaggtattgtgtgtgccgccggaggtgatccacccctagccgcataagggaggggcgtccccacccacccaggaagaagggggagcaaccaacgcgggcggcttcacaacaagacacacctgtcgccgggagcagaggggggaaagaagaactcctcctgcttacagaaggaacggacagccgctctctaacaacacccaacaccaacggctggcggggggggggggcgagtcccacgccacacacatagtgatggacatggcaaggtagacgttactagtgagggacagagagggaccacaccagccacatca

SEQ ID NO: 510427 - DNA, 1422 bp, Homo sapiens
  misc_feature (324)..(324): n is a, c, g, or t
ggttcatatgctgtcgttgcgaagctcgctcccgagcatcaatcaaaggtagaggttcatgactgcttggcatgtcatgtggatcccagaactaacatgctagacttgaatgcgtgcaggtgggttggagatgtatcagactatggaacctgtattcctatggatgcatgtgtctcctgtgcaattccatcggttctgcaagatttgcgcacacgtcggaacaagcgtagagccatcgtaatatcccggtcgtatcgtacaaacacgttcgattctccgtctgtacactcgggggcgagagggctcaaattgaaactccctttnctatttctgggttgaacagacgggttgctcgaggtcaaacccgcagggactggccttttcccggagaagcgaacttacagattaggtataaatacagaaaaaaggttcccgatgctcgaaaggtcgtagtcgtcgaaatctacggaacagacctacaatgtgcccacgtgaagtggcgagataaaccgtgttaagagctttgtcacgcgaagagaaggcacttacgggcgcaactacagcgcactttcttactaacacaatggtttccgcaatggccttgattagcgctttttatccctacagaagttgccttgcctacctgcgcaaattccgaacttttttacgcccattgtcctagcgtgcaaagccgccttaaccgcacaggaaacccggacaagatatagcctcactgcggtgaggtctgccgcgacggctcactgtggtttacccttcggacaatcgaatattaacgcccaatttaattcctattagcctaaggtttcgcttcggatttccaccattctttcctttgaaagacaaacacggtaagggtttccgaaccaccaaattaccagtgtttttgccgccgttggaaaactactccccacccgaatttcaccacaacgtcttttgtggtggccctttcctaggggccccggggggcaaacatttaccttgcgggaacggcgaaacacgaagggccaaaagttaagggctcttttttgaattagggcttccgggtaacaccggaggtcccacagagttcccctataatggacaattgggtgtaacggtgctcgatcgtttgggtagagcttcatttgaaagcctacacacccaaccctcaatgagcggtagggtgtctagacagttagggcccctttggaaccggctccccaatgaggaggagtgatttttatgagaaaggcccaagattttggggccatgtaacattgctctaatatctttacaaaaggcccccccatagggttgggcgtattgggacaaaaacaggtgcgcaataacgcgccattacccaccgattttcccatttaccctccaaaaagtagtgttggtgtaagtgacgcgcgtttatac

SEQ ID NO: 510428 - DNA, 375 bp, Homo sapiens
  misc_feature (85)..(85): n is a, c, g, or t
  misc_feature (327)..(327): n is a, c, g, or t
  misc_feature (362)..(362): n is a, c, g, or t
acggggtttcaccatgctggccaggcgggtctcaaactcctggactcaagtgatctgtgcaactcggcctcccagtgtgctgganttacaggcctgagcaccacacctggccaaggtttccttttttcttcctacatagaagtgaggacatgaaatatttgtcattctgtgcctggcttatttcatttaatatacagacctgcaatctcatccattttgtctgcagtggagaggagtttcttcctttttaggctgaataatacttcactgggtgtttataccacagtttcttcattgaaacaaatttcttgaagagcaaatattttnaaagatgtcttgggaatgtggaaactttcacgggntacttgtgcccat

SEQ ID NO: 510429 - DNA, 104 bp, Homo sapiens
atataaagcatactagatactactatcgcactaagttttacggtactatagcatataggtccaatatacaaagggaatgatagcatagaaggcactcggggata

SEQ ID NO: 510430 - DNA, 574 bp, Homo sapiens
cactggtcgtggttgattcagctgaggtgctgtcgtgtttagccagcccatgctcgctctgatccagcagggagaaggtgacacggccgggcaaagggccactcaatggagattgtcaaagtgcaccagtgcagcacacgagatgtacatgtgagagtgtgtgtgccctacaccacgtgccatatgccatatgagtgaatgcatgacaccttgcagcgttgtaaaccataactatatagtgtagtatgaattgcttgggcttgaatgcacgtcaatggtttggtgcttgtgcctatgtgcctccctagtaggcctgcctgtaccagtagcttgccaaatctatacatgatagaaagcactgccatacacttggcccactatgatatgctcctcccatgctctctgcctgaatgctacctgcaagcttcctgcctgttgcctggctcaccagtggcacacatacatggccatgatgtggcttcacactctcctccacatgcctgtgccatttgccagcttagggcacctgtgcttgctgccggagtctttgaatgggcagagcaccagggcggtg

SEQ ID NO: 510431 - DNA, 202 bp, Homo sapiens
ctcatcgcgtggctctttgtgtggctcgttgtggggctccttgtgtggcacgtcgcgtggctcatggtgtggctcctggtgtggctcttcggggggctcttagtggggctcatcgcgtggccctttgtgtgctcttcgtgtggctcgtagggtggcgcattgggtggctcttggtgggtggcgcattgggtggctctaggtg

SEQ ID NO: 510432 - DNA, 706 bp, Homo sapiens
  misc_feature (385)..(385): n is a, c, g, or t
  misc_feature (689)..(689): n is a, c, g, or t
ggtgtttggtgctggctcctggggacgtacaaatcccacgagtgcggtgtgcccggcctcagtttctcgatagatcccgcttgcggggatggtgcgtgtatggttacagagtctgtgcatcttgggacactgtagtagcccaggtcggcttgtcactcgctgtgagactggggagattttcgtcttctagatgtatccctgtaggcgctggcagggttgtagatgaaggtgggaatgatctgagccttggttccgcctgacacgtcttggctagctcccagggttagacgtgggtcaggtgcagagcccgcgcagcaccttgggagcggtacctttgcccttgggacagacctggggtctccaggtatcaatgccagcggcgagntggcactgtctgcctgagcatgggtgtggccaccagaagagctgaggacgtgtggagctgtgcagtagagcttcgacgggcaacggccaccacgcgggggcgctgtgtgtggtggggcttggcaatgtgatgtgcatgctccaggcatgccgctgctctgtatggctttcttcggcctctgaccctgctgcccattctttccaacatcacagatgaactgcctctcctcctcctcgcctggggagcccagtggccagggaggggagtggtggagccagtcgctgtaacactgagcctcagagantacccagagcgctgggc

SEQ ID NO: 510433 - DNA, 340 bp, Homo sapiens
acgcgggcccattcggtgagtgagcatggtcatctctgttatcctctcgaggatccgtggataattgagatcctgtttgggtgcatcaaccaataatcccaaggcccggtcgggagaacccgaaacgatgtctgagaccacacatccagggatgggccagttctcgagagatcatttactgggattctaagcgaccaggagtcccaagcagagttactcatcattagatgacgctcatgatgtgttcaagcaacgaatccttagttgtccaatagggtgactggaactttcaagcatgcatctcctaattctgcctcccgggttcaagccattttcctgc

SEQ ID NO: 510434 - DNA, 499 bp, Homo sapiens
ttcagaggatctccatcaaccctaaatttattatggagccaaactaagcttcacaagtgaaggagaaataaaatcctttacagacaagcaatgctgagagattttgtcaccacaggcctgccttataagagctcctgaaggaagcactaaacatggaaaggaaaaactggtaccagccactgtaaaaacatgccaaattgtaaagaccatcggcactatgaagaaactgcatcgactaacaggcaaaatgaccagctagcatcataatgatgggatcaaattcacacatgacaatattaaccttaaatgtaaatgggctaaatgcaccaattaaaagacacagactggcaaattggataaagagtcaaggcccatcagtgtgctgtattcaggaaccccatctcacaggcaaagacacatgtaggctcaaagtacagggatggaggaatatttaccaagcaaatgacaaacataatacatttagggttgatggggtacc

SEQ ID NO: 510435 - DNA, 100 bp, Homo sapiens
gcagaggaaaaatcaggaatttcttgagggaacacatctgtggggaaaaagctggaagccttttacctttctggtgctcctggaactggaaaaactgcct

SEQ ID NO: 510436 - DNA, 117 bp, Homo sapiens
gcttttattgagacagggtctcaatctgtcactcaggccagagtgcagtggtgtgatcacagctcctcttatttctcaacctcccaagctcaaacaatcctcccacctcagtctcca

SEQ ID NO: 510437 - DNA, 224 bp, Homo sapiens
  misc_feature (1)..(1): n is a, c, g, or t
ntccggcagatctgcgtttattgtcaatctgtgatcacccgtgtagaggcccatataccgagtcattacgggagaggagagaggcgtggactccaggcctgacccacactggagctgagtcctcacacctcgcgtgaaggcagagtatctttgagcacatcagcttcattctgcagaccagctttggctacctggaacactgttcaggattccaagacctcggg

SEQ ID NO: 510438 - DNA, 201 bp, Homo sapiens
gctatgaagtcagtaatactgaatttgagaggtttgtgaactcaactggctatttgacagaggctgagaaggtttgcgacttctttgtctttgaaggcatgttgagttagcaagttaaggcccatattcaacaggcagttgcagctgctccctgtgtggggtacctgtgaaaggcgcctaactggagacacccagaagggg

SEQ ID NO: 510439 - DNA, 344 bp, Homo sapiens
gtcattcctgccaaaacctataaaaagtcaaaagcatcagctgggtttggtcgcccacgcctctaatcttagcactttgggaggctgcagggggtggatcccttgagcccaggaattcaagaccagcctggggcccctggtgaaaccttatctccacaaaaaaatcaccacattagccaggcatggtgacacacacctgtattctcagcttcttgggaggctgaagtgggaggatcacctgagcctgggaggccaaggtgcagtgagccgtgattgtgccactgcactccagcctgggcatcagggtgagaccctgtctaaagaaaaaaaaaatcaaaaatatc

SEQ ID NO: 510440 - DNA, 474 bp, Homo sapiens
cccgggacatcactgcagtgtagatgcatgtggtgaagattctctcatttgtaggtctctgtttaatcccgttagtttgttttgctgtgaagaagttctttatttaattatgtcccatttgtcaactttttcttttgtggcagtcgctttgggcatcttcatcatgaaatacttgccaggtcctatgtccagaatggtatttcctaggttatcttccagggtttttttatctttaaatttttacatttaagtctttaatgcatctaaagtttatatttgtatatggtgtaaggaaggggtccagtttcaatcttctgcatgtggctagccagtaatcctagcaccatttatcgaataggaagtcctttcctcattatttgttttggttgattttgtcaaaaatcagatggttggccaggcgcagtggctcacgcctgtggtcccagcactttgggaggcttgcaggtggatagt

SEQ ID NO: 510441 - DNA, 361 bp, Homo sapiens
ggcagagtcaaatcctcacatatcagtgttaaccttgaatgtgaataggaaaaatgtcccacctaaaaggcacacagtgcaagttgaataaagaagcaagacccaactttctgctgtcttcaagagatccacctcccatgaaatgacatgcataggatcaaagtaaagggacacagaagatcttacagcaaatggaccaccaaaagagcagcattgctattctatttagacagatagactttaaccacattatcaataggacaagagggcattacatatgataaagatcacatagaggcccactatctcatatatatacaccccactgtggaccagttcatacgaggtctcggccttgagg

SEQ ID NO: 510442 - DNA, 1193 bp, Homo sapiens
gttcaatgactggttgatgagtcaggagtgagattctttaccaggggtgcagtgccattcgctgtcctgaattctcggatcgctatactgcgctaccgttttgccaatgtccacactgtgaagggcatcggtagtattcgggccctcatatatgacattctgaagtatgaagaaaatcaaagggtctcctttctaggctgaggagaggtgaatgaatttagcacgtgtaccgcggaaggtcgcgcgtaatcagttgtccagggagccctctaaggactccgatacggtagcgtcgactggggtcgcgtgcccgtaagataatagctttgtcacgcacagataacgctatcgttcaggtgctagcgaccaggtcatgtcaacgtggaactcgataggtggagttccagactgcgtcaatccaccacccggccgggatacgtacgataggaggcacaagtgccgcgaatcggagcgcaccatagcctagtccttctgaccgttctgtggcacgtctagaagttcctaccaacgcataaggttgaggccttgatcattgggacgtgcacatgtttgcttcaactgtaggggactttgtggtgcgacaagggttatacgctacgagacacgtttggatccaggacctatctccctgaggaaggggtacgaatagatccggccacacggacggacagagggactccaacgagacttctctaagttaaagcgggggaaacgcaaggacacgcggcagtatacatctagaagagcgttaacgagttcaagcccggcgggcgtaatcaaagacaacctttgggggcatacctgaagaggggctctggacttgaaaattaatccaacgaaggaaatggcttgccatttctatagagaaccaccggctaatgtaggaggtcgttcccaattgttgttgctttgggaagcgccgcctatattttagaaatggcaactcttgttatagcaggattaccccttacagattataggcggtataagccccttttggagtccgaattaaacccgtacacccacttcggatttgcccccccttttggagataaggttggttagaccgaagggaaacccaccacgagtgcggacgaaagactacgacgagactcgcaacgtggatgggcgccacacgcggcgaggacacatcttgtggggagcgcattaag

SEQ ID NO: 510443 - DNA, 741 bp, Homo sapiens
  misc_feature (4)..(4): n is a, c, g, or t
  misc_feature (24)..(24): n is a, c, g, or t
  misc_feature (247)..(247): n is a, c, g, or t
  misc_feature (442)..(442): n is a, c, g, or t
  misc_feature (446)..(446): n is a, c, g, or t
  misc_feature (462)..(462): n is a, c, g, or t
  misc_feature (473)..(473): n is a, c, g, or t
  misc_feature (477)..(477): n is a, c, g, or t
ccgnttttccgaaacaccttatgnggcctgtacctaatgaaccaatttttgagaactatatctagatttaaaattccatgtttcatatacatttggcagaatagtttctttcctttaaccaaaacttgatcttagaaatgaaatagtttagccttcagtatttgtaattggatcctcaagggtttctaggaatatctggacaatttctcatactctcatattctacttttttttaaaccatcagccnagagcataagtaaaatttttcatagtatgttttttacctatttatttattaagctatagtgaagtaaagttaatttggggggtccatttttcagaactccaaaattagaacctgatgaagtataataaattgaaaacaacattttttatctgaatgtttgatgcaactgtgtttcttgtttctcagttgaacctnaaangtatatttctttcatnctagactgagntganacaatgcgggttctcaagagccctgggacacagtgacccttgtgtcccagcatccaaccccacgggccggcaccccactcccccctacagacattcattcctgccttcatctttgccattttacttctcttttggaatgccattccttcccacctgtccaaattccaagttcgtgtctataaagaataactattccagaccacagtgatctctttctctgtgtcccagttacataatccttataattttacacatgagaaaact

SEQ ID NO: 510444 - DNA, 1212 bp, Homo sapiens
  misc_feature (477)..(477): n is a, c, g, or t
tctgtacccctatgatggcatccacccggacgacttgtctttcaagtaaaggtagagaagatgaaagtcctggaggagcatggagaatggtggaaagcaaagtcccttttaaggaagagagaaagagaggcttcattccccagacaaactagtgtggaccaatactcaaggacctgtagaaatgcagaagagctggcttggtcaaggtatataaactcgaggcaaggacgcagacaaggctggcttgtggggcgccaggaatatagcagcatggatgctttccttaataagaggaaacgtgagaagctacttaagagaggataggcgttctcatcgtgtactgtcatgagacgttttgaaccctggtgcagtggtgatggtgtattaaaggcatcatgagcaacatagttagaaggtctggaatagaatcggtgggcatattacatctgcatccacgtaatcacttgttgcacctgntatcagacgacgatgagttaagatcattgaccgaataagcatggctagatggctttgtgcacgatagattggacgaaggctatgtattgagtcccgaagcctacgagaagaccatggcgataaacgagtgccatgggaggatcccccgtgagtccatccatgtcggtgaaaaggctttggtgcgggtgcagtgtggggaacggtctggatgggttactatatagcaatagtaccatagggtgggtgtggaaaaacctgagagccaggaactatgtctgtgcatagccttgctggaggaaggccaatactcatgaaggaccctggcagcgtgacaagctcgtgaggctctaaggtgtgagtcccaggggaggagcccgtttacgtcattaccgggtacggtggcaggcagttgctggtttcctgaagacgatgcagtggccgatggggccgttccaaaaggcatatggattccggagccaagatgcgggggaaatgtgtctattcggcgcgggaaaaagtcaattcccgggggccggacacaggcaaaggatgggtgccagaccctggcgcgaagcggagagagcggcgaaaaaagaacaagagagcacacaagagaggggaacgccaaacagaggcgaacacaacatctgtgtcagcaaagaggaggagcgtcctaggagagtaaaccacaaagcaacgaacacacacagacgagtacacaaagagagatcagga

SEQ ID NO: 510445 - DNA, 104 bp, Homo sapiens
  misc_feature (46)..(46): n is a, c, g, or t
ctagagtaccctttctctgatcgctcccccgttatgaggccattgncctcgtacgggggggggggagcgatcagagaaacgcgatcagtgagcgatcagagaaa

SEQ ID NO: 510446 - DNA, 139 bp, Homo sapiens
tgtagctgaccttgatttcacgcggttctcgtataatcgacaatgtcagtcaggtaatcacagtcctatagtggtactgagaatcaaaagcagagctcatatagccagcaaccatataataaccaggaacagcagcaaa

SEQ ID NO: 510447 - DNA, 347 bp, Homo sapiens
accaggacggggctcacacggatatcctcaggctgagaagcagcgtgtagagcgagccagctccactccctgggaggaggaagagagtcatagaccatactcgcgcgggaaaacaaagcgtggaggtgtctgctgtccgtcgtgaaggcgaacaaacccttcaaaagtgtcccgtacctgtgcctctccttattggtagacaagcttgacctgtttctgcagtcaagtctgttatatgttgtgttgttcacagtatatgaggaaaatccagtctcacacagacatacagctcctatgacagatcatcttcccaaggttaggttccaggtaatccagctcatttcttt

SEQ ID NO: 510448 - DNA, 551 bp, Homo sapiens
  misc_feature (162)..(163): n is a, c, g, or t
  misc_feature (197)..(197): n is a, c, g, or t
  misc_feature (429)..(429): n is a, c, g, or t
tctttgtggggagagagggcaccaccccccctcccacaaaaatatttccccgggcgcgtcccttaaattttttgcgcgcccggggtgttctctcctccaccctttttttttctttcctccttctttttatataagagaaaagaaaaactccccccctcctcnncaagagggcgccgcgcggcggagagagagaaaanaaatataatttttggttgtttttcttattccacccggcgggggggggcggggagggaggttttcttctttcttgcgggtgggagaaaataatttttttataaaaaaaaagaagagaggaggggcgggggggggccggcgccccccactttataaaaaataaagaaaagaaggggggtgtgttttttttatataaagaggggggcccccccccccccccccccgttttgcttnttaaggaggggggcgggggggaaataaaataaaagggcggcgcgctttctataaaaaaaaaagaaaccgggggggggagagaggaaaaaaacccccccactccccgctcgcgcgggcggggg

SEQ ID NO: 510449 - DNA, 424 bp, Homo sapiens
ccttttggaggttgtaatgactcatggattggccttagataccatcctgagggtctaaaatatgggcatctgtcaagcaaggttcatggatggtgaactcagaatgaagatactatcacctaggggacaaaacactgatcatcatagcaatatccaggtgtgtatgaaataaatcatgcagattgaccccagcccctgttggttagtggctgccagtgtggcacatttatgtcaaaatttaccagaagccaagatgatgtaggaccccaaaggtgggttgttaagagatgctcctccaagggtctcttctgatcccacggatcctgcagagcgtgtcaggaatgaaaccatccataactgccagtgccctttcacagctgattatttctgtgtccccttgtaaaatctaagaagtgtgacagca

SEQ ID NO: 510450 - DNA, 586 bp, Homo sapiens
cctcctactcctcattgtacccacttcgtaatcgcaatggcattcctaattgcttaccgaatcgaaagattctaggctatatacaacatacgcataaggccccaacgtagtatcgcccctacgggactactacaatcccttcgcatgacgcctataaaactcttcacctaaagagtcccctaaaacccgctcgacatctaccagtcaccctctacatcactcgaccaccataccttagctctcaccatcgtcgtcttctactatgaatccctgaatcccacatacgccaatcccgttgtgttcgacctgaatccggaagggtccgtcgcgtatattggagttcttagacgctactccaacgttaagcgcatgatggcttcgcttttgaacgttcatagtacctcatgcattcgagcggatgtaggccatgctgacacgtgcgacaccccgtgaccggcccctgtcatcagcgtggcgacctggcggtagacatggtgaggccggccagagactagatggtccatcatgaagagtcttacaccgtttagcccatcgattctttaattatgggaaagattacgtaacg

SEQ ID NO: 510451 - DNA, 210 bp, Homo sapiens
agctcggtcgtgcacacatactagctaatttttgtctttttaggtagagacgggttcaccattttgcccaggctgatctcgaactcctggcctcaagtgatccacccgcctcagccacccaaagttcaggaattacaggcgtgagccaccgctcccggcaaggtttttaaaaaaattataagatgattatttttaggaatttggacaata

SEQ ID NO: 510452 - DNA, 1070 bp, Homo sapiens
  misc_feature (139)..(139): n is a, c, g, or t
cataaaaataagataattataactaaaccctgagtaaccaaaatgaacgataatctgttctgcttcaattcattgccccactactaatcctagagcgcgtacccagcgctgcagtacatgatcgattcatatttccccnctctattgatcccctagctccaaatagtctcatcatacaagccgtactaatcatccactctcaaacctacaatgacgttaattcaatacttaagccatcgaatatacaacattgagtcacatccataacaacaaccaacgtacataggcaccgataacctgcactcatacttagtaactgagtattcgcgttcacactccatttgtgtcattcgaccacagactaaactctcctcaggacgtcctgaccttcatcatcactttatcacgctaatccactccgaactatcgtagtaatacactagccattggcctatcccctttattgagctgggcgcagtgacttatagcgctttcgtctctacgcattcataattgccctagtcccaggttcttaccacaaggcactaccttacagccctttatccccattactagtttattatcgaaatcattcagcctactcattcagatcaatagccctggccgtacgcctaaccgctaacattactgcaggccaccgtactcatgctacctcattggaagcgccacctagcaatatcaatcattaaccttccctctacacttatcagtcttcacaattctaattctactgatgatcctaggaatcggtggcgcgttaatccaggctacgttttcacacttctagtaagcctctacggccgagaaccattaaaacaaacacacagagaaatccagcaacacacaagagcgacacacaaagaaggcgcgcgcgccaaaaactccgggaggcgcccactttggacccccgtttttgtaaaggggcccaaagagcgccttaaagcagaaacccgggttaaacactcggagaaacgtgcccgcactggaggacacatgggggaccacggcgcccgcgagacccgcggaaaaatgggtggacccacgcgaga

SEQ ID NO: 510453 - DNA, 222 bp, Homo sapiens
  misc_feature (119)..(119): n is a, c, g, or t
  misc_feature (129)..(129): n is a, c, g, or t
  misc_feature (131)..(131): n is a, c, g, or t
  misc_feature (169)..(169): n is a, c, g, or t
gtggcacatgcctgtgggggcaacaactcagaaggctgagatgtgaggttcacctgagcccaggaggtcgaggctgcatgagcggtgattataccactgcactccagcctgggcgacanaatgagactntntcaaaaaaataaaaataaaataattattaaaaagacgnactgcaaaggtcatctgagcagtaaaatattgagatggctttatttataattt

SEQ ID NO: 510454 - DNA, 162 bp, Homo sapiens
gtgttaccaagtttatatgtgacagttgaaaagaaattcccttgaatgatcatgaggttaaaatttcttcattaggggacttggagaccagtagtcgtaagattagttgatagtttcactccaagaatgaattcctctgtgtgtttccttaggactcaatag

SEQ ID NO: 510455 - DNA, 353 bp, Homo sapiens
acgtacagtgtagcttctcggattatcatcactgagggtggaagagggagtgagcagacacacgctggaggtgtcttgagattatcatccgctgagggtggagctgagggtggaaggggagtgagcagacactcggaggtgtcttgagattatcatccgctgagggtggaaggggatagagcagacactccgcaggtgtcttgaggctcagggagttatcagttatagaatgttgttgagttggaggaggtggctggtggcccatcctgtcttttacagtttcagctgtgaggtagggccagcagggcaatcctgaagaatgacgatgctctgctgacgccaattctgacccg

SEQ ID NO: 510456 - DNA, 491 bp, Homo sapiens
aactttcttcgcatctgtgcacggggcccccaggcagataggaggtcctcccctctcctctccacaccccgtgctgccccctcccggggtggggttgggggggtggatgtggactaactgggagccggcccgggtaaatgcatcccctgcccatccctgcagatgggatgaagtgtcagacagccatagaggagtcgggggtgacacggcccctgcactctccccaacgcccgacgcccaacctcgacgccgaaaggccactgggagcaagtacacgggcaactgggcggttgcagcccccagcccaaaccaccccaagtcgcggatacatcacaacttcaagggcgactccacaaacgattcatgacccaacggaaagggtccacatgccatgtgcccccccagcagccatcgagtcgcgaccaaacgccagggcagactgccgcggcacgccgccagcaaatgccccgtaaggcgcccacccccgcccg

SEQ ID NO: 510457 - DNA, 217 bp, Homo sapiens
  misc_feature (168)..(168): n is a, c, g, or t
  misc_feature (171)..(171): n is a, c, g, or t
  misc_feature (196)..(196): n is a, c, g, or t
ctgaaaaccatttgtatgtgtattctctttgcccagtttacttgtatttacctttcagaactcttctcaatgcctcatcctcacaaaatctttactaggctcctcactcctcaccacaactcaggtaagatagtccctgttaaattttcttggcacgctgtatttctnctnataaatatttatatttatagcacanattaaaatgttttataaaggg

SEQ ID NO: 510458 - DNA, 358 bp, Homo sapiens
  misc_feature (37)..(38): n is a, c, g, or t
  misc_feature (42)..(42): n is a, c, g, or t
  misc_feature (51)..(51): n is a, c, g, or t
  misc_feature (108)..(108): n is a, c, g, or t
  misc_feature (240)..(240): n is a, c, g, or t
cgcgtacgctcgaaaatgtgttccagccgcctttccnncaanccatgctgntccctgtgagccagtctgtgcaaggaggcctcccagagagccaggacaggacatctnccatagaccttcagcaacagttgcatcatggatttgtttccactggcctaagaaaggcaggggtaaagatcccagtagttccctaaagcaggtagaatatgagggagttcattctccttttcacttattganttgacatgtgcctaagagggtatcagcagaacaaaattcctgcttcagagacttataatttatgagttcctccatttttatttctcaaaagaatgcgactcagaactagaggatagag

SEQ ID NO: 510459 - DNA, 408 bp, Homo sapiens
  misc_feature (400)..(400): n is a, c, g, or t
aggcgaacacaggaggattacttatggccaggcgttcaagaccagcctgggcaacgtagtgagaccctgtctctacaaaacagtttaaaaattagccaggtgtggtggtgcacctgtagtcccaatggctcaggaggctgaggtgggaagattgcttgagcccaggaggttgaggctgtagtgaaccatgattgtgccagtgcgttctagcctggatgagagagtgagaccctgtcttaaaaataaagaatattttttcttggctgggagcagtggctcatgcctataatccaaggactttgggaggctaaggcaggaggaatacttgaggccaggagttcaagccagcctgggcaacatagcaagaacccatctctacccaaaaaaaagaagaaaaatnttaaacaa

SEQ ID NO: 510460 - DNA, 361 bp, Homo sapiens
ccaatttttttttccaaaaagaaaaggcaggggggtgtgagtgggtgcattttttaaagctgtcttgaacacctatttaaatgtgtgttttggggtgttttttttagggttttttttttaagctgcctgtgatatgtccactgggctgagattggaggcctcaggcaggagcccacccatagttctcttccctatgacgacttccccagatagcattagccaccctggggggcagggggggaagaatccggctgtggggtatccacctcgcccaagtctccttttactgaaataaaatttgaggggaagagaaaaaacttacacgagcaccgaatttcaaataaacgaaaatgagacatga

SEQ ID NO: 510461 - DNA, 374 bp, Homo sapiens
  misc_feature (139)..(139): n is a, c, g, or t
  misc_feature (224)..(224): n is a, c, g, or t
caggccggggcctgtgcttcctcctgcgcctgacatactcccaggctgtctcccggcaagaggctctccttagcaggcatgcggtaaagcatggtgctttaggtcagctggccgggtccatgtgtgcgggcacctatgngccttgtgagcgtgcaggtgtatccacgtgtgagccatgcgcttgcactgtgtatatgtgcacatgtatgtacacacgtgtgcanacatgtgtactgtgctcttgcacagctgtgtgctgtgggcatgctcacgtgtgtgtgtgtgtgtgtgtgtgtgtacgtgtgtgtttgtatgctgtggcaggtgctttctgggcgtttacccgcccgcgaatttagtagtagtagtcgccc

SEQ ID NO: 510462 - DNA, 247 bp, Homo sapiens
ggtgcgaaggacttatcattccgccgcaacatctgagctggctctctgttctccccgctggggcatcaccatggtcagggggctgagagtgacccccacgtcaccgagcctctcatgggaggagttcccgagacccggctggaggaggagcgagagcgtgagctgccgcctccagcaccaccagctggcatcacccgctccaagtgcaagcacgagctgaaactgctggagaagattcctgagaatg

SEQ ID NO: 510463 - DNA, 380 bp, Homo sapiens
agtttagaaactggcccaacttcacattcgggtaggcccaggggcatcggcgttctcttacataccccttttccgaacaggcatttctgctctcagtgtggtatcctccctcccacaaatatttgcacctggcatagggcgtgtgcacgggcgctatgcagcctgagtgttccagaagtcctcgtacaccttgtgcacagttgatgatcttcctccgtggcaaactttgcagctttaggtttttggttcccgtaagccttcatcagctcgcgagcctctcagcccaagagccagagggataagtatccgtatcatagtttcgtgtgtccacagctgtccaagtgtgtatctgcacctctgcgcagaacgttacaccgcct

SEQ ID NO: 510464 - DNA, 124 bp, Homo sapiens
taatatcttacgaaagtccagaaagacatggaacagaaggtgactggtgtttctctgagagagaggcggaggtgacagaagagttgaggtttccatatgtcaatacagtatcaatgtttaatta

SEQ ID NO: 510465 - DNA, 170 bp, Homo sapiens
tcatccaagcgtaacatacacaaacacaatatacaatccaaaatagatatacagcattctggaataaagcacagagtgtacacttcacacacacagacagctaacaaaactgtacgatctgtttgctccccatgtagttttctaaacgatggacaaaccgggcggacgct

SEQ ID NO: 510466 - DNA, 462 bp, Homo sapiens
  misc_feature (21)..(21): n is a, c, g, or t
  misc_feature (76)..(76): n is a, c, g, or t
  misc_feature (153)..(153): n is a, c, g, or t
  misc_feature (180)..(180): n is a, c, g, or t
  misc_feature (312)..(312): n is a, c, g, or t
  misc_feature (423)..(423): n is a, c, g, or t
  misc_feature (437)..(437): n is a, c, g, or t
ttactaatctaggcacagcgnagtgtggttactggactaggcacagcgaagttagttactaatctaggcacagcgnattggttactaatctaggcacagcggaattagttactggtctaggtacagccggattagttactaatctaggtacanccgggttggttactaatctaggtacanccgggttagttactaatctaggtacagctggattagtaactaatgtaggtacagctggattagtaactggttgattgaccacactattaggtacaaacaaatgggctcaatatcataatataggggattccngtggcatattgcaaggatattttcggccttatcttgggtcacaagtttttttcaattaactgggaattgaaaacatatttcattaggattttgcagatgacatgaggtccngattacctaggaanaagttgtttggaatggaagttattc

SEQ ID NO: 510467 - DNA, 111 bp, Homo sapiens
ctaggtcgatgcgcttgatgccgttgggccctgataaaaccgcaccatgctcgtttttgcgaatgatgcctgttgggccccatccagctgtgttgcgtcctgtagcggcct

SEQ ID NO: 510468 - DNA, 849 bp, Homo sapiens
aaggcgagagtggtcagtcacaggtgcggaagccgcctaccgccgtgagcccgcggccatgttcgcctgaccggtaacctagggccgaaacgttttgggaacgcgcctggcccccaagggtaatcccctccacacgtgtgtcccgtcggaacgcgtgtccccccaaaaaaaacggctggtcgtgaacaaccctcggaatggtccgaaggaaaacagtggccaggaggcccgccatccattgaccggcccacggcgccattcgtaacactgagccccgtggggcactctcccccaacccgggggtttgtggtaatccctcccgctcgcgttcgcgtaggtagcgctgggaccccccgttcatgttcgtctccgcgtggcgccccgctttttaacaggttctataggcggacactccctcggctggcaccgtgtggcgccaaggacacctggcggcccgttgtttaatgatgccccgcctctctgggctcatatttccgggtccccctgcaagtccccttgtggggacactgcaccgaagacccaacgtggcgctcacacactggcgggccccccgctgtgtgtgaattcacaggcgggctgtggacatcttcaacaatggtgccgccctcaggcaggaacaatcgtggaccaccgcgggcagacaagggggagcgagacacgcaggtcctccgaacaaaccttgaccccgcccgccctactcgggatggcacctgcaaggcactggcgcaaaaacagccggggagaacttcccccccccgacaccccgtgcccccccccctccccccccttcccaaaaaaaaaaatcttcccccccccgcacaataaaaa

SEQ ID NO: 510469 - DNA, 122 bp, Homo sapiens
tgcgatgtcgcgtgcatgttttggtcaatataacattacaccatctaatatgtgactgtgaggtgtgactgtgaggcgtggactgtgaggcgtgactgaggcgtgactgtgaggcgtgactg

SEQ ID NO: 510470 - DNA, 208 bp, Homo sapiens
attagaataagagcttatatgagtgaagactgggggagcttataaagacctcggccagtcatgatctcaaaccaattaggagcaccaagctcccttcccaggtaactgttgggagcaatggcatcactgtatgcccttgtaatggctggacagggacatgatcttgtacagtacggaccacgctgtaactaccaaacttgtacttgtt

SEQ ID NO: 510471 - DNA, 388 bp, Homo sapiens
agaaaaccttccccaaacaaggggcacagtgaataggtcatatgatattcctattattctctattatggaattggtacatcatcaagcagcccctgactgacagcattcgtctcttatccttgtgtgtcattcaaatattggaactatgttacaggctgcagcccgactgtcggaagctgttcatatagttcttggattatatgaagttgtccctatataagcctctacctcaggctaatagttggagtgaaatcatatttacagtcagatgtttgacaggctgtctagtctattcagttgattaatacccatttatttcaatgttaaacctcattatcagcaaagagctgagcttcattatcgaactgaatggcatataattagaac

SEQ ID NO: 510472 - DNA, 2288 bp, Homo sapiens
ggacgcgtgggtcgacccacgcgtccggaagttccctgtgggaggctgttttctgagggagctgagtgtttacagccactcagccctgctctgctcagctgaagcagaaaacagagaccttttgcattactttggttcaagagcaagacaggaggcgactgcatgagaccatggctgagacacctagtcctccaggcactgaggaactccagggcattctgtgggtctcatgggaagccagcacctctacctgttcctcagaagatcgtggccacctgggaagccatcagcctgggaaggcagctggtgcctgagtacttcaacttcgcccatgatgtgctggatgtgtggagtcggctggaagaggctggacaccgccccccaaatcctgccttctggtgggtcaatggcacaggagcagagatcaagtggagctttgaggagctggggaagcagtccaggaaggcagccaatgtgctggggggtgcatgcggcctgcagcctggggacagaatgatgctggtactcccacggctcccggagtggtggctggtcagtgtggcttgcatgcggacagggactgtgatgattccgggtgtgactcagctgacagagaaggacctcaagtaccggctgcaggcgtccagggccaagtccattatcaccagtgactccctagctccaagggtggatgccatcagtgccgaatgcccctccctccagaccaagctgctggtgtcagacagcagtcggccaggctggttgaacttcagggaactcctccgggaggcttctacagagcacaactgcatgaggacaaagagtcgagacccgctggccatctactttaccagcggaaccaccgggggcccccaagatggtcgagcactcccagagcagctacggactgggttttgtggccagcggaagacggtgggtggccttgaccgaatctgacatcttctggaacacgactgacactggctgggtgaaggcagcctggactctcttctctgcctggcctaatggatcttgcatttttgtgcatgagctgccccgagttgatgccaaagttatcctgaatactctctccaaattcccgataaccaccctctgctgtgtcccaaccatctttcggctgcttgtgcaggaggatctgaccaggtaccagtttcagagcctgaggcactgtctgaccggaggagaggccctcaaccgtgacgtgagggagaagtggaaacaccagaccggtgtggagctgtacgaaggctatggccagtctgaaacggttgtcatctgtgccaatccaaaaggcatggtggatgatgagggcaacgtcctgcctcctggagaagaggggaatgttgccgtccgtatcagacccactcggcccttctgtttcttcaattgctatttggacaatcctgagaagacagctgcatcagaacaaggggacttttacatcacaggggaccgagctcgcatggacaaggatggctacttttggttcatgggaagaaacgacgatgtgatcaattcttcaagctaccggatcgggcctgttgaagtggaaagtgccctggcagagcatcctgctgtcctggagtcggctgtggtcagcagcccagaccccatcaggggagaggtggtaaaggcatttatagtccttactccagcctactcctctcatgacccagaggcactaacgcgggaactccaggagcatgtgaaaagggtgactgctccatacaaataccccaggaaggtggcctttgtttcagaactgccaaagacggtttctggaaagatccaaaggagtaaattgcgaagtcaggagtgggggaaatgaggtgcaccccaggaaggccccgtagacctccgaagactccacaagaaactaatggatcactggtcagtccccatggggagcatcatctcttcgaccctaaagatgtcaaaggtgtgcagcttccaaacggcatccccaggatcactgggcaatgctggaaagagcaaaagaatatcattggccctgatcacatagatgctgcgccgcctagcaaatgcttggtggttcgacttctccctctgtctgggggcaggctcagcatctgcccactggtctcactaagagctttcagatttccctccataggacaggttaccatagacttggggcacttgtgggtactcattttctgccagtgggaatgtaaaggcttcatcctttgtatgtaaccatttggcaaaagtatgcaggaacataaaataaaatatcctttagctca

SEQ ID NO: 510473 - DNA, 1859 bp, Homo sapiens
  misc_feature (1146)..(1146): n is a, c, g, or t
  misc_feature (1156)..(1156): n is a, c, g, or t
  misc_feature (1697)..(1697): n is a, c, g, or t
ggaggatctgacaataaatgcgtggtatagtggaatgggcgtgtttatacaatcccgtacccaatcaaaagtaaaggtggtataggcattaaaatattccgagtcagagggtaattcttttcagagccaaaaggcactaacgcgggaactccaggagcatgtgaaaagggtgactgctccatacaaataccccaggaaggtggcctttgtttcagaactgccaaagacggtttctggaaagatccaaaggagtaaattgcgaagtcaggagtgggggaaatgaggtgcaccccaggaaggccccgtagacctccgaagactccacaagaaactaatggatcactggtcagtccccatggggagcatcatctcttcgaccctaaagatgtcaaaggtgtgcagcttccaaacggcatccccaggatcactgggcaatgctggaaagagcaaaagaatatcattggccctgatcacatagatgctgcgccgcctagcaaatgcttggtggttcgacttctccctctgtctgggggcaggctcagcatctgcccactggtctcactaagagctttcagatttccctccataggacaggttaccatagacttggggcacttgtgggtactcattttctgccagtgggaatgtaaaggcttcatcctttgtatgtaaccatttggcaaaagtatgcaggaacataaaataaaatatcctttagctcagaaattctatcttcgggagtcaccacaaaagaaaaaaatcaaaatgcagaaaatgtgtggtgcactaagatgatcacacagcattaaaactaaaaaaaaaaaagaaaaaattaacaattaacatccaaacaacaaggaaatgattaacaaaattgtagtagattaactcaattacatatgatgtagccactaaaatatttgagagcagtttagtatgtcttgggaaaagtgtaagctatattaattttaaaaatcagagcaaaaatattcatactggagaatcccaactctgaaaaataaagggaaaactgtggttaattgtaatcctcctggagattgaggagggagggagagaaaataatggatggtagtttttcttcttcctttttccattacatttctgtattttccaagtttttgtacnaagcacatanaactattttaatgaaaaagttatgttaaagaaagcatactctgcttcatgtctagttcttcctccacatactcatacatcaaccccaaagactgctgtattatgtctgtattagtcagcattctccagagaaggagaagcaataggacatatatagacataggagaggggatttatgatgggaattggctcactcgattttggaggctgagaagttccacaatctaccatctgcatgctggagatccaggaaaccccgtggtataattccatctgagtccaaaggccgttgtggaggctggaggtctaggatcaggggttggcaaggttggtttcattctgaggatgtttccttggtttgtagatcgccgtcttctccctctgtcttcacgtggtctttcttctgtgcatgtgtgtctggggcccaatctcctcttcttctaaggacacctggtatttgtcatatgcctcggctcctcaaactgcagcaaacaaactctatggaagagaaaaaaatgggactccagagacttgaaatcacngccacttgtcagatgcagcccccaactcagctgcaggagcttagccaaatttctagtcctctctgagcctcaatttccttatctataaaatggggctctggatacctctcttgtagagttcttgtttagattacatgtgagcacttctataaaacactgaac

SEQ ID NO: 510474 - DNA, 516 bp, Homo sapiens
  misc_feature (324)..(324): n is a, c, g, or t
  misc_feature (384)..(385): n is a, c, g, or t
  misc_feature (388)..(388): n is a, c, g, or t
  misc_feature (390)..(390): n is a, c, g, or t
  misc_feature (392)..(393): n is a, c, g, or t
  misc_feature (395)..(396): n is a, c, g, or t
  misc_feature (407)..(407): n is a, c, g, or t
  misc_feature (466)..(466): n is a, c, g, or t
tccaggagacagctttactgtgggtcagtgctactacctagcgaaacagttaggtcaccgtgagacatttattgctaggagaacatgtagaaccgtatcatggaacatagccgtctccttttaatgtccccccatgtcagataatgcattatcttctcgtacagtttctttacatcgaaagcatgcacagtggcagagcagacaatcacctgaagtcttgatccatcagaggtacccgtgaggaatctgattgtgcatcctagtttataaaatcagaataaccttaagaaagaagcccattcagcttcatccaggaccaggaanctaactgagataagttcagctttccagttgacaccaagtcatctagtcttcccggagtanntanantnnanntactccatttnccaaaacagagagctgatcccgggctgcaacacctccaatagtcgaagctcccttaatnaaggatatcaatgtatttcttaaacgcttgatgtcgttcaaagtctgttc

SEQ ID NO: 510475 - DNA, 170 bp, Homo sapiens
cctctgcatgcacagttcaaggtccctctttcctggacctccaaagcatttttttttgagacacggttcactcttcacccaggcatgagtgcatgtggtataatcacagctcactgcatgactttaccccccaggcgtctggttatcctcccagctcagcctcttgagta

SEQ ID NO: 510476 - DNA, 85 bp, Homo sapiens
gacagcagcttctacatctgcagtgctagaacaaggacagggggctacgagcagtacttcgggccgggcaccaggctcacggtca

SEQ ID NO: 510477 - DNA, 1741 bp, Homo sapiens
  misc_feature (1028)..(1028): n is a, c, g, or t
  misc_feature (1038)..(1038): n is a, c, g, or t
  misc_feature (1579)..(1579): n is a, c, g, or t
tttttttttctctttcaaaacaaaagtctttttgagaaatgatgatttccaagtgttttttgttttgtgtttggtcactaggtggcctttgtttcagaactgccaaagacggtttctggaaagatccaaaggagtaaattgcgaagtcaggagtgggggaaatgaggtgcaccccaggaaggccccgtagacctccgaagactccacaagaaactaatggatcactggtcagtccccatggggagcatcatctcttcgaccctaaagatgtcaaaggtgtgcagcttccaaacggcatccccaggatcactgggcaatgctggaaagagcaaaagaatatcattggccctgatcacatagatgctgcgccgcctagcaaatgcttggtggttcgacttctccctctgtctgggggcaggctcagcatctgcccactggtctcactaagagctttcagatttccctccataggacaggttaccatagacttggggcacttgtgggtactcattttctgccagtgggaatgtaaaggcttcatcctttgtatgtaaccatttggcaaaagtatgcaggaacataaaataaaatatcctttagctcagaaattctatcttcgggagtcaccacaaaagaaaaaaatcaaaatgcagaaaatgtgtggtgcactaagatgatcacacagcattaaaactaaaaaaaaaaaagaaaaaattaacaattaacatccaaacaacaaggaaatgattaacaaaattgtagtagattaactcaattacatatgatgtagccactaaaatatttgagagcagtttagtatgtcttgggaaaagtgtaagctatattaattttaaaaatcagagcaaaaatattcatactggagaatcccaactctgaaaaataaagggaaaactgtggttaattgtaatcctcctggagattgaggagggagggagagaaaataatggatggtagtttttcttcttcctttttccattacatttctgtattttccaagtttttgtacnaagcacatanaactattttaatgaaaaagttatgttaaagaaagcatactctgcttcatgtctagttcttcctccacatactcatacatcaaccccaaagactgctgtattatgtctgtattagtcagcattctccagagaaggagaagcaataggacatatatagacataggagaggggatttatgatgggaattggctcactcgattttggaggctgagaagttccacaatctaccatctgcatgctggagatccaggaaaccccgtggtataattccatctgagtccaaaggccgttgtggaggctggaggtctaggatcaggggttggcaaggttggtttcattctgaggatgtttccttggtttgtagatcgccgtcttctccctctgtcttcacgtggtctttcttctgtgcatgtgtgtctggggcccaatctcctcttcttctaaggacacctggtatttgtcatatgcctcggctcctcaaactgcagcaaacaaactctatggaagagaaaaaaatgggactccagagacttgaaatcacngccacttgtcagatgcagcccccaactcagctgcaggagcttagccaaatttctagtcctctctgagcctcaatttccttatctataaaatggggctctggatacctctcttgtagagttcttgtttagattacatgtgagcacttctataaaacactgaac

SEQ ID NO: 510478 - DNA, 130 bp, Homo sapiens
taggctccagcttctgtgtcaggtacaggtgcggatacacatgttttcaggctaatcgcccactccgtctctattagcggccttggatgtggctgtcacccctctcgggggcccacaggggtggtcggtg

SEQ ID NO: 510479 - DNA, 1309 bp, Homo sapiens
ggacgcgtgggtcgacccacgcgtccggaagttccctgtgggaggctgttttctgagggagctgagtgtttacagccactcagccctgctctgctcagctgaagcagaaaacagagaccttttgcattactttggttcaagagcaagacaggaggcgactgcatgagaccatggctgagacacctagtcctccaggcactgaggaactccagggcattctgtgggtctcatgggaagccagcacctctacctgttcctcagaagatcgtggccacctgggaagccatcagcctgggaaggcagctggtgcctgagtacttcaacttcgcccatgatgtgctggatgtgtggagtcggctggaagaggctggacaccgccccccaaatcctgccttctggtgggtcaatggcacaggagcagagatcaagtggagctttgaggagctggggaagcagtccaggaaggcagccaatgtgctggggggtgcatgcggcctgcagcctggggacagaatgatgctggtactcccacggctcccggagtggtggctggtcagtgtggcttgcatgcggacagggactgtgatgattccgggtgtgactcagctgacagagaaggacctcaagtaccggctgcaggcgtccagggccaagtccattatcaccagtgactccctagctccaagggtggatgccatcagtgccgaatgcccctccctccagaccaagctgctggtgtcagacagcagtcggccaggctggttgaacttcagggaactcctccgggaggcttctacagagcacaactgcatgaggacaaagagtcgagacccgctggccatctactttaccagcggaaccaccgggggcccccaagatggtcgagcactcccagagcagctacggactgggttttgtggccagcggaaggtaccagagcagcttgtctagaggatccaagaacagaaagtggggagtggtctggagggggtggtgtgaggggaaaggtgtcaggaacggaggtcagagagccaacagaattactgagaagccaataggagcagcttaggaaggatcttgatggttctggattttactctgagtgaggtgaaaagccatgggaggtttctttttaaatcgtggctatatatatatatatatatatatatatatatatacacacacacatatatatacatacatacacatataaacatatatatacatatatcataaatgtacccttttaaccattttaagtgtacagtttaatgtcattaaatacattcacattgttgtgcaaccacaa

SEQ ID NO: 510480 - DNA, 410 bp, Homo sapiens
  misc_feature (266)..(266): n is a, c, g, or t
  misc_feature (331)..(331): n is a, c, g, or t
tagcgtgtgaccctcacactacctgtcctgaatgcagcacgaactgtcatctttgtggcaactggagaagcgcattttggaggaccaggaggaaaacccgctgcccgccgccctggtccaagccccacaccgggaaactgtgctggttcttggaccgagggccgcccgcctcctgaccgtgcccttcgagaagcattccactttgtagctggccagagggacgccgcagctgggaccgaggctacgtggccaatggctggcccctntggccgccactctccgggctctcctttcaaaaagccacgtcgtgctgctgctggaagccgatacntccggccagcaagcctacccggggctcaacacacaggctgtggctctggacatccggatattaaaaggacgttgctgga

SEQ ID NO: 510481 - DNA, 750 bp, Homo sapiens
tgatttgatcataagtttgttgagttattaaccttcttctgtagtgccaaattatatgacgttatctcattaaaaccacacaaaaacttcaatatgaagcaatgatacaaataattacataacacaatagtgaaattcagctgagaaaatcttgccctcgaagttggaagatgttatctcgtgagtaccttgcaaaaagtgcatttgctttctgctgactgcaataacaggcgaataatcccagttaaataaagctactgtacacccctccgtgtgtgcaatttctggcctaacatacagaaaaaatagtaacaggaggcagatacgtaaacagagtaaatagccataggcctatataacacatccttcttgaaccaaacaactaaggtaacatgagctgcaacaaatggttaccacaaagatatcatgtgaagtctattccataggctatttatcttcccttctttcccctccccacagttttgtaaacaaaaacatcatgctgattgaataccttgtacgagcacttggcccaatctccaaacttgaatatcctttttatagaaatcctgtctcaagctcattagtccaggagagaccatccaagaggttcagttctctgagttgctcaacacatccagttatatcacgtcctgacaagatttgcgatttactaaaccttatatttgccgaccagaagtgcttgtgcccgtacattctgacttgtccacaactgtagcgccagttcca

SEQ ID NO: 510482 - DNA, 172 bp, Homo sapiens
ggcctacttggatgattgtcaccggggattagctgtcccactgccgcctcacctggccaaccacacgacctcttctccaagtcatccgggcagtcaggggctactccctcttcactcgtggtaaactggatgcgggccgcaaggggcgttcatctcacctaagcttctttaa

SEQ ID NO: 510483 - DNA, 218 bp, Homo sapiens
agctgttgccgaaggtgactctagaggacccggtcaatttctacacacacacacacacacacccatgtatgtatagttgattcattatttgtggtagttatattctataaagtcacctcaagcaatgaattaccaaataccaagccactgctcctagtggaaatacaggtttagattcctgggagcctctggttgcattccttagtgtagaaattgaa

SEQ ID NO: 510484 - DNA, 602 bp, Homo sapiens
  misc_feature (441)..(441): n is a, c, g, or t
  misc_feature (602)..(602): n is a, c, g, or t
accaccagatggcagttccggtttaggaggccacaaccaggccacccagggggaccaaaccacggccggcggggattttccaaatttccttggaaggtaggtttggttttggccaaagaaaggtctggttggaaaagtttttggagcccaggatgccagcttgtgccaatgactgtaaccttaatcttttcaaaggaaaggccttagccgaggactgtccggggaccccgggggactgcgtttaggccatgggatccggtttccattcctaatccaatccaattggccctttcctcctgccatttccttcctctgtggccctttcaaagtggtaataattggacctgaacttcaaatggtgtccggttttcccaagaccattttagccacagtatatggcattaaaataacttcttatattggcaaaaaaaaaaaaaaaanaaaaacctgtgtcgccgcttgggccaagtcgattctggactggaccaggctaatgcatgcggccgaatttggggcttcttggcccatttggccctatggggagccggattccattcttgcccgtggttttacaccgtcgtgactgggttgccggattaccn

SEQ ID NO: 510485 - DNA, 177 bp, Homo sapiens
tttaccgaactgggtgaatggtgaggtgggtccccttgcatgtgactgcacgacatgcctccccgatctgtatgtccagctggacttggccgaagtacacaggactggtcctccttccgcaggttcgagatcctgagtgaagccgcccttgatccttgctattccctcttgagtatc

SEQ ID NO: 510486 - DNA, 1627 bp, Homo sapiens
  misc_feature (13)..(13): n is a, c, g, or t
  misc_feature (226)..(226): n is a, c, g, or t
  misc_feature (279)..(279): n is a, c, g, or t
  misc_feature (406)..(406): n is a, c, g, or t
  misc_feature (465)..(465): n is a, c, g, or t
  misc_feature (1346)..(1346): n is a, c, g, or t
  misc_feature (1445)..(1445): n is a, c, g, or t
  misc_feature (1448)..(1448): n is a, c, g, or t
cctgcgtggtcantctctatgcattcaacagtgttttggactggaacagatccagtgggcactctcttccagcctcctgaccagccatcctgattatccatcatccggctatgcaacccgtcacgggagccactcattcatctggccactctccaagcatatctgtggacccttgaccagacaaccggtaattatagatggatatatgcatccatatcttatgacnaaaacacagaaccacttgagcatccacatgactatctgtacatgaaattactncacagcctgatcagatgagagtgcatgacacgtacaaaacaggaccatggatacaaagtaagataaccatgcatgtgcacttccataacaccactaaaccatactacatcttgcgtggtctatctanttttctgaacacctgcagattggactcgtagggcatcttggagaaacggcgatgaagcnaacatatcatatcacagcagaaaatatgagcctgacggggatgacatgcctgctgatgtgtgtcttacagatgcggatcatccccttgaacagcattgacaaaaaacccaagaccgttggtgcttgtatcgtccgacctacaatccttatcccatagtggaacaataccaaagaacatgccacaatggcttggacaatgccattgcatgtttggtgtgttacacatataaccaccactatggaacatggcccaacatggcacaccaaggtcatggcacaaattgaggcaccccctcgttgtcatcgtcacacacattggcctggcatcacaccaaaatggtgagcgcaccacgtattacagtggaagaaagtaccctatctgcaccaattggccacacttaggatgagataaagtaggacccacagacacaacgggaaaacccacacccaccaattaagttacctagattggacactctacacgctgtgaggaaggaccttacaacctctcttctttatcgcaattggtcagcggccatacggttggaccaatgcactattaattagcagagaaacagtcattgggggatgaacacaacgctgtggaaaccacaacatcagcttttccaatcatttgggtcggtaggtaggtgagtacattagagaaaggagtaattgagaggcattgagaggacaaaagataaatcaatagtatacgggagaagaggagtttaagtttcttttaattggtagtgatctatatggaagcgccttatatagtgggcacagcagagcagaaattagtagaagaaggagtgggacccctcttgtgaactatgttactacactttggttgtatctattgtatctataaaagacantataagcctaggcaacagagcaagaaggaagagtagacgaattgattcgaagtaatcatctttacaacaagtcattggagttgcatcattttgttgaanttntcattttttcttcttgtagcgcaagaagaacaaagaaaaaagaaagaagaaacagatagtacagaggacagatagcaacaaaaagtatgtatatttctagttgtgtttggtgccttatgttatttttaatatttttattatatataatagttgatctgtgtgtagatagagaagagaag

SEQ ID NO: 510487 - DNA, 984 bp, Homo sapiens
gatgctctagggtgagctctgcccggctgcaggatgttggcgcgggctaagctcatcgcagtgatcggagcacgaggtacacggtgactagtttcctgctgagcggcataggggagcttaacaatgaaccgccatcccaatttcctggtggtggcagaaggatacaccctatcaagtgaggatcgagagacactattccggacaatttctaaagccgggaatgaccattggcattcatcctcgatcaaccaagtactatctgcagacgatcggtgcggacgatgcccttggacgcccaaccaggagtcgcatcccgcgctgtccgtggtagagtcccgctccaaggtagcacaccagtatagacgcctgcaagggacctccaatcctgcgcagaggccgaggggcactgttcacatgaccgagagaccgctgctgcatagggagacatcactctattaagcctctgagtcctttcaccatcgatataaccaaggcatcattcgccaaaaggcttttgcgaattcagcccatatctagtaactgtttgtgacgccctcgtgatagtttcccagattacccctggtatacattgtccacacatccatttagagaggtaagagtgacgagcgcgtacatagagtagcctgggacatcctgcagaggtagaggacccagggcaatgcttggaccattcttctcccttccgaagtacccttctttccgttgtgtgcctgtttacaccaggtgctccttgctgctgttccacttcaaacgccatattccttgcgtcttagaaaaaacacgcgtagggaacgctacacacatcaaacatacacatatttgtaggcgcgcccccacaagaattacccccccgtgtgagcgccgccccaagaaaggagtgtccacgacgcccaacacacctggcgcagagcgggaccaaaaaaaggcggggcacgcgtgtaacaacacggctgggctggcccc

SEQ ID NO: 510488 - DNA, 167 bp, Homo sapiens
taacagacttcacagaaaatgcagttgtcttgacttcaggtctgtctgttctgtgggcaagtaaatgcagtactgttctgatcccgctgctataaaaatgcattgtgaaaggactggagtatgataaaaagttgtgtcccccaattgctgtggagtaggtgattgtg

SEQ ID NO: 510489 - DNA, 313 bp, Homo sapiens
ccgcggtataaactagtatcaacatacacacagataaagcactctggtatcacctgacccaatatctaccttagatgtcaccccaagacatttgactactgatagtggttaatatgataactttatacttgctccacttaacaatgtttaagtttcctacatcttattaccttgaggacacaaaagtggcagagttgttgagagctgatgacaatacaaaggagaacactagaggaaatgagatctaggaacagaacgccaaagactagatttatccaactctctgctgactccaacctacagtacccagccg

SEQ ID NO: 510490 - DNA, 241 bp, Homo sapiens
cacagctggaagagcggagaaatagaattgtcttcaaacaatataaaaattcataaagaatagaaagactactatgtgtgggtcgggaaattaactagaatttttttatatccacactctagtatgaaatgagtacttatagagtagagtgtaacatatttagacatagtatatatatatacaagtgtaacaaatatatatattaaatatatatatgttttatagaaacacagagcacaca

SEQ ID NO: 510491 - DNA, 295 bp, Homo sapiens
atatttttgtaataattagatctatgtcttatgagaacatgatagctcttattcattcattcattcagttagccaacgattatttactgagctccctctacatgccaggcactgtgctaagcagtgggtatatgatattcagcaaaactgacgtagtctttgccctccatggagcttattattaagcgagagaaaacaacaataaacaagttaatgtaaaaataaataccaattatggcaattgtttgtgttgtgtgagagaaaataacagtgaagggaaactgggtgttcagag

SEQ ID NO: 510492 - DNA, 1399 bp, Homo sapiens
  misc_feature (156)..(156): n is a, c, g, or t
cgtggtgtgcgaacccggttttgtactcgggatatcctatgtgcacacggaccttgccagtcaatggtgaccttctgcagtctcactgtccacgattccaggacgtgtagcgtacgttgacatgtgactcagctatgcatgcttagcgcgaattgnctgctggtgtagcatgtctgctaacttgtgctatatcatagtctttactgatatagactattctatgttacaatgactcactcatgagcattcaacacgcttctcgatcacaacgcattacgacgatcccacgcaaagatacaaacaccacagcagcatcagaaacattggcatgtgatgacgatggagaatggatatgcggggagtgattaagacgcggtgtggtaagcgtagccgtgctagttacgggatgtgctcccatcacatagagtgtaactcgcgatgctcttgatgacatgagagagcaatcaacgacacaacagacaatgagacagcaagacagagacttgggcagccatctgtgatggagtccacatcatgacatccgttcacaaagttaacaatagggcacaacttaaaggatgtgcactgcattatatccacttgctttgactcaatgtcaaagcttatgcctctgaggctaaggttttacccttgacaatcgtgtacatactcagcaatctgagctctatgcaaatcatacctgttccgtgcaatgtccatccctatcgaatgtgtgattaacttataaatgaatgcatagttagttggtcaacaacctggttaaagttgtgaccaatcattgattcattgggcatttaaggtctttctggtgtggaagacaccatttagggtggataggacaattaatgttataaaaacaaaaaaaaagacaaaacacaaaaagggaaaatagaaccaatgagatgtattagagcaaggaggagatagaaaaaggagggcccacatgacaccgagcaccccccaatggcggaccaaaaaacacagtgcacacccactcaagataggaaacaccagagccgaacactagcagggtgacacccctatagaaacagcaaaacaactacaaccatacaacgagccaaaaataacaaaaacaacaagaacgacaaaaaccaaaacaaaaaaaaagaaggaaaacaaaaaagaagacaaaagaagagaaagagagaagggcgggacacgcaaaagaaaagaaaaaaaaaaagaaaaaagacagacagcaaaaaaagaacgacaagagagagaagacagaagaaagaaaaaaaaggaagaacgaaagagaagaaagaggaaaaagaaaggagaaagaaaaaaaaagaaaaagacgaaaaccgaggaggagcgaccgacgaaaaaaagaagaagagaagaaataaaa

SEQ ID NO: 510493 - DNA, 209 bp, Homo sapiens
cacttccttcccagtggtcctccatttcgccttcggacaaagccccatcttccagtggctgatcccctgacagtgcggacaccacagtcacatcaacacactgtgcttatgacaggattgtggttggctgagctctgctccaggctgctgttgttcccaactcggctgttccttttgatttccaagcagaatacggactttccaaccat

SEQ ID NO: 510494 - DNA, 280 bp, Homo sapiens
caggtcacgtggatgggtgccccattctcagaggctatggacgagtaccatcgtgcagccagggttggggaccccgcaccatacatgctctgagaaataagtgtctattaagtagtgtttatatcgtgtgtgacatcagtctctgacactgtgaacagtgttcagttacgggcaagagtggtaagtcctgcgtgcagttccgtcggcccgtctggtattcgtatcccgtttaagaaactcagatatttaacacattttattcctaatgtgtttcatcagg

SEQ ID NO: 510495 - DNA, 739 bp, Homo sapiens
ggaatcacatatactccagtatcaagtacaacattgaaagttggatatgtacagacttcctagcaggacatggggctctcagaaggcattcaccaagtcaaagattcgtaaacccaagactgtgtccacagacgttcaacagtatgaatatgcatggaaccatgaaggtctacgtgtgggtattaatggacgtcagatgtaaggggaagaggccaatgcacgcctggtgcatgttgcaagagcctcgcagggagaccgtgcgacagtacttccctgagacatggatctgggatattggtcggtgtgataaactcagtccatggttgtggctgagcgtacggagtacacagtcacctggacaccatcatccgagtgaggaagtgcggaggggccttcttgactgtctgaagatgctgggactgtggctgtctgcttgccactgcctgctctccgagcctgtccaggccctgtctcttgtagtgagctcacagatgccgttgactctgtgagtcgtaggagaggccttgctagcactcgaatgtgcatcggtccgtaaaggtacctttcccaatattgcatccgggagtgcagtgtgcaggcttggaagcctctccgcgacttcctgagctggggccgacgtggagaagggaaacagagggctctcacggcagtctgtgccataccgggctggcaaaactggtgtcctgggcagtgaaccccgaaagtcatgaggaaatgg

SEQ ID NO: 510496 - DNA, 1393 bp, Homo sapiens
gctcggatcgaggtctgcagcgcagcttcgggagcatgagtagctgcagtgactgccgggcaagctggcacgggcaccggccgaccctgggaaacgccggggtccccggcagttgcagctcccggagactccggtcggcggcatccaccgtgcgaacagagatccctggcaggtcacgtagtaggacctcactgcatgcctgtgcggcgccttatgtgctggggccggctatattggaggcaaggaggtcggcctattagccaaatgctggcctgtccgaagtaattcttcgggatcagacgtggaccatcgcacagcgcatgcgatggtactcggcgtgcgaccaaatgcaatatggcttgtcgccttaaacggctaccttccttgccactggcctttcgacagtgtctcggcccaatcacaaggctacggcgccggaaagccaacacgtcactaggatacgccaagattgtggctatcaaaacgttaaacttttcccgatgttgttcccatgccacctgtcacctatggtccgcccgattccgagagccccgagcaaatacgactagaaggagcgcagcaccggggtgatacagcgcgcatcaaagcgtcggcaaagttattgccccctaagacactaggtgggacccacgattacactagagtaactgatctcccacggcacaaccgcacggacacactccgacatgagatgcagagaaaaacgccctctttagttacgagagcagaatgagacctatctatccaagcgcattatagacggagtgtggggccatatacaggagccggccaaacggcccccgttatccacctttaggcccgcccccccacggagaccccccactgggtagcgacaacatcggccgtaggagtatcctccgtatccccgctgtatcccaccggtattttgggcaggtgacaaatgtgccctcctgtctttatcgggccgtcatacccctacatcgagagcaggggcaaacaatcagggcagcgggacacccgtgctggggacaacaatcctacatgcgggcagcctccacccacatcgttaatgagagaagaaaccacgtctgttaggcggtcgtacgagacatccccccgacactgcttttgcccaacactggctcgggcgcctcccccctcgccgagttgacaaactctctattcgcagacccaccgcttgtacaaacacacccgcccctcgacttattttaaataatcaccaagtgctcagcgtgagccagtctcgtcaccgacgcacgcaacacgtgaatactagtgctggggccccattatgggccagccccaccaatatcgtacctgagcacagtcacccaccaactatttaggtcgacggccatccgcgcacaga

SEQ ID NO: 510497 - DNA, 271 bp, Homo sapiens
  misc_feature (15)..(15): n is a, c, g, or t
gatctacaactgccngtccgtgaccagaccctgttccagcgggccgacaacatcgaaaacggctggcgagcggcgcagccgttctcgatgcctgggcccagggcggcgatgtgcatggctacccggccggcgaagatgggcccgaagcgggcaatgaattgctggcgcgggacaagcgcgagtggcaccggttggggtaagacttttgtaaattctgtgccggccctttcgcggccaaagccgctcccacagggataccacttcctttagg

SEQ ID NO: 510498 - DNA, 143 bp, Homo sapiens
cagaacaggctttggtcgatggccttgcctcaagtgaggagacaggccctcgctttccagtgcatgccgctcactgatttcatcctcacgtttccgcaccgtgcaccagaagtatgtccgacaagcctggcagacggcagacc

SEQ ID NO: 510499 - DNA, 178 bp, Homo sapiens
cttgtacatttactactcaccattaggatctgtgtggagagggaatgtgaaatttacatcatttcttttggggagacgacttgtcttggatgccccctaatccccttctcccctgcactgtcacatgtgggattatgggtcacagagaaaaagtgggacggtctatgctggtgggaag

SEQ ID NO: 510500 - DNA, 294 bp, Homo sapiens
aacgggtgatgcggttgggcgcctgtagtcccagctactcgggaggctgaggcaggagaatggtgcaaacccgggcgggagagcttgcagtgagccgagattgcgccactgaactccagcctgggagacagcgagactctgtctcaaaaaaaaaaaaaaaaaaggaatttccgtggagccaactgatttttaaagggccataccaaattattcaaaaggctaaagttaaaccctaagattttctaaaacctaggcctgtttgcgctatttgaaacgtgggaagttggaaggggt

SEQ ID NO: 510501 - DNA, 719 bp, Homo sapiens
  misc_feature (247)..(247): n is a, c, g, or t
  misc_feature (284)..(284): n is a, c, g, or t
  misc_feature (558)..(558): n is a, c, g, or t
  misc_feature (567)..(567): n is a, c, g, or t
tgtactccagcctgggcgactagactccgtctcaaaaacaaacaaacaaacgaaagaaacaaaagaaatcaatacccccaaatatggctatgctaaccaaagaagcctcaaggtatctctgacacctcactccatccacacaaaccttctcttccaaagcatacagtaaagcttaaattcctttatgcgcctaaaatccagacccacctaaaggaacaactgttcttctgtatgttgtaacaccacnaatgtaaccacacctaaatggaccctttcacaagatnatgtgcaggttaatctctgttccctgatccattcattctccctagtaatcccctcagcggaattcctcttctccaggtttccataacctgttttgccagaatggtatataacctctgaaccacctggggggatgggcaatcactctgtgataaatttgtatgccttggccagcccagtgactcacgcctataatctcaatactttaggaggccgaggcaggaggatagcttgagctcaggagttcaagatcaggctgggtaacatttatctacnaaaatacanaaaactggctgggtgtgtgatgctcacctatagtcccagctactcaggaggctgatgtgggaagatcactcgaacccaggaggtatggctgcagtgagctgtgatcatgtcattgcactccagcctgggtgacaaagcaaaaccctgtatca

SEQ ID NO: 510502 - DNA, 122 bp, Homo sapiens
gcgggcgccctgcgagcaggaaacccaagactattctagtcatcaccagagatggtgcatgctgcaggggtccagccctttgtctgtcctgcgtgacctgggcacgtgacggagacgctgct

SEQ ID NO: 510503 - DNA, 526 bp, Homo sapiens
  misc_feature (316)..(316): n is a, c, g, or t
  misc_feature (333)..(333): n is a, c, g, or t
gtcagtgccgcgaaagaatacggggcagctggcatctttccagcccgggatacctaccatcctatgagagagtacccaccctaccacacccatgggcgttatgtgccccctagcagtaccgattgtagcccctatgagaaggtttttgcaggtaatggtggcagcagccttttttacacaaacccagcagtggcagccacttttgccaacttgtaggggcacgtcgcccgttaagttgagtggccagccagtgccattccactccactcaggtttttcagggccaaagcccctgccccctgtttgggttggtgagntgggagttcaggtgggntgctcacagcctccttcaaaggcccccccaatttttgggacacttttcagggtgtggaagttcatgtgggcccctaagggttcatgcctgggaagtgttgtggtgggggctcccaggaggactggcccaaaaagccctgaaaaagcggggatcctgaattggactgaataaaacgtggtttccccctgcgcca

SEQ ID NO: 510504 - DNA, 306 bp, Homo sapiens
ataccactctactaatttggaggctctcaggtgctgtgccgctctctgctgtctgcagcttcagtgtcgtagtgtctctggtacttggggcagctgtgcccgcttgcttctgcctttccccttcccagggttttgttctcagtgctgcccgagttcagtgtcccaaacctgcctctgatcatgtgccacccctgccttgcctccaggacatagcccatgctcagttgcattaccaaagaggttctttgcagcctgaccccatagttctcccacgtcacctcctgcttttccctccccaggatacag

SEQ ID NO: 510505 - DNA, 648 bp, Homo sapiens
ggtgtgcaccgccatgccaggctaatttttgtgtttttagtagagacagggtttcgccaagtagtccaggctggtctcgaactcctgggctccagtatccgcccgcctcggtctcccaaagtgcgaggatgacatgtgtgactaccaaccacatgtctatgcttctcgatcgctgtgaacatgacaaagacatctattgggagttcgaggcacaggtggattgcttgaggccgggagctttctagacccagcctgtccaacaaggcagaaaactcgtcttctacttcaacatatgaaaattcggctacgcttggcatggcgtcaatgacctcataaatcatatgtcgtaactctagacatggattgacatgtcacataagagctttagcattacatactccttacccacgacacttatcaatcgctccatagcgacacacattcacacaatatatttcaatctccaaactccaacctcaccaatacatgcacaacataattctcacaacccaactcatctcacaccacccatactacttacacattaccctccctatatatgtatttactctaacatatatcaaccacgctaatcatactaacaacactacccataaatcctctcaaacaatcaacccaaacacaaac

SEQ ID NO: 510506 - DNA, 504 bp, Homo sapiens
  misc_feature (20)..(20): n is a, c, g, or t
  misc_feature (112)..(112): n is a, c, g, or t
  misc_feature (170)..(170): n is a, c, g, or t
  misc_feature (184)..(184): n is a, c, g, or t
  misc_feature (196)..(196): n is a, c, g, or t
  misc_feature (209)..(210): n is a, c, g, or t
  misc_feature (222)..(222): n is a, c, g, or t
  misc_feature (237)..(237): n is a, c, g, or t
  misc_feature (245)..(245): n is a, c, g, or t
  misc_feature (336)..(336): n is a, c, g, or t
  misc_feature (371)..(371): n is a, c, g, or t
  misc_feature (409)..(410): n is a, c, g, or t
  misc_feature (418)..(418): n is a, c, g, or t
  misc_feature (440)..(440): n is a, c, g, or t
  misc_feature (493)..(493): n is a, c, g, or t
gtttttttaaaaggattttnatactatattaaaaaaccacaaaataaaaaagggatcaatcaacatatatcttagaagtccttccaagaatcttggaatgcaacaaccatgnaggctgtgacctttttccttcttttctcagcctgcagttcatttaaagatcaccgganatgactcgtgctcnaattcttaaaancaaacttatacanncaaatccaagancctgaatttatcccnattgtcgncccttgcttttcccccccgtccccccccctccctccctttccagtccccccccgctttccttgctgtttcccctctctccctttcttcccntctccgtcctgcttcctcctccggggcccccggcntttcccttttccccctttttccccctttgccttttttnnccctttcntccttggcttccccttccccgncttcctccccctctcccgccccccccctgttcctttgtcagccccctttggtnggccccttccg

SEQ ID NO: 510507 - DNA, 389 bp, Homo sapiens
aaaacagttctgactttcaacattatctttaggaatctgacttgggaagtgcaagatcagatgatcttggagatcttaactatgtcagtgtctagaaattccatgattctttatctttactgtgtacagtaagtggaggagtgtttgggaaagtgacctccttggagcattccttctagactgaagatgacgtgggaattggtttcttcagcttgcaccagagcttgccaaatcactctctgtaaagttagtttgttaagacctttacggccgggtgcagtggctcaggcctgtagtcccagcactttgggaggccaaggcaggtgcatcgcttgagctcaggagtttgagaccagccttagcaacatggcaaaaccttgtgtctgttt

SEQ ID NO: 510508 - DNA, 559 bp, Homo sapiens
  misc_feature (433)..(433): n is a, c, g, or t
ggaggtttcattgtaatattccatttagtagtagaaatgttgaaagggagtaggataggcgtatatgataatgagagctagttagatgttgtaaatgacggtcagtgaattgtatatggccaaaatagggagaattgggaactggaaccactgaaggtgtttggataagatatttattttggaagttaattttaatgataaagtacaatgaaggaagggcagagaggttaagcctagttgtctggggtgatgtggtggtggtagactggatacacaaactgttgctgatgtgaatgcttcttggtgaccgcattgctggggaggtcattggcattctctgtaggtgtcagtgccgtgtcagttgcacttgtccttggcttcattggctgtttcaacaagtgttttgaaaggggcatggcagtgcagcttagtnaaaccctgtctctactaaaaatacaaaaattaggcaggcgtggtggtgcacgcctataatcccagctatttgggaggctgaggcaggagaatcactagcagagattgtgtctcctcgccccctctc

SEQ ID NO: 510509 - DNA, 820 bp, Homo sapiens
  misc_feature (492)..(492): n is a, c, g, or t
agcggaacggtcgctgtaccctaaccgtgcaaaggtaggcataatcacttgcttccttaattagggacctgtatgaatggctccacgagggttcatgctgatctcttacgtttctaaccacgtgaaattgaccgtgcccgtgtgagcaggcgggcagtatacacagactagagactgaggaagacccgtatggatgctctaagtttattgaatgcgaagacagtacctagacatacccacagtgttcctaaagctacacaaagcctgcagttaaagaactttccggtatggggcagactctctggatgcgagaagcccagaccttccgatgcatgttacatgcttaatgatctgtcagccatgatcaatagtcgacactgactaaatactcacattcgagtccatataaactttggacgcagacaggaaagcaagtatacccgctagggaatagacagctgcaatgtcctagttactaaagagtccgatatncaagcgaatagggcgatttacggaccctctgattgttgggatccagtgacagtcccgagatgtgtggcagcccgcgtaattaagagggttgcagtaaggtacaaccgagttacaagtcgctacagtgagtctgaagtctcagacacggaagtaactccagagtcgccattctaatctaacttgcaagattccttccctggtacgacaagcgacacagagacaataagtgcctaacttcacaaaagcgcctttcccccgttaatgagtatcattctcaacttagtattaataccccacaccacccaagaacaggggtatgtaaagaaaa

SEQ ID NO: 510510 - DNA, 144 bp, Homo sapiens
cgcggcctccagattgtccccgtccggagtacatattgatgcgacttagtgatacccgatcggataggactaagccagaatctgggtcaaagatctccactcagctccgagtagtgggatacaggcacggggtacgagctcgaa

SEQ ID NO: 510511 - DNA, 1185 bp, Homo sapiens
ataacacggagaccgtcccccgtgtgctccgattcccctggagtgtgaagctgaccacggctcgcagccctcctgaggccctgatggcagctcggtgcgccaggccatagctgccgccctgctgcctggtgctctgccatgtcctcaccagccggttctctgtcgtggcctgtcctgtcgcgggtggttgctggtgcgggccccgagcccactgtcccgagagttcgcagatggagagtctgccagactgccccggcgcaggcttgcgcgggatgtcctcattccgaccgtatgtggctgggtatcgttgcctggatcttacctgggaccctccggtaactccgacatctcgccagggtacagcatcgaagctcatgagacgcaaacacgggtacctcaggggctgccttaacgtgctatccatctccccgttgttcgccctgtcaactttctaccagggaagggggcgaacagggggcgtggccatggctaggggggcactctcatcacacatttgttacttgccatcatacttccagataattgcacctctggtaggactgtactaagttgtgagagagcgtccaacaggcatttgcctacgcccgctttcgtgtccgtgcatcacttacgtgctgtagggaccctggcggttcaaggaactacaaggcaatagtgtaccagcggcaattgaacggagggagtgcggtacaatgccagttgagagcggtaagttccttgggagcaacccattttcaccttgagaaagtcccgtttcgcgaagggccctagggcatcccgttggttcacttactcccttacggacgcgcccataacccccgaaacgtcaactgcggcgccaccctccctttggccacgaggtaatgaaaaccatattgtgggggggaggaaccaaaaggtgtggaccacacagcggcgcggtaccaaggacgggcagcgcggggacacaacaacctttgcaacgtcggaaaacacgatacgttgttcccccaagttgtcgcccttccgcccgaagatcgatgtgcacttccgagagacaaaattatacagcgagcccccgtttgggggaaaccagcgtgtggctgaccaatgcggttgatggtaccgtgccttgcgcctgggtaacgcccctttacatgaggcaaacttgggtgaagtcacaat

SEQ ID NO: 510512 - DNA, 315 bp, Homo sapiens
taaaacgactgcctgccagattctggtacatgtgcatcgttgttctcatgagggtacaaagagcttcttgaattctgccttaattttattatttacccagaagtcactcaggagcacgttgttcaatatccatgtagttgtgtggttttgagtgagtttcttaatcttgagttctaatttgattgcactgtggtctgagagattgttatgatttcagttattttgcatttgctgaggagtgttttaattctaattttgtgatcaattttagagtgtcatatgccactaagaataatatatagtctgttgtttcgt

SEQ ID NO: 510513 - DNA, 1078 bp, Homo sapiens
tgactgagcaagagtctcaagcttcagtcgtgtacagtgacaagatgataaaaagatagacctgcagaacaaaacaaactcaaagaaatgtgttcagatgtacatgtacatgcggatgtgaccaaactggtgggaaccacgtgggacgtctctatacaaggctcttcctgtggacacgacaaccttcaatggcacggcacgaacgaaaatctcgtcgcaacgactcataacatcctaactattgcgagtaaaacacgtgtataagtgtactactggaccaaggagaacatactgtgttcggtggcattgatactctcagaaatcggacatttcaaaagcttgacagctgaaactcagttgtgtgagtgtggtaatgccgtggtactatgatgtcagcaaatcccaagatcctttttgactacttgtgccaggcatcttaaagcaacacttaattggacagcagcaataccttgcttaactcgtagctgcaaaggtcagaccttgcattgaacgttaaaaccaaggaatcaccagtatttcacctactggatttctggcaggaaaacacaaaatggcctccaccatcaagccttacacttgcacatacttgcttgaatgcaccccagtaaggggatcatcttggttacacattggaccaacaattggcccatgtattccggcacgttgacaacaaaggctgacctcaaagaagctccaacggtatggggttcgacgcaagtgttggggtgcacgtggatttatggcagagatgtgtgggcatatggcaaatgtaccaaaggcattttatttgaacacagcggcatgatattaaagaggaacttaagggtccgtaacgaaaataacacaataccttgttattgtaacttccgtacgtggcacaagcgacctgcgaggaaatattgggcgaattttaaaacctatggaggggtactaactaacaatgttgacccacccacaacccgagttaagaggagaaaaaccgcgacctggaccaaattagaacaaacgcggatatccccacaagaaggttgcccctggccacagcgcaatgtcgcat

SEQ ID NO: 510514 - DNA, 407 bp, Homo sapiens
gactctagaggctccccctgcgtcctcatatttgggcttaaaattacaagaagggcacttcaaatggctttgcattgtgattgtatcagtgctagagcgtaggaatcgaccctggcgtccactgtgagatgttcttcagctaccagagcatcatgtctctgcagcaggtcattcttgggtaaagaaatgacttccacaaactctccatcccctggctttggcttcggccttcaggttaaacggcatcatctccgtagaaggtgactgacacgatgtggtatagtacagttagacaagcctgggtccatacagaccgctggagaaccttcggcaatgtccccatttgtagccagtttcttcttcaagctcccggagagcagctgtaactggggtaacaccatcatcta

SEQ ID NO: 510515 - DNA, 161 bp, Homo sapiens
ggtaatatactggtccccatgatgagaaataataagccacagactgagcagcgcgtatagttaagccgtaatgaagtcataagagtaagaccctaaaggatcaggtttccaaagcaaagttaactacggttccaggaacaaagctgcatggttttatagta

SEQ ID NO: 510516 - DNA, 323 bp, Homo sapiens
attcggcacgaggcttctttctgccttaagcaatgtccttttaggctgggcaatggtgctcacgcctgtaaccccagcactttgggaggcggagacgggcagataacctgaggtcaggatttcgagaccaacctgacctacatggagaaactccgcctctagtaaaaatacaaaattagccgggcatggtggtgcacgcctctaatcccagctactcgggaggctgaggcaggagaatcacttgaacccgggaagtggaggttgcagtgagccaagagtacaccactgcactccagcctgggcaacagagcgagctccgtctt

SEQ ID NO: 510517 - DNA, 772 bp, Homo sapiens
  misc_feature (374)..(374): n is a, c, g, or t
  misc_feature (378)..(378): n is a, c, g, or t
  misc_feature (391)..(391): n is a, c, g, or t
ttagcccgcctcggaaaaaaacatggttgagacaccccaaggctacagtgtgctcccaatacaaagaacccatatatgtttaagctttccctgagactttatttaaacttattctcacggtcattcttgtcacaaggtaagtccatgagcccaatgggtttatatgacccaccaagtggagctaaaactgcacagtggcattctttgccctctcgtggcttatagccttaacccacctacaacttccaatagcttataacagtttcacaagcattccttgggaaaacgtgttcaaagtcaaccagtcactagaatatttctacccatgcaacggaagaaaaaccccattactccagaagagtatatctaagtanctanaatggaggcaganaatgtttaaggatttttcttcaaagaataagccacagcaatggttttgtagaaaactcctgtgcttttgagcaaggacttttgccctctagaaagcaactgaggccaggtgcggtggctcacgcctgtaatcccagcactttgggaggccgaggtgagcggatcacttgaggtcaggagttttgagaccagcttggccaacatggtaaaatcccgtctctactaaaattataaaaattagccgggcatgatggtgggcacctgtaatcccagctacttgggaggctgaggcaggagaatcacttgaacccaggaggcagaggttgcagtgagccaagattgcaccctgcactccagcctgggtgactagcaaaactccatc

SEQ ID NO: 510518 - DNA, 193 bp, Homo sapiens
tgcacttatacctttgtcacagtaacagtccagtccccaagcaccatcttgcaggtataataactcagattcaggctagcgggaactgtgggatgctcagtcagtacgggcatggctattaggaaattcctatacatacccaatccagctacaggtcaagaatttcgacgtcctccactccagtgcctggcct

SEQ ID NO: 510519 - DNA, 179 bp, Homo sapiens
  misc_feature (28)..(28): n is a, c, g, or t
cacaagaagcaaagagaaggacacaggnaccatagcacatcgagggacaccatgtgcagaacagagagaaacagcatctgcaagccatggacagaggcctcagaagaaaccagcccactgacaccttggtctccagcatccagcctccagaactgagagaaaatacatttctattgtct

SEQ ID NO: 510520 - DNA, 1149 bp, Homo sapiens
ctgtacattgatggctagaaaaagtgaaaagactgggactgtgtgtatgaactcagacgagatcatcccgtgctgtgggatcaggctaggcctcggatctcttactgccgcagagcttcgatatgtgatcgagcaaccctctggacgcatgagagttaccaaatgaagactggtgcttgatatgattcgggcatagctctatatcgcatggtgcactgcgtctcatgtcatgcgtataaatagcttggtacaaatatcgatgcaaagccatagtgaatagctttgtactagaattgtgttccttgttcttgttcaaaagattagtggtatatctgacgtgcccatatatgttctgtgatctgtatcgtcgtaatagggtttcttcctcatcactgtcgatcctgcatatggcaatgtggtaggtaccctctcaggacttctcataccctcctatgtttcttgtccgcttatcttgaactcgtacattgtcactatagagaattccttcatgttctcacgacacacacttggactacaacccttgacacctagtcgcttagcagtagatcgcctctaacttcttggaattaattattctataggcccctcttcggcatctatctaaatacctttactagtggtgatgctctggggtgccgttttgcaagtgtgaaactatgcttggagtttattgcactttctgttcaaaagctaaattagttcctttcaggaggagtccgtgtaccgccatttgaagaaagtccgagcccgcggaagatgtgactcctgacgttgccatctatggtgcaggtcagcagttctgtacctagtatgtgtgctgctatcgcacctgtggtgtcttcctccggttactcgtctctctagtggtctgggccaggggtcccttagcctgagcttgtactctcctgtccggtgccttctaagtttgcttccgcagttaaagggtggcttgggaccgtggggccccagcctccggtcgctttggtctcgcacaggatttcgcccaacattatcgggggcgcggctaacccctggccacatcccgcagggttaggcccccggtggttcccgcctcgctgtggggggcgcacctcctcgccccctttcgcgttccccacgccggactct

SEQ ID NO: 510521 - DNA, 358 bp, Homo sapiens
  misc_feature (98)..(98): n is a, c, g, or t
  misc_feature (105)..(105): n is a, c, g, or t
  misc_feature (118)..(118): n is a, c, g, or t
  misc_feature (135)..(135): n is a, c, g, or t
atcatacctacctctccttcatcatacctaccgtgcatggattctgcttggattctgggtgggtatgatgaaggacgggtaggtatgatgaaggacgngtaggtntgatgaaggacgngtaggtatgatgaaggncgggtaggtatgatgaaggacgggtaggtatgatgaaggacgagtaggtatgatgaaggacgggtaggtatgatgaaggacgggtaggtatgatgaaggacgagtaggtatgatgaaggacgggtaggtatgatgaaggacgggtaggtatgatgaagggacgagtaggtatgatgcagggacgggtaggtatgattgaaggacgggtaggtatgatgaagga

SEQ ID NO: 510522 - DNA, 629 bp, Homo sapiens
  misc_feature (23)..(23): n is a, c, g, or t
  misc_feature (34)..(34): n is a, c, g, or t
  misc_feature (50)..(50): n is a, c, g, or t
  misc_feature (54)..(54): n is a, c, g, or t
  misc_feature (60)..(60): n is a, c, g, or t
  misc_feature (73)..(73): n is a, c, g, or t
  misc_feature (102)..(102): n is a, c, g, or t
  misc_feature (108)..(109): n is a, c, g, or t
  misc_feature (118)..(118): n is a, c, g, or t
  misc_feature (619)..(620): n is a, c, g, or t
caaagggtcccccccccccaagnggccccccccnccctggggcaaaattncagnggcccnccgggggaccaanttcccccaaggaattccagggtcggagcntgtcannctgtccaanaaaagggttccccaggtaattatgaggaattagaaaactcaggagatacaactgtggaatctgaaagaccaaataaagtgactattccaagcacatttgctgcagtgaccatcaaagaaacattaaatgcaaatataaattctaccaactttgctccggatgaaaatcagttagagtttatactgatggtgttaatcccattgattttattggtcctcttacttttatccgtggtattccttgcaacatactataaaagaaaaagaactaaacaagaaccttctagccaaggatctcagagtgctttacagacatgtaaaatacaactatcatggaaggtcataccagcgttttgcttggaaagctcccacagaaatgctttataggagagcatggacacctgcacactatgtcccctgggaagttagaagcagacatactgtttcttactgcacttgggtagagcctggtctgttatactatactaggaaataaacaaannaaggccgtc

SEQ ID NO: 510523 - DNA, 452 bp, Homo sapiens
  misc_feature (152)..(152): n is a, c, g, or t
catacagtgattatgcctgtcatcgctggtggtatcctggcggccttgctcctgctgatagttgtcgtgctctgtctttacttcaaaatacgcaacgcgctaaaagctgcaaaggaacctgaagctgtggctgtaaaaaatcacaacctcanacaaggtgtggtggggccagagcagccaggccacacccattgcctcggagtcttgtcctgccctacagtactgttaaggatatagaatgtgtgccagttttgattccctgcctccttgctgttgtaacataaatgagggcctctcagttaggaaaggtgggcacaaagatcttcatgatcaatacttcttagtagatcggtttgttattcaaatcaagatagagtgtttgcatgtgaaattatataatggccagtgttgttttaaagtcttttgaataaatgttctctattcttaataaa

SEQ ID NO: 510524 - DNA, 901 bp, Homo sapiens
gaactcatgaccataggaagatcagctgttttcccactttacccaattctttcctaccgtgcaatctgatggaaatcattctgcagacacgttggaacctcaggcgaagccatcttattccactgtctatcctgagacatgcagattctagcttttggagcactggggtgctgcagggacagaataaccaagcagtgatgaattgtgtcctttccagtgtcagaggcatgttgaagttttgcatctgtgttattagtgctttttccatttcaagagccttgacatcattaatcttttcatcactatcactccttggtgaggccatttttgtgcaagtaaccacgcagatcagagaactatggtatttaactgtatcaggttcgtggatagaaaatacgatttcagtaactaacaatgagtttgcttttattctgtcctagccgactttgaatgtttacctaccttgaaggaagagaaggaatcaaatcacaacccaagtgacagtgaatcctaaacctgaatggcgctcatgttttccaagagaagcagcccctgagggagtctgctgaggctgccaacagaggatgaagaggatacaaatttaattaatttcaaatcaacatagacacaagaaccttttgctgtttcttccaacgcccactcttcctaatgatggcatcacttgcacttggaagaatgtgcaattgagaagtactaggaaaaggcctggctgccatccatcgctgcctctgaaggtggagaaggaggccggtgaagttcttacttttgatcaacatgggttggccttctttagccaattttaacttaatgcccttacttctggcaagaaaaagttcggaacctttttggttatttctttggggcctaattaggaactggt

SEQ ID NO: 510525 - DNA, 1212 bp, Homo sapiens
gtcgcgatgtattctcactctcactaggctgatcgccatcgtcccctcttgattctagggacgacatggtaatcgcacttacatacggaagagtacagctgatggatcgaggcagagagaccatattaaagcgtgacgacatacggcatgacggaaggatatgatgactgactgaatcagaataagactgctaggagttgaccatagtagtgtgcattcagtggttacgcgagtgactaatcccgcggatcagagacgaagcgtgaaatggatgtgatctctcgagagactcaggggacgccaggtatgagtagcatctgagcgagtatatcagcctgttaaagcacaatgatctagggtgcgattcgttggagtgacaccagcacaaaactgacatcggagtggaaccggattatcgtgcagaggtacgcgcaatctaattgagtacggacactctgcgtaaccatggtgatggcctgtgtcccttcgtatggccctgtgcatatcgagtgccgtcttgtctgcaggatccagagttgcagactgatgtagagtacgtgagtagaccgagtgcgacgcggcaggggccacctacctacttgtgccgactcatgtcgtaatttccaaagtgagcgctgtcccaccttgggggagggtcccccctcattttgaagatcctatactgcgcgagcgacaggcaaaccagaataattagacacccaggagacacccacaaaagggtccttcaaaattctctcgatggtggtttcccttgccccgtggttggtttgtttccgactaacaactgtgagtagccaatggcctctgtagcggaattagcatggtttgggaagttaaacgctatccaccttgtagttcgtgcggacactcttgtgaattgcgctggttgtggtccctttgttgatcttggcaacgtgccttagcaggggactgtcctcggcgcttccccgaaaaacccgtattttcggaccgtgttcggaaagtcggcttgcaccaagtgcctgaaagcgcccccattggccttgttggcattcaagtggggggccccaggacttggttgccccttaaggtgggctggcacgcgcttcccttatgccacgccgtgcctttggcttttgggagcgcccttgtgggcaggctggcattggcttggaagtaacgtggagggggggtatattcacttcctggatg

SEQ ID NO: 510526 - DNA, 117 bp, Homo sapiens
ttgcctttcatatcatttacattttatccaggtgcccttgtattccataggctctgaacagcctctaagaggggaaggatgtcagaaagaaagtttcacaaaaacaagggcggcctc

SEQ ID NO: 510527 - DNA, 662 bp, Homo sapiens
ataaggcactgaatcaagttcatcttcctcaggatcagcattctagtctctttccaaatgaaattaggcatctttcacatttctttctaacaagtcttttgctctctatttctagccctatttttgaggaagatacaccctctgttatggaaattgaaatggaagagcttgataaatggatgaacagcatgaatagaaatgccgactttgaatgtttacctaccttgaaggaagagaaggaatcaaatcacaacccaagtgacagtgaatcctaaacctgaatggcgctcatgttttccaagagaagcagcccctgagggagtctgctgaggctgccaacagaggatgaagaggatacaaatttaattaatttcaaatcaacatagacacaagaaccttttgctgtttcttccaacgcccactcttcctaatgatggcatcacttgcacttggaagaatgtgcaattgagaagtactaggaaaaggcctggctgccatccatcgctgcctctgaaggtggagaaggaggccggtgaagttcttacttttgatcaacatgggttggccttctttagccaattttaacttaatgcccttacttctggcaagaaaaagttcggaacctttttggttatttctttggggcctaattaggaactggt

SEQ ID NO: 510528 - DNA, 683 bp, Homo sapiens
  misc_feature (488)..(488): n is a, c, g, or t
agcggatcatgaggactcgacattgaggcccttctgcctaacacagtcaaacactgtcattactacccatacaagctattaggcggcactggtgttaagcactacttaggaggctgcggcctgagaacgatgctaactcgcaaggtggaactagcaatgcgctcacagcccactactgcactttagtctgggcctcagtgctagactccgactcatagctatatggggacgtctcacaagcatcgctgggttaagtttacaacgaaggtactggactcatgccagaactctctgtgctagcaaccacagactgcagaacaggatctactcatcatctagcagtactcaaccatctatgcacaaccgtatacctgctcaacatattgaccacagtcacatgtggctctatcagtcacgacatagacaattagagtccctcatgtatgcgataccaccacctcgtgatcatacgcctatactcgatactnctactattcctcaatcacgatgcattaccggcagtactcttcagcaagatagaccatatatatggtggaccataaaataagctgcgaaagaattgtcgtagacgtgtgtgcttggatcataatcgacttagaagtcattgccttctggtgagcgctctgatcacaactcagtacgggactatcgcggagtacccc

SEQ ID NO: 510529 - DNA, 1040 bp, Homo sapiens
  misc_feature (69)..(69): n is a, c, g, or t
  misc_feature (128)..(128): n is a, c, g, or t
  misc_feature (145)..(145): n is a, c, g, or t
tcagcaccgacccaaacaagcaggaaacaggaaatgttcacgtttcagagaggctgcagcccggcgcanatcctgagcgcgcctctgccgaggcgagcggacatgcaggctccccgcgcagcctagtnttcgccctggtgatcgngctcgttcccgtcggccggggtaattatgaggaattagaaaactcaggagatacaactgtggaatctgaaagaccaaataaagtgactattccaagcacatttgctgcagtgaccatcaaagaaacattaaatgcaaatataaattctaccaactttgctccggatgaaaatcagttagagtttatactgatggtgttaatcccattgattttattggtcctcttacttttatccgtggtattccttgcaacatactataaaagaaaaagaactaaacaagaaccttctagccaaggatctcagagtgctttacagacatatgaactgggaagtgaaaacgtgaaagtccctatttttgaggaagatacaccctctgttatggaaattgaaatggaagagcttgataaatggatgaacagcatgaatagaaatgccgactttgaatgtttacctaccttgaaggaagagaaggaatcaaatcacaacccaagtgacagtgaatcctaaacctgaatggcgctcatgttttccaagagaagcagcccctgagggagtctgctgaggctgccaacagaggatgaagaggatacaaatttaattaatttcaaatcaacatagacacaagaaccttttgctgtttcttccaacgcccactcttcctaatgatggcatcacttgcacttggaagaatgtgcaattgagaagtactaggaaaaggcctggctgccatccatcgctgcctctgaaggtggagaaggaggccggtgaagttcttacttttgatcaacatgggttggccttctttagccaattttaacttaatgcccttacttctggcaagaaaaagttcggaacctttttggttatttctttggggcctaattaggaactggt

SEQ ID NO: 510530 - DNA, 932 bp, Homo sapiens
tgctggtggggcaaggaggaggagacacggagttggagcagcctccgtgtggcttgactggtggctgaggcctcagcagcgcgagcttgagttgcggccgagcctgtggcgccttcccctgcgggtggggacgagctgggccccgcggcgtcatcggcggcgaggagccgctggcctcggcctagcatgtcggaagcgggcgaggagcacgccatggagacgactgggctggccacctgagaactggacatagaaggccgtcccctgaaggcgaggtcgcctggctggggccttggactgggcggcctgctgggggggggcctggatggcgcgactgtgggtggcccccggagcggggaatcatgaatgggcgccgaggggcgaccagattccaactgccatgcaagaacgagggagggaccgcggcgaacaacatgtccgtttggtggcctggagatggggatactaggcaaaaacagattttacagaggactattttacatagaagtttgagagacggtcgatgggagttgttacaaataaagattggattcgccacatttggactggtcaaagaagggttgcgggtaaatccttgtcagaggatgcaggccagtgtgaagaagggtcttaagagcagaaggtaaggcacacggctggaattgcccgctgtcatttgaagcctttagagaagtgtccattgcttattcaccgcactcgtacccgggtaaagaaaaatctaccggatggaggggtcatgaaatcctgaaggccacgtgacggaccacactcaggaggtacctctgtgcgaaagtatggggagacttacggccattgcacttgccattgtatcacagttgaccaaagaccaggtctgtgtcaaaactttaacgagagaacccgtaacaggttgcagaacgtcaatgtcttga

SEQ ID NO: 510531 - DNA, 606 bp, Homo sapiens
  misc_feature (69)..(69): n is a, c, g, or t
  misc_feature (128)..(128): n is a, c, g, or t
  misc_feature (145)..(145): n is a, c, g, or t
tcagcaccgacccaaacaagcaggaaacaggaaatgttcacgtttcagagaggctgcagcccggcgcanatcctgagcgcgcctctgccgaggcgagcggacatgcaggctccccgcgcagcctagtnttcgccctggtgatcgngctcgttcccgtcggccggggtaattatgaggaattagaaaactcaggagatacaactgtggaatctgaaagaccaaataaagtgactattccaagcacatttgctgcagtgaccatcaaagaaacattaaatgcaaatataaattctaccaactttgctccggatgaaaatcagttagagtttatactgatggtgttaatcccattgattttattggtcctcttacttttatccgtggtattccttgcaacatactataaaagaaaaagaactaaacaagaaccttctagccaaggatctcagagtgctttacagacatatgaactgggaagtgaaaacgtgaaagttaacagaaggctgcaacagctttataaatatctcaataaatcctggagtgagacagaagaacccaatcccacattagatctggtacatgcagataataaacctagatcggcaa

SEQ ID NO: 510532 - DNA, 721 bp, Homo sapiens
  misc_feature (288)..(288): n is a, c, g, or t
  misc_feature (483)..(483): n is a, c, g, or t
acgcacctggcgcatgaagtgggtaacctttattccccttatttctctctttagctcggcttataccacgggtgcgtttcgtccatatgcacacatgagtgaggttgctcatagacttaaagatctgggagaagaaaagtccatagccttgatgttgattgcctttgctcagtatctccagaagagtccattcgaagatcatgtgaatttagtgaatgaagtaactgaatttgcacatgtgttgctgatgagtcagctgacaattgtgacaaatcactttataccctntttggacacaaattatgcacagttgccactcttctggaaacctatggagaaatggatgactgctgtgcatatcaagaacctgacagaaatgaatgcttcttgcaacacaaagatgacaaccaatacctgccgcgattgatgagaccagaggttgatgtgatgtgcactgcttttcatgacaatgcagagacattnttgccataatacttatgtgaaattgtcagaagacatgcttactcttatgccccagaactacttttctttgctcagaggtgtaaagctgcttttacagaatgatgccaagctgctgataaagctatctgcctgttgccaaagctcaatgctcttctggatgaaaggaacgtcttggctgcccacagattatgggtgacagtcttctttttaaccatgtgaatgtaatgctccagtgctt

SEQ ID NO: 510533 - DNA, 293 bp, Homo sapiens
  misc_feature (12)..(12): n is a, c, g, or t
  misc_feature (20)..(20): n is a, c, g, or t
  misc_feature (24)..(24): n is a, c, g, or t
  misc_feature (31)..(31): n is a, c, g, or t
  misc_feature (69)..(69): n is a, c, g, or t
  misc_feature (99)..(99): n is a, c, g, or t
  misc_feature (218)..(218): n is a, c, g, or t
cgaaccccgttncctaactntganagacatnatgacaaaagaagaaaggattcccatgaggaatcattntttcgaaagacttctttggtgggtccggtngccagctactttaccagcttttacagggtaattcactctacaagccggctcacacaaaagactacatattggatgaatctggttatatgaaatggccagaaaagggaaatctattgacnaagcaaatcagtagttgcctacggcccagggattggctacaaataggctccagaaaactctgggaagatggtaga

SEQ ID NO: 510534 - DNA, 203 bp, Homo sapiens
agagacctcggacgccacgagaactgaggcccttgaacgacggggatctacgcatgcatagtggtcactatctctgcttgcgcgactcgggcagaccatccgacctctgcaccttgggaggacatcgtgcatggacaagcgctcgagaagtttacctgtttcgaaggatctgcgcatgctgagtgcaggcctgatgcgcgttg

SEQ ID NO: 510535 - DNA, 212 bp, Homo sapiens
ttctctcggcgagcgcggcagcacaagaaacctgctgcgagatcacctgcactctccggaacccactgcgacagcaaaatgccccctgctctgaacaaggcttaactgcgaggctacgtggacgccgcagggtgtcagccaatgcgctgctgcccctacactgcccgagtggcagaaacctgtcgcgtgctcctatggacgccacaaccctg

SEQ ID NO: 510536 - DNA, 119 bp, Homo sapiens
ctagagatcgggcgggccccaagtgatgtgccttctgtgtcagggtctgcgatgctattacagaaggggctactgtatgagtagcaagagcaggaagatctcagattatgaggtgctac

SEQ ID NO: 510537 - DNA, 143 bp, Homo sapiens
taactacttaaaaacaagttgaggcaggcgtggtggatcacacatgtaatcccagcaccttgtgaaggcccgaagtgggcagatcacctgaggtcaggagtgctgagaccagcccgtgcagcatggcaaagccccgtctctac

SEQ ID NO: 510538 - DNA, 574 bp, Homo sapiens
ttgcagcaagtttgtttagtgaagaaaaaattgattccgttctggtaaaaagtggaaagatgccctaaaatcttgaagtctggtgatgctgccatgttttatatggttcttgcaagcccatgtgtgttgaaagcttctcaactaatccacctttgggttgcttttctgtttgttatattaaacaaacaatttcggtgggtgttatcaaaacaatggacaaaaagggttctggagctggcaaggttcccaagttttccccaaaagctcaaaagggtaaattaatttttttcctaaaacctgccccccccctttttatcagtgggggaaaaacggtttcaaaactgttttttttaattggccctttaagtttagtagtaaaaaactggtttattataacaatgccttgttaaacctttaaaaagaaaagaaaattttttttgggcccctttggtttttttttttggggggggcagttttaagtttttagttttttaaaacaggacttttttattgaaaaaactttgccaaaaattttttccaaaatttttagacccctttaaaaagtttaatttga

SEQ ID NO: 510539 - DNA, 731 bp, Homo sapiens
  misc_feature (60)..(60): n is a, c, g, or t
  misc_feature (106)..(106): n is a, c, g, or t
  misc_feature (136)..(137): n is a, c, g, or t
  misc_feature (206)..(206): n is a, c, g, or t
  misc_feature (209)..(209): n is a, c, g, or t
  misc_feature (272)..(272): n is a, c, g, or t
  misc_feature (351)..(351): n is a, c, g, or t
  misc_feature (359)..(359): n is a, c, g, or t
  misc_feature (372)..(373): n is a, c, g, or t
  misc_feature (495)..(495): n is a, c, g, or t
aggagccctccgtggagacggaggacccagccctgagactttccgccagctcttccggcncttctgctaccaggaggtggctgggccccgggaggccctgagccgnctctgggagctgtgctgccgctggctgcgnncggagctgcgcaccaaggagcagatcctggagctgctggtgctggagcagttcctgactgtgctgccgnggngagatccaggctcgggtacgcgagcagcagccggagagctggtgaggaggccgtggtcctcgntggaagggctgcagcggaagcccaggaaacacaggcagcggggctcagagctgctttctgatgacgaggtgcccctcgnggataggngggacagttcttnnaaacaccatggcagaggctcagccagaggatctgtccctggaggaagaggctcgattctccagccagcagcccccagcccagctgagccacaggccacagaggggcccgctgttgtggccangagagaggccctccagctccccgtgcatcagtgagatggcgtcagcctcgcccttcctttcggcctggtcccaggtgcccgtgaacttggaggacgtggctgtataccaatctggggaggagccaagattgcctggacccagctcagcgggacgcgccgctggagaattgccggactgggatccagttggaggccggcggtgatgcccggcacgatgcccgttgagactggactgg

SEQ ID NO: 510540 - DNA, 236 bp, Homo sapiens
  misc_feature (83)..(83): n is a, c, g, or t
ctgaaaggttcaccgctctgtggcatggagaggcagatctatgacacacctagaaacggacccctaaagcaatggcacagagngtgattttctattattcatacatgctgtctgagtgcccccagttagctatttggaagagaaacgaatacgcccgatgagtcacacacactaacagatctcaagtagtgaggatgaatttttttagatcataataattaaaatataggctgggc

SEQ ID NO: 510541 - DNA, 169 bp, Homo sapiens
  misc_feature (26)..(26): n is a, c, g, or t
  misc_feature (114)..(114): n is a, c, g, or t
  misc_feature (147)..(147): n is a, c, g, or t
  misc_feature (153)..(153): n is a, c, g, or t
ggggctcctgcagtccgggagcgcangggccgcggcgctccgacctccgctttcccaccgcccgcagctgaagcacatcccgcagcccggcgcgacctccgatcgccgcagttnccctctggcgccatgtcgagaacggagcgcccnggatgnaggaggagagcctgga

SEQ ID NO: 510542 - DNA, 220 bp, Homo sapiens
ctctagagcgcatccccgtaccaggcgcacttctgcaggtactgtgctgcggaaggggagcgagggcctcacttaacggcatggcactggcgcgggaactgtgagcactggtggtattctgaggctacgatgtcctgtggtcctaacggagcagcattacagcggaagggacggaagagcccacgaacaggatgactgacagaagcatcgcactttgact

SEQ ID NO: 510543 - DNA, 577 bp, Homo sapiens
tacaggcgagtcgggttagcactttatgtttacctggcacgggaggaaaggtcacggcctctatggacatggggggcggggtgggactcgtcaacgttcggtcacgaccaaagcagtctctgtgtgatggacatgtggcactgcggtgggagtcaccataaaacaacacatcctgtaccgggaatgggacagagacagtagctacacagctggacagatccccttcccatctgccaggactcaagagccaatacacctttggcggtgctccagccaatttgatgagactgaggatcccgtgttgtggaaatcattctttggttggctgaggaatattcatgtcattcacatccctgtcccggtcactgaagcgctggcatggtccaggtgccggtcaggctgaatggttgtcctgaccagtaacccaagcctatttcacagcaaggaaatgcaccttcacaagcactgattagccaatgcacctccctccccagctcgagatcattcttcacttaggacacaaaccagacaggttaggtagcgaatctaatctagaattgtgaccatggatagccgg

SEQ ID NO: 510544 - DNA, 448 bp, Homo sapiens
aattcggccataatggccgggaagggggttaaaaaaaaaaaaaaaatttaaaaaaaaaaaaaaaaaaaaaaaaaaaaaaaaaggaaaaaaaaaaaaaaaaaaaaaaaaaaaaaaaaaaaaaaaaaaaaacatgggggcccccttggcccaaccaattttaaacttggccaagcttaatcatggggcccaaatttgggcccaattggccaattccccctaaaggggggcgatttaaaaataaagggcccgggttttaaaaaggcgggaccgggaaaaccctggggttccccaacttaaaccccttggaaaaaaacccccttttcccaaggggcggaaaacccaaaaggccccaaccgaaggccctttccaaaaagtggccaccccaaaagggcaagggaaattggaagcctaaaaattttggaaaaaatccgggaaaaattttgtaaaa

SEQ ID NO: 510545 - DNA, 386 bp, Homo sapiens
gcagcaataaaaggaacaggagtcgatccatataccagcacatacaatcaggtcagtctcagcgtaggcccttcagaactgttcgccgcaacatatagtgcccatgtgttcaccatgctaaagagcatcacttagggtcctcaggaatgaccttacagtgaacgctttactatatacctaaagagaggagctgagcaggaggcagccaaaaacaagaaaagcccagagatacacaggagaatagacatttcccccagtacattcagagaacatggttaggctcatgatgaaatgaaaagtccccgggaacctggctacaaggctgagggaaaatacaaagatgatcctgtggatctccgccttgctattgaaacttctaaactagg

SEQ ID NO: 510546 - DNA, 762 bp, Homo sapiens
ggtggaggtcttgaggctatcagatcggtatggcattggcggtcctgtggaccccgcaatggcggagcgctaggtgggtccgaggcagctaacggccttgggggcttcggggccccgagactgcgtggggcgctatgaacgtgtgggtgcggtgccgcatccatgcggaaaggtcggcaaggcgcttcctcccgctgtggattgggggtgtacgagactccctgtgcgtctgtgcgcgccatcaccttttgcgggaagatgccttcgtgccctgggtgcggcggccgatctttccgcccctgggaccgcggtaacgaggaccccagggttctacgctcgcgcccttcttcacgagcatcgggtgtacaagtgaccaggccgtgttatatctttcacccacgtgtttgccggccttctcgagggtgtaaagcaggccctcgtggctcaccatgaccatgttattagaaggccttcccgagaaagtgcttaggccttgttgatgcatccagtgaaccaccttaggatgaaccaagaagagtgcgtctgaatgtgatctctcacgcccgtcttcttggcagaccagctgatggaaatccgccaagagagagacctactgcccggttcatcggtggacgacctagtaacagctgtgtaacctctgcagatgctcaagcatccttctctggccaggaggatctgtgtccaacactccatgtttctggctcctggaccgagagtctcttctcttcagccgggatctgg

SEQ ID NO: 510547 - DNA, 498 bp, Homo sapiens
tagttctagatcgcgagcggctcccaagtagctggaattgcaggtgcctgccaccagacctggctaatttttgtatttttagtagagacggggtttcaccatgttgaccaggcatgcgccaccatgcccagctaatttttgtatttttagtagagatgggacttcgccgttttggtcaggctgggctcgaactcctgacctcaggtggtccgcctgcttaggcctcccaaagtgctgggattagccactacgcccagccccaaattaaaaaaaaaaaaaaactagcggggcgtggcggggaggggtggctcacgcctgtaatcccagcacttggggaggctgaggcaggcggatcacgagatcaggagatccagatcatccgggctaacatggtggagccctgtctttactaaaaatacagaaaaattagccaggcgtggtggcgggcgcctgtggtcccagctactcgggaggctgagacaggagaatgcggtgaaa

SEQ ID NO: 510548 - DNA, 971 bp, Homo sapiens
  misc_feature (469)..(469): n is a, c, g, or t
cctagggcaccagaaccgccgccacgggtgttgcggaagaacaaaccaatgtgtggtgttcccaacaccaacaagggagggtgttgcttaccaaaaaacaggggcccctgttgtttgtgtaacacacagacgcgtgtgttggtctataaacccgccgcggaccgacttgtcccgaccagtacggcgaggcaccaaagttgggggcccacccacccaaacgctgggaaattgcaccccgcaagtaggaggtgtgcactagtactgtgtaattaagcccaccgcctcgccgccctggctatcgttggggcaagaaaagagctgacctgggagaaatgtggcggcgcccgccccgacgcgcgccgcaacagtatggttcttgtgagaaaaagaaaacgcccgcactggcgtagtttcttggtaggaacaaccaataccacgtggggcgacgcgtggtagtgcggcgtccaanatagtaattgttttgtctgtgcggaaaacaataccccccctcttctgtctcccaactctagtaggggcaccacgtgcttgccaactggaagctttgttctttggtctctctttacaatatttccccactcacagaattttacttgtcgttgccctctcgcactcgcagtgtgctcacagctcacgcaaacaaacaattacgcgcctccctccactttaggatatcctgaactagccggtatgcactactggaggagagtatatacatagcagttcttctcatattccatccgtggtaacaaccaccaggagcacacattatattaatgattctttgtttacgcagatcgtgacaacatttacggccgcactttgttccgttcaaataaggggcgaaactatctgttttcttccctcaaaaagagacagcctcaaccatatatgttggcacccagatccgcacgctgttggggcataaaaaaaacatttcgcccaaaaaaaca

SEQ ID NO: 510549 - DNA, 133 bp, Homo sapiens
tcacagttaatgatgcagaacttactggcatctagtacgtggggtctccggggcttttcatgtttaacttccaatctgtgaagaactgtgcaggtgatcacctgccttcctaccccacacaccaagcacaggg

SEQ ID NO: 510550 - DNA, 546 bp, Homo sapiens
gcggaggcgccatataggaggggacaaatccgacgacagcgagtgacacaataaaccggaccctgtacctcagctctagggcggagtgtacctaaagactatctggaaatgatgagcagtcctatggatctgcgggacgttcaggaaatgcgcgagatggactgcaggtgcagaatgcaggatcactagaacaaagagtcaggaatctttatgaatgcagcaaataaacctgagggagggaagagccaatggctccacaaaagactactataacgcttggcgatgcgagagaaggtcgcggccacaatttgactgcgcactccccgctgcccccagaagatgaagtatcatattccatatgagcactgggccctctcatgaacatcctctaatatacctcagaactgcatcctgtatgctccagactaagcgaaactgccacttggctatccggttaatcctcctatggcttccggtaaataaccgacagtggtagtaaagcctgagacgccacaccggggccctagggatgacgcatcaaactga

SEQ ID NO: 510551 - DNA, 337 bp, Homo sapiens
cttagaggatcccccgtgaagcatgacagcattaaagagactcggaggacttaagcagttatcgatgggatggatggaatcaaaatctctcagtggcttgggctgcaggactttgacctaattaagaagttcttcggggcgcgggcacgctacgccaaggttctccctggtgcggttgaaagaagaatgaccaaattttacgcccatgaaaagttggtgaaagaaaagagcttggtcgcatgatgacggaggatatttgacctgggtacgagacatgagaaagcacggtgttttgagccaggctatccagcaaccccctttcctgggtcgggattta

SEQ ID NO: 510552 - DNA, 355 bp, Homo sapiens
aacagagagcacacccccgactctgagccagcccaagcagatgtactcgtcagtgctgcgctgagtcagtatgtccctcgatgtctgctctcctcccttcttgtgttcctgctcacttcaagcttcttccatggactttccaggacacagtcatctctagcccccaaatcatctcgttcatcctctgtgtgtgcattctgttcaaccaatatgaaatagacaaggaaagctcactacctttgtgggacaggcagaactttctaaatttagtacgcaatcacgtgttctagagatagactgttgactatatatgtatagtgtatatatatcaaaaacaacattggataggagcaat

SEQ ID NO: 510553 - DNA, 313 bp, Homo sapiens
ggcaactatagaatgtaatagtatctagtatagaatatgtaaagacatctgcaaattagtacctagcaaagaagacatacatttataaatatacacattctaggtcacgataaggtcaatagtcaacagatgccatgactcctatattcaaacagaaactccacaagactaatagagacccaataggctccctatagtacgaatgtgcacaacttaaagcataggtcacatgatctactacataaatatcaaaccaaccattagtttatacattgtcaaagaccttctcagatatgtcatgagtgcacccaag

SEQ ID NO: 510554 - DNA, 248 bp, Homo sapiens
  misc_feature (7)..(7): n is a, c, g, or t
tcgcccntacagactgcgccggtgagaggcagtgaggaaaaccaccagcgagaccagtgtggtggctcacaccttgtaatcccagcactttgggaagtcaaggcaggtggatcccttgagctcaggagttcaagaccagcctgggcaacatagcaagaccccatctctacaaaaaatacaaaaactagccaggcagggctgggcgcggtggctcacgcctgtaatcccagcactttgggaggccgagg

SEQ ID NO: 510555 - DNA, 1278 bp, Homo sapiens
  misc_feature (799)..(799): n is a, c, g, or t
cgaccattgggcgtgttccacgaaaaagggggattctatttctgttttgtaattgtgttcccaccgtcgcccgcaaagagggggtgcccgccgccgatgtgctttgtaaggagtagtttttgttgtcttttggtataagtggccgcctcaagtaaatttttaaggaggggttttttgtggcgggggcggtatagatttggttgtggggcatccctaaaaacccccctccgcgccaatagatcctgatgacagtattatggggggtgtaaaaaggtgttggtaatagtttggcttaatataaagagactggcgggggtttctttttttgagaagggcctccctcttgggggggtctctaggacacagtgggcacacagggacaaagctcttgtctcgccccacagtctttgaaggggcaaccagtcactatgtcctctgggggcaccacagaagagtgttcgttgtgtgccccacacccacacaacagggaacccacagtgagagccccacagagagcgtgcccctcgctgtgtccctgtgtgacacccacaggccacacaggtgcgcacatcgccccttgtcgacgagacgcgcctctcctaggtgccccctcttcacagtggtctttgggtgggcgcacacactcggggacacacacagggtgcgacacacagcatttgtggtgggttttgtgtgagaggtccacatgtcacatcttataatcacagagagctttgggagagcgcactcacattcccctgctgtcacacacagagatgagaggagaacctcacacagnggcacatgtgagagcacagcgtttctcctacagagaggtctgagaattcttaagagttcttcacattctggtacacattccgcggtgttttaattcgctcttggcttctcgtttgttgctatcttacacagggcttctggagaaattcacgagatgctgtgggaacttataatttttcctcctctccctcggccctcacacccacacttagtgttctttttcacattcctgcttccctgccttaaacttcctccttcccacctggcccctgagttcccacggcccacaggcttttacacaacctcggtggctcacagctttccccacatcacagtgaaagaaggggtggggctaagagagtaaactaacctcacgcacggccctcccgtcctgatagtctgtggagtttcggagtccttttcacggaagcttcaagtctaaatggagactattaaattataactcctggtctgcaaata

SEQ ID NO: 510556 - DNA, 275 bp, Homo sapiens
ttacaaggtcaccgctccggcctcattttctttattcactttgtctctcgtatgacacttaggttgattccaaatcttggctattgtgaatatgctgcaataaacatcgattgcagattttctttgacatactaatttcctttctttttggtgtatacctagcagcagaattgccggatcatatggtagttctgtttttagtgttttgaggaacctccatactgttctccatagtggccatactaatttgcattcctactaccagtgtacaaggg

SEQ ID NO: 510557 - DNA, 320 bp, Homo sapiens
  misc_feature (33)..(33): n is a, c, g, or t
  misc_feature (51)..(51): n is a, c, g, or t
  misc_feature (157)..(157): n is a, c, g, or t
  misc_feature (307)..(307): n is a, c, g, or t
tcattctccagaaggatcagacagcttcctggnggcacgttagttactctnggtggtttcaacctggaagaggcaatacactcttcttagtggaatagaggcttaccctacatatgaagtcactgttcctacatagaatgcaatgcttttaggctgngctgcatgagagtctttgtgttaaagaaaggaatgcggtcttcaaagggcatgacaataatttcactgaactaatagttgaggctgcttcctagatgctttggggtcttcaggctgttgcatcaacaagcaggagttgagtgttggctgnggttattgttctg

SEQ ID NO: 510558 - DNA, 224 bp, Homo sapiens
  misc_feature (194)..(194): n is a, c, g, or t
  misc_feature (224)..(224): n is a, c, g, or t
gctgggcgtggtggcacgtgcctatagtcccggctacatggagagctggggcaggagaatcacttgagccaggctggagtgcagtggtatgatcttggctcatggacgcctctacctcccgggctcaggtgatcctcccgctcagcctcccgagtagctgggacaacaggcatgtcctgcctattttttgatanggttagctttggtttttttgagacgggccn

SEQ ID NO: 510559 - DNA, 530 bp, Homo sapiens
  misc_feature (57)..(57): n is a, c, g, or t
  misc_feature (81)..(81): n is a, c, g, or t
  misc_feature (111)..(111): n is a, c, g, or t
  misc_feature (114)..(114): n is a, c, g, or t
  misc_feature (116)..(116): n is a, c, g, or t
  misc_feature (133)..(133): n is a, c, g, or t
  misc_feature (149)..(149): n is a, c, g, or t
  misc_feature (153)..(153): n is a, c, g, or t
  misc_feature (161)..(161): n is a, c, g, or t
  misc_feature (163)..(164): n is a, c, g, or t
  misc_feature (167)..(167): n is a, c, g, or t
  misc_feature (199)..(199): n is a, c, g, or t
  misc_feature (202)..(202): n is a, c, g, or t
  misc_feature (208)..(208): n is a, c, g, or t
  misc_feature (225)..(225): n is a, c, g, or t
  misc_feature (231)..(231): n is a, c, g, or t
  misc_feature (257)..(257): n is a, c, g, or t
  misc_feature (462)..(462): n is a, c, g, or t
  misc_feature (528)..(528): n is a, c, g, or t
ggggggggggttgggtgggggggggggggggggcttggggggggggggggggggggncaccctgggtcattaatgatatgnttacaccacaaatcccaagtgcactaaaanggngngatgggccctaccacancttctggggggggggntgangcgaaggngnnggntcttgtgcctttctccctgggggctcacaagnggncgcatnttcaaggtatcaggggngcgggnccaagggcgcgcaaaagagggggctngtgacatggtccagagcggtggtaagggaggagagaaggcctcaaactatgggcaactgaaccccacaggtaggcatcggtcattcctgaagagctgcgggagttttgtccagtgtgtccttatggaggtggagggactgctgggagggactctcccagacgagaaacctccagaagagggcacagggtcggggagggagcaganaaaaaaaaggccttgaatgacaatacccccaaccctgcctccaaagaggttagagggagcagaggngg

SEQ ID NO: 510560 - DNA, 375 bp, Homo sapiens
  misc_feature (337)..(337): n is a, c, g, or t
  misc_feature (352)..(352): n is a, c, g, or t
acgttggaaaatagccgacgaacactggcgtggttaattgaaggatggctaattaatcgttcccactcaagagtggcatctctggcttagggattggttgttggagggagtgggcctcacttggggaaatgtatcaaatggataagattcttggaattattaggattacagagaatctccatataaaccacagtggaaaccggagaaacctgtacagttggatagagtagaataactcctatgagggcggtaactgggctaattataatgactgaagtgctgagaggaagggtggaaaagtgaacaggtttcctaggtagtggatctcactggggtnggcgggcacctcttnagaacaataccgactacctcctc

SEQ ID NO: 510561 - DNA, 324 bp, Homo sapiens
agaagatacgtaacctacatatagacataatggcagtaagggcaagaaagctcaaaacaaccataaggaagggaaaaagagaaaaatacatctggaggaaaataaattagaaggccagataatcaattgcagagcgccgccaggaaaacatcgtgtagaaagaggccggggtgattacaaacgagtctcaatgtcatgaggcaacaaaaaggccagaacaaccaacctgcgtatggatagtcgaaagaaacataaagacgcagaaaggacaatgacaccaaaaataataaatgtcagctggttttgatactaaaatgtgctgaa

SEQ ID NO: 510562 - DNA, 183 bp, Homo sapiens
tggttttctcaggggaagagtagaaggtggagggggatgagggataaaagactacacactaggtacagtgtacactgcttgggtgatgagtgtaccaagatctcagaagatcaccactaaaggccaagtgcagtggctcatgccgtattatcccagacactttgcggaggctgagcgcaagtg

SEQ ID NO: 510563 - DNA, 112 bp, Homo sapiens
  misc_feature (13)..(13): n is a, c, g, or t
cggaccctattantcacaagcacaaaaatcagctgggcgttgtggtgtgcacctgtactcccacctacgtggggggccgagccaggataatcgctctcaacccaggtaagct

SEQ ID NO: 510564 - DNA, 292 bp, Homo sapiens
aggtgtaccccgcatggccaatggcatctcctcatgagaaacctctgagtgcaagcatggcctggggcccgctgcccaactggcatgttctcagcatggatcatgtcattgggagtcttcttggactcatctctggacattgctcaggtccgaagtgatggtcttcaggtgcttctgtacgtgcttattcttctctgactcagtggtacgtttctcgctcattgcggtccttgaggcatatgactcaggcctgtatgtaggaatagtgtctgtcctaatgctcattctgcta

SEQ ID NO: 510565 - DNA, 358 bp, Homo sapiens
cgatgaagtcatgagatgttctacgtaaacttataaatcatatttaaagtaccccagattgctaaggtttattctcttttaatatacgcatagcacacaccaagataaagttataataagtgtcaatttcactctcttacatttggtatgttttcctaagtgataaagctagcacacagagtttcatataaccattgataagtccttaggaaaatgtcaagtgctgagaaccagtaatattaatactcagtactcagtggtatcttggcaagatattgtatcttaacactctgtcacagatgttgccatatggccttcataattgacattttccttaaatccaggtaaaatatacaaa

SEQ ID NO: 510566 - DNA, 179 bp, Homo sapiens
gcccgatgtgatatttgtgatccattagagacttcttcggcagatgctgaaaacaagcttaaattctggccccagcaatacagagctgatgccaagcacgacactgaccatccttcttcagagcaaataaatgccgtttctccacaaggcaccacccaagccaggacagacactcccga

SEQ ID NO: 510567 - DNA, 1668 bp, Homo sapiens
gtcctgacactgtgccggactcgaaggcagtcagtagatgtctagcaccgtgcgcataagtacactctgtcgttattgtgctagtgtctctcctcaatgggagcatgtggacagaacttggccgtcggggacgtgtgtttgtcacttggtttccagctatgctaactgatattcgtcaggtatagggccacttggagatgcatagaggattccattctcagactgtcagtactagccgggttatgtcctatagtgttaccactaaacttaggagaacggtgactaggagccaaagtctactccgattactaccgaggttccaaggcgatgagatctctgaaaagatagtggctatttgtaccctgtgctcacttgggttcacagccatctttgcttgctacggagtctccatgaaaccgcacacccgcttggggggtgacaaacatgtgcatctgcgcacaagataaactcgaagcaaaggaagttgtgcttgtagcaatgggatacgctgagatatgagcctggcgtgtgtgccagggcttttgtgcttgaggtgctgtaacagtgtatccagatgaccactacgtggtgaaacaacattggtacccagatgcacagaaaaagggagcaagaaattgagggaggagctcaaaggccttgcaacttcgctaagtggccgcaccgggaacttgaacaggcctctggcctgaaaacagggtctggaatctaattaaaggttcccaatgggtacccagaagagggggacgacccgaaacaagtggtttgcgtgttacaccatagatgaccatgcaacacggatacgtggctcaaactacataattataggaaaaaaaaaaatgtaagggcgaatggcaatataggcacacgaacgggagtatgcaagtatatgatgcttattgcattacgcttcgtatagagaaaacaaaaagaacaacaaaaaaagacagcgaataaagaaggaagagagacacaagcagaacacaggaaaagcaatcaaagggagagggacacacaaagacagagaaagaagcagaagagatagagaggcaagaaaagagacgacaaggagaggaaacaggcgagagggataagagacgtacaacgaagatacgcaagaaacaaagcaaaacgagaaaacagcatggagaaaggagacaggacagctagagtaagaaaaagaaacaaaagcagaagagcgacaagagacgaagaaaaacaagaagtagagagacaacagaagaaaaacagaaacagacacgagaaaacgagaagagggcagacagataaagcgaaaaaacaacaacaaaaaacagaaccaagccaacaggagacaagggaaagacaagaacagatggcaaaagcagaaagaaagcgaaagagagcgcaaagaaaagcacagaagagtaacagaagaagcacaaacaagaggaagagaaagagggagcagagacaccatgagacgaacgaaagaagacacgaacgagacaagaaagaaacagaagagaatgatagagcagagtgaggacagagagcaggacgagaagggagaagagacaggaaaagcaacgaagaaacaagaagagaacagacaaacggaagagagaaagagaaaaacacgagagagaatagcggcacacacaacacgac

SEQ ID NO: 510568 - DNA, 801 bp, Homo sapiens
aaactgaagatggcgtgtgttgtaggagggttgctccgagcgtcggtgcccgaatgtgagtgccattccttggggcattctgccattgggccctcaggctgctgatgtggaagaaggagcttgacaaatttatggtgtactggtatccagtcaagcagaagattattcagcgacccagttcctcatgccatgcactgttgtcacccagaatgaccctattttatggggtacagccgtgtcaatggagagtccaaagacctaagcctgatgactttaaggggaaatattgtggtgctttcttctatccttttgatttcaccttggtgtgtcctacagaaatggtggttttagtgacaaagctaagcgaatttcacgattgtgaactgtgaagtggtcgcagtctcagtggattcccattttagccatctttgcctggataaatacacaggaaagaatggtggttgtggggcaattgaacatcgcactcttgtcaagacttaataagcagatttccgagactacggtgtgctgtagaaggttctggtcttgaccttaagcaggttctcttccttaaattagaccccaatggggtcatcaagcattttgaggcgtcaacgatcttcccagtgggccgaagcgttgtgaagaaaaccttcccgtttggtggaagcgttccagttctttcggaacaccattgtcgaaggttgcccagggaactgggaccggggttctcctagaacaaccaagtacacgtgttcccacacagactttccacaagggaaccacgggaccccctgtgta

SEQ ID NO: 510569 - DNA, 350 bp, Homo sapiens
tttttccggggggtggggctttttcccagcaaacccacgtcagtggggtgcgcctttcgcacaggccattttgggtttggtggggccaggtcccgtaacaccccgtgttgggcttgtgctgcagctggggggtggggccctcattttcatgttccagctgttgggcagtgttttgcctgtgtgttgggcctccagggtgggtgggctcccgtggttttcctgcatcccttgccccctccccccctcaaaggaaagggtgctccccgaggccccgtttccctgtggggggctgcaaaggggcccccagtgtggccctccttgtcaaaaaaaaataaaggctagacctgcca

SEQ ID NO: 510570 - DNA, 610 bp, Homo sapiens
ctcatccttcttctttctatattttaatcatcccatactacctaatattcatttctcgactctcacaataactattctaatctatcaaattacacaacactcctcaaacctaacttcttaccaccctacaaaaacacacatctccaactatccctcatcccacactcaacacttaatatcttccacctcctccatcaacaaccaacaccctccctctccccctcacttctacctcccccatccccataccccaccaacatctcaccactaccacttcaatataataaacatccctaccaccaaccaccctcacaaaccttatcaataaatacaacacttccacataaaccactccatatcaccatctaacccacaaccccaccaatttcctcactccttccaacattcaccacttcatcacccccactaacacactcatcctcccacctcaaacatccatacctatcacactacacaaacccctccacaccacctcactacctctcacaacctcacaccttattcaccactcaccaaccccaacctctaacatatacttaacacaactcttttcacaaatactcatcacacaccttcaacccttccttca

SEQ ID NO: 510571 - DNA, 719 bp, Homo sapiens
  misc_feature (9)..(9): n is a, c, g, or t
  misc_feature (89)..(89): n is a, c, g, or t
  misc_feature (104)..(104): n is a, c, g, or t
  misc_feature (123)..(123): n is a, c, g, or t
  misc_feature (125)..(125): n is a, c, g, or t
  misc_feature (132)..(132): n is a, c, g, or t
  misc_feature (136)..(137): n is a, c, g, or t
  misc_feature (143)..(144): n is a, c, g, or t
  misc_feature (153)..(153): n is a, c, g, or t
  misc_feature (163)..(163): n is a, c, g, or t
  misc_feature (217)..(217): n is a, c, g, or t
  misc_feature (220)..(220): n is a, c, g, or t
  misc_feature (244)..(244): n is a, c, g, or t
  misc_feature (273)..(273): n is a, c, g, or t
  misc_feature (307)..(307): n is a, c, g, or t
  misc_feature (407)..(407): n is a, c, g, or t
cccgggccnactcatatacaacctcaaccagcccaaaatttagctcccccacaaattcctccaccgtctggttcaggccataagctacntggacctcaccaatncgcttggttatagtttggntntgttttntttnntgcttnntggtgtttnggagctgatncccagcgtccccagggctctggcagaccaggccagagagcaaggcagctatttnctnaggccgcaggtgctcagtgtattnttaaatatgagctcagtgaggagcaaatnatggctgttcatggcacaagctacccgccctgcnagcttcacagtttccgcctcgtccacataaaccagggttcggagcacctctactcgctgatggtactcaggaagcagcagcaatgactgatccgacagtnggaagcgcagcgctcccatctccttctgtatctgcattcgctcccgcagcttcaggtactgggcaggaaaacgggggctgtgtacacactgagccccctggatcagctcctccagcttccgggcccggagcccaccctctacaactgacatatctttgagctgcaggtcattgacagggtcgagggtgggaggtccggctgggtgggcctgagccagacgcagcagttcctggacagcagtggtcacggctgcaaggggaggatccttcttgaattttggctgctgcctcttgctgaagtcctccaagatct

SEQ ID NO: 510572 - DNA, 885 bp, Homo sapiens
  misc_feature (24)..(24): n is a, c, g, or t
  misc_feature (126)..(126): n is a, c, g, or t
  misc_feature (130)..(130): n is a, c, g, or t
  misc_feature (133)..(133): n is a, c, g, or t
  misc_feature (143)..(143): n is a, c, g, or t
  misc_feature (278)..(278): n is a, c, g, or t
  misc_feature (491)..(491): n is a, c, g, or t
  misc_feature (500)..(500): n is a, c, g, or t
  misc_feature (516)..(516): n is a, c, g, or t
  misc_feature (736)..(736): n is a, c, g, or t
  misc_feature (787)..(787): n is a, c, g, or t
  misc_feature (810)..(810): n is a, c, g, or t
  misc_feature (860)..(860): n is a, c, g, or t
ccccccccccccttctgggagttngcctgctgctgcgcgccccgggccccgctgggcctggctgtgctctggcggggctgcccgcggggcttcccccggtgccgtgggttgcggcccgtgtgtgcnggtngcngccccccgcngttctcctctccctgttcttgccttctccgctggttcgcctccggtggtgctgggtgcccgctggcggggccgtctcgcggggccgggcgggccccgctgtgcggggccctcgccctccctgcctccccgccggngtcggggctcccctggcgcccccgctggggccggcgccccttgggccgccccccctccccccgccggcttccgggctccgtctgccgccccccgctcggcttgggtggtgtggggcggtggccttggggctctgctgcggtgcgtgcccccccccggtccgtccccctgccttcgccccggccgccccccggtgggtccgccccgcgccgccntggggcgcntggcgcccccgcgccntttcctgtccccccgcgggccgggccccggcccccccctcccggcccccccccctgccctccgccccgccctgggggccccggctccccccgccgcccggggtgggggggccccccccgggtcccttcctttcttgccgttcccccgctgtgccctcgccccccctcctgtgctgtggcccccggcgcctgggctctttctgccctggcggttggggccntcctgggtccgccggggtgggctcgggcgtcctcttccccgtgcgcgtgtnttgggggcctctgtcggtgtgtnctgcctgtgcgtgtgtccgcctcggtccgggtgccctctgcctgccctgntttctcgggtctgtcccgccgtggt

SEQ ID NO: 510573 - DNA, 479 bp, Homo sapiens
ggaaacatattaacttcatagttaatatgtagaaacgtggcagacatcatattcaccaaatgatcaacttaataccatcagtaagaagacttcttgacatcatataccacctgatgtgatgcactgagaagtgcacaagagcacttccatggtcttcttgccaaaaatacaaatcttccatttaattaagtgaaaatattggccggacacagttgcttatgcttataatcctagcacttcgggaggctgaggtgagtggatcacctgaggtcaggagttcgataccagcttggccaacttggtgaaaccctgtatctactaaaaatacaacaattatctgggcgtggtggtgcatgactgtaatctcagctactcgggaggctgaggcaggagaatcgcttgaacccaggaggtggagattgcagtgagctgaaatcgtgtcattgcactccagcctgggtgacagagccagagggaaa

SEQ ID NO: 510574 - DNA, 513 bp, Homo sapiens
cggaccccagaaggtcatcctggaacctgcccctagagtaataggcagcagatcaggtctaagcagcagaacatccagcctggccagccgaaccagctctgagatgacgttggatagatctgaacatccctgatagcccagaagctcctccctgatatatggatgtcatacctgaagatcaccgataggagagcccaaccactcctctgctagatgacatggatggatctcaagacagccctatctttatgtctgcccctgagtacaagtacatgccaccaccgacttatactgaggtggatccctgcatcctcaacaacaatgtgcagtgagcatgtggaagaaacgaagcagctttacctacttgttactggtagtctctctgcctggacactcacttaatcagagactcaacagtctctgcaatggagtgtgggtccaccttagcctctgacttcctaatgtaggaggtggtcagcaggcacatctcctgggactaaaaggatgaggact

SEQ ID NO: 510575 - DNA, 208 bp, Homo sapiens
tagcaatgagtcaggttcgttactgctgagcacaatgggaacggggtgcctggtgttttatcgtgaagccacaacctctctttggcagaatgacaacattgttgtggagggcagggccaagtttgagcatgcaagatgttggtaagtggggcctggtgtgggggggggtatgagctttggaacaagggtctctcaagggtaccggagc

SEQ ID NO: 510576 - DNA, 513 bp, Homo sapiens
  misc_feature (32)..(32): n is a, c, g, or t
  misc_feature (41)..(41): n is a, c, g, or t
  misc_feature (53)..(53): n is a, c, g, or t
  misc_feature (56)..(56): n is a, c, g, or t
  misc_feature (66)..(66): n is a, c, g, or t
  misc_feature (93)..(93): n is a, c, g, or t
  misc_feature (111)..(111): n is a, c, g, or t
  misc_feature (117)..(117): n is a, c, g, or t
  misc_feature (119)..(119): n is a, c, g, or t
  misc_feature (122)..(122): n is a, c, g, or t
  misc_feature (143)..(143): n is a, c, g, or t
  misc_feature (151)..(151): n is a, c, g, or t
  misc_feature (159)..(160): n is a, c, g, or t
  misc_feature (183)..(183): n is a, c, g, or t
  misc_feature (188)..(188): n is a, c, g, or t
  misc_feature (227)..(227): n is a, c, g, or t
  misc_feature (236)..(236): n is a, c, g, or t
  misc_feature (242)..(242): n is a, c, g, or t
  misc_feature (259)..(259): n is a, c, g, or t
  misc_feature (267)..(267): n is a, c, g, or t
  misc_feature (270)..(271): n is a, c, g, or t
  misc_feature (310)..(311): n is a, c, g, or t
  misc_feature (315)..(316): n is a, c, g, or t
  misc_feature (321)..(322): n is a, c, g, or t
  misc_feature (326)..(328): n is a, c, g, or t
  misc_feature (332)..(333): n is a, c, g, or t
  misc_feature (336)..(337): n is a, c, g, or t
  misc_feature (343)..(344): n is a, c, g, or t
  misc_feature (346)..(347): n is a, c, g, or t
  misc_feature (369)..(369): n is a, c, g, or t
  misc_feature (373)..(373): n is a, c, g, or t
  misc_feature (380)..(380): n is a, c, g, or t
  misc_feature (503)..(503): n is a, c, g, or t
cacccggcccgtgggggagtatctgtcctgcngccttcgcncacgccctgcantcngggaccgtcnctgcgcgctctgggcgcaccatggccngcggggctgcgctggcgntgatgntnttnggaatgatgggtgttatggtngccgcccnggatggtnntttcgatttatccgatgcccttnctganaatgaaaacaagaaacccactgcaatccccaagaaaccnagtgatggngatgantttgaattaggagatgntgttgttnatnnagaaaatgaagaaaaaagaaaaaagaaaaaaaaaaaaannatgnnaaatnnaaannncaannaanntagttnntnnggtagattttaagatgctgaanttgnggatggngtttaaggtggagaaggaaaaggaggaagttatggtggaggaagaaaaaggaaagaaggggaagaggccgacgccccaggcgtgcatccccgggattgtgcgcgcgcgctgtagtggctagangtgcgcatgc

SEQ ID NO: 510577 - DNA, 366 bp, Homo sapiens
tcaggctttaaagacgaataaaagtttggtaggagaaagaaagcaacatcccgagtagctgggactacaggtgcctgccaccacacccggctaatttttgtatttttagtagagaaggggtttcaccatgttggtcaggctggtctcgaatgcctgacctcaggtgatccacctgcctcagcccctcaaagtgctgggattacaggcatgagccaccacgcccagccttcccccaagaaatgtaatcatcctttttcacttttacagttgtggaattcctccaataaaggccaccagaaacacacctgtagttaaacaagctgggtttattaacttggttgcaaggagggaagacttcacactatg

SEQ ID NO: 510578 - DNA, 413 bp, Homo sapiens
  misc_feature (9)..(9): n is a, c, g, or t
  misc_feature (20)..(20): n is a, c, g, or t
  misc_feature (128)..(128): n is a, c, g, or t
  misc_feature (141)..(141): n is a, c, g, or t
gaaacacanccatgtgggtnaagccgctggccccagctctgtgcggctgtgtgaatgtgctgaaagctgaaagaacgcgaagcctgcatggctgccatcgtggtggtttttagaaattcgttcctccnctgggcgtggtgnctcatgccctgtaatcccagcactttgggaggccgaggcagatcacttgaggtcaggagttcgagaccaacctggccaacatggtgaaaccctgtctctactgaaaatacaaaaattagccagacatggtggtgcacatgtgtaatcccagctacttgggaggcggaggcaggagaatcgcttgaatgtgggaggcggagattgcagtgaactgagatcatgccactgcactccagcctgggcaacagagccaaactctcaaaaaaaaaaaa

SEQ ID NO: 510579 - DNA, 241 bp, Homo sapiens
caaactccagaagtcatagctgatcaaggtacaaatgcacttgacaaaaaaaaaaaagatgttaatgccttacagacggtactgcaggacagtacataaacaccaaaagggaacacataagcaaatcattaaaatgcaagtaaggatgtccgagcaggtcgccgaccgggccagatagatacccacggccacacgaatgatgtaggctaaactaaatcagccgtcgatcactttgcaacgt

SEQ ID NO: 510580 - DNA, 280 bp, Homo sapiens
ttgtacgcgtgtacactcggtgtcgctgtatgacgacagcagcctcacgcccttgcagataccggatgcacgtgtcgaacaactgggcgaatcacgcacctatgagaaggtcatcaacagcatccgccatggcgtgatcgaaacccgctacgccctctacccgcaacacagtggcgccgtggtgattccggcgcagaccttcagcgctaccctggtggaatcgcgaccgccccaggaaaacaccctgcagggcaccaagccgggcaagatgattcatgtc

SEQ ID NO: 510581 - DNA, 198 bp, Homo sapiens
tcaacagtgccacacaaattaaaatacttttttatatatttgtggccatttgtatatcttcttttgagaactgtctattcgtgcccttggcccactttttgataggatagtttggtttttttcttgctaatttgtttgagttccttgtaaattctggatattagtcctttgtcagatcaatgtcttagaatactttct

SEQ ID NO: 510582 - DNA, 398 bp, Homo sapiens
gagatggagtctcgctctgtcgcccaggcaagagagcagtggcagaatctcggctcactgcaagctccgcctcctgggttcacgccattctcctgcctcagcctccccagtggctgggactacaggcgcccgccacacccatctaatttttttatttttagtagagatggggttttaccatgttggccaggctggtctcaaactcctaacctcaggtgatcctcccaccttggcctcccaaagtgttgggattgcaggcgtgagccaccacacccagcctttttcatgaattttctaaaaacttaaagcaagaactttttgcttctgtgacagattagcttacatcttaccacctcaccgagaagagctataaagctggattttaaaaataatactat

SEQ ID NO: 510583 - DNA, 749 bp, Homo sapiens
gtccgccctattgttgtcttttttgggaaaacccccaaccttttatgcttgaaagacagcgggatgaacgggcaaaagccagttggttgaaatttcaagagggtataaaagaggcttccaggatatagtcagcatattcacgttcacgttcagattccattcacagagtggatttcagcttccaccgggttgcactgcttgaatcactcatccatcattggccaactcgtgatggtgaggtactgatacaagggatcaagtccttaaaaattttaacaagaataaatggatggctgggaattctgggacctggaggatcttcagtatttggaacaaatccacagattaaactggaaggtaaattaagacttcagtttgggttatttccaacttttctggggaggatgtatatccattaaagctcaggcttatagccacacgtgttactttggctaggataactcttcaagttatagtggtttaaaatccagccaaccaggtggctgtaacagccgaattagccataattcacgggctcacacaggggcaaatcgggctctcattcataccaaagcatttctgggtaatgacctccatatttagagatcaggggaacaactttagtgagcagcaaccaatccactcaaacagtcggcctggtgcttaatgcctgactttttctggtgcctacctcaggaacccccaaggtaaaacggctttatcttggaaacattggggttcacttggaa

SEQ ID NO: 510584 - DNA, 262 bp, Homo sapiens
ctggagtagtcacatgagtgtgaggacatcaacacagcatatgaaacatatcactccagtatatggtcagatacggtggtaggaataggcagagaataggaatagctaatttgctagagatgtgctgtgcatatcttgtaatttcctagctatgatcttagctcctcagtcattcattgcagaatattgaaacacattaaatttgagatccaaggcgttcctattttttatttttttttgggaccttttaaacctcccccgg

SEQ ID NO: 510585 - DNA, 870 bp, Homo sapiens
  misc_feature (1)..(1): n is a, c, g, or t
  misc_feature (59)..(59): n is a, c, g, or t
  misc_feature (815)..(815): n is a, c, g, or t
ncgccccactggtaggtagtacacggcgagccagcagagacaggtgcgcagattgttanctttcttgtcatctgcttgtatcctcgctctccttctctttgttactcgatgatcgccactgttcgtgacccccccggtttccaccctgccgttcccggccgtctaatgaaattttttgtggatagctctctcctttggggatgggccccacccccctcgggtcttccacgtgccctccctcttagtcgaggccgccaacaagctggggaacaacgcacgccccacacgtgtggtacaactgccacgcagtgtttcaaatacaaaggaaggcgtttgccttttttataggcccaccaacgggtcactccccccacctcgacaaattccttgtcaccccccccgatacatgttgtccccactcagcaccacccggttacctctctatcatccaagggcccctcaacctgccccttgtcttccgctgggagcacccacaaatgtatccttcacaatgtgtgaacagtaggcatcaagcaagttcccatcccccagatgatcgccgtccagcaaccaacacagaatcgccccattttgtgaagcctattgcagactccacattttttctaaaaaaaggaaacccctttttcccccccacgatgcacaactagggctaaccctcgtcatagaaagaaagatggcactaatgcacacggccacacaatagaaacatggtgattctgctataaaccctctgccttcctcctcctttgggacacctgcagtcgatactccccccacctagagtgcccctgtgncaaatcccctcgatcttctcccccccccaaaaacaatatccccgcccacaaaaca

SEQ ID NO: 510586 - DNA, 579 bp, Homo sapiens
  misc_feature (2)..(2): n is a, c, g, or t
  misc_feature (129)..(129): n is a, c, g, or t
  misc_feature (133)..(133): n is a, c, g, or t
  misc_feature (141)..(141): n is a, c, g, or t
  misc_feature (154)..(154): n is a, c, g, or t
  misc_feature (182)..(182): n is a, c, g, or t
  misc_feature (186)..(186): n is a, c, g, or t
  misc_feature (189)..(190): n is a, c, g, or t
  misc_feature (199)..(199): n is a, c, g, or t
  misc_feature (221)..(221): n is a, c, g, or t
  misc_feature (251)..(251): n is a, c, g, or t
  misc_feature (258)..(258): n is a, c, g, or t
  misc_feature (260)..(260): n is a, c, g, or t
  misc_feature (266)..(266): n is a, c, g, or t
  misc_feature (276)..(276): n is a, c, g, or t
  misc_feature (284)..(284): n is a, c, g, or t
  misc_feature (287)..(287): n is a, c, g, or t
  misc_feature (297)..(297): n is a, c, g, or t
  misc_feature (305)..(305): n is a, c, g, or t
  misc_feature (309)..(309): n is a, c, g, or t
  misc_feature (318)..(318): n is a, c, g, or t
  misc_feature (320)..(320): n is a, c, g, or t
  misc_feature (323)..(323): n is a, c, g, or t
  misc_feature (327)..(327): n is a, c, g, or t
  misc_feature (329)..(329): n is a, c, g, or t
  misc_feature (334)..(334): n is a, c, g, or t
  misc_feature (345)..(345): n is a, c, g, or t
  misc_feature (352)..(353): n is a, c, g, or t
  misc_feature (357)..(357): n is a, c, g, or t
  misc_feature (377)..(378): n is a, c, g, or t
  misc_feature (381)..(383): n is a, c, g, or t
  misc_feature (388)..(389): n is a, c, g, or t
  misc_feature (393)..(394): n is a, c, g, or t
  misc_feature (397)..(397): n is a, c, g, or t
  misc_feature (410)..(410): n is a, c, g, or t
  misc_feature (423)..(423): n is a, c, g, or t
  misc_feature (450)..(451): n is a, c, g, or t
  misc_feature (494)..(494): n is a, c, g, or t
  misc_feature (513)..(513): n is a, c, g, or t
  misc_feature (533)..(533): n is a, c, g, or t
gngcctttgcacatagaaatacgcttaccctacgcgagagaattcaggagaaagcatagaaaactaaaaagtctctctcttggtggtagaaaaggcgagacgacacttaggcagaattcctcgccgccncacncacgcgcngcagagtgcaggnagccaccagtgaaattttacctggctgngggnggnnatcccggcnacatcttcggggtatcccgggngggaagggcgggcggattgcatggcccgcnacttttncncccggnggggcgccangcctcccngcntttgctagcngccaccgncggngggacgccncngtntccngnaaaangcaaagcttgngaggggnnggcngccttgccccccgtggcatnnggnnncgcgnnaccnnccngggccccccggcngccgaggaaagangtggttgtcgggggagggggccggtcnngcctctgatacttctccaaatggtctggcatcataacagctantgatcctccacaagtaggnacgaggaaagacttactggnttatcacctcaaatcccagcctaatcagctccacaaagcataaggc

SEQ ID NO: 510587 - DNA, 212 bp, Homo sapiens
ctgttattgacttcaacacaccacaatactatgggtgattgtggtttgttatgctctctttcttcattcccatgtcatcgtatccctagttcctagatcatcataaacgtattacccccggatgcaatctcagattacaatatatacaccagacaaacaatgtacagccagtgaactactactagatcaactgcctattttacaccaatccc

SEQ ID NO: 510588 - DNA, 491 bp, Homo sapiens
tcgctcggtaccggcgttgcgctctgaatcctaccggaaaatgtgccgtggtctgttgttactcatgtgttatcaggcagaaagttgatccagcagttgtaaaatctgctgccattcgtcaggcagtgacgggggtgatagacaaccggctgcctttttgcagcacacgcattgacgacagcgacggcaccgcacgttattcggcaagactaagcaagcgggttttacgtacacccttcacatccaccatcatccagcgagggttttcacggcgtcgccttcggatcaaaatagtggctggaggagtcaaattgcgtgtgatccgggtaagccgtgctgacgacttctgccatgacccgcgataccgggcgcaggacaactcgaatggtaaaacagaacaccatcaccaatctgcatcgcatcccgcatgaaattcctggcctgataattcctcacgccaaaccaggggatggaagatgtagccatcacat

SEQ ID NO: 510589 - DNA, 114 bp, Homo sapiens
gaggaaaaggttggggaacagctaaataggttgttgatgagatatttggaggtggggatcaatagagggggaaatagaatgatcagtactgcgacctttcacagtcgctatgca

SEQ ID NO: 510590 - DNA, 486 bp, Homo sapiens
atcattagaagcaggccagaacaggcgggggaaaagtaaaccttttcccccacaaaaattcccccgcaaacccaaaaccagcaaaaatttcccttaaaaaaaattgccgggtttaaaaaaaaaaaactcgtgccgaattcggcacgagagagaggggagcatccattattgaaacatgtgggcttttaaaaactccatcccttaaaaaaagtcaaggtttgggccccccaaaggatattttcatcaaggaaaaatttcaactccccaagccggaaaggtgaacagaattggagcattttcaaaaaaaattcttgaacaggcaaaagaaagcctattatagaaagcaaggatttccctcatccgggaacaacagccccaggaaaacgcgggcagctaatgtactaaaaaataaaggaaactttccccaacaaaaaggaatcttttttcccccctcaagaaaaaaaacaacaaccggggaaaaaggga

SEQ ID NO: 510591 - DNA, 167 bp, Homo sapiens
gcttacatacccgacgggaaacagcagtgatcactttacaataaacgaaagtttaactaagctatactaaccccagtgttggtcaatttcgtgccagccaccgtggtcacacgattaacccaagtcaatagtttatgctgtaatagtttatgctgtaatagtttatg

SEQ ID NO: 510592 - DNA, 148 bp, Homo sapiens
tgttgacctcctgagcttgacgactcggtctcgaggtcggatcatcgggatgccgatgcgctcggctggctcgcggccacccttaggtttccagactttaaggaagagcagggagagggcgacggtgacgacggcggcgaaaatctca

SEQ ID NO: 510593 - DNA, 148 bp, Homo sapiens
tggaattaccaacgtgggcacagtctaaaaaaggagtaatgcgcaattaaattatcctctctttgaaagtcttttgaaataagagaccatgtaagtaggaccctaagacaaccaaggaatttgcttccagggccctcattcctctgct

SEQ ID NO: 510594 - DNA, 319 bp, Homo sapiens
aatgtcgcgtgcgtgtgaactcacacctgtaattccagcattttgggaggccacgggaggtggatcacttgaggtcaggagttctgagacctgcctggccaacatggcaaaaccgcatctctaaaaaaatacaaaaattagaccgtgcgcgatgcttcacacctgtattcccagcattctgggaggccgaggtgggcggatcacctgaggtcaggagttcaaaaccagccttgaccaacatggtgaaaccccgtctctactaaaaatagaaaagttaaccaggtatggtggtgcgtgcctgtcgcttgaacccgggagg

SEQ ID NO: 510595 - DNA, 359 bp, Homo sapiens
tcggtcattgatcacttactacagctgctcagaagcaccactaggaaactcagatgtgggcgccccagccagaagcagagaggggtacaggcaagctacagatgaagccccttctagatgccccagtgcagtcaagtcgatctccttaccaggtctaccaggaacaccacatatgcaatatagaaacctgtatcatagagaaggagtacaggaatagcctatccatccaaaggaaacgatgacctactcccgtagaccagtcgaggataataggggagaactaaccagtctagctaccactaaaaccatcacatccctaccagtagatagcttctagaataggtaccctgagggggtaa

SEQ ID NO: 510596 - DNA, 303 bp, Homo sapiens
  misc_feature (2)..(2): n is a, c, g, or t
  misc_feature (29)..(29): n is a, c, g, or t
tnagacacaagaatcgcttgagcctgggngatggaggctgcggtgggctgagatgatgccactgcactccagcttggactacagagtgagactccgtctcaaaaaaaaagaaagaaaaagataaaatattctccaaaagtatgtttttatgctctgtagaataacaagttttatatctaattttgaaatctaacttcagcattctttctttcacgagtctcttgaattctctattgaatcagctttgttctcctgctggctgtctcatgagtcagttaaataaatcactgacataccctcact

SEQ ID NO: 510597 - DNA, 158 bp, Homo sapiens
cacttcagtgacacctgaattgtttgtagtgtttttgttttttattggtcttcaaagaggaagggccccattaaagggtgaactgtgtaataaatgggaatttcaaataaacctcatgtactgtgtgtttataaagcaagaaaacaccaacaaaaagg

SEQ ID NO: 510598 - DNA, 885 bp, Homo sapiens
cactccaccttactaccagacaatccttagccatagaacatgttacccaaataaggtataggcgatggaaattgagcacctggcgcaattagatatagtaccgcaagggaaatgatgaaaaattataatcgagcataatatagcaaggactaacccctatacctgtctgcgatatactgaattaacctatgaagagtacacttttcgtccgaaggagaagccgaaagctaaagacccccgaaaccagacgagctacctaagaacagctaaaagagcacactccgttcggtatgctagacaagaagtaatggtggaagacgattgtgatatgcgtagcaggcgacaagacctatccgagtcctgtgttgataggctggttgttcccacgatatgaatcttagtatgcaacttttgaattgttgcccagcaggaaacccgtctaaatcgcccttggtaacattttaacctgtttagtccattagaggaacagacatctctggacaagtaggaaagaagaccctatgtagagagcagtagatagattttaaacaaccattagtaggcgctaacaaagcaagcaacaagtttaagaaagcgttgcagatgctcaacaaccgggtaactaaagagatatcccaagacatgataactgaactcctcaaacccaaatttggatcaagtctatcaccctataggaaagaactcaaggttagtataagttacatgagaagcgattctccctgccgctcaggcgctgccgtcggattagaacactgaacggacgattgaacagccaatatatacaatcaacgcaaacaagtccatgatgtacctcgacggtaaaccaaacaggagtggcatacgaaaggtccaaagagtaaggga

SEQ ID NO: 510599 - DNA, 367 bp, Homo sapiens
cctgctcagaatcaaacttatcactgtttcccttatgagactcctactgaaagaaattcagttgatactactttttaacatgggttttaagacgtggcttgttgatataatagcgcatccacttgtactcaagtgattcaaaccttgcgtcacaaggcgagtttctggagaatttagaagaatctttattgacatttaatctagagcacgtcttcaggagcaaaccagtgcaagtacaagtgtaaccaggtgccctgagtcagtcatgtgctacttgtggttcaacaccgaaacatgatactgggatgagaagtgcgcagggtacacacgtcaataataatcaaattacccaagcaccgcaccagag

SEQ ID NO: 510600 - DNA, 322 bp, Homo sapiens
ccggtttgggatgtgaggagcacctctgcccggccgcgaccccgtctgggaggtgaggagcgtctctgcccggccaccctatctgagaagtgaggagcccctccgcccagcagccgccccgtctgagaagtgaggagcccctccacccggcagccgccccgtctgggaagtgaggagcgtctccgcccggcagccgtcccgtccaggagctggactccgtcccatagatgagctgaagcaaaaggaccttcacacagaacttttatcatcagcctgaggaaaagtactcgaaggacaaggccattggttgggaacttacacc

SEQ ID NO: 510601 - DNA, 743 bp, Homo sapiens
agcgggttttcaggcacctcttgggtggcgcctggcacaacagtttcccctggaagtttcagcacagccacaatttcccctggagcaagtagaacgactggggctgcacctgccgcagaaaccacaacttccctagaaggaggtggcaccactggagcggaaataaaatcaggagccacctccggagtaccgggaagtaagacaggcacagctggagtgccctctgctacaacaattgcccctgggagctccaactcagaggccacgacttctttaggagaaagtggaaaaacaagagttgaaacaatcacaggtactactgagggtaaaactctggcagctggaagtgcccacacagaggccacaactttctcaggaggcagcgggagcacccgagcaggaccactgggtggcgcttctggtacatcaggaggatatgtccctggaagggaaacagagcccacaacttccattgaagaaactggaacttccagaactatattcaaaactgtaggcatcacttcagccccagggaggcaagcaggcacctctgtggtggcgcctagcacaacagttgcccctggaagtttcagcacagcagccacaacttctcctggagcaagtggaatgactggggttagaaccacttcaaagactacaagttgcctaggtggaactggcaccactagaactgaaataaaatcaggagccacactggagcaccaggaattaagacagatatc

SEQ ID NO: 510602 - DNA, 257 bp, Homo sapiens
tccggctagcttgcatgcaggcagactgtatagtgaagcatgacacgactgaacgcactgagtgcaaacgattctcctgtctcagcctcccgagtagctaggattacaggcacgcactaccacgcctggctaatttttctgtttttaggagtgacagggttacaacatgttggccaggctggtctggaactcctgacttcaagtaatccacctgccttggcctcccaaagtgtcagaatattttatttttttatttt

SEQ ID NO: 510603 - DNA, 1549 bp, Homo sapiens
  misc_feature (555)..(555): n is a, c, g, or t
ccgcgtgtgtgtcgtcacaaggagaatcccacgagggcccccccgttgtcgcgagaaaaagggccgcggccccccccaaacaaaggggggggagactccccccaccgcggagagagaaaaaatagtgcggttggagagcacgccgcagaggtgggtcggtctagaagaaaaaaagagattttggggggtaacaaaagaagaggggtggtggaaagcgccccccgcccctcgtgcggataaatagcgtgtccccgccagataaaattgagaagacaggatgatttgaatagtggggggacaaaagagaacccggccgcctctgctggttgccacacccccacgggggggagccccccccacatgggggagcagctcgccgcgaaagtaggtggccagatgccgtcgcgaaatagggggttttccctctcccacaacagggttttttccccctccttctgtgtttttgggaaaaagcacgcgaaagatttcctcctgctgcctaggaaagtttgtcccccccgacaagaattagcgaaccgcgaacaagagttttgncccaactatttgatgacacaaagaatagttctcccaacagcccttgcgaaattttacccctgcagagcacaataagtgtttcccacagcggcgctttaaaaaatacaccctggccccccctgagccgtaaaaacccttgttccacaccaagggccccccattgggggattcctctttattccccccccgcggagcacaccacaaacaatgggtggggtgtgcccaccatggggggtccacacacaaaaaaatgtggggcccacagaccccacacagtgagttgtggaaaaagtctcttcacactgttgtgtggacactgtctccaaagaagactgaccccccgagtgcgggtttaaactctggggcttttcgctgtctcgtgtgttgtctcgtgggtgtgtgcgtgtgtgttacactctcaataataccccccacactcacactccacagattaccgcgagaagagcctctcttgataggtctccacagccaccccacacacaggtgctctcgcccacacattcctcgcgagaagacaagattgtagatgtgagagatatctcactgtgagactctccagagagagagtgcgccacgacccacacatctgagactctgtaataagataatttggtgcacaataaaaattgaattccacacaccacgccactctggaaaaaagacacacatatagaacacaagagctctgccccacttctattcttattcctcctcccactcgagttgttcttcgcttatagagaaaggtataaaaatgtctgagaagaaggccccacgctcttgaagattgggagaacgcctcactggaggccttcactggtgaaggcccgctatgctttctggaaaaaccccctggggaccgacgacaccggtgccttaaattgaacgcacctgatgcgatatgaaccccccctcccagaatctgttttaagttccacacttccaattagtggccaataaaaaatgctatttg

SEQ ID NO: 510604 - DNA, 157 bp, Homo sapiens
cttagtattccaacatgtgaggttacagttatgtacacagtaaactatgattatctcaataatacttagaggtaggcatattatatcattgtctacaagacatttgagacttagggactaagtgaattgtccggcgttacacagcttgcaggtgatg

SEQ ID NO: 510605 - DNA, 322 bp, Homo sapiens
  misc_feature (271)..(271): n is a, c, g, or t
  misc_feature (300)..(300): n is a, c, g, or t
  misc_feature (302)..(302): n is a, c, g, or t
aatcccagcacttggaggccgaggcggtggatcacttgaggtcgggagttcgagaccagcctggccagcatggtaaaaccccttctttactaaacatgcaagaattggccgggtgtggtggtgcacgcctgtagtctcagcctccccagtggctgggtttgcaggcgtgcaccaccatgcctggctggtttttgtatctttggtggagatggggtttctccatgttggtcaggcttgtcttcgagcttccgacctcaggtggtccgcccgncttgggcttccaaaagtgcttgggtttanangcggggttccactggggctt

SEQ ID NO: 510606 - DNA, 285 bp, Homo sapiens
ggggggtgccgaccggctcccccagcccagatctcgcacctgcagcagagccggctccctgggatgcagctgccaccgtccgccgccacccaactgaccaacggcactcgcagtaccttcgcgagggagtaagtatagatgacatagtggaggggtaagagagagaagataccgagattatataataaaattataaaaatagaaactatattatatgaaaagagtaaaaaaagaaagagaaataaaattatataataagaaagatattaaagagaagaaaagaga

SEQ ID NO: 510607 - DNA, 316 bp, Homo sapiens
ttgctataacttttttcaaaattttgacttaatttcagactttttagaaaattggccaggtgtgatggctcatgcctgtaatcccagcactttgggaggccaaggtgggtaaattacttgaacccagcagttcgagacttgcctgggcaacatagtgagaccttgtctctactgaaaacaaactaaaaaaaaaattagccaaccatggtggtgcatgcctgtagtcctagctactcgggaagctgaggcaagaggatagcctgagcccaggggagttggggctgaagcctgggtgacagaggaagaccttgccttc

SEQ ID NO: 510608 - DNA, 921 bp, Homo sapiens
tgtcttcctgttgggcctgacaatcatagccagacacctgggctcgtgacgcccactcagtagctcaccaagcatgacgtggagagactaaaagcctcggtggatcgccctttcacaaatttggaatctgccttctactccatcgtgggactcagcagccttggtgctcaggtgccatggatgcaaagaagagcatgtacgctacgaatcagatctaacgcttggatcccagcgaatgtgggattcccctcttctacagcttggccaggccagcgcaggccctctcaggatgtgagatctctatttcaaatgagaccaaatgatctgtttctggcaggtgtcagtgaggactcatctgttacccagatctaccatgcagttgcgagctctaagtggcttatggccttcccttggcactcccaaagaatgcatcctcagtgccccttacgtgctcgttctcatgcgaagggagagaggactggtgcttgtgcgaatcgaggtccgagagctctaggtcagacaagcatccgcaaccgtgtccccagcaggcgtagacctgagtgagcatctgtgtgacggagattgaggaccttgttgctcgcctggatgaactcgggggcgtgtatctccgagtttgaagaaggactggaaacgtacagcgttatttgtggtgccaacatatagagctcatggatcatgtggggggactgagggcatgcgattaaggaggatcgaggtcattccacgtctgatggaaagcgatactctcagtacagaggaacttttgggttcctctttccgaaacttcaagggcctctgcgagtgctgggcgctcggataaatggtacccgtgccagttggtgggtgtgccgagggatcgggccggacatctgaaaagggcttgggggggtccccgtttgt

SEQ ID NO: 510609 - DNA, 522 bp, Homo sapiens
  misc_feature (438)..(438): n is a, c, g, or t
catatgggtcaggcgggtctctaacactggcctcaagtgatccgcccgtctcggctcgcaaagggcggggattacagatgtgagccagggcaccgggtcagaggtctggcggtgatctttttcacgggataggtcaagcacttttccacatggcctcatagtcttcattatgatcacctttaaggggcggggggaaagtcggtcaagggggctgtcccatacgttcacttaccccttaaatagtgtcatagtatatagcaagggtttcatggccagcggttttctcatccattcccagggtttccgctactacctatacaacagtgacacagatttatttttctagttctctccttcccaagcggaagatgcttcccagggaggggctgcccccagctgagccagtccagtataatcagaccttccggatggtccagncccttccttcctgagcgccatgcagggtctcctcattcacccctgttcctcagctgtggcagggtcgatatgattcacttacca

SEQ ID NO: 510610 - DNA, 546 bp, Homo sapiens
ctagcaggatcttcgctctccacccaccccagccaaggagtagtgattgtgcaaccacacctgggaaaccacacttctcccacagatctttgcaactcacctatcaggagagtcccctacatgagaccatgccaacagggccttgggtctgatacacagagctatgtggagtcacggcagagtagccacttaggtacatgcagagacccaggagttttaaatacaccagccccaggattcccagaaaggtgggaaatccatctgtatatatccctaggaagggagctgaatccagggagtcaagcagcgacgttctgtgggccccacttccacagcacctcacaagttaagaccgactggcgtggaatcccagccagccaatggcagtggattagagtccatcagagacaactctgagttcctgggggggagaggcagccaccacctctatggttcagtcaagtcagctgctctagtctgccagctatggagaatataggtggtccaaacaaggaagggacctcctccaacacagcatacctgctc

SEQ ID NO: 510611 - DNA, 588 bp, Homo sapiens
  misc_feature (413)..(413): n is a, c, g, or t
  misc_feature (509)..(509): n is a, c, g, or t
  misc_feature (538)..(538): n is a, c, g, or t
  misc_feature (541)..(541): n is a, c, g, or t
  misc_feature (568)..(568): n is a, c, g, or t
tgccctgcctgttggcagcctccatgggccaagctcttgcctctcaccatcctctccaggcccagtactgtttccagccggcctctccaggcccaactctccctctcagctgtgcctgccggcccagctcctacctcgcaaaagccacgttcggcccagctcctgcccagctcctggcagcctttgtaaaccccaggatcctctaagtcaggcctttcaggccctgcctttggctccccggtggcatggagaggcccagctcctgcctgacagcggcctctccaggcccagctcttgcctcacgttggcctccctgggccacgtttccgcctgcctcgcggcagccccgacaatcccggctcctgcctcccgatggcatctttaggctcatctcgtgcctcaccacggcctgnaccaggccacactcctgcctttcggtggcctccgcgggcctgactcctgcgtcccaatggcctctttaggcccggctcgtgcctcgccgcggcctnctgaggcccacctttgcccttctggcagnctntcaggcccaggacttcctcaagtcggnctttgccagcccagttggcc

SEQ ID NO: 510612 - DNA, 334 bp, Homo sapiens
cgtcgacgaggtcatacaggcacgtggaggccacacacactactgagcctcattttgacttgttttaaggacattacatcaaagttggatcagcgtgtagtgtagttttccactttaattttgtgtgactccaaatccagacctccatgggttgatacatttgatttccattgataatttttgtgattttgttgtcagcacattcaactatgtaaataaagtatttaataagaatatttcattttattttagtgttccctttatttgttttgagcagtgtgtgtgtgtgtgtgtgtgtgtgtgtgtgtgtgtggtcgacgcggccgcgaattta

SEQ ID NO: 510613 - DNA, 1289 bp, Homo sapiens
  misc_feature (624)..(624): n is a, c, g, or t
  misc_feature (825)..(825): n is a, c, g, or t
  misc_feature (864)..(864): n is a, c, g, or t
ttccggggcgcggtaatgtgaggaaattttgtagaaaggagggcccgaaatgtttttttgcttcctacgggccactaagttccacaaggaaacacctctggtttctgagaaaacaacgtttgtttcgccaccggggaaaaaaaagttgggtccggaagcccaaccgtgttgataacgtttttcttggagaaaaaaggggaggaaatcctgttcaccccacggggtttaattatccccgctgagaaaaagggggggcccccccccccaacggaagagggggaagaaacccccccttcgctccgcggatagggggaaaacctctcttcaacaattgtcaacacaacttgtcacaatcgttatgagagatacttttcacagccccttctttctcttcggggacgaaagagagatagacatatacatagaagaggggtctctcccggcggcgttgtttgaacacacacaaaatggtgttagcggggtgttattaacacacagagcataacggggagaatccttgtggcgttatacccgcgctgtttttcgggagaccatcaatattctgtcgataaaggtcatcacattggtacccacagcagaacacaacatgggagatataccaancggggggctttgttatacaccacactcgggggctcttccaccgtttacacacacagagtatgagaggtgtctctgtggtataaaagcgctctcacactctgtcccccccactgtcacaacacgctgttgtgtaatctcccacaggagagagatatggggtgtctctctcttttcgagaaatcctcgagaaaatttttcttntgtggggtgagaaaaaatatacacatctcgcaacagagnggtttctggagatgagagagaccacagcggtgtgtttgtcctgtgtggttcacagatatatctctcacaaggcccacagagaaagagatgagaattataatcccgttgagaaggagaaatgagcaccttgagagccttgttttctaaaattctacagcggcgctttgagattcaccgcacaagccacacacaccacaggtttagaaacacacaaggagatatatcaggagaaatttttgtgagatggtatatcttaatgtttcttgtaaaaaagggagacctgttctaagcaaggcgtgagatgagaataaagagatttaaagagagttatccctgggtaacaagagaaagaagaatgcccagatgacacttaagacctacttgtgatatttaaatgaagccattaaagacctattgatttggga

SEQ ID NO: 510614 - DNA, 604 bp, Homo sapiens
gtagtcatggtgtagctatccgtgtaaacacgacagcagtgaatctactccactagtctactagctgtatatacagtctactggagcactactgcatgacatgcaaaaggacaggattaacaggtttaatctagttcttctcccaaaagtgccaatccagcaattccaaataaggtatgaaaaggatccaccatatctacctggcctgtctgcaaatccccccgatgtcttcatacttgacatgctaaaatgaaattacgcagttactctctatcaatccaatgaagtcttccaattatcttgagggaagccaggacccaccatgagtagcatacatctggtaacttctccggccttccattgagcccgactgagggtaatagtcgttcacacaagccatcagccaagtaactcagcatatacttaatgcaactgacttgtaatagccagaaatcctgtgcaccaatagatctgaccagcatgggattcagaacctggtctgcaaccaaatccaccgtcaaagttcctacaggactaaaccaaatacgatagacatatataccaacataaaatagcatcaagctacccgacaaagccaaagtag

SEQ ID NO: 510615 - DNA, 663 bp, Homo sapiens
  misc_feature (11)..(11): n is a, c, g, or t
  misc_feature (123)..(123): n is a, c, g, or t
  misc_feature (148)..(148): n is a, c, g, or t
  misc_feature (177)..(177): n is a, c, g, or t
  misc_feature (184)..(184): n is a, c, g, or t
  misc_feature (191)..(191): n is a, c, g, or t
  misc_feature (216)..(216): n is a, c, g, or t
  misc_feature (289)..(289): n is a, c, g, or t
  misc_feature (295)..(295): n is a, c, g, or t
  misc_feature (300)..(300): n is a, c, g, or t
  misc_feature (322)..(322): n is a, c, g, or t
  misc_feature (325)..(325): n is a, c, g, or t
  misc_feature (351)..(351): n is a, c, g, or t
  misc_feature (355)..(355): n is a, c, g, or t
  misc_feature (365)..(365): n is a, c, g, or t
  misc_feature (404)..(404): n is a, c, g, or t
  misc_feature (410)..(410): n is a, c, g, or t
  misc_feature (555)..(555): n is a, c, g, or t
  misc_feature (562)..(562): n is a, c, g, or t
  misc_feature (573)..(573): n is a, c, g, or t
  misc_feature (636)..(636): n is a, c, g, or t
aaaagcaaatngattcatttcaatcaaaataactcatgtttacatatttataactgtacaataaaatatataaaatgttttcatatttcatacttcaatcatcatcttcttcctcttcatcgntgatcacatacttcttatgcttttnatttgctttatcatcatcttctgcttttntctttcnggaaggntcaccttcctcatcactggtaagtntctttgctttgagtaatctttgagctttatcttcttctgatccctcatcactgtctgatgaatagattctggntcgggnctctngggggggcccttgatggggggnttnggggggggggggggggatggggtggngggnttcctcctcngcatggtatcgatcaggttccaggtaactggggctcagnccccgntggtgctgtttctctctcattcggcgctgctgagattccctacgtatggaagccctcaaacgttcttcttctttcttaatcatttctgtgcgttggcattcaggatcacgaccagccattggcgaagattctaatcttctgtgtntttgaanacctatctgcnagtgacagagtcatctttctatgtgtggcactgtccgtagagtgaggtctgaaggtgagtttngttttaaagactgcttgtccctgtaga

SEQ ID NO: 510616 - DNA, 474 bp, Homo sapiens
  misc_feature (465)..(465): n is a, c, g, or t
ccacttaggcaccaatgtactccagggttccacctatgttgtaagccatgtgtccggaatttacttccttaagggctaagtaatctaattgtgtgtatataccacatttttgcttatcccattcatcccactgatagacacttggattgctccgatgttttagctattgtgaatattgctgctatgaatacgggtgtatagatacctcttcaaggtctgttttcaattcttgggtatatacccagaagtggatttgggaatcatctggtaattatatctttttaaactttttgagtatcttctctactactttccacagtggctgtaccattttcattcccaccaacagtatgcaaggaaaggctccaatttttccatttccttgccaacactattttctgggtagtttttgtttgttttttgtttttaatctttggagaaatgtctattcaagttttttgcccnatttttatt

SEQ ID NO: 510617 - DNA, 2211 bp, Homo sapiens
gttggtggttgcggcgtgggccgctctttcgctctctcttgctgtctgtgccgtgcttcgtctcgtccgcctgcttttctgccttgtttcgtctcccttcgtgctgctcgctcgcggcggctctgtcgttccttgtctcgctctcttcttctcttctcacctttcgctcatcctcccttcttctctcttctcgctctcgcttcgttcgccgtcctctctcgtccttccgctttctgttcttgtcgcctgctcgtctctctctggtttcttgttctctctcgtgtctgcttctcgttgcgtcctcgcctctccgccttctctctttctccctcttcctttctctcttcttctgtgctccctctgctccgtgctggtgctctcgcgtgctgctctcgcccttccttgttctgttctcgtcgtgctctctgtctccgtgtggcgtcctgcgccctgtgctctgccctgctctctcctgctctttttctggtgggcttctcgctgctgctcgtgtctgttcgtgtgtgcttcgtcgcgctcgcgtttgcgtgtctccgtcgtcatgtggtggttgtcgattgtccggtcgggtgctgtgcctcgctgcgagtgcgtccgcatctctcgtggtcctcgcctcttcccgctcctctctttcttcggtctctcgtcgtagtaccctcatctctcctgcggcttgtgctccttcctccctgtgtcgcttcgtctcgtgcttcactcgcgtccgagtcgctcgtgtgtgcgtagttctctggggcttggtgtgccgtcgcgtatgctgttgtttgtttttgttgtctttctgtgttggtttgatgtgtttgtgttgtggtttgtgtgtgggctttttgtctgggtgtgtatgttgtgtcctggcgtcgtgtgttcttggttgggctttgttttcttttgcttttttgttgttggtttgtttcgttgtgtccttgttgttttgtgttcgtctctctcttttctgttttttgtgttctttttcttgtctctgtgtgttaggttcgacaggcgtgcgcgctctctgtgcttttcttgtcgtctgtgtgagtgttcatgtgtgtggtcgagtttctgttgtccgtttcttatgctttgcccttggcgttgttgtggtgggtctgcggtttcatgtctggggtatggctccgtgcgtctgtgcgtctcgttgtcgagtgccgtctgttcatcttgccccttgcgtgtctcccgagggctgccggcgttggtcgctttggcctggttgctgggatgtgtctggtatgcttgggtgtaccatggacgtgcgggttgtgcggttgggttgcacgggtgtgtggtactcttggctggtggttgtgacaggcgttgccgttgggtgccctttgcgttcgtgcctgtgcgtttctgggcgtctctgaagtgtggttgtgtctgttttgtgctccggatggtggtcgtatcttgccccgtgcgaggcctccttgtggcgttcgtgtgtctgcctggtcctcggtgtccgtcgcgtgctgttgtcccttgctggtcgtgggttcatggtagcctcccttcgaggttgcgtcgccagttggccgagctttgcagtgcgggtggtgcactgctgccttctggggggccggttggttcggcgcaggctggtcctgtcttggttgtgtcgctaggcttcgcgatgggcgttctagccttgcgagctatgcttgggatgcccgtgggatggcgctgacctgtgcagggagtctctctgctgtggcctatctgactatcctgccgctcgagcttgcctcgggggttcgcctgcctgatgtgcattggcctgtggccatcgggctctttgggactccttcgtccaagatctggaacttaatggcacgtcacctcccatctgggccccaaggtcgcaggatgggtcccgtgccctatgccctatcactacacggccaggtgctgcagggccgtgtgcgcaagtcgccagccccgcttgccccgggtccagcggggctttgggtccgctgcctctcccacccaggtttggttcctcccggggccacccacgtgtggagataagaaggggatggaatgggggaacgaggaggagcacggaggccctcaatctttctgcatgaccctgtggttggggcatcaccccttctggagggctcggaggtcaggaggtggaaaccccag

SEQ ID NO: 510618 - DNA, 311 bp, Homo sapiens
  misc_feature (7)..(7): n is a, c, g, or t
  misc_feature (68)..(68): n is a, c, g, or t
  misc_feature (256)..(256): n is a, c, g, or t
tcagaangctttgctgatattgctgacttgaaacttaaaagaaatttgagaagcatgggtctccgaanctgcagatttctcttgtgctctctgttgcattgaaccatctgaaagctaccccttgaaagtcatcggtggaaaagcggaaatgcaacctgccactgtgcaacgcagcgcctggcaaattttttagttcattccagcaacaactttggtgccattctctcatctaccaactgggatcgcatacatatgngcagaggaatgcagtagaggttttaaagagagagccactgaattacttgcccctt

SEQ ID NO: 510619 - DNA, 973 bp, Homo sapiens
  misc_feature (750)..(750): n is a, c, g, or t
agcggggtccggacccattcgtcgcgtgccggaaccggccccgtagcgtgccatggcctgatacatctatccagctgccctcctgtggtgctgtacgatctgtgccgttaagcatgagacgcgctcattcgatctggagactagtgatgtgcggtgcagcctcctacggtgatcacagacctgatccagcatgtacgaagcatcaaagtccatggtagctgggtgcctggtgtgatgcgtcactgccgggatctgctgatttgtgcgttggggcatgccgagtaacggccacctgtctatactactgtgtggactcctccgtgtgaccgccttggagcctctaaccggagcgtgaccagaatcactcctgtactcctggaacatcctgtgttccgtgtaaactcaggctgtccccaagaatcgcaggccgttctccttgtaccgtctgattcagattgcacaagtaagaaagtcgcattttgggtaaaggcctatcttcgtaacgaaaaactgcgccttgacgggacttgaacatcccagcgaagcgaagagcgcgcgcagagctctataggattgcatagtgaactcgagaccaccgcttctttcgcaaagtggctccatacgcgaggtctacatacattgtccacgtcactgaggaagtactcgctaagatgcatcgcggcgagtgcacgtggtttcctttacaccaagagcacctttacacatatgaggaagggcagaggaatattncccccctgccgttaccttaaatttccctattgtaaacgcacaaggactcagaacgtcctttcacgcaccaaatggatgttctgctcttttgagatatctaagcgcacgtgtatcttttcagagttgctatagccttccgccatatttagcgccttaacagcccatgcggaaagaccaaagctttgtgtggtaaaggccgtttggggccttgtgaagcaacaag

SEQ ID NO: 510620 - DNA, 1278 bp, Homo sapiens
  misc_feature (160)..(160): n is a, c, g, or t
  misc_feature (304)..(304): n is a, c, g, or t
aatgcctacagttattcccccgtggacttactcgagaacaagaaagagcttatatagtgcaagctgacacgatagagaggacctgaacatcgtaaacttgctgcacaaggagaccatggggattctcgcctcactaagcccatgaggactagggtccccnttcacccatgagccctatctacaattagcgaggtggaagcggcttaatcagccagaagagttcgcgcgacctcgcaattaaagactggaaagagggaggcggcgacaaccttcgatcaacacgacgatggcttgcgactcgaantctctggatttcaatgcgcatcacttgtcacgattacagagacgcatccaagactaactatcggatgatgaggtgattaacatgatcgaattgagttaccagcaaagatcgcatgttacccacgaagagtcgacatctgtatgtagggcgcttgctcaatcgaggcgccagtaggagaatcgagcccgtgacagatacattagaggaaggcaggtgcaatggccgagatttatgagtccgggggacaagggtctcgtgaacaggcaacgcgaacggttagggctgcatgaagagtcgggccagactgtttgccacggagacagagtgacgccaactatcatgtccctggcttagctgaccaatacaagtggtagaagcgtcacaacacggccgttgcgaacagataagaaaacatcctgagagcagggctactcgatgacgtccagtaggagcagaatgatctacggaacaatgcagcttcgggagttggctcgcttaacatgggacccttcgggaaagaccgattcacgagcgatctgcaggacacgtggcagaaagctcaagagaacccacaagcgattgacaaccaccccagagcgtaccaaatgtggaaggggccggccacatagcgtcagcacggcactccaaaggcctggagaccccagacaggtccagaaaaagcgcgagatggactaacagaacccttggacccccatgatgaacagcgtgacaacacgctcccgagaccgggagcacaacgagaggcgggcaccaaaccccggtacaggcaccagacatgtctacccacaacaaacaccagaggactgaggacaccagcagagcaccagaaaatagaccgcacagaggccaaccagcgagaagaaggacaatagacgcaccaacccccaggccgactacagacgaaaagagcaccagcaaagaggcggaaccaagcaacgagacgaaaataaaaa

SEQ ID NO: 510621 - DNA, 250 bp, Homo sapiens
ggtaccgcgttgagggctgggtggctggcagcaccaggcggcgatggggcccgtcattcttcagcacacgaagtactctctccactctgccgtcttgtacaacgcacagggcgtctctcggtcacctcacaggccagcatgacacactcggaagttatggcatgcacgaacaccatgttctcgggggtccacgatacgcggggtgaactttcggggtaacccggaggcttccgaaatttcggtaaatcaa

SEQ ID NO: 510622 - DNA, 120 bp, Homo sapiens
gaaatggtatcccgaaaatttgtggccagaaaacaatatatatttgaggtgggacacccaataagagaagagacagcttggattcttagataatagaaagcaagctataacattcaggta

SEQ ID NO: 510623 - DNA, 170 bp, Homo sapiens
tttggggggggccccccccctttttttttggtttgggccccggaatttcccccccgggggggatttttcccgggggttttttgtttttgtgccccccccttttttggaacccccccctttttgggggttttcccccttttttcaaaaaatgggttttgtggggggattta

SEQ ID NO: 510624 - DNA, 378 bp, Homo sapiens
tgtctcagtaattaaatagagggctgggtgcgtcagctcatgtgtaatcccagcactttgggaagtcaggcaggtggatcacttgaggccaggagctcgagaccagcctggccaacttggtaaaaccccatctctactaaaaatacaaaaatttttacatggcgcctgtaaccccagctactccagaggctgaggcaggagaattgcttgaacccgggaggtggaggttgcagtgagccatgattgcactaccgcactctatcctgggcaacagagcaacaccctgtttggaaaaattaataaatagataataagaaaaaaaggattggttttttgtgcgtgtgtgtatatatatatttttttaagtaacagctttat

SEQ ID NO: 510625 - DNA, 246 bp, Homo sapiens
tgagagagagttcagtctgcagtcctgtgctcacagacatctgaaaagtgaatggccaagctggtctagtagatgaggctggactgacgaggggtaggcctcgcaccacattgaggatccaggccatggcacaggctgtcagtggcagagattggctgtgacctttgcccctaacacgaggaactcgctctacgggggcagacgttcctgtctcatttgccctctggtagaaagcggttatcacta

SEQ ID NO: 510626 - DNA, 911 bp, Homo sapiens
  misc_feature (35)..(35): n is a, c, g, or t
  misc_feature (42)..(43): n is a, c, g, or t
tctgtcagtaatccccggggttatgtagcgaggcntgggtgnngggcggcagttgtggtggcggagggggacagcgactcccggcccggacaggagttgttagtggcctggaacaccgtgagcaccggcctggtgccgccggctgcgctggggctggtgtcttcccggaccagcggtgcagtcccgccaaaggaagaggagctccgggcggcggtggaggttctgaggggccacgggctacactcggtcctggaggagtggttcgtggaggtgctgcagaacgatctgcaggccaacatctcccctgagttctggaatgccatctcccaatgcgagaactctgcggatgagccccagtgccttttgctactccttgacgcttttggcctgctggagagccgcctggatccctacctgcgtagcctagagctgctggagaaatggactcgcctgggcttgctgatgggcactggtgctcaggggctgcgagaagaagtccacactatgttgcgcggagtcttgttctttagcacccccagaaccttccaagagatgatccagcgtctgtatgggtgcttcttgagagtctatatgcagagtaagaggaagggggaagggggcacagacccggaactggaaggggagctggacagccggtatgcccgtcgccggtactaccggctcctgcagagcccgctgtgtgcagggtgcagcagtgacaagcaacagtgctggtgtcgccaggctctggagcagttccatcagctcagccaggtcttcacgagggtccgctggtgggagggtctgccgagtggccccacctgccaggtcccggagagtggtcgccccggcgggacaggccctcgggagccggtcggggtgcggcccaagttcaggagagcaatcggaag

SEQ ID NO: 510627 - DNA, 832 bp, Homo sapiens
gctggtgaccctgagggcgggcggagttacgcggctccccgtgcggctcctccgcggcggtgacggcgcaccgccactccccggttcccgctccccgtgctcctccgcccgggtccgccagtccgtgggcgctcccgtgcgtcggaatgatgccggccgtgtccaacgggtggacgtgcattgcggggcgctgcgctggtctctcatctctgggatatcctggagacctgctaaaagtaaatgaacgcagaacataacataagggataaacctagaggaaacctcggcaaattatcagactcaacatctcaagaggtgacaagacggtcgtctttgactgtgctagtacgctagaagaagaatagtacgctactgcgcagtgtgtcgtcttcactctcttcctaccatgtggcgcactgaccactatgatcttttgggacaccactgtgaggcctgctgaatccgtgcctttgacgtttcaaagctaagatacagcggaagaaagctagcattcgtggcgtaccccttgttcagtcctctgctggtgtgggtgaaacctcaaaaacaggtcgagcctgagtccgttcctgaattcagatagacgccagtcaacgaattgaccttgggccacgccgtggagacctcacgctatcattgggctcttggcgccgtgcagcctgcatcggcccagcatgtgggcacgctcgggaggatgtgcctgagtgccgttctgccgtgggacgatcgcctagagggtccctccgtacgcctggatggacacttatgagacatgctgttgacatgcagaagctgccggcccctggtgcgttga

SEQ ID NO: 510628 - DNA, 133 bp, Homo sapiens
gcgtcgacaaaattacctactgggtacagtgtacctaattcaggtgactggcatactaaaagtccagacttcatcattgtacaattcatccatgtaaccaaaaaccatttgtacccctaaagctattgaaagt

SEQ ID NO: 510629 - DNA, 810 bp, Homo sapiens
  misc_feature (26)..(26): n is a, c, g, or t
  misc_feature (707)..(707): n is a, c, g, or t
  misc_feature (715)..(715): n is a, c, g, or t
  misc_feature (725)..(726): n is a, c, g, or t
  misc_feature (728)..(728): n is a, c, g, or t
ggaacgagcgacaagggaaaacaacnaaaaacatacggctaggtacgaggctgggtgttaggcggcagttgtggtggcggagggggacagcgactcccggcccggacaggagttgttagtggcctggaacaccgtgagcaccggcctggtgccgccggctgcgctggggctggtgtcttcccggaccagcggtgcagtcccgccaaaggaagaggagctccgggcggcggtggaggttctgaggggccacgggctacactcggtcctggaggagtggttcgtggaggtgctgcagaacgatctgcaggccaacatctcccctgagttctggaatgccatctcccaatgcgagaactctgcggatgagccccagtgccttttgctactccttgacgcttttggcctgctggagagccgcctggatccctacctgcgtagcctagagctgctggagaaatggactcgcctgggcttgctgatgggcactggtgctcaggggctgcgagaagaagtccacactatgttgcgcggagtcttgttctttagcacccccagaaccttccaagagatgatccagcgtctgtatgggtgcttcttgagagtctatatgcagagtaagaggaagggggaagggggcacagacccggaactggaaggggagctggacagccggtatgcccgtcgccggtactaccggctcctgcaancccgttgntccaggtcanntnacagcaacatgtggtcccggtcgagcattcctatcgcaggttaccggcgctgtgacgtccgccagtttaccccctccggtcc

SEQ ID NO: 510630 - DNA, 206 bp, Homo sapiens
  misc_feature (41)..(41): n is a, c, g, or t
gagtcggcccagttctagttatacaggtttgaccctgccangcctgaattactaggaactaaacaccatgaatagccaagtaaacgccaacgttgtccacgaatccgaagcccagcgccaacacgcccgggtcaaaatcccggccaagctgcgcttcttcggcgccgaccaaacaccgatggaagtgctaagaattttggcatggg

SEQ ID NO: 510631 - DNA, 284 bp, Homo sapiens
acaccagtagcaatggtaacaaaaaccaaaattgacaacatgggatctaattaaactaaagagcttctgcattgcgaggagaaactaccatcagagtgaacaggcgacgtacagaatgggagaaaatttctgcaatctactcatctgacaaacggctaatatccagaattgccccgaagtccagaattgccccgaagtccagaattgccccgagtccagaattgccccgaagtccagaattgccccgaagtccagaattgccccgaagtccagaattgccccga

SEQ ID NO: 510632 - DNA, 482 bp, Homo sapiens
  misc_feature (261)..(262): n is a, c, g, or t
  misc_feature (351)..(352): n is a, c, g, or t
  misc_feature (397)..(397): n is a, c, g, or t
  misc_feature (465)..(465): n is a, c, g, or t
cattgttgaacttgaatctgaagaggaagtgaaattggctttgaagaacggacagagaaaccatgggacacagatacgttgaagtattcaagtctaacagtgttgaaatggattagggtgttgacagcatacatggtccgaatagccctgatactgccaacgatggcttcgtccggcttagaggactcccatttggctgtagcaaggaagagattgttcagattcttattcaagaggatatgcgaaaacttagtagcccannaatggcgatgacacatgccagtaggactttcagcgggcgtaagacacagggagacagccctatatgttgcaagattatgactatccacnnaggacgaactagctggagcacaggcccttaacagaaagcacaagngaaagaatagggcacaggtacattgagatcttcaagagtagccgagctgaagttcgaacccactatgnattccccctcggaaacg

SEQ ID NO: 510633 - DNA, 2692 bp, Homo sapiens
  misc_feature (26)..(26): n is a, c, g, or t
ggaacgagcgacaagggaaaacaacnaaaaacatacggctaggtacgaggctgggtgttaggcggcagttgtggtggcggagggggacagcgactcccggcccggacaggagttgttagtggcctggaacaccgtgagcaccggcctggtgccgccggctgcgctggggctggtgtcttcccggaccagcggtgcagtcccgccaaaggaagaggagctccgggcggcggtggaggttctgaggggccacgggctacactcggtcctggaggagtggttcgtggaggtgctgcagaacgatctgcaggccaacatctcccctgagttctggaatgccatctcccaatgcgagaactctgcggatgagccccagtgccttttgctactccttgacgcttttggcctgctggagagccgcctggatccctacctgcgtagcctagagctgctggagaaatggactcgcctgggcttgctgatgggcactggtgctcaggggctgcgagaagaagtccacactatgttgcgcggagtcttgttctttagcacccccagaaccttccaagagatgatccagcgtctgtatgggtgcttcttgagagtctatatgcagagtaagaggaagggggaagggggcacagacccggaactggaaggggagctggacagccggtatgcccgtcgccggtactaccggctcctgcagagcccgctgtgtgcagggtgcagcagtgacaagcaacagtgctggtgtcgccaggctctggagcagttccatcagctcagccaggtcttacacaggctcagtctgctggagcgggtcagtgccgaggctgtgaccaccaccctgcaccaggtgacccgggagaggatggaggaccgttgccggggcgagtacgagcgctccttcctgcgtgagttccacaagtggatcgagcgggtggtcggctggctcggcaaggtgttcctgcaggacggccccgccaggcccgcatctcccgaggccggcaacaccctgcgccgctggcgctgccacgtgcaaaggttcttctaccgcatctacgccagcctgcgcatcgaggagctcttcagcatcgtccgagacttcccagactcccggccagccatcgaggacctcaagtactgcctggagaggacggaccagaggcagcagctgctcgtgtccctcaaggctgccctggagactcggctcctgcatccaggcgtcaacacgtgtgacatcatcaccctctatatctctgccatcaaggcgctgcgcgtgctggacccttccatggtcatcctggaggtggcctgtgagcctatccgccgctacctgaggacgcgggaggacacagtgcggcagattgtggctgggctgacgggggactcggacgggacaggggacctggctgttgagctgtccaagaccgacccggcgagcctggagacaggccaggacagtgaggatgactcaggcgagccagaggactgggtcccggaccctgtggatgccgatccagggaagtcgagctccaagcggcgttcatcggacatcatcagcctgctggtcagcatctacggcagcaaggacctcttcatcaatgagtaccgctcgctgctggccgaccgcctgctgcaccagttcagcttcagccccgagcgggagatccgcaacgtggagctgctgaagctgcgctttggcgaggccccaatgcacttctgtgaagtcatgctgaaggacatggcggactcccgccgcatcaatgccaacatccgggaggaggatgagaagcggccagcagaggagcagccaccgttcggggtctacgctgtcatcctgtccagtgagttctggccgcccttcaaggacgagaagctggaggtccccgaggatatcagggcagccctggaggcttactgcaagaagtatgagcagctcaaggccatgcggaccctcagttggaagcacaccctgggcctggtgaccatggacgtggagctggccgaccgcacgctgtctgtggcggtcaccccagtacaggcggtgatcttgctgtattttcaggaccaagccagctggaccctggaggaactgagcaaggcggtgaagatgcccgtggcgctgctgcggcggcggatgtccgtgtggctgcagcagggtgtgctgcgtgaggagccccccggcaccttctctgtcattgaggaggagcggcctcaggaccgggacaacatggtgctcattgacagtgacgacgagagcgactccggcatggcctcccaggccgaccagaaggaggaggagctgctgctcttctggacgtacatccaggccatgctgaccaacctggagagcctctcactggatcgtatctacaacatgctccgcatgtttgtggtgactgggcctgcactggccgagattgacctgcaggagctgcagggctacctgcagaagaaggtgcgggaccagcagctcgtctactcggccggcgtctaccgcctgcccaagaactgcagctgacacatcgcccgcccgcccgcccgcccgccaggcgctgccctgcaggtgctctcgtcctcccgtgccagcccccgcccgcccgtgtcccagaatgcactgctgaggagcatgcccacccccacccccgcagtgtgcagattaaagcaagtcagatcatcaaaaaaaaaa

SEQ ID NO: 510634 - DNA, 2682 bp, Homo sapiens
  misc_feature (12)..(12): n is a, c, g, or t
tcgccgcgcgcngcgccgagcgaatctcggagtcggtgggtgcagatggcggcggcagttgtggtggcggagggggacagcgactcccggcccggacaggagttgttagtggcctggaacaccgtgagcaccggcctggtgccgccggctgcgctggggctggtgtcttcccggaccagcggtgcagtcccgccaaaggaagaggagctccgggcggcggtggaggttctgaggggccacgggctacactcggtcctggaggagtggttcgtggaggtgctgcagaacgatctgcaggccaacatctcccctgagttctggaatgccatctcccaatgcgagaactctgcggatgagccccagtgccttttgctactccttgacgcttttggcctgctggagagccgcctggatccctacctgcgtagcctagagctgctggagaaatggactcgcctgggcttgctgatgggcactggtgctcaggggctgcgagaagaagtccacactatgttgcgcggagtcttgttctttagcacccccagaaccttccaagagatgatccagcgtctgtatgggtgcttcttgagagtctatatgcagagtaagaggaagggggaagggggcacagacccggaactggaaggggagctggacagccggtatgcccgtcgccggtactaccggctcctgcagagcccgctgtgtgcagggtgcagcagtgacaagcaacagtgctggtgtcgccaggctctggagcagttccatcagctcagccaggtcttacacaggctcagtctgctggagcgggtcagtgccgaggctgtgaccaccaccctgcaccaggtgacccgggagaggatggaggaccgttgccggggcgagtacgagcgctccttcctgcgtgagttccacaagtggatcgagcgggtggtcggctggctcggcaaggtgttcctgcaggacggccccgccaggcccgcatctcccgaggccggcaacaccctgcgccgctggcgctgccacgtgcaaaggttcttctaccgcatctacgccagcctgcgcatcgaggagctcttcagcatcgtccgagacttcccagactcccggccagccatcgaggacctcaagtactgcctggagaggacggaccagaggcagcagctgctcgtgtccctcaaggctgccctggagactcggctcctgcatccaggcgtcaacacgtgtgacatcatcaccctctatatctctgccatcaaggcgctgcgcgtgctggacccttccatggtcatcctggaggtggcctgtgagcctatccgccgctacctgaggacgcgggaggacacagtgcggcagattgtggctgggctgacgggggactcggacgggacaggggacctggctgttgagctgtccaagaccgacccggcgagcctggagacaggccaggacagtgaggatgactcaggcgagccagaggactgggtcccggaccctgtggatgccgatccagggaagtcgagctccaagcggcgttcatcggacatcatcagcctgctggtcagcatctacggcagcaaggacctcttcatcaatgagtaccgctcgctgctggccgaccgcctgctgcaccagttcagcttcagccccgagcgggagatccgcaacgtggagctgctgaagctgcgctttggcgaggccccaatgcacttctgtgaagtcatgctgaaggacatggcggactcccgccgcatcaatgccaacatccgggaggaggatgagaagcggccagcagaggagcagccaccgttcggggtctacgctgtcatcctgtccagtgagttctggccgcccttcaaggacgagaagctggaggtccccgaggatatcagggcagccctggaggcttactgcaagaagtatgagcagctcaaggccatgcggaccctcagttggaagcacaccctgggcctggtgaccatggacgtggagctggccgaccgcacgctgtctgtggcggtcaccccagtacaggcggtgatcttgctgtattttcaggaccaagccagctggaccctggaggaactgagcaaggcggtgaagatgcccgtggcgctgctgcggcggcggatgtccgtgtggctgcagcagggtgtgctgcgtgaggagccccccggcaccttctctgtcattgaggaggagcggcctcaggaccgggacaacatggtgctcattgacagtgacgacgagagcgactccggcatggcctcccaggccgaccagaaggaggaggagctgctgctcttctggacgtacatccaggccatgctgaccaacctggagagcctctcactggatcgtatctacaacatgctccgcatgtttgtggtgactgggcctgcactggccgagattgacctgcaggagctgcagggctacctgcagaagaaggtgcgggaccagcagctcgtctactcggccggcgtctaccgcctgcccaagaactgcagctgacacatcgcccgcccgcccgcccgcccgccaggcgctgccctgcaggtgctctcgtcctcccgtgccagcccccgcccgcccgtgtcccagaatgcactgctgaggagcatgcccacccccacccccgcagtgtgcagattaaagcaagtcagatcatcaaaaaaaaaa

SEQ ID NO: 510635 - DNA, 409 bp, Homo sapiens
gcacggcctaaccgacggcatcttgaacttgggcattttgaacctgctgtctttggcagtcacatccttgtcggccaaggacaggtccccctccaactgtgcactatccagcttggctctccgagcctggacgtccacctcgacgctgggcagagacacctcgacatcggggactctcacttccaccttggggtcttttaggtccagcttggggcccttgatgtccatctgggggcccttgaggtccattttggccatcttcaaactgcgcttctccaccttgggcaagttcccttcaaggccagctccctcgggcaggtggccctccgggagcttcacatccacctggtcagcctggaccttcaggtcagtagaagcgggctgaatgctgaggtcagtggtcttcagg

SEQ ID NO: 510636 - DNA, 243 bp, Homo sapiens
  misc_feature (6)..(6): n is a, c, g, or t
accttnaccttttccctcttggggaaaaggaggggatttataggggaaaatggactttatggaaaaaattttaagaactaaaaaaaattttttttttaaaaaaggaaagggcccttaattttaccccggtaaaatactgattaaaaatttggtgaggtgatttaaggggtaaaaaaattggatccagaggtttattttttggcttcaaagcccttttaaaaaagccttttttttacatgggga

SEQ ID NO: 510637 - DNA, 2676 bp, Homo sapiens
  misc_feature (35)..(35): n is a, c, g, or t
  misc_feature (42)..(43): n is a, c, g, or t
tctgtcagtaatccccggggttatgtagcgaggcntgggtgnngggcggcagttgtggtggcggagggggacagcgactcccggcccggacaggagttgttagtggcctggaacaccgtgagcaccggcctggtgccgccggctgcgctggggctggtgtcttcccggaccagcggtgcagtcccgccaaaggaagaggagctccgggcggcggtggaggttctgaggggccacgggctacactcggtcctggaggagtggttcgtggaggtgctgcagaacgatctgcaggccaacatctcccctgagttctggaatgccatctcccaatgcgagaactctgcggatgagccccagtgccttttgctactccttgacgcttttggcctgctggagagccgcctggatccctacctgcgtagcctagagctgctggagaaatggactcgcctgggcttgctgatgggcactggtgctcaggggctgcgagaagaagtccacactatgttgcgcggagtcttgttctttagcacccccagaaccttccaagagatgatccagcgtctgtatgggtgcttcttgagagtctatatgcagagtaagaggaagggggaagggggcacagacccggaactggaaggggagctggacagccggtatgcccgtcgccggtactaccggctcctgcagagcccgctgtgtgcagggtgcagcagtgacaagcaacagtgctggtgtcgccaggctctggagcagttccatcagctcagccaggtcttacacaggctcagtctgctggagcgggtcagtgccgaggctgtgaccaccaccctgcaccaggtgacccgggagaggatggaggaccgttgccggggcgagtacgagcgctccttcctgcgtgagttccacaagtggatcgagcgggtggtcggctggctcggcaaggtgttcctgcaggacggccccgccaggcccgcatctcccgaggccggcaacaccctgcgccgctggcgctgccacgtgcaaaggttcttctaccgcatctacgccagcctgcgcatcgaggagctcttcagcatcgtccgagacttcccagactcccggccagccatcgaggacctcaagtactgcctggagaggacggaccagaggcagcagctgctcgtgtccctcaaggctgccctggagactcggctcctgcatccaggcgtcaacacgtgtgacatcatcaccctctatatctctgccatcaaggcgctgcgcgtgctggacccttccatggtcatcctggaggtggcctgtgagcctatccgccgctacctgaggacgcgggaggacacagtgcggcagattgtggctgggctgacgggggactcggacgggacaggggacctggctgttgagctgtccaagaccgacccggcgagcctggagacaggccaggacagtgaggatgactcaggcgagccagaggactgggtcccggaccctgtggatgccgatccagggaagtcgagctccaagcggcgttcatcggacatcatcagcctgctggtcagcatctacggcagcaaggacctcttcatcaatgagtaccgctcgctgctggccgaccgcctgctgcaccagttcagcttcagccccgagcgggagatccgcaacgtggagctgctgaagctgcgctttggcgaggccccaatgcacttctgtgaagtcatgctgaaggacatggcggactcccgccgcatcaatgccaacatccgggaggaggatgagaagcggccagcagaggagcagccaccgttcggggtctacgctgtcatcctgtccagtgagttctggccgcccttcaaggacgagaagctggaggtccccgaggatatcagggcagccctggaggcttactgcaagaagtatgagcagctcaaggccatgcggaccctcagttggaagcacaccctgggcctggtgaccatggacgtggagctggccgaccgcacgctgtctgtggcggtcaccccagtacaggcggtgatcttgctgtattttcaggaccaagccagctggaccctggaggaactgagcaaggcggtgaagatgcccgtggcgctgctgcggcggcggatgtccgtgtggctgcagcagggtgtgctgcgtgaggagccccccggcaccttctctgtcattgaggaggagcggcctcaggaccgggacaacatggtgctcattgacagtgacgacgagagcgactccggcatggcctcccaggccgaccagaaggaggaggagctgctgctcttctggacgtacatccaggccatgctgaccaacctggagagcctctcactggatcgtatctacaacatgctccgcatgtttgtggtgactgggcctgcactggccgagattgacctgcaggagctgcagggctacctgcagaagaaggtgcgggaccagcagctcgtctactcggccggcgtctaccgcctgcccaagaactgcagctgacacatcgcccgcccgcccgcccgcccgccaggcgctgccctgcaggtgctctcgtcctcccgtgccagcccccgcccgcccgtgtcccagaatgcactgctgaggagcatgcccacccccacccccgcagtgtgcagattaaagcaagtcagatcatcaaaaaaaaaa

SEQ ID NO: 510638 - DNA, 2673 bp, Homo sapiens
ccatgaagagtagaggcgtcacgtgtaattcatcctgtacgttggcttagttgtagtagttgcctggctacaatttacacggccggacaggagttgttagtggcctggaacaccgtgagcaccggcctggtgccgccggctgcgctggggctggtgtcttcccggaccagcggtgcagtcccgccaaaggaagaggagctccgggcggcggtggaggttctgaggggccacgggctacactcggtcctggaggagtggttcgtggaggtgctgcagaacgatctgcaggccaacatctcccctgagttctggaatgccatctcccaatgcgagaactctgcggatgagccccagtgccttttgctactccttgacgcttttggcctgctggagagccgcctggatccctacctgcgtagcctagagctgctggagaaatggactcgcctgggcttgctgatgggcactggtgctcaggggctgcgagaagaagtccacactatgttgcgcggagtcttgttctttagcacccccagaaccttccaagagatgatccagcgtctgtatgggtgcttcttgagagtctatatgcagagtaagaggaagggggaagggggcacagacccggaactggaaggggagctggacagccggtatgcccgtcgccggtactaccggctcctgcagagcccgctgtgtgcagggtgcagcagtgacaagcaacagtgctggtgtcgccaggctctggagcagttccatcagctcagccaggtcttacacaggctcagtctgctggagcgggtcagtgccgaggctgtgaccaccaccctgcaccaggtgacccgggagaggatggaggaccgttgccggggcgagtacgagcgctccttcctgcgtgagttccacaagtggatcgagcgggtggtcggctggctcggcaaggtgttcctgcaggacggccccgccaggcccgcatctcccgaggccggcaacaccctgcgccgctggcgctgccacgtgcaaaggttcttctaccgcatctacgccagcctgcgcatcgaggagctcttcagcatcgtccgagacttcccagactcccggccagccatcgaggacctcaagtactgcctggagaggacggaccagaggcagcagctgctcgtgtccctcaaggctgccctggagactcggctcctgcatccaggcgtcaacacgtgtgacatcatcaccctctatatctctgccatcaaggcgctgcgcgtgctggacccttccatggtcatcctggaggtggcctgtgagcctatccgccgctacctgaggacgcgggaggacacagtgcggcagattgtggctgggctgacgggggactcggacgggacaggggacctggctgttgagctgtccaagaccgacccggcgagcctggagacaggccaggacagtgaggatgactcaggcgagccagaggactgggtcccggaccctgtggatgccgatccagggaagtcgagctccaagcggcgttcatcggacatcatcagcctgctggtcagcatctacggcagcaaggacctcttcatcaatgagtaccgctcgctgctggccgaccgcctgctgcaccagttcagcttcagccccgagcgggagatccgcaacgtggagctgctgaagctgcgctttggcgaggccccaatgcacttctgtgaagtcatgctgaaggacatggcggactcccgccgcatcaatgccaacatccgggaggaggatgagaagcggccagcagaggagcagccaccgttcggggtctacgctgtcatcctgtccagtgagttctggccgcccttcaaggacgagaagctggaggtccccgaggatatcagggcagccctggaggcttactgcaagaagtatgagcagctcaaggccatgcggaccctcagttggaagcacaccctgggcctggtgaccatggacgtggagctggccgaccgcacgctgtctgtggcggtcaccccagtacaggcggtgatcttgctgtattttcaggaccaagccagctggaccctggaggaactgagcaaggcggtgaagatgcccgtggcgctgctgcggcggcggatgtccgtgtggctgcagcagggtgtgctgcgtgaggagccccccggcaccttctctgtcattgaggaggagcggcctcaggaccgggacaacatggtgctcattgacagtgacgacgagagcgactccggcatggcctcccaggccgaccagaaggaggaggagctgctgctcttctggacgtacatccaggccatgctgaccaacctggagagcctctcactggatcgtatctacaacatgctccgcatgtttgtggtgactgggcctgcactggccgagattgacctgcaggagctgcagggctacctgcagaagaaggtgcgggaccagcagctcgtctactcggccggcgtctaccgcctgcccaagaactgcagctgacacatcgcccgcccgcccgcccgcccgccaggcgctgccctgcaggtgctctcgtcctcccgtgccagcccccgcccgcccgtgtcccagaatgcactgctgaggagcatgcccacccccacccccgcagtgtgcagattaaagcaagtcagatcatcaaaaaaaaaa

SEQ ID NO: 510639 - DNA, 183 bp, Homo sapiens
tctttcgcgcctttcctgagcgcaccgtagtcgaactcgtggttcccgatcgcgagcgcggcgtaaggaagcgtgttgtagtacttctccacgctctcgccatggaagaggttcgactcgagcgtgccctggtacatgtcgcccgcgtcgagcatgacgaggtgatcgccgaacttgcgccgg

SEQ ID NO: 510640 - DNA, 2683 bp, Homo sapiens
  misc_feature (75)..(75): n is a, c, g, or t
  misc_feature (77)..(77): n is a, c, g, or t
  misc_feature (79)..(79): n is a, c, g, or t
  misc_feature (85)..(89): n is a, c, g, or t
ggagatatgcctaggtctgtgctgggttttatttcgtcacggggacatggctgcggtagttgtggtggcgcctcngngnaccgannnnnggcccggacaggagttgttagtggcctggaacaccgtgagcaccggcctggtgccgccggctgcgctggggctggtgtcttcccggaccagcggtgcagtcccgccaaaggaagaggagctccgggcggcggtggaggttctgaggggccacgggctacactcggtcctggaggagtggttcgtggaggtgctgcagaacgatctgcaggccaacatctcccctgagttctggaatgccatctcccaatgcgagaactctgcggatgagccccagtgccttttgctactccttgacgcttttggcctgctggagagccgcctggatccctacctgcgtagcctagagctgctggagaaatggactcgcctgggcttgctgatgggcactggtgctcaggggctgcgagaagaagtccacactatgttgcgcggagtcttgttctttagcacccccagaaccttccaagagatgatccagcgtctgtatgggtgcttcttgagagtctatatgcagagtaagaggaagggggaagggggcacagacccggaactggaaggggagctggacagccggtatgcccgtcgccggtactaccggctcctgcagagcccgctgtgtgcagggtgcagcagtgacaagcaacagtgctggtgtcgccaggctctggagcagttccatcagctcagccaggtcttacacaggctcagtctgctggagcgggtcagtgccgaggctgtgaccaccaccctgcaccaggtgacccgggagaggatggaggaccgttgccggggcgagtacgagcgctccttcctgcgtgagttccacaagtggatcgagcgggtggtcggctggctcggcaaggtgttcctgcaggacggccccgccaggcccgcatctcccgaggccggcaacaccctgcgccgctggcgctgccacgtgcaaaggttcttctaccgcatctacgccagcctgcgcatcgaggagctcttcagcatcgtccgagacttcccagactcccggccagccatcgaggacctcaagtactgcctggagaggacggaccagaggcagcagctgctcgtgtccctcaaggctgccctggagactcggctcctgcatccaggcgtcaacacgtgtgacatcatcaccctctatatctctgccatcaaggcgctgcgcgtgctggacccttccatggtcatcctggaggtggcctgtgagcctatccgccgctacctgaggacgcgggaggacacagtgcggcagattgtggctgggctgacgggggactcggacgggacaggggacctggctgttgagctgtccaagaccgacccggcgagcctggagacaggccaggacagtgaggatgactcaggcgagccagaggactgggtcccggaccctgtggatgccgatccagggaagtcgagctccaagcggcgttcatcggacatcatcagcctgctggtcagcatctacggcagcaaggacctcttcatcaatgagtaccgctcgctgctggccgaccgcctgctgcaccagttcagcttcagccccgagcgggagatccgcaacgtggagctgctgaagctgcgctttggcgaggccccaatgcacttctgtgaagtcatgctgaaggacatggcggactcccgccgcatcaatgccaacatccgggaggaggatgagaagcggccagcagaggagcagccaccgttcggggtctacgctgtcatcctgtccagtgagttctggccgcccttcaaggacgagaagctggaggtccccgaggatatcagggcagccctggaggcttactgcaagaagtatgagcagctcaaggccatgcggaccctcagttggaagcacaccctgggcctggtgaccatggacgtggagctggccgaccgcacgctgtctgtggcggtcaccccagtacaggcggtgatcttgctgtattttcaggaccaagccagctggaccctggaggaactgagcaaggcggtgaagatgcccgtggcgctgctgcggcggcggatgtccgtgtggctgcagcagggtgtgctgcgtgaggagccccccggcaccttctctgtcattgaggaggagcggcctcaggaccgggacaacatggtgctcattgacagtgacgacgagagcgactccggcatggcctcccaggccgaccagaaggaggaggagctgctgctcttctggacgtacatccaggccatgctgaccaacctggagagcctctcactggatcgtatctacaacatgctccgcatgtttgtggtgactgggcctgcactggccgagattgacctgcaggagctgcagggctacctgcagaagaaggtgcgggaccagcagctcgtctactcggccggcgtctaccgcctgcccaagaactgcagctgacacatcgcccgcccgcccgcccgcccgccaggcgctgccctgcaggtgctctcgtcctcccgtgccagcccccgcccgcccgtgtcccagaatgcactgctgaggagcatgcccacccccacccccgcagtgtgcagattaaagcaagtcagatcatcaaaaaaaaaa

SEQ ID NO: 510641 - DNA, 724 bp, Homo sapiens
tgtcgccgcgacacgcgtggagttgcgtgatgctcgtgggtacgcttactgggtgcgatcgtcggtagtgcagggtgagcgtgcggagaccgagccgatcgcaatggcgtttgccgacatgtggcctcacattcagcaattggggttcgtctcgagctacgaaggtggtcgtgtctattaatcttagttgtatatatttttgagacgagtcttgttttgtcatccaggctggagtgcaatagcacgatctcggctcactgcaacctctgcctcctgaggcaggagaattgcttgaacctgggagccagaggtagcagtgagctgagatcacgccactacactccagcctggatgacaaaacaagactctgtctaaaaaatatataaataaataaaagaaagaaaattcatagtagagagaaaccctacaaatgtgaagaatgtggcaaagcttttaatcggtcctcaagacttactcaacataagaaaattcatactagagagaaaccttacagatgtgaagaatgtgccaaagcttttacccggtcttcaagacttactcaacataagaaaattcataggatgggtgtggtggctcatgcctgtaatcccagcactttgggagtcagaggtgggcggatcacgaggtcaggagatgagaccgtcttcagcgacatggtaaaccgttagctgggggtgggggggcgtggtgggttggggggggg

SEQ ID NO: 510642 - DNA, 2928 bp, Homo sapiens
  misc_feature (26)..(26): n is a, c, g, or t
ggaacgagcgacaagggaaaacaacnaaaaacatacggctaggtacgaggctgggtgttaggcggcagttgtggtggcggagggggacagcgactcccggcccggacaggagttgttagtggcctggaacaccgtgagcaccggcctggtgccgccggctgcgctggggctggtgtcttcccggaccagcggtgcagtcccgccaaaggaagaggagctccgggcggcggtggaggttctgaggggccacgggctacactcggtcctggaggagtggttcgtggaggtgctgcagaacgatctgcaggccaacatctcccctgagttctggaatgccatctcccaatgcgagaactctgcggatgagccccagtgccttttgctactccttgacgcttttggcctgctggagagccgcctggatccctacctgcgtagcctagagctgctggagaaatggactcgcctgggcttgctgatgggcactggtgctcaggggctgcgagaagaagtccacactatgttgcgcggagtcttgttctttagcacccccagaaccttccaagagatgatccagcgtctgtatgggtgcttcttgagagtctatatgcagagtaagaggaagggggaagggggcacagacccggaactggaaggggagctggacagccggtatgcccgtcgccggtactaccggctcctgcagagcccgctgtgtgcagggtgcagcagtgacaagcaacagtgctggtgtcgccaggctctggagcagttccatcagctcagccaggtcttacacaggctcagtctgctggagcgggtcagtgccgaggctgtgaccaccaccctgcaccaggtgacccgggagaggatggaggaccgttgccggggcgagtacgagcgctccttcctgcgtgagttccacaagtggatcgagcgggtggtcggctggctcggcaaggtgttcctgcaggacggccccgccaggcccgcatctcccgaggccggcaacaccctgcgccgctggcgctgccacgtgcaaaggttcttctaccgcatctacgccagcctgcgcatcgaggagctcttcagcatcgtccgagacttcccagactcccggccagccatcgaggacctcaagtactgcctggagaggacggaccagaggcagcagctgctcgtgtccctcaaggctgccctggagactcggctcctgcatccaggcgtcaacacgtgtgacatcatcaccctctatatctctgccatcaaggcgctgcgcgtgctggacccttccatggtcatcctggaggtggcctgtgagcctatccgccgctacctgaggacgcgggaggacacagtgcggcagattgtggctgggctgacgggggactcggacgggacaggggacctggctgttgagctgtccaagaccgacccggcgagcctggagacaggccaggacagtgaggatgactcaggcgagccagaggactgggtcccggaccctgtggatgccgatccagggaagtcgagctccaagcggcgttcatcggacatcatcagcctgctggtcagcatctacggcagcaaggacctcttcatcaatgagtaccgctcgctgctggccgaccgcctgctgcaccagttcagcttcagccccgagcgggagatccgcaacgtggagctgctgaagctgcgctttggcgaggccccaatgcacttctgtgaagtcatgctgaaggacatggcggactcccgccgcatcaatgccaacatccgggaggaggatgagaagcggccagcagaggagcagccaccgttcggggtctacgctgtcatcctgtccagtgagttctggccgcccttcaaggacgagaagctggaggtccccgaggatatcagggcagccctggaggcttactgcaagaagtatgagcagctcaaggccatgcggaccctcagttggaagcacaccctgggcctggtgaccatggacgtggagctggccgaccgcacgctgtctgtggcggtcaccccagtacaggcggtgatcttgctgtattttcaggaccaaggtgagcccaccagcccctagctggcctgccccggccacacggcccagctgtgggtgaggggctgttccccagtgagggtgtggtttggggcagctgcgccagcaggcggcacccttccctttcccacgggcaaggcagggtggcccgggagccccccgacctctcggctgacgggaggcaggggaggtgcagcccgtgcccaggctgcccagcgtccccggtgactctgcacgcagccagctggaccctggaggaactgagcaaggcggtgaagatgcccgtggcgctgctgcggcggcggatgtccgtgtggctgcagcagggtgtgctgcgtgaggagccccccggcaccttctctgtcattgaggaggagcggcctcaggaccgggacaacatggtgctcattgacagtgacgacgagagcgactccggcatggcctcccaggccgaccagaaggaggaggagctgctgctcttctggacgtacatccaggccatgctgaccaacctggagagcctctcactggatcgtatctacaacatgctccgcatgtttgtggtgactgggcctgcactggccgagattgacctgcaggagctgcagggctacctgcagaagaaggtgcgggaccagcagctcgtctactcggccggcgtctaccgcctgcccaagaactgcagctgacacatcgcccgcccgcccgcccgcccgccaggcgctgccctgcaggtgctctcgtcctcccgtgccagcccccgcccgcccgtgtcccagaatgcactgctgaggagcatgcccacccccacccccgcagtgtgcagattaaagcaagtcagatcatcaaaaaaaaaa

SEQ ID NO: 510643 - DNA, 411 bp, Homo sapiens
  misc_feature (57)..(57): n is a, c, g, or t
  misc_feature (386)..(386): n is a, c, g, or t
  misc_feature (401)..(401): n is a, c, g, or t
gatgtgtaaaattccccacgatagggcaaaagcatggcccactcccacactaatgcngcccctctcactaaattaaacccttggaaaaataagatgtggccttggcctttaaaacctcagtgaactatcctttatggtacagttggtttcccatagcctgtaaacacaaaagatcctatggtttcctgccctaccccaggatagtccttgtctctagacaatgtattgatgatgcaaatgttctggaactaaatagtggtgatggtggcacaacactgtgaatgtactaaatgtcactgatttgtacgtatttaatatgaattaaatgttaaaatggtgaattatatttatgtatattttaccataataaaaatatgcattggaanatgcattttttgtgnccaaaaaaaa

SEQ ID NO: 510644 - DNA, 302 bp, Homo sapiens
  misc_feature (10)..(10): n is a, c, g, or t
  misc_feature (21)..(21): n is a, c, g, or t
  misc_feature (23)..(23): n is a, c, g, or t
  misc_feature (38)..(38): n is a, c, g, or t
  misc_feature (114)..(114): n is a, c, g, or t
  misc_feature (224)..(224): n is a, c, g, or t
  misc_feature (296)..(296): n is a, c, g, or t
aggagtcatntttcgcagccngngaccaggccctccanggagacgtactgtgctacccccgccaagtccgagagggacgtgtcgacccctccgaccgtgcttccggacaacttncccagataccccgtgggcaagttcttccaatatgacacctggaatcagtccacccagcgcctggaggggcctgctgccctcctgcgtgcccgccggggtcacgtgctcgncaaggagctcgaggcgttcagggaggccaaacgtcaccgtcccctgattgctctacccacccaagaccccgnccaggg

SEQ ID NO: 510645 - DNA, 2767 bp, Homo sapiens
  misc_feature (75)..(75): n is a, c, g, or t
  misc_feature (77)..(77): n is a, c, g, or t
  misc_feature (79)..(79): n is a, c, g, or t
  misc_feature (85)..(89): n is a, c, g, or t
ggagatatgcctaggtctgtgctgggttttatttcgtcacggggacatggctgcggtagttgtggtggcgcctcngngnaccgannnnnggcggcggcagttgtggtggcggagggggacagcgactcccggcccggacaggagttgttagtggcctggaacaccgtgagcaccggcctggtgccgccggctgcgctggggctggtgtcttcccggaccagcggtgcagtcccgccaaaggaagaggagctccgggcggcggtggaggttctgaggggccacgggctacactcggtcctggaggagtggttcgtggaggtgctgcagaacgatctgcaggccaacatctcccctgagttctggaatgccatctcccaatgcgagaactctgcggatgagccccagtgccttttgctactccttgacgcttttggcctgctggagagccgcctggatccctacctgcgtagcctagagctgctggagaaatggactcgcctgggcttgctgatgggcactggtgctcaggggctgcgagaagaagtccacactatgttgcgcggagtcttgttcttcttaaggggccccaacacccctccccccaatgaaaaactcctttagcacccccagaaccttccaagagatgatccagcgtctgtatgggtgcttcttgagagtctatatgcagagtaagaggaagggggaagggggcacagacccggaactggaaggggagctggacagccggtatgcccgtcgccggtactaccggctcctgcagagcccgctgtgtgcagggtgcagcagtgacaagcaacagtgctggtgtcgccaggctctggagcagttccatcagctcagccaggtcttacacaggctcagtctgctggagcgggtcagtgccgaggctgtgaccaccaccctgcaccaggtgacccgggagaggatggaggaccgttgccggggcgagtacgagcgctccttcctgcgtgagttccacaagtggatcgagcgggtggtcggctggctcggcaaggtgttcctgcaggacggccccgccaggcccgcatctcccgaggccggcaacaccctgcgccgctggcgctgccacgtgcaaaggttcttctaccgcatctacgccagcctgcgcatcgaggagctcttcagcatcgtccgagacttcccagactcccggccagccatcgaggacctcaagtactgcctggagaggacggaccagaggcagcagctgctcgtgtccctcaaggctgccctggagactcggctcctgcatccaggcgtcaacacgtgtgacatcatcaccctctatatctctgccatcaaggcgctgcgcgtgctggacccttccatggtcatcctggaggtggcctgtgagcctatccgccgctacctgaggacgcgggaggacacagtgcggcagattgtggctgggctgacgggggactcggacgggacaggggacctggctgttgagctgtccaagaccgacccggcgagcctggagacaggccaggacagtgaggatgactcaggcgagccagaggactgggtcccggaccctgtggatgccgatccagggaagtcgagctccaagcggcgttcatcggacatcatcagcctgctggtcagcatctacggcagcaaggacctcttcatcaatgagtaccgctcgctgctggccgaccgcctgctgcaccagttcagcttcagccccgagcgggagatccgcaacgtggagctgctgaagctgcgctttggcgaggccccaatgcacttctgtgaagtcatgctgaaggacatggcggactcccgccgcatcaatgccaacatccgggaggaggatgagaagcggccagcagaggagcagccaccgttcggggtctacgctgtcatcctgtccagtgagttctggccgcccttcaaggacgagaagctggaggtccccgaggatatcagggcagccctggaggcttactgcaagaagtatgagcagctcaaggccatgcggaccctcagttggaagcacaccctgggcctggtgaccatggacgtggagctggccgaccgcacgctgtctgtggcggtcaccccagtacaggcggtgatcttgctgtattttcaggaccaagccagctggaccctggaggaactgagcaaggcggtgaagatgcccgtggcgctgctgcggcggcggatgtccgtgtggctgcagcagggtgtgctgcgtgaggagccccccggcaccttctctgtcattgaggaggagcggcctcaggaccgggacaacatggtgctcattgacagtgacgacgagagcgactccggcatggcctcccaggccgaccagaaggaggaggagctgctgctcttctggacgtacatccaggccatgctgaccaacctggagagcctctcactggatcgtatctacaacatgctccgcatgtttgtggtgactgggcctgcactggccgagattgacctgcaggagctgcagggctacctgcagaagaaggtgcgggaccagcagctcgtctactcggccggcgtctaccgcctgcccaagaactgcagctgacacatcgcccgcccgcccgcccgcccgccaggcgctgccctgcaggtgctctcgtcctcccgtgccagcccccgcccgcccgtgtcccagaatgcactgctgaggagcatgcccacccccacccccgcagtgtgcagattaaagcaagtcagatcatcaaaaaaaaaa

SEQ ID NO: 510646 - DNA, 157 bp, Homo sapiens
  misc_feature (79)..(79): n is a, c, g, or t
ttctgattacgtagcttgtagtaagtttgaaataaggaaatgcgagatcctcaactatgtacttttggaagattctttngacgtgttcagagtcccttaagattccatgtgaatttggggatcgattttttttttgatttctgcagaaagtaccatg

SEQ ID NO: 510647 - DNA, 188 bp, Homo sapiens
ccccgtatgtatgtatgtatgtatgcatgtatgtatgtatgtatttattttgagacggagttttgctcttgttgcccaggctagagtgcaatggtgcggtctcagctcactgcaacctccacctcctgggttcaaacgattcattctcctgcctcagcctcccaactagctaggattacaggtgccca

SEQ ID NO: 510648 - DNA, 301 bp, Homo sapiens
  misc_feature (140)..(140): n is a, c, g, or t
  misc_feature (267)..(267): n is a, c, g, or t
gtcttatcacgtgcatgtggaaggatagtgctgctgtgtacaattatacaccatgatgtttctggtctataactccggaatacaggctgcgcaagatcatgtgacactacatctacaggaacaagatctgcagggcattngtggaggcacgtatcgttcgaagaattcctttccctgccgcaataaagagacacttgtccattaaagttatcaaatcccaatcccctgggaaaaggttctttccaactggcaccaacaatcgatggncctttacaatgtggccaaacatttagtttggctc

SEQ ID NO: 510649 - DNA, 553 bp, Homo sapiens
gcaagatcctgctgcacaagtcgagcattaacagggagggcacacggttacggagccggatggctgactgtatttcaattgggcatgtcaaagtccaatggcagcgtctatcggccgggactcctctcaggtgcacccgttagctgtgctgctgcatgaccgacggggacgtgcacatccgtgatgacgggcgccgggcccaccatcgtcaactgagcgacagtgacctgctgccggctggagggtgactcgcgtaccgtgcggcttgctgacaggagctgcggcgggccctgggccgcatggtggagcggaacctgcgcagcgagctggctgcacttgctccgcagcgatactatggaggagcacggtgcaagctgcgttgcgctacgtgtgcatgagcatgctgcagaggaccacgtgtggcagttttgatgtgcgcaagaccagctgacgactgagccctgcttctgctaggggctgtgtacagagtgcaaatgtctgatttaccacactaaagttctattgtatccctatgtgaaagcagtgccctcgg

SEQ ID NO: 510650 - DNA, 517 bp, Homo sapiens
gaccacctcttccggtaagtaatagtcacagggtctaacttagatactttaggttatcaattcacattcattccacgatagacctccccttctcttaggtgggtagagtaattctcagtgtgtccatttttcttatagcaaaactcattacataaactgaatggtattgtgtctcttttccccattccttcgcatacatacccccaataatttatttgaggtcagagacccctatctttctcactttagtagttacagttctaacattatacctggaacataggtccccaataactgtttcctgatttagcaaataaaattcctatccttgaatgtgttcacgcataggagcaataaatacccatctgatagacatgtatgatttcaaggacccttttcacctgggtattgactcattacaactgccttcgttctagacttagtaggtcaggtccgcttatgcttgagcacagttagattttagaccgtgacttatttaacatgatattctttcgaa

SEQ ID NO: 510651 - DNA, 141 bp, Homo sapiens
tctctcgactgaaggcatcattaaccttccagtggactcacaacttccagatgaatccttaatttgaatattctcagattaggttctttctctcgctttctcatttcatcagcctatagaactggtgaattctacaacgct

SEQ ID NO: 510652 - DNA, 156 bp, Homo sapiens
ctgctctcatctacgtaatccaaccggccagtctaatgctagtatctattctgtgcctggtcgattagggggctccaggtgtgggcatgctctcgagtcgaccagcgggacctggaagttagggacaggcggtcgtgtatccacgggaagattgag

SEQ ID NO: 510653 - DNA, 1048 bp, Homo sapiens
agttccgctgtagggaacgtgaaggcgaatgtgagggacatactcgtggatcgttgatgcatcgtgcccgcatttctaaagaggtacctccgtcagttatgaatacactctgattgaccaacgtgcattctgagggacgctacgactcgtccagtgtcagtcttccagttagcggaaccaggacatccaatgcaaaacgccacaaaccacagtgacctcatgtgcgtggataaaaattctcgacccaaaatgagtgatgcaatagaagttgacttatccgggcagagaacgtgggtcgctgagacttgagtatactttaatatcatggagactggtcttcctatatcttttgttggactggcttgcactctggtcattggcaccacatacacctaattatggtactaaagcctacgaccaatgtctcttggcgccctgatagactgtcggccgacttgattgcacgtctcctggacttttcgccttctccctctgactgaacactgtggcatatacccaggtatgttacgccgacgacgggtgacccatattttcgcttcaatttccaccctgttgatcacgagaacagtcgacctccgactgaggaccgtccgcgtccgccctttattaaggacttggtgcgtctgggactaacccgctattctaatgatgctgcgggatgcctcagcgctgcgtctaagagtaccagggacgcactagcgtcgataaaaccatccgaatcttgtctctatctgtatcaatcgttcagtccgacttaatttgtaaccgctgaatccttaaaatgttgcagactccctgaatccaagcctttgttagactaacatttctaagtgagcgcgattcatggacattgcctcataggcacgtccctcgtgatggcgggcatccgtcctcgtcacctggcgaaggaacataccaccggctgagttgccacaggcaacagaacggggccgcgccacaagactggtcacattcgggatccccgtaacggggcattctctccgagcgctgcccacgcgacccacgg

SEQ ID NO: 510654 - DNA, 215 bp, Homo sapiens
attaacaattataaaatagttttcattgatgctgcttttttcacctaaattttgaactactaagtagcacctgcgtggtctaagaaacaaaagatgaagacctagtgttttggatggaaagcaccttgtagaccattatatactacctgaagttctttttctcgatcgaaaaacaaaattacagcttaattcgtgtatctcagcattctattaaa

SEQ ID NO: 510655 - DNA, 111 bp, Homo sapiens
atcctcctgcacttcctcttaggatccttgtaattacatttgagtccacccagatagtctagaatgatctccttgggcggatgtggtggttcatacctgttatcccaggcc

SEQ ID NO: 510656 - DNA, 533 bp, Homo sapiens
acatgcagtcgggcgcggtgcatcatacctgtaatcctgcactttggcaccacttgcaagtagctgactaatagaggtcaggagatcaagaccgtcctggctaacgtggtgaaaccccatctctactaaaattccaaaaattagccgggcgtggttgtcggcgcccgtagtcccagctactcgggaggctgaggcaggagaatggcctgaacccaggaggcagagcttgcagtgagccgagatcacgccaacgcactccagcctgggcgacagagtgactccgtctcaaaaaacaaaacaaaacaaaaaaaaccaagacacggatgcctgctgcaatttacctatatggatggtagtcgtggaattactagccagtgcagaaaggcaagaaaacgatgtaaggattgaaaggaggaactaatactgccattaacttatcatggtgtaggtggaacacttttaaatcttaagaatctacaggtcagtaataagaattctgtatgctcatatgcacacatggattctgtttaccg

SEQ ID NO: 510657 - DNA, 861 bp, Homo sapiens
  misc_feature (36)..(36): n is a, c, g, or t
  misc_feature (86)..(86): n is a, c, g, or t
  misc_feature (135)..(136): n is a, c, g, or t
  misc_feature (218)..(218): n is a, c, g, or t
  misc_feature (225)..(225): n is a, c, g, or t
  misc_feature (256)..(256): n is a, c, g, or t
  misc_feature (326)..(327): n is a, c, g, or t
  misc_feature (333)..(334): n is a, c, g, or t
  misc_feature (336)..(338): n is a, c, g, or t
  misc_feature (340)..(342): n is a, c, g, or t
  misc_feature (350)..(351): n is a, c, g, or t
  misc_feature (365)..(366): n is a, c, g, or t
  misc_feature (378)..(378): n is a, c, g, or t
  misc_feature (412)..(412): n is a, c, g, or t
  misc_feature (415)..(415): n is a, c, g, or t
  misc_feature (423)..(423): n is a, c, g, or t
  misc_feature (441)..(441): n is a, c, g, or t
  misc_feature (503)..(503): n is a, c, g, or t
  misc_feature (563)..(563): n is a, c, g, or t
  misc_feature (628)..(628): n is a, c, g, or t
  misc_feature (630)..(630): n is a, c, g, or t
  misc_feature (638)..(638): n is a, c, g, or t
  misc_feature (640)..(641): n is a, c, g, or t
  misc_feature (643)..(643): n is a, c, g, or t
  misc_feature (645)..(645): n is a, c, g, or t
  misc_feature (661)..(661): n is a, c, g, or t
  misc_feature (664)..(664): n is a, c, g, or t
  misc_feature (667)..(670): n is a, c, g, or t
  misc_feature (673)..(673): n is a, c, g, or t
  misc_feature (838)..(838): n is a, c, g, or t
ggcagcgggcgaggaggctgcgagcgagccgcgaancgagcgggcggcgggcgcgcgcaccatgggggagaaacccgggaccaggntcttcaagaagtcgagccctaactgcaagctcaccgtgtacttgggcanncgggacttcgtagatcacctggacaaagtggaccctgtagatggcgtggtgcttgtggaccctgactacctgaaggaccgcnaagtgtntgtgaccctcacctgcgccttccgctatggncgtgaagacctggatgtgctgggcttgtccttccgcaaagacctgttcatcgccacctaccaagccttcnncccggnntnnnannnagcccggnncggcaaccggctgnnggggggggtggngaggaagctgggccagcatgggcaccccttcttnttnaccatacnccagaatcttccatggtncgtcacactgcagccaggcccagaggatacaggaaagggctgcggcgtagactttgagattngagccttctgtgctaaatcactagaagagaaaagcgagaaaaggaactctgtgcggcgtngtgatccgaaaggtgcagttcgccccggagaaacccggcccccagccttcagccgaaaccacacncnacttcctntnntntnaccggtccctgcaccncgnggnnnnccnggacaaggagctgtactaccatggggagcccctcaatgtaaatgtccacgtcaccaacaactccaccaagaccgtcaagaagatcaaagtctctgtgagacagtacgccgacatctgcctcttcagcaccgcccagtacaagtgtcctgtggctcaactcgaacnagatgaccaggtatctcccagct

SEQ ID NO: 510658 - DNA, 228 bp, Homo sapiens
gcttgctacgtggggaatgcttaagttaagtgggcgacagtggagtggctgggatgtatggatatgttgtctggcggcaattttgctgatggatcctgttgccattctctcgcaaagtttatggctctctgccgctgcggtcgcggcattgatattttggtatcagtggtttccctgtcctgagtggcaactgccgccggtattgcgtgcagttgtttccctcatcca

SEQ ID NO: 510659 - DNA, 140 bp, Homo sapiens
aaactgctacgatcctttctcaaatgtatccctctccgtgaaggacacatgtctgtatggacatcattgtccttagactttggcaaactacacataagtggaccttggatttcaggtatgatattggccaaacgcggagg

SEQ ID NO: 510660 - DNA, 849 bp, Homo sapiens
  misc_feature (39)..(39): n is a, c, g, or t
  misc_feature (100)..(100): n is a, c, g, or t
  misc_feature (155)..(155): n is a, c, g, or t
  misc_feature (162)..(163): n is a, c, g, or t
  misc_feature (174)..(174): n is a, c, g, or t
  misc_feature (181)..(181): n is a, c, g, or t
  misc_feature (186)..(186): n is a, c, g, or t
  misc_feature (189)..(190): n is a, c, g, or t
  misc_feature (192)..(193): n is a, c, g, or t
  misc_feature (202)..(203): n is a, c, g, or t
  misc_feature (206)..(206): n is a, c, g, or t
  misc_feature (230)..(230): n is a, c, g, or t
  misc_feature (247)..(247): n is a, c, g, or t
  misc_feature (264)..(264): n is a, c, g, or t
  misc_feature (309)..(309): n is a, c, g, or t
  misc_feature (313)..(313): n is a, c, g, or t
  misc_feature (323)..(323): n is a, c, g, or t
  misc_feature (345)..(345): n is a, c, g, or t
  misc_feature (352)..(352): n is a, c, g, or t
  misc_feature (370)..(370): n is a, c, g, or t
  misc_feature (401)..(401): n is a, c, g, or t
  misc_feature (539)..(539): n is a, c, g, or t
  misc_feature (550)..(550): n is a, c, g, or t
  misc_feature (555)..(555): n is a, c, g, or t
  misc_feature (559)..(559): n is a, c, g, or t
  misc_feature (562)..(562): n is a, c, g, or t
  misc_feature (566)..(566): n is a, c, g, or t
  misc_feature (569)..(569): n is a, c, g, or t
  misc_feature (573)..(573): n is a, c, g, or t
  misc_feature (578)..(578): n is a, c, g, or t
  misc_feature (584)..(584): n is a, c, g, or t
  misc_feature (591)..(593): n is a, c, g, or t
  misc_feature (599)..(600): n is a, c, g, or t
  misc_feature (606)..(607): n is a, c, g, or t
  misc_feature (618)..(618): n is a, c, g, or t
  misc_feature (621)..(622): n is a, c, g, or t
  misc_feature (630)..(630): n is a, c, g, or t
  misc_feature (656)..(656): n is a, c, g, or t
  misc_feature (665)..(665): n is a, c, g, or t
  misc_feature (677)..(678): n is a, c, g, or t
  misc_feature (682)..(682): n is a, c, g, or t
  misc_feature (688)..(688): n is a, c, g, or t
  misc_feature (705)..(705): n is a, c, g, or t
  misc_feature (711)..(712): n is a, c, g, or t
  misc_feature (717)..(717): n is a, c, g, or t
  misc_feature (719)..(719): n is a, c, g, or t
  misc_feature (722)..(723): n is a, c, g, or t
  misc_feature (725)..(725): n is a, c, g, or t
  misc_feature (728)..(728): n is a, c, g, or t
  misc_feature (737)..(738): n is a, c, g, or t
  misc_feature (753)..(754): n is a, c, g, or t
  misc_feature (762)..(763): n is a, c, g, or t
  misc_feature (766)..(766): n is a, c, g, or t
  misc_feature (772)..(772): n is a, c, g, or t
ctctcgctctgtcaccaaaaccctccgtccctcccagancctcgaggagtttccccttgtgtaaaccggtatcgcgtcccttccagctctgacatcctgnggttctagaatacccattgattgaaagagctgtggccaaacaggaaggacagagnaagagcnnctgacaaaggnttgtgcnaaganagnntnncaaggtcannggngagaggcttggggcagtgaaagcnctctcgggtcttggctntggaagtgtggactgtnccagcagatgggcccttgggaagccaacagggaacaattcaaggntggngagaaaaggncacctttgacccagcagaaggnagagggnggagaggagggtgaggangtacaaggagcatcgcaggcgaggaaacaanggccaggacctaactgtggtgggaactgcctttgtctccacacactcgcaatcaacatgcgtttttgctattctcaaacaactcccttccacccccttaggctgaaaggacaaactcatcagagtggaggagtacctncctgatgaagntgttnatgnttncagnatnaaantggangtttantgtctgnnnaaaagnnagtttnnaaaaggtttgnttnnctctgttnagtggattcttgactacatataggtnatatatttnaaaaaataatgnntagntatttntactttgaaatcatgantaaagnnaaacnanaannanagnaaagataanntaaggatttgtttannagaaatanntanaaaaangtttgcaggccgggcgcgatggctcacacttgttatcccagcactttgagaggccgagatgggcagatcacctgagg

SEQ ID NO: 510661 - DNA, 500 bp, Homo sapiens
  misc_feature (93)..(93): n is a, c, g, or t
attgtatctgtaacatgctattgagcagtacaataagtataaatgggatgactgggcaaaggtatgtgaaacgtcatatgtagctccttcatnggaatcaagtactgttctcaagattagaagatgtcacactctttgcattacctccctaaagaagtgcaacaccattaattttcccttatggaatcaatatggagtggaaatatgaaatgaggagatgtattagaaagcaggacaaatctacctaccattactggaattacaatgtatactctgggcccactccattgataccgatctgaggtgaggaggactaaaagcagcagcaggttacagaaagactgaataagatgatagtatgctacgtctgtctagctggggaaggggggatctggaaaaaaaatcttacgaactagaatgtagtgtcagtcagcatagctgctgaaatctacgttgtagaggtaaacctagcagagctaatacaaacaagggtaccgagc

SEQ ID NO: 510662 - DNA, 1029 bp, Homo sapiens
gggaacaagttgagtttgccggcatagacccggtcctctccatctctctcctcggtaggctgcgggaggcagaggaaggcggcaagaagatagaagagctgtttcccactccaggggtgactttttataaagaagcccaccactcttgtgactcgcacgatccctgactcgctgacgggttttcagtggggacagtggaggatccaggtcttggggagctcagtgacttgggactgattctggtagatttaataattggccttattagacaaggaaaagaaaatctatcgcagctctttagcttatagattctgatgactcgatttatcttctagctactgttggtccccaattttccataaacgtcgtcatctaagagtgtcctatgggacctggggcagggtccaagatcttcttgcaccttgccgacaggcccctcggtctcacctgcgcaagataccacgagcgccaagagaacacatggtagaccaaaagcgagaaaaatactgccgacagcccatcatgcaccacagcaactgactcatggatcgagaaccgagagcccccactaactcgactacgagtggggcatagggagaaggggaggacaccaaaggaacagggacctcgccgcaggaaatacaggcaacaccactcgaaaaagtgcgagaaccccaagaaactaacgcactaagaaatggaacatacacccgtgcagaaataagagcaaaactaaagagagaggagaacaggcgagagaacaaaagatggcagcgggcacacgggcggcagccaggcgaccccaacagacgcaactccccaagagggccatccatccaagacgaccaactgcagtgcacgagatacacagacacaccggaccgcggtacggacaagtcactcacgatgacatcgaggaacaacgagcaaaacaaacgacaaacaaacgacaacccacggcacaaaacaaaaagaacaaaacaagaccaccacagaggcacaggtagacgacacagccgcaggagcagc

SEQ ID NO: 510663 - DNA, 279 bp, Homo sapiens
  misc_feature (168)..(168): n is a, c, g, or t
gttattcaaacagaaactaccattttcaaactctaggcaggaaatcctaagtcacacagaaatagaaaggaaaggccattttcaggaggattttttgtttgtttgttttattgttgtttgagacacagcagactctgtctcaaaaccacacaccaccaccacatattngcaggcttgatggtaggtgctatatctagctactcaggaggctgaggcagacacttgcttcaccaggggtggagcttagtagctgagatcggccatgcactcagctgggcg

SEQ ID NO: 510664 - DNA, 312 bp, Homo sapiens
  misc_feature (217)..(217): n is a, c, g, or t
cgtcgtgctccactgtatcagcacttctaggaggccagtgggaggatcaactgagcccgagagttcaagatcagcctgagccaggcgcatgtggctcatgcctgtaaccccagcacttgtgggaggctgagcgcgggtggatcaccgtgaggtcaggagttcagagaccatgcctggccagcatgagagaaacccctgtctctacgtgaaaatacanaaaattagcctgtggcatggttggcagacaccttgtaatcccatgctactgtgggaggctgaggcagtgagaatttgcttgaacccggggaggcg

SEQ ID NO: 510665 - DNA, 1059 bp, Homo sapiens
gcaacaacccggagaaccctcgacccagccgcgcagcacgtgcttagaatttcagagacgtaatgtgaatattacttgtcataatctccaagaggaaactatgccaaagtcacatccatcttgagaaggcctcagaggagctgtaaggaagctgagggagacctgcgtctcaaagaggcatctccaggagagtagacacgtaaatccctaaacagactgtgactgtgatgcatgtaaaaagtgaacgagaactcagaacgagcctaaatcgggcaagcagcctcagctccattctgacgtcgaagagacaggaacttggcgtgtctttctcgacatagttctgaaatatgagaaactttcaaacacccttcctatgctgacgatacagctcagctcagaatcacttgcccaggttgtgtcactccttgctacactgatgcagtttcaccgaagaactagtctgcagtgggcaagttcaccttggttcaacggactgactgatctgcaggctcgacaagacacgcgcaacatgtctgcgccagattcaaatgcaccaaccgtcgacgtaacactgggatctccccattcactaagtaaaggcagcagagcagagtactttacgagcatgaggataagccaagtaccaccttctgctggtctacattactgtacaaaggctcagagaaacaactggatagaaaatacaacatgacgagtctagcacgcacaagccttaacaggaatcacgcctctctttccagcccagccaagggcacaagtcggctcacactctgttcctcccagccatctccggcgaggctgcctgcggcacgggatccctttgacgccccgggcaggttccacgggctggcagccatagcctcacggcatgccctgcccactggcacttccaacccctgcgagtcgaaccgcacgtacggaacccctggccctcgctaagcaccaacggacaaagcaaggcaaaaacgcctcagacaacagcgccccgcgcgctccactatcccgcgggcgggaccacacagcgacacagacacgcgc

SEQ ID NO: 510666 - DNA, 120 bp, Homo sapiens
gtggactccccaggaaatcgaaagagttgctgagagggatgagactcagttgtggacacgcacacctgtcgacgatgactgtctagagagattaaacctgccaacgcccaaaaaaaaaaa

SEQ ID NO: 510667 - DNA, 118 bp, Homo sapiens
gcccagccttgatctcaaactcctgggcctcaggttgatcctccgaagtcagcctccccaaggggcggggattacaggcatgtgccaccaggcgggccaattttaaaaaattttctgg

SEQ ID NO: 510668 - DNA, 112 bp, Homo sapiens
tctagaggatcccggcaaacttcgtccattgcgatttctcgtatggtcgttcggcgtgtgcagcaacaacttcgtccatagcgatctgtatggaccttcggcgtgtgcagga

SEQ ID NO: 510669 - DNA, 752 bp, Homo sapiens
atgaattattaacccaatatgtcatagattgatgaggctgaattcctcttgaattaattgaaatagcttccttcacatcctctgtgatgatcatgttctatttagctgataagaattcaatacctagaaactggcacctatctcatgatggtacctattaaatatcttgccattgaaatgatgtggtgatgcatgcctataagttttaagctacgttgagagagaggtggtctagtagtcccaggtggggttcctagacactagcttagactaacgatagcaacagacccccatcttcgaaaaattcatgtgcgcaagatactaaaacaagattaaagcatgttgtagtaagttaacttcgttggaatacagtcgagcttatttcgtaataatcggaaatgttggtccgcgcgtgcgatgtgaggtcttatgcgctgtttttccaacgacatggttttggctggtgggggtgtgcaagtgtcctttgatgtcactatttcgaaaccagcccagccaacatggtgaaaccccgtgctctactaacaatacaaaacacttagactgggtgctggtgatgtgcacctgtaatcccaggctacttgggaggctgaagcaggagaattcacttgaacctgggaggtggaggttgctttgagccagattgcaccatgaacctccattgcctgggtcgacaggttgcgaccgctgtcaccactgaggttcgttgactttttgccaatacacttacaagg

SEQ ID NO: 510670 - DNA, 1499 bp, Homo sapiens
taaaaattttttttttttccatttttggaaaaaatagggtccccccttttgccccgggggggttttaaccccgcttggccctcaagcccttcttctccgccctcggccctccccaagagctgtctgagaattctacgcggccctgaagactgccatgtagtggccatagtaattgtgtgcttaagagcccgcacacagagagcggtgatagtctcacagcgtgcctaaacattccgcgagtctttaagagagggtggagagtctccacttttgtgcacactctctgtgcgccctctctgtgttgtcgccccaacatttgtcgcgagggctccacagtgtgttctccccagtgtgtgcctcccgaggtgttacacccctgtgaacagtgtgcgggagctcccccacaccctcttttctctgtgtgtgacggcgcaccccgaggcgccgagagattctcccccacctgtgagagcggccaagaagagtaaccccctgtgaggaaaccaaactctcctgtgatggggccctctctctatcgtgtgggggaggttctcccgacgaaaaaaaccaccgctgttggggggggcgtctccccccccggcgtgttgtgttgctaccacacacaaacggggggtgtggtcttcttgtgcgagaggcctccatcttattaacacaggaggcggagagtactacaagagagagtcttccaaccacagaggagagacccgacctatgctcgcccacaacaaaagaggagtaaacacgctccccgtagaagagaactagcagctccaggcgcctcggtagagacacacacttcttttcttctaccaagaagcaggaggtggttgattctcatagtcgcggcgcggcggcggagagaagatctaccatcccccgcggagggaccccccccgcagagatgattattaccccgcccccacgaaagaagaaagaagcataggttatctcttcttcgatcgcagaacgagcgacaaaccaacagccgcgcagagtatgttgatcccagaaggaggagagggccctcatccaccattataaaaagaacaccccgccggagagataaatatgagcggacgcgaggaaaaaaacacctctatcgtagcaataggaggagcccttcgtggagcggcattatagcacaaccccaccttctgtttgcgcggaggaaaaacaattttgagggggagggtgaacactcatcccccccgcggacaacacccactcgtcgtgatgacaagaggaggcgcaccccccctcgatgattgaaacacgagtagtgtgtgacgccacaacaaaacacaacaacggacgcgtcatgactccacaacagcgagtagtatgtctccacgtgctacatcaacaacgaaggggcgggcccccccccgcgggtcgtaaaatacttgataccccgctggtgcagcccacctcctcttcacccaccgaatgaagacgggagagcacgacaaacaaaacgg

SEQ ID NO: 510671 - DNA, 1571 bp, Homo sapiens
  misc_feature (237)..(237): n is a, c, g, or t
  misc_feature (355)..(355): n is a, c, g, or t
gttcaaacccctattgagtgcaggagccgacaattccagtagctctcttcaaggtcgctattggccatggtgaatggacggatggaagtgatgaatgacaggcgagttgactctgtgcggtagatagcaggaaagctgcatccaatccgtcgcgatccaccacgagtccgcgtcgcgtgctcggcgtccggtcgtccgcttagcctctgcgaatcgtcactcacgcaattatcttgntgagccctgtctcctgccccatggagaacgaatcactgcgaactctggaatgatcttgccacatcaatggcacggaagtacacgtggcagtaaaggcaggtccaggtgtccgatgtgnagagacagatgtgtcctgtagaggcgcctcaggagacccaggcagaagcgtcagtccttgagccgcatggctttgtgtcttgtcgtggagcatgtggttggtccttcgattctctggggctctcgcgcatgccatggcctgtgccgttgctcgtccttatcgcctagtccgctgcaggtctgaaagatagacccgtgtgtactgtgtccgtcgtagtttgcacgtaggcacagacacgcagcacccatccccttgtgtattcgcatgaccaattgacggaggcaattagcttgaagggttccttgtgtgacaagcagatgtggtgcgaacggatcactgggttagggacaatgcgagtgcggaagaacttgcttcatctagaggagtgcatatacgagtaacgtacgcctcgtgtacatcaagtccgcgttaaaagtaaatagaggcgagggtgcacagcaatcgtgtaggacggttgacttgtagggacagagacgcgagaaggatctaggccgtcctgtgatcactctaacccatggggaggtactcgcaccccattgacactctgggaattggtacattcgcatcacccaactttatgttcgtcgacacccatatggttgagctcgatcgggacttccgtagagcagactatagaggtcgagatttggaacgcggaatacacaagggccgagtggcgaaacattcctttatagagagtttttcagcgaggtgtgcgctgggcaacggaacaaattgggcccaatggtaacaggctttcgaaagggaattcgaaaccggacataggagaaacgacaacggttccccacattgggtaccacacgggcggccacttagaacacacatactgtgatacacctagaacccaaggaacaatcccggtgaccagactaactccaatgttacacagttaacgatagcagagcacatagaagcaacagttacaagacatctatagagacccgattgatttaaacccacaaataggggagaacatctaagcagcaaaatggtgtccagcgagagatataggacaacatacaaaaatcgatatccagcacccggatcataataacgcagaacgatagaacagaacatctagggcaaaacacaaatcaggcgacgatacaactaactaactaatgacagagaaacaaagacatattagacacgacatcagtagtacaacacagct

SEQ ID NO: 510672 - DNA, 422 bp, Homo sapiens
agtgctgtgctggcgctctagaggtccccagggtgcagcaataattaaaatcattggaacaaaaaaaaaaagggcactcggattaaacggcattacagccggcaggacacctggggccagctgggttttactctagaatttcactggtcgtcccaccccacctcttccaccccacttcttccttcaccaacaggcaagttctttccttcccggccagccagatagatagacagaggggaaaggcaggcgcggccttcgtggtcagtagtccttggatgtgaagggggcagcacagtcatttaacctggatccaacctcttggcatcttacaaagttaaccagctaaaagaagtaaaataagaaggcaaggctggtgggaatggtacaggggcatatgggctggcacccgggggtaccgagct

SEQ ID NO: 510673 - DNA, 916 bp, Homo sapiens
  misc_feature (49)..(49): n is a, c, g, or t
  misc_feature (61)..(61): n is a, c, g, or t
  misc_feature (64)..(64): n is a, c, g, or t
  misc_feature (68)..(69): n is a, c, g, or t
  misc_feature (72)..(73): n is a, c, g, or t
  misc_feature (76)..(76): n is a, c, g, or t
  misc_feature (80)..(81): n is a, c, g, or t
  misc_feature (89)..(89): n is a, c, g, or t
  misc_feature (93)..(93): n is a, c, g, or t
  misc_feature (101)..(101): n is a, c, g, or t
  misc_feature (107)..(107): n is a, c, g, or t
  misc_feature (117)..(117): n is a, c, g, or t
  misc_feature (134)..(134): n is a, c, g, or t
  misc_feature (149)..(149): n is a, c, g, or t
  misc_feature (155)..(155): n is a, c, g, or t
  misc_feature (167)..(167): n is a, c, g, or t
  misc_feature (229)..(229): n is a, c, g, or t
  misc_feature (257)..(257): n is a, c, g, or t
  misc_feature (313)..(313): n is a, c, g, or t
  misc_feature (409)..(409): n is a, c, g, or t
  misc_feature (420)..(420): n is a, c, g, or t
  misc_feature (437)..(437): n is a, c, g, or t
  misc_feature (447)..(450): n is a, c, g, or t
  misc_feature (456)..(456): n is a, c, g, or t
  misc_feature (460)..(460): n is a, c, g, or t
  misc_feature (471)..(471): n is a, c, g, or t
  misc_feature (478)..(478): n is a, c, g, or t
  misc_feature (487)..(487): n is a, c, g, or t
  misc_feature (554)..(554): n is a, c, g, or t
  misc_feature (577)..(577): n is a, c, g, or t
  misc_feature (581)..(582): n is a, c, g, or t
  misc_feature (589)..(589): n is a, c, g, or t
  misc_feature (594)..(594): n is a, c, g, or t
  misc_feature (607)..(607): n is a, c, g, or t
  misc_feature (620)..(620): n is a, c, g, or t
  misc_feature (634)..(634): n is a, c, g, or t
  misc_feature (654)..(654): n is a, c, g, or t
  misc_feature (657)..(657): n is a, c, g, or t
  misc_feature (671)..(671): n is a, c, g, or t
  misc_feature (697)..(697): n is a, c, g, or t
  misc_feature (801)..(801): n is a, c, g, or t
  misc_feature (841)..(842): n is a, c, g, or t
  misc_feature (851)..(851): n is a, c, g, or t
  misc_feature (899)..(899): n is a, c, g, or t
ttcatttcaggttagttttgtcggtttcttgtaaatcttttgataatcncataaaactcangcntctnnganntgnatgnntgcttatntgtntagatatngctggnaggggaatantttgggggtttgggggngtaggcgagagggtngagagnggagccaaatgngaattcctcatgtcaaaagcactttaatgccctatcctccttcaatcaagagatcaaaaganacggcaagtcctgtacttacaaaaccgntgaaaatcacactgtaataatcagtgaatgtagaactgcacagatctgtgtttccncctttttccaccatgattctacatcaaggtaaaaaaagattcttttatacaaatccaagaagaatgtggacagaggtggcagcaaaacgtcaaggntggtgcacggncttacgactgcagctgngacagggcgnnnncggggngggncgggtcctcgngaaaganccctacggngagggtggctcagtcagtggtcgatttccggtaccaaaaccgcgctctgaggtcatcgctgcacgtnatgaacccggggttggtgggggngtgnnctttgcngcgtncaattttgttgtntcctaacgatagntggttttttcgctnggctgtccttgagttccagnagnaaagattgatggtnctgttgtcggggagggagagatagtnctcggtgtggttaaacacagcctgtgtccggtgcacctggcgtccacttaaacccgcgcccgtgtatctgaccagtgttcgtcccgttgatatttcccaaagtntagctacagagtcttttccacttgagagaatgtatttagnntttttggcnaaaatggcagaacaaacttcagcaccgtcatgtgctttctcaaaagtngtgatgcatcgatttga

SEQ ID NO: 510674 - DNA, 676 bp, Homo sapiens
  misc_feature (461)..(461): n is a, c, g, or t
  misc_feature (486)..(486): n is a, c, g, or t
  misc_feature (492)..(492): n is a, c, g, or t
  misc_feature (503)..(503): n is a, c, g, or t
  misc_feature (509)..(509): n is a, c, g, or t
  misc_feature (514)..(514): n is a, c, g, or t
  misc_feature (521)..(521): n is a, c, g, or t
  misc_feature (534)..(534): n is a, c, g, or t
  misc_feature (543)..(543): n is a, c, g, or t
  misc_feature (551)..(551): n is a, c, g, or t
  misc_feature (564)..(564): n is a, c, g, or t
  misc_feature (619)..(619): n is a, c, g, or t
  misc_feature (627)..(627): n is a, c, g, or t
  misc_feature (645)..(645): n is a, c, g, or t
  misc_feature (662)..(662): n is a, c, g, or t
tagcaacgagcctgtctgtaactgagtccctacatttaataataataaaaggagggccttttagtttctttagttgagagtttcaaagtatgtgtgtgttatattttttcacttgggattgatacattgaatgctttttctaacattgagggagaaattattttctttaagcctttggtgattactatagaactttttttaaaaatttatttaaaatttttttgaaagctaatgtactgttaacaaaattgtttttaaaaaattgtttcttatgtataggattctcaaatggtagtagactccttcaagtctggctttgaacctccaggagactttccatttgaagattacagtcagcacatttacagaaccatttctgacgggaccatcagtgcagccaaacaggagagtggcaagatggattcccagtccacagtggggaaggcccagggcaagctgtngctctttggaaagaagccaaaggtnaaaccnttaaaatcccntatgcnaatcnaactctncttagtaagttgnaaagacgtngatggtanaaatttttgccgnttgagggtaatgccctccgctgaatggtccattaatcttccctattggaaacgtntgtcctgngccttataagtggggatntaccggtttataccagnaattcagttttcca

SEQ ID NO: 510675 - DNA, 242 bp, Homo sapiens
tatctatactgaccctctctggtcatagaggtaggaaactatagctgtcccaactaaatgtcaggacgaattagcccagctggtcacgctcacagtcaccgcctccaccagaactgatgcggacccctgggaactgaggtgtttgctctgtgacttgggaaggacagcggaaggtatttccgtttagctcttgtggtcagatttttttgtgaatgaaaatctgctgtgcgtcagtatagata

SEQ ID NO: 510676 - DNA, 106 bp, Homo sapiens
gggaggttggggattgtgggacaaggtcccttggtgttgatggcatgaaggggcctgagctgtgggcagatgcagttttttgtgggcttggggaacctctcacgtt

SEQ ID NO: 510677 - DNA, 252 bp, Homo sapiens
tataccacggaacagttcatcatcgggaaacacagttgatcctccaacagatatcgtgctgtatgatttcagaggcttactagtatttaactttcatggatagataactgtttactatgagatttgtcattagagtcgtaaaatataactctcttttggaataacacattagaataaattataatttttcacatacaataaaaaatgcttagaatatatcaaatgataaacacaatatactatagatagcat

SEQ ID NO: 510678 - DNA, 425 bp, Homo sapiens
ggaacgtttgaaatgcatcccttcccccaacccccaaaaaaacacacaacacagtggtgtttctgttcagactgtcctctgagaggcagtgtgctccgtatggcaggagcaaagctttgtggttttaccatacttagtttgtagcatatgtctgtgccaaatgcatattattttcgaggcttttgcagtcaaatataataaggcaatacacataaatgcacaaaactacgcaagttgttatcactttgagagaattctaaactacagaaatttgaatattttattataaaagagagtaattgaactataagcatatcatgaaaatgaagttatttagtttgcaaaatgtattatggtattctaagcagtgagttcctctccatataaatacatgatttatttaaaaggtaatatgtagacttttg

SEQ ID NO: 510679 - DNA, 216 bp, Homo sapiens
tttaacccccctaaaaaaattttgtcccccctgggggaagaaccaaaactcttgggaaaatttttagtcccccaaaaacaggggtcccccaaaaatgcaaagttgggatctcccttccaaagttttttgttcctgaggaaataaatttaaagaaaaaaaggggtttttttttaaagttggaaaaaaaacccgattaaaaagtttttccctgtttta

SEQ ID NO: 510680 - DNA, 954 bp, Homo sapiens
gtgcgaggtgcgatcatggctcactgcaaccttcgactactgggctcaagtgatcctcccacctcatctgggaaataggtgcacactaccacactgggctaattttttttttttttttttttttaaaagagacggcggtctgtcccccgggctgaattgccctgggtgtgacctttgactcacgggagcctaaaccccgtgtgggctcacgttgatccttcccaatttcagtctcctgtgagttagcgtcggaccccacggcgcttttgccaccatgtggcccggggtaattttttttttttttaacacaggaggtctcgcttgtgtcgccagggtggggtcgcgggggagggaagacccacagcgactcagtggagaaccccgggccctccggggggtaacaaacgaaggttctctcgggccatacacgcccccgagaggggggggaaatcggcggtgtggccccgccaccatatggccaaggggggatgtgggtgtgtcggggggagacgcggcggtcccatggggtgggcagggggatggtcgcaaaactctttagcccgctagggtagaggaccgggatgaatacgggtggttccggggaaaaacacgccggctctaaaaaatgggcggttcacagaggaagtggtccacggaaacagactcggggcgcaaggagaccaccagaggtggacccctgagaggggcgggggattcacggtttgaagccattattggccgaccggagggttcacactcgggaagcgctggggggtcgcgccggtgctcaaccctgtgcatagaggtctcaacttgggcccagccggtccggggacacccaggggcccccattaagatggttggccgaaaaagacgcaggaatacagggggagaaaactgactgcgcgaaagggacaaacacaggtcgggaaaaaacgccctcgcggtgtcggg

SEQ ID NO: 510681 - DNA, 258 bp, Homo sapiens
tgtacttgtggtcacagcaccttcagtgcatccgcgtcgctcaacgacgctacgctgtacacgcagctactacagtcatggaagctgctgcttctatcgacctgaacggattgggacggttgactagcatgctcctagtactgacgttcgtggattgggaatgcccttgcgcgatcctgatcactgactcttggtcaacctttttttttttttttttttcctttaaaaaacttccagttaaccagtttctggaataca

SEQ ID NO: 510682 - DNA, 312 bp, Homo sapiens
aatcttcaagactggtggggacaggggcgattgcttcaggtggtggggatagaggcgtcgtcaggtgcatgagatgggtgtgagtcttccggtggggacgagggcgattccgtccagtgagataagaaggtgatgattcaggtgggggaagacagaggagactcctcaggcggcggagagaggggcgattcctccagcggccgggacaggtgcaatgcctcaggaagtggggatgcgggcaattcctcaggtggtggtgacaggcgtgatgcctcaggtggtggggacgtgggtcctaagttcagagccagg

SEQ ID NO: 510683 - DNA, 488 bp, Homo sapiens
  misc_feature (57)..(57): n is a, c, g, or t
  misc_feature (75)..(75): n is a, c, g, or t
  misc_feature (108)..(108): n is a, c, g, or t
  misc_feature (122)..(122): n is a, c, g, or t
  misc_feature (320)..(320): n is a, c, g, or t
  misc_feature (337)..(337): n is a, c, g, or t
  misc_feature (345)..(345): n is a, c, g, or t
  misc_feature (400)..(400): n is a, c, g, or t
  misc_feature (416)..(416): n is a, c, g, or t
  misc_feature (458)..(458): n is a, c, g, or t
  misc_feature (488)..(488): n is a, c, g, or t
gtggctgcttctaccagcatctgttggtgctgtgttgccaatccaccaagaagctancaatcgaggaggcgaggncgggtggctgcggcctcagtgactactacatgncgtgggcatgtgcnggcagggccaacaactcccacgtggggatttgaagccgcgccgcagtgcgcgcggagatgagcccctaccaacattagatgccactgtacgagccacgagaagggaaagcaagcggcctcggccccgcacagcccaggattaaatgtatgcgccagggcgccctcctggctacctcgcgtggtggccccgagcggccncggaggccgcgccgtantcctgggngaaggcgtctctcaatcgctcagcgcggcggcacagggagcccacgggcccagcngcgaggacctgcaggnggcgggccgcgtcctggccccgcagctgggcctgcagcagtncgaaggccgtgagcggcgccgcacgtaggn

SEQ ID NO: 510684 - DNA, 411 bp, Homo sapiens
tcctttagttttctttacccagtaagtgtattttgccttcatctaaatgttttacatttatagttcttaactcttgtaattagatgataatcttaagaatacattgctggctaaaacctgtactttaacaaatgtagtttttaagttttatgtgtcttgagtgttttgcctcactctgtatctgtgtgtcatgtgcatacagtgcccacggaggccacatgcagctctcagatcccctgggacttgactttcagatggttgtgagctgctatgtctatgctgggaactaaacatggtcttccgtactgctgtgtcatctctccagcctcctaaaggcatgcttattaaatgtaatgcttatgaggaagtttaaccttgtatggttaaagaattaaaattatagttttgtta

SEQ ID NO: 510685 - DNA, 238 bp, Homo sapiens
  misc_feature (108)..(108): n is a, c, g, or t
aggatccgacacatagaagtgtcatgcagactcgctcaggcataagtatgtgacgtttgcatcactgctcacagcctgctagatttgtatgatgctgaattatatgcngactaattccacccagttgagacacacatgctgtcacttgtattatagaactgtggatcttgcccgtgctgtccttgtattactttaagactgatcacttatcattcattccatatctaatgggttgtcg

SEQ ID NO: 510686 - DNA, 126 bp, Homo sapiens
gggttgatttttaggttagaactggaataaagagctagcactgtttattactaggcctactcatggtaacaaatcagtgtgagcttagcgcagtgttcattgtgcctgcaatgatggtagtgtaga

SEQ ID NO: 510687 - DNA, 136 bp, Homo sapiens
tgcaggtacgactttagagtatccctgtactctgatctagtaccattggcggccaattgatttgatgtaagtttatagatcgttgacctcgtccgttatgtaaaggatgcgtagggatggtagggcgatgaggact

SEQ ID NO: 510688 - DNA, 314 bp, Homo sapiens
  misc_feature (1)..(1): n is a, c, g, or t
  misc_feature (64)..(64): n is a, c, g, or t
  misc_feature (66)..(66): n is a, c, g, or t
  misc_feature (69)..(70): n is a, c, g, or t
  misc_feature (74)..(74): n is a, c, g, or t
  misc_feature (86)..(86): n is a, c, g, or t
  misc_feature (92)..(94): n is a, c, g, or t
  misc_feature (105)..(105): n is a, c, g, or t
  misc_feature (107)..(107): n is a, c, g, or t
  misc_feature (113)..(114): n is a, c, g, or t
  misc_feature (118)..(120): n is a, c, g, or t
  misc_feature (311)..(311): n is a, c, g, or t
nggggggggggctgggggggggggggggggggggcgggggggggggggggggggggggggaatnanttnnggancccatcccatangggctnnngggtccggganancaaaanngacnnnttacttcccctgtgggtaggtgccacagaatgaagagtaaagcaataaaatgcatattcagtgcatgtgaagtagaagggtatatatcctatatatattgttaagtttagcctaaagtctctttacatatctcaagttcagcttaaaggtttctcagtacatagaactgtagcctaactggacgtgtaaanaga

SEQ ID NO: 510689 - DNA, 107 bp, Homo sapiens
agcgactctagaggaccgagaagagacagaggacagtgctcttcaggagtggtgcagcaggggctagaagtcactctgacagtatattatactatgcaatatggata

SEQ ID NO: 510690 - DNA, 370 bp, Homo sapiens
aacatgtgttacataagcacatagtgagtactcgaatcaacctcggactctccgggcgtgaggggtgggtgaggggaccggcaggtggtcacagccccatcaaaagggagttggggctgggggatgtcgcggtcaactgggaaaggagagccaatcagcaagtggcgcgtcccacgccgtctgtcaaatgcatctgggggttagctgtactcatacatcttgtgggtgactaggtgacttccgtgttcaagacacaagcgagctaagcctgggatttcagtttgcacagcgctttgttaagttttgtctctcaatcttgctgtccaagagcgaacctggaggtcgtctgttagcggtaaattctttaccc

SEQ ID NO: 510691 - DNA, 148 bp, Homo sapiens
  misc_feature (148)..(148): n is a, c, g, or t
gacctttacataaagactcaatcatcacatgagtgtggcaaagaactgagcagccagtggtgttctcatacctgtgctacaattctggtaataattccagctccagctcttcagacagtgccctgtggtggaatgtgtggggtgatcn

SEQ ID NO: 510692 - DNA, 329 bp, Homo sapiens
ggtatagacaccgaaaatcagccaaggaaaaggcgatcgccatctacaacgtgataggataccccaagcttcatcatggatcccaaggagctggacaaagtgtttaagtgactacactcgcagttccatgacctactactcttgaaaattggcatgcaggtttttcaactatctcatggcagggtcactgccagatcagctcaggaaagcccccaacagagatcagtggagcatgaccccgcccatagtgaacgcctactactcgccacaccaagaatgagattgttgttccggccgggatcctgcaggcagcattcttaatacgctcc

SEQ ID NO: 510693 - DNA, 214 bp, Homo sapiens
  misc_feature (13)..(13): n is a, c, g, or t
  misc_feature (42)..(42): n is a, c, g, or t
  misc_feature (56)..(56): n is a, c, g, or t
  misc_feature (100)..(100): n is a, c, g, or t
taaggttattttngatgttatttttaagatttatagttattngatttttgattttnggaaggagattgtatttattaagtttttttattaggagtttatngattattttgttaagatttatattagagtttttgtgtagtggatttaggttttagttgtggttataatatagggtttttatataagaaaaataaagtgaattaagtgtgtaata

SEQ ID NO: 510694 - DNA, 1210 bp, Homo sapiens
caaaatggccctgccccagctccccaggcgagtgctcagagccagagaccaagtggtacctccatacgcagcttcgaagaccagcggaggggagacgagctccctacgaaggaccgacagcatcgccccctggacctaggcaggtgtcatctgttcggcagcaggtacctggcagtaagcgcgaggaagcgacctaggcgccccgtggctgcagtatggcagtcgcgggggaaggggtgcagcgaggcgcatcctcgatctggagtagtgacgcccagacgggacccaattgcttgcagcaaatgctggtccttctgtcatggatgaccccgcactttgacgcagcgagggatccagacacacagggcagggcggattgactttcccgtgcgcgatgacccctccggatgtgactgacggaggcatgagtggccctgcccgtgtccgcccgccatgcaccccacggctccctcgtcctccggcctctctggactgcacggaggtgcacgtcgccacgcgactctcgggcgcatgcgtggctgggcagggaaggggcctgtcaaccgccggaggagtcgaggaggagcggaagcgtaagtgaggggcgaaaatactccggtgcataaaagggagcacacgagggcacagagagacgggaaccccccgggcggccgcaacgggcaggacggaagaactccgctgtgcattgcacttggcgaggcgagcataacgagataaccgagcaaaggggacctagagatggaggggcccgggtgggggtaggcgggcgatcgggcgcggcgggggatttgggccgctgcgtggcagcgaggggcgcagtgccagggcgtggcccgaatgggacgttggccggggtatcgcatgcctgggccatggggttcccagtgggcggggcgggcactcttgtatggcttggggaggcctagcgaagggtcgtcaacgggccggggagtagtggcggctgggcctcgccgtcagtcacggggcgcgggggtgtccttgtgtctctggcctggggggtggcattgttggggttttgaatgccagcctccgtttgcgcggtgccccgttttctcgtgcggcatagtcgtgttcccgagctggcggcacttgcctgggtacttggggtgtggcccccggctgtgtccccgtcaggtggggtcgactccgcaccctcgttgtttgcacc

SEQ ID NO: 510695 - DNA, 1475 bp, Homo sapiens
gagatacccccggagctccagacgagcggatcgggcgctcccggcggtctgaccctaaacttctgccgtagctccccgtttcaagccagtgaatctagttctcttagataccagaaaggtgagacgcgtcgtgatatgggaggaggagtccgtcggagggcagaaaaccgcagcatagccagaagacgctccaggagagcagtcattagccggaagcactcaataccggtgatcgtggatgtgcgtaaaagcaacaatgtgaatacgggcgggggcgttaccgcgggtgtcgcagactgtaggtactggcgggcaatgccagagtcgcatgtgagggacgagaacgccggaaggctgccactccgcagagtctgcacggaggcgccctgagttcacccgaaagcggtgacgcactggccaatacgactggacgtgtcatctacgggtatcccgagtattctccagtcggttgccgcccgtgggccttgtatccggcaggcgccttgagggccaagcgaagtgccctatccgtccattagtcccttgagatttgcacaaagccgagggcagtgccatgggggaagccacgccctgagtgcaccttgaggcgtacattcaatgcgggcagtcggccgttggaactcctctgggcatcccactctttgggaggctcatgggtcggggaccgtaggggttcgtcgggggcgagaaggttccaagaaatggccatgaagtttggaccattcattgtagttcacatttaaccattgttaatttttgcaaccaaagagagctccatttgtggagggaacaccgctttacccagaggatagtgtcacccccatagatagagaagtgaattgaagtgaacagataatggtttcgccttggcgagttccttgggccttccggagggaagacttgtagttgcacggtaattggtgagactgaacgtcacaaagtgaaggttgggaagaaagccgttgcctcgtgaaccaaatgttcacaaaggaggggtcactggtgtgggagccttaagtttgacttggttccccagaagctggggggggcgataccaaagtagaggtttgaccagtgttagcggaaaactaatgagcaaacttgagtcgaagagacaataacggttgatccgggcagcgaacaaccggccttaagcacagcaaacaggttggacccctcctctagtgagatccacacaaattgcggctaaattgtggtaaccccaggacgtaaggggagggacacacccaaggtggttgacatacgggcgtaaaaacacagtcaagagagggatgtgtctagcaactcggacaacgaaatgtctcttcaaacgagcaaattgttcagataggcagtggagtagtaccgaacaatgagcactgcctcgatggcgaacacagagagattatcagagggggcgagggcaagacacaggtagacacaagcacacaggt

SEQ ID NO: 510696 - DNA, 368 bp, Homo sapiens
aggagttcaagatcagctacgcagaagcgagacctgtttctacaaaaataaaaaaattagtaggtgtggtgttgtgtacctgtagtcccagctacttggaaggctgaagtgggagaatcatttaagcccaggaagtggaggctgcagtgagccatgatggtggcattgcactccgggcggtcggagtgcaatggttgtgacgagctgatattcagcaatgagtatacccagcgcagaaaaccagaacttggcacctgaaacaacttctggtggtttgacttgtgatagcattctaagctggggagaatatacgtgatggtccatgaccaagcccgtgtgccaagccctggtaatgtgacagaatcacg

SEQ ID NO: 510697 - DNA, 872 bp, Homo sapiens
agaatgtataatattttttccttataatttagcatacaggaaaattatttatttatataacgtagggctatctctaattatgctcatttcttccccgtaaaccacattatctatatgataggaccctttagtgaaattagaaaaataaagtaggcagtgaataaatgttcaggacacacgacatacacgtcacacacatcacagctatcagctctttcagtgagtttgcattaactagataacacatgtaagtacatagatagaatacatttcagaggcagagttcctcggattatttttgtcatggatattcagtgttcagcagcttattatttaaaggggtgccaaatatagcatccttactgtagtcatatctcttgaacatatatttctcaactgaaagagggacttaaacaagtaaacatgattatcgtaagatgcacgttacacaatttctttaaatccttagtcaaagaattctaggaaagttatctagtttaaatttcgaaatgttgtcacacaatttgtaggcatttaataaattatcttctataggaggggtggatgctgcatttcattggaaatgtcatttttccaaaggtttctagctatatactctctttccttcaaataacataagtctgaaagcaatgaaaacgtcaaaggaaaatgtgtatatacatccacatgtttactttaatatgttactcttaacaagctgaaagttgtggtaagaaggacaaaagcagtattcacttccaaaatcatacaacttaggaattcctgggtatctcatgtccagaaaatatggttatgcgcttgccttcttaagtgggtgctgtttgccccattagggcatgacgtgttacaga

SEQ ID NO: 510698 - DNA, 148 bp, Homo sapiens
ggaagagggtggatattgcttttttacggggttggggaagccagaacaccacttggttttatttttttaagggcatgtgatgtgaaaaagtgtgtgggggtttgtgtccttccgtgggagttttttttttagggggccccttttttta

SEQ ID NO: 510699 - DNA, 120 bp, Homo sapiens
gggcaagggcgagatcctggagagcctgcaggacggcgcggagagtccccgtacgcctacagtaacgggatcgactacaatgaccaccaccatcctgcgtggacgtgccggcgctgtgaa

SEQ ID NO: 510700 - DNA, 301 bp, Homo sapiens
atcagtagttcctaagcttcatgaatacagaactagctgccttcacaaggaaccagaatgaccctggttgtcctttagcgcgtgatgaacaaactggacgccaacagtgatggtcagctagatttctcagaatttcttaatctgacttgagtaggctctagctatcgcttgccattactccttcctcaaggctgtctcttcccagaagcggacctgacgaccccttggccctggccttcaaacccatcccctctccttccagcctttctgtcatcatctccacagaccatcctatccccag

SEQ ID NO: 510701 - DNA, 358 bp, Homo sapiens
  misc_feature (218)..(218): n is a, c, g, or t
  misc_feature (261)..(261): n is a, c, g, or t
aggcaaggtctagctgttcccccccggcatacaagcttatagagcagcctcctttgaagatctccaggtggacttcacagagatgccaaagtgtggaggtgttcgagtgtggatcaaggactggaacgtagcctctttgtgcccatggtggaaaggaccccagactgtcgtcctgatcactcccactgctgtgaacgtagagagaatcctagcctggntccatcacaaccgtgtaaaacctgcagcgcctgaatcctgggnggcaagaccaagtctggacaacccctgcagagtgaccctgaagaagatgacaagcccttttccatcacaccagaagttgatggtcaggacagccgag

SEQ ID NO: 510702 - DNA, 424 bp, Homo sapiens
cggcacgaggcgatgtccagttcccagcaatttactcagagatggtaccatcaagcccccatgtttgtccggtagataacacccagagccccctcacctgtcactttgtgatgaatttgaagctcctgcacctggaactgttttcctgtaaccatttgtctttaacttttttgtctgtttttcttccctaagatggctgcagctagaatccccctcccctctccaaaccaaagtataaaagaaaatctagctccttcttcgaggccgagatactttcatgcggtagccgtctctcggtcgccggctaataaaggactcctgaactcgtctccaagtgtggcgtttctaactcgctcaggtacaccacttggaagcagcttgaatacttgctatcatcatgttggagcttcgaactaccaaaacg

SEQ ID NO: 510703 - DNA, 467 bp, Homo sapiens
  misc_feature (376)..(376): n is a, c, g, or t
accctgggggtagaaggtccctggcagttgcctgctgccagtggtgaccagaaaggcagccctgtccccccaaagccccagcaagcagaagtctgggcagagttcatcttcttgacctttggccactcctttccaactgcccgcagggggttccccctgctgaggaaagaccaggtggacccacactgcctgtcacccttcatttgggacttgctgtcaaaccctaggatagtttcataaaggggaggctgggccagcctgctgctgtttgcttcagggccaggcaaaaagttaggctgggggttttcaccccttactcccccgggcacatcccaacctgcactggggccccctcgagtgcttgttttggtttcanccgctcccttggcagctgcagcccccatgcaaaaaaggctcccaggcccaagctttgtgtgacccaaagaaataaaaatgcctcagtgtga

SEQ ID NO: 510704 - DNA, 401 bp, Homo sapiens
agaggaaattgaatacttcgaagcagaacaggcatgtgcacgccctcatttatgagaacaccctcaggaaactcccaggatgatgctaggagaagggggagttgagctgcagctggagaacttcctccagagcacagggcttaagacagaaagaagaactctaagctgggtctgctaacatcactccagtttagatggatcttggcagagagacatgcttgttcctctggattggaaagatgagggactctcgggaatcttctctgtcagcctgtacatctcacggcatgccgcactcaattgggcaattcccattagtgtttcgttctctgctggtatctctgagcatactggttgtaggactggccagtagtgccttcggggctcagtcgaacggactg

SEQ ID NO: 510705 - DNA, 303 bp, Homo sapiens
cctctaacatctggtattcacgcctctagatcatcgtgtcatctggacctttaagccttgttacacaaagtactctttggaaaagattgtcagtgccgtgaaagacatccctgatagaacatgaaagtctggaaggatgataatattgaaaataccatcattgttatagaaaaagccatgaaagttatcaagccccaagcaatacattcctgctggagaaaattgcccagatgttgtgcatgacttcacaggatttacgacaaagctaaccaaggcaaacatgaaagagattgtgaatacggc

SEQ ID NO: 510706 - DNA, 188 bp, Homo sapiens
gtgaagtgagccaaatactatcagattgggaggacgctatgcatgaagcgtgactcactcagactgcgacgagctgaggcggcactgagctgaagagaaggcaggcacgtgatgctggtgcatcgagacacagtgtagagcacaggcattcacctccgagctcaggagagtgctgtcgcgaggagaag

SEQ ID NO: 510707 - DNA, 350 bp, Homo sapiens
cgctctctctctctctctctctctctggctctctctgaaccgcggtgcatgtctcacaggcactgagcccctaacccacgcaaggttgacctaaaccgctatgcaatggcatgagagccttggctaacggggcatacctgggtccctacaaaggcatagatgtggggcttgtagattacccccagctcctgacatacccgcacatgacaatggaacaaaggtgccacacgctcggtcttttttacaaccagtgcctctgacatagtccccatgggccggtgtccaaagctcttttcattggccaaggagggaagggtctgtgcaacagaggttctttgatcaatcaaaaa

SEQ ID NO: 510708 - DNA, 272 bp, Homo sapiens
gccttattcagatttataaaaaaacacataggtaacgacgtcagagcttgggctaggaatgattgggaaaagaccggaaggcttaatcccacaggacatctcacagtggtgtgctaacgacagagaggagcaggaaagtgtttaaaaagctttggggggggacaagggaaggccgggcatcactcgatatccgggtaggcggacccacattcgtgcgtggaaagggtggacagaagaggccaggaagtgagccaccgatctccagaacagag

SEQ ID NO: 510709 - DNA, 231 bp, Homo sapiens
ggagtatctccaatattcaccggtaagtgtggacatttggattggaacggatagtaaccgggacgcgccgtgggatttccgagcttgcgcagggtgtcgatggcgccggcgccaatgacccacaacgggtaggaaacctgtactttctcgacaaatttttgcatgttggcggcagaatccacgccgataccgacaaacttgatttgcgggtattttttctgcaacgcgtcg

SEQ ID NO: 510710 - DNA, 142 bp, Homo sapiens
cggcatggtgtcgctgatctccgttatttctaccattggcattgccctcggcgtggcggtattgatcgtcggcttaagcgcgatgaacggctttgaacgcgaactgaacaaccgtattctggcggtggtgccgcatggtgaa

SEQ ID NO: 510711 - DNA, 390 bp, Homo sapiens
aaaccagacaacgcttacaggttacttcaggatctgcgccttatcaaccaacattgtttaagcctatctaccccgtggctgccaaacccatatactctcctatcctcaatacctccctccacaacccattattctagttctagatctcaaacatgcttagtttgctattcctttgcacccttcatcccagcctctcttcgctttcacttgtactgaccctgacacccatcaggctcagcaaattacttaggctgtactgctgcaaggcttcacagacagcccccattacttcagtcaagcccaaatttcttcctcatctgttacctatctcagcatagttctcataaaaacacacgtgctctccctgattatcgtctccggctaatctcc

SEQ ID NO: 510712 - DNA, 269 bp, Homo sapiens
cccacccagcggcactggaagagcactttctgtttttttttttgagacagagtcgggctctatcgacaaggctgaagcgaatgcttggcagcgaccaaggtgtccctggatcagcaagggctcaaaagaccaggcggaacgatgagacaggccagcctagtctcacactcctgacctggtgaaccacctacctgagccttccaaagtgctgagattacagatgtgagccaccacgcccgtcctgcagagagctttgattggaccactgc

SEQ ID NO: 510713 - DNA, 243 bp, Homo sapiens
ctcaatgaagtggtgtggtcgtttcaactgctactgatgatgggctacttggtacactggctggggtggctggagacgatggcctgatgtacagctgtggttactctgactagcatggagctggaacgagtcggggacgctgcccgggaagatggtttggaccttcgaccccgtgagcggacaggggtcattccctgggatgctccctctggtcggatgactttctctctaagttcactgtta

SEQ ID NO: 510714 - DNA, 353 bp, Homo sapiens
ggcccaaattcccccgttcccccccaaaaaaaaaccttttttatataattttcccaaagttggggaactaaaatttttttaaatttactgggggttccttttaaatgaacaaaattacccaaattttttacccccccttgggaaatgctttccaaaaactaaggaaaaaatttggaataaggggcccaatgttaaaaattttttctaaagttaaaaatgggcccaagtccctttttccccaatccctttttaaaaggggggggcccttggttaccctttttggggggtttaaaaaccccaaaaccaaaaggttattttttcttttttaaaataaaaaaatttaatttgtttta

SEQ ID NO: 510715 - DNA, 253 bp, Homo sapiens
  misc_feature (212)..(212): n is a, c, g, or t
ttcactcttatctatttgtaaaggatgtgctggtttatatttcatttagaaaccaacggtttatagagccaacaactgtgaaattctctttcggaaagaatgaggaaaaccaattaataaatacacaaaacaatcagcagtaaacacttttttaatatatccagcttcccttgctctagaacacatcagtaacccccaaagcaatttacatngtgcaaggcttgccctggggtgggagtgaggaggtcacatg

SEQ ID NO: 510716 - DNA, 674 bp, Homo sapiens
ggccccccgtgacacgaggagcacctgtatgtcaacacccaggtctggactgcccccgagccggaggacagccccaaaaaggatctgtttgacatgcgaccctttgaggatgccctgaagttgcatgagtgctcagtggcggcaggctgtgacatgcatgcccctcttcccttggatggaccagtggcccagcccccctaccctgccggggcccctgtggcccccactggagttgaacatgctgctgtcaggagccctggtaccacggcctggatgatgcctgcctggtgcggcagagatggatgcttcgagctgacggggacttccttgtgcgagacagcgtcaccaacccctgtggcaagtatgtcctcacctggcatgcactgcctgtggacatgcccaagcacctgctgctcgttggaccccctgaagggcgtggtacgtgacgaaaggaacgtgcttgttttgagagcatcagccaactgatcgaccaaacatcttgaagaactgggcagccacatcgttggacgtcgagaagtgagcttgaacttgcgatagcggatggtcatcaagcggagccactgaagcaaagtgaccagtctcagccctggatcatgcctgttctcagacccagacactgactgacatgccttggagggacaagaccaccacat

SEQ ID NO: 510717 - DNA, 106 bp, Homo sapiens
  misc_feature (58)..(58): n is a, c, g, or t
agcctgacctcaagttagcgtgatttaactattttaattgacagccgggggcaaatgnccgcgaattggcgtacgcgacttgggaccttcttggggccggttactg

SEQ ID NO: 510718 - DNA, 533 bp, Homo sapiens
caacgatggtcctcaagctactcaggagtgaggcgggagaatcacttgaacccgggaggcagaggttgcagtgagtagagatggctccactgctctgcaaccggggtgacagagcaagactctgtggggaaaaaaaaaaaaaccaactcttatgataacatagcattaaccataactcgtcaaaggtaaagtcaaccttgaccatacttcagtaaatttaatcttaaaaaaaacaagttcctgcccaacagtagtccgggctaccggaggaggctgaggcaggggtagagatccttggagcttggggagctagtctggagcctaggcaacatagtaagagcgggtaaatatataaccctgggcgggtgtggggggctcacacctggtattcccacgcatcttgggaagagccgagagggggggatcacctggaggtggggatgtcaaaagcagccggacaaattgggagaaaccccatctctattaaaattacaaatttagccgggcgggggggccctggttggtaatcctag

SEQ ID NO: 510719 - DNA, 979 bp, Homo sapiens
  misc_feature (979)..(979): n is a, c, g, or t
tgaggtcaggagttcaagattagaccttgaaaatcatggtgaaaccatgtctctgctagaatgcaaaatattagccaggtgtggtggtcacgcctgtgatccggcagtacttggagaggctgggcgtggagagagttacctgagcccaggaggcagaaggtggtagggagtctaggattgcatactgatctctatcctgcgtgattaccgtgagactctgtctcagtacggacatcgaaagaatgaaggctctcttcccctccacgtagctcaggaggatctcgccaaatcatctggggagaagatttttaacccatgcccttaaacattacttatgagagcccgtcatgggtggaacgcgattttagagatgaaccgaataacacctagggacacgggacaaaccaaaacccatcaacacgatggggacagacagcgagacgaagatattctaaaagcgccggtatatgcccacgcgaagattcataaacgcaacggacactgcgagacaacacaaccgcaacgagccagcataacacccatgcagtcggggcaagggacaagtcacaagtaggcatctaggggctacgaacaggcctgccagaagaaatggtcaacagggaaaaaccaaaagggggcaaaaagaagggatgggagacacgccaactgcaaacgtggaggaggtgggcacgtaggaacactcaagactgagtgcgggacaccccagataaccacctactcatccacgaccaattgggacggacagaccagcggcgaaggtagcggccgagggcacaaacgaacacgacccctacacgctgacacgtcgagcaaacgcaagcgcagcggcacaccagcaagcgaccacacaccaaacctacagagaacaaacaaccaccgcagagacacaacacgacacaacgcaaacacgaccacacacacctcactaacagccagaccaagaacaaagcagagtatn

SEQ ID NO: 510720 - DNA, 110 bp, Homo sapiens
ttgcattgcaaggccaagcatcccctggagttggagagacgaggaagattgaaccacgtgacgaaatgtgcccttgcgccttgccatagtgcaaggcgtatccgagctcg

SEQ ID NO: 510721 - DNA, 431 bp, Homo sapiens
gtgatcacacggagttctccatgtgtctctgtctgtgttcgtctctcttcttggaaagacataggtcatgttgggctagccccactctaaccaagcacaacctcatctcaacttgattatatctgcaaagtccctactttaaataaggttacattcacatttactaggggttaggaccacaaagtgccttttcaggggaatacagttcaacccttaacacactgttctctagcccccaccaaattcatggccttcccatctgcaaaatatatacatcccattccaatatccctacaagtcttaacccatcccagcatcaactcttaagcccaaaatctcatttaaatataatcaactcaagaagtcccaatcttattttctaaatcattaaatcagttttggatgagacttggtatggtccattctgggac

SEQ ID NO: 510722 - DNA, 408 bp, Homo sapiens
  misc_feature (36)..(36): n is a, c, g, or t
  misc_feature (77)..(77): n is a, c, g, or t
  misc_feature (84)..(84): n is a, c, g, or t
  misc_feature (88)..(88): n is a, c, g, or t
  misc_feature (99)..(99): n is a, c, g, or t
  misc_feature (101)..(102): n is a, c, g, or t
  misc_feature (106)..(106): n is a, c, g, or t
  misc_feature (125)..(125): n is a, c, g, or t
  misc_feature (133)..(133): n is a, c, g, or t
  misc_feature (136)..(136): n is a, c, g, or t
  misc_feature (177)..(177): n is a, c, g, or t
  misc_feature (195)..(195): n is a, c, g, or t
  misc_feature (200)..(200): n is a, c, g, or t
  misc_feature (202)..(202): n is a, c, g, or t
  misc_feature (391)..(391): n is a, c, g, or t
aaaaaaaaaaaaaaaaaaatatgatacaagtaacantaaagtaaagaaaatcccagtctgacagcgcagtacctgtntgtaaanaatntaccatctcantnncacnctgcctgtgactgagaacnccgccccnacncccggagggtctgcgagtcaataccttgagaatagtctacngttttccatagtctgtcngagcnanaaaacttgtcacctgtaaaacaaaggacagcattgaggactgaaacttgtctcttttttgaacaactgtgcaagaaaatatatccctttttaaaaaacatcagtcatggctaaactacaatctagtgtctagaattacaaagaataaaatgaaatcaaagatttctcgctagtaaaatgaaatgttagnaaaagtattaaaatata

SEQ ID NO: 510723 - DNA, 237 bp, Homo sapiens
cacagaggggaatgtgccacacgggggatgaccaccaatgccctgagatgaacaggtatttactagagcagttgtattcgagatatgggtcttcatgaatcatgtgtaacaatcagatgaccgcgataggcaagttcctgagctgccggggtgccttgagttaagagctgagaaccggcctgctgggctgttctactgtactctgtttggaagcactggcggacggtcgaaataaga

SEQ ID NO: 510724 - DNA, 362 bp, Homo sapiens
tgttctagaatcagatgccaggtccttgccttttctgaatcttcatttagaaggatttttatgaatgaacattttcaaactatgtgcttcttgggccgttgtttttttcactagaatctggaagcttggattgcagatgtttgtctccaacattggcattatggtaatgaggttctcttggaataagaatgagcatattagtgttttctagggttgaggtgtaaatctattttattttattttattttatttttttggtctccaaactactttaagtcttgtctggtaacacattaacaatcctttctgttctgtaggttagcattgaggaacgtctgggagcaatggatatagacacacac

SEQ ID NO: 510725 - DNA, 201 bp, Homo sapiens
gggcttagtattgagtggcatgtgatgctcatgtatgtatcctagcacttttggagggcaaggcgggtggaccacttgaactcaggagttcgaggctaacttgtgcgacatagtgaaaccccatccctattaaaaatacaaaaactagcccagtgcagtggtacgcacctgtagtgccagctattcaggaggcagaggcag

SEQ ID NO: 510726 - DNA, 385 bp, Homo sapiens
  misc_feature (1)..(1): n is a, c, g, or t
  misc_feature (10)..(10): n is a, c, g, or t
  misc_feature (122)..(122): n is a, c, g, or t
ncaaaactanccatactccctcttggtaagtagaaccgaattcttggacactgatggtagatgatataccaatgcgcatacattcttagtcatagtttggcttgcttaaaagttgtacattnggccagcacagtaggtcacacctgagagctgaggcggcagatcacttgaggtcagttcataacaagcctggccagcatggtgaaaccccatctctactaaaataaataaataaaattagcccaggtataatggcacatgcctgtagtcccagctactcaggaggctgaggcagaatcgcttgaacacaggaggtggaggttgcagtgggccgagatcatgccacttcactgtagcttaggagacagagctagactccatctgc

SEQ ID NO: 510727 - DNA, 142 bp, Homo sapiens
agaagaagcaattcagcctccagactgcagcgtcaaatctccctgggtctccaggctgtttgtctgccctgcagatttcagacttgccagctcccagaataatgtgagccaattccttaaaataaatctctttctgcatata

SEQ ID NO: 510728 - DNA, 318 bp, Homo sapiens
actagtccacggtggctcaacaagacaactactatcccatataaatatacactcaacactggagaacccagattcataaaacaagttctcagagacctatagactcttaagataaccacacaatagtggcggacttcaaaaccccactgacagtattagacagatcactgaagcagaaaactaacaaagatatttgggacctgaactcaacacttgaccaaatggatctaacagatatctacagagcactccacccaacaacagaatatacattctcctcatctgcacaaggcagccaaccgtggactagtgggtacc

SEQ ID NO: 510729 - DNA, 162 bp, Homo sapiens
accatgcttgtatcctaaggacatcaggtgaagtacatgaagcatatacttaatatggagagtacttttctaaccttttaataaagtggggtaaatgaaatggggttctcctattaaatagtggactcctaatccctgcaagtagtaaagcaaaggggtccc

SEQ ID NO: 510730 - DNA, 459 bp, Homo sapiens
  misc_feature (7)..(7): n is a, c, g, or t
  misc_feature (61)..(61): n is a, c, g, or t
  misc_feature (127)..(127): n is a, c, g, or t
  misc_feature (131)..(131): n is a, c, g, or t
  misc_feature (148)..(148): n is a, c, g, or t
  misc_feature (167)..(167): n is a, c, g, or t
  misc_feature (169)..(169): n is a, c, g, or t
  misc_feature (174)..(176): n is a, c, g, or t
  misc_feature (179)..(179): n is a, c, g, or t
  misc_feature (197)..(197): n is a, c, g, or t
  misc_feature (205)..(205): n is a, c, g, or t
  misc_feature (223)..(223): n is a, c, g, or t
  misc_feature (291)..(291): n is a, c, g, or t
  misc_feature (318)..(318): n is a, c, g, or t
  misc_feature (323)..(323): n is a, c, g, or t
  misc_feature (332)..(332): n is a, c, g, or t
  misc_feature (342)..(342): n is a, c, g, or t
  misc_feature (344)..(344): n is a, c, g, or t
  misc_feature (376)..(376): n is a, c, g, or t
  misc_feature (439)..(439): n is a, c, g, or t
gaagatnagctcgaggttcgccgcggccccgggggtgcggaccgtcttcaaggccttcgtntcgccctcgcgcagagctcgaaggtgacgtcggggatgggtccctcgcagcgcaggaaggcatctnggcncgccaggttcgccccantccacgtcgcccggttctnangcctnnnaanggtccgtccacgtgcagntccaagcncttgctgggcgcggagcnccgaaaggtggctttaggtccacgtagacgcagctgtagttggcggagtcagccacggaaatgttgtncagctcgaagacgccctcggtcccagnggggntctggaaanggtgcacgangngcccgcccctgtcctcgcgcaccagggcgaangcggcgccctccaggggcgccaggcaccgcagccgcaaggccctgccggcactccggctccgngggagaactccggcgcgggc

SEQ ID NO: 510731 - DNA, 296 bp, Homo sapiens
tttttgtctggcgtcttcactcttgacttcctcctttctgataagtaataggtgagcacctaataaccttttagggcaaaactgaaaacatgaagtgcctggggccctttagctgttctattggatggactaaggccaggggtgttggctcagccacctactagctctgtgatctagaggagtcagtgaagctccctgccttggtgtcctctgttgtgcaatgggcacctttcatcatagagtttctgagaggattaaataagacacagtggttagccctgtgctcagcatgaaaa

SEQ ID NO: 510732 - DNA, 283 bp, Homo sapiens
gtacatatatccacacgatcactaaataatcatgcgctatgagatatatgaatttgtatttgtacttctccgcttctttgaactacctatagaaatagagactgaaacttaaaagtcgttgctaaacaagtcacttatcgctccctatggtataaccacactgctttataataagttaactatagttactcagtcattagatatgttctctgattgactaaatggatgaatgtaatctttaattaaggaaataattcaagttcttggctgtgtgtcacttctg

SEQ ID NO: 510733 - DNA, 1000 bp, Homo sapiens
agtcgcttcgtgatctggccgctcccggggagaggcggtgtgcctgagcggtggagtggatggagctaaactggttacatctggcacttgatccacgcaccccctgagtgtggcctgagtgtgatattggtagtacacctatcttccacccactgccccgtgtgatgagaaggctatgggcaccagcccagctcctaatgtcctcatgatgtgcacatgtggccctgtgcccgtctgtgaaatggtgggacggtgtgaggtgaatgcgtgtccatctccatacaacaaacaataaactcttcatcatggtgatgcatattcgtgggcttgcaactgctccaggatggaaatgaccctgaccctatgtgaaaatatacctccttcctgaccctcagaacaaccactaagaggacaaccaaagtggcccggaaaacctgctatcctacctacaatgagatgttggtctatgctgggataccccaagggtgacctgcagacagctgggagctccagctgagcgtgctgagtgagcagggatacttgggagaacgtcctcctcgtgatgaggtgaacatccgacctgcgagagctggacctggctcatgagaagaccggctggttcgccctgggatcctcgaggtcatggcacgcatgtagagccccacgagagccacaacccagacatcccatgctggttggcttgagctgtttggagatggattcaccactgtggagatactcccatgtcgacagggcccaggaacagagggcatgcccatcaagcctcggatccagcgagagcctaggccaactgtagaaaggcggcccgaaacgacgcagaacccagacccaagccgcccacacccccgtgccacacgccaccggccgcaccgcacgacacagaccctcaccggcgcacagtccgcaccacgcacacccgcccccgaacagacgacacagcaacgacaaacgacaaacgacaacaaagacccgcgagcga

SEQ ID NO: 510734 - DNA, 196 bp, Homo sapiens
aaaggggcccccccccctttggggggggggccaccctgcttttttgggccgcccttgaaaatttttaaaggttttccccttttcccccccctttttttgggggtttaggggggttggggggtttttttttccttgttttttgggcccccccccccggttttccgggggggccttttttttttttgtttttgtttta

SEQ ID NO: 510735 - DNA, 348 bp, Homo sapiens
tatgtcagtacacatgcatgtacagcatgaggggctgcgaagcccctcacccttgagatgggagccatcttcccagtccaccatccccatcgtgggcattgttgctggcctggctgtcctagctgttctaggagctgtgattgctgttgtgatgtgtatgaggaagagctcaagtgcaagtggagggagctgctctcacgctgagtctacctacagtgcccatggctctgattattctctcatcctcttgtatgcctgagactgctgcctgtgtgtgactgagattcagagatactacacatctttcctttgtgactgcgagagcctctggcttctctttctgttact

SEQ ID NO: 510736 - DNA, 991 bp, Homo sapiens
atatcggtttatggatgaaggagggagcggtcgaatattttaggcgatcaagcacggtctccgctgggctttggtcccttttgtgatacctggcttagtccgggggccttttccccctcttataggcagccaaatctccataggtctatttggtgtgtgtgattgagctaagctgcaaacatctatgtcgggacgatgtacagctagaatacaccgtgttcggtataaggacttatagtatttagcttctgtcgagtctcgatagcgcaagttgtattgagatcggagtctcagtctgtcacccaggctggagtgcacttggattgatcttggctcactgaaacctcggcctcccaggttcaagcaattctcctggcctcagcctcccaagtagctgggacaacaggcacactgccaccacgcccaactgattttttgtatttcttagtagagattggcgctttcaccagtgttggccagtatgtgtctccaagtctcattgaccttgtgatccaccccacctcagcgctcccaaagtgctgggagttacaggcatgagccaccacacccagcgagacggggtttcattatggttggtccaggactggtctccaactcctgacctaaagtgatctgccacgcgttggcctcgcaaagtgctgggattacagacatgagccaccacgacttggccgggtatagtatatgtcgtatattgagcacttcccctactgagttgctgccttctctgtggctacaagggacctcacagaattacagggaagttacagggaagcaggtttcatctcaatattgggagagatttcaaacaatcacacctgcctgagaaggagtgggctgtcactaggaatttttattcacagtccgtcaggtaattttgtagaagggcttcatgtgctggttcatccaataggacaggaagctattaaatcagctttactatctatgttaacttacgaaacctggtagt

SEQ ID NO: 510737 - DNA, 235 bp, Homo sapiens
gagcgctggcctccctagcccctcgccgggctccatcctgacctcggcggccggcgggtgaatcacgcactctatgttcacctgcagccgggcatgagccgggagggcccggctcagccccagtccagccccgtgcaggccacgtttgaggttctgggtttcatcacgcacctctatgctggcgccgacgtccacaggcactgggacgtcagaatcctactgaccaatatccgaa

SEQ ID NO: 510738 - DNA, 541 bp, Homo sapiens
atgagataagcacggtggtcaacttgtcttgtaattgagttgagctaataataagccctttaccagtgtacaagataaaagatttcctttcagttcatgtgctaattaggacaaaactaacttccataaaaaacccaaaaatatcagtggttgaacacaagagaagttgtgggggactgtgatgcagtcatctggtgatccagagacccaggttccttttatcttgtggttccattcgtttcctagggccttgcctttgtttttgtttttgtttttttccttatcagccctttctaactcattgagatgaaattcacttaccataggattcaccctgtttaccacctgttcttgttttttttttttttttcccgatacagagtcttgctctgtggcccaggctagagtgcagtggtgtgatctcggctcactgcagcctttgcctcccgagttcaagcagttctcctgcttcggccccccaagttgctgggattacaggcacccgccattacaccgggcttatctcaatccgggtaccgac

SEQ ID NO: 510739 - DNA, 132 bp, Homo sapiens
ccatacgcgcatacatatcttacgtaatgaacaccatactccataacttttaatgcattattctcatattttatagctgcattactctaatataggccgggcgcggtggctcacgcctgtaatcccaaggtg

SEQ ID NO: 510740 - DNA, 460 bp, Homo sapiens
acgattgacttactactaaacatttgagaacagaacattagtagtgaatgttcaacatgacatctgacatgcgtaccataccatatacattttaatgtatatgcagatttagagaaggtaagtgatgaccacaggatgtctactgtctttgacatctgatgaatatattaatgacacacctctaatatttactacccttctactttaaatgtgacgagagggtgacaactcttactagtggtgtccaccccccccccttaagtagtgtcaactgtattagtagtctaggtattaggtatagaaggacgggaactaggtaatggatttggtgtagtatgctgctaaacttactgtagcagatagttcgcagctgggtaagcctgtagtgtgtacgtgtgtgaaagagagagaaggagagagacagaggcttgcatgatgtcgctaaatactacatttgcca

SEQ ID NO: 510741 - DNA, 312 bp, Homo sapiens
cgaccctgcagaccccttgactgaacggcagggggagggtgggggtgaggccaccaatcgcaactcacaccaattctttggctcaagaggccccctgccaagcacaccctgggcaaagattggaccccacattaaaaaccgaggaaatagccctacttgctggaacaaaggaagaacccctccccactatacctggctcatcctcaaaccctgacctgggcctgagggactgcaggggctgttcagcatggccctgaagctgcgcagaattgttggcaaatagggaggggggtcccagggaggaggggtacc

SEQ ID NO: 510742 - DNA, 419 bp, Homo sapiens
tgtacgacttcctgtaggagttcggcacgcgggcccccgagcgctgttgacattgagacctgtggtgagcctcacacgaacacaacattaccctttcatttgtactggctccttccacacgagtggccctttggcccaagaagattattatcagatattaggagtgcctctaaatgcgcccccgaaagagatcaagaaagcctattattagcttggcaagaagtattaccctgtcacaaataagggtgattccggccaggggaaggtcttccagatggcagaagcctataagggtttgagtgatgaggtgaagaggaagcactaccatgcctaccggtctgtaggcttcgatactgggggcagcgggttccagcataggtactgggggagggcccactgtggaccccgaggagctgttc

SEQ ID NO: 510743 - DNA, 359 bp, Homo sapiens
tcaagttggttgatggcatatgagaatgtggccatatagtgccagatctttcttctggtttggaaagacatgttagactctagatttttatattaaatagtctgtctctctctctctccttttttttctttttctttttttttttggagacagggtctcattctcttacccaggctggcatctaactttttaaacagtaaaaggctggtcatggtggctcatgcctgcaatcccagcactttgggaggctgaggcggccagatcacctgaggtcaggaattcgagaccagcctggccaacacggcaaaaccccatctctactaaaaatacaaaaaatagctgggcgtggtgccggcccc

SEQ ID NO: 510744 - DNA, 170 bp, Homo sapiens
gctactagtcgcacacagggaaaaattaagttgcagatgcaagagttctctggaggtgatacgtttaagaaacatactacaggaaaagatattgtaggtccaccaactatggttaaattccagaaattacttcagttattacgtcttcatttctcgcttttattgcatcc

SEQ ID NO: 510745 - DNA, 242 bp, Homo sapiens
aaaagcttcttacgtggttaaatatgtcaccaaactagttggtagaaaggctgtccaatttatgttcctatcagccatatgcccagttggtccatattttccccagaattaattatgatcattaaaaatacttaaggccaggtgtggaggctcacacctgtaatcccagcacttagggaggccaaggtgggtggactgctggagcccaggagttcaagaccagcctgggcaacattatggag

SEQ ID NO: 510746 - DNA, 1067 bp, Homo sapiens
gacagaagcacttgcagaactcatcagaagccaccccgcttatcagcagatctcaagagagcgtacggtggaggccctgggtctgcacagctcacctcccgtgggaactgctcgcccgagccgtcggagccggcgcatggcccccgtgcagccggaagggtggcaagccgcaggcagccccggcagccccaggacacaggggaaggaacagcacagcagtgtcgtctcctagcacaatctagcactgggaagcaacacgagcgaaccttcttccagcgatggtctcccacctcagagctgacggaagcttttctactcagcagatgctgtgtgtacggattgtggaccagcaaggcacatcagagcaccaaggatccgatgagctagccaaaattctgggggcgtcgaggcaccgcggcgtccgacacatgacacggcgagccatggggcgggcgcagtgcctttcaaagactgctctcacagaagcgcttagccctcatccagcccctccagggacgccaggtgccgagactccatagcaagagcaagccgccacacctggaacccccgggcatacagcgaagctgggcacggccgcctacaggaaccgaacaggacaaggtatccgtaatatccgggctggcccacgacgacaggtcgaacgcaggttggcatccacagcggcccaactatttcccagacatcgcaaagtgacgttggccacacagggcgtgacaaccgaccaacccggggcaccaagcgcgcgatgggatacaacacaccaccaaggtgccactgtgtgccacagcgcacactgccctaccgtgtaacatggacaaacgtacggcagagccaaaacatcgctggtgcacagtgggcccaaactgcaaacggcacacgcgcaagatacaagatgggagccacggtctagccaaagcaacacaccaagcaacccacagagatgtgcgcggacaaccaccgtgtgcaccaacacagcgaaaaactgacggacgacagcactcgcacactcttttctctttgcctgtggtgctcctctgcgagagacg

SEQ ID NO: 510747 - DNA, 901 bp, Homo sapiens
aagctaccaaaaagaaagtggcaatatattgactcaggatctcaaagctgggtgtgtagcattgactgtgtaaagacttgaagggacagaagtgaagaaaataagctgcaatttgtacagataccaacttctgaaaagctggtgtaacaactagcattgaatgcagtccaatttgcagtagtaatcttcaatagacaagcagcttttgttgctgcctttatggacatgggtaccaattgctttgtaatatggtaaaaatgtgagctagcacttctgcgttcctttggattggtgtttaacatgtattcgatggagaaatatgattttaatgctttaatctcatgtagtgggttttaatttcaagcggaaatcttactggtacttgaattgtgccctgtttggtagagcacacctagaagtgtgctggtaacctgtactcatgtcccagtatgtacgtcctttctatgaacagagaaaagcactaatcttaaatgatttccagcaatgtttctggtactcctttcagaaaagtctaagactattatttcgttcccttcctgtgcagcagtcaaaatcacccctagaaaagtgagtggctaacgagacttccttaggaacggcagcactgaaaaccaaacagtatgctgggacaccagatagcgcagggcacacaccctaccagtatcacgcacacttgagcacagacatccacacaacggccgtttgggcaccgcaccaggtcttcgacagtgacaacggggaaaaaccagcgatagcgcacagcttttcggcacagcacgccaccaacggctgggacggtaaccagtgctccaccacatgggcacaccaacggaacgaccagagcgaagctcacaaggccacggcgagcgccgcacgcagg

SEQ ID NO: 510748 - DNA, 228 bp, Homo sapiens
gacaaagactatctacagtgatagagcaaagcatcaaagaatctttaggggaggtttaaaaaaaaaaaaaaaaaaaaagatgggtggcctctgccttggggatcctgagtccagaagggtacacaaggtgatataatgggtagatgtcactcacctagaacaaccagaggcgtggcattgagtgcataacttccaacacaggggcatctcagaatgcctcagataggc

SEQ ID NO: 510749 - DNA, 775 bp, Homo sapiens
caagtgcttgggtaccggcccccctgggtaccggcatatcgcgaccatgtcgtctgccctccacagcgctagacctgggtgtctccgtgaattggtgtgggctgtgcttatactagctcctgacttagtgaagagcctcgtgtcacaacacgtgtccctacagtgcaaagtgtcctggcatttaacaacccagattatccctgggtttggagctgcagtcacctgtgcagaagctggtaggggggggggagggaccctgccggtgttcactggtggattctttcttttggtccttcctggaatgaacaggttccctccctgccacctgtgaggagagttggggcccatgccgtcttcctggcctccttcctttcctcgtggcatgatggcctgcatgtgggtgccagaggccagctctccacactccatcttgggggggcggagcagattgggcccaagctgaccgggagggtgggtgcagacaccaggctgagagaccagccctggaccctgccccgacaatctgctttcaccaagctgtctctcccaccgtggacttcccttaatccactccaggacaaaggtgcttgctgattcccaagtcccttggtatattcgtccttgcccagacggttgcctgtaatgcgttgtgagtggtgggaggggaagctccagtgggccagggaactcggcggatccgatgaggtccgtggaggacgggaaccattttgcccgaccgttccaatcccctcctccatccttaggaatgaattac

SEQ ID NO: 510750 - DNA, 122 bp, Homo sapiens
agtctagcttcaaactcgtacaagacttgcatttcaggactggctgggcaggcttggcgctggagggccgaagggaaacagtgtcctggtatcctaagggtgcttggtaggagcgtgacaga

SEQ ID NO: 510751 - DNA, 411 bp, Homo sapiens
atgtgcatggcctactccggtcgctgcctgctctctggctatatcaacaagcgcgacccgaaccagggcacctgcaccaacgcctgccgctgggagtacaacgtccaggaagggaaagaagattatctcgtagatgattgctttcgctgacggacatgtatccttttgccttcctcagttgcacgtatgcggcgaggtcaacgcgtgcgtcgatcaaccggttcagcagatcgattcgctgtctgtcaacgaacatacttcgatcctcctcttcccagccttgttgcaattaaatagtatggctattttttgagcaaaatgctgtccaggatcaattcttcacgccgaattaacaaaatttacatttccttcgcctccgccagcgaatgagattgcgatacaaattttatc

SEQ ID NO: 510752 - DNA, 84 bp, Homo sapiens
cccactccaccttaatcaccagacaaccctagccaaaccatctaccaaattacaagtatagtgcgatagcaatttaagcctaag

SEQ ID NO: 510753 - DNA, 476 bp, Homo sapiens
aagcagctggtctcgagctcctgacttcagctgatccgcccacctcgacctcccagaaaggctgggataacaagcgtgagccacggcacccagcctatttttaatcttttataccatatttttactgtaccttttctatgtttagataggtttagatacataaatacttgccattatgctacaatggcctacagtatccagcatagtaacatgctatacaggtttatagcctaggagcaatactgtaccatagcaataccgtatagcctaggtgtatagcaggctgtaccatctaggtttgtgtaaatacactctgccctcaccgatgaaatcacctaacatgcatttaaaagagcgtatccttgtcattatgacggtataatctaatgtgggtatctaatagctcctatggtggccgggctcacattgttatacacacatacagatttggtgtcctcggttagattgtatattcc

SEQ ID NO: 510754 - DNA, 119 bp, Homo sapiens
  misc_feature (15)..(15): n is a, c, g, or t
gcattagcataccangcacactttctgataggcagctgcactggtggggtgaattcttgccaaagtgatgggccagcacacagaccagcacgtgcccaggagcctgaagtctcaggatc

SEQ ID NO: 510755 - DNA, 313 bp, Homo sapiens
caagctctgcctcccgggttcaaacgattcccctgcctcagcctcccaagtaggtgggactacaggtgcgtgccaccacgcgcaggtagttttattttttctattttagtagagacggggtttcaccatgttggccagggtggtctcaatcttctgacctcaagtgatctgcctgtcttggcctcccaaagtgctgggattacaggcacaagctactgcactgggccatggccaggatttttatgacttgtaaaaccactgtcttcaaggaggctataagttattatgggagaaaagtaaagggctttgtaaa

SEQ ID NO: 510756 - DNA, 1003 bp, Homo sapiens
cggagccggtcaacgcgaggaacttgcccccgacaggatggtcccagcgagacatccagggagcccgcacgccaacaaggtggccggcccgggcgaccaggggtcgaagcatcccctgggtctcccaacacggcgggggcttgcccaggccccagcgcagcccctcacagctcccagaaaccggtgagaagcagcccatagctgtgacctgttatccgaaggacagattcggtgctcacagaaagctgtctgaacccttggcaagttacgtaacctctctgcatctcgcgaccatgatggaaccaaagtaagggaaatagcgatacaatgttatcttcagcactgtttgaggtctggagacactgttcagcaaagggcttcccgtcgttccgtggacccagcactggttacttccatactgtactggctatcttataggatgtaataaacttagacgctgggaatcacctagtcggaccatctcaggcagcgatgagctacctgtggatgggagtgttcaacacaggaccagaggcaaggccaggtcttaggagagaaacagttgagatgatccaagtatgatggaatgcgtggcgctggatgcgaggctttgcgagaagtaggggcttggatctgattgaccatataaagctcattgcagtcatgacggatctaattcttaacgtagctcgggctagtttcacaggtgcagtaaatgcctgataaacatgtgcaagtggcaactttgtcttaaagacccaagagcgacaatgagatgcgtactttctactcgctggatagtagctaaagtgaaagaaattgggcacttggtatgatgcagggctgagagaatgggacccagtgtagagttgtatgtgtagaggaacaataggcacttccgtgctatgtagtttgctcagagtgatcactgacggtgtgaatgcccaaatgctccaggtaccccaactctaggcgtataacccaaggaatatttacatcataa

SEQ ID NO: 510757 - DNA, 110 bp, Homo sapiens
aatcgatgcgtggtccttgcagaaggtcttggccgtagctaatggattataggtgtccctaggaaccaagtagatggcgcagtgtactcccaatatttcttgggcctgtt

SEQ ID NO: 510758 - DNA, 789 bp, Homo sapiens
cgtggtacgaatcacggctgtggacatctcggtatcaccgttgatgaactcattggtttcacagagtcatgtgtgatgtactgtgtttgataggccaggtcgagtgacggagcacgtgggacagctctccaccctcccccgggggtgatggtgtgcgagtggtgtggtagaaagttagtaaactgagtggtgggccctgttattgtagtggcataaagccacctcagtaagtccaggtttacgcctgtgcctgtcgcaggcttctcgcgctgggagaaaaggtctctacctggttatctctctcctccttccagcctgcaccctccctccatcaggctcaacggctgtctggttgccctgtgtccctcaccgttacctccccctcagggatccctagccccacgcctcttgtgaagaagacaaaggtctggccgtaccatagaaagactttgttttctattttgtaacccgaaagagtctaacgtgtttggttttacctgcttggaccttttggggggcgcaactaaattacgtaggtcataaaaacattggggttttccgcgtagaattggacaaaccaacacgaactgaccgaacgcaaaagccacgaccgaatacctcgcgggagggcgttgactaaagtacgcgtgggggaacgacaacgtggacgaaaaggatcgcgggggatgggcgcaaacccggtgtcgtatgaaccaacttttgggttgaccgaagggagggaaaacaggaggggaccccccaaagggacggcgaaaaaaatccgaaaac

SEQ ID NO: 510759 - DNA, 455 bp, Homo sapiens
tgtggacctgtcgggatgagagcgtggcccacggaacgcatatgacatgtcgatgctttctagtgagacatcgcgcctgtgccataaggtcacctacacggaccgtagtggggctagtcaggtctaagactggatgacctctttgtgacaggccgctaatgtccgctacgttccactatcccagaatgacgtgaaacatcacgcttcgagcgcattgtagtcagtcagactgtcagaattatccatcggtgtgcgtaagacttgtggtggcaaggtgccaaggccgtgtggggaagtttcgccccaaaaaactgctaagtgatggcctctcatgtaagctcctgggcccaaactcggagtcctccaagtgatctcctggagctatttccctggcctcacaccctgtctggttcccgagaagaaagcagggccggccagaggctggtgtcctgcag

SEQ ID NO: 510760 - DNA, 414 bp, Homo sapiens
gccgcagttagagaccattcaacatggcaaaacacctattctcttactaaaatacaaaaacacttagctgggtgtggtggtgtgcgcgtgtggtccctactactctggaggctgaggtggggggatcacttgccacctgggatgttgaaattgcagtgagtcgagattgcaccactgcgctccatcctgggtgacagagcaagactctgcctcaaaaaaaaaaaaaaaaaaacacacacaggaaaaaaaaaggttttttttaatgagaacccagggaagcccttgcccattataatgctctagtactcgaggttctgttacggggttcaaagattccgcattttattttggggcccattttcctggtttttttttaatggcccgattaaaatgttttttttcaaacacaagcac

SEQ ID NO: 510761 - DNA, 409 bp, Homo sapiens
  misc_feature (68)..(68): n is a, c, g, or t
cttttttttaaccccccagaaaattagtgatgaaagtgtaaattgccacaaagtgtttaaaataaatncccagtcacaatggggagtggcagttatcagtataatcacctaatcacatgaaatcaagaaaacacaaatggctgggccacgggtgtcacgccctataatccccaacactttgactttgggaagctcaggtgggcagatcatttgaggtcaggagtttgagaccagcctggccaacatggcaaaagcccatctctactaaaaatacaaaaaaattagctgggcattttggcgggcacctgcaatcccagctactcaggaggctgaggcaggagaatcacttgagcccaggaggcagaggttgcagtgagccgagatcatgccactagtgacagaatgagac

SEQ ID NO: 510762 - DNA, 921 bp, Homo sapiens
ggctgtgtgtgctgcctgagtgccggagacggtcctgctgctgccgaattcctgccagctgtccgacaatgtcgtcccacctagtcgagccgccgccgcccctgacaacaacaacaacaactgcgagggcgccgtgcgcctcaaacagttcctgggtggagctacccatgaacagcagcaattggcactgatacatggcactgggaacactggggggctgaacaacgtaccatccatcatcctccatccacaagtgagaccctgagaagattcttgtgatgcacaacaatgaatcaggaccagagtagttccaggaggcagttctcacttgttgacacgcccttccgccaacaagaaagatgggccagatcattgttcgatggtggaaactgcacaccacagcgagggaccaactagctctcaggtcgcgaacgaagacgttgtacaccgggacgcgaaaggaagtcgaaggctctcgacacgaacaagtgcgggactgggtactcacgacgtgtccaggtaggacccgaaagatttcaccaagggagttccacttccagaacaccctaaacgtgctgtgtcttaagccatgaggcacaagtggagccatgaagaacggcggtattcactccgcagaactctgaaggtgttcaattccatctccttttcctttcctaatgtgggcgttgggctaggcatcaactatgggaaggatggacacacctctgcggcactaatggggaagaaaggccgtgaaatggtgtgcctggacgtgggttcgacagacgtattgactggacctgtagctaccactacacctgttagttcactcggcgcaccattttacctgggggtgaactccttgcggagacacatccagcggcgcaaaggttgcagccgaaagggtttgagaacttatcc

SEQ ID NO: 510763 - DNA, 124 bp, Homo sapiens
tctgtaccacccagcattgtttgaagtgccctcgctcaaactccttgcgtgcctctgcattgtgggacaccaacacatgatcccagagaacgctctagaggagatcaccacaaacatggatact

SEQ ID NO: 510764 - DNA, 624 bp, Homo sapiens
tctctcggccttagcgccattttttgggaaacctctgcgccatgagagccaagtggaggaagaagcgaatggaccaggattaattcctttcatttcttagtaaattaaaacctgcagctggtggattgtgatcacacattcccgaagtaataagtgaggacgaatgcactgctctggaacataacccagtgctaactgggggtttcatttattcagtcaagcacatcttactcacatccagatttattttcctacagtgcaaacacaccagatgaaactttaaaatgttacttttgtaagcttatcataaatgagttgcagtaatttgttgcttgttgtttaaccacaaccactattttaatgatatactaaagataacactatttagttttttcagaaacatctgcattatatgtgtgtcggtgtggattttgtttctaaaattggcttagtccaataaataaagaaaagcattaaggacttaaagcaacaataaccaaataaaaacttgataggatctttgaagtctatttaaatattcattccattacatctagactcaccaagaactacatgttatgatgttaagtcgaagttgaaacatgatgtttgcattaaatttag

SEQ ID NO: 510765 - DNA, 143 bp, Homo sapiens
  misc_feature (15)..(15): n is a, c, g, or t
cccaagcccacctgngctctctccacccttctagagtccagtcaaccagagtccaaccaaggctccatcctctgattctgccaatgaaaatctccctgcagggcctcttcttttcccagagctcaccccaaccaggagctcta

SEQ ID NO: 510766 - DNA, 227 bp, Homo sapiens
atctagtcagggtgcagctctactagctcagcgctgtcgaaccgagaaccgcagatataatcgccctacagtggtgcttggagcatcccgataccatctcagtaaatctcctacaatggcctccttaccctccccgggacccacacccttcaggtccacatcctgagacctaagggtcccatgatctcagagggtccctcctttccccactgagatctttcgggttc

SEQ ID NO: 510767 - DNA, 423 bp, Homo sapiens
aatcttctgccactgataaggactattctgccattcctggtatcgtgttaccgcatgttcttgataaaatgaatcttcttaaaattctttggtctgggtgaacctgagagagttcgacatctccggagaggggcgttctcctcaatatcttccagggtctccaaggaagatctctgggagatgaggcgccgtcgggacctctgcagctgctcgaaggcgctggtgctgccgccctggcctggctgctccagggagcagtagttctgcgaagtcggcctggagaaggcgatgggcaggattccctgagtgaacgagttgaggcgtccccgactgccgctcccactcccgggggtcccggagcccaaaaaggcggccgccggcacctgcacgctgataaaggcatcgtcctcctccaactcctcc

SEQ ID NO: 510768 - DNA, 311 bp, Homo sapiens
ctcttcctgcagtactcccctgctctctcagaggacaacactgacctcccagttgtcaaatcagctgggcacggtggctcatgcctgtaatcccagcactttgggaggccgaggcaggtggatcacgaggtcaggagttcaagaccagcctggctaatatggtgaaactccatctctactaaaaatacaaaaaaaaaaaattagccaggcgtggtggcgggcacctgtagtcctagctactcgggaggctgagacaggagaatggcatgaattcaggaggcagagcttgcagtgagctgagatcacgccac

SEQ ID NO: 510769 - DNA, 535 bp, Homo sapiens
  misc_feature (12)..(12): n is a, c, g, or t
aagtcttcttcnaacttctcctcgaaaacctcgaaactcaaggaacactgcaatcccgaagctaaaaagccctgccctgggaaattcctgaagaggggagagccctctgtagccggtaccccgagtcacccggtttttcttcggctcacagtggcccacgttgttccaaggaccatggcttctagtagcctctcgaaactccaggggcttctcaacgttattcatggattttctccggagaggggcgttctcctcaatatcttccagggtctccaaggaagatctctgggagatgaggcgccgtcgggacctctgcagctgctcgaaggcgctggtgctgccgccctggcctggctgctccagggagcagtagttctgcgaagtcggcctggagaaggcgatgggcaggattccctgagtgaacgagttgaggcgtccccgactgccgctcccactcccgggggtcccggagcccaaaaaggcggccgccggcacctgcacgctgataaaggcatcgtcctcctccaactcctcc

SEQ ID NO: 510770 - DNA, 165 bp, Homo sapiens
  misc_feature (134)..(134): n is a, c, g, or t
cggaggagcaggcaagagatagcatgacattctttcttcctgccatcgcctcacccctgtggcttagagcaagaggtcagtgagtgtgctagccctgcgattcgggcctgtgcctgccaggagctcgcccgttntcgtcggtgtaccgacgctcgaacttcgtaa

SEQ ID NO: 510771 - DNA, 466 bp, Homo sapiens
  misc_feature (36)..(36): n is a, c, g, or t
  misc_feature (103)..(103): n is a, c, g, or t
  misc_feature (124)..(124): n is a, c, g, or t
  misc_feature (173)..(173): n is a, c, g, or t
  misc_feature (232)..(232): n is a, c, g, or t
  misc_feature (365)..(365): n is a, c, g, or t
ttgccctgcccccactttgtagacccagcagatccnaaacttttcccaatgagaaccttaggaaaccaaaataaaattgtacgccccctgcatcagaattttncctgttttattcccctgattnaagaaaagtacaccatgataaaaaagcctaccctgaattccatcccaanagcagctttaagtgacctatcctaaaacttgatattcagggctgagcatggtggctcanacctgtaatcccagcactttggcaggctgaggcagtcggatcacaaggtcaggagtttgagaccggtctagccaatatggtgaaaccccagctctactaaaaatacaaaaattagctgggcatggcggcgcanacctgtagtcccagctgctccagaggctgaggcaagagaatcgcttgaacccacgagggggaggttgcagtgagctgagatcatgccactgcactccaacc

SEQ ID NO: 510772 - DNA, 105 bp, Homo sapiens
ctacttcacatgtttcagttcattgcgttcgcttcccttgccttatgtattcagcacgggatgacccattcgggccgggctttccccattcggctctctgcggat

SEQ ID NO: 510773 - DNA, 863 bp, Homo sapiens
gggaaaattttttaaaaatgctgctttgccatttttcccgtgcaggagaatatgcaaatggcctttctgtggtcgccctgtcacagccttgtaaaggttctgtggggatccatgcatcttgttgagttgagccttgtgccagcttggagggtttgattgtttttgctaatagagacagattttgtcattagagacaccgaagtgtgattctgtctacattcttctcaagtgtatggtcatagaaatccctttggctttaggtgcaattcagtggaaacacacacacacacacacacacacacacacccacaagcacacgagaatttcacgtgtggatattggcaagggatatagatgtgagccaatatttggtctgtagaatattaacatcgtggcaatcttcgtgatgtaaaatattatagtgaaagagcatctctagtgaggggaagggaagaagggaaaaaacaacacatctagggataaccaggtgcaacgagaccatttttcctatccacgagtcgtgtcttctgcggggggtgttgtgtctaaacagctatttgccagtttcttctaaacagtactgcgtggtgtcctcagatcgtgtaatatcgaccgtgactcgggcttatgcggaccatagtgctcgtaggggttacgagagtccctttatttggggccaatttaacacacaaagagcctcagttcttgtccaaatcttgtactacgccaggggccagtaaaaatgccttgtccacaatgggaagatctgcattacaaacattacacatgtgccttaagtggtccccaactcttgggttacacaggaattgagtccaattaaacacataacactaacgaacccc

SEQ ID NO: 510774 - DNA, 214 bp, Homo sapiens
  misc_feature (57)..(57): n is a, c, g, or t
gatcttctcaatgggggggcggctgtgctccagccaccccgaagtcactttctttgntacaactcccattgttgtcatcttaaactgacacagcgtttataacgtgtgcatacatcaccttctgacctcattttggtatttttcgacacaaggccctatcgaagatcctagaaaacttgaagaagcattaaagtcattctgttaaggtgcgtga

SEQ ID NO: 510775 - DNA, 154 bp, Homo sapiens
gggctgacctagagttcccgactagtcaacatacctattttgtccctattttccactcgcatcatatacttaggtacttttgacccatgcaaaaaaaatatctaacgttcagaactaccaataacaggaagaagagaaatttttttatttcttt

SEQ ID NO: 510776 - DNA, 441 bp, Homo sapiens
aaggtaggactgctagatacttcagctaagcaagacaatctcctctaactgaaaaaggacacgagctttgagcagaaattcaagggtcaagtcagtcttcagaaagcatcaggaacttgtaaatatggagactgctccctgtgggacatcagaaaccttctggctgagagggacacggagacacatcctgtgagggatcagacagtggtgatagtgggcacagtgatcatggcattcaattgtaagctatcatgcttccagaataatgtttctcagagaattgctttgtgaccaggacagcacagatacagtatctgaagacttcagagacattggtaatacaggttgagtattccttatccaaaatgcttgggcatgagaagtgttcagatataggcatatttgcctatgtgtgagaatatcctgggatagggcgatcaa

SEQ ID NO: 510777 - DNA, 820 bp, Homo sapiens
  misc_feature (660)..(660): n is a, c, g, or t
  misc_feature (707)..(707): n is a, c, g, or t
  misc_feature (756)..(756): n is a, c, g, or t
  misc_feature (766)..(766): n is a, c, g, or t
  misc_feature (808)..(808): n is a, c, g, or t
tttgacatatgttggttcaacttgtatatactattttgtaaactgtttttcccaattaacaatatacacagatgtcttcattttacacacccctctcctacacaccctcagacaaaaggcaaacctattcaagtttttgatttttgaaaatgtttcaatcagggaagctctgggtacatttcatgaagagaagtgatgaagatatccctctgacataacagaaagtggctgtttagctaggaaaatcatcaaataagtaagtagaaatgcatgcagaaacagaatgagtcaatcccaattaatgtttctgtgtttcctaaaagaaaataaacaccgcacatttgtctttagacagcttagtgtgcaccatggttccagtgtttttgctggaagtgtaaagttgttagcacaggcatatttctcagttagcagaaaacagctgctactggaattagtacccagaaatgaagttatttcctcccatcatcttactgaattgctctgctttacaaacaagaagtgaacattaattacttggaaaataggcctgacccagccaggatgaggctgacgcgtggaaagaggtaaaaataaaatgacaaagctctcttcacttcctatgctagtgtctgaaaacagagctgctcagaccattatggncatttcaaagttttcattcaataaatagttttttagacacctactgngccctacagggacatatatttttggcatacaatcaataactacaaccgnggtaagaaantaaggacctgctgaaccttacccctgcaaaaggacttatcgnccgaatttaaca

SEQ ID NO: 510778 - DNA, 590 bp, Homo sapiens
  misc_feature (21)..(21): n is a, c, g, or t
  misc_feature (75)..(75): n is a, c, g, or t
  misc_feature (79)..(79): n is a, c, g, or t
  misc_feature (81)..(81): n is a, c, g, or t
  misc_feature (84)..(84): n is a, c, g, or t
  misc_feature (86)..(86): n is a, c, g, or t
  misc_feature (88)..(88): n is a, c, g, or t
  misc_feature (93)..(93): n is a, c, g, or t
  misc_feature (97)..(97): n is a, c, g, or t
  misc_feature (104)..(105): n is a, c, g, or t
  misc_feature (108)..(108): n is a, c, g, or t
  misc_feature (111)..(111): n is a, c, g, or t
  misc_feature (162)..(162): n is a, c, g, or t
  misc_feature (204)..(204): n is a, c, g, or t
  misc_feature (273)..(273): n is a, c, g, or t
  misc_feature (285)..(285): n is a, c, g, or t
  misc_feature (482)..(482): n is a, c, g, or t
  misc_feature (497)..(497): n is a, c, g, or t
  misc_feature (503)..(503): n is a, c, g, or t
  misc_feature (588)..(588): n is a, c, g, or t
gggcagggtcagctgtcaggngccttgaacagggaggtctctgtacctaactttaccatcctaaatccttccctncttntnttntntnccctnccanttccttnnctngtnccaagttaatttcaggccttcaatgtactctcccaccatagcacttacccnttctgggtcatagaagagtgtggctgcaccctaacaccacanactcccaggcacaagttgaaggaatgaggggacctgggttagcttttttgttagggaaactctaacctntttctgctctcnccctcttctctatacctggtccgtagggacgctcttccctgtgtttactattactccccacctctccccacttccctgtgtctcctaatatttattgtctgtagtgtttgtatcatgtcactatcacaaagccttcagaaagaaaaaaaagcattctgcccaccactagcaccctgccatggttaaaatatctctanattggtgtctatatntctttnaaagtttataaaaagctttctgttatctgcagcttctaagggtgattggcctggcgagcactcagtgctcagacttggccttcanaa

SEQ ID NO: 510779 - DNA, 3243 bp, Homo sapiens
ggacgccgccttcgccgctggctccgtctgttggggggcgaacacgccgcggtcctcgtcgtggtgagcgcagccactcaggctggtcctgggggtggggctgtaggggaaagtgctaaagccgctgagtgaagtaagaactctgctagagaggaaatggctgcttcatcatcatcctcctcagctggtggggtcagtggaagttctgtcactggatctggtttcagtgtctcagaccttgccccaccacggaaagcccttttcacctaccccaaaggagctggagagatgttagaagatggctctgagagattcctctgcgaatctgtttttagctatcaagtggcatccacgcttaaacaggtgaaacatgatcagcaagttgctcggatggaaaaactagctggtttggtagaagagctggaggctgacgagtggcggtttaagcccatcgagcagctgctgggattcaccccctcttcaggttgatactgcctggatggtcacctctggtgcgcagcaagtgcaaagccagtgggggactttctcacagcttacatagccatccagagatccacagctacgtcactgaattgttaatgcacatttgtacttggtttctctgtatctattcacaggcaacaaatacttatatgtgtgatctttcagggaatgttttgtttatttgtttttaaaagtattgggaatcagattaagacaatcagtttcagagaaccaggaggtttggggttaagagatactcaaaaattttcacaagccaagtagggcatatatcagatttggccaactgaatggcgtctgtcctgtcatccatatggtgcctggaaatatttaccagtcaaggtcaaggtcagcatctgtggttaaaaatatagcattctgacctaaaaaagttattttgcagatgaatgtgttttcaactcaggacctatccaaatgaggaatttttaaatattcttttttttttcctatttttagacatcaattctatagattctgactttttctaacctcttatagacatgccaaatgctggcaaaaagaagtgctttttggatatggcagcacttgtaaaaataaagcagtaagcaaaatccttttaaacacagaaatcctgagttcttctcattggtggactcaagcaattctgtagcaaataaatcctttgaaagagctccaaattggtggcattatcctttcaaaatctcagggatttgggatgaagtgaagaggtcaaattactttttagaagaagggaatctaaaaaccatctctcctaaacaaatggtagactggctttacttaagggatatttgtctttataggagtacataaatttatcttaatgatatttaagtagttttttttttttttttttgggacgaagttttgctcttgttgcccaggctgtatcgcaatggcgcggtctctgctcactgcagcatccgcctcccgggttcgggcggttctcctgcctcagcctcccgagtagctgggattacaggcgcccgccaccacacccagctaattttttgtatatttggtagagacggggtttcaccgtgttgaccaggctggtctcgagcttctggcctcaggtgatccacctgcctcagcctcccaaattgctgggattacaggcgtgagccaccttgcccagccaatttttttttaaagagacatggtcttgctatgttgcccaggttggtcttgaactcctggcctcaagagatccccccaaccttggcctccaaagtgctgggattacaggcatgagccaccgcgcctggcctcaagtaagtttttataccatgataggggaaaacctggaaggctaagagatgtgctgttttccttcatgggaccccactttccacagtaaacaactggtataatcatttattacgttgtatgcaaattttgccttagacaacatttgtctggttccttattaataacttgcatctgatctgcttagagttgcttaattataagtaaatataatcccagtagcatttagccttaatctcaagagttcaaaatgtttaacacattctacctgacgggaggtggtgacctcattcagtcggttaagagcctgagccctgtgaagttaaacacctgctcatggtcacatagcccaggcagaagaaaatctcggacttggaatagatcccagttgcctgataattcatctcattattgcctctaaagcaaattggagactgggcacagtggctcccacctttaatcccagcacctggggaggctgaggtgagtggatcactagaggtcaggagttcaagaccagtctggccgacatggtgaaactcagtctctattgaaaatacaaaaattagcccagtgtggtggcacacacttgtaatcccagctactcaggaggctgaggcatgagaatcgcttaaacccaggaggcggaggttgcagtgagctgagatcacaccattgcactctagtctgggtgacagagcgagactctgtctcaaaaaaaaaaaaataaagccgggcgtggtggctcacgcctgtaatcccggcacttggggaggctgaggcaggcggattgcctgagaatcgggagttcgagaccagcctggccagcatggtgaaaccttgtctctactaaaactacaaaaaaaatgggccgggcgtggtggcgggcgcctgtaatcccagctactcgggaggctgaggcagcagaatcgtttgaacccgggaggcggaggttgcagtgagtggagatcgtgcctgtgtgctccagcctgagcaacaagagcgaaactgtctcaaaaaaaagaagaaaataaataaataaaaatcagagcacaagaagtaccagtccaccaactcacattttctatattaataattcttaactaaaagaagttccatattcgacagcattttagttttttaatagtacttattagcatcaaccatcttgataatcaccaagggaaaaattaaaaatacctagactgcaataaacctttaaattggattttcagtgagaatttagaagcaatcactacctttctcgtttcatttgtgtaaccatgcagcataggcactgtgttacatcatctttacgctttggtatttgaacttattacagaattttttctctaaattggatgtttctttatatgaccttggaaactgaagtgatcttagcattaaacaaaaatgctttttaaagcaaaa

SEQ ID NO: 510780 - DNA, 3195 bp, Homo sapiens
ggacgccgccttcgccgctggctccgtctgttggggggcgaacacgccgcggtcctcgtcgtggtgagcgcagccactcaggctggtcctgggggtggggctgtaggggaaagtgctaaagccgctgagtgaagtaagaactctgctagagaggaaatggctgcttcatcatcatcctcctcagctggtggggtcagtggaagttctgtcactggatctggtttcagtgtctcagaccttgccccaccacggaaagcccttttcacctaccccaaaggagctggagagatgttagaagatggctctgagagattcctctgcgaatctgtttttagctatcaagtggcatccacgcttaaacaggtgaaacatgatcagcaagttgctcggatggaaaaactagctggtttggtagaagagctggaggctgacgagtggcggtttaagcccatcgagcagctgctgggattcaccccctcttcaggttgatactgcctggatggtcacctctggtgcgcagcaagtgcaaagccagtgggggactttctcacagcttacatagccatccagagatccacagctacgtcactgaattgttaatgcacatttgtacttggtttctctgtatctattcacaggcaacaaatacttatatgtgtgatctttcagggaatgttttgtttatttgtttttaaaagtattgggaatcagattaagacaatcagtttcagagaaccaggaggtttggggttaagagatactcaaaaattttcacaagccaagtagggcatatatcagatttggccaactgaatggcgtctgtcctgtcatccatatggtgcctggaaatatttaccagtcaaggtcaaggtcagcatctgtggttaaaaatatagcattctgacctaaaaaagttattttgcagatgaatgtgttttcaactcaggacctatccaaatgaggaatttttaaatattcttttttttttcctatttttagacatcaattctatagattctgactttttctaacctcttatagacatgccaaatgctggcaaaaagaagtgctttttggatatggcagcacttgtaaaaataaagcagtaagcaaaatccttttaaacacagaaatcctgagttcttctcattggtggactcaagcaattctgtagcaaataaatcctttgaaagagctccaaattggtggcattatcctttcaaaatctcagggatttgggatgaagtgaagaggtcaaattactttttagaagaagggaatctaaaaaccatctctcctaaacaaatggtagactggctttacttaagggatatttgtctttataggagtacataaatttatcttaatgatatttaagtagttttttttttttttttttgggacgaagttttgctcttgttgcccaggctgtatcgcaatggcgcggtctctgctcactgcagcatccgcctcccgggttcgggcggttctcctgcctcagcctcccgagtagctgggattacaggcgcccgccaccacacccagctaattttttgtatatttggtagagacggggtttcaccgtgttgaccaggctggtctcgagcttctggcctcaggtgatccacctgcctcagcctcccaaattgctgggattacaggcgtgagccaccttgcccagccaatttttttttaaagagacatggtcttgctatgttgcccaggttggtcttgaactcctggcctcaagagatcccgcctggcctcaagtaagtttttataccatgataggggaaaacctggaaggctaagagatgtgctgttttccttcatgggaccccactttccacagtaaacaactggtataatcatttattacgttgtatgcaaattttgccttagacaacatttgtctggttccttattaataacttgcatctgatctgcttagagttgcttaattataagtaaatataatcccagtagcatttagccttaatctcaagagttcaaaatgtttaacacattctacctgacgggaggtggtgacctcattcagtcggttaagagcctgagccctgtgaagttaaacacctgctcatggtcacatagcccaggcagaagaaaatctcggacttggaatagatcccagttgcctgataattcatctcattattgcctctaaagcaaattggagactgggcacagtggctcccacctttaatcccagcacctggggaggctgaggtgagtggatcactagaggtcaggagttcaagaccagtctggccgacatggtgaaactcagtctctattgaaaatacaaaaattagcccagtgtggtggcacacacttgtaatcccagctactcaggaggctgaggcatgagaatcgcttaaacccaggaggcggaggttgcagtgagctgagatcacaccattgcactctagtctgggtgacagagcgagactctgtctcaaaaaaaaaaaaataaagccgggcgtggtggctcacgcctgtaatcccggcacttggggaggctgaggcaggcggattgcctgagaatcgggagttcgagaccagcctggccagcatggtgaaaccttgtctctactaaaactacaaaaaaaatgggccgggcgtggtggcgggcgcctgtaatcccagctactcgggaggctgaggcagcagaatcgtttgaacccgggaggcggaggttgcagtgagtggagatcgtgcctgtgtgctccagcctgagcaacaagagcgaaactgtctcaaaaaaaagaagaaaataaataaataaaaatcagagcacaagaagtaccagtccaccaactcacattttctatattaataattcttaactaaaagaagttccatattcgacagcattttagttttttaatagtacttattagcatcaaccatcttgataatcaccaagggaaaaattaaaaatacctagactgcaataaacctttaaattggattttcagtgagaatttagaagcaatcactacctttctcgtttcatttgtgtaaccatgcagcataggcactgtgttacatcatctttacgctttggtatttgaacttattacagaattttttctctaaattggatgtttctttatatgaccttggaaactgaagtgatcttagcattaaacaaaaatgctttttaaagcaaaa

SEQ ID NO: 510781 - DNA, 359 bp, Homo sapiens
  misc_feature (41)..(41): n is a, c, g, or t
  misc_feature (58)..(58): n is a, c, g, or t
ttttttgggagtatgaaaagtaagtgcctttcttaaatctnaataataaatgagagtnccagaaaaccagtgcttcaaacaaatttgatttacttgaatttttttttattttaaatcacactttgggaggctgaggcagaaggatcacttgagcccaggagtttgacaccagcctgggcaacatggtgacactctgtctatacaagaaatataaaaattagccaggcatggtggcacacgcctttggtcccagctgctcaaaaggattgcctgagcctgggaggttgaggctgcagtgagctatgattgtgccactgcacaacagcctgggtgacagagtgagaccttgtctaaaaaaa

SEQ ID NO: 510782 - DNA, 2929 bp, Homo sapiens
ggacgccgccttcgccgctggctccgtctgttggggggcgaacacgccgcggtcctcgtcgtggtgagcgcagccactcaggctggtcctgggggtggggctgtaggggaaagtgctaaagccgctgagtgaagtaagaactctgctagagaggaaatggctgcttcatcatcatcctcctcagctggtggggtcagtggaagttctgtcactggatctggtttcagtgtctcagaccttgccccaccacggaaagcccttttcacctaccccaaaggagctggagagatgttagaagatggctctgagagattcctctgcgaatctgtttttagctatcaagtggcatccacgcttaaacaggtgaaacatgatcagcaagttgctcggatggaaaaactagctggtttggtagaagagctggaggctgacgagtggcggtttaagcccatcgagcagctgctgggattcaccccctcttcaggttgatactgcctggatggtcacctctggtgcgcagcaagtgcaaagccagtgggggactttctcacagcttacatagccatccagagatccacagctacgtcactgaattgttaatgcacatttgtacttggtttctctgtatctattcacaggcaacaaatacttatatgtgtgatctttcagggaatgttttgtttatttgtttttaaaagtattgggaatcagattaagacaatcagtttcagagaaccaggaggtttggggttaagagatactcaaaaattttcacaagccaagtagggcatatatcagatttggccaactgaatggcgtctgtcctgtcatccatatggtgcctggaaatatttaccagtcaaggtcaaggtcagcatctgtggttaaaaatatagcattctgacctaaaaaagttattttgcagatgaatgtgttttcaactcaggacctatccaaatgaggaatttttaaatattcttttttttttcctatttttagacatcaattctatagattctgactttttctaacctcttatagacatgccaaatgctggcaaaaagaagtgctttttggatatggcagcacttgtaaaaataaagcagtaagcaaaatccttttaaacacagaaatcctgagttcttctcattggtggactcaagcaattctgtagcaaataaatcctttgaaagagctccaaattggtggcattatcctttcaaaatctcagggatttgggatgaagtgaagaggtcaaattactttttagaagaagggaatctaaaaaccatctctcctaaacaaatggtagactggctttacttaagggatatttgtctttataggagtacataaatttatcttaatgatatttaagtagttttttttttttttttttgggacgaagttttgctcttgttgcccaggctgtatcgcaatggcgcggtctctgctcactgcagcatccgcctcccgggttcgggcggttctcctgcctcagcctcccgagtagctgggattacaggcgcccgccaccacacccagctaattttttgtatatttggtagagacggggtttcaccgtgttgaccaggctggtctcgagcttctggcctcaggtgatccacctgcctcagcctcccaaattgctgggattacaggcgtgagccaccttgcccagccaatttttttttaaagagacatggtcttgctatgttgcccaggttggtcttgaactcctggcctcaagagatccccccaaccttggcctccaaagtgctgggattacaggcatgagccaccgcgcctggcctcaagtaagtttttataccatgataggggaaaacctggaaggctaagagatgtgctgttttccttcatgggaccccactttccacagtaaacaactggtataatcatttattacgttgtatgcaaattttgccttagacaacatttgtctggttccttattaataacttgcatctgatctgcttagagttgcttaattataagtaaatataatcccagtagcatttagccttaatctcaagagttcaaaatgtttaacacattctacctgacgggaggtggtgacctcattcagtcggttaagagcctgagccctgtgaagttaaacacctgctcatggtcacatagcccaggcagaagaaaatctcggacttggaatagatcccagttgcctgataattcatctcattattgcctctaaagcaaattggagactgggcacagtggctcccacctttaatcccagcacctggggaggctgaggtgagtggatcactagaggtcaggagttcaagaccagtctggccgacatggtgaaactcagtctctattgaaaatacaaaaattagcccagtgtggtggcacacacttgttcgggaggctgaggcagcagaatcgtttgaacccgggaggcggaggttgcagtgagtggagatcgtgcctgtgtgctccagcctgagcaacaagagcgaaactgtctcaaaaaaaagaagaaaataaataaataaaaatcagagcacaagaagtaccagtccaccaactcacattttctatattaataattcttaactaaaagaagttccatattcgacagcattttagttttttaatagtacttattagcatcaaccatcttgataatcaccaagggaaaaattaaaaatacctagactgcaataaacctttaaattggattttcagtgagaatttagaagcaatcactacctttctcgtttcatttgtgtaaccatgcagcataggcactgtgttacatcatctttacgctttggtatttgaacttattacagaattttttctctaaattggatgtttctttatatgaccttggaaactgaagtgatcttagcattaaacaaaaatgctttttaaagcaaaa

SEQ ID NO: 510783 - DNA, 2025 bp, Homo sapiens
ggacgccgccttcgccgctggctccgtctgttggggggcgaacacgccgcggtcctcgtcgtggtgagcgcagccactcaggctggtcctgggggtggggctgtaggggaaagtgctaaagccgctgagtgaagtaagaactctgctagagaggaaatggctgcttcatcatcatcctcctcagctggtggggtcagtggaagttctgtcactggatctggtttcagtgtctcagaccttgccccaccacggaaagcccttttcacctaccccaaaggagctggagagatgttagaagatggctctgagagattcctctgcgaatctgtttttagctatcaagtggcatccacgcttaaacaggtgaaacatgatcagcaagttgctcggatggaaaaactagctggtttggtagaagagctggaggctgacgagtggcggtttaagcccatcgagcagctgctgggattcaccccctcttcaggttgatactgcctggatggtcacctctggtgcgcagcaagtgcaaagccagtgggggactttctcacagcttacatagccatccagagatccacagctacgtcactgaattgttaatgcacatttgtacttggtttctctgtatctattcacaggcaacaaatacttatatgtgtgatctttcagggaatgttttgtttatttgtttttaaaagtattgggaatcagattaagacaatcagtttcagagaaccaggaggtttggggttaagagatactcaaaaattttcacaagccaagtagggcatatatcagatttggccaactgaatggcgtctgtcctgtcatccatatggtgcctggaaatatttaccagtcaaggtcaaggtcagcatctgtggttaaaaatatagcattctgacctaaaaaagttattttgcagatgaatgtgttttcaactcaggacctatccaaatgaggaatttttaaatattcttttttttttcctatttttagacatcaattctatagattctgactttttctaacctcttatagacatgccaaatgctggcaaaaagaagtgctttttggatatggcagcacttgtaaaaataaagcagtaagcaaaatccttttaaacacagaaatcctgagttcttctcattggtggactcaagcaattctgtagcaaataaatcctttgaaagagctccaaattggtggcattatcctttcaaaatctcagggatttgggatgaagtgaagaggtcaaattactttttagaagaagggaatctaaaaaccatctctcctaaacaaatggtagactggctttacttaagggatatttgtctttataggagtacataaatttatcttaatgatatttaagtagttttttttttttttttttgggacgaagttttgctcttgttgcccaggctgtatcgcaatggcgcggtctctgctcactgcagcatccgcctcccgggttcgggcggttctcctgcctcagtcgggaggctgaggcagcagaatcgtttgaacccgggaggcggaggttgcagtgagtggagatcgtgcctgtgtgctccagcctgagcaacaagagcgaaactgtctcaaaaaaaagaagaaaataaataaataaaaatcagagcacaagaagtaccagtccaccaactcacattttctatattaataattcttaactaaaagaagttccatattcgacagcattttagttttttaatagtacttattagcatcaaccatcttgataatcaccaagggaaaaattaaaaatacctagactgcaataaacctttaaattggattttcagtgagaatttagaagcaatcactacctttctcgtttcatttgtgtaaccatgcagcataggcactgtgttacatcatctttacgctttggtatttgaacttattacagaattttttctctaaattggatgtttctttatatgaccttggaaactgaagtgatcttagcattaaacaaaaatgctttttaaagcaaaa

SEQ ID NO: 510784 - DNA, 420 bp, Homo sapiens
  misc_feature (303)..(303): n is a, c, g, or t
  misc_feature (308)..(308): n is a, c, g, or t
acgccgtgacacaacggggggagcggaaagctggcctttcacagaaaaccatggttttccagtgaaattggtgggccattccaaaacaaagctaaaggttcccaaacttccagaatggaagctgtttcccccaactccattacctatacaacaggagggatggcttttggtagaaccctttcttccagggtgcaattttggcattatttaccctccccggatctaaaagcaatatggcgtccaggaaagtgcggctgatgcagctgggccatcattgtgatgcagctggagcaaaaggcggcnccgtncacttcagccagatccatttgtctcccacctgggtgttgtcccagggctggtattggggccggcaagtctctgacctggtgtaaaacccgggcagtcgagataagtccaatg

SEQ ID NO: 510785 - DNA, 239 bp, Homo sapiens
gctcaatgccaaggagatctgtgctgctggttgggttcatgtgatgaggtgaaatgagatgcccatgcagcactcatggtcccctgccacagtggcctccaatgaatgtcatcccatgccctgagaacttgtttggcgcccattaatgaagcacgaggtcccagcccaagtctgatgttaactagtgaggtgtgtgaattccatggtgaaggaggtgaccacactgcttgacaacaaca

SEQ ID NO: 510786 - DNA, 1128 bp, Homo sapiens
cggacgcgtgggtcgacccacgcgtccgggcgaacacgccgcggtcctcgtcgtgtgaagtaagaactctgctagagaggaaatggctgcttcatcatcatcctcctcagctggtggggtcagtggaagttctgtcactggatctggtttcagtgtctcagaccttgccccaccacggaaagcccttttcacctaccccaaaggagctggagagatgttagaagatggctctgagagattcctctgcgaatctgtttttagctatcaagtggcatccacgcttaaacaggtgaaacatgatcagcaagttgctcggatggaaaaactagctggtttggtagaagagctggaggctgacgagtggcggtttaagcccatcgagcagctgctgggattcaccccctcttcaggttgatactgcctggatggtcacctctggtgcgcagcaagtgcaaagccagtgggggactttctcacagcttacatagccatccagagatccacagctacgtcactgaattgttaatgcacatttgtacttggtttctctgtatctattcacaggcaacaaatacttatatgtgtgatctttcagggaatgttttgtttatttgtttttaaaagtattgggaatcagattaagacaatcagtttcagagaaccaggaggtttggggttaagagatactcaaaaattttcacaagccaagtagggcatatatcagatttggccaactgaatggcgtctgtcctgtcatccatatggtgcctggaaatatttaccagtcaaggtcaaggtcagcatctgtggttaaaaatatagcattctgacctaaaaaagttattttgcagatgaatgtgttttcaactcaggacctatccaaatgaggaatttttaaatattcttttttttttcctatttttagacatcaattctatagattctgactttttctaacctcttatagacatgccaaatgctggcaaaaagaagtgctttttggatatggcagcacttgtaaaaataaagcagtaagcaaaatccttttaaacacagaaatcctgagttcttctcattggtggactcaagcaattctgtagcaaataaatcctttgaaagagctccaaa

SEQ ID NO: 510787 - DNA, 993 bp, Homo sapiens
tggaaaaaaaaggacaccccttcccccccccttgttctttaacccttttttaaaaaggggggaaaacacccgggggttaaggattgggggtgtccagccgtggtgtttcttgtggcccccattaaactctgtgatttattggggctttctactttctcccacgaaagcctttattattgtggggagattacaccaactggtgttgttttacccaaaggtcgtcgtttattttgttcccttcttttcttactttattgctttcctccccagttttcccgcgcggtggccccacaacgtttttttgtcccccacattgtttgcgccaccgccgtttttgggttttcgtagcccccgttattttgtgaccggcctgtgctaatttatgtcacaacaaaggggtggaccgtccgtgggggtcattaaacgcttggggagattctgccgcgatcatcccacccaatcttagcgagggaaaaaaaagtgtgcatggtctttcgtagttgcacgctagacgcttcatcaaaacagggtgcgccacttattttgaagggacacatatcaaaagcggtttagtaacccctgtgtatttacaacaagggggggccagcaagccccgagagaaaagcgcttctacaagaatacgtgcagcttaacgaaaaaagtcgttcctgatggcccacggttgctcacagaaattatttgcccctgttctcacgggacaaagaaaacacgaccttttggaaggttgtcgaattctaccgcatgaaccaaattttttgacaacacctcccgaggggtgcaaactcaatatcttgaagatgccaaactttcagggatgtgtaacacacgcccccaatgccatgagagatatggccgcaacgaatcagccgcgagaagcaaatggtctcttttggaaatagcatgcgtgtgaataacacgggggaccatcacaggccagcatggacaccaaccacaagggttggaacggttgct

SEQ ID NO: 510788 - DNA, 415 bp, Homo sapiens
gtagattaactacttaatgtaactgggatgactcagtctctatgttattaatctcatcagactaaactaaggcttaaggaaagggtgtaagtatcagtaaccctctgggtttcactggagctttcttcagggctggggaagggcaggtaagtagcctgctgtagggaggatggagcaggacacatgtgttaaggatatattctgatgccaccagtctgtaacctatgaaacttacatcttggctttaggtcctctgaagtataaaactagtgatgtagctgttattaacaagtcagttttgccttcagtcttctaacttgttttctgtttccttcataattaaaatgctcacttgataatactgccttcctgtaatgatagatgttcctcattctaccagcgtcagtatagatag

SEQ ID NO: 510789 - DNA, 1528 bp, Homo sapiens
ggacgccgccttcgccgctggctccgtctgttggggggcgaacacgccgcggtcctcgtcgtggtgagcgcagccactcaggctggtcctgggggtggggctgtaggggaaagtgctaaagccgctgaggtgcagtggctcacgcctgtaatcccagcactttgggaggccaaggcaggtggatcacctgaggtcgggagttcaagaccagcctgaccaacatggagaaaccccatctctactagaaatacaaaattagccaggcatggtggtgcatgcctgtaatcccagctactcgggaggctgaagcaggagaatcgcttgaatccgggaggcagaggttgctgtgagccgagatcgcgccatttccagcctgggcaacaagagggaaactccgtctcaaaaaaaaaaaaaaaaaggaagagaaaagaaaacttaagtttcagccaggcatgtgaagtaagaactctgctagagaggaaatggctgcttcatcatcatcctcctcagctggtggggtcagtggaagttctgtcactggatctggtttcagtgtctcagaccttgccccaccacggaaagcccttttcacctaccccaaaggagctggagagatgttagaagatggctctgagagattcctctgcgaatctgtttttagctatcaagtggcatccacgcttaaacaggtgaaacatgatcagcaagttgctcggatggaaaaactagctggtttggtagaagagctggaggctgacgagtggcggtttaagcccatcgagcagctgctgggattcaccccctcttcaggttgatactgcctggatggtcacctctggtgcgcagcaagtgcaaagccagtgggggactttctcacagcttacatagccatccagagatccacagctacgtcactgaattgttaatgcacatttgtacttggtttctctgtatctattcacaggcaacaaatacttatatgtgtgatctttcagggaatgttttgtttatttgtttttaaaagtattgggaatcagattaagacaatcagtttcagagaaccaggaggtttggggttaagagatactcaaaaattttcacaagccaagtagggcatatatcagatttggccaactgaatggcgtctgtcctgtcatccatatggtgcctggaaatatttaccagtcaaggtcaaggtcagcatctgtggttaaaaatatagcattctgacctaaaaaagttattttgcagatgaatgtgttttcaactcaggacctatccaaatgaggaatttttaaatattcttttttttttcctatttttagacatcaattctatagattctgactttttctaacctcttatagacatgccaaatgctggcaaaaagaagtgctttttggatatggcagcacttgtaaaaataaagcagtaagcaaaatccttttaaacacagaaatcctgagttcttctcattggtggactcaagcaattctgtagcaaataaatcctttgaaagagctccaaa

SEQ ID NO: 510790 - DNA, 169 bp, Homo sapiens
ccatctttggttctttacctaccacacactgctactggaacaccttctacacacacctacggggggactcctctacgacgtcgacccgtgcacggcatgcacacgcttgtggcacctggcccccgtcgttttaccacaccgtcgttgacctggggaccggcctaccgta

SEQ ID NO: 510791 - DNA, 1520 bp, Homo sapiens
cggacgcgtgggtcgacccacgcgtccgggcgaacacgccgcggtcctcgtcgtggtgagcgcagccactcaggctggtcctgggggtggggctgtaggggaaagtgctaaagccgctgaggtgcagtggctcacgcctgtaatcccagcactttgggaggccaaggcaggtggatcacctgaggtcgggagttcaagaccagcctgaccaacatggagaaaccccatctctactagaaatacaaaattagccaggcatggtggtgcatgcctgtaatcccagctactcgggaggctgaagcaggagaatcgcttgaatccgggaggcagaggttgctgtgagccgagatcgcgccatttccagcctgggcaacaagagggaaactccgtctcaaaaaaaaaaaaaaaaaggaagagaaaagaaaacttaagtttcagccaggcatgtgaagtaagaactctgctagagaggaaatggctgcttcatcatcatcctcctcagctggtggggtcagtggaagttctgtcactggatctggtttcagtgtctcagaccttgccccaccacggaaagcccttttcacctaccccaaaggagctggagagatgttagaagatggctctgagagattcctctgcgaatctgtttttagctatcaagtggcatccacgcttaaacaggtgaaacatgatcagcaagttgctcggatggaaaaactagctggtttggtagaagagctggaggctgacgagtggcggtttaagcccatcgagcagctgctgggattcaccccctcttcaggttgatactgcctggatggtcacctctggtgcgcagcaagtgcaaagccagtgggggactttctcacagcttacatagccatccagagatccacagctacgtcactgaattgttaatgcacatttgtacttggtttctctgtatctattcacaggcaacaaatacttatatgtgtgatctttcagggaatgttttgtttatttgtttttaaaagtattgggaatcagattaagacaatcagtttcagagaaccaggaggtttggggttaagagatactcaaaaattttcacaagccaagtagggcatatatcagatttggccaactgaatggcgtctgtcctgtcatccatatggtgcctggaaatatttaccagtcaaggtcaaggtcagcatctgtggttaaaaatatagcattctgacctaaaaaagttattttgcagatgaatgtgttttcaactcaggacctatccaaatgaggaatttttaaatattcttttttttttcctatttttagacatcaattctatagattctgactttttctaacctcttatagacatgccaaatgctggcaaaaagaagtgctttttggatatggcagcacttgtaaaaataaagcagtaagcaaaatccttttaaacacagaaatcctgagttcttctcattggtggactcaagcaattctgtagcaaataaatcctttgaaagagctccaaa

SEQ ID NO: 510792 - DNA, 223 bp, Homo sapiens
acggtagcacgcacgtgttgggccacgcaccgtgatatggaaggattggtgaagagatgtcagaatttctttggtctgctcttaggggaggacgagcttttgatttttgactatccagtccccttgaaaggaggctccttgctgtatagcaaagctttctcggtgggagagttcttgggtaggattgctgggataacaggaaggagacggtgcgttggcccaa

SEQ ID NO: 510793 - DNA, 242 bp, Homo sapiens
  misc_feature (7)..(7): n is a, c, g, or t
  misc_feature (105)..(105): n is a, c, g, or t
  misc_feature (121)..(121): n is a, c, g, or t
  misc_feature (149)..(149): n is a, c, g, or t
  misc_feature (151)..(151): n is a, c, g, or t
aagcgcncagtactgcctcatgactgagttctcacgagatctggttgtttaaaagtgtgtaacccagccgagcaggtggctcctgcctgctatccccgcactttnggaggctgaggcaccntaagtcaggagttccagaccagcttggncnatatgagaaaactttgtatctactgtaaatagcaaaattacccgggtatagtggcacatgcctgtagtcccagctacttagggcgctcgtg

SEQ ID NO: 510794 - DNA, 379 bp, Homo sapiens
gacccgttctgctgctgctgctctcccgcctctgcctggactacgagacggccaccatctactacatcctcactctcactgatgaacaggttctggagcaggatcagctcccagagacgcccgtgagcacgctgagagcagagtccagacaaacggcgcggcggctgctgacccactacgggaagaggcagagcctggtcatatcacagatgctgcgcaagagcatggagactcgcgactggctcagcactctggagccccggaatgtgcgagccgccatgaagcgcatggtgaaggataccaccgtcatcgacgtgcagatgtggctcctgtacgaagagtgtgttcgcaaggcccagagcagcgactccagcaagag

SEQ ID NO: 510795 - DNA, 1462 bp, Homo sapiens
ggacgccgccttcgccgctggctccgtctgttggggggcgaacacgccgcggtcctcgtcgtggtgcagtggctcacgcctgtaatcccagcactttgggaggccaaggcaggtggatcacctgaggtcgggagttcaagaccagcctgaccaacatggagaaaccccatctctactagaaatacaaaattagccaggcatggtggtgcatgcctgtaatcccagctactcgggaggctgaagcaggagaatcgcttgaatccgggaggcagaggttgctgtgagccgagatcgcgccatttccagcctgggcaacaagagggaaactccgtctcaaaaaaaaaaaaaaaaaggaagagaaaagaaaacttaagtttcagccaggcatgtgaagtaagaactctgctagagaggaaatggctgcttcatcatcatcctcctcagctggtggggtcagtggaagttctgtcactggatctggtttcagtgtctcagaccttgccccaccacggaaagcccttttcacctaccccaaaggagctggagagatgttagaagatggctctgagagattcctctgcgaatctgtttttagctatcaagtggcatccacgcttaaacaggtgaaacatgatcagcaagttgctcggatggaaaaactagctggtttggtagaagagctggaggctgacgagtggcggtttaagcccatcgagcagctgctgggattcaccccctcttcaggttgatactgcctggatggtcacctctggtgcgcagcaagtgcaaagccagtgggggactttctcacagcttacatagccatccagagatccacagctacgtcactgaattgttaatgcacatttgtacttggtttctctgtatctattcacaggcaacaaatacttatatgtgtgatctttcagggaatgttttgtttatttgtttttaaaagtattgggaatcagattaagacaatcagtttcagagaaccaggaggtttggggttaagagatactcaaaaattttcacaagccaagtagggcatatatcagatttggccaactgaatggcgtctgtcctgtcatccatatggtgcctggaaatatttaccagtcaaggtcaaggtcagcatctgtggttaaaaatatagcattctgacctaaaaaagttattttgcagatgaatgtgttttcaactcaggacctatccaaatgaggaatttttaaatattcttttttttttcctatttttagacatcaattctatagattctgactttttctaacctcttatagacatgccaaatgctggcaaaaagaagtgctttttggatatggcagcacttgtaaaaataaagcagtaagcaaaatccttttaaacacagaaatcctgagttcttctcattggtggactcaagcaattctgtagcaaataaatcctttgaaagagctccaaa

SEQ ID NO: 510796 - DNA, 835 bp, Homo sapiens
  misc_feature (139)..(139): n is a, c, g, or t
  misc_feature (145)..(145): n is a, c, g, or t
  misc_feature (151)..(151): n is a, c, g, or t
  misc_feature (176)..(176): n is a, c, g, or t
  misc_feature (190)..(190): n is a, c, g, or t
  misc_feature (202)..(202): n is a, c, g, or t
  misc_feature (210)..(210): n is a, c, g, or t
  misc_feature (252)..(252): n is a, c, g, or t
  misc_feature (290)..(290): n is a, c, g, or t
  misc_feature (764)..(764): n is a, c, g, or t
tgtgacgaggagggtgattgtagaggaggtgggtgttagctggagggtggttgatagtggagaccggtttaaggtgctggcgtggtgtcatggggtagcggagtaaaatgggtagctcctcgaaatcctctgtctggangatganataganggctgctccacccaagggggtgagngttaccatggcaancatgcagacgancagcccancccgggctctgcgtgcatgtccatcctggtcccttcatctcnatatcaccagctctgcagtgctccaaactttgggtttntacggtccctagttttgtatgagcctcatcttgatcctaagagccacctctccctaacactcccgatttttctcacctctggaggacgtcccatcctctgataccataggtctcctctgatctctgcattactcctcctccccaagtttagccagagccagtgccccctagacttcctcatctcttccctgccatggcccctggtcctggacagatgattacctgaagcaaagcccaggatgaccacagccatcagccagcagaatcgcatcaggtcgccaaaaatcatctagaaggagcaggaggcagagaacatctgcacacattccccaagcaattgccccatccagcctctaacaggtctcaccccgacaagtctcacagctccacctctgggacagggattggctatctatggcctgtggaccagatctacctgacctgctttggtgtggcctttgaactgaaaaggtntctacatttttaaaaggattgttaaaaaagaagaaaaacatgcagtgaggccatgtgtggcttgcagaacc

SEQ ID NO: 510797 - DNA, 253 bp, Homo sapiens
ctggaacctcatgtgatcgacaccgagcaccattttaaataaggctctctagcaaagtgggagaaattaagaagctatggttccaccgctcagctagcaatgaaagcaaacttcatgaccaggtgaaccctaaaagaatgttgcggagcttgaagaacactgctgaatcaggcggcagacgaagagaaaaacaaagaattgaaggaaaaacaccccacagatctgcaatttcagtgctgaagcaagagccctg

SEQ ID NO: 510798 - DNA, 1548 bp, Homo sapiens
ggacgccgccttcgccgctggctccgtctgttggggggcgaacacgccgcggtcctcgtcgtggtgagcgcagccactcaggctggtcctgggggtggggctgtaggggaaagtgctaaagccgctgaggtaagaggccgaggggtcgagggccctcgggagcttggtgaaaagggagttaacccccaggatcctacctgcagggactagaaaaatggagaaggtaggaggagaaacaggagactgctgcagcagacgtgcgataggaaatttccccaggccgggtttgaccgagtgcgcatgcgggccgagggctggcgcctgcgcagtgggagaatcgcttgaatccgggaggcagaggttgctgtgagccgagatcgcgccatttccagcctgggcaacaagagggaaactccgtctcaaaaaaaaaaaaaaaaaggaagagaaaagaaaacttaagtttcagccaggcatgtgaagtaagaactctgctagagaggaaatggctgcttcatcatcatcctcctcagctggtggggtcagtggaagttctgtcactggatctggtttcagtgtctcagaccttgccccaccacggaaagcccttttcacctaccccaaaggagctggagagatgttagaagatggctctgagagattcctctgcgaatctgtttttagctatcaagtggcatccacgcttaaacaggtgaaacatgatcagcaagttgctcggatggaaaaactagctggtttggtagaagagctggaggctgacgagtggcggtttaagcccatcgagcagctgctgggattcaccccctcttcaggttgatactgcctggatggtcacctctggtgcgcagcaagtgcaaagccagtgggggactttctcacagcttacatagccatccagagatccacagctacgtcactgaattgttaatgcacatttgtacttggtttctctgtatctattcacaggcaacaaatacttatatgtgtgatctttcagggaatgttttgtttatttgtttttaaaagtattgggaatcagattaagacaatcagtttcagagaaccaggaggtttggggttaagagatactcaaaaattttcacaagccaagtagggcatatatcagatttggccaactgaatggcgtctgtcctgtcatccatatggtgcctggaaatatttaccagtcaaggtcaaggtcagcatctgtggttaaaaatatagcattctgacctaaaaaagttattttgcagatgaatgtgttttcaactcaggacctatccaaatgaggaatttttaaatattcttttttttttcctatttttagacatcaattctatagattctgactttttctaacctcttatagacatgccaaatgctggcaaaaagaagtgctttttggatatggcagcacttgtaaaaataaagcagtaagcaaaatccttttaaacacagaaatcctgagttcttctcattggtggactcaagcaattctgtagcaaataaatcctttgaaagagctccaaa

SEQ ID NO: 510799 - DNA, 1782 bp, Homo sapiens
  misc_feature (25)..(25): n is a, c, g, or t
  misc_feature (29)..(29): n is a, c, g, or t
  misc_feature (34)..(34): n is a, c, g, or t
  misc_feature (43)..(43): n is a, c, g, or t
  misc_feature (49)..(49): n is a, c, g, or t
  misc_feature (63)..(63): n is a, c, g, or t
taggggtttaccccagacatatcantaangaatncctcttacnctgctntagcatctcacatntctgctggatctcttcctcactcaaaagcacccaacatcccaatagttagatgaagctttttaggattctggaaaatgctgctgtcaaccccatgatccatggagcacttcgccagtacttcctcctggaatctcaggaatccttcctgaacctcaacttcattgaggaaaaaggcaaggaagtgagtgaagggctgctttcttcgaaaagtgtccaaaagaacatcaatccgtgttcgggctgaaattacaccatttcgatgctggccagtgattacaatttccccgtcttgtccaggtttaggaatgctaatagaagttttggtctccatttctattttcttcctagtgtcccctctctttccaactatatgcttatagagcaagctgggggccctcaaagtagaccggaatccttgtggggtctgctccacctcgtaggcatcacagggctcatcagcacactccatggagccttgatagaagtcctcttcatcttcttcatgttgataggtctgttcttggactggattcttcctgtaattccggccatcaattcttataagctgtggacgcagaacttccatgacactttctccaaatgatattccaattatgccctgcagggactagaaaaatggagaagtgaagtaagaactctgctagagaggaaatggctgcttcatcatcatcctcctcagctggtggggtcagtggaagttctgtcactggatctggtttcagtgtctcagaccttgccccaccacggaaagcccttttcacctaccccaaaggagctggagagatgttagaagatggctctgagagattcctctgcgaatctgtttttagctatcaagtggcatccacgcttaaacaggtgaaacatgatcagcaagttgctcggatggaaaaactagctggtttggtagaagagctggaggctgacgagtggcggtttaagcccatcgagcagctgctgggattcaccccctcttcaggttgatactgcctggatggtcacctctggtgcgcagcaagtgcaaagccagtgggggactttctcacagcttacatagccatccagagatccacagctacgtcactgaattgttaatgcacatttgtacttggtttctctgtatctattcacaggcaacaaatacttatatgtgtgatctttcagggaatgttttgtttatttgtttttaaaagtattgggaatcagattaagacaatcagtttcagagaaccaggaggtttggggttaagagatactcaaaaattttcacaagccaagtagggcatatatcagatttggccaactgaatggcgtctgtcctgtcatccatatggtgcctggaaatatttaccagtcaaggtcaaggtcagcatctgtggttaaaaatatagcattctgacctaaaaaagttattttgcagatgaatgtgttttcaactcaggacctatccaaatgaggaatttttaaatattcttttttttttcctatttttagacatcaattctatagattctgactttttctaacctcttatagacatgccaaatgctggcaaaaagaagtgctttttggatatggcagcacttgtaaaaataaagcagtaagcaaaatccttttaaacacagaaatcctgagttcttctcattggtggactcaagcaattctgtagcaaataaatcctttgaaagagctccaaa

SEQ ID NO: 510800 - DNA, 340 bp, Homo sapiens
acggcacagtatcatgcatgtattccgactactacttccacgttctagcaattggctgagaggagttggccacaggggcaacagcgcaccagctgagggagccgtgggcatagctggcagggctgagggtggcaccacttgcgaacatgtctggttaccgcatttcacgtccctgttaagcaaaacacatcattcacatcaattgttgcatcacagtgcagctttcagttcacctgaagcacaacgtaaaaccttacttgccacatatctttaacacagctgcaaatccccaaatccatccagcactttcctcacatcggttcccacataacacatctcg

SEQ ID NO: 510801 - DNA, 374 bp, Homo sapiens
  misc_feature (3)..(3): n is a, c, g, or t
ttntgagacagtcttgctctgttgtccaggctgcagttcaatggcacaatcacagctcaccacagccttaacctctgaggctcaagtgattatcccaacttcttggttttgtagagatgggggcctccctgtgttgcctgcactggtctcgaattcctaggctcaagcaatcctcccatcttgcctcccaaagtgctgggattacgggtatgagctaccacacccagcctagagaaagaagtttaagttaagcctgcttcctgataaattcgcaatacaccataaatctaactgtaatagcacataaccagaaattcacatgtagttccctttttttttttttttgagacagagtctcactctgtcacccaggc

SEQ ID NO: 510802 - DNA, 348 bp, Homo sapiens
gctctctgcggatggtggagggcttgctgtgtgctggtggttgccagctccaaaatggatgctccacatggattcatggccacacccctgtactcgtggcatgcagttcctctttgccttatatttgtggtactgccctgcccttccctggggatggcgggccgctcatgcgacccactttgcggcctgcagggtgcatctctgctggatggtgtgcgtgcttgctgaatgtacttggtggtttgccaactccaaaaggatgctccacaggattcatggccacacccctgtactcgtgggccatgcagttcctctttgccttataattttgtggtactgcccggcctc

SEQ ID NO: 510803 - DNA, 156 bp, Homo sapiens
agtgaagatagtctgtacaggactcacttattactccctagagcccatgtcgaatgcccccatcggcgtgggtcaagtagtacttgccgcaggacgtctgaagagactgaggcagggtataggtataatactgcctcacacgtcattctcaatccc

SEQ ID NO: 510804 - DNA, 977 bp, Homo sapiens
gctaaaaatacaaaaattagccgggcgtggtggcaagcacctgtaatcccagctactcgggaggctgaggtaggagaatcgcttgaacccggaggcagacgttacagtgatccgagatcgcgccattgcactgcagcccaggcaacagtgagacactccgattcaaaaaaaaaaaaaaaatttgggcctttatttctaaattagttgggaagcaatgggaccgtgttgtttataagggaattgatacgacctgggagtgtccttttcccagaaacaattatctcttttctactttagaaatgtgtcctttaaccaaattttgggtattattataattagttccccttctccttttaatgggaaacccttcagtgacctgtgtattcctggtttctcttttaacgcctgacattctagaaggcaagcctattagcactctgggtagctcccagtgaatggcttcctttttgggtaggctgttggtcccctggttgaccagtgaacctcccgggttaaattagacatagaaaggctgaccttagccaggcatggttggctcaccgcttgtattcccagccactttggggcggatcacagggtcaaaagatcgagaccatcctggtttaaacattggtgaaaccccgtctctactaaaaattcaaaattagctgttgtattgcacgtgctgtaatccagctactcgggaggctgaggcaggagaatcacttgacctgcgagggggatgggtgagccgaaatgagcatggggttaagctgcgaaagagcgaatcctctcaaaaacaagggggggcctaattgtgtcggacgagagaacggcctaccttattttgtttcccaactgtgatataacttagtttagctgggtgagacttcgttagcacaatattttattccaagggcgctcacaaagtaatgggcgggacattggtgtaagttatgagcaaataggcatacaag

SEQ ID NO: 510805 - DNA, 341 bp, Homo sapiens
aggtgaactagaggatcccctctctccacactgggatagactctgagtggaatacctggcacatccactaggatctacgtctgcacgttttcttgcatgactttatacgcagtaagtatgtgaaaacaaacaaaaagaagaaaacactcaacaaaaccaatctacatgttttggactaaaaaaaaaaaaatagaggtggtattctcagggtccgactcggaattatgtggctgcctctcggtgctttgggcctcggtgtggccgtgtttggccagggtgagatacggtcccctcgggaggatttcaggggaggaagagccacgtccccagtgtggagagag

SEQ ID NO: 510806 - DNA, 972 bp, Homo sapiens
cctaattgactgcctcctatcgtttatttcccattctttacctctctttactttggttgttccaatgatctatgtattctctaatatcctgaagttgaagtttgtttctctatcacttgcctgtatcgctcgtgggtgtattatatctacagaaatgtgtcccccctggcctctaaccgttgtcgtcccttgggacctctttcactatccggattcctataggcatcttgcctcgcgcttggttatggcgtccttgggtgaattcctgtctcggtactttgaatgcgtactgctgaccttgactactgtctaactttctataagcttgtaatttgtaaatgtatgtttattcccctaatgtatgccgtgtatgtgttggctccctatgtatctatgctctccagtatatctgagtgggcatttcctcctccaaagtgtatggcccctgtcttagtcatgcttatgtcttgatgccattcgtcacaattggtgaagccaccccgtgcaataccagaacgtgtctccatgaaccattgatgcagccttgcttgtatgtgtattgtgaattaattgcaacgccctaccctcacctgaccttgcaccctgctacctgggcggtgcaccatgagctgggagacatgcagcccttacatgccagctccgtgcgcagacggtggacgcgagacacgtgccctgaggtcctgatcgtcctcaatccaccaggtccgtcgctctccacatccaagaaaccatgcacgtcgtgattccacaggggccaccaaagctctttctggggaatgaaggggtgcacgagcagccacagccaccacataggcctcatagtggctgtaggcccccagcacaacaccacaactacggccaagagaaggcaagaaatgattctctgtcaacctttctctactagtggagacggagtgataaccccccggggggggtcattcaataccatgc

SEQ ID NO: 510807 - DNA, 543 bp, Homo sapiens
tgacatggtactgatgggggtcacgcttgactacatgcagatctgatatatcagagttctgacactcatatagtatatgaaactagtgaattagcaagatgatataacaccatcatataatatgacctattgggtagagtatgctgattcataaacatgggaatttaaaggaggtatattcagtgcaagagtctccatttcagaagcatgaatccatgtggataatcttaatacaactaagaggttacaggataggcttgggttacactgcgctgagaaatccatcataaaataccctcaagatagagactatgtttcaactgacagcttggaataagatgagagtgaagttgttgtgaaataagagaagctagatcctgcttaaaagaggagactccagctgtgtataatgatttagggtaacaaacctgtggctcctctggcccttgttatgaaaggagcacatatatttgctggattctatctttatcacctctgtctactgctatccagacacggtagagccgaggggtagggagctcg

SEQ ID NO: 510808 - DNA, 446 bp, Homo sapiens
cttctctgccctctagcggaggttttccaacgtgtaggaggcgcctttggggctgcccctaagtacagagccaggatggcatgtatctctgcactgatcacctcggtcttgtaactcttttctaggatctgcccacagggtgccttgtgacgtatcccagcaaggattacccaggtgatgtacctctcatcaaggctctgcctacaggcacattgcgatgtatctctgcactgatcacctaggtcatgtaacttttgtctaaggctctgcctacgatggcattgtgaaatatctctgcactaatcatccaagtgacgtaacacttgtctaggatctgtctaaattaactttgtgacagaaccctgtactgatcatccaggtgatggggctttggactaggctctgcctaagggggcattgtgacatatttctgcattgatcaccca

SEQ ID NO: 510809 - DNA, 377 bp, Homo sapiens
tatacagactcctctgagatctagaagaaatcatataccatcctatatacaagccatctccataagaccacctctggaagtatgctatgctcaacttatacacacacatacagatttgcacataggttgaacagtgaagtttacgtcacacccatagcacagacagttccttacatcacagacacacagcaggtgagagtaagatgctatcaaggaactagccactctaggaccaagcgtacatgctcccttccttcttactccatggaaaagactgatccatgggcctctcctggacctgtagccacggggagatttaaggaggccaatccaaggagtgactgagccttggacctcttccatggctacaggaatat

SEQ ID NO: 510810 - DNA, 310 bp, Homo sapiens
aaggacatcaccttgttgctacacctcgggtagtgcccatgggcttcgctctatagaataaagtctctcaactgagtacgcaatatcatgagagtaatgactttcctcctttccatctcaagaaatttctcaaagaaactgaaaacatttcctgattttctttttagactttgaagccacacccccgtggcttgaaaccttcactttatcacttcttcaaaaggaataatcactcattatttatattttctcatttgtaaagaggggatagtaatagtacctaaacatcccagtgtttggggaacaggtg

SEQ ID NO: 510811 - DNA, 410 bp, Homo sapiens
accgtgtttacagtcatacaggctgaagtgcaatggcgtgatctcagcaacctgtgcctcctgagtacaaatgattctcctgcctcagcctccctagaatgctgggattacaggcgcccaccaccatgcccagctaatttttctggtattttcagtagagacgggtttcaccatgtgggccaggcgggtcttgaactcctgaccttgtgatccacccaccttggcctcccaaagtgctgggtttacgggcatgagccaccgcgcccagccttataattttttataaacgtagactaacaggtttggaactcgttaacatgtattggcttgaatatccatataagttaaatatgtataactagggaatcctttcttaagaggtgcttaatatagataccagaaatctcatg

SEQ ID NO: 510812 - DNA, 148 bp, Homo sapiens
tcagggcggagccgcttccgcggtggaacttgccggaggtggggctgtcctgtgcactgtgcgatgtaggcctgcagctcactctcctctgcgcctgcgccgccgggatgcttgatggtgtcgtaggcgccggtgatgagcgcgatga

SEQ ID NO: 510813 - DNA, 98 bp, Homo sapiens
  misc_feature (48)..(48): n is a, c, g, or t
  misc_feature (64)..(64): n is a, c, g, or t
cagaagaagtgaagccaagaggaagaaccatttgcttttctggggagncctggcaggttttatnaaggctgttcatgtgaaagcccaagaagacgaaa

SEQ ID NO: 510814 - DNA, 950 bp, Homo sapiens
tatcgccggagccgaacccagccgagcgaacgccgctgcccgtcgcctctcgcctccgcgccaggccggtccaactccctgaggcgggaaacgcaagaccaggccctgcagcagcaggcggacgaggcggaagaccgcgcgcagggcttcagcgggagctgaacgggagcgcgagcggcgcgagaaatgctgaaggtgatgtgtccgccctttattgacgcattccagcgtcggtgaggaggagttgtacagtgctcatgtaactacatggccacggccctgcagattctgtatgatgcagaaaaagctgcagatgatagtgagagagtaatgaattttatataaacatccggtccatgtaaggatgtaggagcatagaatggattatacattgagtattgcatattcaaaataattgacaatgcacattgctgaagcaggctatacgctgaaaaatacgagtatagtatactcgtaagactgtttcatcctgtgaagtattgaacatggacgagtggcagagagacattgcgtaggtgtcttgaaactacacaatgttgtttacacttggaaataagaaactcaaatgatttgttactaacaatcgtgctacatcttatgagacggccttgctttattgtataaaagtaatatctgtaaataggtcttgaacctactatttgacgaatgacattttaaacctatctttgtctgatcacaacactgcataatgcatgcttatattaacccatatccttgaattttgcagaagatcaaacgtgtttgcataacgtttgcaacactaccaattaatgacctttgcagcgaaacatgtccgagtcccaaacaaaagaaagttgcctatattaggaacagttgtataaacataacgacattatggtatttggacacgtgaagatttgtccacgaattttgacccgtgattacct

SEQ ID NO: 510815 - DNA, 182 bp, Homo sapiens
cagccctcttcccgagtatgtgccctgatttctgggctgtgctgtaatggtgcctgggttgggttcaggccagactctgtggacccattccggttctctatttctggtcacgggtgggcaccggcggccctcatgtcccgtgcctctggccgggcttaccggcagtcagctgcaagggacgg

SEQ ID NO: 510816 - DNA, 490 bp, Homo sapiens
  misc_feature (18)..(18): n is a, c, g, or t
  misc_feature (51)..(51): n is a, c, g, or t
  misc_feature (59)..(59): n is a, c, g, or t
  misc_feature (122)..(122): n is a, c, g, or t
  misc_feature (312)..(312): n is a, c, g, or t
  misc_feature (350)..(350): n is a, c, g, or t
  misc_feature (359)..(359): n is a, c, g, or t
  misc_feature (361)..(361): n is a, c, g, or t
  misc_feature (370)..(370): n is a, c, g, or t
  misc_feature (373)..(373): n is a, c, g, or t
  misc_feature (425)..(425): n is a, c, g, or t
  misc_feature (448)..(448): n is a, c, g, or t
aaaacttaagttgtcaanaagaaagtggctgaatgcttgcccaatggcccnaaaacccnagggcctgtttggttacaagacgaagacaagtgcccgaaacacaattcaaacaagctgcaagnaccccagggcatcgaagtacgacgtcatcacccctggccgatgacttgaaccccgagggcccaacacaagatcatggatttgcgggccagctctccctgggggtagggggccacccaggactcacctccctcttcatttaggatctccagatactggatagccagcatcctctcattcccagggagccanacctgtgctgttggggttaggggcaccattggccccanccaggacantntgggtgccnccnactgcaggcaggctttgggagagaaatttatttttgtttgggtggacccacntggccctgtcagtctcaataaanggaccggagtccagtcctgaacagcttaaaacaaaaaaaaaa

SEQ ID NO: 510817 - DNA, 1288 bp, Homo sapiens
cggacgcgtgggtcgacccacgcgtccgggcgaacacgccgcggtcctcgtcgtggtgagcgcagccactcaggctggtcctgggggtggggctgtaggggaaagtgctaaagccgctgaggtaagaggccgaggggtcgagggccctcgggagcttggtgaaaagggagttaacccccaggatcctacctgcagggactagaaaaatggagaagtgaagtaagaactctgctagagaggaaatggctgcttcatcatcatcctcctcagctggtggggtcagtggaagttctgtcactggatctggtttcagtgtctcagaccttgccccaccacggaaagcccttttcacctaccccaaaggagctggagagatgttagaagatggctctgagagattcctctgcgaatctgtttttagctatcaagtggcatccacgcttaaacaggtgaaacatgatcagcaagttgctcggatggaaaaactagctggtttggtagaagagctggaggctgacgagtggcggtttaagcccatcgagcagctgctgggattcaccccctcttcaggttgatactgcctggatggtcacctctggtgcgcagcaagtgcaaagccagtgggggactttctcacagcttacatagccatccagagatccacagctacgtcactgaattgttaatgcacatttgtacttggtttctctgtatctattcacaggcaacaaatacttatatgtgtgatctttcagggaatgttttgtttatttgtttttaaaagtattgggaatcagattaagacaatcagtttcagagaaccaggaggtttggggttaagagatactcaaaaattttcacaagccaagtagggcatatatcagatttggccaactgaatggcgtctgtcctgtcatccatatggtgcctggaaatatttaccagtcaaggtcaaggtcagcatctgtggttaaaaatatagcattctgacctaaaaaagttattttgcagatgaatgtgttttcaactcaggacctatccaaatgaggaatttttaaatattcttttttttttcctatttttagacatcaattctatagattctgactttttctaacctcttatagacatgccaaatgctggcaaaaagaagtgctttttggatatggcagcacttgtaaaaataaagcagtaagcaaaatccttttaaacacagaaatcctgagttcttctcattggtggactcaagcaattctgtagcaaataaatcctttgaaagagctccaaa

SEQ ID NO: 510818 - DNA, 3189 bp, Homo sapiens
ggacgccgccttcgccgctggctccgtctgttggggggcgaacacgccgcggtcctcgtcgtggtgagcgcagccactcaggctggtcctgggggtggggctgtaggggaaagtgctaaagccgctgagtgaagtaagaactctgctagagaggaaatggctgcttcatcatcatcctcctcagctggtggggtcagtggaagttctgtcactggatctggtttcagtgtctcagaccttgccccaccacggaaagcccttttcacctaccccaaaggagctggagagatgttagaagatggctctgagagattcctctgcgaatctgtttttagctatcaagtggcatccacgcttaaacaggtgaaacatgatcagcaagttgctcggatggaaaaactagctggtttggtagaagagctggaggctgacgagtggcggtttaagcccatcgagcagctgctgggattcaccccctcttcaggttgatactgcctggatggtcacctctggtgcgcagcaagtgcaaagccagtgggggactttctcacagcttacatagccatccagagatccacagctacgtcactgaattgttaatgcacatttgtacttggtttctctgtatctattcacaggcaacaaatacttatatgtgtgatctttcagggaatgttttgtttatttgtttttaaaagtattgggaatcagattaagacaatcagtttcagagaaccaggaggtttggggttaagagatactcaaaaattttcacaagccaagtagggcatatatcagatttggccaactgaatggcgtctgtcctgtcatccatatggtgcctggaaatatttaccagtcaaggtcaaggtcagcatctgtggttaaaaatatagcattctgacctaaaatttttaaatattcttttttttttcctatttttagacatcaattctatagattctgactttttctaacctcttatagacatgccaaatgctggcaaaaagaagtgctttttggatatggcagcacttgtaaaaataaagcagtaagcaaaatccttttaaacacagaaatcctgagttcttctcattggtggactcaagcaattctgtagcaaataaatcctttgaaagagctccaaattggtggcattatcctttcaaaatctcagggatttgggatgaagtgaagaggtcaaattactttttagaagaagggaatctaaaaaccatctctcctaaacaaatggtagactggctttacttaagggatatttgtctttataggagtacataaatttatcttaatgatatttaagtagttttttttttttttttttgggacgaagttttgctcttgttgcccaggctgtatcgcaatggcgcggtctctgctcactgcagcatccgcctcccgggttcgggcggttctcctgcctcagcctcccgagtagctgggattacaggcgcccgccaccacacccagctaattttttgtatatttggtagagacggggtttcaccgtgttgaccaggctggtctcgagcttctggcctcaggtgatccacctgcctcagcctcccaaattgctgggattacaggcgtgagccaccttgcccagccaatttttttttaaagagacatggtcttgctatgttgcccaggttggtcttgaactcctggcctcaagagatccccccaaccttggcctccaaagtgctgggattacaggcatgagccaccgcgcctggcctcaagtaagtttttataccatgataggggaaaacctggaaggctaagagatgtgctgttttccttcatgggaccccactttccacagtaaacaactggtataatcatttattacgttgtatgcaaattttgccttagacaacatttgtctggttccttattaataacttgcatctgatctgcttagagttgcttaattataagtaaatataatcccagtagcatttagccttaatctcaagagttcaaaatgtttaacacattctacctgacgggaggtggtgacctcattcagtcggttaagagcctgagccctgtgaagttaaacacctgctcatggtcacatagcccaggcagaagaaaatctcggacttggaatagatcccagttgcctgataattcatctcattattgcctctaaagcaaattggagactgggcacagtggctcccacctttaatcccagcacctggggaggctgaggtgagtggatcactagaggtcaggagttcaagaccagtctggccgacatggtgaaactcagtctctattgaaaatacaaaaattagcccagtgtggtggcacacacttgtaatcccagctactcaggaggctgaggcatgagaatcgcttaaacccaggaggcggaggttgcagtgagctgagatcacaccattgcactctagtctgggtgacagagcgagactctgtctcaaaaaaaaaaaaataaagccgggcgtggtggctcacgcctgtaatcccggcacttggggaggctgaggcaggcggattgcctgagaatcgggagttcgagaccagcctggccagcatggtgaaaccttgtctctactaaaactacaaaaaaaatgggccgggcgtggtggcgggcgcctgtaatcccagctactcgggaggctgaggcagcagaatcgtttgaacccgggaggcggaggttgcagtgagtggagatcgtgcctgtgtgctccagcctgagcaacaagagcgaaactgtctcaaaaaaaagaagaaaataaataaataaaaatcagagcacaagaagtaccagtccaccaactcacattttctatattaataattcttaactaaaagaagttccatattcgacagcattttagttttttaatagtacttattagcatcaaccatcttgataatcaccaagggaaaaattaaaaatacctagactgcaataaacctttaaattggattttcagtgagaatttagaagcaatcactacctttctcgtttcatttgtgtaaccatgcagcataggcactgtgttacatcatctttacgctttggtatttgaacttattacagaattttttctctaaattggatgtttctttatatgaccttggaaactgaagtgatcttagcattaaacaaaaatgctttttaaagcaaaa

SEQ ID NO: 510819 - DNA, 1022 bp, Homo sapiens
cggacgcgtgggtcgacccacgcgtccgggcgaacacgccgcggtcctcgtcgtggtgagcgcagccactcaggctggtcctgggggtggggctgtaggggaaagtgctaaagccgctgaggctctgagagattcctctgcgaatctgtttttagctatcaagtggcatccacgcttaaacaggtgaaacatgatcagcaagttgctcggatggaaaaactagctggtttggtagaagagctggaggctgacgagtggcggtttaagcccatcgagcagctgctgggattcaccccctcttcaggttgatactgcctggatggtcacctctggtgcgcagcaagtgcaaagccagtgggggactttctcacagcttacatagccatccagagatccacagctacgtcactgaattgttaatgcacatttgtacttggtttctctgtatctattcacaggcaacaaatacttatatgtgtgatctttcagggaatgttttgtttatttgtttttaaaagtattgggaatcagattaagacaatcagtttcagagaaccaggaggtttggggttaagagatactcaaaaattttcacaagccaagtagggcatatatcagatttggccaactgaatggcgtctgtcctgtcatccatatggtgcctggaaatatttaccagtcaaggtcaaggtcagcatctgtggttaaaaatatagcattctgacctaaaaaagttattttgcagatgaatgtgttttcaactcaggacctatccaaatgaggaatttttaaatattcttttttttttcctatttttagacatcaattctatagattctgactttttctaacctcttatagacatgccaaatgctggcaaaaagaagtgctttttggatatggcagcacttgtaaaaataaagcagtaagcaaaatccttttaaacacagaaatcctgagttcttctcattggtggactcaagcaattctgtagcaaataaatcctttgaaagagctccaaa

SEQ ID NO: 510820 - DNA, 964 bp, Homo sapiens
ggacgccgccttcgccgctggctccgtctgttggggggcgaacacgccgcggtcctcgtcgtggctctgagagattcctctgcgaatctgtttttagctatcaagtggcatccacgcttaaacaggtgaaacatgatcagcaagttgctcggatggaaaaactagctggtttggtagaagagctggaggctgacgagtggcggtttaagcccatcgagcagctgctgggattcaccccctcttcaggttgatactgcctggatggtcacctctggtgcgcagcaagtgcaaagccagtgggggactttctcacagcttacatagccatccagagatccacagctacgtcactgaattgttaatgcacatttgtacttggtttctctgtatctattcacaggcaacaaatacttatatgtgtgatctttcagggaatgttttgtttatttgtttttaaaagtattgggaatcagattaagacaatcagtttcagagaaccaggaggtttggggttaagagatactcaaaaattttcacaagccaagtagggcatatatcagatttggccaactgaatggcgtctgtcctgtcatccatatggtgcctggaaatatttaccagtcaaggtcaaggtcagcatctgtggttaaaaatatagcattctgacctaaaaaagttattttgcagatgaatgtgttttcaactcaggacctatccaaatgaggaatttttaaatattcttttttttttcctatttttagacatcaattctatagattctgactttttctaacctcttatagacatgccaaatgctggcaaaaagaagtgctttttggatatggcagcacttgtaaaaataaagcagtaagcaaaatccttttaaacacagaaatcctgagttcttctcattggtggactcaagcaattctgtagcaaataaatcctttgaaagagctccaaa

SEQ ID NO: 510821 - DNA, 438 bp, Homo sapiens
cagatggcaggcttcgctgaaagagctctagcagtctcagtaatgtactggagacagattgagattgcaggagtgctgtgaaatggaatgggaggggcagcaagctcagggatgatggggaacatttcttctgaatgctcgcgtgggtggagggagggaacgagagactgggctgacgggtgggtgacggggagagatgtctaaaggaacggaaggtgttctttgaaaagacggggtggacttgactaacactgtggtctgaaagcgataagcacagggatggtgacgaagttcaggggagagcatggagggaatctctggtggaggaagggcagtgaggaggtagcccggagtgggaacaacagcagaggaggagttagcctccaggaggacgcggagcttctgagagcggtgacgaggtgaggatggctgaaatca

SEQ ID NO: 510822 - DNA, 1348 bp, Homo sapiens
cggacgcgtgggtcgacccacgcgtccgggcgaacacgccgcggtcctcgtcgtggtgagcgcagccactcaggctggtcctgggggtggggctgtaggggaaagtgctaaagccgctgaggtgcagtggctcacgcctgtaatcccagcactttgggaggccaaggcaggtggatcacctgaggtcgggagttcaagaccagcctgaccaacatggagaaaccccatctctactagaaatacaaaattagccaggcatggtggtgcatgcctgtaatcccagctactcgggaggctgaagcaggagaatcgcttgaatccgggaggcagaggttgctgtgagccgagatcgcgccatttccagcctgggcaacaagagggaaactccgtctcaaaaaaaaaaaaaaaaaggaagagaaaagaaaacttaagtttcagccaggcatggctctgagagattcctctgcgaatctgtttttagctatcaagtggcatccacgcttaaacaggtgaaacatgatcagcaagttgctcggatggaaaaactagctggtttggtagaagagctggaggctgacgagtggcggtttaagcccatcgagcagctgctgggattcaccccctcttcaggttgatactgcctggatggtcacctctggtgcgcagcaagtgcaaagccagtgggggactttctcacagcttacatagccatccagagatccacagctacgtcactgaattgttaatgcacatttgtacttggtttctctgtatctattcacaggcaacaaatacttatatgtgtgatctttcagggaatgttttgtttatttgtttttaaaagtattgggaatcagattaagacaatcagtttcagagaaccaggaggtttggggttaagagatactcaaaaattttcacaagccaagtagggcatatatcagatttggccaactgaatggcgtctgtcctgtcatccatatggtgcctggaaatatttaccagtcaaggtcaaggtcagcatctgtggttaaaaatatagcattctgacctaaaaaagttattttgcagatgaatgtgttttcaactcaggacctatccaaatgaggaatttttaaatattcttttttttttcctatttttagacatcaattctatagattctgactttttctaacctcttatagacatgccaaatgctggcaaaaagaagtgctttttggatatggcagcacttgtaaaaataaagcagtaagcaaaatccttttaaacacagaaatcctgagttcttctcattggtggactcaagcaattctgtagcaaataaatcctttgaaagagctccaaa

SEQ ID NO: 510823 - DNA, 411 bp, Homo sapiens
ggttatgtacaaaaagttgtttagttctagcttcatccttctggtataagtataaccatgtcagtcatatccccccggctaccgtagcatcacctttgcaagacgcttccctggcgaggtctcagaccacagaatttcggtctgctcacctgctttccatattgtccccactggcaaaaaagctaaaagtctgcacgacgttagatcctgctctcaagaattccatgtgaagttggcgaactgcatctgggtgtactatcgctacctctgaagtccagagcccagccttcacataacctctcatctgcagagtaatcacaaacctgccatctccaatctcaggctccccactgtgcaggcgctacaaaatccccttatcggcccctgggtgtccaacacgtaccatggtgc

SEQ ID NO: 510824 - DNA, 1073 bp, Homo sapiens
cggacgcgtgggtcgacccacgcgtccgggcgaacacgccgcggtcctcgtcgtggtgagcgcagccactcaggctggtcctgggggtggggctgtaggggaaagtgctaaagccgctgagtgaagtaagaactctgctagagaggaaatggctgcttcatcatcatcctcggctctgagagattcctctgcgaatctgtttttagctatcaagtggcatccacgcttaaacaggtgaaacatgatcagcaagttgctcggatggaaaaactagctggtttggtagaagagctggaggctgacgagtggcggtttaagcccatcgagcagctgctgggattcaccccctcttcaggttgatactgcctggatggtcacctctggtgcgcagcaagtgcaaagccagtgggggactttctcacagcttacatagccatccagagatccacagctacgtcactgaattgttaatgcacatttgtacttggtttctctgtatctattcacaggcaacaaatacttatatgtgtgatctttcagggaatgttttgtttatttgtttttaaaagtattgggaatcagattaagacaatcagtttcagagaaccaggaggtttggggttaagagatactcaaaaattttcacaagccaagtagggcatatatcagatttggccaactgaatggcgtctgtcctgtcatccatatggtgcctggaaatatttaccagtcaaggtcaaggtcagcatctgtggttaaaaatatagcattctgacctaaaaaagttattttgcagatgaatgtgttttcaactcaggacctatccaaatgaggaatttttaaatattcttttttttttcctatttttagacatcaattctatagattctgactttttctaacctcttatagacatgccaaatgctggcaaaaagaagtgctttttggatatggcagcacttgtaaaaataaagcagtaagcaaaatccttttaaacacagaaatcctgagttcttctcattggtggactcaagcaattctgtagcaaataaatcctttgaaagagctccaaa

SEQ ID NO: 510825 - DNA, 1446 bp, Homo sapiens
cggacgcgtgggtcgacccacgcgtccgggcgaacacgccgcggtcctcgtcgtggtgagcgcagccactcaggctggtcctgggggtggggctgtaggggaaagtgctaaagccgctgaggtgcagtggctcacgcctgtaatcccagcactttgggaggccaaggcaggtggatcacctgaggtcgggagttcaagaccagcctgaccaacatggagaaaccccatctctactagaaatacaaaattagccaggcatggtggtgcatgcctgtaatcccagctactcgggaggctgaagcaggagaatcgcttgaatccgggaggcagaggttgctgtgagccgagatcgcgccatttccagcctgggcaacaagagggaaactccgtctcaaaaaaaaaaaaaaaaaggaagagaaaagaaaacttaagtttcagccaggcatgtgaagtaagaactctgctagagaggaaatggctgcttcatcatcatcctcctcagctggtggggtcagtggaagttctgtcactggatctggtttcagtgtctcagaccttgccccaccacggaaagcccttttcacctaccccaaaggagctggagagatgttagaagattcagcaagttgctcggatggaaaaactagctggtttggtagaagagctggaggctgacgagtggcggtttaagcccatcgagcagctgctgggattcaccccctcttcaggttgatactgcctggatggtcacctctggtgcgcagcaagtgcaaagccagtgggggactttctcacagcttacatagccatccagagatccacagctacgtcactgaattgttaatgcacatttgtacttggtttctctgtatctattcacaggcaacaaatacttatatgtgtgatctttcagggaatgttttgtttatttgtttttaaaagtattgggaatcagattaagacaatcagtttcagagaaccaggaggtttggggttaagagatactcaaaaattttcacaagccaagtagggcatatatcagatttggccaactgaatggcgtctgtcctgtcatccatatggtgcctggaaatatttaccagtcaaggtcaaggtcagcatctgtggttaaaaatatagcattctgacctaaaaaagttattttgcagatgaatgtgttttcaactcaggacctatccaaatgaggaatttttaaatattcttttttttttcctatttttagacatcaattctatagattctgactttttctaacctcttatagacatgccaaatgctggcaaaaagaagtgctttttggatatggcagcacttgtaaaaataaagcagtaagcaaaatccttttaaacacagaaatcctgagttcttctcattggtggactcaagcaattctgtagcaaataaatcctttgaaagagctccaaa

SEQ ID NO: 510826 - DNA, 181 bp, Homo sapiens
tggcatctaagatctcagtagtcggacgcagtggacgagtctttagattggtgtggggatgggatatacagacagctcggtaggtcactcctggtcagggtgcagttgctggacttggagcatggatgaagagatgtcagagatagagatcattaggttgctgaactcccctaaggcagtg

SEQ ID NO: 510827 - DNA, 1062 bp, Homo sapiens
ggacgccgccttcgccgctggctccgtctgttggggggcgaacacgccgcggtcctcgtcgtgtgaagtaagaactctgctagagaggaaatggctgcttcatcatcatcctcctcagctggtggggtcagtggaagttctgtcactggatctggtttcagtgtctcagaccttgccccaccacggaaagcccttttcacctaccccaaaggagctggagagatgttagaagattcagcaagttgctcggatggaaaaactagctggtttggtagaagagctggaggctgacgagtggcggtttaagcccatcgagcagctgctgggattcaccccctcttcaggttgatactgcctggatggtcacctctggtgcgcagcaagtgcaaagccagtgggggactttctcacagcttacatagccatccagagatccacagctacgtcactgaattgttaatgcacatttgtacttggtttctctgtatctattcacaggcaacaaatacttatatgtgtgatctttcagggaatgttttgtttatttgtttttaaaagtattgggaatcagattaagacaatcagtttcagagaaccaggaggtttggggttaagagatactcaaaaattttcacaagccaagtagggcatatatcagatttggccaactgaatggcgtctgtcctgtcatccatatggtgcctggaaatatttaccagtcaaggtcaaggtcagcatctgtggttaaaaatatagcattctgacctaaaaaagttattttgcagatgaatgtgttttcaactcaggacctatccaaatgaggaatttttaaatattcttttttttttcctatttttagacatcaattctatagattctgactttttctaacctcttatagacatgccaaatgctggcaaaaagaagtgctttttggatatggcagcacttgtaaaaataaagcagtaagcaaaatccttttaaacacagaaatcctgagttcttctcattggtggactcaagcaattctgtagcaaataaatcctttgaaagagctccaaa

SEQ ID NO: 510828 - DNA, 1499 bp, Homo sapiens
ggacgccgccttcgccgctggctccgtctgttggggggcgaacacgccgcggtcctcgtcgtggtgagcgcagccactcaggctggtcctgggggtggggctgtaggggaaagtgctaaagccgctgaggtgcagtggctcacgcctgtaatcccagcactttgggaggccaaggcaggtggatcacctgaggtcgggagttcaagaccagcctgaccaacatggagaaaccccatctctactagaaatacaaaattagccaggcatggtggtgcatgcctgtaatcccagctactcgggaggctgaagcaggagaatcgcttgaatccgggaggcagaggttgctgtgagccgagatcgcgccatttccagcctgggcaacaagagggaaactccgtctcaaaaaaaaaaaaaaaaaggaagagaaaagaaaacttaagtttcagccaggcatgtgaagtaagaactctgctagagaggaaatggctgcttcatcatcatcctcctcagctggtggggtcagtggaagttctgtcactggatctggtttcagtgtctcagaccttgccccaccacggaaagcccttttcacctaccccaaaggagctggagagatgttagaagatggctctgagagattcctctgcgaatctgtttttagctatcaagtggcatccacgcttaaacaggtgaaacatgatcagcaagttgctcggatggaaaaactagctggtttggtagaagagctggaggctgacgagtggcggtttaagcccatcgagcagctgctgggattcaccccctcttcaggttgatactgcctggatggtcacctctggtgcgcagcaagtgcaaagccagtgggggactttctcacagctgtcactgaattgttaatgcacatttgtacttggtttctctgtatctattcacaggcaacaaatacttatatgtgtgatctttcagggaatgttttgtttatttgtttttaaaagtattgggaatcagattaagacaatcagtttcagagaaccaggaggtttggggttaagagatactcaaaaattttcacaagccaagtagggcatatatcagatttggccaactgaatggcgtctgtcctgtcatccatatggtgcctggaaatatttaccagtcaaggtcaaggtcagcatctgtggttaaaaatatagcattctgacctaaaaaagttattttgcagatgaatgtgttttcaactcaggacctatccaaatgaggaatttttaaatattcttttttttttcctatttttagacatcaattctatagattctgactttttctaacctcttatagacatgccaaatgctggcaaaaagaagtgctttttggatatggcagcacttgtaaaaataaagcagtaagcaaaatccttttaaacacagaaatcctgagttcttctcattggtggactcaagcaattctgtagcaaataaatcctttgaaagagctccaaa

SEQ ID NO: 510829 - DNA, 1161 bp, Homo sapiens
ggacgccgccttcgccgctggctccgtctgttggggggcgaacacgccgcggtcctcgtcgtggtgagcgcagccactcaggctggtcctgggggtggggctgtaggggaaagtgctaaagccgctgagtgaagtaagaactctgctagagaggaaatggctgcttcatcatcatcctcctcagctggtggggtcagtggaagttctgtcactggatctggtttcagtgtctcagaccttgccccaccacggaaagcccttttcacctaccccaaaggagctggagagatgttagaagatggctctgagagattcctctgcgaatctgtttttagctatcaagtggcatccacgcttaaacaggtgaaacatgatcagcaagttgctcggatggaaaaactagctggtcatcgagcagctgctgggattcaccccctcttcaggttgatactgcctggatggtcacctctggtgcgcagcaagtgcaaagccagtgggggactttctcacagcttacatagccatccagagatccacagctacgtcactgaattgttaatgcacatttgtacttggtttctctgtatctattcacaggcaacaaatacttatatgtgtgatctttcagggaatgttttgtttatttgtttttaaaagtattgggaatcagattaagacaatcagtttcagagaaccaggaggtttggggttaagagatactcaaaaattttcacaagccaagtagggcatatatcagatttggccaactgaatggcgtctgtcctgtcatccatatggtgcctggaaatatttaccagtcaaggtcaaggtcagcatctgtggttaaaaatatagcattctgacctaaaaaagttattttgcagatgaatgtgttttcaactcaggacctatccaaatgaggaatttttaaatattcttttttttttcctatttttagacatcaattctatagattctgactttttctaacctcttatagacatgccaaatgctggcaaaaagaagtgctttttggatatggcagcacttgtaaaaataaagcagtaagcaaaatccttttaaacacagaaatcctgagttcttctcattggtggactcaagcaattctgtagcaaataaatcctttgaaagagctccaaa

SEQ ID NO: 510830 - DNA, 169 bp, Homo sapiens
gatgggccggggcttgaaacattctccagagaagtaatataaatggccaataaaaaaatgaaagatgctcggtagccatggttgttagggagatggaaattaatacccaggagataccccttcataccctactaggatggctgtaattaaacacaacaccaccaacagc

SEQ ID NO: 510831 - DNA, 256 bp, Homo sapiens
  misc_feature (154)..(154): n is a, c, g, or t
  misc_feature (170)..(170): n is a, c, g, or t
  misc_feature (174)..(174): n is a, c, g, or t
  misc_feature (210)..(210): n is a, c, g, or t
  misc_feature (246)..(246): n is a, c, g, or t
gaattcggcacgagttcacaatgtcagttaaaaaaaaaaaaaaaaaaaaaaagtgtagtatttatatcttgggcacaggtccagatccctatgggaataaagcattcagctggaaatccttgtcattggtcgtggggcaggtgcccagccagtntcactctgcagccccntctncactgaaaggggctcttcaggctcgttgtacctggnggatgcccaccttaaccccaaccggggcccatcggnagagaagccc

SEQ ID NO: 510832 - DNA, 413 bp, Homo sapiens
  misc_feature (3)..(3): n is a, c, g, or t
aanaagggggccactgtgacaggacatgagcttaacagtcatagaagtccacatgggctccagactggaaggtgtccttttgcagcaagcccagcagtttctgggctgaagtcccacagtccaccagcgccccatccgacttcaacttctgcagtttgctccttaactctgggtccttggaggtttcccgagccaactgctgcatgtcattgtccaggggacctggagcatagctcagcacccgcacactcggttcctcagcagccaggacctggtagagcatgtctcgggcagccttccccgcacagtacagaccccagcctttgtagggctgcagggcacacagagatgagatgttaaccacagtcttgctcaggccagggctatcctggaaggcattcaaggtgccggaa

SEQ ID NO: 510833 - DNA, 258 bp, Homo sapiens
  misc_feature (40)..(40): n is a, c, g, or t
tgggttcaagcaattctcctgcctccgcctcccaagtagntgggattacacaggcatatactatcatgcccagctaatttttgtatttttagtagagacagagtttcaccattttggccaggctggtctcaaactcctgacttcaggtgatcagcccacctcagcctcccaaaatgctggggttacaggcgtgagccacagcgcccagcccagaatttgcattttaaccagcctcccccaggttactgcccaactgca

SEQ ID NO: 510834 - DNA, 189 bp, Homo sapiens
agaggatccccagtcacaagcagataggaagccgcgagatcattcacgcatcccagactacacgacgatggatcagttaccaggtcatcaccgatagcagtgcacaatgttcctgacaagagttggtacagcagaaagcgatcgcgataagcatccagttcctgcaggccagatgctccgcactgccac

SEQ ID NO: 510835 - DNA, 652 bp, Homo sapiens
agcgtgggatggcgaatgagcggtatagaaccacccacagacctgccacctgaatgcgaatcttgaggctccgcttgacaggcccccaaggtggctccgtgtattcatggggctctctcaggccccacattccatcccagctcgcaacctgcagctgactccaagtcgttccctgaactaacctgcgttggtaaaaacggcgagacctgtgctagcccatttgctcaaaccatcgaatcattgggcaaaagacaatactccagcgaaccattaccacagaagaatcacgaggcgaacgtggagagaagaccgagagcacaaaacaaccaagaaaccaaagaacataaacacagaagggaacagcaaagagcaagcgaaagaagcaatagaaaagatacaatagacaaacaaagataagaagagaagaccacaaaccaaaagtcaacccgagaacaaacacaggacaaccaaaccacaagcagaacgggcggaagaaccaatgaggagactgagaaaccagcacacaacgagccaacaggagaggaatgcaggacggccgaaactaccgcaggagcgcaacagaaaaggcaatcaaaagcagaacacacacagacgtaaaaatcagccgagaacacaaatcgagaacagaagg

SEQ ID NO: 510836 - DNA, 148 bp, Homo sapiens
gatcccattcaatttgctgagccatcgtgccttgcccccagcttgtgtcttggaaaagcatgatgggacatgagaggatgggagggtgtctgagcctttcccggactgacggaacctgtgtcttctctcttttgatggacaggatggt

SEQ ID NO: 510837 - DNA, 821 bp, Homo sapiens
gccttctcctcactctctcaatcttatccatcatagcaggcaggttgaggtggattaaaccaaacgccagctatgcagaaatcttagcatacgtcctcgaagttacccagcgataggatgaataatagctagttctaccgttacaaggcctaactataaccattcttaagttataactatttatacttgatcctaactacgtaccggaattcctacatacgtcaagcttaaacgtccagcaacacgaccctactactatctcgcacctgaaacaagctaacatgagctagacacccttaaatgtccattctcacacctccatctacccgtatggaggaccgtgccacccgtgtgaaccggacatgtattgtgcccaacactggagccacttatcgaaggaagattcaacaaaataatcaattagcgcgtcatcaatccccagccagtcatagccacgcagtgcagccatccttaagccgtcgtacttcgtaacctacgcgctaatctacatccacctcaaatcagcactaactcacccagtatgctaagcgaacgtaagcatctaacatgacagttggaacatccaagaagcgcaacccgattcctgcgccagagtcatcacccttaccacgcctactcctcaccatatctcccccgcttacgatacctaaagtgatccttcattgcaacactcccagagagacaaccacacacttaacaccaaacagaataccaagcagtccggacacgaagaccaccgccccacacacgagagcacctggaacaaagaccacgtccaggcgaggtcccgagcggccaat

SEQ ID NO: 510838 - DNA, 391 bp, Homo sapiens
ccggctgaggagtatgagacccccgagagcccgggcccgcagtcgaagccctcgcccgcctcccaaggtggtagatgtacccaggcatgccgagtcgagcaggcaggtctaaaacacctggatcgagaggtgtcaaacttttgcgcagagcagcagagctgatacctgcgatgccagatggcacgggcgtccgaaactatggcctaaaacagcggggcccgatccttggtggcagaacgcgtgctgcgctgaggccgaggcagcgcggcgcgcgacagaaagaggaggcgcgatgcgcgcaggcgggaactgcgacgcaaagacgctgcgagtcgcagagacaggatgcgcgatgcttgaaacgccagcgtgaaggttggctcaggagggc

SEQ ID NO: 510839 - DNA, 599 bp, Homo sapiens
gactctagaggttcacttttgacgcgttctcctccggctccatggtcatctaaacatgtctagacattcagtcaacatttgcaagacataccaaaaaaaaagggaataaggggggaaaaaactatggtcaagagataaagcaatcattagacccagattcagaaataattcagatgtgggacctagtgacaggaacttaaaacagttatgatggatgtactaaaggacctagtgaaaacgacaatatgcacaaacaagcgggaactttcatgaacacgtttcagcagagagatggaaccttcatgaccacgtcaattggaaaacctaggggcaaaacacacaaaagaaacccctgggcagcagaaatgaggacttgagtacatggacaggctccacagcagccggggcagaactgaggggatcggcgggggtggaaacgggcacaggaaccacccagaggtacacacagagaaatgcgccagcatgggaaagccggggggcggcagcccccaggggtctgaggctcgtgccgccagagtccaggagaggggaggatgcggcagaagacatgcttgaggagaaaatgggtaagaattttc

SEQ ID NO: 510840 - DNA, 923 bp, Homo sapiens
  misc_feature (908)..(908): n is a, c, g, or t
  misc_feature (914)..(914): n is a, c, g, or t
gttaaattaatttgtaccggccgggcgcggtggcttacgcctgtaatcccaacactttgggaggccgaggcgggcgaatcacaaggtcatgagttcgaaaccagcctggccaatatggtgaaacccccgtctctactaaaaatacagaaattagccgggagtggtggcgtacgcctgtagtcccagctactctggaggctaaggcaggagaatcgcttgaatccgggaggtggaggtcgcagtgagccgagaccgggccactgcactccagcctgggagacagagcgagactctgtctcaagaaaaaaaaaaaatcaatttgtaccattccttgccccaccctgccgaacttattgaaagagcatcgctttcctcacttttctcctctaacagaaaagcacttagatgaagctacagggagccagaattcttttgacttggtgggtaccggaggattggaagaatctagattgagtattccttggcctttggggagcttgctctatgcaaagtcacccaggaaatgatactccccccactgtgaaacactagctagagatgatagacaaaaagcacatttgttgtaatctccctttgacgggattcaggttgggatagatgtcgaagcagctgcttctaggtagtcaacgaagatgtcaactagtaaatgacaacagacaaggatgagcacagcagagctgtaagattctagatatcaaaaagagcaagcagtctgttgtactcaccatcgcatcctcagcagctgcccagtgcccggttttaacttagtgctcagtgtatgtgtcaggtttgaatcccaattctgatactacctgtgctactctcttcacctctctgagtctgtaaaggattatttaagaattaaatgaaacaacatacagaaaatnaaaaanattaaaaaa

SEQ ID NO: 510841 - DNA, 572 bp, Homo sapiens
  misc_feature (557)..(557): n is a, c, g, or t
  misc_feature (563)..(563): n is a, c, g, or t
cggcacgagcggcacgagcggcacgagtttctcctctaacagaaaagcacttagatgaagctacagggagccagaattcttttgacttggtgggtaccggaggattggaagaatctagattgagtattccttggcctttggggagcttgctctatgcaaagtcacccaggaaatgatactccccccactgtgaaacactagctagagatgatagacaaaaagcacatttgttgtaatctccctttgacgggattcaggttgggatagatgtcgaagcagctgcttctaggtagtcaacgaagatgtcaactagtaaatgacaacagacaaggatgagcacagcagagctgtaagattctagatatcaaaaagagcaagcagtctgttgtactcaccatcgcatcctcagcagctgcccagtgcccggttttaacttagtgctcagtgtatgtgtcaggtttgaatcccaattctgatactacctgtgctactctcttcacctctctgagtctgtaaaggattatttaagaattaaatgaaacaacatacagaaaatnaaaaanattaaaaaa

SEQ ID NO: 510842 - DNA, 395 bp, Homo sapiens
gcacataactattctgtaatacatatgcacccaatacagggaacacctagattcataaggcaagttcttagacacctatgaagagacttaagtaggcatacaataataatgggggacttcaataccccactgacagtattagacaaatcatcgtagcagaaaactaacaaacacattcaggacctgaacttgacatttgaccaaataggcctaacagacatatacataattctctaccttaaatcatcagaatatacattcttcccatctgcatgtggcatacactctaaaaatgatcacacaatcagccataaaacaaccctcagcaaaatcaaaaaacccccaaatgtactaaacacactcttggacaacaggggcaacacgaataaggggac

SEQ ID NO: 510843 - DNA, 1232 bp, Homo sapiens
ggagctgccgacggacggagcgcccccgcccccgcccgtggcgcccgcccgccgccgtcatgcccttctccaagcagtccacaagcgcactgaagctgcgcttcccgagccgaggacgagttccccgaccgtgagcgctcatcaacaagccacatggaccaaggtgctgacccccgagcatgtacgcggagctgcgcgccaagagcacgccgagcgagtttcacgctggacgacgtcatccagacaggcgtggacaacccgggccacccgtacatcatgaccgatgggcatgcgatggcgggcgacagaggagtcctacgaagctgtacaacggatctcttcgaaacccatcatcgaggaccaggcacggcggcatacaagcccagccgatgagcacaagaccgagctcaaaccccgagcaacctgcagggcggcgacagaccatggaaccccaacatacgtgctgagctcgcgggtgcgcacaggccgcagcatccgtggcattctgacatcaccaccgcactgcagccgcagcaaagccgccgagccatccgacgaaacgactcagcgggcggacagccctgagccacaccatggacccggagaaccatggacaggacaacagaacaccaaagacgcatcaagacgccatgaccggccgcaggagccagcaagcacgaccaacaaagaaacacatacctcatacgaaaccaacacacccagaaggatagccacctgcactacactgagacaacgagagcactaaacccaggcacaatgcacaccaacaacccacgagaaacacggaacaaagcaaacaaaagacacatacaagactagcacaaacgaaagaacgaccaaacaagaaacacacaacgaatacagcaacgacaacaaaaagccaagaaggctaccaaacgacaaacaacagcgcacaccaaaagacgacgacactacaacatagcagaccaacgacataagaaacacctaactggcagcacaccaacgtgcaccccacaagaaccccaacaaaggaacaacagaaatacgcagacaaaaccaggcgaaacacaaaacacagacgaccaaaaaaaaaaaacaaaacaaacacaaagacacaaagcgccaccaaaaagaacacataaaagcacgaaacaagaaaaaacaacacaagcgacaaacacaaaacgagaaaaacacaacaaacgaacgaacaaaaagcaaaacacatg

SEQ ID NO: 510844 - DNA, 126 bp, Homo sapiens
tggtgttctagaggtcccctcatactggtgtgccagaacggcagatacatatcagctgggcacttgttaagaaactcaaaagtcctggatcggttgcggtgggtcacgcgtgtaatcccagcactt

SEQ ID NO: 510845 - DNA, 421 bp, Homo sapiens
tgcgacggatccgcatctgtcgcccaggctggagtgcagtggcgccatctcggctcactgcaagctctgccacacggtatcacaatgatctttacacctcagcctccggagtagctgggactacaggcgtctgcaaccgtgcccagctaattttttgtatttttagtagagacagggtttcaccgtggtctcgatctcctgacctcgaggtccgctcaacatagcctaccaggtcacattgtttacaatgtgtgagccaccacgcccggccggaacatatttcttcccaaatttcatctccatttctttttttgatacaggatctcgctctgtctcccaggccagtctggaatgcagtggacaatctcggctcactgcaactccacctcccgggttcaaggaatctccagcctaacctttc

SEQ ID NO: 510846 - DNA, 200 bp, Homo sapiens
aggactccccacaccctctgagtccacaccacctgagtcatggggattatgtcgtacagcttatttcatcactctgctatgatggataagattgagagagtgcggagaagtgctatacgtttagttgagggagagatttggtatatgcaaagagatgggggctagttttgtgtcatgtgcagaagcaagccaggcctggc

SEQ ID NO: 510847 - DNA, 172 bp, Homo sapiens
aggatctagggagcgttcttggtgggtcacgtagaacaacgatgcagctggtgcttccaggaacttctgcaagttcttggtgacctcctcgagggaggtcaggccctcccgcagctgcagcgccgtgtgcctcgtccatgcacctgcgagcgcaccacgctcctccactggt

SEQ ID NO: 510848 - DNA, 402 bp, Homo sapiens
tcaaccgtggggaccatcaaccttcgagaaattccagttgtttttttcccaaccgcatcctgcctgtaaatggccggggaaggctttaaaaaaggggggcattgcgatccaaccatcggcaaccgattccgtgttttgatcccggggtgggagggaaccgtggggtccctgggtggggcccatgggtgagaccctccagtactgagacctaaagtccaaatgcttgtaggagccaagtcgtgttttaagtattttttttaaacaaaaaaatcccgttttcccctttgtacttcagcgctagcccctgttttgcccaaccgagtactggggagtatgttttatgttgggcctcctgctgcaaaacaataaacaaagggcgcaaaggtcctcctgcctggccca

SEQ ID NO: 510849 - DNA, 357 bp, Homo sapiens
cccttccctatatgagcatgcctgtgttgggttcacattgagggtaataataatctgacccaggcttatgcgaagaagaatgtttccatgttccttatcctacctttagttcttcatatagggtatatagattggtccaattggtgtgtgagaagtccagttatatgtttggtatttttttagatagtgggtgttaagcttacccgctttcttaattggtgcctgcttttaggcctactatgggtgttaaattttttactctctccacaagtgttttctcatatgtgtccaaagacctgctcctctgtgctctcacagttatattcacaagggtatttagagggctccgctcgtgcc

SEQ ID NO: 510850 - DNA, 383 bp, Homo sapiens
  misc_feature (281)..(281): n is a, c, g, or t
  misc_feature (338)..(338): n is a, c, g, or t
  misc_feature (380)..(380): n is a, c, g, or t
tgggtattgttgctggttattcagggcccaagggctcttcagttagtaggtgatgaatgctgccagaacttagtccttcccttcaaggcagcaggttctcttctggcccagggtgtgtctagtattatcatccagaagttaggacctggaaagtggggcccagaactctgaccagtgccttatcttgctgtggctaagctggtatcttaagatataagacaaagacctctgcacttttccctctcctctcctcaagtggagggaatgggagtctctcacanctgtgagctgtgcaacctggggtgaagggggaggggtgatgcccttagccaccccanctgggttcaaagtaaggtcaatgtccccaacaacctctcaantca

SEQ ID NO: 510851 - DNA, 297 bp, Homo sapiens
  misc_feature (13)..(13): n is a, c, g, or t
  misc_feature (25)..(25): n is a, c, g, or t
  misc_feature (274)..(274): n is a, c, g, or t
  misc_feature (281)..(281): n is a, c, g, or t
acggcataatgtngccagatccttngttttccaggagaagctggaaattcagatttttaaatcttatctcattgggaagtaatttaaagaaaatttaatgcaatgttagccaaataaaacctatctagaagccatgttttgtcccccagtttgtgattcgaatttgagtcgagtgtatagtatattggtgttagatagtctgtttcttcatgctactaacaacaagccattgtaatgtatttctacattttgtgacttatagagttaccacccncttattntagaaacgtggcccag

SEQ ID NO: 510852 - DNA, 845 bp, Homo sapiens
gtgagtgtttacaccggcggcagtgcggcgggttccttccgcgggacggggagaaagagagagcgcgaaagacgagaggatgtctctcgtcagactggcacctggcggtgatagctggctgaccagtccacttactccaaagtctattcgttcggcttgccagcaggacagaacctgggcagcaactacgtcgcctagggggcctactagctactctcactctctcctgacagcagcttcacttgcctggcaacactccagcgagctctcgttccagcacccctgcagctgaccttgactctgacctcttaccgtgctggctccggacacgcctaccacagactgaccccacgcacaactcagcacctctctactagcgccactcacacacccctgcgagcctcccacctgcttccactgctcacctcgccgaaaacgctcgcctggcccttgacaccacctgcacttcaagagaacgaccccgcggcgaaaccctggtcgccgacaaccgcacgcctgggcgcctcgcccccacctgcaccaccgaacgctctccccgcacagctagctccagcaccacccaacccatgtaccccacactggccccacccacccccccagatacttccccgttccttattcaacaacaacgcgcaaacgacgcccgcccgcccacaccttccaccacgagccaaatacgccttccaacgcacaacatcctacaacctgtcaaacaacccctacaactcgacatacttaccacacaaacatccaaatctagcatgggctccacaacccccccccaacgagccccaatctcaaaccacagcttgtaaccccactta

SEQ ID NO: 510853 - DNA, 550 bp, Homo sapiens
  misc_feature (2)..(2): n is a, c, g, or t
  misc_feature (4)..(4): n is a, c, g, or t
  misc_feature (42)..(42): n is a, c, g, or t
  misc_feature (60)..(60): n is a, c, g, or t
  misc_feature (83)..(83): n is a, c, g, or t
  misc_feature (91)..(91): n is a, c, g, or t
  misc_feature (115)..(115): n is a, c, g, or t
  misc_feature (133)..(133): n is a, c, g, or t
  misc_feature (185)..(185): n is a, c, g, or t
  misc_feature (192)..(192): n is a, c, g, or t
  misc_feature (247)..(247): n is a, c, g, or t
tnanaccccggttccctttgggggttgcaccttttccagtgntgctgcttgcacctcttntggaagcctactttgacttgagnccagtggntacccaccgttgggacggcagttncagtcaagcccaaggaanggccagttccaacaccattgtccaagtcaagcaccccaagcccaagcttaanggcttgntcaccgaagtaggctctggcttctgcccacagggcacctgtctgccgctgccgcntcagctgctttggcccagccagcttcagatctggtcttggcgagctctcgccaggaccccaaggctgttggtctgtctggcccttgccccacccccttgccagatccctggtgtctggagctgagtggccgggcatcggtcccaagcatcaaagcctttggcctttctcctcccaggcctccacaaaggcctggcagacagaggtctcattccagcctgactcttgtcccctgggggacccagacaaagcacagcagccgctcagagacaggaatagaaatttcattaaaatctatggacttt

SEQ ID NO: 510854 - DNA, 696 bp, Homo sapiens
gcaagatggcggcgcccagaggctgctgaggcgcggaacggacgatggcgctggctgtgcgttggtgtgcatggtgtgctctggctggcggctgtgcgtgcttgatgctggtgccgtgtggctggggcgaggtgcactgtgactgtgctgtgcctggtgcgctcccggagcctggcgcgaagcggcagaagccgacggctggacgtgtgccctgtggtaccaagtaacagtaggtagcgaagcagcgctagcccagcagccgatctgcagtacatatacgtagtagaggggctatacagctatactacggggaggtgcgcttagggctgtatgctctatcactataatgttggtagcacccaagacgtacacgtgggacccagggtgcccccagcggcccagtgctgccccagaaccagacgccctgcacggggattcccgtgccctgttgcccactaatacagcctgcggagctagggacgcgagacagacgaatcttccactccttgccttggatatagctgcggcctaactggggactatccaacacccctggcctaggctcccctcgatagacgaacatagccagggcagttggttacccgaaacacgcttctgggagagggctagggcgaaccatcagaacaaaaggagaattccatccaggccctctgggactttctcaccagggaaggc

SEQ ID NO: 510855 - DNA, 1422 bp, Homo sapiens
ggacgccgccttcgccgctggctccgtctgttggggggcgaacacgccgcggtcctcgtcgtggtgagcgcagccactcaggctggtcctgggggtggggctgtaggggaaagtgctaaagccgctgaggtgcagtggctcacgcctgtaatcccagcactttgggaggccaaggcaggtggatcacctgaggtcgggagttcaagaccagcctgaccaacatggagaaaccccatctctactagaaatacaaaattagccaggcatggtggtgcatgcctgtaatcccagctactcgggaggctgaagcaggagaatcgcttgaatccgggaggcagaggttgctgtgagccgagatcgcgccatttccagcctgggcaacaagagggaaactccgtctcaaaaaaaaaaaaaaaaaggaagagaaaagaaaacttaagtttcagccaggcatgtgaagtaagaactctgctagagaggaaatggctgcttcatcatcatcctcctcagctggtggggtcagtggaagttctgtcactggatctggtttcagtgtctcagaccttgccccaccacggaaagcccttttcacctaccccaaaggagctggagagatgttagaagatggctctgagagattcctctgcgaatctgtttttagctatcaagtggcatccacgcttaaacaggtgaaacatgatcagcaagttgctcggatggaaaaactagctggtgcgcagcaagtgcaaagccagtgggggactttctcacagcttacatagccatccagagatccacagctacgtcactgaattgttaatgcacatttgtacttggtttctctgtatctattcacaggcaacaaatacttatatgtgtgatctttcagggaatgttttgtttatttgtttttaaaagtattgggaatcagattaagacaatcagtttcagagaaccaggaggtttggggttaagagatactcaaaaattttcacaagccaagtagggcatatatcagatttggccaactgaatggcgtctgtcctgtcatccatatggtgcctggaaatatttaccagtcaaggtcaaggtcagcatctgtggttaaaaatatagcattctgacctaaaaaagttattttgcagatgaatgtgttttcaactcaggacctatccaaatgaggaatttttaaatattcttttttttttcctatttttagacatcaattctatagattctgactttttctaacctcttatagacatgccaaatgctggcaaaaagaagtgctttttggatatggcagcacttgtaaaaataaagcagtaagcaaaatccttttaaacacagaaatcctgagttcttctcattggtggactcaagcaattctgtagcaaataaatcctttgaaagagctccaaa

SEQ ID NO: 510856 - DNA, 229 bp, Homo sapiens
acagtaacagtgagctcagacgtctctaaaaaaatgttgccttaatgaacgcacatggcggttgaatcttaaggttaaattgaatatgaaagatcctcatgaattaagtagtcgatgcaattttgaacgttaattgatataaaaaacaaccaccaaaattaggcttataaaactgactttttcattacggtggttatgaaatctagccccagactttatgtaaaagata

SEQ ID NO: 510857 - DNA, 1062 bp, Homo sapiens
ggacgccgccttcgccgctggctccgtctgttggggggcgaacacgccgcggtcctcgtcgtgtgaagtaagaactctgctagagaggaaatggctgcttcatcatcatcctcctcagctggtggggtcagtggaagttctgtcactggatctggtttcagtgtctcagaccttgccccaccacggaaagcccttttcacctaccccaaaggagctggagagatgttagaagatggctctgagagattcctctgcgaatctgtttttagctatcaagtggcatccacgcttaaacaggtgaaacatgatcagcaagttgctcggatggaaaaactagctggttgtggtagaagagctggatggtcacctctgtggcgcagcaagtgcaaagccagtgggggactttctcacagcttacatagccatccagagatccacagctacgtcactgaattgttaatgcacatttgtacttggtttctctgtatctattcacaggcaacaaatacttatatgtgtgatctttcagggaatgttttgtttatttgtttttaaaagtattgggaatcagattaagacaatcagtttcagagaaccaggaggtttggggttaagagatactcaaaaattttcacaagccaagtagggcatatatcagatttggccaactgaatggcgtctgtcctgtcatccatatggtgcctggaaatatttaccagtcaaggtcaaggtcagcatctgtggttaaaaatatagcattctgacctaaaaaagttattttgcagatgaatgtgttttcaactcaggacctatccaaatgaggaatttttaaatattcttttttttttcctatttttagacatcaattctatagattctgactttttctaacctcttatagacatgccaaatgctggcaaaaagaagtgctttttggatatggcagcacttgtaaaaataaagcagtaagcaaaatccttttaaacacagaaatcctgagttcttctcattggtggactcaagcaattctgtagcaaataaatcctttgaaagagctccaaa

SEQ ID NO: 510858 - DNA, 379 bp, Homo sapiens
atcacagcagcagaagtttcaacggtgacctggtgaagatgggataagaggctcggtcagactcacagtcgggcttcccacaatccaggcatcgggatatgtgaaaatgatagagaaagtacatttcgggcactgattagttggtaaagacaaatcttacagtccctatgggacagccagttaaaagcaggcagtatcacccagcggtcaagaggagagaccttcggaactgccggttatggggcttaaattctagctctcctctatcaaatgtgtaacctttggccagtcactttacctctccatgcctcagtttcctcacttgaaaaatggaaggcatagtccctatctggtaaggtacttgagaggattaaatgag

SEQ ID NO: 510859 - DNA, 3009 bp, Homo sapiens
cggacgcgtgggtcgacccacgcgtccgggcgaacacgccgcggtcctcgtcgtggtgagcgcagccactcaggctggtcctgggggtggggctgtaggggaaagtgctaaagccgctgaggctctgagagattcctctgcgaatctgtttttagctatcaagtggcatccacgcttaaacaggtgaaacatgatcagcaagttgctcggatggaaaaactagctggtttggtagaagagctggaggctgacgagtggcggtttaagcccatcgagcagctgctgggattcaccccctcttcaggttgatactgcctggatggtcacctctggtgcgcagcaagtgcaaagccagtgggggactttctcacagcttacatagccatccagagatccacagctacgtcactgaattgttaatgcacatttgtacttggtttctctgtatctattcacaggcaacaaatacttatatgtgtgatctttcagggaatgttttgtttatttgtttttaaaagtattgggaatcagattaagacaatcagtttcagagaaccaggaggtttggggttaagagatactcatctgtcctgtcatccatatggtgcctggaaatatttaccagtcaaggtcaaggtcagcatctgtggttaaaaatatagcattctgacctaaaaaagttattttgcagatgaatgtgttttcaactcaggacctatccaaatgaggaatttttaaatattcttttttttttcctatttttagacatcaattctatagattctgactttttctaacctcttatagacatgccaaatgctggcaaaaagaagtgctttttggatatggcagcacttgtaaaaataaagcagtaagcaaaatccttttaaacacagaaatcctgagttcttctcattggtggactcaagcaattctgtagcaaataaatcctttgaaagagctccaaattggtggcattatcctttcaaaatctcagggatttgggatgaagtgaagaggtcaaattactttttagaagaagggaatctaaaaaccatctctcctaaacaaatggtagactggctttacttaagggatatttgtctttataggagtacataaatttatcttaatgatatttaagtagttttttttttttttttttgggacgaagttttgctcttgttgcccaggctgtatcgcaatggcgcggtctctgctcactgcagcatccgcctcccgggttcgggcggttctcctgcctcagcctcccgagtagctgggattacaggcgcccgccaccacacccagctaattttttgtatatttggtagagacggggtttcaccgtgttgaccaggctggtctcgagcttctggcctcaggtgatccacctgcctcagcctcccaaattgctgggattacaggcgtgagccaccttgcccagccaatttttttttaaagagacatggtcttgctatgttgcccaggttggtcttgaactcctggcctcaagagatccccccaaccttggcctccaaagtgctgggattacaggcatgagccaccgcgcctggcctcaagtaagtttttataccatgataggggaaaacctggaaggctaagagatgtgctgttttccttcatgggaccccactttccacagtaaacaactggtataatcatttattacgttgtatgcaaattttgccttagacaacatttgtctggttccttattaataacttgcatctgatctgcttagagttgcttaattataagtaaatataatcccagtagcatttagccttaatctcaagagttcaaaatgtttaacacattctacctgacgggaggtggtgacctcattcagtcggttaagagcctgagccctgtgaagttaaacacctgctcatggtcacatagcccaggcagaagaaaatctcggacttggaatagatcccagttgcctgataattcatctcattattgcctctaaagcaaattggagactgggcacagtggctcccacctttaatcccagcacctggggaggctgaggtgagtggatcactagaggtcaggagttcaagaccagtctggccgacatggtgaaactcagtctctattgaaaatacaaaaattagcccagtgtggtggcacacacttgtaatcccagctactcaggaggctgaggcatgagaatcgcttaaacccaggaggcggaggttgcagtgagctgagatcacaccattgcactctagtctgggtgacagagcgagactctgtctcaaaaaaaaaaaaataaagccgggcgtggtggctcacgcctgtaatcccggcacttggggaggctgaggcaggcggattgcctgagaatcgggagttcgagaccagcctggccagcatggtgaaaccttgtctctactaaaactacaaaaaaaatgggccgggcgtggtggcgggcgcctgtaatcccagctactcgggaggctgaggcagcagaatcgtttgaacccgggaggcggaggttgcagtgagtggagatcgtgcctgtgtgctccagcctgagcaacaagagcgaaactgtctcaaaaaaaagaagaaaataaataaataaaaatcagagcacaagaagtaccagtccaccaactcacattttctatattaataattcttaactaaaagaagttccatattcgacagcattttagttttttaatagtacttattagcatcaaccatcttgataatcaccaagggaaaaattaaaaatacctagactgcaataaacctttaaattggattttcagtgagaatttagaagcaatcactacctttctcgtttcatttgtgtaaccatgcagcataggcactgtgttacatcatctttacgctttggtatttgaacttattacagaattttttctctaaattggatgtttctttatatgaccttggaaactgaagtgatcttagcattaaacaaaaatgctttttaaagcaaaa

SEQ ID NO: 510860 - DNA, 1108 bp, Homo sapiens
ggacgccgccttcgccgctggctccgtctgttggggggcgaacacgccgcggtcctcgtcgtggtgagcgcagccactcaggctggtcctgggggtggggctgtaggggaaagtgctaaagccgctgagtgaagtaagaactctgctagagaggaaatggctgcttcatcatcatcctcctcagctggtggggtcagtggaagttctgtcactggatctggtttcagtgtctcagaccttgccccaccacggaaagcccttttcacctaccccaaaggagctggagagatgttagaagatggctctgagagattcctctgcgaatctgtttttagctatcaagtggcatccacgcttaaacaggtgaaacatgatcagcaagttgctcggatggaaaaactagctggtttggtagaagagctggaggctgacgagtggcggtttaagcccatcgagcagctgctgggattcaccccctcttcaggttgatactgcctggatggtcacctctggtgcgcagcaagtgcaaagccagtgggggactttctcacagcttacatagccatccagagatccacagctactcgggaggctgaggcagcagaatcgtttgaacccgggaggcggaggttgcagtgagtggagatcgtgcctgtgtgctccagcctgagcaacaagagcgaaactgtctcaaaaaaaagaagaaaataaataaataaaaatcagagcacaagaagtaccagtccaccaactcacattttctatattaataattcttaactaaaagaagttccatattcgacagcattttagttttttaatagtacttattagcatcaaccatcttgataatcaccaagggaaaaattaaaaatacctagactgcaataaacctttaaattggattttcagtgagaatttagaagcaatcactacctttctcgtttcatttgtgtaaccatgcagcataggcactgtgttacatcatctttacgctttggtatttgaacttattacagaattttttctctaaattggatgtttctttatatgaccttggaaactgaagtgatcttagcattaaacaaaaatgctttttaaagcaaaa

SEQ ID NO: 510861 - DNA, 353 bp, Homo sapiens
aatagccacatttttttactggccacaaattacaattgcagaatatttatggccatacaagacacttccaccaagcctgaaaaatgtataaatgtcctaggagtgcagcattttttcttaaaagataatattaatgagctagcttaggtcaacgggttaatggtcattgttaaaacgaatagccccgactttaatgagtacatctgcaccttccaagtttaattataactctttctctttatagttagagtacagacactaacaaaagacaatgcattcctgctcttgttttctgaggatgtccaactctgtaatggagtcatttctaataaacttgcttctttaactttgca

SEQ ID NO: 510862 - DNA, 723 bp, Homo sapiens
cggacgcgtgggtcgacccacgcgtccgggcgaacacgccgcggtcctcgtcgtggtgagcgcagccactcaggctggtcctgggggtggggctgtaggggaaagtgctaaagccgctgaggtgcagtggctcacgcctgtaatcccagcactttgggaggccaaggcaggtggatcacctgaggtcgggagttcaagaccagcctgaccaacatggagaaaccccatctctactagaaatacaaaattagccaggcatggtggtgcatgcctgtaatcccagctactcgggaggctgaagcaggagaatcgcttgaatccgggaggcagaggttgctgtgagccgagatcgcgccatttccagcctgggcaacaagagggaaactccgtctcaaaaaaaaaaaaaaaaaggaagagaaaagaaaacttaagtttcagccaggcatgtgaagtaagaactctgctagagaggaaatggctgcttcatcatcatcctcctcagctggtggggtcagtggaagttctgtcactggatctggtttcagtgtctcagaccttgccccaccacggaaagcccttttcacctaccccaaaggagctggagagatgttagaagatgatctcatgctgctttctgaataattggattcagatctgcaatgcatattaattgtaaagaagctattaagtggattaaagatgagtttgccctgaaaaaaaaaa

SEQ ID NO: 510863 - DNA, 422 bp, Homo sapiens
  misc_feature (182)..(182): n is a, c, g, or t
  misc_feature (196)..(196): n is a, c, g, or t
ccaccctagcccaggaaagaactggcctgtgtaaagcaaaaccccagtcatccccctccagaaatttttttggcagccaagcctgaccctaagggttccactttgctttaaaagctaggagtggcctttagagccaggaccacattaatcccacagttcaacctcagccccaagtcaggcangaagcgcttgatangcggcatttttctctatatcacagtttaaatttccgcaaacagcctttggttgccaacgaccattccagccataccacagtccgtaatctcagcaacaggcgaaacgtatttaacacacattcagttttaataaacagataaaactctattacagaaataactgagacagagcaaatctcttactcatttctcttcaccaataaaacattttatcccgtaaacaaa

SEQ ID NO: 510864 - DNA, 405 bp, Homo sapiens
ggacgccgccttcgccgctggctccgtctgttggggggcgaacacgccgcggtcctcgtcgtggtgagcgcagccactcaggctggtcctgggggtggggctgtaggggaaagtgctaaagccgctgagtgaagtaagaactctgctagagaggaaatggctgcttcatcatcatcctcctcagctggtggggtcagtggaagttctgtcactggatctggtttcagtgtctcagaccttgccccaccacggaaagcccttttcacctaccccaaaggagctggagagatgttagaagatgatctcatgctgctttctgaataattggattcagatctgcaatgcatattaattgtaaagaagctattaagtggattaaagatgagtttgccctgaaaaaaaaaa

SEQ ID NO: 510865 - DNA, 237 bp, Homo sapiens
acattgccaggatcttttttcctttccaggaagtggaataatggcccccccccccctgtttcccctcgttaaaatcctatgacttttggccgggggcagtggctcacgcctgtagtcccagccctttgggaggtcgaaatgggcagatcccctgaggccaggagttcgagaccagcctggacgacagagtgagaccctgactcaataaataaataaataaatataaataaagaaata

SEQ ID NO: 510866 - DNA, 734 bp, Homo sapiens
  misc_feature (373)..(373): n is a, c, g, or t
  misc_feature (413)..(415): n is a, c, g, or t
  misc_feature (437)..(437): n is a, c, g, or t
  misc_feature (442)..(444): n is a, c, g, or t
  misc_feature (448)..(448): n is a, c, g, or t
  misc_feature (482)..(484): n is a, c, g, or t
  misc_feature (487)..(487): n is a, c, g, or t
  misc_feature (494)..(494): n is a, c, g, or t
  misc_feature (500)..(500): n is a, c, g, or t
  misc_feature (502)..(502): n is a, c, g, or t
  misc_feature (523)..(523): n is a, c, g, or t
  misc_feature (544)..(544): n is a, c, g, or t
  misc_feature (561)..(561): n is a, c, g, or t
  misc_feature (570)..(570): n is a, c, g, or t
  misc_feature (576)..(576): n is a, c, g, or t
  misc_feature (582)..(582): n is a, c, g, or t
  misc_feature (590)..(590): n is a, c, g, or t
  misc_feature (602)..(602): n is a, c, g, or t
  misc_feature (605)..(605): n is a, c, g, or t
  misc_feature (616)..(616): n is a, c, g, or t
  misc_feature (626)..(626): n is a, c, g, or t
  misc_feature (631)..(631): n is a, c, g, or t
  misc_feature (633)..(633): n is a, c, g, or t
  misc_feature (636)..(637): n is a, c, g, or t
  misc_feature (645)..(645): n is a, c, g, or t
  misc_feature (647)..(647): n is a, c, g, or t
  misc_feature (652)..(652): n is a, c, g, or t
  misc_feature (660)..(660): n is a, c, g, or t
  misc_feature (667)..(667): n is a, c, g, or t
  misc_feature (673)..(673): n is a, c, g, or t
  misc_feature (676)..(676): n is a, c, g, or t
  misc_feature (686)..(686): n is a, c, g, or t
  misc_feature (696)..(696): n is a, c, g, or t
  misc_feature (700)..(700): n is a, c, g, or t
  misc_feature (710)..(710): n is a, c, g, or t
  misc_feature (722)..(724): n is a, c, g, or t
cggacgcgtgggtcgacccacgcgtccgggcgaacacgccgcggtcctcgtcgtggtgagcgcagccactcaggctggtcctgggggtggggctgtaggggaaagtgctaaagccgctgaggtaagaggccgaggggtcgagggccctcgggagcttggtgaaaagggagttaacccccaggatcctacctgcagggactagaaaaatggagaaggtaggaggagaaacaggagactgctgcagcagacgtgcgataggaaatttccccaggccgggtttgaccgagtgcgcatgcgggccgagggctggcgcctgcgcagtgggacagcgccgatggcgtagtttcctggggacccagctgggtgggaaaantggctaagagttagcttgggagccgctggtgttctgagcnnncccctctctggccactttttcnccacnnnaaanaaaaaaaaaaaaaaaaaaaaaaaaaaaaaagggnnnggnggggggnagaagnangggagggggggaaaaaaaggngaaaaaaaggaaaaaaaaaangaaaaaagggaaaaaanaagaaaggngaaggnaggggngaaaaaanaaggagaaaganganagaaaacaaanagagggaganacaangnagnngaaaaaangnagaanagaagggngagacgngagaanaanagaaaaaccnaaacgcaaangaangaaaaaagancacaaaagaaannnaaagagaagg

SEQ ID NO: 510867 - DNA, 613 bp, Homo sapiens
  misc_feature (9)..(9): n is a, c, g, or t
  misc_feature (169)..(169): n is a, c, g, or t
  misc_feature (180)..(180): n is a, c, g, or t
  misc_feature (223)..(223): n is a, c, g, or t
  misc_feature (248)..(249): n is a, c, g, or t
  misc_feature (256)..(256): n is a, c, g, or t
  misc_feature (274)..(274): n is a, c, g, or t
  misc_feature (278)..(279): n is a, c, g, or t
  misc_feature (286)..(286): n is a, c, g, or t
  misc_feature (288)..(288): n is a, c, g, or t
  misc_feature (292)..(293): n is a, c, g, or t
  misc_feature (310)..(310): n is a, c, g, or t
  misc_feature (328)..(328): n is a, c, g, or t
  misc_feature (347)..(348): n is a, c, g, or t
  misc_feature (354)..(354): n is a, c, g, or t
  misc_feature (360)..(360): n is a, c, g, or t
  misc_feature (408)..(408): n is a, c, g, or t
  misc_feature (612)..(612): n is a, c, g, or t
gtaaaatanaaaggatggtaacacacacagtggaaagggatgtgagggtatgggcaggagcaataccagaaatgggaaaaaatatagatatcattatatacacacagtggactggaaagaagtaaagatgggggtgtaaggtagggcaggggcaggtgaggaaagcagntgggggggccnaataaattacattcttgagagagcatagtgtgtgggggggtgngtgggtgtaggtgagagctggtagnnaggacantccaaaatgtgccaggcntggnntcttgancncatnnaagggaggaggaaggancagattctgcacggtgcntggcttagtgctggaattnncatttngtggcntggaggcaggtggagggccaggatagtgtgtaggcggcatctccaacntaagcacaggcttctggggaagaagcaggctggagaaaaaggcttggaagataggggtttgcgagcggaggtcagggcaagctgaagtggaggggtgaaatcctgcaggagtgagctggggcatgttcccactagagtaagaggagcaggaagatgcagtgcaggaaagctgtaaggagtgagtatgggagggctgggtgggcna

SEQ ID NO: 510868 - DNA, 280 bp, Homo sapiens
catgaggcggaaattgcacagttaattcagcatattcatgataaggggccggtacgttcagccgattttgagcatcctcgtaaaggtgcaagcggctggtgggaatggaagccgcataaacggcatctggaaggtttatttactgccggaaaggtgatggtgattgaacggcgcaacttccagcgcgtttatgatttaacccaccgtgtcatgcctcactgggatgatgagcgcgatctcgtttcgaaacagaagcagaaatcatcatgctggataacag

SEQ ID NO: 510869 - DNA, 403 bp, Homo sapiens
cctgaagaaagtaaggaagcaagcttgaggcaacctggcagaaaactgtgcccattagaagggtcgctcttaggccaggcgtgatgactcacgcctgtaatcccagcactttgggaggctgagacaggcggatcacttgaggtcaggagttcgagaccagcctggccaacatggtgcaacctcgtctctactaaaaatacaaaaattagccgggcatggtggcaggcacctgtgatcccagctactcgggaggctgaggcaggagaatagcttgaacccgggaggcagaggttgcagtgggccaagatcgcaccattgtactccagcctgggggacaagagtgagacttcgtttcaaaaaaaagaaaaaaggaaagacaacacaataggagacattttgcaaa

SEQ ID NO: 510870 - DNA, 583 bp, Homo sapiens
cttcttacgcccaaactcacaaacattctatagaagtagcaaaaatagacagatctgcaacatggtgaggtaactccagtctatttatgggagaatcacacgatgaactcttaagtcatattcacagtttacttatttactttatggggctgcctatggtgggcggggtggaaaggctagctagttagggggggtgcacgctaatagtgtttcagtcggtgacgtcactcactctgagacggtgacgtcactcactctgagacctagaagtagttgttccccttgctctggaggggccacggcttttgtggagtgatgggtaaacgatgcttcgtgagtggctgtggttgatgtgtgcagagggtccctaagttcaagcccaggttggagcgaggagagggacggaagctatactgttacacctactccagattacttgtatttatataagcaaaaaatatttcactttattttgtatagtgtacagccaaggccgcagctactcttcatggtgtccacacaggaataacacaatacctcataaaaagacatatatctacaagaacttatacataatactcca

SEQ ID NO: 510871 - DNA, 339 bp, Homo sapiens
  misc_feature (205)..(205): n is a, c, g, or t
  misc_feature (300)..(300): n is a, c, g, or t
cacaggtccctcagctctgttctccacgtttccttctcctgcctggctttgcttcctgtatcctctgcagccctgacctccagatgctggaggtgatgatggcaggcatgctgtctctgcttcttttcaagggctggaactgaaagctcctttgactcccacagcttacctgtgacctttccagttgctctgagggtagccacgncccttcgttggaccattactggccgagttatgggttgccgttgtagtgaggggcaaaattaatatccttgataccctgggagaggttcctgggancttctggggtgagaccagggacgttggggcaggaaggca

SEQ ID NO: 510872 - DNA, 106 bp, Homo sapiens
cagttataatatgatgatctgatgaatcgcctgacttaccatgtgtgtgctattgttttttatatatacacaccacactgccagtttacacactaaaatataatct

SEQ ID NO: 510873 - DNA, 540 bp, Homo sapiens
  misc_feature (503)..(503): n is a, c, g, or t
catcccagggagcctgggagtcagcgggcctggatgcacctcccagttctgcctcttattagccagctgtgtgttaacccctcatctggtttgctcaaggtaacatgaccatcacaaaagcaacagaaacagattatttactttcagattaacttgtgaaaatgacaagttgaatattgtcatttcagtattcaagttgaatactatcaattcaatattcaagttgaatattgtcacaagttgaaagattaacttgtgaaaatgacagttggttgaatattggtattttctgcctccaattgttgcatttgttatttgcaacttttaatgcaccataaaagcatttttgttttgttttaaaagcatttgttttaacgcaccttacaagcatttttgttttgttttaaaagcgtttgtttacaaatttgtgttttgtgacttctgggatgatttaacaacttttaatgtaccttaatacttctctgttagcttttgagattaanaactattctaatgcaatttagccattatgaaaattga

SEQ ID NO: 510874 - DNA, 1206 bp, Homo sapiens
  misc_feature (71)..(71): n is a, c, g, or t
  misc_feature (476)..(476): n is a, c, g, or t
caagaaggcctagtgttgaaaggtgtacagcagctcacaaagacagaagaagatccgcacgtgacccaccnttctcggcggtccgaacgacactcgcagcactctccggagaacatgtcccatacatatcctacggtagagagcgctcccaggagaaacaagcttgaccgactatgctatcatcaagttgccgctgaccagcatgagtctgcgcatagaagaagatagaagacaatgaatcacactatgtgttcacttgtcggatgtagaatagctcagactaagctaccgagatgtaaacaggctgtgaagtaagctgtagtgacaattgagtgtggccaaggatctaaaatgccttgaattcggccttgaatggatgagaatgaatggtactattgtgcgagcatggcctgcgctgattacgagtagcttgtggaatgtggccatcaaagagtagggggatagatcttaatacntggagatcacagatctgccgtcaatgtgcgtgtaattatgatgagtcattattgattattagtgttcttctcacactcatcatcaaataatagataatagcaaacatagaataagataaaaaaatagaggacacacatagaaacattataaagagacacaaaaactgtagtatacaccagcatttgactcattctgttgagttccacaaggaaacacatcacgaggcggacacctggcacaaacacccaagagaatgctaaagatgaccgtgggacagcgttggagccagggcctggagcaacgtcttttccagaggtccccccgccatgaacggtgctggaagccgtatcacgaactggccgttgtaaaagcaacggccggggcaggcagcagcgccagcggggaaaggcaggggaacagtttccccctaaattctgtttccggtaacgacacgtagcagggtagcgaacacgcgaaagggagagagggccatgggccaaatatagtggtgagttcgttcaaggagaaatggcggtcgcaaagagcccgaatgggtacacgaggcgattacgcccgccgcgatacaaggacccctggataaggcagataggacccacgggaaacagaacagtgggaacagtgggaagagagtccagcggccaacctcaggggcaacgggcactcaggcacaaggagatatgggcacgtggaacgaaacacaggcaaaga

SEQ ID NO: 510875 - DNA, 156 bp, Homo sapiens
aaggttgatatcatagctctatacatctcagtaaagtacttacgatattgctcaccgatatcaaaaaatcatttatatctggacctcgctttgtgcacagtggcattgtcacgctggaacaggagactgccttcccgttactggtacggcggggac

SEQ ID NO: 510876 - DNA, 715 bp, Homo sapiens
ataatatacccttaaaatgtcatctattctatcctacttgtattattcagggttccctagaggaacagaactaataggatagatagatgtatatatgaaagggagtttattaaggagtattgactcacacaatcacaaggtgaagtcccacaataggctgtctgcaagctgaagagcaaggaagccagtccaagtcccaaaacctcaaaagtaaggaagctgatagagcagccttcggtctatggccgaaggccctagaacccctggcaaatcactggtgtaagtccaagagtccaaagctgaagaacttggagtctggatgttcaagggcaggaagcatccagcacaggcagaatgatgaagaccagaagactcagccagtctagtccttccacattcttctgcctgctctattttagccacgctggcagctgattagatggtgcccacccagactgggggtgggtcagcctctcccagtccacttgactcaaatgttaatttccttgtggcaacagcttcacagacacacccaggaacaattactttgcatccttcaatccaatcaagtggaccctcaatattaaccatcacactactcaacacaggaattcaatttacaacatgatgggatggaaaataccagtgaacctgggttggggaggccagatttggtttcactttttaaaatttactatggttgttgaccttgaag

SEQ ID NO: 510877 - DNA, 262 bp, Homo sapiens
tggacagggaccaggaattgggggaagggagcccaggaagaggtggatacaggagacacttctcatttcttctccagacctaggggggtccacagatggggacaaaagacccagccagcccactgggtggcccgggcaagtaaaaacctctttgtgcttcatttgagggcacggtgagagttacccgccgcctcccagggcctaacacgagtttcatgtgagtggacaggtgtgagctaataaaggtgctttgcaaagttta

SEQ ID NO: 510878 - DNA, 563 bp, Homo sapiens
  misc_feature (362)..(362): n is a, c, g, or t
  misc_feature (472)..(472): n is a, c, g, or t
  misc_feature (497)..(497): n is a, c, g, or t
ccagcgtctcaattcttcaatctctacaatgatgctgttgtgtaggagatctcatgtattctccttactgacaatgtagtcaaatcagtcaacagacaggcataagggtgattatccatttatattgtttatttattcacatatcttggtatatagcacattatgtaaatatttttccttcaaatgtcaaattacatttagaagtaatagtacgatggtgggtgctctggcttaagcccgtaattgagcagcttgggaggtttaggcaggcagatttcttcagcgcaattagtggagaccaacctgggaagaacggcgaagcccagtctctagtaaaaatacaacaattagccaggtgtggnggcatccatctgtagtcctagctatttgggaggctaatgtgggaggatagcttgaggctggaactgtagacagcagtgagccaatctcaaaccactgcactccatttggngctacagagtgagaacgtgtctcanaaaatgaaaaatagaggggagtaataataccaaaaatctaaggagaaagatggagtatcaataata

SEQ ID NO: 510879 - DNA, 83 bp, Homo sapiens
accccccaaaggttttaaaagaagttttttggaattttttggaaaggccggtataaggtaaaaaataaggttttttaaaatta

SEQ ID NO: 510880 - DNA, 1545 bp, Homo sapiens
cccttttttttttattattttgttggcccaaatttattttaattttggcacacataggaaacaggatcctatcaaaagaaaacaaaaaagagaaacgagccaattgtgtttgcaaaggaaaacgcattgcacagactctgtgctttcaagttttacctcttgacaccacggacgctctccgggaatttctacaccaccaggagcgtgtctcacatctccagagaagtgtgggcccaaccccacccattccacacaatgtggaaacaaaaagtggccaggaaagtgtccccaaagtgtgggactttccattattgcaggaatcaggcgtttcaacagatagcaacaattatttaaacgcagagttttcaggggcacaaaccaaaatatcgtggtcttacacagacaaaacatttgggaaatttaacaacacagtgtgtttagagccacaatagacacattcgaagtgaatctcttataaacattaatatgggacatattcgaaaaaacagaaacaaaaagggacaacctttatagcctctaagagggaacaatgtttaggagagcgtgcacataattttcaagatagtgtacacacgcgaaatattccacagggggggcacaagatataatcgagtgtctgacttataaatcgcaattttcaccaaacaacaacatttaaagagacaacatctttacaagaaaaaagttgcaaaaaacaaaaaacaaccatttgacaccctgttgcggagagaaaaaagaaacgggcagcagttgattataggcgaaaccccccaagagaccaaaaatatagataacatgatggagcatgtggataacaaaacaacggttgcgcaacaaccaattcagtcaatgaccaactaagggaaataggacataatacaacatataacaaacatattggagaaggaggcccaatgtagacaacaacagaatgggcagatacggatacacaccaagcacgacagtggaacaagcaaaccacgagaacgaagcgacgcaaccaaccaccaaagagagggagtggaaacaaagaaaagacaccacaatgatgagagtggcaacaaagaaacaatcgaagaagggcaccataagaacccaaaacgatcgacaacaatctactaccaaacagagagtgagatacacacgagaaaatagaagaaccccaccaaaagagtgagaatacacatcacccaaccaacaactaatatcgcccaacaaagaaggacgaggaatctactcccggacattaatagcaagaggtactcattaaacaatgttgtacacaaagaggtagtggagacactgaccacagactaatacgagctccgaagtagttaacagaatgtacacagatgcaagaatagtgatatgtccgaaagatcaccaaagataaactaagtgaagatatacaaaacgatatgttaacaagacgagaggaacatcacaatgaggatcaaatattaagaaaaaagtagtgagcaccaccaccaagataataacacgagaaagaaagacaaatatgaa

SEQ ID NO: 510881 - DNA, 198 bp, Homo sapiens
gagcctatgatacccttcaaaagtgaaggagaagtaaagcctttcttatactaatgaaaactgagggaattttttgcctagtagacctgccttgctaaaaaatgctgaaaaggccgagagaaggaatatgatataggtcagaaacttatatctattaatacacaaagaaaagcatcagagaaggcagaagcacggaag

SEQ ID NO: 510882 - DNA, 354 bp, Homo sapiens
ctagagcatccccccccttccccgggtaaccactgacctatttactgtcattttagattattttgcatttttctagaattttatatgggggaaatcatggaatgtactgtttttcggccaggccctttttcaccaatataattattttgagatccatccaaaattctggatattttgcaaatatccataagctactcctttttattggagagtattgttccattacgtgcatatgccacaatttctttacccattcagctgttaatcgacattggaattttttactgtcttggactatttcaaataacgttgatatgaacatttatgctttcatttatcttgaataaatacccg

SEQ ID NO: 510883 - DNA, 980 bp, Homo sapiens
  misc_feature (29)..(29): n is a, c, g, or t
  misc_feature (69)..(69): n is a, c, g, or t
  misc_feature (80)..(80): n is a, c, g, or t
  misc_feature (108)..(108): n is a, c, g, or t
  misc_feature (127)..(127): n is a, c, g, or t
  misc_feature (137)..(137): n is a, c, g, or t
  misc_feature (168)..(168): n is a, c, g, or t
  misc_feature (174)..(175): n is a, c, g, or t
  misc_feature (187)..(187): n is a, c, g, or t
  misc_feature (192)..(192): n is a, c, g, or t
  misc_feature (212)..(212): n is a, c, g, or t
  misc_feature (235)..(235): n is a, c, g, or t
  misc_feature (238)..(238): n is a, c, g, or t
  misc_feature (261)..(261): n is a, c, g, or t
  misc_feature (295)..(295): n is a, c, g, or t
  misc_feature (317)..(317): n is a, c, g, or t
  misc_feature (320)..(320): n is a, c, g, or t
  misc_feature (324)..(324): n is a, c, g, or t
  misc_feature (329)..(329): n is a, c, g, or t
  misc_feature (332)..(332): n is a, c, g, or t
  misc_feature (335)..(336): n is a, c, g, or t
  misc_feature (338)..(338): n is a, c, g, or t
  misc_feature (340)..(340): n is a, c, g, or t
  misc_feature (342)..(342): n is a, c, g, or t
  misc_feature (345)..(346): n is a, c, g, or t
  misc_feature (348)..(348): n is a, c, g, or t
  misc_feature (351)..(351): n is a, c, g, or t
  misc_feature (357)..(357): n is a, c, g, or t
  misc_feature (360)..(361): n is a, c, g, or t
  misc_feature (385)..(386): n is a, c, g, or t
  misc_feature (395)..(395): n is a, c, g, or t
  misc_feature (414)..(414): n is a, c, g, or t
  misc_feature (422)..(424): n is a, c, g, or t
  misc_feature (426)..(427): n is a, c, g, or t
  misc_feature (432)..(432): n is a, c, g, or t
  misc_feature (447)..(447): n is a, c, g, or t
  misc_feature (455)..(455): n is a, c, g, or t
  misc_feature (457)..(457): n is a, c, g, or t
  misc_feature (464)..(464): n is a, c, g, or t
  misc_feature (467)..(467): n is a, c, g, or t
  misc_feature (482)..(484): n is a, c, g, or t
  misc_feature (496)..(496): n is a, c, g, or t
  misc_feature (506)..(506): n is a, c, g, or t
tttaagaggatgccattgtacacccagtncgaaccaatcagattccacgtcagatacctgaacagtcgntctacacgaancccttgcctggtattatcatgggagggnttttgccctttggctgcanctttataccncttttcttcattctgaatagtattggtcacnccaganntattacatgttnggctncctatctctggtctctcccnttttggttattacctgttctgangcnactatacctctttgctatttccncctatgtgcagaggcaccattggcttctttgcangcttttggtttgttaccccaanatncagngtggnganggnngncngnggnngnccngtgtgnccnngtaaaacagaaattaattaaatcnntcatcaacnaagacccgtttttgtgacncctgagtnnnannagaantattggcctagtaancctccagnanccccgtnatnctagataaacccccnnncccatacccctnttcccccacnaagatgtgtcttcaacactataaagcatttgtattgtgatttgattaagtatatatttggttgttctcaatgaagagcaaatttaaatattatgtgcatttgtaaatacagtagctataaaattttccatacttctaatggcagaatagaggaggccatattaaataatactgatgaaaggcaggacactgcattgtaaataggattttctaggctcggtaggcagaaagaattatttttctttgaaggaaataactttttatcatggtaattttgaaggatgattcctatgatgtgttcaccaggggaatgtggcttttaaagaaaatcttctattggttgtaactgttcataatcttcttacttttctgtgttgacttcattattcccctggtattggccttttaaactatgtgcctctgagtctttccatttataaatttgttatcttaataaatattataaaaatgtcca

SEQ ID NO: 510884 - DNA, 274 bp, Homo sapiens
gcggccttgtggggcggagctttttgcccagcaaatatggagcgcgcccaaaagagcccccccggaagggtccccgcattttccttcttttcaataggggttgaaaattaacccaggcggatcgtggcatgatgggaactttagttgacgaacccccccccgcccctgaggggcagtaaaagtcgccaggtccggctccatttctggcaaaaaacttgcagcaccgaggggttgtggagagcccttgcaggggaagagggcagggtcatcccga

SEQ ID NO: 510885 - DNA, 927 bp, Homo sapiens
  misc_feature (29)..(29): n is a, c, g, or t
  misc_feature (69)..(69): n is a, c, g, or t
  misc_feature (80)..(80): n is a, c, g, or t
  misc_feature (108)..(108): n is a, c, g, or t
  misc_feature (127)..(127): n is a, c, g, or t
  misc_feature (137)..(137): n is a, c, g, or t
  misc_feature (168)..(168): n is a, c, g, or t
  misc_feature (174)..(175): n is a, c, g, or t
  misc_feature (187)..(187): n is a, c, g, or t
  misc_feature (192)..(192): n is a, c, g, or t
  misc_feature (212)..(212): n is a, c, g, or t
  misc_feature (235)..(235): n is a, c, g, or t
  misc_feature (238)..(238): n is a, c, g, or t
  misc_feature (261)..(261): n is a, c, g, or t
  misc_feature (295)..(295): n is a, c, g, or t
  misc_feature (317)..(317): n is a, c, g, or t
  misc_feature (320)..(320): n is a, c, g, or t
  misc_feature (324)..(324): n is a, c, g, or t
  misc_feature (329)..(329): n is a, c, g, or t
  misc_feature (332)..(332): n is a, c, g, or t
  misc_feature (335)..(336): n is a, c, g, or t
  misc_feature (338)..(338): n is a, c, g, or t
  misc_feature (340)..(340): n is a, c, g, or t
  misc_feature (342)..(342): n is a, c, g, or t
  misc_feature (345)..(346): n is a, c, g, or t
  misc_feature (348)..(348): n is a, c, g, or t
  misc_feature (351)..(351): n is a, c, g, or t
  misc_feature (357)..(357): n is a, c, g, or t
  misc_feature (360)..(361): n is a, c, g, or t
  misc_feature (385)..(386): n is a, c, g, or t
  misc_feature (395)..(395): n is a, c, g, or t
  misc_feature (414)..(414): n is a, c, g, or t
  misc_feature (422)..(424): n is a, c, g, or t
  misc_feature (426)..(427): n is a, c, g, or t
  misc_feature (432)..(432): n is a, c, g, or t
  misc_feature (447)..(447): n is a, c, g, or t
  misc_feature (455)..(455): n is a, c, g, or t
  misc_feature (457)..(457): n is a, c, g, or t
  misc_feature (464)..(464): n is a, c, g, or t
  misc_feature (467)..(467): n is a, c, g, or t
  misc_feature (482)..(484): n is a, c, g, or t
  misc_feature (496)..(496): n is a, c, g, or t
  misc_feature (506)..(506): n is a, c, g, or t
tttaagaggatgccattgtacacccagtncgaaccaatcagattccacgtcagatacctgaacagtcgntctacacgaancccttgcctggtattatcatgggagggnttttgccctttggctgcanctttataccncttttcttcattctgaatagtattggtcacnccaganntattacatgttnggctncctatctctggtctctcccnttttggttattacctgttctgangcnactatacctctttgctatttccncctatgtgcagaggcaccattggcttctttgcangcttttggtttgttaccccaanatncagngtggnganggnngncngnggnngnccngtgtgnccnngtaaaacagaaattaattaaatcnntcatcaacnaagacccgtttttgtgacncctgagtnnnannagaantattggcctagtaancctccagnanccccgtnatnctagataaacccccnnncccatacccctnttcccccacnaagatgtgtcttcaacactataaagcatttgtattgtgatttgattaagtatatatttggttgttctcaatgaagagcaaatttaaatattatgtgcatttgtaaatacagtagctataaaattttccatacttctaatggcagaatagaggaggccatattaaataatactgatgaaaggcaggacactgcattgtaaataggattttctaggctcggtaggcagaaagaattatttttctttgaaggaaataacttgtgactcactgataatgaggtagtattagacgacaaatatattacaggaggggaatatggctcattaaatgacaaatcttgctattcggtagcacactgttatagtgcgttctaactaatctgtatagacgttcattatacccatggtattggcccaaatgcg

SEQ ID NO: 510886 - DNA, 419 bp, Homo sapiens
agcatacacgtaaatgagccaataggcagagcaagcagccattctaaccagccgagtgtgttttccagtgccttgtttttattctctgctggcacatacttatttcccatcagttataaacaatattgaccaacatatgttacctaaattaatcaactactttgtatccagtcctgcatatgaaaatccaaactgtaggaagagcgtctacactttgtactagatatctggtttttatttttacttatcgtaagtgatttcacacattaaattttaatttgattttgaataggtctatgtacaaggttgtcggtttctgtttatcacatagattcaagattgtgtatataaggtagcttctggtcatttctgatcagtttttggtgtgtttcttccagcatgtgcagtctttgccaaca

SEQ ID NO: 510887 - DNA, 278 bp, Homo sapiens
agtgtttaagctcctccacctccaaattgatcatttacctcagcatgttttcatcttgaccactgatcataggtgacagctgggggtgttttcaaaaggcagctcccagaagctcgttttgtgccctttctgagatgggccctaggtgggtccctcccgaggaggcgaagggtggggtgctgggaccagtgcacacaaggccttttcagaccccatccgtcttctccctgaaggagagcacgtttggaggtgttttccattcagttgcaaattcaagg

SEQ ID NO: 510888 - DNA, 118 bp, Homo sapiens
ggggagtcttgagatctatacaggatcctgacaggagatgaaggacagatgggtcaccaggaaaggtagctggaagatccaatgtcagagctcctccctgtgcccacttgctttagcg

SEQ ID NO: 510889 - DNA, 412 bp, Homo sapiens
  misc_feature (58)..(58): n is a, c, g, or t
ggggaacaaaaagttggagttccaacccggttgccgcccgttcttagaacttagttgnatcccccggggcttccaggaatttcggccacggagagcctttctgtatttaagaaacttaagcagccgggcattggttgtcacgcctgtaatcccagcactttgggaggccgaggcggatcataaggtcaggagatcaagaccatcctggctaacacggtgaaaccccgtctctactaaaagtacaaaaaattagctgggtgtggtggtgggcgcctgtagtcccagctactcgggaggctgaggcaggagaatcgcttgaacctgagaggcggaggttgcagtgagccaaaattgcaccactgcacactgcactccatcctgggcgacagtctgagactctgtctcaaaaaaa

SEQ ID NO: 510890 - DNA, 373 bp, Homo sapiens
cctggttttgcgtctgttcccctgagggccatcgtcatcctggagcttcaatgggccttggctcctttcttcctctcattcagaatcagggcttacaaaggactcagcttccttagcatctcagcagaaaactttcttttaagacccaaggcgaaagggacagaaaacggaattccttcttcttttccaaggccattgggaattcaagcaaatcccttaaagtcaacaattctgggttcttcatatcccaacagggcccttcttaacactttccttcatttttccacccaacaccctggttctcaggggatcttgaggggtagaacatgtctggttggggcttgggaataaacatgatctattgaaaaaaaaa

SEQ ID NO: 510891 - DNA, 811 bp, Homo sapiens
  misc_feature (148)..(151): n is a, c, g, or t
  misc_feature (154)..(154): n is a, c, g, or t
  misc_feature (156)..(159): n is a, c, g, or t
  misc_feature (162)..(162): n is a, c, g, or t
  misc_feature (164)..(164): n is a, c, g, or t
  misc_feature (251)..(251): n is a, c, g, or t
ccgccatgaatggctgtcgctgagtgagctctgctgtctcttctgctgcccgccctggccccggccgcatcgctgccaagctcgccttcctgcacgccggaggccatctactccctggatgcctgagcccgagccgggggcctaggtnnnnccngnnnngancncttgggacctgagagcctcctcgggcgcacgggcgctggaagctgcacctgacggagcgtgcgacttccagtacagccagcgcgagntggacaccatcgaggttcttccccaccaagtatcgccctgcggcaaacacgtcgtgtccgtgcatgatatgttcgcctgcagtgccatggttgccaggatagcacggatccatctatctcagcacggtcaagtgccgtgcgacctgggccaggatgagcagcttactacgattggacctggagcgtccctgccgtccacatgtcatacatcgttcgtccgtacggactacataccggattatcagggttgcacagcatctggtgcagcgctcttccgagaaggatacctctactgccagatcaatctgacgtccgacactggtcaaagccctgtcggcatcctagagtacaggcatcaagcccgggacagcgatcagtcctggtacagggcaggagcatcaggcacgtgtgcccacacgtggacactggcctcagcgctaacgagtgtgccgacggtggtagctagcactcagccggtcacctcgggcaatgcgcgtcgccattccccagacaccaagtaagacctactgcttcagacgcgcttccctaaacatcgagga

SEQ ID NO: 510892 - DNA, 486 bp, Homo sapiens
tatgtgacctgccttccatgttggtaaataaagttttacttggaacatgaccatgtccatttgtacatgaatagtctggctgctttcggtttactgtggctgggttaagtagttgtgacaaaggactgtcttgcaaagcctaaaaaatttaataattggcccttttagaattttaatcaaaatttgtttaaatttaaaactttttttttagagacaagttcttgctctcttgcccaggctggagtgcagcggtgcaatcatagctcactgcagtctcaaactcctgagcttaatccatccttacgcctcaggatcctgagtagctgggactaaaggtatgcaccaccatgcctggcgaatttttaaattttttgtggagacagagtcttgctatgttgtccaggccggtctggaactcctggtctcaagcaatcctccctcctccacctcccaaagtgctgggattataggcacaaaccaacacac

SEQ ID NO: 510893 - DNA, 158 bp, Homo sapiens
tcgaccggattggggattaattctaggacgatgggcattataccgtggtttgctccacagatttcagagcattgaccgtagtaacccccggtcgtgtaggcgataaagtggtttggtttagatgtccgggaattgcatctgtttttaagcctaatgtg

SEQ ID NO: 510894 - DNA, 233 bp, Homo sapiens
ctgtggctatgtaccattatctcagcatctaggatagtatttcattatcaccttggtataaagatgagaggtaaagaaacttgctcaaggtcacgactaagctaaatgagtgaccaacccaggtactgagactcaggcagtctggctgggagcccggagccccatcccttctattgtgtaaggcttctgtattctagtgtcaacttccaagcttgccaaagtcccctgcaggg

SEQ ID NO: 510895 - DNA, 239 bp, Homo sapiens
tactcaggttaaaagtatttaagaatacagttaactaattgtaaatatgctgttaaccaaaagagctttccctccctcactttttcctttgtaaacactcatgactgcttttttgtctcgagtcatctttgcattaactccccttggtggtcactaaagggctttttgatgccttttaaaagaacaactgcttttttacaatgccccccacccccccacccacccaagaacagggttta

SEQ ID NO: 510896 - DNA, 171 bp, Homo sapiens
atagagctatgattgaggaggaggaggaggaagaagaggctgaagaagaggaggaggaggaggattccgaggtgcaggtggagcagcccctcccagcatccagataaagcgggtgatgacctaccgtgacctggacaatgacctcatgaagtactcagccattcagcctct

SEQ ID NO: 510897 - DNA, 244 bp, Homo sapiens
tgttaataaatttcccccagtaagccctgtaaaggcagggaattggaaccggagggtatctagcttccgtatacataattggtcatagcatcttttaaaattgtaattcgttttgcagtattggctgaaatgtattacataaaataatgtacatttagacatctgggttcatttgctagttgtctgttaatttataacagcttaatcttgtacaggcttcacatatggacgtccatgcatagtt

SEQ ID NO: 510898 - DNA, 229 bp, Homo sapiens
caggcagtggagacagaatgccgaaggtgtttggccaccgagcatatcaaaaatggtgacctcaaaatatgtacaacaatcataaaatgtacatcacaaatcaaaaaaatttccttttcaaagtattttaagaaaaaaaagcagggccttggaagttttggttctttttttctcccctgttgcaaattctcatggtttgggttgggtggtggagagcgcgtgtcatctg

SEQ ID NO: 510899 - DNA, 588 bp, Homo sapiens
agccgcgtgggagggggggcgcggagggaggaggggggagagggggggcggcgcaccagggggcgaagagcggtagggggggggcgacgggggggggaggggggggtggtgggggccgcgggagggggggccgccagccggaggggagagggggggggaggggagggggggggggggggggggcccccggggtggacgcaggcggcgcagggtggggaggagagggcggggaggggcgcggggggggggaggggacggggtgggggcggggacgcccgtcgtggcgccggcggaggaagagggtgggcggcgccggcctcgccggagaagcggaggaaaggggcagccggaaaagggagagtcgtcgaatgcttctaaatcccccccaaaatctccgtgagacatgggggaacatgggggaataccgccgccaaagcgtctcctgctgttgggaaacgctgtgtctcccgcatgtgcttgttgtccgtcgccttttgggagccccttttttccgagatcgtaaaagccaataagaagttgacccccgaatatagtgggatctcccggtcgtcggccgcaaataacaaa

SEQ ID NO: 510900 - DNA, 140 bp, Homo sapiens
caggagctgtctctccaccctaggttatccacgttactttctgtactgtgtatgtgacgagagaaataaagcttctatcttccttttgagaaaaaaatgtcatcaggaggatccaagagaagaggacatagggcgggacc

SEQ ID NO: 510901 - DNA, 972 bp, Homo sapiens
  misc_feature (4)..(4): n is a, c, g, or t
  misc_feature (112)..(112): n is a, c, g, or t
  misc_feature (147)..(147): n is a, c, g, or t
  misc_feature (335)..(335): n is a, c, g, or t
  misc_feature (411)..(411): n is a, c, g, or t
  misc_feature (418)..(418): n is a, c, g, or t
  misc_feature (424)..(424): n is a, c, g, or t
  misc_feature (426)..(426): n is a, c, g, or t
  misc_feature (530)..(530): n is a, c, g, or t
  misc_feature (533)..(533): n is a, c, g, or t
  misc_feature (558)..(558): n is a, c, g, or t
  misc_feature (578)..(578): n is a, c, g, or t
  misc_feature (596)..(596): n is a, c, g, or t
  misc_feature (628)..(628): n is a, c, g, or t
  misc_feature (642)..(642): n is a, c, g, or t
  misc_feature (664)..(664): n is a, c, g, or t
  misc_feature (689)..(689): n is a, c, g, or t
  misc_feature (694)..(694): n is a, c, g, or t
  misc_feature (716)..(716): n is a, c, g, or t
  misc_feature (725)..(726): n is a, c, g, or t
  misc_feature (732)..(732): n is a, c, g, or t
  misc_feature (750)..(750): n is a, c, g, or t
  misc_feature (755)..(755): n is a, c, g, or t
  misc_feature (777)..(778): n is a, c, g, or t
  misc_feature (795)..(795): n is a, c, g, or t
  misc_feature (803)..(803): n is a, c, g, or t
  misc_feature (813)..(813): n is a, c, g, or t
  misc_feature (817)..(817): n is a, c, g, or t
  misc_feature (843)..(843): n is a, c, g, or t
  misc_feature (852)..(852): n is a, c, g, or t
  misc_feature (865)..(865): n is a, c, g, or t
  misc_feature (889)..(889): n is a, c, g, or t
  misc_feature (892)..(892): n is a, c, g, or t
  misc_feature (896)..(896): n is a, c, g, or t
  misc_feature (900)..(900): n is a, c, g, or t
  misc_feature (928)..(928): n is a, c, g, or t
tgtntgtcgaaatgaaaactgaaaacaagtatacaaaacatgtcgattagctaatcgtgtatggaaagcagatgagaggttccacgacaccaaatagaccagttctgaggtntccccaagataaatttaacagctccagcttcagtntttatcaaaatacaaaagaaaagaagtgagaggttgtcttttatcgatggcaaatcgagacccttgcaggctgaagggagagagagctactatcactacacagaggtaggggtgctcccgaggggctgttgtggatctaggtggacctgcctgcccggcttgctatcgtcgcttcctgctggtgaggncccatgacatcctgaccgaaagtgtctgagcgagctcagagtgtgggggacgacggacccactctggccacacggngaccganggacananggggccctgcgtcccataggctgcctgaaggtgggtagggcggcctgcggcatagtggggtggctgtgggctcccagcctggcccctgggaaccgtgggtagcncanggcactaagtcacatggctatgtgnaatggcaggggtgtacccanagggacaaagcgatgttngcgggggatctcatacgtgtcgacccatgcangaaattgtatcgcnagtactgcatgcgcctacccancaacctcaatggtaccccgcagggngcaanagctgtggctgggcggactggncataccagnnccgtcnactagcaaaatcttatanctacngcgggggtctcccttcctagtnntgttccaaagatgttcntcgacatnggtattcatnaacntagttttaaaaaaatggcacttgagntatggggtnaaaaaaccaaccnaccaaaaatgggatttccaacaanagntctnaaanccgaagggcgtgggcaggctctccccancatagcgtactcctgggaggccaaggtgcccatggggcctaaca

SEQ ID NO: 510902 - DNA, 195 bp, Homo sapiens
ctctctctctctctctctcttcctgtgtgtgtgtgtgtgtgtgtgtgtgtgtgtgtgtgtgtgtcgtgcgctcacacacacctctctcgcttgtgagctggggggcctgctctctatatctctgcgaacctgtctgcgtgtgtctctttcactacacactctgtggccttctgtctagagctgagactgctctct

SEQ ID NO: 510903 - DNA, 956 bp, Homo sapiens
gtctaagtttttaaactttttattgcagtattaaaaaaatgtgcattccaataattaaaatcatttgaacaaaaaaaaaaatggcactctgattacactgcattacagcctgacaggacacctggggccagctgggttttactctaggatttcactgtcgtcccaccccacttcttccaccccacttcttccttcaccaacatgcaagttctttccttccctgccagccagatagatagacagatgggaaaggcaggcgcggcctatcgtggtcagtagtctcttgatgtgaacaggggcagcacagtcattataaacttgatccaacctctttgcatcttacaaagttcaccagctcacagacgtacccctcagacaggcactgctggtggaatgtacagtgcatctgggcggagcacgcctcattaacagattcgccgggtctgctctctccggttcaatcgtctccttgggaaggcagtggatcattcctctggaagtctctgtcttctaccagctttcgccttatcgaattcatcgatactcagcatatcgggttctgtcagacatggtatgcggaggaaacagcgaagcgaggcgcacgagtacgagcgagtctggtctgcgcaggggatgccggaccggacagacggcacgggaacgacggtggccggccccaggatgtcgtgacaagcccggacggtacagaacgggggaatccccggtcggggacagggctcacaattcggccatgggacaggacatgcagcccaaagaacctccaaccgctagcgacgaggccgatattaccgtgcacggagcgaagccaccccaaacgatgaaggcacgggaatacagtcaccagcctgacggcaagacacgatgcaatgccagaggaccaccacggaaacaacggccgcacacagggacggcccaacactgcgcagacgccggaa

SEQ ID NO: 510904 - DNA, 405 bp, Homo sapiens
gtttggtgcagcaagattggctttcccagtcctgtattctgaatgtctaaaatctctgcatcttgctgaagtaaacaactgtctccagaggttggccaggcagcagctctcaaaagtacccaaagcttagcagaatcttagatctggaatcaaagaattcaagcccgaatggtgagaaccagatattactcaacagaatgctcttcctaaaggaatctagagctgttcatgggtggacagtggtggggctggagtgctccttgttaataggatgggccatgcgccctctcgggatatccagcagggcctctacagaatagggttggtcctggctagaagcgtggtctagaggatggctcagctcttggccagctctcatggggagttaaatgatggcacaaaatc

SEQ ID NO: 510905 - DNA, 107 bp, Homo sapiens
  misc_feature (94)..(94): n is a, c, g, or t
gtcatggagcgcccgccttgtttctgctcctgttgcttggacttgggcccggcggccggcaggccttccttcccgggaacccccttgatcaatnaggacgtgaaggc

SEQ ID NO: 510906 - DNA, 223 bp, Homo sapiens
cccgagtgatgcatgtggtcggttcgcaatccatcatataagaatttatcttaatgaaacaattttatctctaattgattcgttgacttttaaataggacccttaacatttacagttacattcatgtactcaaaagcacttgcatattgtggcctgcagtattctctactgcgtaaagtttcacatactaatcctcttatttagattgtgataacaatcagac

SEQ ID NO: 510907 - DNA, 352 bp, Homo sapiens
taagatccccaaagatctttgagcatcacctagtatttacattgtattttatttttctgaggcagggtctcactctgtcacccaggctggagtgcagtggcacagtctcggctcactgcaacctcacctcccaggctcttgcagttctcctgtctcagcctcccaagtagctgggattacaggcacacaccaccatgcctggctagtttttgcatttttagtagaaatgaggtttcaccatgttggccaggctggtgtcaaactcctgaccttaagtgatccgcccgcctctgcctcccaaagtgctgggattacagggtgtgagccattgcacccagcccaaaagaggggt

SEQ ID NO: 510908 - DNA, 536 bp, Homo sapiens
ttttaaaaaaaaaacccccccttttaaatttttttttgccccccccccccaaaaaatttggtttttttttaaaaggaagggtttttttttccccgggtttaaaaaaaaaaaccaaaatttttttgggggaaaatttttttaaaatttttcccgggggggttcccccggttttttgttttaaggtttttttgggggggttagggggggggcccaaaaattttttcccccggggatggggccccccccctttttaaaaggtccccttttaaatgccccccccgttttaattttccccgggccccccggggtttttttggggcttttgggtttaaaaacttgggggggttaaacaaaaaccgggggttaattttggttaaagggggttccccccccattttgggaattaagttttctttggggttaaaaaaggggggtgggtttttttttaaagaaaaaaaacggggggccaaaggtaaaaaaacccggggggccaccccccaaggggggttttttaaaaaaaaaaaagggttttttta

SEQ ID NO: 510909 - DNA, 147 bp, Homo sapiens
  misc_feature (34)..(35): n is a, c, g, or t
  misc_feature (44)..(44): n is a, c, g, or t
  misc_feature (47)..(47): n is a, c, g, or t
  misc_feature (60)..(61): n is a, c, g, or t
  misc_feature (67)..(67): n is a, c, g, or t
tggtaccagctctccatcagaggcatcttaggtnntctctctgntgnacctcatcaccanngttggncaaaaggcggagaatgtgcttatctccaagaagccatgacaggtatcatgtcacaatcctgatgtggacgcaagatgtgt

SEQ ID NO: 510910 - DNA, 766 bp, Homo sapiens
  misc_feature (212)..(212): n is a, c, g, or t
  misc_feature (254)..(254): n is a, c, g, or t
  misc_feature (460)..(460): n is a, c, g, or t
  misc_feature (630)..(630): n is a, c, g, or t
gggctctcgtggcgtaagggtacacgcatgcttgaagatcttagactgaaaagatagtctatgatattgtataatataaatcatgttagactttacctgataagaaactattttgagtcttcgtgatctcattatgccatcaaataggtgttactgtatacatcgtgattcacattagaagagatcaagcattgttcagcccttaagtaggntcattcttgctcgtttagttgaaaatcttggatctctggttnatactagtaatgcgtgccacaataaaagctcatcgcgagtggaagatatattacatttcatcattagagtgtcttgggggaacgtccctctatattagtaagtccccggcatgtcatagaattcttcatcgagtgatggtggatcgtggagtacctctatattgagatttgttctagacacagtactagtggatttggtctagacngagtcctttgtagtggggatacatcccataggtaaggaacaaaagggatacctttagagattgtcgggattgtgatcaggcgttttagtggtgtaatccgcatgccatagagagtagatgacatcgcgaagatccgataagctttaactcttcaactttgcgattagcantttttagcggcatcatcaacttggggatagcgtcagtattttgtgctgagctaaaaacctaacacattgttaaataaaccttccaattaacaaaagttgccggcttgtgagcttcctttaaatggttcttacttaa

SEQ ID NO: 510911 - DNA, 112 bp, Homo sapiens
atataatcaacatgatcgtccaaaccccatgagatgagataactctgatgatatgacaggatgatagagatgaaaaggaacccgatgaaaggacaatgaatttaatattcat

SEQ ID NO: 510912 - DNA, 361 bp, Homo sapiens
tttgtgggttaaaaaaattttaaaaaaaaaaaaaaaaataaaaaaaaaaaagaaaaaaaaaaaaaaaaaaaaaccaaaaaaaaaaaaaaaaaaaaaatggggccgaatttggggttaattgggccaattggccttatggggggtggatttacaattaatgggccggggtttaaaaacgtcgggattggaaaaacctgggggttcccaaattaaatcgcttggaagaaaatccccttttggccggttggggaaatagcaaaggggcccgaacggatggcctttccaaaaagttgcgcagcctgaagggcaatgggaaattgaaggcggaaatatttggttaaaattcgggtttttggttgtt

SEQ ID NO: 510913 - DNA, 221 bp, Homo sapiens
agtagaggcaacggattatccgtatagaaagtggagacggcaaagtttcaaccggagagacagagagtagagagtaacgcatacaacagtttcgcaaggccgggcgtgacagcgtacgaacgtaggtaggtttgaaagtagggatgagcgcgtgacgggtatggccggagcggtttggcccaggaggaagagtcgcgagcggcgatttcatcgagtagaag

SEQ ID NO: 510914 - DNA, 274 bp, Homo sapiens
gtgagtcagtactgggtcgcagtattcaaccattattgtggactgctgttttactttaatttacacaaacacaaacactgctcacatttgaggtacactttaccctgcaaatttttttgtttgttttttgtttgtacgtttgagacacagtctcactctcactcaggctggcgtgcagcgaagtgatctccagattactgcaaactctgtctcccaagttcaagtgattctcttgtcttagcctccggagttagctgggactataggtgtgcgt

SEQ ID NO: 510915 - DNA, 132 bp, Homo sapiens
actcgcggacggtcttcctaacgtactgactgtgcctctgggccttgactgacggtgcttgttgacccacttggtgaaggtttacttctgcacacgatcccgctcatctttgagggagctgatctcgttctg

SEQ ID NO: 510916 - DNA, 267 bp, Homo sapiens
aagagcgtactctcatttggtcaggctggttcgaactcccgacctcagcgtgatccgcccgcctcggcctcccaaagtgctgggattacaggcgtgagccaccaagcccggtcggtaactagattttctaatagactgtgagggggaagaggagcggttggtcttgctgtctcaggagtgtcaaaggcagaaggcgtgaaggaggtggaaaggaatgcagacatacgtcatgtaacttttactgaaaaatattcacatagaggtgga

SEQ ID NO: 510917 - DNA, 701 bp, Homo sapiens
gggactctaagggtcatggtcaagttgggatgcgtgtgtgcgtgtgccgggcaggggagaggaagagtgggtggactccggtgagctagtgcccggagactgcctggtgctgccccaggagggtgggctgatgccctgtgatgccgccctggtggccggcgagtgcatggtgaatgagagctctctgacaggagagagccttccagtgctgaagaggcactgcccgagggctgggccctactgtggcgaacacagcggcgtgaccacactcttctgcgggaccctcatcttgcaggcccgggctatgtggaccgcacgtctgggcagttgggtgacccggcacagggttctgcacgaggaaaaggcgggcctggtgagctccatcttgcacccccggagccaatcaacttcgaagttctataaatgacaaggcgttgaagttttgtggcttgcccgtctactgtgctggactctccttcggagccagtcttacaggcgttctttcatcctctagccggaaacgcggggcttgccttcttgcaatgacgacttgtaagctcccgggctcattcgaagcattgggtgacaccgttggatgggagaccaccctgtcaccatggccttgctcgggctggacttggtgtagcccggtctataggcgccgaagccgcactgcgggaggaacgaggttatacggagtc

SEQ ID NO: 510918 - DNA, 276 bp, Homo sapiens
ggggggggaccccccccccggtttttttccctccctgggggggggggggacttttcccccctcgggctttttgcctcggcggggggttgggttgccttttttccccgggtttggttttaacccttgggcgtttttgggtggccttttccgggaatttttttccccccgcgggcggggcccgttttgtttttcccgggacttttttttttcccggggtccgttttttcttttttttttagaaaaacccttaaattttaataaaaagttatatatgta

SEQ ID NO: 510919 - DNA, 122 bp, Homo sapiens
atgaaactggaggcatgataatggaaaatgatgagggaggggagaggtgacgttacactgctgctccccagtgcagtgcttcctgagctaacagcaggtggagttgccctcctccctcgctg

SEQ ID NO: 510920 - DNA, 291 bp, Homo sapiens
catccctattctggccacgctttttcgagtcacttcggtcggtctcgcggggcaatcgcgcacggtgctggagacggtctatgcccgtgtagaggagggcggccgcgtcaggtttcgacgggtcttatggcggcaacttcaataaggagcaatcggatgggcaaggagagccagggttttaccctgattgagttactgatcgtcgtggcgatcatcgctgttgctgtgccggcgattggcgtatcccggtgtacctcacagccaggtgcagaaggcgtatcgggcgcagat

SEQ ID NO: 510921 - DNA, 101 bp, Homo sapiens
tgagtactgttgcatctgtcacacattgtttggactgatagtgtaaaggactatgctctgatagagaagaaacatgatcgtaggatggttgacacttttat

SEQ ID NO: 510922 - DNA, 1672 bp, Homo sapiens
  misc_feature (1494)..(1494): n is a, c, g, or t
ctctcctctcctgtacgtagatgttgtcttgtcggcgggtcgttgtctttcgtctcgacgatgtaattatatcgcgtgcgctgtggttttgttcgatttgtggtaggtgatgaggtgaccgatcgtcgatcattcttttttttatgctgcttcgcgtgcggatatcgccctcctgtcggtgcgctcttggtcggtggctgcgcgggcttttctcctgtgggaaataatgttttattctccctcggtaccaaccgtgggtggctccccccccgccgctgtaggtggggtgttttgctctatcaacctagggcgtggctttcttcggttcctttgttgtgtgttgtatgttgtttcttgtgtcgcctcctcttttgtggtgcttctcttctctcttccggagatgtgggtgcgtccctctggggggtgtcttctctgttggtgctcgccctctcgttctcttggcgctgttattgttggtgttgtttcccccgctttggtgtttcacacacggagacattttgtgcgtgctgttttctacagggtgttctcactgtgtgtgttgaaaagtggtgtttctatgtggggcgcccgcacgtcctcgttttatttggtggctggtccggtttttgtctctgtctcgcagcccccgttgtgtgttgttgttgcatccgtagttcccagcggtcgtcgtcgttttcaatattgcacaccaccattgtttgtgggtacctcagctgtggtgctcttgtggcatcgtgttcgtatatgtgggtgtccatcaacacgtttggggggcgttctccccgtgggggtgtaccaaaatgatatttgggggtcctccagagtactcctcatatctgtctgctctaattctctgtgtttttgtttgttcctccaaatgtgccaaaaactgtgtcccatcgttttccgttcgctcagatgattttggtttctacagatcctgcctatattgttgccacaagacgcatggttttgtggcgccgcccacccgcagagacacttgtatccgcggttgttcactcacgtggtccacttcttttctccctcaatattctctctcccgccacttttgtgcacgcccgcagacaacgagactcttggggcttctctctatagagtgatgatatgtgtggagactcttcaccccctcctcgcgagaggggtaaatttccccggcagcagccgttgggaagacaccacacgcgccccctctcgtggacacacactgagtttccacagaaacacagtttgggccgctgtctcctctccaaggagagccctcgggcacacctctttcacagccggagagacctcacttgtgctctctccccacttctccccagaggagcctctcttggtggtgtgttctcgccacacactaaggccggcccgcgggttaaatggtggcctcggcacacccaattcgagattcttctcacatttgttgcctcgtgggaaccacggtgagttgtntgcctagaatatcctcggttgtttttctgaatattggcacactcggtttctttgagtggggggccctttggttgtcaaccccaggaagaccctggtccctttccctggtttaatacaactacccggaccaagggtttttccctaattgtaataaaaggccagaccactatttaattag

SEQ ID NO: 510923 - DNA, 708 bp, Homo sapiens
  misc_feature (580)..(580): n is a, c, g, or t
ctaattttctgtatttttagtagagacggggtttcactgtgttagccaggctggtctccacctcctgacctagtgatccacccgcctcggcctgccgagtggctgggactacaggtgtgcaccaccacgcccagctaatttttgtattcttagtggagatagagttttgccatgttggccagggtggtctcgatctcctgaccctcatgatccgcccacttcggcctcccaaagtgctgggattacacgtgtgagccaccgtgcccagccatttttctgatatatattatttatttatttgttattgtatttttgagacagaatgtcactctgtcgctcaggatagagtgcagtggcacattcatggctcactgcaaccttgacctcctgggctcaagcaatccccccgagtcagtgggaccacaactaggcaccaccattcccggctaatttttaagtgttcgtagagatgtggtatggctgcgttgcccaggcaggtctcaaattcctgggctcaggtgatcctcctgctttggttcccaacgtgctgggattctaggcgtgagcccacgtgcccagncatatttattttttaaagctaaaacaatattattggtatagacaaaaaatgaaaccttactcttgcttttaataaattcttcgattagctgggtgcagtggctcacgcctgtaatcccagcactttgg

SEQ ID NO: 510924 - DNA, 94 bp, Homo sapiens
acatatcaagcaagttattctttgtctgtatctttttttcgtatgcaaactttttgtttggtttgtttaagaatggctttatagaagggctttt

SEQ ID NO: 510925 - DNA, 134 bp, Homo sapiens
agaaggaagaagaaagtaagaagaaggagaagacggtgacgaaggaagaagaaggagaaggaagaaggagaagaactaagaagaggaaaggaggaggagaagaaagaactaaggagaagaagaaaaaggaggga

SEQ ID NO: 510926 - DNA, 503 bp, Homo sapiens
ctgaccttaaagaggcagggggtggccatgcttgtctccaatccaagagtgtgtccgagatacagagcttcttcaggcgccttttccggcaagacggggatcaccagtcgcttcggccccagcagtctctcttgccctctccccagagctacgcttctctgcggggaccacggggtagcctggctggaccttccttgtgaccctgcagaagggggaatctcgcttacatacctcagctgatttgctggagaatagtacacccttgggggatgaaagggggcactctagaggaatcgattcggcttcaacacctgtgagggcttgctccagctttgtactgccctctctgtgagatcctggtcgcaatctcatgtctgtggtgttaggaagaatgcccgaggactctgatcttcggcaaggtgggtgtgtctggagcaatgctgggggctctgcaggcagcttgctcacggtggacagttccttttctggaggctctgtgacac

SEQ ID NO: 510927 - DNA, 317 bp, Homo sapiens
gtccccatcatagccctcacacactttatagcacaacagcccggactgagaccccctagacataggcgaggggaggacccctgagggctcagaccagggaggggtaccaggaatcaactggagccccgtttctaggaagtaccagccccatcccccacagtaccagactccggggaaggggcctctgggaggcattttcctgctttgcccctttacttcctgacttactaatactaaagaagtagggggagctcgagagccagacggcaagacaaggcagacccctccagaggcccgcaggtgggcatggtccccac

SEQ ID NO: 510928 - DNA, 1087 bp, Homo sapiens
gaggagaggagagcatagcacctgcagcaagatggatgtgggcagcaaagaaggtccatgatggagagcccagcctggactacgtccagacagcatcccactggtggaccgcatttggcagttccactgcatgccacagatgcacactgaaaacgccatgtcttatcggtggtgggtgagtggtcggtccatcaatcagatctgtgggttgattagtaggagagaccacgtgctcattggtgtcatccagcatagaagccaggcaaacagcaacggacgaatgggttactagggacggattgaggcatttgtgaggacgacctggaaagccacagcgaagcggcctggacccctgagcgtgagacaacacatgggttacaccaagcgtgactcagcgcagtatgcattctcaaatcggggcatcccaaacgtggggccccgtccagagtgggctggtagttgaacgttagcgccagaggcaaggacgttgccattgaagttctgcaccataacaggaaggcccaagcacccccgtgagaccaacccatggcatggcgattagcaatcgattgacacaggaattaaggcagtgcaccaatgaaaggaaggccgagttcccgacacaaggttcattttgcaaggggcatccgttccaacagtcatggacaagagaaggtgtacagcgaacgaagagacgtatccacaggatgggacgcaaaagtggcacccaggaagaggaatgggagccgttatacaggagtcgctaacagggacattgggggggcagcacaatgagggccaaagggaagcagtcgggtgcccgcgaaacggaatatctggcccaaaggaggccacgtccaagagggcagaacaccacacgtaccccaggcagaaaggatgatggggcaagccctcaccgggggagaccacaaggagcgcccatttggaggagcaccacacgttcggtgaggccacagggagtggagaacagaccaaaaaccagaccagtaggctaggagtattgggaggcaagcgaaaggggaatacggacacgaagaaagcgcgtatagcaggtataaacgcagta

SEQ ID NO: 510929 - DNA, 967 bp, Homo sapiens
gtttttattacgattataccacaacacgaataatcattccagtactgaaattggttatgcttagctgtgtgatttgggcaagaaacttaacttttctgtgcctcagcttcttcatctataaacagaaaaatcatagtacctcatagggtggtgtgagcattgaattaagttgacaatagggaaagtgcttagaagggttcctgtacataccttaatttcctggtgttttctaatgtacacaaacacacacacacacacacacacactacatctcgacacacacacacaagagagtgatgttcaaactcatttcagtgtcgacattcaggcattgagatgcaatgttcaagaatatgctgtcctcctatgattgtctgcccagcctggatcccgtgagctgaattcggtaggaagcatggacccgagcggtatctccgtggggagctggttgcccgctgaggcagtgtgaaaaaaaccctggtggatgctgtcgataagcttgcctgcccaaaagacagagggtgcacagaggggtccgggagcaggtgcgcaggtgggcgtgggaagcaagtcaagtgtgtggcgtccgtaggagggaacatcatcagtgccagcccctatctacgaccctcacgccggtgttcatggacagggggcccactctgacaactctgtgttcagagggtgagcctggcgtgaaagcagaggtccagggcacaaggacggggggaagaacacgtctcgccaaataggtcatccgggacaaagagaccacagtccggacccactttcccggatgtggacccgggcgctgacaaaggcctggtcgggacgcgaaggcgaattactggggagagactccggcgaccggcaccggagccacacaaagggcgggggaggcaacggggcacacaaggggggggaccgacatcgagaagtgacagctaaaaccagggacggaagcacc

SEQ ID NO: 510930 - DNA, 221 bp, Homo sapiens
gcgtttacactaacatgcattaccatcactgcccgtcgtttatacactaacagctataaccagtcactgcccgtcgtttaacactaacagctataaccatcactgcccttcttttaacactaacagctataaccatccattgcccttctttgtccacaaacagctataaccatgcattgcccgttcgttgccagctaaacagcatataccaatgtcattgc

SEQ ID NO: 510931 - DNA, 800 bp, Homo sapiens
  misc_feature (205)..(205): n is a, c, g, or t
  misc_feature (384)..(384): n is a, c, g, or t
  misc_feature (430)..(430): n is a, c, g, or t
  misc_feature (438)..(438): n is a, c, g, or t
  misc_feature (454)..(454): n is a, c, g, or t
  misc_feature (494)..(494): n is a, c, g, or t
  misc_feature (514)..(514): n is a, c, g, or t
  misc_feature (550)..(550): n is a, c, g, or t
cttcagcatcctgcaaactctgtcctcaacatctgtgttgcgggagagtaggcgacaggatcctgtagcgcgagcatgccaagggtagttggatgcatctcacagggacatgacccctgttgtgttcctacatacgctagatacacctgttcaggatccttatgggcatccggcagagaatggaaaagattgtctgtccacatgncaacatggattcgagggagcccgagaggtcagcaagatctcttgcgcagtagagggatctaactatggttgacggagtagctactgagattacagaactaaacaacatttcatcaagcaataacctggcgaagactttatgagctgtgttgggggaagtctccagtgcacactgactantctgccactcgtgagggtttatcgaaaatgtttggacccaaatggncattgtgnctatcatactggaccntggtgaacattcctattggtgagagtgcctgcggatgagngcccaggggtttcgatgcantctgccagatcagagagagatcagctagtcgatcanggcctagctagattgaggggcgcgaaaatcgaactagtgacattccaggcaaagagggaaaggacgggctctatggtcgggcctcgtgatttctccacgtcgacgcatagggtaagtatgaattagggagaagtttcagttccctttaccctgggggccagacagttagaaatctacccccggtgtagcgtaattaccggaaacatggaatgccaaattcaaaaaaggtttttcctcgttgaaattacca

SEQ ID NO: 510932 - DNA, 891 bp, Homo sapiens
gactcatgccagcagatgagatgaagcaagaggagtggccttgatagactggcaatgtgctcctgtgctggtgacagctaactgcagggatctgacggacatgtgtaattgttgcacagtaatatgaaatgaatgagataatgctagggagtccacgctcgtaagtatctgtaaaatgaataatggtgagtagtcacatacggctatctgtgttagccaaataggtaaaggaaacttagcgttaacctgtactgacggcgaaatagaggtagaattgggagataattgaacgcttaaaatgaatgatgaaagtgaatgtagtagaaatatatctggcctcgatagggaaggaattgatacggatctcatgaaattggtgcataggcagcgattgatccaggaatcgaacaggatatagggctcctctcgctgattgaattgggctacactttgctaaatgggtagtactacggagcgctgggtggccgtgtgcggccaagtactacagaaacctttgagtagtgaggtgagcaccacatgggattatggttgaaccttgggggattacttatatagtcttgctgattatagacgcttggtggcttgtggctttgaagatatgagagttgtcgtcacttgtggagaaggatggacagttactcacttccatgtgtaacatggtggttaccatttcacacgactaaagtcagcttggaatgaaactgagaatgcatagggcttgtggctggaaaaggcctcttagaccttatgaaatttgctaaaggaaagctgataaccttgggaagacgcagggagcaaaaagttgagaatgggtgaagatgggacttaagtgacgctcggtgtggtggttagaatttataagcatggtgc

SEQ ID NO: 510933 - DNA, 120 bp, Homo sapiens
tgagaagagctgttgcttcagaagaagggtcctggcataaccaatgatgaggctccaaacacagttccaatcccagccccagaaccagccaacccctctgtgctgtccagctgtccacct

SEQ ID NO: 510934 - DNA, 160 bp, Homo sapiens
  misc_feature (79)..(79): n is a, c, g, or t
tccccctgagatccccaacactctgaatcttctactcagctcttctgctgaagattttggcctgcacgatgacagactncgtaggtgttctttcccttgcccagaactccctagcagccctagaagaacagagaaaaaagtatacaatacactgtagaga

SEQ ID NO: 510935 - DNA, 583 bp, Homo sapiens
aagcactcgtgttgggtacaaggcatttctgacattttataaacctacatttaaggggaatttttaaaggaaatgtgtttttcttttttttttggttttcgagggggcaaggagggacagaaaaataaccttttcttaagtggaatattctaataagctaccttttgtaagtgccatggttattatctaatcattccaaggtttgcattgatgtctgactggcactcctttcttttaaggacagtgttttttggagtaaaatcactgggttataccaagctttatttaaggggtaaaggtaagctgtttaaaccccatggtggctgttgctgttgagatactgtgctttgggagtaaaaaaagaaaggtatttctttggcttaaagaatttttaaaaaattagacatgagacttattcatcttttcagggaacatactgattgtgcttaaaagactatacagttaagttaaaggtggctggaacatctatttttctacacaactggaaaaatgaacctgtgtctataaaaatgtgcaccacaataaaacatgtgaagcacttaaaaaaaacaaatacaaaaaa

SEQ ID NO: 510936 - DNA, 131 bp, Homo sapiens
gcacgcaaggatccgagaacagattccatgttggctgtagtgccgggagccttagtcgtgtgccagcatgttgggctggtcataaatcagcaggaaatcctaggagcctgcatcagtcatctcacaggagt

SEQ ID NO: 510937 - DNA, 160 bp, Homo sapiens
  misc_feature (104)..(104): n is a, c, g, or t
ttgtgtttgattttgaggcacttgcagatttctgagatcagagagctcttcctactgcagtagtctttgaataaagtctctcttcatctaagcccagatttttnattgaacccagtatagactcttatcttattattttctaggcatattcttcattaga

SEQ ID NO: 510938 - DNA, 186 bp, Homo sapiens
tctcagtgaatgctgagttgggtcccaggctcagaccaatcctgaggcatttctaggcggcatgggcccttcctccaatggatccactccgacttcccttctcatgatctcctgtcctggactgagagctccgtgaacgttggatgactcttttacgcagcctgtattgatcagtctcacggaaag

SEQ ID NO: 510939 - DNA, 698 bp, Homo sapiens
  misc_feature (15)..(15): n is a, c, g, or t
  misc_feature (160)..(160): n is a, c, g, or t
ccagccacatggcanaattttaatctttcaaaatcccttttggaaatattccaaagaccattatgtaaggtctaggaatacttttagatcataaccgatgttattctttcatggacaaaagggaaaaagttagtggccaactgagcaggcaagtatgcanaattttttatttaaagttaataataagtcctcaaatgcaatatcatgagaattacgctcacatttgtctttcttatccgcttaccctagcttttatcaccagaaagggacatagtggagctgactgaaaatatggccattacaaacagaacatctcataaatgaagcaaccatgtatagttccatttaacattcagtttatcatttcatgctccccttcacagttctaaaatttgttataaattaaatagatataaaatttaactagtattatgtacaattcaataagtgggtcgctctccttgcgcagtccttgacatccaactttgatagacatcacttaatacatctcacagcagcatacttggtagcctcagacagataggggaaattcatgtatgctattatttaataaaataagtgctcaatgtgcttaaatatgttattaatatctttgataattaaaaaataataggttctgaccataagcctgctgttggtatgaaccgcacaaattctgtttcagtttctaaaaaaaa

SEQ ID NO: 510940 - DNA, 404 bp, Homo sapiens
aggataaaccgacgccgaggagaatcagcagcaggagactaacaggagcgggatttaaacccagcggctgggaattctcaaggtgagggcggaggccattctggagtgaacctgggtaccaggccctgggtactccttgtggtaccaggctggcctggtgattcctgaggcgttggctcggcaccccatgggggactgccctcctccaggcctggcacaaagccagggggctaagagcagtctgcaggacacagggcaggaccacagcagggagggggctcctatgccagctccccctcatgccatatgagggcaggcctgtggctcgaagcccctgagctgggcatgtcctgagagtctgggaccatccaggggctgcatgttcatcctcagccctgcgtagc

SEQ ID NO: 510941 - DNA, 431 bp, Homo sapiens
acagacattagacgtagcaaatgagcatctatgggatgtcgatgactttagctgggggatgtgcctcagatggagttacaggtacgattatcggtaggggagatttgttgcaagacagcatggaatgggaagcggggtagggtcactgccatgggtggttttgtctcttgcctctctgattccagttcccactcactgttcctctaaagccattcactctcaagtgtgttggcttgaggtacttgctatgtatgtgacttcgagcaatatatagtgcttggtgtaatgtatgtttaaaatttatactagactatagttttctttggtttattttattcagtgaaagctatgtgtttaagatgttgcggttggtacttccaattcattgctctgaccactgcatagtattccaccgtttgcgtgttccgctg

SEQ ID NO: 510942 - DNA, 747 bp, Homo sapiens
gtgagtctagaggatctcaagtaaggcaggaggatgatgaagatagagaagatgaggaggaagtccccaatgcgcaagtggcaagggatcgaggccgtgttttgaagcttaccaggaacacatagaagagcaaaatctggtagcggcaggttgttacaggacacaactgtagagcgactggatggccgcggcactacagtcctcagcgctgacggcagagcagctcgtcccacatgcgtgtgcggagttgagcgagccagaaaacagtaagatagtctcagaatagggagcggctccaggcagtaactggaccacttacgaaagtgccttgccttgcctgcaatgcactggcctgaggggctacatgaagggatatcccaggtgacggtttcccttgcactaggccgaacctatagtatagaaatattatccattttattaccttgaatatttaatatttttcactgggaggtttgaagcttacaaaatgagaatgtgccatgcatgaagcaaaggattccaggctccagaaaaaatgaatgaactcaccttgacgtcaatgcaattgaatcaccgttgtcattcagcgagcaaccaatgtaggattgcccacagtttttctttttaaaggtggttttcgcccttcctctcccacattatttcttaatctgaacatgaaggctccattagcaacactaaaaattgatcattaacagcccctgtgcatatgagtggatccaacggttc

SEQ ID NO: 510943 - DNA, 382 bp, Homo sapiens
  misc_feature (19)..(19): n is a, c, g, or t
  misc_feature (34)..(34): n is a, c, g, or t
  misc_feature (60)..(60): n is a, c, g, or t
agggttgggtgcttttggntggaggttccttccnttggcggtcccaatagagcccggggntatttccactggccaggttcccgggtatttggttgaccccagcttggggaggagggttggtttccgttcctcaggggtttagtccgtcccaccccttcccttccctggggccccgggcccaggcccctcaggtgtaagttggttttgatggcctcccattgccccacacgccgggggacctccaggggggattttagtggcctgaggaaatgtatttataggcccccagcaggggtgctcccccctcggccggtgccccaggatgggttcctcccgggggggggttggccaaagcttttttaataaaatgcctttcccctca

SEQ ID NO: 510944 - DNA, 243 bp, Homo sapiens
ggggggggggggggggggggccccccccgggtttattttttttttctccctccttctccccccagggggggggggaagggggggggggggctccccccccccccccccggggggggggggggggttttttttttttcccccccctttttttcccccccccccgggggggccctcttttgggggggggggggggggcccgggggcccccccccgtgggggggtcgccccccccccctttttttt

SEQ ID NO: 510945 - DNA, 928 bp, Homo sapiens
  misc_feature (729)..(729): n is a, c, g, or t
  misc_feature (749)..(749): n is a, c, g, or t
  misc_feature (783)..(783): n is a, c, g, or t
  misc_feature (791)..(791): n is a, c, g, or t
  misc_feature (797)..(797): n is a, c, g, or t
  misc_feature (804)..(804): n is a, c, g, or t
  misc_feature (907)..(907): n is a, c, g, or t
  misc_feature (910)..(910): n is a, c, g, or t
  misc_feature (914)..(914): n is a, c, g, or t
  misc_feature (916)..(916): n is a, c, g, or t
aaaaggatcgaaagggaccaagcagctcactacgatatcaagttacactaagacttggaacactaacattctgtaagaggttatatagttttcagtgggaggggttgggatgggtaatctcatttgtacatatagcaatttttgatgcattttatatgcataccagcaattattactgtgttcgcacagttctcacttaactggtgctatgtgaagactctgctaatataggtattttagcagagtcttcacatagcaccagttaagtgaagactctgctaatataggtattttagaatgtgaattgaagaatggatcccaaaaacttcagaaagaggatagcaaaaaaagatctagtgcgattttatatatatatatatatatatacatacatatatatatatcatatagcttaagctgatttaaaacaaaggccttagactaattttcgattttctttcttgaaataagctaatggcttgtttgtgtaaagcttttttattaaaagaaaaattttaaaaatcttgtacctagcacagtattgttatagaatatacatgtaacattttatatggtagtttaagtctgtcagtttcttaattgtggacaaattaacagttggctctggccttttgctgtaacatgcctgtgtcactcacttagccttggcatttgtgcagacataccattttcagttctgctgtcactggaagttcaggctcagacagnaattttggcgagtgaattcnaaaaccggaatttttcttgttttttttttttttnttcattgnaatttnagaaggnaaataccagtgttcagttttgaactataatagtttgtatattcaacatttgaagtatattctattttgttgtatcttgtttcaaatgtatcaagtaggttttntgnaaananaaaaagaaattt

SEQ ID NO: 510946 - DNA, 883 bp, Homo sapiens
  misc_feature (1)..(1): n is a, c, g, or t
  misc_feature (719)..(719): n is a, c, g, or t
ncgaagatggtgtgctccgcttcccctgttgagagttgttgttttaaaagtgggggccccacaattatattggggtacgtttgcccaatggggggtcctgttccgttcgagtttggtcagggaacacttgtggcccccaattttagtggtttacggcatactcaattggtctccctctcgcgttggcgtcctcacacgagctgtgttggtgggtcgtcgccgcccccccactcagttgatccttcgggggactataatggcctctccacccgccgcgcgcgcacgccgcggtcatggtttacatttctagggagaaagataaatgaggcgttaatcccccaaatctgagcgcacaagggtgagagcctatgggttaactgcttcaggctccctccgtcggggtgtctcgacaccctccagtgggagccctcgaaccaaatacatcggagtgatactaaatcacggttgagagctcacacgcaagccactgggccaactcctccgcaaatgtctcaggacatttcattcctcacttctcccggtcttgtgtggacctcctctctcccagaccgcgctttgtcattccggtgagttccttctactctagtggcacgcctcacttacaccggtctttcgcgaccgtgcccctttgcgcggccgggtttattccctcctgcctgaagtatcagcccacctcggtcatttacaaggtgcggtgncctcttgcctggtagccccacgtcgtccgggctactcaccctgattgggtgccggagacacgccttagagtggagttctgcacaacccacggtgccagcggggggttaaaacaaaagaacttggcccaacatgtaaggagaacagggggaacaccccacataac

SEQ ID NO: 510947 - DNA, 456 bp, Homo sapiens
tctggcgatcaacttctttcctaggaataaattagagataaaatagatataccaatttttaccaatgaaataattggttatttgggaatgcctcaacatagcagagatgtaattttcctatattgaaaagttaaataaaaggtgggggggggggagtgcaagaaagaaagagatggagaacgagagcgatctggagatgaaccacatgcgatgagtaggcctggttgggatcctgaatcgaacacaccaacggtaaaaatatgtttaagacgcatcgggaaaatggggacagggattcgatattggatgttttttagggaatggatgtcagtttttttaggcgtcacagtagtatggggattatgttttcaaatggtcctttttggtagagacatacgaaaatatttagggattaaataaggtcggggatgggcttctaaatacattaatgactag

SEQ ID NO: 510948 - DNA, 341 bp, Homo sapiens
cagagaatacgagagcagttccacttgccgtgctttgttaatcatagctcatggatcctcttggcctaacatacccaaagactccttgtaaagatatagtactggttctccccaaactattttgagaggaagaaaagtcttgtattctgagtactacttttttacatttccagtagtaagtaagtgctggctccaccaagctgagaagaaatggcccttggttgtactcggggccagtgctaagaactctggaccaaccgtctgtagtggggcatgacttcgtgctcgggcaagtggagggcgaattccaaggccaataacaccggggattcaaagtcaat

SEQ ID NO: 510949 - DNA, 185 bp, Homo sapiens
gggaagtgctccttggagagtagaggtggagactcagcctttcagtgtattgccgactcttgtctccttcttcgatacctatctatcccacaagggtcattctttggggtcagctctcgtatgctcagttctgggccggttcctttgggcctgcgcccttgagtgacgtgaaggcaaatagactt

SEQ ID NO: 510950 - DNA, 467 bp, Homo sapiens
aggagctagtacagcacgagggtggagctgaagtacacaggcaggggggcgcactctgcatcctcccagatcaagacacgatggcggcagtggacgccatgctgctcccagagaccctgacgcggaggagagactctctggagtacagagagatcggtgagctctcactgccaaagtaatccatctcggggggactataacctagaacgacataacttctccagctgcggcatagaggaagccttcatcagcaaggctgacctgtcagggatcacaggggactaggaacctacgcagtctcccaaggtggatcatacggctgtgcttgatgtatttgaggagggcacagaagcatctgctgccacagcagtcacgatcaccctcctttctgcattagtggagacaaggaccatagtgcgtctcacaggcccttcctgatgatcattgtccctacagacacccagaac

SEQ ID NO: 510951 - DNA, 114 bp, Homo sapiens
tgggctgggacaggaacttgaaccgttctctggccttgatggcttctcagagacatcttaaaacacctgatgaaggatatgaagagagactagagatttagcacggagcaaggt

SEQ ID NO: 510952 - DNA, 191 bp, Homo sapiens
agaggatccggtcgctcggacatcacaagacgtttgcattcatgagctgtccccacattagcgcttaaaaacagagtgcaattcccggacgtctaaaccaaaccactttcaccgctacacgacggggtatactacggtcaggctctgaaatctgtggagcaaacccagttcatgcccatcgtccgagcggt

SEQ ID NO: 510953 - DNA, 309 bp, Homo sapiens
  misc_feature (7)..(7): n is a, c, g, or t
  misc_feature (43)..(43): n is a, c, g, or t
  misc_feature (265)..(265): n is a, c, g, or t
atgcacntgcttacccacaatttgatgagttcgtatgtgtggngggtgcggtctgtggctttccccttgcgcttctaggccaccgaggtccgtatttgccttgtggaattcaaccctaacttcgtggcgtgtatgatacttaaagtggagtggtcggtgttcttggaggtggctgataacttgtgtctgatccaggtgccgaaagggctggttgagggatatgaggagaatgaggagtttctgaggaccatgcaccacttgctgntggaggtggaagtgatagagggcaccctgcagtgcccggaatct

SEQ ID NO: 510954 - DNA, 367 bp, Homo sapiens
  misc_feature (123)..(123): n is a, c, g, or t
tgccaaacccttccctggggggtttaacccaaaacagggagatgggccaccccttccaaaaaaaaccccccgaatgcagtttttgcttggctgactgggcctgcagctcccctctcctggganttaaaggtggcccgatttaaggcccccctactcatccaactcccttttccctggggctccccatccatcaaaaaacccccaaattttaacttatgtggatgggaatatgggaattagggtgggggggggggattaaaggaaaaaatccctgtgctttgttcggcctggtgtgccaggatggttggtggttttccccccttggatctttttttactgttttttttataaatgggatgagagggga

SEQ ID NO: 510955 - DNA, 1017 bp, Homo sapiens
  misc_feature (427)..(427): n is a, c, g, or t
gcgcggagcatgaggccatgttgctggctggtagctgcggtgctggtcagagcatgcggtgtgactacgcagctcgcctggccgactgccccgaagtggaggagatacgacgctcatgacgtggcgagtgcgtgaggttgtgcatagtagtcgtcgttcgtgtcagacgcctcggggcacacagtacacgactaatgcgattactatcctggtactcggatgagctctcttagttccgcctcttgccacttcccagtccgcagagatttgcccgtatgagaaaatacctgcacagacctgacgcaggtgatcgttgtagaggggcggttggtttacaatggaacggacctcgtcacggacacgtgggctcttgggtcctatgatcctcaaacctggccagatctcagagagagagagaataacatgntacgttcaatttggtgacagaaatggcggggcaagtagcgaaagaaaatgtggtgtggctgtcatgttagacagcgaagtgcaagtgttaagcgtgcatatacacaaattcgcccaagtaacttgggcaggagatgtttacatataaagcatgagagcaacttcagtaatgtaagggcaaaatgtgggaatggggtggacattgtgtctgaaggacagctcaatagggggcgaaaggagaggtggatttggaaccagaattgcgtggattctaggggctatggtgaacaagttagcaacgtttgggtgggccttcgtcgcaaaaatgacgcctgagtttcgcgctggtgtcgcggagaggttgggaatggtgtatgacatgggtcgaatgcccggaggggttggagaacgaaatatggaatgcaattcgcaagtatacacaagttaatgctcttcgcattgtggaaccacaaactgtagattaacgggattattcaaataacccttttatcttcttatggacggtgattcaagggggaagatgggtaagaggcgtgatttcaacgtattcccggggaagttgttggttga

SEQ ID NO: 510956 - DNA, 663 bp, Homo sapiens
cagctgggggcgccatcctgctagcagcctctactctcctgcaggtggcaccatccaaggtggatggcacatcccacgtcactgggaataggagttacggttgaaacagtctgttctgtggatgagttagctgcatctgtcctcactggtaaaactgaccacatggcttccttccaattgtctacacaattgtgttggtggtgggtttgccaagtaacggcatggcccgtgtgggtctttcttttccgaactaagaagaagcaccctgctgtgatttacatggccaatctggccttggctgacctcctctctgtcatctggttccgctgaaagattgcctatcacatacatggcaacaactggatttatggggaagctctttgtaatgtgcttattggctttttctatggcaacatgtactgttccattctcttcatgacctgcctcagtgtgcagaggtattgggtcatcgtgaaccccatggggcactccaggaagaaggcaaacattgccattggcatctccctggcaatatggctgctgattctgctggtcaccatccctttgtatgtcgtgaagcagaccatcttcattcctgccctgaacatcacgacctgtcatgatgtttggcctgagcagctcttggtgggagacatgttcaat

SEQ ID NO: 510957 - DNA, 418 bp, Homo sapiens
agaatatcctataagagtttatttaacgtttattgaaacctaagagaaatgtgtgtgtgtgtgtgcgccgcaccagtggcttaactaagcaacttgttattgaaagtgttaagtcagttgatctagttgctttggctcttgcaatacagtgtctatatatgaggagccatactacacttttcttggctgtaaccccctgcttatttctttttctaatttacttttctgggctgtccacgaatgaaatctcataactcctgcagtttatgaaaataccctttaatctgacgtgtcatcgttcacccattgtgctgtaaaaaaatcagaccagacgggtttgtcatgccctgcctgaaaacacagaaatctgcctgtaaatacttttcaaaatgcccatttaataaagactttttaaata

SEQ ID NO: 510958 - DNA, 339 bp, Homo sapiens
gcggaccctagttagaagttcaatagcactagttttagaagtttcaatagcaaagcccaagggcagcacctctgtttatagcgtaatttactgaatattggcagcctactatggagaccttggtggagaagaaagatttcctttcgaaatatggctgttattgacagtgacctgttcacgcaagagctctgatgcaggtgtacaaggagattaatatagtttttatgcctgctaacacaacattcatttggcagtccatgaatcaaagaatgcctccaacttttaagtcttatcatttaagaaatacatttcataaggctatagctgctattgaaactt

SEQ ID NO: 510959 - DNA, 666 bp, Homo sapiens
  misc_feature (326)..(326): n is a, c, g, or t
  misc_feature (600)..(600): n is a, c, g, or t
attctagaggccgaggagagtgaaataccaaattctgcagtgactatcttaaaataatttttaaattttattttattttatttattaatttatttgtgagacagagtctcactgtctcactctgtcacccaggctggagagctgtgcagtggcacgatcatggcagcctcaatctcctgggctcaaacgatcctcccacctcagcctcccgagtggctgggactacaggcacccaccaccacgcctggctaatctttgcatttttagtagagacagggtttccctgttagccaggctggtctcgaactcctgacctcgtgatccgnccgcctcagcctcccaaagagctgggattacaggcgtgagccactgtgcccacccttttttttgtattgttaacagaggcagggtttcaccacgttggccaggctggtctcgaactcctaacctcaagtgacttgctcgccttgggcctcctgctaggattacaggcatgagtcactgcacctggccagagttttttattttgcatatattttctagttttttgttggttttagagacgaggtctcactatgttgcccaggctggtcttgatcntctgacctcgtgatccctccgtcttttgcttcccgtgctgagattccaggcttgagccccgcttcc

SEQ ID NO: 510960 - DNA, 1219 bp, Homo sapiens
gggcggagcagggctaccatggggcacacacatcgcgctgcaacatccaaagccacgctggcagcaacatcacccaacctccggacccgtgggcgcaggacttccggttggtacctgaagatgcacaatgtggcacactgtaggtagagcattatcaggcacaagatgtgccagtcacatcactggcatgcattggcacaagtttgtggcaacatcgaagtggagggccagttggaacaatgcattccaataggtcccagcaagatgccacagaatgtgtgccaagcagcacacaattccccatcgcagcataaatcaagccagccacccatccaagccattcaccaactgcctgcacagcaccaatgcagcacaattccacagcacacatcagcaggcagctccgcagtgcccgagaggcccatagaaacaccacagcctcagacatacatcccacggcccagcacaaaagacatggggaaataggactggcctagacagacgggacgcatggcagctacagagagacaacgcaccttcaaccagaatgacacacatctacatatcactggcaccagcagccaacgcgcaccctggagaacacctgggcaaatacgaggcacgaggaacaacccaaggagcccacacagagccagactactaggacgacaaccacctcctcacaggaagagacgacaaacaccacacccacgagaaggagcgacaacgcagcaacgacgtccgcacatcctgacaccaagacacgcacaagagacccccaaacaggagactgcgaacacacacggagcacaacagaacccaccacaaaggaaacgacgagaacacacacagaacgacagcagccgacaccctttaaggacaccagaaggacacccaaagggacgcgacaaaccaacagaccatacacaagcaaacacagcgaattgcttggcgctacacaataccagacaagcccaaacacacaccaagcaaatccaaggcacccagctacccacaccacacacagaagtccaagaacggcacaacaacacggcggacacgccaaaccaccacacaacacccaacacactcacgacccgcccacacaccgccacacagaacagcagagaccagaaaaaacgaaacgagcaaaacccggcaaaagcaaaaaaatcaaaccggacccaagcaccacaaaagaaagaggacaagaaagagt

SEQ ID NO: 510961 - DNA, 452 bp, Homo sapiens
cattgttgaggcagtggaactgatagacagcccatatctatgtacagaaaccacaagacaaacagggtaagtgaggagctactaaaataacatgtggcaaacagaacctttgttaaacttgttccctatcgacattactcccattccctaaccaggaagttttacctgcttagaatcttcttccatgtcacttgcttagaatcccttttcatctcaccctatagacaaagtcttacacagatgctcctcatgttaacaattggtttacctggatgtaatcccatcataagctgaggaacataatggaagtgcatcatcataaagctgtaagttggaccattctgagttgggaaccatttgtactttaagtaccaaataaattaaatagcaagggatatattatctttcaaaggacagctagaggaagaaggtaattaccactaaggggatac

SEQ ID NO: 510962 - DNA, 218 bp, Homo sapiens
tctttcttcccaacttttattttaggttcagggagtacatatgcacatgtgcaggttttatacgggtaaactctgtgtcatgggggcttggtatacaatttatgttgtcaccccggtaataagcataatacctaataggtaacttttcggatcctcacccccctcccacccttcaccctcaagttaagccctggcttatggtcgacgcggccgcgaat

SEQ ID NO: 510963 - DNA, 80 bp, Homo sapiens
ctactcctacggccgagccctgcaggcctctgcactgaaggactggggcgggaagaaggagaacctgaaggctgcgcagg

SEQ ID NO: 510964 - DNA, 609 bp, Homo sapiens
cagtagctattcttgatgttcctcgtatattggtatccaatgctaggcgagcgtagtagctgccccgactcatccatggtcatcctggacacctggttcggtgtgagctttcccagcagtaaggagtcgttctcccccgtctctgaatcccagtaattaatgtgtccgtcgtggctcccagagtaactgtaggacttgccgccgtttttatacaccgtcagacactggatcgatttactgtgacccttgatgacgtgcagggcattagctggggttgtatctgtccagatagttgatgtacccggacagggagacactgagcaggtggtccttctgccataggcagcccatgctgctggtccagaaccgtggagccccatggaaaatgtgctgaccacggattccacgctgactgtccaaatcttggaagtatgggtctccagaagcagaaagcaaatgggtgctgtcgggactccgactaattgcgtaaatcccagcgtcgtgagccttttttccgcccagcgcgcacaccttctccccagtttcccgtatagatgtattctgggcgtcagaatggtttggaaatcttgtccatcaggggaaatcgca

SEQ ID NO: 510965 - DNA, 134 bp, Homo sapiens
  misc_feature (78)..(78): n is a, c, g, or t
  misc_feature (82)..(82): n is a, c, g, or t
atcttcccaaaatcctttaatttacctgatgccctcatcaggtcgttaaaaattcaaatggttttaatagcttcctanctgncggttaagctctaaaacaaacaaactacagaaatgtaaaccttcatttgcca

SEQ ID NO: 510966 - DNA, 408 bp, Homo sapiens
  misc_feature (22)..(22): n is a, c, g, or t
  misc_feature (59)..(59): n is a, c, g, or t
  misc_feature (158)..(158): n is a, c, g, or t
  misc_feature (177)..(177): n is a, c, g, or t
  misc_feature (183)..(183): n is a, c, g, or t
aaactgaaacctaatgcccttnaaatatgggccttaaaaaacggatcgccccggaattnacccgcccacccatcggaccctaatgccccggtaaagaatgatatctccggtgcgcaagcggttcaccccaagactggcccattttgccgtgcccagcnagacggccgcattaaagcnggatgncccccaggcacttctgccgcgcccgctagaaacctcttcgttattacgcgtcatcttcatggcgcagtttttcaggtctaaccccgccggacgttgcgccggaccgccgatgacatacaccccacaggaggcgttatctgccacggtatcgacaaactgaatcgaccaggtcgcgaatgcggctccccaccacttccagcgccggaagtacccattcaatggcgt

SEQ ID NO: 510967 - DNA, 101 bp, Homo sapiens
agcgatatgcatatgcttgttaagacaccaattccgttatttgtttcagattcaaacatacttcccttttactattcacaagaaccattttataccaatcc

SEQ ID NO: 510968 - DNA, 193 bp, Homo sapiens
taactgcatagacagggagtgcatagcttggcctggcgacgagtcaaggagaagctgcttaggactatggagcacttggggtcaaagacctcagaaagaagtcctagatattggcgatatgctaccccatatcatgcctgtagcctacagcacagtgccaaatagatgccttttctagacactttacccataa

SEQ ID NO: 510969 - DNA, 140 bp, Homo sapiens
aattcctgggatcctccggccgccacgttgttcaaattaaaatttgtgccgtaagaaccccaaaaagtttaagggaaaaaccccccattaaagttatggataaaaattgcacacccccaactcaacagaaataacttacc

SEQ ID NO: 510970 - DNA, 316 bp, Homo sapiens
  misc_feature (40)..(40): n is a, c, g, or t
  misc_feature (115)..(115): n is a, c, g, or t
  misc_feature (156)..(156): n is a, c, g, or t
  misc_feature (218)..(218): n is a, c, g, or t
  misc_feature (247)..(247): n is a, c, g, or t
  misc_feature (257)..(257): n is a, c, g, or t
  misc_feature (278)..(278): n is a, c, g, or t
  misc_feature (281)..(281): n is a, c, g, or t
cacgcacaccaggttcttcattgggccagccatccaggtnctgtgtcctccccgtcagatgatgccattgccagcgtagccagggcttgcactcggcagtggtacatggggttcnctatagtggtcccaggtagttgcacttggtcgttcttgttntcagtcgtgggtcccatccgtgcaggggttacgcgggcttgcacacctgtttgtttgccgtngcatgttcgacaccctggccgaaggctgntgagccggtnaagcgtgggggtcagggcagncanttttagccgggttccgtgttctcacaccggtgctc

SEQ ID NO: 510971 - DNA, 971 bp, Homo sapiens
  misc_feature (899)..(899): n is a, c, g, or t
aagtgtaaggtgacaattaagtaagaaacgcggctccctcctgtcggaccccacgcttgagaacctcacacactcaccacctccccatggcataccaaataaccagtaacttacaacaaccgagagagcaccgatgcacttgacattttctaagtcttcatttgattgtttttgtacagactcattctactggaagtatatgaatactaactcactgacaactcattaaactcgaactttataaaaatatgatcctaagggccacaatgcccaacttcagtataggacctctctaacatattgaaagcacggatctccaaatgtaaatatttcactagccacttctgcagttgtagtttacgctcaagtatgattcccaactccccccttaaaatatcccccgctattaactacctgtccacctagaagaaagacacccactccacccgttctcgcccttaccctgaatgatacactcttcaagctccccccacccactaacgatgcacaagaacgcgccccgccccgcgtcttcctggtcgccccatgtgagcctgactcacggggcttcgtttgggaggctgtagcctcattccttttcgccgcgatttcttcctcccaacctctcatcttcgtcccacactcattctcccacaccacctcctttcctcctcccgccccccccctccccgaccccatatatattttcttatcccaccatatcccgaaaccctcactgatgctgaaccgacccgtctagagtgtagatcgacagaagaaacatagagtaatacgaatcgctgctaatttccatactctctcctgtagctgcgtccttggccacggctcttcctccaccgcacgcgctccgcttcgcctctagatgctttcacaccccncacctcgctttcctccctcatgtgaattttaagagtaggcaactcgggagacgcgctgcacggatctcgagt

SEQ ID NO: 510972 - DNA, 222 bp, Homo sapiens
gttgaaaagtgtagatctgccagcctgggcaacacggcaagaccccacctttacaaaaaatttaaaaattagccaggaatggtggcacgtgccagtggtcccagctccgagggagactaaggatacaggatcgcttgagcctgggtgctcaaggctgcagtgagctgagattgcgccactgccctccagactgggtgacagagtgagatttgtctcaaaaat

SEQ ID NO: 510973 - DNA, 138 bp, Homo sapiens
ggttgtagggctgggctcccaaggccttgggcagcttggcacctgtggctttgcagggtccatgcctctcggccgccctcaggggcccggctggtgccgagcgcccgtgacccttccccactaaggatacaagttgtt

SEQ ID NO: 510974 - DNA, 756 bp, Homo sapiens
cgttgttacccgcgcacccccctcgtttatatcccgagaagtgtgttctcccaagtttcttgccggggttgatcatcccggggacaaaatattttgcgcccccgcgggaaatttatcttggcgcccccattattctcgctccgcccggccgagggagaccccccaccatatgtgagcgacaaaacgaagtgtagctgacagccccacggctgtccttcttctagtcttctccctggcgatcgtgaccactctctgtctcgcctcacaggttcccctctttatatagaacaacatatgtggagttggcgccccgccctagggagcgtgctccgcacgaccgccggtggcttttcgagggtgtccacacaagaacctcccccgccctacagagtgtttcatatgggcgcccctcttatcatggcacgcatggcgcgtactgttgttgtctcaccatgtgaagcccgtctactggggcccccgtgcgcccgtatatctgctttcttctatggcgttcttcataggcgcccctccccttttgcgaccccgttatctcccacacctccctcctctcttgttcctctgcaacgcccatccctttcccgccctcccctccacgcttcaactttttccccctccttattggaacgccaccacccgaagggcccccttcagctaaataagagagcgccctctccgttcatactgctacaataatacacaccactcctgggacaaccacatcattaatacaaacaa

SEQ ID NO: 510975 - DNA, 108 bp, Homo sapiens
gctgaaaaatctcacccagtatagctggctgttggatggttttccaaggacacttccacaggcagaagccctagatagagcttatcagatcgacacagtgattaaccc

SEQ ID NO: 510976 - DNA, 364 bp, Homo sapiens
  misc_feature (281)..(281): n is a, c, g, or t
  misc_feature (355)..(355): n is a, c, g, or t
aaggccttttaccagcactcttcaagctcagtaggggaaagacttcaagcactcaggaagcatgcattcactttatttggaacaatacccttacttgtaactgtgcctcaggtgccatagtccacagagacttcttttacctgtccagagaataaaattagttgtctgttggggtaacaaaaagtgtggagctgaagagggtacctataaatgaagttgttttctgggccgggcgcagtggcttcacgcctgtaatcccagcacttcgggaggccaaggtnggaggggatccactttgagtccagggagttttgaggaccagcctggggccaacatacttgaggacttccgtctnttcccaaaa

SEQ ID NO: 510977 - DNA, 122 bp, Homo sapiens
cggacgcgtgggtatatattaaaggatttttctaggcaagaagctcaacttttttgccccataaaaataatttgtgcttaaatagtaactcatggttttcttttattaaatggggttgttgt

SEQ ID NO: 510978 - DNA, 814 bp, Homo sapiens
gcccgtcccgtcccgtcctgtgcggccccgtcccgccgccgcccgccagccatgagctccacgcagtcaacaaggcctcgtacgggtgtcggcgaaggtcaagaacggtctgtcaaatagaccccagaaggaggagagctcgcactggatcgagggactcacggcctctccatcggccgattccagaagggctgaaggatggaactatcttatgcacactcatgaacaagctacagcgggctccgtccccaagatcaccgtccatgcagaatggcacagctagaaaactgtccaattcatcaaggccatggtcagctacggatgaccctgtggactgttcgaggccaagactgtttgagagtgggaacatgacgcaggtgcaggtgtctcttctcgccctggctggaaggccaagactaaggggctgcagagcggggtggacatggcgtcaagtactcggagaagcaggagcggaatttcgacatgcaccatgaaggctggccagtgcgtcatcgggctgcacatgggcaccaacaaatgcgccagccagtcgggcatgatgcgtacggcacgaggaggcatctctatgaccccaagaaccatatctgcccccatggaccactcgacatcagcctccagatgggcacgaacaagtgcgccagccaggtgggcatgacggctccgggacccggggcacatctatgattacaagctgggaaacgacaagtgtgacaactcctccatgtccttccagattggctacacgcgggcgcaaacaggagcggccagtttcggctgggcgggatatatgacc

SEQ ID NO: 510979 - DNA, 248 bp, Homo sapiens
cacgggttcctgcccatgttgtgtaggacagtgttgtgcatagcaggcatggctacttatccttagaaaggctgcgtactaaggccttgtgtggagtctaagaactcaaatttcaggagggttcccacaatttccagactgataaaaagtggctcaatgtgcctaaactgttcatacaaacaatttggtttatcataaacacctgtttccttctgggagtcttaaaattttagtacatgggcagggag

SEQ ID NO: 510980 - DNA, 656 bp, Homo sapiens
ctgacagtccaattcagtgattgtggattgtatgacttacctagtccatccatactcatatgatcaaatatataggtggaaacttggaaacaattagcatgggtctcttgtggatttaacttgaggtttagtgaatattcataaacctgttgctgggggagagaaatgaaagttaatggagcatgcttgctgatgagagagggatttgtaatttaacgtttgtaagttatagtttacttattgtctttagaagttagctttatacattatgccccgaactagatggcctagagtccaacatgacctttggagatgacataagttgtctccataattgagtggatagcgtttaaataaaaagattagtttggcttaaggaagttatgtaacaattgagtcagccctagtatgaacttaactgtttcaggccatatatgaatagcataagtggagttataacttatcagccgtatatggagcataaatagtttgctagctgctgagtttagagaagctttaattgtggttctaataaataccagtatggatagtgatgataggaatccaggatgttgaagaaatgtggcataatgtcgtatattttggaacagagaggaaaagtcactgaagaatagtatgaagtattaaattcctat

SEQ ID NO: 510981 - DNA, 919 bp, Homo sapiens
gatgacgccggtgcagcggggtggggccgggggcctggtggccctgggatggggaaccgcgtggcttccgcgaggttcggcagtggcatccgggccggtgtcgcggcgtggacggggccgggtgcgatggccgcggagtcgcggaggcagtgccgggataaggagtggatgcccgtcaccaaagttgggccgcttggtcaggacatgaagatcaagtccctggaggagatctatctcttctccctgcccattacggaactcagagcaatcatttgatttttcttcctgggggcctctctcaaggatgaggttttgaagataatgccagttgcaaaagcaagacccgtgccggccaagcgcaccaggttcaaggcatttgtgcaatcggagaactacaatggcccacgtcggctgggtgtaaagtgcctccaaaggaggttggccaccgccattccggtgggcgccatcaatcctgggacaagcttcttccatcggtccccggtgccgcaagagggctacttggggggaacaagatcggaaagccccaaagtgtccttttgcaaggtagacagggccgtgcgggtatgatctaggtacgcctcatccattgcacacaggggcatggatcggctccgcacttgtggcctaaaagctgctcaatgattgcctggtatcgatgagtgctacacttaagcccggggctgcaattgccaaccttggggaaatttcggcaaggccatcctgtgatgcaatttctagaacctaaagtaaccttgaacccgaactctggaaggaactgtatcaccagtcccctaaaggagtatgacccttgtagaccaacaatccggggggatcaggccactgggtcaaaaggtttatcgaacaaggtacggtcgtaagaaaacacacaaaaaggggg

SEQ ID NO: 510982 - DNA, 127 bp, Homo sapiens
caagtacatcgatcgtcgatcttgagttgatctccccgcgatttgtccacgtagagctcaagatgcacctctcgtggtgaggtactactgcagctcggacaggaacagtacgctgggtgtatctccg

SEQ ID NO: 510983 - DNA, 626 bp, Homo sapiens
  misc_feature (39)..(39): n is a, c, g, or t
  misc_feature (75)..(75): n is a, c, g, or t
  misc_feature (82)..(82): n is a, c, g, or t
  misc_feature (110)..(110): n is a, c, g, or t
  misc_feature (136)..(136): n is a, c, g, or t
  misc_feature (168)..(168): n is a, c, g, or t
  misc_feature (193)..(196): n is a, c, g, or t
  misc_feature (212)..(212): n is a, c, g, or t
  misc_feature (221)..(221): n is a, c, g, or t
  misc_feature (237)..(238): n is a, c, g, or t
  misc_feature (242)..(242): n is a, c, g, or t
  misc_feature (253)..(253): n is a, c, g, or t
  misc_feature (256)..(256): n is a, c, g, or t
  misc_feature (260)..(260): n is a, c, g, or t
  misc_feature (269)..(269): n is a, c, g, or t
  misc_feature (273)..(275): n is a, c, g, or t
  misc_feature (297)..(297): n is a, c, g, or t
  misc_feature (306)..(306): n is a, c, g, or t
  misc_feature (320)..(320): n is a, c, g, or t
  misc_feature (329)..(329): n is a, c, g, or t
  misc_feature (362)..(362): n is a, c, g, or t
  misc_feature (376)..(376): n is a, c, g, or t
  misc_feature (384)..(384): n is a, c, g, or t
  misc_feature (395)..(395): n is a, c, g, or t
  misc_feature (398)..(398): n is a, c, g, or t
  misc_feature (438)..(438): n is a, c, g, or t
  misc_feature (487)..(487): n is a, c, g, or t
  misc_feature (511)..(511): n is a, c, g, or t
  misc_feature (521)..(521): n is a, c, g, or t
  misc_feature (524)..(524): n is a, c, g, or t
  misc_feature (527)..(527): n is a, c, g, or t
  misc_feature (569)..(569): n is a, c, g, or t
  misc_feature (587)..(587): n is a, c, g, or t
gcataaaataatatgctaaaacatttcatgcagaaagtntcattaaatatacatttcagcttatatccatttccnaaaaccngattatccccaatacaggaataaaaganttagaaagccaacaaacagctttaanaatgcaatccttgcagccttaaaacatttatnaccactacatatacaaagaaaatgnnnncaagtgatgtggtgangggtttcanatgaattccgaatggnntacnacactgtaatngtnaagngcagtaaangggnnnctgacctgagcccctgccagantggcttccncatagattgccatnctatccccnataggcctcgtcattggctcaataagtccaagncaaaaccaatactnaacaagcntttcggcatcnggnatatttttaatcaggtcattcagtgtgaccagtatatctncttttggacatccctcattaatcaagtccaggcattcagaaaatgtgtngtgtactttttcagtaaataatcnttgtccaccnccntcngcacatgggagtccaaaaagaccacaactggtttttcatttngtcctgcaggctcatgcngagtaactactgaattagggggcctttttagcactcttc

SEQ ID NO: 510984 - DNA, 965 bp, Homo sapiens
agtgtatgccacactccgtgggcaggtgtactgttggtggaactcctgtggcatctagtgctctggcaattgctaccagtgcggtcatcggcttcccagaatggtgtttcggggtatcgtcttaggttgtgcgtgaacgcgcccttgtggcgtcctcctatgcgcttgtccgttgtgcgctcagcaccggaggaggtgtggcggacccctataaaatgcccactttgcaatcgctttactcgttgcgtggaacattctgtggccccgctggcacagcttccggtgctgatcatatgtggccgcgaccctgggtgccgcctctaggttataagcgagctattttgtacccgcgctatccctgcctcgattgcatgccacggggacacgtgggtccactgtccttgggtatggcggggcatatgtgccaccgtgggagtacgtcacacttgtccatgtgggaacccttggtgtctcatgtgcgtttcaccgccggagatatgcgcctcggccgggcggcgcacgtgacaagatagctggtctatgagggcgacctctctgcgcctagcaccagcacttgccctattggagatatgtgacaggaggttggagatggcacagcgtttatacgagtgggagggaggacgaaccggtcgcgtcgtaatacgagttattctggagcaactgagtcgcaggtgacgggaggccagtacgacggcggcatcagtgtatgcaccaagcatcttgtggcctacacggatctctctgccatcacccggcattctagccgcagggcccactggagagctgatcccgctctgagtcctctgcccctttccaacggacaactaatcgagcactgggagggtggcagggaggaggggacagcttcaccaccttggaagtcctaggggtttatcctcttccttctttgtggtttctgtttaccacctagagaagagctattc

SEQ ID NO: 510985 - DNA, 434 bp, Homo sapiens
gtaacccagggcctgcgtatacagtaggtaaactgtatagcctttgctatagtaaacatcaacaataggataatgcctagataagggttattagtttaacatgcaacagatgtgttaagtgcctactgtgtgtcacgtactactaaggatacaactcagtgatcttgagaagaaacaaggtgcatgctctcatgcagtttgggaagccttggatagacagtaaaaacataataatttaatcaaaacatgggtgaaagatatttttcaagacatacagatggcaaacacacacatgaaaaggtgcacagtatcattgttcatcagagaaatgcaaatcaaaactacaatgatatatcacctcactccagttaaaatggcttatatccaaaagacaggcaataacaaatgctggtgaggatatggagaaaagggaa

SEQ ID NO: 510986 - DNA, 273 bp, Homo sapiens
  misc_feature (83)..(83): n is a, c, g, or t
  misc_feature (237)..(237): n is a, c, g, or t
ctgtgtgtcctaacccaaatctcttctggaattgtaatcaccacctgttgagggagaaaagtgattggattatggaagtggtntcccctgcgctgttctcatgatagtgaatgagtctcacgagatctgatggttttaaaagttgcaatttttcctgtgctcactctcacttctctcctgctgccttgtgaagaaggtgccttgcttcccctttgccttctgccttgattgtaagtntcctgaggcctcaacagccatgcggaactgtgagtc

SEQ ID NO: 510987 - DNA, 1154 bp, Homo sapiens
  misc_feature (30)..(30): n is a, c, g, or t
  misc_feature (408)..(408): n is a, c, g, or t
gctttctgacagtgcagggattctgaagcngtctgcttgagttactgtgctctcttccaaggctgtaggagttctggagctgctggctggagaggagggtggacgaagctctctctagaaagacatcctgagaggacttggcagactccaggttcttcagttttggaactcaaactggctctccttgcacctcagcctgcagatggcctattgtgggaccttgtgatcatgaagtcagggaccctgaatggagggatcggccagagctgaggcagaagaacataaattgtgaagatttcatggatatttatcacttcccaaaattaatacttttataatttcttatgcctgtctttactgcaatctctgaacataaattgtgaagatttcatggacatttatcacgtncccaattaacactcttatagtttcttatgcctatctttactttaatctcttaatcctgttatcttcataagctcagaatgtaattcacctcaggactactattgcacaaatggattgtaaaacatgtgtgtttgaacaatatgaaatcagtatacccggaaaaagaacagaatatcagtgattttcagggaacaatggaagataactataaggtctgactgcctgcggggtcgggcagaatagagccatatttttcttcttgcagaaagcctatagaaggatgtgcaagtaggagaaatatttgctgaattccttttcccagcatggaagaaccctggggaaggaatgcattcctgggggtaggtctatagatggccgctctgggagtgtttgtcttatgcggttgagataaggattgaaatacgccctggtgtcctgcagtaccctcaggcttactaggattgggaaattccagccgggtaaattctagtcagagtggttctctgttctcaaacctgtttcctgtgaagatgtttatcaagacactgtgtgcacagcaggacatagaccctcatcagtaattctaatttgcctttgcctggtgaccttaacggccctttgaagctgtgatccttgtgacctactcctgttcgacacctctcctctttaaatccttataaactgctggtttgccgtcgggtcaccacaatatctacatattgatgacggccgagccactgtaattc

SEQ ID NO: 510988 - DNA, 1243 bp, Homo sapiens
  misc_feature (165)..(165): n is a, c, g, or t
  misc_feature (1243)..(1243): n is a, c, g, or t
aactgggtcacatcggatgctccaaaatggtagccggactggcagagggagctagtgctagtcccaaggttggccactttgccagatcgggcggcgcgagtcggaccctcggtcgtacttgcactgaatggccagtgctttcgctagagatcacagtgaggatantcggctcagtgaaacaaaaggactcgtgttacatgaacaagcgtggcaagactacacgctatgttccactagatactcgggcactgcatatcacgttaacactacagagatagtaacgatgttactggtaatcgtgcaacttgcattgcccttcgaaggaaaatttcataccgaggttatcatgtgattcgcatttccctgtgggctgtaaaaccagggaactcctgagtgataatctctgaggagacttgcgagtgccttattccttagtaccgacaggtactacccaagaagatcaaatttgtgatgatcgaatgtaattccgtctaggcatggagccatgtactaaatcgctcgttaattcgagataacggtatgggatgtttatacttgtgtcttaacggggataaatttagatagatagtctattggggggctcacgtgtggggttggcattgaacatttgggtttgaatttaatgattaattttgaatgggaaaagcacatccatgtggcccctaatggctttagggaaaaagaggagcctataaagtcacgggagctttgtcccagtcccgaagccaactcactccggaagtatcactcgctgggattgtggaactggcaggcgattgtgaaaggttcttaccatatccaggacgcaatccatggggttttacacgtaacacgacggacggaaattgaatccacaatttaattggggacccggttggcgctctctggtgaaacttacaggcgagaattggtttaattagaagagtaaatgaaggaaaccaggttgggaattagaacctcggtgagaacacaggaaccatggtaataggaatgatattgcttcggggggaaatgtagacaaaacgatggtcgggctcttgaggatctatgcccaatgaatcatttgttgtattcctagtaaaagatttagcactcggcttggtcatgtaccattttgagcacggggtgttggatcagacttattggatctaggagagcatggggcttgggagacgaacaggccaacggatattgtgtgaaacgacaagacactgataactan

SEQ ID NO: 510989 - DNA, 152 bp, Homo sapiens
aggctccgccgtcccttctcctggcttttgccctgtttctgcctgctcctggctgtctagcagcgctggtgccggccagcccgttcctgttctccaggctttttgaccatgctatgctcccagcccaatcgcgcgcgcctgctggcccttgt

SEQ ID NO: 510990 - DNA, 883 bp, Homo sapiens
  misc_feature (30)..(30): n is a, c, g, or t
  misc_feature (392)..(392): n is a, c, g, or t
  misc_feature (602)..(602): n is a, c, g, or t
gctttctgacagtgcagggattctgaagcngtctgcttgagttactgtgctctcttccaaggctgtaggagttctggagctgctggctggagaggagggtggacgaagctctctctagaaagacatcctgagaggacttggcaggtgagcactgtttcaaggaatgggctgatggggtcataatccatgataacctcaccaatcttttagagtcacagctggtgagaagagcaaaaatcctcacagaaaagcagaaattcctagggaccatgaaagacagtacctgccaagtcttaggaggaaacactgggcagaggaaaaggcacctttatggcagcaacagggagagacgagggcagctggaaaaaggtggtaacagggggctggtagtngggtggtggtcagagaaggatgaatctcagaggaggtgagaccagaagaatgaagaagagcttattatggaaaaagagagggaccagcaggtacaaaggcaatgtgtagttctgctcaggagctggtacagtaatcttcaattcttattccgtagaaaaaaaggagacagaaatgtcagacactgtgatggttaatactgagtgtcactngattgaattgaacggatgcacagtgttgatcctggatgtgtctgtgaagggatgtgtcaaaaagagattaccatttgagtcggtgggctgggagaggcagacccacccttatctggggtaggaaccaacctaatgccagcatgactagactactagccaggcaggaaaagtatgaccgcgagagcactgggcctagcttgccaggcatagatcctgcttccgtatgggatgcttcctggaattgaacacccaaactccagggtcctccagtttaggactca

SEQ ID NO: 510991 - DNA, 1068 bp, Homo sapiens
  misc_feature (30)..(30): n is a, c, g, or t
  misc_feature (322)..(322): n is a, c, g, or t
gctttctgacagtgcagggattctgaagcngtctgcttgagttactgtgctctcttccaaggctgtaggagttctggagctgctggctggagaggagggtggacgaagctctctctagaaagacatcctgagaggacttggcaggaagtcagggaccctgaatggagggatcggccagagctgaggcagaagaacataaattgtgaagatttcatggatatttatcacttcccaaaattaatacttttataatttcttatgcctgtctttactgcaatctctgaacataaattgtgaagatttcatggacatttatcacgtncccaattaacactcttatagtttcttatgcctatctttactttaatctcttaatcctgttatcttcataagctcagaatgtaattcacctcaggactactattgcacaaatggattgtaaaacatgtgtgtttgaacaatatgaaatcagtatacccggaaaaagaacagaatatcagtgattttcagggaacaatggaagataactataaggtctgactgcctgcggggtcgggcagaatagagccatatttttcttcttgcagaaagcctatagaaggatgtgcaagtaggagaaatatttgctgaattccttttcccagcatggaagaaccctggggaaggaatgcattcctgggggtaggtctatagatggccgctctgggagtgtttgtcttatgcggttgagataaggattgaaatacgccctggtgtcctgcagtaccctcaggcttactaggattgggaaattccagccgggtaaattctagtcagagtggttctctgttctcaaacctgtttcctgtgaagatgtttatcaagacactgtgtgcacagcaggacatagaccctcatcagtaattctaatttgcctttgcctggtgaccttaacggccctttgaagctgtgatccttgtgacctactcctgttcgacacctctcctctttaaatccttataaactgctggtttgccgtcgggtcaccacaatatctacatattgatgacggccgagccactgtaattc

SEQ ID NO: 510992 - DNA, 532 bp, Homo sapiens
  misc_feature (514)..(514): n is a, c, g, or t
atatatccatagcaaagggtccagtcagctcacccttcatacctctttattgaccttttttgtagacatacatacggtaccaaagtcgaccacaaaggatgcttggtttcatttttccaccttaaacatccactcacctgaagcaatgaaagaataaggccagaagagtaaagacatggatgttgtgccatattttctttttacagatagtataagtggggaagactaggtaatagcctcaaagtagagaagacatcaagcaaaggcaactgagaaaatgtctgtgtggcattgtggctatggttgaccatctcattcagggtgcttctaaaacagccctcccatctgtctaccaggagttagcctatccttgttgatgaacatagggtgctcatcagtatagtaactaggaatggggaacagttctcccaacagtttgtaaggtgatgttctgtcgctctgaaggctttgatcatgctcccaacaggtttgggtcagtcttgttttgaaatgnatgactaatgggtgacgc

SEQ ID NO: 510993 - DNA, 850 bp, Homo sapiens
  misc_feature (30)..(30): n is a, c, g, or t
gctttctgacagtgcagggattctgaagcngtctgcttgagttactgtgctctcttccaaggctgtaggagttctggagctgctggctggagaggagggtggacgaagctctctctagaaagacatcctgagaggacttggcaggcctgaatatgcattggctgcgaaaagttcagggactttgcaccctgtggggtactcagatgtccagccgcactctctacattaatagtaggcaattggtgtccctgcagtggggccaccaggagtgccggccaagtttaactttgctagtgatgtgttggatcactgggctgacatggagaaaagatagaagaaaaataacttgaacgggagaatcagaaaaataaacgagaagaaaggaaacgaaataacacgagagaaagagaaacgaacgacaagacgcaaaagaacacaagcaacacgaaaccgacgacgggacgaacacgacgacgggacgaacaggggacgacgacacaacaccccttcgtacccacctaacacaactagtaaaagaaactgataaagaacacagtaactggaagacccgcgacgaaacacgaaagacgaagcgaagtaacgacggaaacacttattaatattcccacagatagacaaagtcaagcataaaactggagcttgagaaggcaatgaaaggccgtggcaccttcttataccctagaaagaagacctccattacaggaaagacttgtgtgtgggggttcgggaccattagaatcatccacaagtcaacccaaaacttggaaccgtcagggtcagaggggaaccaccatttattaagcatttgccatgtgcaggcactaaccag

SEQ ID NO: 510994 - DNA, 1106 bp, Homo sapiens
  misc_feature (30)..(30): n is a, c, g, or t
  misc_feature (360)..(360): n is a, c, g, or t
gctttctgacagtgcagggattctgaagcngtctgcttgagttactgtgctctcttccaaggctgtaggagttctggagctgctggctggagaggagggtggacgaagctctctctagaaagacatcctgagaggacttggcagcagcctgcagatggcctattgtgggaccttgtgatcatgaagtcagggaccctgaatggagggatcggccagagctgaggcagaagaacataaattgtgaagatttcatggatatttatcacttcccaaaattaatacttttataatttcttatgcctgtctttactgcaatctctgaacataaattgtgaagatttcatggacatttatcacgtncccaattaacactcttatagtttcttatgcctatctttactttaatctcttaatcctgttatcttcataagctcagaatgtaattcacctcaggactactattgcacaaatggattgtaaaacatgtgtgtttgaacaatatgaaatcagtatacccggaaaaagaacagaatatcagtgattttcagggaacaatggaagataactataaggtctgactgcctgcggggtcgggcagaatagagccatatttttcttcttgcagaaagcctatagaaggatgtgcaagtaggagaaatatttgctgaattccttttcccagcatggaagaaccctggggaaggaatgcattcctgggggtaggtctatagatggccgctctgggagtgtttgtcttatgcggttgagataaggattgaaatacgccctggtgtcctgcagtaccctcaggcttactaggattgggaaattccagccgggtaaattctagtcagagtggttctctgttctcaaacctgtttcctgtgaagatgtttatcaagacactgtgtgcacagcaggacatagaccctcatcagtaattctaatttgcctttgcctggtgaccttaacggccctttgaagctgtgatccttgtgacctactcctgttcgacacctctcctctttaaatccttataaactgctggtttgccgtcgggtcaccacaatatctacatattgatgacggccgagccactgtaattc

SEQ ID NO: 510995 - DNA, 637 bp, Homo sapiens
aagctttgcaaatacttacagcatggtccagactactatactgaaaatgtgccatcagagaaatactttcagataacaagtccttgagcacatgcctctcccgatgtaaatttcttataccaaaaataagcatctctgatgccttggcagggctcattatcttcggaaaagtgtaagacgagcatccttccggacttaggcctaggtgactccatggtagtatgaaatgttgccctgtcggatgcatacacggcatcgaatagcccaaggagggtgacggagatgcccacagttggactattgaccactgcaatcagaggcttaggaaaatctataaatcagcccacaaattccctcagtaaaacggcattaatactcagctttctcctctactccaccagggggaatatcagtgaagttagtcagatcattcccactagtgtaatagtcaccattttcctgttaaaacagtgatgattgagtcatccttgctggcagctattagtgcacgcataatttccatgatacatctcagtgttcatggcattttcctgtttggcccgtttgcacatgatctctgtgatgccatcttcggagagcacaccaataccggtaccgagccgaatcgtatcgtgtc

SEQ ID NO: 510996 - DNA, 1187 bp, Homo sapiens
  misc_feature (30)..(30): n is a, c, g, or t
  misc_feature (700)..(700): n is a, c, g, or t
  misc_feature (744)..(744): n is a, c, g, or t
  misc_feature (846)..(847): n is a, c, g, or t
  misc_feature (849)..(849): n is a, c, g, or t
  misc_feature (852)..(852): n is a, c, g, or t
gctttctgacagtgcagggattctgaagcngtctgcttgagttactgtgctctcttccaaggctgtaggagttctggagctgctggctggagaggagggtggacgaagctctctctagaaagacatcctgagaggacttggcaggcctgaatatgcattggctgcgaaaagttcagggactttgcaccctgtggggtactcagatgtccagccgcactctctacattaatagtaggcaattggtgtccctgcagtggggccaccaggagtgccggccaagtttaactttgctagtgatgtgttggatcactgggctgacatggagaaggtaatggggtggaaaagaggcacagagtgagacaattttgttgacttttaaaattcatccattaattcagtaaatatttgttaagtacttattacatgtaaggcactgtaataagctatggacaagacactcgtcttccatgaaggcagtatggtatgggagagagacagcatgagcttggaaggaagaaaggcacaggaatgtggcaacctggtaactcccaggcagccaacacacagtttgtttacactatatgtagactgcacatgctctgttgtgacctcccagggtgaaatgaggacttttggtctggggtcgtagaagaggcgggtttgaatctaataatagcaaatcaagcctgggcaacacagngagactctgtctctaccaaaaatgtttaaaacaaaattagccangcatggtggcacatacctgcagtcctagctactcaggagattgaggtggcaagattgcttgagcccaggagttggaggctgcagtgaactgtgatcacaccnncncanctccacagagtgagattctctctcaaaaaagtggggggcaaatcagcactgaacaaagactgagtcttcccagaaagttaggtcacgtgtccctgtcaaatagaggtgtgcaagtaagatagctacgaggttgacagttatcaaaagggcttcaatatgagacatccaagaaagacaaagatgacagaaatttctgagttatacttcacagacctgagagtctagaattgtactccattcactggtgatcaatcaattgccttagactgaagtcctatgagtctttctgtaggatggaaggattcataactggctagaggtaggggaagggtgga

SEQ ID NO: 510997 - DNA, 438 bp, Homo sapiens
gatgacttatttgatggcttagtaattgggtcctttggtcgtgtctgtaagtgatacagactgttattatcatttttaaaaaccacattcaaataatgcaaagtgaaaaaaaaaggtgtcaaaaatccgctggcgttactctgacagtctctagctgtggttccctagctgtggtcttcaccctcggctgcacactcgaatccctttgggacgttcgttgttttttgtgggaaattaaaaaaatcatgctgattgggcagagattctgatttaattggtctggaatggggccagggcattggtaacttttgtagttttcttagagcttcctcaggtaattttgacattcaatgaagactgagcccctctgcaccttcccaaatagcatagttagtaacaatgacaatgaagaactttcagcctaaaattcgtgtggat

SEQ ID NO: 510998 - DNA, 369 bp, Homo sapiens
ctgggtatgcatgatcctatcacccaagtagagaacatggtacccatagttaaacagccctatgcctgccgccatactctccagcctaacagtagtccccagtgtctactgtaccactctttatgcccatgagtatcccatgtatagctcccacatttaagtgagaaaatgcaccatctggtttactgcttctgtacgtattatatagtataatggcctccagctacatccattttgcttcaaaagacatgattatatttttatggctagcacagaatcacatggtgtacatgtaccacattcactttctccagtccaacattgatgggcacgtgggtcgataccatgaaatagctattttgaaataac

SEQ ID NO: 510999 - DNA, 904 bp, Homo sapiens
ccagaaatagcgggttcgctaaacaccacacatatggggtcccccctgtaagtgacccaacaagccccttggcctcgtgagattgaaactgcagcccgcgctagaagagttctgtcgcgtaacaacacacttgtgtggcgacattgctccaagaagaaagctgaacctgtatggcgaagtggtctgcttacgccagcagccaggtgtaattactgcgcgggggcagtgcaaccaagggacgccccaaaaatttggggctgggagagtagctcttcaacaaccaggcggacaactagtaccttgccgacacccctgtggagtgtgttccgccccccgaggccgccgcccgtatgtgaacaaagaggggggtaaaccggacccccacgctctatttcaaagaagggcgccttaacaatactgtgccgccgctcaacaccactctcgcgagcaaaaaacagttggtcctgttagcaccacgcgcgtcgcaccggactctgttgtcacaaccacgctccaagagttttagcatccgcggtcattgttatacataacccagccggtcttgtccggggccgtgcccacagttcgaagaggcggatactccacacaggaacagtgtaataagcgagacgactcccagcccccacactacagcaggggtcgcacagcgccagtctggcggcagagacacaccacgccagcaaaaggaataagcccgcaagcgttcccgcttcgaacaaggcagtgtggcccccgcaccgcgcgtacaaaagagagggagaactggcacacaaacagtgtgtttatcaaatgaaaacactaaaaggggaacagaacaaccactagcgctgggggaaggaggtcccacacgtgcatccagcaacccgctccccgccaacaagca

SEQ ID NO: 511000 - DNA, 344 bp, Homo sapiens
  misc_feature (315)..(315): n is a, c, g, or t
  misc_feature (322)..(322): n is a, c, g, or t
ggaaggcaaccctcctgcaaagggtccagggtggcggtggtgggggggacagtgatgcaatctcagctcactgcaacctctgccaccccagttcaagcgattctcctgcctcagcctcccaagtagctgggattacagttgcctgccaccgtgcctggctaatttttgtagttttagtagagatggggtttcaccgtctaggccaggctggtcttgaactcctgacctagtgatccacctgcctcggcctcccaaagtgctgggattacaggcataagccaccacacccggccagggctgctttcttatctcctngggtctnacatgggggttgggagtcttcc

SEQ ID NO: 511001 - DNA, 294 bp, Homo sapiens
cgtgtcccttccattacttgctgggctggttctgtcccatgcagcactgtgcgaccgattggaataacttttcgattcctggggcacagtgtacaatttcatggtcccagaacttaaacgctgggttttaaatcagctcaatgaaggtaataagaagaccccaaggtatgtgcctatttacaatcaaccgttccaagagaactcttgtgatctgttcttggatggcttccgtattgccctcttgcaaaaggtacagcatggtgcacttgaagtagtgagtgtggctatttgggt

SEQ ID NO: 511002 - DNA, 1198 bp, Homo sapiens
  misc_feature (1198)..(1198): n is a, c, g, or t
cgggcggggaggggaggggagcggcccggcccactatgcaaagcgccgggacgccgccgacgcaccccgtggcaaagaatatgcttttggtctaagtgatgttagataaaaagcaaatttggagcagttttctttattcgagttcgaaaatggttcataaagcagcgaagacaactcaaaacatcaggtaacacatttggcccaggaactgctaacaagacatacaggtgcagtggtggcattaagaagtttggcaaggaagagagccttgaagatgaggaacgtgatatgggccatgggaagttgacaaggaccaatggagagcaatcattgaactacatgaaaaattacagaagaactcagcgttgactattctacggtcattagggtcagttcagcattcgaagcaaattggaaaggtgaaaaagcttgataagtgggtgcctcatgagctgagcggaaatcaaaactatcgtttgaagtgtagtcttcttttatgctacgcaacaacaaaccattactcaatcggatgtgacatgtaatgaaaagtgaatttaatacaaaaacagttcagtggttggaccagaggcagtccaaagcagttaccaaagcaaacttgcacaggaaaaaggtcatggtcactgggtcaggggatctgcaggcccatctgatacaattacagttactgacatcctggtgaacaccattacatctgagacagtatggctccagcaatggtcaagatgcacccgaaactgggcatcactggtggactgcattgtgcaacacacagtgccacactctcgaccaacagaaacaaacaggtacgggatgttgcaacaaccacagggccaacaacgcgcaaccgacaacggggaacaaaacggctggagaccacaaccaacaaggataaaacaactgagaaccgagtagcaaagaggaaaaacagagggacgagacgtcgggaacaaacgcgccgagaatacgcaccataacgagcgcaacaagactgtcacagacacagacacaatgcagacagcgaatagaccagacaacgaaacatccatcatcaagctacataaccacacagaacaacaaacggacagacaacacaaaacgaacaaaagcccaaatgagaacaaagagaacacgacaaagacggatacggctgaagagccatagctccaccgattcgctn

SEQ ID NO: 511003 - DNA, 711 bp, Homo sapiens
ttagaactcctttactttcaactgtattgttcaaaattgccaagagatttctttcccggccaggacaagaaaagcagacacctttccattttccatgcacttgacgagtgtgcgtttttgtctgtgttggggagtggcgggccgggccacagaagagcatctcaaaacattctaaagcaaacaggaacttgatccatgttccctgaacctgaggagaacacacttctactctgctcagagccaactctcccaccaccggccccctgtatctcttctcctccccgccttccagcccaatcttcttcggaccttcactcacctcccccagtcgaccattttccccaccgaccccctcgccccccgcccccccctctacctctcgccggcccctccacctccgcaccccccccccgccctccccctcccctcccctcctccctcctcaccccagcgccccctctcccccccctccctcgctgctcccctgccccctccccgccctcctccccacctcccctcgccacctccttccccccctccccccctgccccccctcgcccccccccccctccccccctccccctcccccccgcagcgaccccctgcgcccacccgccccccccctccgcccccctccctggcccccccccgccctccccctccctccaccacccccctcccctccccctgctcttgcctctcccccgtctc

SEQ ID NO: 511004 - DNA, 166 bp, Homo sapiens
tactgtgaaatgtgatccccaaagttggaggtgggaccctagatggaaggtgtttggggatggatccctcatgaatggcttgatgccttcctggaggtaatgaatgagttctcactttgttacttcatagagagctggttgtttaaaagaggctggctcctctctg

SEQ ID NO: 511005 - DNA, 598 bp, Homo sapiens
  misc_feature (240)..(240): n is a, c, g, or t
aatccacgtgctttggcctcccaaaaggctgagatcacaggcgtgagccaccatgcctgcccgctttccttacgtattatccacacattaactcaaaatggactaaagtattaaatgtaaaatctgaaaccataaaatctctagaagtaaatcggggcaacaccatttaggacataagcacaggcaaacatttcatgatgaaaacatcaaaagcaattgcaacaacaccaaaccaaatanaaagaaggcacagcaaagcaaattatcatcagagctaacagccaacgaacagaatgggagaaaattttcacaatttatccatctgataaaggtctaatatcaagaatctacaaggaacttaagcaaatttacaagaaaaaaccaaccccattaaaaagtaggcaaaagatataaacagactcttctcaagaggagacatttatgtggccaacaaacataagaaaaaaagcccaatgtcactgaccattagagaaatgcatatcaaaaccacaatgagatatcatctcatgccagtcacaatggtgattattaaacagtcaagaaataacagatactggcaaggctgaggagaaacggg

SEQ ID NO: 511006 - DNA, 103 bp, Homo sapiens
tcgatacgaccatcatcatcatgatcgctcgacatcgatacgaccatcatcatcatgatcgctcgacatcgatacgacctactactacttctgtcgtcttctc

SEQ ID NO: 511007 - DNA, 274 bp, Homo sapiens
  misc_feature (97)..(97): n is a, c, g, or t
cagaacaggacagctgttctgtgtcttttcttccattttttatgaagagcgtttctctccttcctatccatatgaagtgtgactagtatttgttgcnttctttacagttaataatcgggatttgtgatattctgtatttaaactgaagtccacagacagggaaataattggcccaaggtcaggttgcaaaccggtggcgacgctaccatctgaactaagccctgggccccgtgtcggataccagtcagtgccctcttactgccctttctggtgt

SEQ ID NO: 511008 - DNA, 116 bp, Homo sapiens
tttccccttttcccccccccccatttggggccctgggggtttcaatcatccccccatttggtcccctgggctgtttttgtttattttaacttgtaaaaaaaaaaaatttttttcca

SEQ ID NO: 511009 - DNA, 815 bp, Homo sapiens
tggcttagtaaaaaattttatttttcttctttatgctccagaaaacaaaaaaagggccttgcccccaaggggtctcctcttgaaggataggggggcaaaaagagtgataaggggaggttgttggggtgtgaggttgaaagtaggagtttggtcctcccccttttcccctccgtggtcacctccctctttttcacgtgctccccttctccagaaaattttaggtattgaacacagctttgccacccacgggggggcgtggagaagcagagcgtgcagctcaaaaaattaagtgcccactttcagcaagaggagggttccaggtgcgtgtactctgggggggcagtgggggaagaagcagttgctgcacgggaatgtggttgtgaacaaacgctcccaggttgcaggggacagggacagcagggcccgtgggaacaattccccccttgtgcaccggggggactccttaaactcctgtgccccttcaacactttctttcccaaaacaccccaatcccccatcacgcgtactatccacccagccccgcgccatcacaataccagcgagctcgcactcaacctccaataaagaccagcaccaagtccctttgacaatatcccccttctccaagccggaaaagccctgcagacaaaaaagtaccttcaaagaccccaaatgggtaacgacatccaggatgggccacagctaggcagcacacaatctcactgcaggcttcgagtgccccaacaggagaccctcagcgatcaccacgcacgcttcaaccggaccctcaggccagcatacaacagcaccaacac

SEQ ID NO: 511010 - DNA, 982 bp, Homo sapiens
tgccctgggaggaatgtgggcctctcccttgaaggagctgtagacccccggtggtcaaaggcagggccgtacataacgggagtgagagcgcgcccgttgtgcataggggggactgaggcttagcgcagtttgacggatcccaccacctaggaaactaagtgtgtatagtcctcaagaagtatctccgtagaaattccagtgcatcaccatagggactgaccagtacttggaagtcccctagtaccctaaggatattttattttcagggtccttcttgtcctctatgaggaacccagggaaacctagaacctactctaagcaagtgtctagttcccgaattctagaagaagtggagtacgtagccctcactttacctttctgagaccgcagatattttaaagtaggggcgcgataaacatgttcttgtcaaactaaacccactcgtcattagtcatagggccaagaaagtggcgcactgaaagaacactactttcaggttatagattcttctcactaagcagaagaggctaagataataaccaagccttttttaatccttgaactgcagtcatagactagacaggtttgaatacaatcgcttctccctatagcatacaacctgtagccaagaagcatcaccaagtctctaagccacctaattgccaacagagggaaggacaatctattacccttcgactctcgttctatggcttacagagggtaggacacaatgtatctacttggcggaccaatttccttgacttcagatgtggcccgcatccatggtcaagggtcccatttgttctctagctgaactctcactccccttcaacttgaagggcagtgactatacattccacagatgaagcccagtgtttactttgaagtatgactagcaaaaagcatttacaccattcactattggtagtactcaactgtggtatagaaagaagtcataattcataactcctagctatagcac

SEQ ID NO: 511011 - DNA, 219 bp, Homo sapiens
ttccacagagcagcatgcatcgtgcaagtgatacgagatagatccagtattggcagtcctaccagatactagcctgcagcgtatccatctcagctctggaacgagtggcacacggttcgtgactggaataaaccctgcgagtcttcttcgctgccacttcctgagcggtcctcctcttgttcctcctcactgtcatcgtcactcacgaccggattggaa

SEQ ID NO: 511012 - DNA, 466 bp, Homo sapiens
  misc_feature (155)..(155): n is a, c, g, or t
  misc_feature (214)..(214): n is a, c, g, or t
  misc_feature (248)..(248): n is a, c, g, or t
  misc_feature (271)..(271): n is a, c, g, or t
agaaagaacaaacagagtttttctgtggaaaacattataattaccttttttgtctctcccccagaccccgaggttttgtaaaaagcccccaaaaccctttgggaggcagtttcctcggttaatttcttcccaaagaaatgtttttaaaaaattcnaaaacaaattggaattatgcttggtatttctcccagtttctagaaggtacctattttcnaccggtttcaagtgatgaagtgaaaaataatttnacattccgatagtgttactgatnaacaacccctacttaagagatatgttgctttttacttaagggatagtgttgatagataaattagaatgtatagataggtttgtgaaagtctaaataatggctgtatagatatgtatatatggttcacatatctggatctgtgtatttgattttgtactttaaatgtgacaaataaaccttttgggagaaaaaaaa

SEQ ID NO: 511013 - DNA, 397 bp, Homo sapiens
  misc_feature (352)..(352): n is a, c, g, or t
  misc_feature (371)..(371): n is a, c, g, or t
tcttatttaaaaactattgttagaaaatgctaatgatcatttgagctttcagtaagttgtaatctttttggtggtagagggtctcgccttgatgttgatggctgctgactgaatcagggtgatggttgctgaaggttgaggtggctgtggctattaaaataaggcaacaatgaagtttgccacattgactcttcctttcaccaaagattcctctgtaggcatgtgacactgtttgataggcatattccccaccacagatcttctttcaggaactgggggtgggacctggggcacttgcagtaatgggttcttaaaccctttgttgtccattttcaacaatgtggcacaggcntctttcaccaggagttggnttccatctccaaggaaaccactttct

SEQ ID NO: 511014 - DNA, 185 bp, Homo sapiens
ccgggttttcgagttgaagctcagaaatgccacactgaccttctcagttcatgcatatgcctggaaaatcacaggcttccattctacagtgcagggcttggaggagcagggcgattatcctttggatagaggcttacttcagggggctgagcaggaacagtccacaggcccttcactccaaaccc

SEQ ID NO: 511015 - DNA, 393 bp, Homo sapiens
gaaatagaccttcatacttccaacaccattggccagttcttagtaaagattcagagcaatccagcaatggttccaactcggaggcagcgcctcttggtccccatttctgtatagcaggcgtgtgtgtgtgtgtcgaggttttttattttttgcttaatcaaactccattcccaaatgcactccatctctggctctgagggcgctccctcctctcagccgggcagcctggcctctcctgcccagacctgcggtcccagcatcccccagagccagggaacaggcccagcgggagggggttttatgttttgtttcaaacagaaaacacaaccttatttttctttacaaaagcaaaaaaggaaaccaaaaaagatacagcctttgaatgatgaaaaa

SEQ ID NO: 511016 - DNA, 129 bp, Homo sapiens
aaaaaagccagacgagaaacgtgaaatttttttttcctgaattggacatgtgtttgcaaacacttgtctgaagataatgctgtttatgcaataattcgtgaacatgctacagagttttatataaattta

SEQ ID NO: 511017 - DNA, 3793 bp, Homo sapiens
  misc_feature (5)..(5): n is a, c, g, or t
  misc_feature (44)..(44): n is a, c, g, or t
  misc_feature (109)..(109): n is a, c, g, or t
  misc_feature (1609)..(1609): n is a, c, g, or t
  misc_feature (1692)..(1692): n is a, c, g, or t
  misc_feature (1710)..(1710): n is a, c, g, or t
  misc_feature (1742)..(1742): n is a, c, g, or t
gaggnggcgcgcgtcgccgccccgcgtcccgcctgcggcccgcncccccggcgtcaccgcctcctgcccgcctgcccgcctgcccgcctgcccgcctacccgcctaccngcctacccagcctacccccctgccggcctgccgtccttccacgcggagagccatggagggagtgagcgcgctgctggcccgctgccccacggccggcctggccggcggcctgggggtcacggcgtgcgccgcggccggcgtgttgctctaccggatcgcgcggaggatgaagccaacgcacacgatggtcaactgctggttctgcaaccaggatacgctggtgccctatgggaaccgcaactgctgggactgtccccactgcgagcagtacaacggcttccaggagaacggcgactacaacaagccgatccccgcccagtacttggagcacctgaaccacgtggtgagcagcgcgcccagcctgcgcgacccttcgcagccgcagcagtgggtgagcagccaagtcctgctgtgcaagaggtgcaaccaccaccagaccaccaagatcaagcagctggccgccttcgctccccgcgaggagggcaggtatgacgaggaggtcgaggtgtaccggcatcacctggagcagatgtacaagctgtgccggccgtgccaagcggctgtggagtactacatcaagcaccagaaccgccagctgcgcgccctgttgctcagccaccagttcaagcgccgggaggccgaccagacccacgcacagaacttctcctccgccgtgaagtccccggtccaggtcatcctgctccgtgccctcgccttcctggcctgcgccttcctactgaccaccgcgctgtatggggccagcggacacttcgccccaggcaccactgtgcccctggccctgccacctggtggcaatggctcagccacacctgacaatggcaccacccctggggccgagggctggcggcagttgctgggcctactccccgagcacatggcggagaagctgtgtgaggcctgggcctttgggcagagccaccagacgggcgtcgtggcactgggcctactcacctgcctgctggcaatgctgctggctggccgcatcaggctccggaggatcgatgccttctgcacctgcctgtgggccctgctgctggggctgcacctggctgagcagcacctgcaggccgcctcgcctagctggctagacacgctcaagttcagcaccacatctttgtgctgcctggttggcttcacggcggctgtggccacaaggaaggcaacgggcccacggaggttccggccccgaaggtcagagaagcagccatgactgcggggggaggacacacggatgctcaggcccaggctttgccaggtccgaagcgggcccctctctgtcctgcctcttttcacctgctcacgccctcccaccccgcaccctacagccccaggtcctggcccagtccctccactgcctcgaagagtcagtctgccctgccttttcctttcgggcaccaccagccatccccgagtgccctgtagccactcaccactgctgccacctctctggccaatggccctttcactggcctggtgacnggaatgtgggcagcgcccacacaggctctggcccatggcttcctactggcagctccaggcacccccctctcaccacgccgttngctggctctgacactgtngggtgagggtcctggtcctgctgtcttccctnctgctccaagaccctcccgagtccccggaaatggagagtgcagttcttgggcccagcctggcttcgccatgagtttggggagcgagaccccacctgagacaggcagtaggagcctgtgctgaccttggggaatctgagcttttccaagggtaaggggcccagggtatgcaggccttcagtgacatcaggtcgttgtcatcctttccctccctgacctgtcacgagcctctgcaggtgcctgctcaccatggcccagcgccactctgtcctccgactcaggtgagggggcagcccacagacctgctcctcagtagcagggcctggccaggcccctgctgttctcagcctcagtttgccatctatgaaatgaggtggacccctctccatagcccttgggtgccagctcagtgggtgtggggatcacatgaggtggctcatgaggacacactctggaagtcgaggggctgccacgtgcagaggaagttcccggcctgggggctttatccaggggtcccagtcgagagtggcccgaggccgtccctcaccgggcatgttccctctggctgcccactccctcagggcccacatgtcctgccactcgccactctgagcacgagttcaccttccagatgtggccaggtgtgccagctcctctctcctgtgcgttggaaccccgggggaggcaagagcagatcacaggtgcatgagggttacacccgtcacctgggtctgccgggatgggttgggggggcaggtgccaggcctcactgctgtgaatctgccacgcctgggggtcctagaggctgccccaccccagtgattgggtagcagctcacatcccacccagcttcacaagtgaggaacccaggtgcatcgggagaccctcgggggcttctgtggcctctgtgcccgatgacctgcgtggcttcagacaaggccccagcgttactgggctcagcttgttgttctgtgtggagcgtgaggtgagaaaacccctctgaaaagatgtggtcggggccacgcttcccactggttctgcagtgaggagttggggcgggtgagccaaagcggccccccatggtgtctacctgaggggcagggaaccgcctgcctgtgcactcacgccaccccccagcccacaaagagcccatctgagagaaggacgtggtggagccaggacgggaaagcgtcctgtcggctggccatgctgttgcttgcgtctcgaatcttcggttctcgaggaagtgttgacagtgtgatgctaatgtctgcttttcttggcgttgggtagaagcaggacatctgtgtgtatgtgcgtatttaaattagattatttataataaccagagccagccctcgcgctggccaggatcctcctgccgagctgatgtcgctcctgccctctgccggggtccggaagcgacatctcaggaggtagctctcagcagagtgaggattcctgcctttcgtagagttttgtgtgactttttaaattattcatgtgtcccttaaaagtttcactacgtggagaaaattccagcaccaagtgttgtggcaacagctgagagagtgcaggcaccactgtgttgtggcttgttgaccgggaatgtgtcacccctgccagggaactcttctcctcgcgggggacttgggatggccatcagaccttctagggtctggctggggtcatcctaggtatgggtgaccgtccctgagacataagcgaggtagattcagccatcctcaccctcagacttgaggtccccacccaggccaagccggccccccgtaccccttgcctgggagcaaaccgccaggacgcagcctccacgccgcacctgccacattcagccctgcccaggaaggaacacatgacccttctgtctgtgactgttgctgagtctctgtctcatgtcgtagaattgtggataattgtctagtgaccctctcatcactgtaaccatcgcgcctggcctagatgtcgtgttttggatgctgtgttttcaataaatgcctctggggccctgcttttacccgctggcgtcaaaaaa

SEQ ID NO: 511018 - DNA, 415 bp, Homo sapiens
  misc_feature (3)..(3): n is a, c, g, or t
ggntcgcgggggtctggacccatgcattcggtatgatgatatctttaatgggaggagtggggagagagtcaggacagtccttactggatacggtgaaaatttgacaaagaccttaagaaagtgacgagtaagcttagtagtgatctaggagaacagctggtggcgggcggtggggaacaacaaatgcagaggccataaggcagaagtattcttgaaacatttgggggacagcaagggggccatggtggcaagactacaaaggagtgaggggagggaagagtggtaggacttggaggttgcaaggctggagctgcaggggaaaacggccctgagggatttttgcaaagacctgtggatttaacttgtggtgagatggggaagccacgtgggggatcacttgaacccagggttccca

SEQ ID NO: 511019 - DNA, 1169 bp, Homo sapiens
atagatgccaatcgttttcccagcaccgtcacttagtattttaggaaacatgcgtgaatttcggacaagaagagaagcatgcttgggcctgtcactaaattgcaagcattcgtggaggatctagctgaagagatcatgtacctagtagtaactgggttgtatcaatgccgcatatgctgactgctcctcacggtcatggactctaagagttgtacaggttgcccataaatggcgttggaaacgtatcctgaggcttggatgaacaggaagccaatacaggaatggcaactggctattaaccctgtactgtgcgttcgacttgactgaagcttatgggtctggataaacatggacgttcttacagtagtcagtgaaaagtcgcaggagtatctaccaacaaggccgttgtgatcttattgagccattccttcgggtacccgagagatgacagacagcagacattgcgaccccaggtttgaccttgaaccagcagcagctacatcttccaacatgtgtgaggctcctatgggaactgtgttccagcctttggaatgcagatactcgtgatttcaacagtatcctgtgtcaggacccaagtctaacccagatcgaaggaccttctttgtggagcccgacagatccttcatggaagcataaattcgtcacatgttttccattaatacatgggatggggctactattcgggtaagccgtttgaggcccacactgcctctcctatacaccacctttcaggagaaaccttccggaaaatccgatgagagggcaaaatccccttttactaaaaggggtaaacacgaaggggccccctctcttttttcacggaaaaatcccctagttctgaggaacccacgtttaattaaagatatggaagataaccaattaattggctgcaccccacttacttggtgggggacaacaaaaagaagccccccacacccttaatgcgggggaaaacagaggtagttagaagggagactacattttgtgtatacaccgcacttaagggagagtactactaagtggttacaacacaatgctggctactggaccgccagtaggggtacaacacaactgaaggtagctattacacctctataatacccccaccttgtttgactgactctgcgtgcgcatgttcatctacatct

SEQ ID NO: 511020 - DNA, 230 bp, Homo sapiens
tgcccggaatgcggcaaggcctttagtcatggctctcagcttactctacatcagagaatccacacaggagagaggccctatggttgcccagagtgtggcaaagccttcaattggagctcccatcttcaaattcatatgagagttcatacaggtgagaaaccgtatgtctgtagtgagtgtggaaggggctttagtaatagttcaaacctttgcatgcatcagaaagtcca

SEQ ID NO: 511021 - DNA, 3964 bp, Homo sapiens
  misc_feature (5)..(5): n is a, c, g, or t
  misc_feature (44)..(44): n is a, c, g, or t
  misc_feature (109)..(109): n is a, c, g, or t
  misc_feature (1651)..(1651): n is a, c, g, or t
  misc_feature (1669)..(1669): n is a, c, g, or t
gaggnggcgcgcgtcgccgccccgcgtcccgcctgcggcccgcncccccggcgtcaccgcctcctgcccgcctgcccgcctgcccgcctgcccgcctacccgcctaccngcctacccagcctacccccctgccggcctgccgtccttccacgcggagagccatggagggagtgagcgcgctgctggcccgctgccccacggccggcctggccggcggcctgggggtcacggcgtgcgccgcggccggcgtgttgctctaccggatcgcgcggaggatgaagccaacgcacacgatggtcaactgctggttctgcaaccaggatacgctggtgccctatgggaaccgcaactgctgggactgtccccactgcgagcagtacaacggcttccaggagaacggcgactacaacaagccgatccccgcccagtacttggagcacctgaaccacgtggtgagcagcgcgcccagcctgcgcgacccttcgcagccgcagcagtgggtgagcagccaagtcctgctgtgcaagaggtgcaaccaccaccagaccaccaagatcaagcagctggccgccttcgctccccgcgaggagggcaggtatgacgaggaggtcgaggtgtaccggcatcacctggagcagatgtacaagctgtgccggccgtgccaagcggctgtggagtactacatcaagcaccagaaccgccagctgcgcgccctgttgctcagccaccagttcaagcgccgggaggccgaccagacccacgcacagaacttctcctccgccgtgaagtccccggtccaggtcatcctgctccgtgccctcgccttcctggcctgcgccttcctactgaccaccgcgctgtatggggccagcggacacttcgccccaggcaccactgtgcccctggccctgccacctggtggcaatggctcagccacacctgacaatggcaccacccctggggccgagggctggcggcagttgctgggcctactccccgagcacatggcggagaagctgtgtgaggcctgggcctttgggcagagccaccagacgggcgtcgtggcactgggcctactcacctgcctgctggcaatgctgctggctggccgcatcaggctccggaggatcgatgccttctgcacctgcctgtgggccctgctgctggggctgcacctggctgagcagcacctgcaggccgcctcgcctagctggctagacacgctcaagttcagcaccacatctttgtgctgcctggttggcttcacggcggctgtggccacaaggaaggcaacgggcccacggaggttccggccccgaaggttcttcccaggagactctgccggccttttccccaccagccccagcttggccatccctcacccgagtgtcggaggctctccagcgtctctgttcatccccagcccgcccagcttcctgcccctcgccaaccagcagctcttccggtctcctcgacggacctcaccctcctcattgcctggccgcctcagccgggccctctctctgggaaccataccctctctgactcgagcagactccggctatctgttcagcggtagccgcccaccatctcaggtgtctcgatctggggagtttcctgtttcagattacttctctcttctgtcggggangctgcccctcctccccantcccttccccagcgccttccgtggccggctcggtggcctccagctccggctctctgcgccaccgcaggcccctcatcagccctgcccggctcaacctgaagggacagaagctgctgctgttcccgtcaccccctggagaggcccccaccacgcccagcagctccgatgagcactcgcctcacaacggcagcctcttcaccatggagccgccccatgttccccggaagccgcccctgcaggacgtgaagcacgccctggacctgagatccaagctggaaagaggcagtgcctgcagcaaccgctccatcaagaaagaggacgactcttcccagtcatctacctgtgtggtggacaccaccaccaggggctgctcggaggaggccgccacctggagaggtcgtttcggcccttccctggtccggggcctcctggccgtgagcttggccgccaacgccctgttcacctcggtgtttctgtaccagagcctgcgctgacccaccgttggagcccctcggaggggagcaacccggtgcctgctgcttcaccactgccggcctcaggaccctccctggaggggctgccacctctgccctcatctccagggccttgacctcactggactgtgactgtcctcaggacacctgcccctcctcacctaacggactgcagggctgagcatgtgtctgaggtcacactctctgcccactcacctccttggctgacatcggttgtgtcttggtgctgacactctgatcccgaagccagggagccccaaggggctggcatgaccctggggtgccccacacagttcagccctgcctggcagggacgccagtactactgtaactgcagcaggagctgcccggcctgccttctggccccacgcccacaggcgtagtcacatctttgtactgtactcccctgtctcacctggggcaacctcagagccccactaagctgaaggccccctgggggagggggaagcatggtccttatcatctgccctatcttgccccttcctgtggagtgggcagaagggctcccgggatcctcagagctcccaggtctgagcagccaaaggcccagctgggcctccaggaccagcgcgagcccctgccccaccctcccctgccacatgtgccctgctttgtgacctctgttgaccttcctggaagcagccccattaccctgagaatgcggagcgccctggcccacctcgccctgtgtttccaggcctgcacgtctggtccttcagctgcacatggaactgcagggcaggctggcggggggccttcagatctcagatgagactgcaccccttcgaccaccctactgggcacctgcctccagcccctgagaactccatcttcccctagttctgcccaggagcccctgagaaccccatcttcccctggttctcttgcccactcccctgctggggctccttcctggcactgaggaggggcgctcccaatgctgtgaggcagcggggagggaccgtgcacccgtggctatcagagcccctccgctgtcccaccctgggcctgggacacgggcctggggcagtgtgtgtctgctggtcatgtgctggtgccagttggggaggaatcagctgtctcggtggattctgagactcactgtggggcgggaagaagggtcttcactctgccattcagggataaagtttaattttatttttctacacattttgccaggtcaggcattttgctagtaagcaggatgcccccaactctccctgccatggaggattcttttttttaagctttgggtgcttttttaatacttttttttttaatgtggggaaggagcttgctctgacgtcaccctcctctcccctgactcctgtcctgagagctgtggatgccgcctcctgccctgcctacccctgaaacgtggggaatgggggccccaggacagcatcaggacttttgagtccagctgccagcaatggttccaactcggaggcagcgcctcttggtccccatttctgtatagcaggcgtgtgtgtgtgtgtcgaggttttttattttttgcttaatcaaactccattcccaaatgcactccatctctggctctgagggcgctccctcctctcagccgggcagcctggcctctcctgcccagacctgcggtcccagcatcccccagagccagggaacaggcccagcgggagggggttttatgttttgtttcaaacagaaaacacaaccttatttttctttacaaaagcaaaaaaggaaaccaaaaaagatacagcctttgaatgatgaaaaa

SEQ ID NO: 511022 - DNA, 912 bp, Homo sapiens
  misc_feature (31)..(31): n is a, c, g, or t
  misc_feature (73)..(73): n is a, c, g, or t
  misc_feature (132)..(132): n is a, c, g, or t
acgccagggattcgataacagtggatgtgtnatatattgccaaacattacaacatgagcaaaagcaaagttgncaaccagttctacagtgtggaagtgggagactcaaccttcacagttctcaagcgctacnagaatctaaagcctattggctctggggctcagggcatagtttgtgccgcgtatgatgctgtccttgacagaaatgtggccattaagaagctcagcagaccctttcagaaccaaacacatgccaagagagcgtaccgggagctggtcctcatgaagtgtgtgaaccataaaaacattattagtttattaaatgtcttcacaccccagaaaacgctggaggagttccaagatgtttacttagtaatggaactgatggatgccaacttatgtcaagtgattcagatggaattagaccatgagcgaatgtcttacctgctgtaccaaatgttgtgtggcattaagcacctccattctgctggaattattcacagggatttaaaaccaagtaacattgtagtcaagtctgattgcacattgaaaatcctggactttggactggccaggacagcaggcacaagcttcatgatgactccatatgtggtgacacgttattacagagcccctgaggtcatcctggggatgggctacaaggagaacgtggatatatggtctgtgggatgcattatgggagaaatggttcgcacaaaaatcctctttcccagggaagggactatatttgaccaggtgggaactaagggtaatttgaacaactagggaacaccatgtcccagaattcctgaacgaaattgcaacccacaagtaaagaaactatgttggagaatcgggccgaggtattgcgggaactcacctttcccaaattcttcccagattccctcttcca

SEQ ID NO: 511023 - DNA, 232 bp, Homo sapiens
gactaagacgtaacaagtagactgctggtaacttgagttagttggttccaaagaggccagaactgtttgcttcaaagaatgcggcaggtgggctccctttggctctgtctggcagatcatgagctcttagactgtgtagcgtttggcacttactctcccttgagagtctcctgcgggggaggcttctgggcttgtcccttcaccttaaccagccgtgtcacctgtgtctctt

SEQ ID NO: 511024 - DNA, 169 bp, Homo sapiens
atgatagaggacccccccttaaacgtgctgacgtataagccagtaattagataaaacaaaaggttcttgtaataatagtcattaaaattgctattgcatgcattatagaaaccaagacacaaataaaaatataccagcagtattgtcttattgacgcagctagaaacct

SEQ ID NO: 511025 - DNA, 391 bp, Homo sapiens
gaatcagcgtgccaaaggtcgaccactgtcactcggcacaatcaaggcaggtctccaagggcagcattcaagtgtggacttgtggcaggatctgtcactaacgtggaaacttgtgctgacgcaaccttggcagatctcgtggctcaaacgagagtaccgaccatgctttgaaagcgctttctccaaacttctgcaacctggcacacatgagtctccgtgtgtcagcaccagccttaccttcatgccacagttcatcgaacataggcaaccgtgaagcagactgtcggagttccaaggcgtaacagtaaggatgtcttcgggccatttcgtatccgcattcttaccaaaatgtctcgtcattgtcaagaggagccgacaacctggcatcagc

SEQ ID NO: 511026 - DNA, 3608 bp, Homo sapiens
  misc_feature (5)..(5): n is a, c, g, or t
  misc_feature (44)..(44): n is a, c, g, or t
  misc_feature (109)..(109): n is a, c, g, or t
  misc_feature (1651)..(1651): n is a, c, g, or t
  misc_feature (1669)..(1669): n is a, c, g, or t
gaggnggcgcgcgtcgccgccccgcgtcccgcctgcggcccgcncccccggcgtcaccgcctcctgcccgcctgcccgcctgcccgcctgcccgcctacccgcctaccngcctacccagcctacccccctgccggcctgccgtccttccacgcggagagccatggagggagtgagcgcgctgctggcccgctgccccacggccggcctggccggcggcctgggggtcacggcgtgcgccgcggccggcgtgttgctctaccggatcgcgcggaggatgaagccaacgcacacgatggtcaactgctggttctgcaaccaggatacgctggtgccctatgggaaccgcaactgctgggactgtccccactgcgagcagtacaacggcttccaggagaacggcgactacaacaagccgatccccgcccagtacttggagcacctgaaccacgtggtgagcagcgcgcccagcctgcgcgacccttcgcagccgcagcagtgggtgagcagccaagtcctgctgtgcaagaggtgcaaccaccaccagaccaccaagatcaagcagctggccgccttcgctccccgcgaggagggcaggtatgacgaggaggtcgaggtgtaccggcatcacctggagcagatgtacaagctgtgccggccgtgccaagcggctgtggagtactacatcaagcaccagaaccgccagctgcgcgccctgttgctcagccaccagttcaagcgccgggaggccgaccagacccacgcacagaacttctcctccgccgtgaagtccccggtccaggtcatcctgctccgtgccctcgccttcctggcctgcgccttcctactgaccaccgcgctgtatggggccagcggacacttcgccccaggcaccactgtgcccctggccctgccacctggtggcaatggctcagccacacctgacaatggcaccacccctggggccgagggctggcggcagttgctgggcctactccccgagcacatggcggagaagctgtgtgaggcctgggcctttgggcagagccaccagacgggcgtcgtggcactgggcctactcacctgcctgctggcaatgctgctggctggccgcatcaggctccggaggatcgatgccttctgcacctgcctgtgggccctgctgctggggctgcacctggctgagcagcacctgcaggccgcctcgcctagctggctagacacgctcaagttcagcaccacatctttgtgctgcctggttggcttcacggcggctgtggccacaaggaaggcaacgggcccacggaggttccggccccgaaggttcttcccaggagactctgccggccttttccccaccagccccagcttggccatccctcacccgagtgtcggaggctctccagcgtctctgttcatccccagcccgcccagcttcctgcccctcgccaaccagcagctcttccggtctcctcgacggacctcaccctcctcattgcctggccgcctcagccgggccctctctctgggaaccataccctctctgactcgagcagactccggctatctgttcagcggtagccgcccaccatctcaggtgtctcgatctggggagtttcctgtttcagattacttctctcttctgtcggggangctgcccctcctccccantcccttccccagcgccttccgtggccggctcggtggcctccagctccggctctctgcgccaccgcaggcccctcatcagccctgcccggctcaacctgaagggacagaagctgctgctgttcccgtcaccccctggagaggcccccaccacgcccagcagctccgatgagcactcgcctcacaacggcagcctcttcaccatggagccgccccatgttccccggaagccgcccctgcaggacgtgaagcacgccctggacctgagatccaagctggaaagaggcagtgcctgcagcaaccgctccatcaagaaagaggacgactcttcccagtcatctacctgtgtggtggacaccaccaccaggggctgctcggaggaggccgccacctggagaggtcgtttcggcccttccctggtccggggcctcctggccgtgagcttggccgccaacgccctgttcacctcggtgtttctgtaccagagcctgcgctgacccaccgttggagcccctcggaggggagcaacccggtgcctgctgcttcaccactgccggcctcaggaccctccctggaggggctgccacctctgccctcatctccagggccttgacctcactggactgtgactgtcctcaggacacctgcccctcctcacctaacggactgcagggctgagcatgtgtctgaggtcacactctctgcccactcacctccttggctgacatcggttgtgtcttggtgctgacactctgatcccgaagccagggagccccaaggggctggcatgaccctggggtgccccacacagttcagccctgcctggcagggacgccagtactactgtaactgcagcaggagctgcccggcctgccttctggccccacgcccacaggcgtagtcacatctttgtactgtactcccctgtctcacctggggcaacctcagagccccactaagctgaaggccccctgggggagggggaagcatggtccttatcatctgccctatcttgccccttcctgtggagtgggcagaagggctcccgggatcctcagagctcccaggtctgagcagccaaaggcccagctgggcctccaggaccagcgcgagcccctgccccaccctcccctgccacatgtgccctgctttgtgacctctgttgaccttcctggaagcagccccattaccctgagaatgcggagcgccctggcccacctcgccctgtgtttccaggcctgcacgtctggtccttcagctgcacatggaactgcagggcaggctggcggggggccttcagatctcagatgagactgcaccccttcgaccaccctactgggcacctgcctccagcccctgagaactccatcttcccctagttctgcccaggagcccctgagaaccccatcttcccctggttctcttgcccactcccctgctggggctccttcctggcactgaggaggggcgctcccaatgctgtgaggcagcggggagggaccgtgcacccgtggctatcagagcccctccgctgtcccaccctgggcctgggacacgggcctggggcagtgtgtgtctgctggtcatgtgctggtgccagttggggaggaatcagctgtctcggtggattctgagactcactgtggggcgggaagaagggtcttcactctgccattcagggataaagtttaattttatttttctacacattttgccaggtcaggcattttgctagtaagcaggatgcccccaactctcctctcagccgggcagcctggcctctcctgcccagacctgcggtcccagcatcccccagagccagggaacaggcccagcgggagggggttttatgttttgtttcaaacagaaaacacaaccttatttttctttacaaaagcaaaaaaggaaaccaaaaaagatacagcctttgaatgatgaaaaa

SEQ ID NO: 511027 - DNA, 946 bp, Homo sapiens
  misc_feature (23)..(23): n is a, c, g, or t
gaattattgctttggaagaaaancttacatctccacaagaccttgcttcccaaataagacatgtcagaagatgctgataatcctcacttctgcattacaaatcgctcataggtgcatctgcaggatcttacttggatccagagtgctagctgcaaaagcttctgggaattgtacacttaactctgaagttttatctttaatataggaagtgccgcgtatgatgctgtccttgacagaaatgtggccattaagaagctcagcagaccctttcagaaccaaacacatgccaagagagcgtaccgggagctggtcctcatgaagtgtgtgaaccataaaaacattattagtttattaaatgtcttcacaccccagaaaacgctggaggagttccaagatgtttacttagtaatggaactgatggatgccaacttatgtcaagtgattcagatggaattagaccatgagcgaatgtcttacctgctgtaccaaatgttgtgtggcattaagcacctccattctgctggaattattcacagggatttaaaaccaagtaacattgtagtcaagtctgattgcacattgaaaatcctggactttggactggccaggacagcaggcacaagcttcatgatgactccatatgtggtgacacgttattacagagcccctgaggtcatcctggggatgggctacaaggagaacgtggatatatggtctgtgggatgcattatgggagaaatggttcgcacaaaaatcctctttcccagggaagggactatatttgaccaggtgggaactaagggtaatttgaacaactagggaacaccatgtcccagaattcctgaacgaaattgcaacccacaagtaaagaaactatgttggagaatcgggccgaggtattgcgggaactcacctttcccaaattcttcccagattccctcttcca

SEQ ID NO: 511028 - DNA, 2225 bp, Homo sapiens
  misc_feature (5)..(5): n is a, c, g, or t
  misc_feature (44)..(44): n is a, c, g, or t
  misc_feature (109)..(109): n is a, c, g, or t
  misc_feature (1609)..(1609): n is a, c, g, or t
  misc_feature (1692)..(1692): n is a, c, g, or t
  misc_feature (1710)..(1710): n is a, c, g, or t
  misc_feature (1742)..(1742): n is a, c, g, or t
gaggnggcgcgcgtcgccgccccgcgtcccgcctgcggcccgcncccccggcgtcaccgcctcctgcccgcctgcccgcctgcccgcctgcccgcctacccgcctaccngcctacccagcctacccccctgccggcctgccgtccttccacgcggagagccatggagggagtgagcgcgctgctggcccgctgccccacggccggcctggccggcggcctgggggtcacggcgtgcgccgcggccggcgtgttgctctaccggatcgcgcggaggatgaagccaacgcacacgatggtcaactgctggttctgcaaccaggatacgctggtgccctatgggaaccgcaactgctgggactgtccccactgcgagcagtacaacggcttccaggagaacggcgactacaacaagccgatccccgcccagtacttggagcacctgaaccacgtggtgagcagcgcgcccagcctgcgcgacccttcgcagccgcagcagtgggtgagcagccaagtcctgctgtgcaagaggtgcaaccaccaccagaccaccaagatcaagcagctggccgccttcgctccccgcgaggagggcaggtatgacgaggaggtcgaggtgtaccggcatcacctggagcagatgtacaagctgtgccggccgtgccaagcggctgtggagtactacatcaagcaccagaaccgccagctgcgcgccctgttgctcagccaccagttcaagcgccgggaggccgaccagacccacgcacagaacttctcctccgccgtgaagtccccggtccaggtcatcctgctccgtgccctcgccttcctggcctgcgccttcctactgaccaccgcgctgtatggggccagcggacacttcgccccaggcaccactgtgcccctggccctgccacctggtggcaatggctcagccacacctgacaatggcaccacccctggggccgagggctggcggcagttgctgggcctactccccgagcacatggcggagaagctgtgtgaggcctgggcctttgggcagagccaccagacgggcgtcgtggcactgggcctactcacctgcctgctggcaatgctgctggctggccgcatcaggctccggaggatcgatgccttctgcacctgcctgtgggccctgctgctggggctgcacctggctgagcagcacctgcaggccgcctcgcctagctggctagacacgctcaagttcagcaccacatctttgtgctgcctggttggcttcacggcggctgtggccacaaggaaggcaacgggcccacggaggttccggccccgaaggtcagagaagcagccatgactgcggggggaggacacacggatgctcaggcccaggctttgccaggtccgaagcgggcccctctctgtcctgcctcttttcacctgctcacgccctcccaccccgcaccctacagccccaggtcctggcccagtccctccactgcctcgaagagtcagtctgccctgccttttcctttcgggcaccaccagccatccccgagtgccctgtagccactcaccactgctgccacctctctggccaatggccctttcactggcctggtgacnggaatgtgggcagcgcccacacaggctctggcccatggcttcctactggcagctccaggcacccccctctcaccacgccgttngctggctctgacactgtngggtgagggtcctggtcctgctgtcttccctnctggcctctgcacaggggtggtgacagtggctacaggctgggccctggcgtgcctgaccgtgcagcagagtgaggctggggcagcagagagcccaaactcaccctgacgagcacctgtggacagtcccatgggacctgcatatggctggaaacggcctgcaggacgttggtagagaccgtaacgaaggcaaaacatcgaaatctgggtagatagatgacaccagagtcaaaaacctaccgaattcccagaattgagaatatgaaaaattaggccaacatgagacataaaagagaaagaggaacaaaccccccgaaaagaggagcaaaacacagtaaaccaggacaagagaatacacaaaaagggacaaaaaacgaaagagaaaaagacaaaaaaaaaaacaaaagaagacaataaagatagaagagagaaacacacaaagaaaaaaaaaaacacaacaaagacagaacacagagaaacagaaa

SEQ ID NO: 511029 - DNA, 659 bp, Homo sapiens
  misc_feature (23)..(23): n is a, c, g, or t
gaattattgctttggaagaaaancttacatctccacaagaccttgcttcccaaataagacatgtcagaagatgctgataatcctcacttctgcattacaaatcgctcataggtgcatctgcaggatcttacttggatccagagtgctagctgcaaaagcttctgggaattgtacacttaactctgaagttttatctttaatataggaagtgccgcgtatgatgctgtccttgacagaaatgtggccattaagaagctcagcagaccctttcagaaccaaacacatgccaagagagcgtaccgggagctggtcctcatgaagtgtgtgaaccataaaaacgtgagttttgttatttttaaacttctggcagtgggagtttgtaagattggaaaaagaaaatgtgtctgtacttgagtaagaaaggctttctttgctttgcaattcctgcctcttaagattgtttatcctgccaatatgctacattcgatttcattgtcctcatggtagctttctgcttaaaaatcacctaaaaaccatatgatgtggaagtgatgaattttataaatatttccctagttagaaaatttaccatatttggttatcttgctccaaattgagagcttcaagaaagaaacaagacaaacaaagcccaaagccag

SEQ ID NO: 511030 - DNA, 451 bp, Homo sapiens
ctggcggatctagaggatcagccctacatttctatacttagggggctacaatcgggagtactactcgattgtcatcgtccaggagtcgcaagtcgcctggttactaggaataatgggggaagtatgtcggagttgaagattagtccgccgtaatcggtgtactcataggtaccgtaccaatgatggccacttgatttgatggtcagggagggatcgttgacctcctctgttatgttaaggatgcgtacggattggagggcgatgaggactaggatgattgcgggcaggatcgttcagacggtttctatttcctgagcgtctgagatgttcgtattagtaagtcctgtagtgagtgctcaagaaaagggcataccaggactaaggaagcagactcaggcatatgattatccagggcgtgatccctgaaaggtgatcagctcttctataatag

SEQ ID NO: 511031 - DNA, 118 bp, Homo sapiens
cttggctccgcgctgctgctgctgacatgtgcttggcgaacgtcggggtacagttagctgaagatgtcactgtgtctggcgtaatacggagtgtggccaccggactgtcaattgaacc

SEQ ID NO: 511032 - DNA, 276 bp, Homo sapiens
cctggatgaagtgtcgggacatcagcccctggggtaacagcccccgacgtaggtcccttggctggaaaaggaagagagaatgtttggatgaatctgatgatgagccagagaaggagctcgcccctgagcctgaggagacctgggtggcggagacgctgtgtggcctcaagatgaaggcgaagcgacggcgagtgtcgctcgtgctccctgagtactacgaggccttcaacaggctgcttggtaggaggacacccagaggacactttgcatccagag

SEQ ID NO: 511033 - DNA, 128 bp, Homo sapiens
tatacccgttgctgactgagcgaccgctcagtagtgttggatctcaacatgtggggtcggtgcttcacggcaccggaccacaatttttcgttattacgctcgcaccagctcacgcatgacggtcactt

SEQ ID NO: 511034 - DNA, 1490 bp, Homo sapiens
  misc_feature (2)..(2): n is a, c, g, or t
gnaagaaccctcctgggatgccacataaccctggcggtcatgaaggctgtgtgcagtgcaaggctgtacctagcaatagtcagaagcaatcagagctagatgtgggcagatttgaaacaccactaaaccacatacggaataatccacaaagggcagaagcctcactggcactagaggcttaagcacaaacttcaccacagctggctgaactgacccagaggcaactcctaggaaagcaggcttaagaagaaaaaccatgctgatccctgggcagcctgaaagtccctgtatacacccaagactgtgccttctccagagtgatgggagaagaaaaatccaagctagtagtccgtcacaaaatgtgaaggcaaacacataattatttaaattgcaatagcagcctccaagccacaaacacatccaaggtaaagagtaaaagtagaactggctaagcggtcttaagcacaatctatgaccagtgattttatgctgacccggagaaatctctacatagccaggctcaaagatataaacacgaggctgcacactgtgtgggaaatagagtttaagtcatcaaagcgtaaataaattggccaagacaacaacatcaaccccctggggtggaggaggggcaatcaataagcagtgttgctacaatgtattatgcaaaagttccagttttcaatgaaacaattacaagacatgcaaagaaataggaaaatgtgaccctgtattaatttgctagggacaccataacaaagtactacagactatgtggcttaaacaatagaaatttattttctcaaaattctggatgctagaagtctaagatcaagatgtaagcagtgttggtttcttttgagccctctctccttaacttgtagatggccacctccctccacgtggtcttcacatgctgtcttcacgtgatcttccctttgtgtgtgtatctaatctcctctttttggaaggacaccagtggtattccattagggcccactcatatgacctcattttacctaattacctctttgaaaggccctgtctccaaatacagtcacattctgagatattggaggttaggacttcaatctgtgaattttggggagaaacacttcatcccataacatattcagctcatagtagatacacagacagaagaaaggcagggaatagaaactgcttttgaaggagcctaaataattgacttagcagacaatgacatcacacattttaaataagttcagagaactgaatgagatcatgtctaaagaattaaagaaaatgtatgataacaatatctaatcaaatagaaaatgccagtaaaagagaaattatttttaaaggtaccaaatgaaaattctgaatttgaaaagtacaaaaatataaataaaacaatgactaaagggtctcgagagacagtctgagctggtagaagaaagaaactgaccttgaagaagatcagtagagattatgtaatccaaaaaaaa

SEQ ID NO: 511035 - DNA, 944 bp, Homo sapiens
gggaaagatggcgtcccgcaatagaaggttaccggctctactgccaactcttccaggctcctaccgccgtggcgcatcacggaaaggcaagaggcaaatggcgggctcgggagattcagccgagaaggcaagtgcagatagatggccttgctggtattaaatgataactcaacacatccatcatggaagaagggacaatgggaactgacagttgtgcaaggagtgctccttgggtctggttgtcaaacgatcgcgcgttgaaatatatccaccctgctttcctttccctcagcatcgacagaggatgatgctgactttgaatgaaggtccaatatcagagtggaaatgatggcggagccttcgccatgtaaacattgatcatctacacgtgggctggtatcagtccacatactatggctcattcgttacccgggcactcctggactctcagtttagattaccagcatgccattgaagaatctgtcgtgtctcatttatgatcccataaaaactgcccaaggatctctctcactaagaggcatacagactgagtcctaaactgatggaagtgcgtaccgaaccggattgctcccctgaagccttgaaacacagcaatatcacctttgagtacatgtctgaagaagtgcgattgtataaaacttcgccttgatcatggtcctagtgctgggaacttgaaaagacgtccagccggtgcaaaatagcatgactgcgcatcctggccgcagaacccattggggagacctacgtgcaggaccgactggctacatgcccccaatctatcccaccatctgcaacctagccccccgacctatccggacccgaaatctccgacggaaaccccagggccacaaacaccgcgggcgtcaccaacggcctcgtcaacaagcactaaaaaccaccaccggcacaagtataccatacgc

SEQ ID NO: 511036 - DNA, 261 bp, Homo sapiens
  misc_feature (77)..(77): n is a, c, g, or t
  misc_feature (93)..(93): n is a, c, g, or t
  misc_feature (159)..(159): n is a, c, g, or t
gagaaaagggaacccttgtacactgttggtgggaatgtaaattagtacaaccactatggagaacagtgtccaaagtntccatcaacagctgantggacgaagaaaatgtggtacatatacacaatggtgtattcacccataaaaaagaatgagattcantcacttgcaacgacatggatggaactggagatcattattttaagtgaaataagccaggcacagaggtaaacttatgtcctcacttacttatgggagtttaaa

SEQ ID NO: 511037 - DNA, 125 bp, Homo sapiens
tggtgcggtggtgatagaggatcccgacaaaaggagggtcacaagcccagggaagcagtaaagtcaagaactagtgggtccagcactgaccggttctacgagggcagcaatttcctgctcagccg

SEQ ID NO: 511038 - DNA, 847 bp, Homo sapiens
ttttttttttcttcgttatcttcgtaaaaggtctggcggggggaatgcttggctaaatggaactggggtcctggactagcatttcattcctcaataattgtcaagggaggagggagagatggattgtattttcaataccatagcgggtgtgttggtagaatcggcccagaacgcggtaagacctaccgcggggataatccctgccacgaccactcgataagatagacacgtgcgcgggctttacaaactggacagggagcctgtgggccaccggaagtcttttctcttcgtgtgtcacaatctccacgggggggaagattcccctccttcgtttgtgattggtcctctcacgcgaaagatccggtcacgtgggtgccagggcgcggtctgctcatacaagctgtgcgggagtcaccctcgtctctcaacaaatcagggacagatagcgtgcgccgctctgccggatatctcgcatctgttagaatcccccttgatagactaagtgacgcaagccccctctcgcgcgtcaagggcaccgaatgggctggcgatctcagagtggtgcttccactgggctgaccgcgtgtgggggatagcacccttcttgatgtccgccactgggtgtctcctcgaagggcgcaggggccgcaatcccagcgtggtgtccctgttggtgttccgggaagccgggcgcccggcgtcggtttctccgggggccccctctgttcttcgaatcgtcgtcggctcgtgcacggcctctgccgggggtcctcccattaaccttttgctgggccccctgccccgagctgccgcgccacggccgtcagttgcgcttgctgtccccccg

SEQ ID NO: 511039 - DNA, 821 bp, Homo sapiens
cttgtttattgtgttcatgactggtgaatatagcgatgagaatgagaatgtttaatttgtagtttccgcgccgcccgttcactatcgcccggtcgactgacgttagagctctggttattatatgctgctctgctactttctctatggctatcggggtcgcatcacagcagtgacccaccccccgcccccccccttaagcattaaatattaaattttgatttgttagtgggtttatcgtggggaggggtgttgcgttcgcggttctgctgatgcttgccgcgcatggcactgatcttctgggttcctccaacattatatagttaaacacatcatttattgattgtttttatatttgtgaggtgccctcccaaccccccctctaggccccccgctctcgtatggcacggcgatccccagccaggcgcgagcgaagacagcgaataagtgcacgttaggtacgtgctcgtcggccgtcggatgtcgttctgagtgagttagttcacgtagacatcttgtgatccgtccgccaacttcgtcgaaacccaaaaacttattactatctactacgcatatcaagaatcgcatcagagcgtcctgatcaaacaccagcaacctcatcccccgcacatcgcacactacttctccacgcacaacaaatggccagtagatgtaaccgcgattaactctcgatggtcctattcgcgctctacagtgtttgcgttctatttcctgctgtttatctttcgcttcgggcgctgcacggtgtgacgtaagatacgttgtgccattgtcggcctcccctcttatagttcggattctcg

SEQ ID NO: 511040 - DNA, 658 bp, Homo sapiens
  misc_feature (574)..(574): n is a, c, g, or t
ttgtatttttagtagagacagggtttcaccatgttagccaggatggtctcgaactcctgacctcgtgatccgcccacctcggcctcccaaagtgctgggattacaggcgtgagccactgtgcccggccaatatgacctttttaagaaaaaaagaccgcagtccgtaaatataagggcataaagcaggaccataatcacatacatgctgactgtgtgttgagagcagtttctgaggcttactgccggcagggtcacagtgagaagggcctctaatttgggtggtgccttctggaaaccaagttggtatggatcacgtccatacaagacactgcaaactgggaccattgcttccactcctaagaagctgtctggcattctggtagacgctggttttcctccaccgttcctggctgacccttccaggagaggtcccacctaagccctgggggcaggaatgctgacatcaggaagcttccgtaaaatcccaagaggactgaggctcagggaacttctggacaggggaacacctggaggttcccagagggcggcaactagcgaggacatggaagcgccngcccctccccgtgcctctctctacgcttcttcattggtatcctttgcaatcaataccctttacaataaaccagtaaacgtcaaa

SEQ ID NO: 511041 - DNA, 703 bp, Homo sapiens
  misc_feature (693)..(694): n is a, c, g, or t
  misc_feature (699)..(699): n is a, c, g, or t
caggtgtccatatacgatgctctcactatagacataatcttccagtgcataggccatctggatggtaatcagcagagcttcgatcaggaggtcccaacatcactggatgtagcttggttgcttttttggagtaaagtcaaggggtcttttcctgatgccagcagtgtgtgcagaattcgctgtttcacttgctcccactcaaccaacattgactcccgatggtactcctcagccatgccgaaggtcctcttccgggactcttcgatggcagacagcagggcattgtccttctcattcttcaggaagccctgaatgtcagtgtccttcacaggctcaagaggctcaaaggtggtggctgcactcagactctccaatcgctgggagatgtgggatatgtcaagtccccgagacccgaggagaactgacgccttgacatctgccgtctcctgggacgtgcgtgttagggtacgggaacgcaggcgctctcccgcctgctggatctcctgtaagttccgttccacatggggaagctctgagatgccctcagtctcagcagcaagctgttcagcttgctgaaggagctcaccaaacccctcagtatccattggagatgcagatccttgtgctacagccgtctccgccgctcaggtgccggcttgaggacgcggccgccgcttctcgcgccgctctccnncgctncctg

SEQ ID NO: 511042 - DNA, 140 bp, Homo sapiens
  misc_feature (130)..(131): n is a, c, g, or t
  misc_feature (136)..(136): n is a, c, g, or t
cggcacgaggaaggacaagcccagggtcgcaaggacgcgaccagacacacccttaccttgtgctacagccgtctccgccgctcaggtgccggcttgaggacgcggccgccgcttctcgcgccgctctccnncgctncctg

SEQ ID NO: 511043 - DNA, 834 bp, Homo sapiens
tgtggcgccaggattgaaccgcgctgacgaagtgggtgatccatcttccgagtatcgccgggattcgaatcggatgatcatcccctctctagaggagctggactccctcaagtacagtgacctgcagaattagccaagagtctgggtctcggggccaacctgagggcagacaagtgtgtaaaagcctttgaagggttacattaaacatgaggcagaaaggaaatgagactcaggatgaaagtcaaattctgatcctctggtgatgagatgagatacagatcagcaaccaggaagaagctgagaagacagccattggccattgtcaccaaaacagggagacggtgcaagaactgtccgtgtggacccctgattcacaagaatcatggaacgcaggacaagccaggatctcagagctactgcaaaagttcccttctccaccagagagcaccaggaaagctgagaatgctgttccctcaggtaccagagattcacaggtaccttcagagggaaagaaatctctctacacagatgagtcatccaaacctggaaaaaataaaagaacgtgcaatcacttactccaaaatttaaggaaagcttcatagaagctcattttacgggaaattggcgtccattgctcaatcattttgtggggcgcacacaccggcaccttttcggccgaacacacttccttgaatgaactggagcccgcccatcaataaggggggggtccggacttccaggacttccaggagggacactctggggttaatcccatagccacaggtcgcaagcgggtttggccgagcaaaaccctggcggagggccccaaggcgg

SEQ ID NO: 511044 - DNA, 616 bp, Homo sapiens
  misc_feature (1)..(1): n is a, c, g, or t
naacagggccgtcggttggctcgctcggaaaacaagggaagttggtatttaccttcaaaagaccttggggtccccttccctcaccttgaaaaaagaaattgtctctcacacctaaaaatctcaagtgcatacacaaaaactcaaatacagcccatgacgggcagagcgctcaatgaaaggtgacagattagcaagaagcccaggagtcagacttatttccctatttaagaggtaaatcgattattagaatcagactctttttaaccttcaaagcaaaaatgaaaataggtaataactttctacccaggcgggccacctgctccccaactatacacagacaacctcgggtgctaagagtgtttaaacatgttcatcagattctcctaaagcagtaacagccaggcatgggctgagacagcattttggaatgtgtttgaaatggtgtaatcttccttagtgccctatctttattgagggagaaagagagagaaaactaattgagaagtaagaagtgagtgggcagtttggtagaagcagccacccatttgattttgaagattttaaggaaagaaagaagattttagatgaaaatgtatgactgcccccttcaatctcc

SEQ ID NO: 511045 - DNA, 734 bp, Homo sapiens
  misc_feature (263)..(263): n is a, c, g, or t
  misc_feature (277)..(277): n is a, c, g, or t
  misc_feature (279)..(279): n is a, c, g, or t
  misc_feature (296)..(296): n is a, c, g, or t
  misc_feature (299)..(300): n is a, c, g, or t
  misc_feature (305)..(305): n is a, c, g, or t
agcgggcttgtgcaagtaacctctggtcttacgtgtgtaactgagagaagagtgtgtgtttgtgtgtgcatgtgtgtttattgttcctaagaatttggcacaagtcagagataattgcctatactaagaatctatactgcagaatatagtgtatcaaaaacttttttcttttaaattattaaagtgtcttttatacttttatgaaatcattggtagccccccaagtgtttaataactggcattaagcttagagggtgaaaaanaaaaaaaagatggntngtattttcataatgaanaannctgangagatacgtgaatgaaaccaggccatagctgtcataaatcttggactttggaatatttacattcttcagtataatttttataatcctcaattatgaaccaccttgtttataggacaaaaaattttacccaattttattgaaccgaatttcactgtgctacacacgtgggtttggattcaaaccttgtgagaagttcgtagattccagatatatgattcctcctatgcgaaattaaccacttctctgtcacgtgactcggtggagtttggattcctctaaattctcagaatgattctttaggaattctataattcatagcaattttgtgacaagtaagattgccaaatagaaatttctataaagattccacagttgtgacattatggtgtgtatgcagattgtgacacatcggttcaatactttgaacga

SEQ ID NO: 511046 - DNA, 969 bp, Homo sapiens
  misc_feature (371)..(371): n is a, c, g, or t
  misc_feature (969)..(969): n is a, c, g, or t
agcgaagagggtccacttcattaaatggaatgagagtgaccaagctgtaacatttgcaggaaatgactttctatttatacgtaagtcagaaagaggaaaaagaaaacttaattcttaccctatttttgggtcccaactccctgagaagcgctgtagaaacagcctctgtgtgaactgttggagagtccgtacgaacacacacgccgttcctactacgcatgcgatgaagatcaaatcgccagacgatccggccccgacgctagtctgtcccagcaaggtcagatttccattgtcctgttgacaagaggggcagtgctcacgcgtgatctcaggaatgacgagagctttggagcccttgaacgatatagccnagaaatgggcgaaatggttcgaatttgtggaaagtccgtacacgtaggcttaccaccgaattcgaggaaacccgagtggaaggctccaacccctggcgtaaaagattacttagcgaaggaaggccatgggggacttggtttccccccacggccctagtgaacggccttggtccccaatattccccccaaagttataactacccagattgtggtcacccacaaagttgtggccgtgtagacagtgcccacaaggcttgggtctccccacagaagttgtagaaaactccccgaggcacagcggtaacacatatgagtcggccatttagggtttgccggagcgatttgcatgtgccgccaattttccgaaggttagcggtaatacggggcgcacccgttactggcaaatggggtcccctgctattaaccccggacgtagtgtaagcgccaataggagtggccaaaacccaaacttttttctgcgcaagacgatactccaagagggttatggaccgggggttatcccccgaaaggttgatgtgtgtcgccccacaacaattcgtcagatgtgagcaccccaatactccgaatgcttactcgn

SEQ ID NO: 511047 - DNA, 1068 bp, Homo sapiens
attcgttagcgacgcagagcgcagtcaggtcctgtgagacatggctctagtatctgtatgctaatgatgcatccctgggtgccagtgacgacgtcgcgtttgcgatatctacaacacgagatgccaacagcgcgccggggggccgactcgaggctgtagcgtcgaacgagattgccagaatggtagtctactggatggtcgatatgactgagatctcatggaacatgcgacgtacacctggacgtatcggatttcagaaagttagcgacttcgcgtcctgtggacgcgaattctacccttgtggtttgcatagggcccaaatttcggaggcaccttccattacggaatcgcaaaacgcatttaggaacaaagcaccttttaaccaagctgctgttgactccaccaagctctccacttgtgatccacagaatactattcgaatccttacgagacacttctggctagcgaccatctcggacccgggttacctacgactttgacctaactttcctaactccttttcgcctccccagtaacccttgacctacgcaatcaggattaccttcacactgcgtggctttaactaactttggcctctaggctaggctcactgtccgtcggtatctactccatcacacacttcccagaatagcgcttattgtggcaagacggttgccatcataccaacggagctcagaatcgccgaattggcgcgcacacagcttttgcgtatcgggcacgtaaactcgggctggagggcagatcaacacgctaagccaacacactaaaccgccatacttagtactctggaatctcgaccgatgtggagcgggaacactttaaggaaacacaaggacgctcttgcgcaatcacttgggggaaaacacgagtgtttgcagttaccacgcctgtatatttgacagccctacatagcggggcacccacaggcccattttcgggccccggaaacacttcctgatggaggaatagtggcccagagggcgtcttcaatctcataatgggcaaagtctttacgtatcgttggcctcgttcatagggacaatccat

SEQ ID NO: 511048 - DNA, 745 bp, Homo sapiens
tgagtcagctacttcacactggtcaaggcgtgttttaccccaaaactcagacaggactttctatgcatgttttgccctccctccccgcgcaattccccccgccccgatcaccgttatctcccatggacacacttgacgaagtagcttctttattccctagtggtgtacatttaagttttaacaagaggttgcacaggtatcatgctcggtggccgaacacgtgtattatggccgttctggtgtcagtcattttctctttcttcacaagtggtcactagagcgtgtctgaaatgccaaggttgacaaccctgataatcgttgatgcagatggcttctgtaggaataacttttagtatttatgtaaaaatgtttaaatttatgggatgctatatgtggtagtggtcgtcgttggtagttggtcatttgtcaatattcagtcagccaattcgtgctcacttcttgccatggataaaattgggtctttctggctaagttaagaaagacaattgtataaacatgggactttaagcaagccatagttaggttgttagttctgtaagtgcacatgggaaagcagaagacgtggtgatgaaggaactgtcatctaagcaaaagatcgagtatgatatgagtaaggctttctacattctaatttagctgtttccccccacttgcatgtgtttaaagggctaattatcaggtcaggaagcagtgagaactgatcacatggggttgtttcctaaca

SEQ ID NO: 511049 - DNA, 120 bp, Homo sapiens
tcttattgaggccacaggctctagtttctttatagagctctctatcttctcttttcagtaatgtgccagcttagatctggcctttgtaaaagagacttctcctattttgtcagctgatga

SEQ ID NO: 511050 - DNA, 104 bp, Homo sapiens
gtgccttgttctcttcatgggcctgctggtcatatgccatcagacaataagaagtaggtggagaaataggtatccatgctgaggtcctgacataaaaaggtcca

SEQ ID NO: 511051 - DNA, 886 bp, Homo sapiens
gtaatcccagcactttgggaggccgaggcatgtggatcacctgaggtcaggagtttgagaccagcctagacaacatggtgaaaccttgtctctatgaaaaatacaaaatttgctgggagtggtggtgcatgcctgtaatcccagctacttggaaggctgaggcaggagaatgtcttgaacctaggaggtggaggttgcagtgagctgagattgcaccattgcactccagcctgtgcaacaagagtgaaactccatttcaagaaaaaaaaaaaaaaaggaatttgccagctggaatgtttcccaggggtgtgagaaacattgcccatttaatgggaatcttaaatcaaaggtctaacgtcagatatttttattaccaattggacaacttggtggcacaactccctggtttctaatggaccaaaggacccgaggttacttaaagagggacttggaaccaagaaagtcagtggtctccacatgtgggatacacacttttccccctctgaaaattcaaaaggggtgtttcctcaccgggggtggcgccaaggtcacttaaccctctcaagaggatagatacctactataagggattcccccaggggtgagggccttaatgaaaaggcctgagttaatcccaggatgcttcatatagctgggggaaagttggcgtcctcaccagcaggtctcaggaaggtctaagccgcgcttagcaatccgaaatagaacttggtccaaaggtttgagccggaccgccaaaattatttcccaccctttaggaggtaaggcgacacgcggtgatcacaatcggaagtacaccatgcacggatgacgcgaggggacaggatacatacggaaatggggcaatccctctgtactatatgtatgc

SEQ ID NO: 511052 - DNA, 383 bp, Homo sapiens
  misc_feature (55)..(55): n is a, c, g, or t
  misc_feature (147)..(147): n is a, c, g, or t
  misc_feature (163)..(163): n is a, c, g, or t
  misc_feature (195)..(195): n is a, c, g, or t
  misc_feature (310)..(310): n is a, c, g, or t
agggccatcgtggcgtcagccgtgagctggcgtcacctgtgcagggccctctggntcagccatgagctggcctcacctgggttccccaccccgggctctcctgccctgccctcctgcccgccctgcctcctgcctgcgcagtccttncctaggcacctctgtnctgcgtcccaccagcctgagcaagacgccctntcggggcttgtgccgcactagcctccctctcctctgtccccatagctggttttttccaccaatcctcaacttaacagttactttacaaatttaaactcaaagcaagcttcttctncttcagcttgggggcagccatttggcttctgtcttcgttttttggggaaaccaaggtcaaggaaggccgttgc

SEQ ID NO: 511053 - DNA, 165 bp, Homo sapiens
cgaccatcacccaacattctagtgggtgggtgggaggtgagaccctctcctgccttgctcatgcctaactacctgtaacagattcagttcggccattttataatgtatgagcatgatctgtggtcccccaaaacaattacatggcacgcgacatcgccaggggat

SEQ ID NO: 511054 - DNA, 155 bp, Homo sapiens
aggcacctgtggagccatcctccttgttttaatcgtcctgctgctgctgccgttccgtgtcgcgtcgcccacatgaccctgaggtcgcaatgatgagtcctctctggtcagacaccgctggaaatgaataccaggcctgacctcaagcaaccatg

SEQ ID NO: 511055 - DNA, 560 bp, Homo sapiens
tgcacgagagcaaccaacacgtgattataaccctcactgtgaacccagcacacacgtgctcatatggagaggggaaaaaaagtgaaagggacttgggaaatattacaccggctggcacagtgtttgagaactatgtggcagatattgaggtggatggaaagccagtagaggtggctttgtgggacacaggtgtgcaggaagagaatgaacggctgagggcccttttctatccagataccgagggtatactcggggggttttccattgacaggcctgatatggttagaaaacattccaggtggaccccacaagtgaagcgattttgtgccaacggggccatatattctggttgggaatatagaaggagattcggaatgatgagcacacaaggcgggagctatcccagatgaagcacgaaccgcggaaacctcggaaaggcggagatatggcaaacaggaatggcgcttttgtgtacacggagtgtgtaacacagaccacaaatagagtgagagaggtttttgtggctaccagagatgctctgtaagctctacactgtggag

SEQ ID NO: 511056 - DNA, 330 bp, Homo sapiens
accgcacgtctgtctcatatcacgaacagcaaagcgacccgaaaggtggatacgtctgagaagctctcaacacacatgggcattgccagagaaccatattaaccacatggtaggatcaccagacttcaagaatttagggtcatcttccagctttttaccagaacggtgatcaatcttttccgttcagctcagcaaacttgcatgcaatgttgagccgtgtggcaatccactacaggggcatagccggcgcttatttggcctggtattggttcaggataatcacctgagcagtgcatccagctgcttccattggtgggtcagtaacataag

SEQ ID NO: 511057 - DNA, 699 bp, Homo sapiens
  misc_feature (448)..(448): n is a, c, g, or t
  misc_feature (469)..(469): n is a, c, g, or t
  misc_feature (661)..(661): n is a, c, g, or t
gcttatttggttacatgcccctttggctttcttagaaaagccgaaacgaaaggtctgttacctttgttagggcccaaaggttcttgattttgttctttaaaaaactaaatgtccttctttatacttccctggacatgaaaaaaaaagtatttgcgggggcaaagacagatggttgaacttcagggggtggcattttgtctccgtttccattgctggttttgggtaattttactgcaaagtggtattcagtggacatgaaatttttttcctaaaatgctcttgtttcgtccgaatggttatttttatattcatgaagaggattacacgtcaagctctaaggtacatgtggcaacatgcaggtgtgttacatatgtaatacacctaccaagtttgtgagggggaccccctaacttgacgtttagcgttacgtagatctcctaatggtatncctcccccctccccccacccnacaactggccccagtgtgtgatgttccccttcctgtgtccatgtgttctcattgttcaattcccacctatgcgagagaacatgcggtgtttggttttttgtccttgcgatagaggcattcagttagtaaagaggttggagcaacaactctttttttttttttttcacaattgtaatcgaacaggtaatgaanccatttgttaaaatatttgcctttttaagtaaaaaaga

SEQ ID NO: 511058 - DNA, 217 bp, Homo sapiens
cgttccttaaaacattttttaaattagctgaattaaatcccttctcataggccaggcattggttcgcctcgtgcttattattcccagcactttggaaggctgagactgaggttgaggctgaggccaggagtttcaagaccacccgtggttaacttcgcaagaccccacctattaaaaataaaaaattctttgtctagttaagtctaacgtctggtcc

SEQ ID NO: 511059 - DNA, 162 bp, Homo sapiens
cgccagccggtcgatcagcgggcgccactcatcggcgttgtccggatgcccgtgcagcatcagcacgacggggccgcgaccggcctccagcacccgggtcctcaccgacaattccggcatgtggaacctgtgttcttcaatcctggaagtaatttgaacctt

SEQ ID NO: 511060 - DNA, 692 bp, Homo sapiens
  misc_feature (441)..(441): n is a, c, g, or t
  misc_feature (462)..(462): n is a, c, g, or t
  misc_feature (654)..(654): n is a, c, g, or t
atttttggtggggaaggccactcgggattttaaaaaaaagaggaccacgcggccctgtttatttgtttgggctccgcgccaattcccgttgggtgtagaaattacaaaaagtcctttttgatggagaaccgttaaggatttttcggtattgggagacaaaggctgttgaatatacttggggggtgggattttgtcagggtacacattctgtattagaaaaattcctttaaagcgcgtatcaggcatacgtgattctgtgttcctaaaagcccgttggtaaaccttatagtggtaatttcttgcacctataaagccccacttcaagcctaagggtatttgtgagaacaccacaggtgtgtcccaaaagtaaacaagcctcatctttcttttcgggttccccctcaatatcgggagctgggcgcgagtgctcataaaagtatncctcccccctccccccacccnacaactggccccagtgtgtgatgttccccttcctgtgtccatgtgttctcattgttcaattcccacctatgcgagagaacatgcggtgtttggttttttgtccttgcgatagaggcattcagttagtaaagaggttggagcaacaactctttttttttttttttcacaattgtaatcgaacaggtaatgaanccatttgttaaaatatttgcctttttaagtaaaaaaga

SEQ ID NO: 511061 - DNA, 875 bp, Homo sapiens
ctgttgctggtctccgtccggtctgccggccgtctagtgtctccgtgccctccccagccgctcctgcgcccttgccctggcccctgccgccctgcagccctgtgctgctccctgcgtggcccctgccgaggtgcctgcctgcgccctgtgccagctgctgctgcccctgtggaacctggtgctgctgcctgactgctggccacctgcttcttgtctgtggctgttgctgttggttgcgcttcttgggcctgatgtgagtgactgtggccacttccctgtgcccctgatgtgctgcctgactgacttgctggcatgctgctgcctgtggatgccctgtgcatgtgccccctgcttcatgcctgcctgcccttcttggggctgctctgatgtgaggtgctgtgcctgctgggctgccctgctgctgctgactgtgcccctgtgccatgctgagtggcctgccgcttgcgatgccttgccttgttgcctgctgcctgactgccctgtgccctgcatcttggccgcctgccctagcctgtagtagtgcttcgccgtgtgccccccctgacgcctgcccctgatgctggtgtgaacctgctgcttgcgaggtggagatgtgctgcttgcgctgtgcaactctgcaccaaacccaaacggcgcgaccttgttgggacaactccattcgaccagacacgtgaacctcttgaatttgacctgccctgggaccccttgcattgtgcccagtgtgccagagtcatggcaacgctttgcatgtgttggacacggggaccaccgtgaattggacccgttacggacatcgaagtgaccttggaccggaactaaccaaggaatgctagcgctggcctcacatctgtcgg

SEQ ID NO: 511062 - DNA, 408 bp, Homo sapiens
tggtataagtatctgatcagattcatcaggccactcttggacaggatcctgctgaatatgatacactcactagatgcctttctgcatgcgctctattggctctattgttctgtgagatgttgtaagagctcaccatgacatagactcatgccatatatgtagtcagctctgttatatcattctcagccactgggcagtatcgcttccttctgacactatgctattcatatctgcgtctcatgatgtctgtagggtcatagagttctggtccactcatcgttggtctactcacagacgcctccagatgcgtaccatattagcgcgtcagttatcatcatcgacagcatgtatcagaagcccgcgagcgttctcgccatggttgtagagaactatcgtggagggtctccg

SEQ ID NO: 511063 - DNA, 230 bp, Homo sapiens
gccaggctcactcttactaaccctttcaagctctgtccaagcatttgctgcctccagaaggccttattgaagcttctaagtccccacatgggcacccccacacagtgctgccgcagagcaatgccctctaggagccccggtgttggtttatggttatgtctcgactcctctccccatttgtgagttcagttcccagcccaggcgcatgcccaataaatgtttgatgaccc

SEQ ID NO: 511064 - DNA, 300 bp, Homo sapiens
  misc_feature (283)..(283): n is a, c, g, or t
cacgaggaccgctgacgccgagcgcgatcagcagcaccgcggcgacgaacagccggcgcgccagcggcggcagacgcaccatctgagtcagttcgcgccgctcgccggcgatggtgagcacgagaaagccgacgccgccgcgggtcagcgcagcgaggtcgccgtgcagcatccacagcagcacgccgaccagccagcacgcggcaccgcccgcttcgaccagcagatgcagcgaccaggcgcgggtgacacccgcatatatatagagcgtgacgagaccggncgccgcggcggtccatc

SEQ ID NO: 511065 - DNA, 550 bp, Homo sapiens
tgaaatataatgatgaatatctggaaaaccaatgtgaatacgggatcaatagatagtaaaaagatccatttacataagattacctaagattagggcttataatatatgctagtatatcaagtttatcactaattactaacatcaatgtacaaataacatgtccaattttggttctgtaatccaaagggaaaattctaggctaaattctatccagggggggggagggggactagaaaataaaaaagtttcaaacagttccatgcaaacatcacattggtcaaatggaaaaactgccaccgggaccagaagtgcatacggctaaggtccttgtcattgaaacaagttctgtgcaagtacaattacatggctttacggttcagaatctaatataggcctgacaatcacgtccttatttccgggaggaaggcctcacgtccaataaatttccagtaacaatgtttttagaaatcaatttaataatagggggtttaatttccttcatgtatttgtgttaagcattctagtcttaagactagattagaagttagct

SEQ ID NO: 511066 - DNA, 707 bp, Homo sapiens
  misc_feature (67)..(67): n is a, c, g, or t
  misc_feature (291)..(291): n is a, c, g, or t
gggagtgtccgcaggtgacaggctcgcgaggaagatggcgtaccagatcttgtgctggacatgagangatacccctggatgatctcctcgatccgagaccagactaggagcacatactacccatctgtggcatgacagtccttcaacccatgcgtgcgtgcgagctcggaggctctgagaaggttgactctacattgctttctctcgatcgtggtacatctcgaactcgcgtgagattcaaatcgttatagaagcagctttacaaatttgatggactgagttcagactcancacatatcttcctgtgagttctaatgtcggagccgttgtgtcggagtgtgcacacttgtcttttagtgtcaaaagtattagaactatttatactactactacgtttacctgttcggaaccttgcctacgacgacgtacatgggacttctatctcctctgagggctcctgggatcacgcacaggcacccattaaaggatcattatggcactggtatacccctccttggggggcctgggcagttctccgtttcacagttgcaccctcgcatatatgggggggagatcctaggtggtagccttggaagccatttcagtggttttcccggtttgggtgcggcacaacgacccttgtataacataatatattgtctcgggtcctagtggtgcgtgtggatggccttaaaggtaactcatgg

SEQ ID NO: 511067 - DNA, 195 bp, Homo sapiens
  misc_feature (170)..(170): n is a, c, g, or t
ccccatctgtaccccccagcaggggccgagtcgctgcggacaacgtatgtaaatgggctcagcaatgccagctccctcaattccccatgtaacccccccaggactcaccaaaccccaggggctgtcctccaatccggaccatcttccagagctctccggatgcgcttgtnaacagcaagttactaggaaaccttc

SEQ ID NO: 511068 - DNA, 489 bp, Homo sapiens
  misc_feature (37)..(37): n is a, c, g, or t
  misc_feature (46)..(46): n is a, c, g, or t
  misc_feature (92)..(92): n is a, c, g, or t
  misc_feature (118)..(118): n is a, c, g, or t
  misc_feature (125)..(125): n is a, c, g, or t
  misc_feature (139)..(139): n is a, c, g, or t
  misc_feature (144)..(144): n is a, c, g, or t
  misc_feature (222)..(222): n is a, c, g, or t
  misc_feature (239)..(239): n is a, c, g, or t
  misc_feature (252)..(252): n is a, c, g, or t
  misc_feature (341)..(341): n is a, c, g, or t
  misc_feature (366)..(366): n is a, c, g, or t
  misc_feature (411)..(411): n is a, c, g, or t
  misc_feature (424)..(424): n is a, c, g, or t
gggccaatgggtgggacctttccatgagattttgganaattgggtnacctgacccctgcttttttgaaaaatgtttccggggggcagccacntggccaatgtgcatttttgcacatgntggaacntttccatgggggtntgggntattggctggagccaggacatgagtcaggggcaccatggacctcacgtgccagggagacttgaatgtggctgtcactnttccggacgccaagggntgcaggaggctgnttttggcactacccaccccgtgtgacagaataggagccagcgattcaggactgctcacgggtcaggagggcaacgcctgaagtcagacntccctataggtcaacagggacaacntggggatttttggagcagggccttcttttttcaggtttggcccantcccccagacacntggacacgtggccacaaatttgggacaagggcccccgcacagcatgaaataaaaagtgcctgagg

SEQ ID NO: 511069 - DNA, 148 bp, Homo sapiens
ggggggggtttttcccccttttttggggggaaagggggttccttgggcccaaaaaatttttgggaaatttttttttaaatccccccttgggcccattgggtttattttggggtggggttgttttttaaaaaaagggggggggttttta

SEQ ID NO: 511070 - DNA, 312 bp, Homo sapiens
gtcgacccacgcgtccgaggacgcgtgggcccatgcccaaggtcaacaacaaagaatcatagcagcactttgggaggctgaggcaggcagatcacctgaggtcaggagttcaagaccggcctggccaacatagtgaaaccccatctctactaaaaatacaaaaattagctggctgtggggctcacgcctataatctcagcttctggggaggctgaggcaggagaattgcttgaacctgggaggtggaggttgcagtgagccgatatcgcaccactgcattccagcctgggtgacagagcaagacactgtctc

SEQ ID NO: 511071 - DNA, 421 bp, Homo sapiens
tgaagattgttactgtctacaatatcagttaccacacccagcacaaaggtcgccttaagtacagaggctccagtctgcatcctttcaggaaggtgcctgcaagagaaggacaaggtgtggctgttgcgggatcagaagcgctagatgaaactccgcaagctgtgtcaagcgcctgcagaacaacgacacgcgcaggatgccaggcctcacgtgcttcacccacgacaaccagcactggcagacggcgcctttctggacacctgatgcatgcagtgaacacactggacagggatgtcctcaaacagctacacgtacagctcatggagctgaggagctgaaagggttacaagcagtgtaacccccggagtcgaaacatggacctgggacttaaagatggaggacgctatgagcaatacagggg

SEQ ID NO: 511072 - DNA, 1553 bp, Homo sapiens
  misc_feature (326)..(326): n is a, c, g, or t
  misc_feature (369)..(369): n is a, c, g, or t
  misc_feature (400)..(400): n is a, c, g, or t
  misc_feature (434)..(434): n is a, c, g, or t
  misc_feature (493)..(493): n is a, c, g, or t
  misc_feature (527)..(527): n is a, c, g, or t
  misc_feature (558)..(558): n is a, c, g, or t
  misc_feature (568)..(568): n is a, c, g, or t
  misc_feature (963)..(963): n is a, c, g, or t
  misc_feature (1053)..(1053): n is a, c, g, or t
  misc_feature (1550)..(1550): n is a, c, g, or t
accattccgctctgtactctaacactctccgcctgctcattacttcatagctgactcctagccctgatatattcaatgctgagtaagagcgtcaaataattccacgtgacaacacttattaattcacagatatactatctcacctactacttatactcacattgtcccataacgaatgctgctcaatctaagtaatcattctacaacgccagacgaaccgacatccatttatttcctattccacatcattcgtaatacctcacttcatatacataccactaactttgcgcggtatacatgcaacccaatatgaccagcataactangccacaatacaacgtacctgcaaccagtcaagagtaacattcntatatcgctactattctaccaactacataantatagggatcctcgtctcccccctatctctcccntctcgtgccgtatcctctataaagcgtctacccacaaggccatacgcgctcatgataanatccgtgtcctatgctatctctctatctcatcantgtagcacacaaaggaatacgtactccacantctctcatgnacgactaataccacaacattttacaatcatgcgcacctccagacttataaaccagttaaaatgacgcccttttcttttcacttatcgatcataccatgcattcaaaccattcttttaatacgcgagtacattcacgaccatgtgactaggatcttgcacgcgttagggaagtcctcacaaatgcctaagaaaacgccaggccctaattgccggaatggagtgctctaaagtcaaggttacaccttcttcgtcccagataatggatcccctaacttattgaagggacttgcaagagtcagagtccatgcctcgggtttctataaactgggctgaccccaataccaccattataccaattacattccaatattcgctctcataggatttaaaaccantaattcttatattagttttatatcccctcataattccatttgattccggttaatttcccttatagtaacggccaatacattttaaataanctcccaagggtgctcccaattgtatggccttaaggaaaataaattcatgaggaccttcttggaatatagcaacggcctatgtcgattttggtctttttcaccccctgttaaatttctaagtcccaccgggttggattatcccacaagggagggcgtcttgtgtacaccacgccataaagagggggtattcggcgcgccaggggtgcccatattatgagacacccccggagaaaaaaccttcggttcaaaaatttccgcccgcaaaaatgccaccaaaaaacggcggttaaccacggggttattaacaacccttccgggagcgccgcccaaaccacccccccatttttagggggctagaaaacacaccgattggggttttaacccacccccacccccacctgggaaaagcgggagggacacaccactcctattattcttactgaaaaacaaacaacacacagggcaccgggcgccccagccacccgacacaccctacncac

SEQ ID NO: 511073 - DNA, 264 bp, Homo sapiens
  misc_feature (11)..(12): n is a, c, g, or t
  misc_feature (51)..(51): n is a, c, g, or t
  misc_feature (66)..(66): n is a, c, g, or t
  misc_feature (92)..(92): n is a, c, g, or t
  misc_feature (131)..(131): n is a, c, g, or t
  misc_feature (134)..(134): n is a, c, g, or t
  misc_feature (161)..(161): n is a, c, g, or t
  misc_feature (172)..(172): n is a, c, g, or t
  misc_feature (177)..(177): n is a, c, g, or t
  misc_feature (183)..(183): n is a, c, g, or t
  misc_feature (233)..(233): n is a, c, g, or t
gcgtccctgtnnaatgtgcacgacattaggcattgagacttcaagcttttnttttctgaccacgtntctttgggtctttgaaaaagaaaagnatccctgtaaattgtaagcacttttagggggcgggtggngangggtgctctgctggtcttcaattaccnagaattctccnaaacnattttntgccggatgattgtacagaatcattgcttatgacatgatcgctttctacnctgtattacataaataacttaaataaaatta

SEQ ID NO: 511074 - DNA, 413 bp, Homo sapiens
cataggcacctgattaaatcaagcaggtggtgataaggaagtacctaaatgcagctttctgtgcagctagatctggtctaacggtagaaaaatcaaggtggcttctccaatgaagtaagttcaaaaaaacagaatagcacaagagaaatgcattcttccaaactgatggtgccagtcaaagacaacccagatgcagacagagacttcgatgctaagagcagtgccggatgatgaaatagacgcaccctcagcattgcacctgctagacagggaacgggtcatagagacccctgagactgacttctatgcacctcaggagtgaaaaccactctcggacacctagtgaaaaacgaggacacagttccaggccccacacgacaggctcaggaacgtcgagagtacatgagaaaagg

SEQ ID NO: 511075 - DNA, 206 bp, Homo sapiens
aaggctactatgggtgtcaattcgtactctctctacaaggttctctcctagtgtccaaagagctgttcctcttatggactaacagttaaatttacaaggggatctaacagggttacagtgggctaatttagaagttgaactaagattctatctatggacacatccagctatcaccatggctcggatcagtttcgtcgcctactacc

SEQ ID NO: 511076 - DNA, 150 bp, Homo sapiens
  misc_feature (145)..(145): n is a, c, g, or t
ctgtgtcaggccaggactggctccctcggcttgcacccctgtcctcctccccttgcctgcctctcagtgatttcacactttgggcctgcctgactagccagacagaactgctttcctaagtggggtgtatcttgttttgcaccanatgat

SEQ ID NO: 511077 - DNA, 261 bp, Homo sapiens
  misc_feature (14)..(14): n is a, c, g, or t
  misc_feature (42)..(42): n is a, c, g, or t
  misc_feature (90)..(90): n is a, c, g, or t
  misc_feature (179)..(179): n is a, c, g, or t
tgtggctcaacagnaatgatcttgaaaagaacaaaggtggangacttacacttaacataacccttatgtggaagaggcacccagagcgtnactcccttgcaccttctatgctctcttgcggcttagagctcatgactcaggcaaacctggaagcagtggaggtgccaccttcccagagncccaagctgtgatgctagtgacaacagtaatactggcaacagcaaagcaacatgcccccaaggacacaaacagcaaggaggg

SEQ ID NO: 511078 - DNA, 642 bp, Homo sapiens
  misc_feature (604)..(604): n is a, c, g, or t
  misc_feature (627)..(627): n is a, c, g, or t
  misc_feature (629)..(629): n is a, c, g, or t
  misc_feature (642)..(642): n is a, c, g, or t
tatagccatctcatggtgatgaattccatcatggtgattaattccatcagctttcttttgtctgggaaagacattgtttctccttcatttatgaaggataactttcctaatccttggttggtagtctttttctttcagcgctttgagtatatcatcccgttctctcctggcctgtaaggtttctgctgagaaatccattgttagtctgatgggtttcctttataagtgactagatgcttttcccttgctgtttttagaactctctctgtctttgacttttgacagtttgagtatagtttgtcatggagcctttttttttttggttttgagacagagtctcattctgtcactcagcctggagtacagtggcgcaatctcagctcactgcagcctctgcctcccaagttcaagcgattctcccacctcagcctcctgagtagtagctgggattacaggtgtgtgttaccacacccatctaatttttgtatttttaatagagacagggtttcaccatgttggccagtctggtctcgaactcctgacctcaggtgatccaccttgctcggccttccaaagtgcttggattacaggcatgagccaccgnaccgggccagaggaccttttttngnatctactggtgcn

SEQ ID NO: 511079 - DNA, 533 bp, Homo sapiens
aaagtatctagtacagtctttaaaggagtctacgctctgtcgcttgggatggagtgcagagggcgatctctgcatcactgcaagctccacctgaccgggttacaaaacattctcctgcctcagactcctgagatagctggagacatgcacggtgcgtgcccaccacaaacatgaccaccacaacctaggcctaactttaccgtattacagatacgaagaatggggataacacacagagctagacccaagcgatggctctcagaatcgtcactgaccctcactgatccaacaccagcaactcagagacatcaacaaaaaggagccggaggattcacactggccggtagcagccaaaccggtggcccaaggccgtatactcataccgataaagcataggagcctagaagtcagccgatgagaagactggaccgtacgagagcgaccagaaaagaacaaacgccaccagggcgcagcacaaccacacacaagaacatcatatcacaaaaacaggagaaaggaaacgagcacagcca

SEQ ID NO: 511080 - DNA, 402 bp, Homo sapiens
tgtgtattctagttttgtcaaagctgtatgaaatgatgatgtgggacagagaaatggcttggttaggtggttttatttgtattggattagtatgccaagtgataagatggtatatttggtactgtatttccctctgattttgatcctagtctcatgctgcagagggtactttaatatatactctttccatcaaatagaaccactatgaagctacctcaaacttccagtcaggtagttgcaattgaattaaattaggaataaataaaaatggatactggtgcagtcattatgagaggcaatgattgttaatttacagctttcatgattagcaagttacagtgatgctgtgctatgaattttcacgtaattgtgaaaaagttaaacattgaagtaatgaatttt

SEQ ID NO: 511081 - DNA, 294 bp, Homo sapiens
tacccgtcctctgatccagttgtcatttcagccatgttcacagcatttttaggggcagattcaatctcaagaaacgactttctttgctcatccctaagaagcaactcctcatccatttcaagtttgatcatgagattgcagcaattcagttacatcttcaggctccactactagttctcttgttctttttttttttttttttaagggaagggtctaacctttgctgcccaggctgcactgaaggggcacaatcacggtttaccagctcactaaagcctaaatttttggggctaa

SEQ ID NO: 511082 - DNA, 323 bp, Homo sapiens
  misc_feature (15)..(15): n is a, c, g, or t
  misc_feature (105)..(105): n is a, c, g, or t
  misc_feature (145)..(146): n is a, c, g, or t
  misc_feature (149)..(149): n is a, c, g, or t
  misc_feature (182)..(182): n is a, c, g, or t
  misc_feature (184)..(184): n is a, c, g, or t
  misc_feature (190)..(191): n is a, c, g, or t
  misc_feature (193)..(193): n is a, c, g, or t
cagtcaatatgatgnacattgtacattaaaaaacacaaacaacaacttaaagccaaatatctatagtaaaccaaggaaaattctgatatggaatggtttgactanaagcaaagaataaggcacctgctatgaatttagcacaacnnatnaaacagaattagttaaccaagacacttgtttcnanaagggnnanaagtacagagactgattaactgggtgagtaaggcaagtatactatttatgttttatacctgctggcctaaggtctgttgattcattcctagtccagaatagtgaagttcctgaagtccttgccctctgct

SEQ ID NO: 511083 - DNA, 768 bp, Homo sapiens
ggcgggccctgcgactccaagatgaaacccgaacgtctcaagttacgtggcgccatgtgctggccgtctggggcctgggtgccaaggtgattttactatcccagaggaagccggtcttgacttcgggggtccagggttcctcgcagatatctccgcactggaagttcagctagccagcaaatccactggtgatagaagggacgaaacgactcctcgaggcatccgcgttgtactacacagccaagctgacggcgcttcaacgcggggatcatggagctgggactggtagtacacggccaggtgatggccatgccaccacgggagaccgccttcatcctcactggctactgcgacggacaagtgcacgccagctggcactgcctccctccgggatccacatcttcgcctctcagatccacacacacctgactggtgagaaaggtggtcacagtgctggtccgggacggccgggagtgggagatcgtgaaccaggacaatcactacagccctcacttccaggagatccgcatgttgacacgacggtcgtgtcggtcatccgggagatgtgctcatcagtctcctgcacgtacaacccagaagaccgggagctgggcacagtggggggcttcgggatcctggaggagatgtgtgtcaataacgtggcatactaggccgttgaagcagatggagctctgaaagagacgctgtggaacgcacgggttcctgcagaagtacttcagctaatcaaaaggtatcaaaaagaggatg

SEQ ID NO: 511084 - DNA, 147 bp, Homo sapiens
  misc_feature (88)..(88): n is a, c, g, or t
tatagacaggtgtgtgcctctccaattcatgtcaaatccattgattgtacaccaggtggactccaatcaagtagtcaaaacatctcanggatgatcactggaacaggatgcactgagatcaatttgagtctcatagcaacggtcaga

SEQ ID NO: 511085 - DNA, 362 bp, Homo sapiens
aacttttgctgcccccttttactgttggtgaagggccgttgttaatggaagtttacgttttaaaactcagatgactcagaaacccgactgtggtccttttttgcagcagccaaaagacttattttggcagcatctcggtttggggcttttgaaaaaaaaggatgaagctgatttgttgaaacaactactttccccactcggaggcaaaagggggtgataaaaaataaccttccccccccctttcattttgtgacccccaaagatcacgtttgggtgttttgggtgagttttttattattgtttgttttaaatgattaaataaaaccccattaaatgtcaggatagcctctcttgcaaagtga

SEQ ID NO: 511086 - DNA, 493 bp, Homo sapiens
  misc_feature (5)..(5): n is a, c, g, or t
  misc_feature (29)..(29): n is a, c, g, or t
  misc_feature (75)..(75): n is a, c, g, or t
  misc_feature (139)..(139): n is a, c, g, or t
  misc_feature (157)..(157): n is a, c, g, or t
  misc_feature (211)..(211): n is a, c, g, or t
  misc_feature (222)..(222): n is a, c, g, or t
  misc_feature (247)..(247): n is a, c, g, or t
  misc_feature (343)..(343): n is a, c, g, or t
  misc_feature (413)..(413): n is a, c, g, or t
  misc_feature (460)..(460): n is a, c, g, or t
tgggncgccccgatttccccaagcctggngcctcgttacagggagtccaacaccgccggcaacgacgttttccanaagttctccgcgttcatcaagaacccggtgcccgcgcaggacgaagccctgtaccagcaagctntgcgcgccctcgccaggntggacagctacctgcgcgcgcccctggagcacgagcttggcgggggagccgcantgcgcgagtcncgccgccgcttcctggacggcgacnaggtcacgctggccgactgcagcctcctgcccaagctgcacatcgtcgacacggtgtgcgcgcacttccccaggcgcccatccccgcggagctttngtacgccgctacctggacagcgcgatgcaggagaaagagttcaaatacacgtgtcgcacagcgccgagantccgctggtaccggcccgccgtgcaccccctagcgccccaccccgcntctgtcgcccaataaaggcatctttgtcgggat

SEQ ID NO: 511087 - DNA, 159 bp, Homo sapiens
gaatggtgagtccattcactgcacacacacctgttacaagactgtagaaattatacaagataaaaataatggtaccctaggatggtagagcaaggatggagcacagtgtattaatttaagaattcgagagttcatgattggatgaagccacgatcggaa

SEQ ID NO: 511088 - DNA, 621 bp, Homo sapiens
tggtatttgaaaacattttaaataaataatgtgacaaaataactttcctgattatgggatttccagtatgcaaaattatggctaaaaataaggggctctcttacatgaacataatgaaaactttaatcacaatgggaattggtccccttaagtactggcaccgcctttcctatgggaacttttccaaattatctaaatggaacaatggtttgggttttgggtgaacaccagcctttttttttggtgggtccagttttggttggcgctatggtttcccactgggggtcagacctgatactttattcttatccttatagattaatttgtcctatttttttccttccaatatagccaccatatttataaatatccaatggtattattcctaataaatatggaccaaaaagggatcctatagaatatctatctaagtccaggagggcatctattgtggtccatttggaacagcaatgtaatggcctcttattaagagtattctacagggaacattcttggtagtgtttccgactattggcgccacaacaaatcttaaaacctccttttttttccttataagtcccagagaaactgttaagacccatttgggtccatgggccccac

SEQ ID NO: 511089 - DNA, 155 bp, Homo sapiens
aaaacccccccccccccgagggggcccccccccccaggggttggggccccccccctccggtttggcccccggggttgtttttccccaaaaaaacagggggggccctttttggttttccccccaaacccctttttaaaaaccccttttttttttta

SEQ ID NO: 511090 - DNA, 183 bp, Homo sapiens
ccccccttttttttaaaaaaaaaacaaaaaagttacccctttgtgggggttcatccctgtaactccagctactcaggggggtgaggcaaaaaaattgctttaacctggatggttgaggttccagtaacccgggccccccccattgccccccagcctgggcaacaaaaaccaaattgggtttta

SEQ ID NO: 511091 - DNA, 848 bp, Homo sapiens
  misc_feature (848)..(848): n is a, c, g, or t
atattacctgagtttgaaatggatgaagacagttgctaccattaaaggaccaaattgttatgctaccactaaacaaaaatacccactcaggtctgtgttaaattgtatgtcttatgttaaatggtatttagacggattcaagcataagctttgatacagagggctgagacacgtctcaggaagtcctgtaatgtgggcataactctttggacctgatcttgatgcttctgctgctcgtgttagcctctgtaagagcaatatctaagttggattattcactgtacatttgtattaaagaggctttaatagtgcctcaggggtcccctgaaagctaattttctatttctgggattccctggattcacttatatgagatggtgacatgattagaggaattgctatatgtctaggttatgaaacattgtccctttgcttcttcagtacttgcctccttgctgggccattgaattaagcacagggacgagaatttggttactgttgttatttctaactctcccaataaaacccctgttgcccagtgattgtgttgttggtgcgacttgtaactcgacgctgagggaaacacacatgagcttattcaagctagcgatatttatctatgaggcttgtgagcagtacactgaattgtactgtgccaggtatatggaagatgctctggggggtgtattgtatcctgcccagtttggcttcatgtctgaattgagttttctttatcttgatgttggtttcccttcatatgacgtcgaggtttagatttgtgaaggaaataacatgatggagataaaaatcttgaaaggaaaaaggggatttaaatccgggggaaaggn

SEQ ID NO: 511092 - DNA, 733 bp, Homo sapiens
  misc_feature (70)..(70): n is a, c, g, or t
ggaactcccccacccagtatcttattccgccaggggctcggcgcggcgggcagcgcgctgggaggacaanccctcctccccccccacacaaaattttttatccgcccgccccggcgcgccccccccacccccctcacacacaacggccacggctgacccccacctaacccactcaccccccccacccctcccgccgagccccaaccacccccccaccacacaacaacaactcaccggacccaacccccaccccccacccgcccacgccaacacccgcgctaccctccacaccccgacccaacacgccacaccacacacaccacaccgagaccacgacccacgcaagccacgccgaccggccacaccaccaactccaaacaacatccaccccgcactgaccgcaacgcccactaccccccagcccccaaccggcgcaccccatacccacgccagacgcacaccacccctaccagcccacgcctcacacccgctcccccaccgcaacccaacccccaccacggcgccacacgccaccgaccgctcccccacccacacgcaacgatacccccaccccacccgatcccccgcccgcacgccgccgcaccgtacacccactcccacacaaaccccacccacaatccacccaccgccgcacacccacaccccacgagaccccacaacacaacccacgccgaccgcccacgactgccaccgtcacaaagcccggcacccg

SEQ ID NO: 511093 - DNA, 162 bp, Homo sapiens
gaggcattccagacacagacactctgctctttaattcacagaactgctgaaagaagtagacatttctatctaaaagtagaaaaaaaggttcgtatagaaggtatttctgttatacaagatatattacacagcttgagggtagtaacagagtccgacaaagct

SEQ ID NO: 511094 - DNA, 910 bp, Homo sapiens
gtattagtctgttttcatgctgctgataaagacatacctgagactggtcaatttacaaaagaaggaggtttatggactcacagttccatgtggctggggagaccacacaatcatggcgaaagatgaaaggcaaggaggagcaagtcacgtcttacatggatggcagcaggcaaagtgagagcttgtgcagggaaactctcatttttaaaaccatcagatctcgtgagactcattcactatcatgagaacagcacacagaaagacctgcccccataattcagtcaccttccactgggttcctcccacaacacatgagaattctgggagtaacaactcaagatgagattgggtggggacacagccaaaccatgccgactttgaaacacagaacttttttaatgaaattgaactgatctattttttgttatgtgcttgagctttttggtgactgctatggtttgaaatatgttcccacaaaaattcatgttggaatgcttatattcctgtatggtgggactgtaacaaccgtacatctagtatggacacacaatatggtgattcctcacgaaattagaaaacagaattaccctatgatccagcatttcaactttctgggtggaataccaaaataatcgcaagcagggtctcaacgagatcttctgtacccccgtgtcatagcagcattagcacatagcaaagggcatatttagcttcatgaggtgatgggaaacaaattgctttctattcgggaatttcggtccacaggagaatggtttggctataattgttacacggtgctggtatggaggagaagcgtgaaacaagggttcataaaagcacaaatcaaaaaaagggcacggcaagggagctacatccaaagagaggggaaaaacaaggaggtggaactcca

SEQ ID NO: 511095 - DNA, 233 bp, Homo sapiens
gggacgtgagcgtgatcgggaaagagacagagaccgtgaccgagcgcgcgagcgagaacgagatcgggcaccgagacgacgcgagcggacccgaagtagagagtcatgacggacacgaagagaccacagctcctttgagacgccacaagtagatgctgagcccactggacgttgccacaggaccagagtctaccaaggagatagatcaagtccatcaatgaaaagtttgctgg

SEQ ID NO: 511096 - DNA, 142 bp, Homo sapiens
tgctcagatcaagatggtctctccatattccgctggagttgcgcacggtgcatcggactctcgtgctgtctctacggagggaccagcgtaacgcggcaagtaaatgcttgatggaggtacccggcagcagttccacttagtg

SEQ ID NO: 511097 - DNA, 102 bp, Homo sapiens
gtccctatcgatatttcgaaaatttaagacgtcgtatctcgtttttacagcacgccctgcattactcaattcgcagagactgcctgactcgacaactatgaa

SEQ ID NO: 511098 - DNA, 164 bp, Homo sapiens
atgtgtgtatatatgctgtgtatatatagtatgtgtatatatagtatgtgtacatagtgggtatatttgtatgtgtgtatatatatttatgtaacaaacctgcatgttctgcacatgtatcccagaacttaaagtataatgatatatgtgtgtatatgtgtgtg

SEQ ID NO: 511099 - DNA, 463 bp, Homo sapiens
cccctgaaacctggttttgttgttattcccattcccccccccacttttcaaaggggggatgtccccctttttttttgccggggtgctgtgccccagagtttcccactgccactgcaggcccccagtgggaaaacagtttcagctcgggggggccttcctttcccccagctttttaaaatcctccattctaacaagggccccctgcgggtaaaagtgggcctccccttcggccccttttccccgtcggggcaggagattttttaggtgaaccacttgcctgtgggattgtggcaggaactgtttcccctcccagccttaaatttttctgtgttcccaacccccggggggccccacagctttgaaccttccccttaggggttcccgcaggggggggtttgggtttgccctgcaaaaaatgggggcccgccccctttttcccccaataaagccccattaagcctta

SEQ ID NO: 511100 - DNA, 331 bp, Homo sapiens
cctggcatggcggtactggcaggccaccggcagcccggagcatctgaacggtgcggtccaccaggggtgcatacgcattatcgacgtctggagcctggagcaggatcatgcgcggtctacctaccgccatgtgcgccccgccgagccgtccgacaccctcggccgcgacggttcgggcactccggtgggacacaccgggatgacctggagcgggttccgcccttccgacgacgcctgccgctacggctacaacattccggctcagttcatggcgatgcgtgccctgcgtcaaattcgcgagttctgtcgcgtctgggatgacgaggctctt

SEQ ID NO: 511101 - DNA, 687 bp, Homo sapiens
agtggggttaggcccttccagccagccccaggtctttttatttgttcaaaaaaaagtaaacagggtccttagttcccccacgcagtaaaccgggccctttgcccctgaaatttttaccaccccaaagtaaataccccatgctttataaaggttaggtttaagggcaactttgggcttattgctccagttttatccccccctaattgccaacaagaaaatttgtccttcaacatggcttaagaaattaccctttccattcaaagtgggagatatttctttataaggacctgtcttcacaaaaagaaaagcagcaggtcaggagcagttgaaagagaatagaggtccctgaaccagaaatgcttccttctaattttgactctaacttttgaaagctaaaggtacatgtaggccgggcgtggtggctcacgcctgtaatcccagaactttggaagcctgaggcgggtggatcacgagctcaggaatgtaagaccagcttggctatcagagtgaaaccccatctctactaaaaacacaaagaaatctagctaggcatggtggcaggctcctgtagtcccagctactcggaagaataaggcaggagaatcgcttgaatctgggagacagaggttgcagtgacctgagataaagccattgcactccagcatgggtggcacagtgcgactctgt

SEQ ID NO: 511102 - DNA, 244 bp, Homo sapiens
gtgtcagctcagaaatgtagtgcttcattcttgtatccaggtggatagatttaagtcatgtgatccagaataatctctcagagaatgatatgccccatagaaggagacacggtccatgccatcatcagcaagtatgttaaatgacaggtacaagtattccaggcctggttccatgtgggcaaacacatagccaggcatccgttcaatctggttcccaaggagtactaggtgcagcaaggacttg

SEQ ID NO: 511103 - DNA, 234 bp, Homo sapiens
atcctactaatgcgtgagacagtaatctacattgggtcaacagatttcagctcatagtcggaagctggaccctcaaatgagccgaatatctatgtaaatggatgcggacttcccctaattcagaagtgtacgctgcggaaggatgaaagcccttcatttgggaaatgaaaatttccacggaaatttggccatttgaaccaggcttcccacagttaggaacaactcaaaaaccat

SEQ ID NO: 511104 - DNA, 779 bp, Homo sapiens
  misc_feature (12)..(12): n is a, c, g, or t
  misc_feature (111)..(111): n is a, c, g, or t
  misc_feature (171)..(171): n is a, c, g, or t
  misc_feature (173)..(173): n is a, c, g, or t
  misc_feature (178)..(178): n is a, c, g, or t
  misc_feature (188)..(188): n is a, c, g, or t
  misc_feature (194)..(194): n is a, c, g, or t
  misc_feature (199)..(199): n is a, c, g, or t
  misc_feature (207)..(207): n is a, c, g, or t
  misc_feature (217)..(217): n is a, c, g, or t
  misc_feature (233)..(234): n is a, c, g, or t
  misc_feature (257)..(257): n is a, c, g, or t
  misc_feature (260)..(260): n is a, c, g, or t
  misc_feature (264)..(264): n is a, c, g, or t
  misc_feature (267)..(268): n is a, c, g, or t
  misc_feature (303)..(303): n is a, c, g, or t
  misc_feature (307)..(307): n is a, c, g, or t
  misc_feature (319)..(321): n is a, c, g, or t
  misc_feature (359)..(360): n is a, c, g, or t
  misc_feature (365)..(365): n is a, c, g, or t
  misc_feature (374)..(374): n is a, c, g, or t
  misc_feature (400)..(400): n is a, c, g, or t
  misc_feature (408)..(408): n is a, c, g, or t
  misc_feature (432)..(432): n is a, c, g, or t
  misc_feature (440)..(440): n is a, c, g, or t
  misc_feature (538)..(538): n is a, c, g, or t
  misc_feature (557)..(557): n is a, c, g, or t
  misc_feature (564)..(564): n is a, c, g, or t
  misc_feature (591)..(592): n is a, c, g, or t
  misc_feature (601)..(601): n is a, c, g, or t
  misc_feature (618)..(618): n is a, c, g, or t
  misc_feature (625)..(625): n is a, c, g, or t
  misc_feature (645)..(645): n is a, c, g, or t
  misc_feature (649)..(649): n is a, c, g, or t
  misc_feature (654)..(654): n is a, c, g, or t
  misc_feature (660)..(660): n is a, c, g, or t
  misc_feature (664)..(665): n is a, c, g, or t
  misc_feature (691)..(691): n is a, c, g, or t
  misc_feature (693)..(693): n is a, c, g, or t
  misc_feature (701)..(701): n is a, c, g, or t
  misc_feature (777)..(777): n is a, c, g, or t
caagtcatatcngcctggtaccagctaaatttaatgaagataagttccactgaattcctaaggaaaatacaacaattccgacaccatttaataattagaaactttcaaacncgagggaaagtatgaacatcataataaatgcctcaatttggaggcaaagaaatgtaagtngngtgcngaaacccgangtatcncagancatcagtngtcccttccngtcgtggatgccttanncccaaggccttacactgttatcnccncccngcnnccctgatggggggtgccatctattgcctgcctganattnaattacacaatnnncccccccgccgggcagcggaccagagagtcataaaacnntttancttcttggngccaatcatacaatcaaacccgacanccctgccngggggggggccagtgccggggggngaattttntatcacactacatcaatagcaaagtcagaggaatcaattttccatcttgtaacactacatcaaaatagcaaattcacagtgccttccaaaggcccccnactaagaaaaataacagtnaagaggnacacagtattacttcatttacaatttnntagctcttncagtgtttcagaggganacagggnttcaacgatctaacatgaangggntagangggggncttnnaacatagcaaacatacatcttgattnantcagcccnctgcgagcacagatcttgattgaatcagcctattggtgtagttttaggtctacatacatcttgattgagtcaaccnac

SEQ ID NO: 511105 - DNA, 121 bp, Homo sapiens
catccaaagtgccatgtatcccactgcctcattctttaacacggaattccctcaaatgtctctgtgcacttacctgcgaaagtcccccatttactctcgtgagtaaagtgtgtcttaccta

SEQ ID NO: 511106 - DNA, 303 bp, Homo sapiens
tggtgctgtgtgacaacagatgatttagtcttctgggtcttatttcactctttctttatatgttaaaatgaagggagatcttcagggtgactaacatgtctatcgttggaaattggagtttaagaaccttcaataggtccggtttttaaaaaaaggcaacaagacttgactgattttgttttctcacacttaggatttctattacttaccaccttattcatatttttaataagccaggttagcactcctcattcgtttgctcaatgagcactggcaggcatcaaccacatgcatgcaccccgg

SEQ ID NO: 511107 - DNA, 234 bp, Homo sapiens
gatttcgggtttcggcatgactccaccactacacgtgacatagccccgatcttatcggcactacaggactccgactcgccaggaacgtcgagggccaccggtgcagcgtccccggactccccggaaacgctatcccgcgaagccctcgcgtgcttgtcatcgtcggcctcattgtgaggcgtctcatcgctgacctcatcagacacgtgcccgccaggggtacggagctcgaat

SEQ ID NO: 511108 - DNA, 499 bp, Homo sapiens
cagatgtcctggggcggacgcatatactccggaaatctagtatcaaactcaacatttacccgattcactagatcgtcacgtacagatacgagtagcgaggaagaagtagtcacactgcattcggggctgtaacgacgaaagatgaatagaaagatggcagtggcatttaagatgcacaaattattaaaattttaactattacagtgtagcaagtctaggtagagggcactgcatttgtacagtaaagtcagaagtggacagagtaatgctttttgtttttgtctgtctgggcagtagttggctgtaacaaagtttgtgtctagcttaaaaagtacctgttgactcagatagccacagtaagagactagaacgtgatggcataatggtgacaaaaatgagttcaaatctacagtccaccacttcctagttggctcaccgcttattacctacacttaattttagctacctaatctgtaaagtggaaataaaaaatacatat

SEQ ID NO: 511109 - DNA, 1146 bp, Homo sapiens
  misc_feature (319)..(319): n is a, c, g, or t
  misc_feature (382)..(382): n is a, c, g, or t
  misc_feature (542)..(542): n is a, c, g, or t
agaagctggaggaagtagatcttttgttggaggaatggtccagatggtcatatcgctttcaaagagcctggatccagtttagtgtcaaggacaagattaaagactactagcaatggataccatcttggcaaatgccaaatattttgataggagagtttatcaaaaggtagccaactataggtctctaactagttaggtagtgggagacggtaaaaagggagcattattaataaaaatgtcgttaaattgttatggcgtgtgtgttctggaatctgcatgtgtgtgtttaatgattatgattcggtagaggtattacaantattcataagaccatgtaagcgatcgtcattactatattatatgaacaaaaaaaagatccgancattatgataaatgtaattaaaacaatggaagatagcaaagaagaatatataaagcataggacatcaattagatcatttaatagatcgactaagaaactatatataataacacgatcgttaatcccaataatggagaccatttgaagtctaagataatcngcgagaagatattaatctggcaacttctgagaagaatctaagaatggtaatgggaaaacaatgcagggataaaggcgatgaggatatctataagatattttgatataagagtgtaacacttatctattttcttattgaaagacctgaagcaggatggaactttcgctataatgaaaggcgaggtccattatagatgaaaaatttagggtttatttaacgattataatctgaaaaattgaataaaatgaaaaaaagaaattcaataacaccaccgaggcgagggggagggaagttaaggggggttatacgaacaagacggggagccggaaggaaagagacgatcattgaaggcccgatcccgaaagaaagacatattagtttcggtgaaacaacagacgagggcggaaccctaattgggggaaaggggacaaggaggacgatttgttacagaactgatgaaggcagagtgggagaacccgggccgagttgactataagaccccgacgaggaggaagacgcagagagaccaacccccgtgtgagccacgaaggaagaaagttccggggagggaggacgaaaaactaaaaacccgcggcgcgagagc

SEQ ID NO: 511110 - DNA, 150 bp, Homo sapiens
gtcaagccaagtgggaagtacggcctggggtacaagcagactctgaagctgatcagacaaggcaaagcgaaatccgtcattctcgctaacaactgcccagctttgaggaaatctgatatagagcactatgctaaggaggctaaaaccgga

SEQ ID NO: 511111 - DNA, 141 bp, Homo sapiens
ctatctctacaaaaaatacaaaacaattagccagacgtggtaatgcatgcctgtgttcccagatacttggggggctgaggcaacgggatcacttgaaacacggaggttcgaggctacagtgagcaaggtttgtgccactgc

SEQ ID NO: 511112 - DNA, 269 bp, Homo sapiens
gcattatggcgggcattgataaagacatcgaaggtgaagcgcgtccgcagccagacatcaagattggttatctgccgcagaaccgcagctgaacccggaacacaccgtgcgtgagtccattgaagaagcggtttcagaagtggttaacgccctgaaacgcctggatgaagtgtatgcgctgtacgccgatccggatgccgattttgacaagctggccgctgaacaaggccgtctggaagagatcattcaggttcacgacggtcataatt

SEQ ID NO: 511113 - DNA, 1278 bp, Homo sapiens
accgctggtgttgtggatggttttttgtttgtttttactttcgaggtatttttttgtagaggaaataaaaggcgacaaaccagcgacatggaggagacagaaaacaagtggagagcgacagtgtacactagcaatgtggtggtgttcgttttgcgtagtaggtatgtgttggttgtcttgctccagtcgaattttctttactcatttgtgtgttatctgttagttgcgggtggggttgttcaccttgccccggcgttatggtgtggaagtagtcttctctctgggatatgatagcgggggtgggtctgcgcatgtcttgcgctgttttttgttatggcggttgtgtaaggagcacgtctcgtgcttagggttgtgtgtgggcggccaggtgtgcctacaatatctgtgttgccccccggggggcgaacaggttgccgatgttgtctctcttcaccggtgtgctttggtgtgtggccccgtgtagtgagatctccctgttgtaacctctctcttattgcctatctgtggtgtattattggtggttacgatttttctgaggggtgcttccgcgacagttcgtgtggcgtggggtgcctgccccggaggatgtggggcggaaaaacagacccttgtggcgcccctttttgtaccggtctcggattgtttattgtcccctggtctggttcggatagacacatctctttgtggaagacacattgtcgagagattgtggcatgccccccgctgagagggcggtgcctcttctgtctcgtgcgccccccgctctcctcacataggtgcgggtgacacccctctgggggactctctttgaggcccccgcgggggcgctctcggagagtgcctctctcagaggctcctctcgcgaagtggataaaaactccccctcttgttcgcccccctatgatgatacgcgggtgtgcccaccacctcgtcgagattctttgtggcgttggtctagatatttccccctgctgggccgccccctgtgggaccttctgtgacccctcctccgctgggttatgggcgttcaatcgcgccttctttgtgtggcctttaagcctctttcctctctccctcgggtgctctctccccacgcattgtcttgttgtttcacacacgcggcgcctaagaatgatgggtatttgtgggcccctaggggtcgtttgtcccctatgttgggcaccaacgctttctccacaaacacagcaaaacagggttttgttttgtctgtatcggagcaatagatacgagaaaata

SEQ ID NO: 511114 - DNA, 900 bp, Homo sapiens
  misc_feature (30)..(30): n is a, c, g, or t
  misc_feature (61)..(61): n is a, c, g, or t
  misc_feature (91)..(92): n is a, c, g, or t
  misc_feature (127)..(127): n is a, c, g, or t
  misc_feature (141)..(141): n is a, c, g, or t
  misc_feature (170)..(170): n is a, c, g, or t
  misc_feature (182)..(182): n is a, c, g, or t
  misc_feature (192)..(192): n is a, c, g, or t
  misc_feature (228)..(228): n is a, c, g, or t
  misc_feature (238)..(238): n is a, c, g, or t
  misc_feature (254)..(254): n is a, c, g, or t
  misc_feature (261)..(262): n is a, c, g, or t
  misc_feature (306)..(306): n is a, c, g, or t
  misc_feature (348)..(348): n is a, c, g, or t
  misc_feature (354)..(354): n is a, c, g, or t
  misc_feature (356)..(356): n is a, c, g, or t
  misc_feature (360)..(360): n is a, c, g, or t
  misc_feature (372)..(372): n is a, c, g, or t
  misc_feature (377)..(377): n is a, c, g, or t
  misc_feature (455)..(456): n is a, c, g, or t
  misc_feature (460)..(460): n is a, c, g, or t
  misc_feature (483)..(483): n is a, c, g, or t
  misc_feature (546)..(546): n is a, c, g, or t
  misc_feature (664)..(664): n is a, c, g, or t
  misc_feature (770)..(770): n is a, c, g, or t
  misc_feature (782)..(782): n is a, c, g, or t
  misc_feature (852)..(852): n is a, c, g, or t
ccccagggagaagagggcggatgccaatangagctggcagaggctgggcaggtcctgagtnggcccaggctaggccaagagagaaggcacnncgccctgggcgccccagtcccagggcagaggccangcctgcctggaganggcagcgcggggtcagctctcaggggtcnggctgggttccncgccgccgcngctctgctcataagacggtggggcctcataggggtngccccaaganctgttctctggggggngaatcanngtgctggtagtgggcgctggccccccggggccctctgcaaagtnggggacagtggcacctgttgatatgcactatggagggtgctncgggtntnatgnagggctgccatnctggnggcagggctccggcgcaccaggcacagaactctatgtggccagcatgggctgccgctgcgttttgctctttgtggttnngtanacggggtccaatttgtgggggcngccatctgcagcctcagcctcagcctcctccttgtgtggtgcggaaggcaccacaggggtgtngccccaggaggcagccccaggcctggccgggggctcactggggcatggttcacagcaatattgccaatgaagaccgggagggtcacagtagcttccggcgccttcagagagacctgtnagtagtagtcgatgtggatgaggctgcagcccggcaggccgcactggggcaaggcaggcaccaggatctgctcgtgccactgcgcccgccgccagccttgtacgcncgcaccctccanctccgcaatggtccgtacgtcgtggatacagcgcttggccttataagacactttctgcagcagactggcnacacagggctggtgtccttgcctgactggttctcaacgtcggcatgca

SEQ ID NO: 511115 - DNA, 249 bp, Homo sapiens
ggcggaccagcaagcagtcttcaggtaggatcctctttggctctgtgcttcgtcaccacgtagctgtcttttgtcccattcccaccatcacccccggatgtctgggacgtcccagcaagggatgggaaaagcagccctgggagcatcgtccccagcgaagccggccttacagagcccagagccattgtcacacacgcaaggcagggctgtcctcttcttcacacagtagctggagctggttcacaggat

SEQ ID NO: 511116 - DNA, 424 bp, Homo sapiens
  misc_feature (7)..(7): n is a, c, g, or t
  misc_feature (24)..(24): n is a, c, g, or t
  misc_feature (258)..(258): n is a, c, g, or t
cccctcnctttgcccttgctcccngccatgtgagaatacttattcccccttttgcccttcccacaatggttggaagccttccctgacgccctcccctacaagctgatcagatgttagcacccatgccttccctgtacagcctgcaaaactgtgagcccaattaaacctcttctttataaattaccccagtctcacgtatttctttatagtacttcaagaatggcctaatacagatggatagtttgcaaatattctttncccattctatgggttgtctcttcactttgttgtttcctttgcaatacagatttttaacttgatgtgatcccacttgtccacttttgctttggttgcctgtcaggtattacacaaaaaatctttgcccactccaatgtcctggagagattccccaatgttttatttt

SEQ ID NO: 511117 - DNA, 193 bp, Homo sapiens
ccagtgttgcatgatggtcagattctagagcgatcccgaacgagggcacaggcatttacatgccatgagaacaggtttctctgctcatgtgatatgaaacaggtaagcagatgcctttaagtcagcgatggggacagtgcccttgggcctttcaagattattacagactactccaagctagcttgaggcctgg

SEQ ID NO: 511118 - DNA, 178 bp, Homo sapiens
ctagccttctattatttatttaaagcaagaatgcatggtaatatcacctttggaggaaaaaaaattatgtttctactatcacaaagtccataatgagagaacacagaaaaacagctatccttcatatattttttgggctttgtgtttttttggccacctcccatttatttttttctct

SEQ ID NO: 511119 - DNA, 812 bp, Homo sapiens
gccctgctgttctaggctctgtgggcataggcaggctagaggtggaaccctgcctccatgccagcgtctggtgggcaatggaacggctggcatcatccaggtgaggaggctggcgcatgttgggaggctgctggctgcacagacccgtgtatggggaggagaggggctgctgtgcaggggtgtggagtagggagctggcatcccctgagagcacatgcagggctgtctgctagcctcatgtgctctctgtgcaagcagctctttgcaccatctctttggacagtggccaccactgctacaatgtgggcctgacgaggcactagggctccttcctacctgcttacaatcttgtgaaacatgtgtggccgtggtgcgtgtggactcacgcctgtaatcccagcactttgggaggccaaggcaggaggatcgctggagcccagtaggtcaagaccagccagggcaacatgatgagaccctgtctctgccacaaaaattctttaaactattagcctggcgtggtagcgcacgcctgtggtcccagctgctggggaggctgaagtaggaggatcatttatgctttgggaggtcgaggaatgcggatgagtcaatggatgtatgagatggagggtaatgcgatgggatgaccagaggcatgaagcctggtgactacgacggaaaggacctggggaaccacgttgactgtcaggggtcgtaaaggactcaatggtttcagtactctagcaaagaacgctgcagcaatttcagaaagatccctccaaggaaaagtcgatgctgaacgcccaatcctccca

SEQ ID NO: 511120 - DNA, 357 bp, Homo sapiens
agtagagacaggattttgccacgttggccaggctggtctcgaactcctgacctcaggtaatcctcccatgtcggcctcccaaagtgcgtggattacaggcatgagccaccgtgcccagccacgatctctgttttgaataatgaagataagcagatcacatccagaacaaccccacccgacagaaatgacagctacttcctagagactttaggtgctacagagcagattcatgcgcttaataagaattgagcctcattatcacctaagaaagctgaggaagcatatattaccaagtgcaattaacaagagagtttttattcctataaaaacacatattaaagaaaggctttgacggta

SEQ ID NO: 511121 - DNA, 451 bp, Homo sapiens
tatggccggggaatggtccttttttaagactcattcttgacttctttactaccactggttagttatataatctaatatcctaatatcaggtttaaaaattttaaattagaatttaagaatctaattattaagatttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatttggggcccctttggcccaaagcgtttttaaccttggccagttttttcctggggcccaaatttggggccctttgggcaaattccccctttgggggggggtttaaaaattaaggggccggtttttaaaaacgcggggttgggaaaaccctggggtttcccaaattaaagccctttggaaaaaaaccctttttccagaggggggg

SEQ ID NO: 511122 - DNA, 643 bp, Homo sapiens
  misc_feature (13)..(13): n is a, c, g, or t
  misc_feature (79)..(79): n is a, c, g, or t
  misc_feature (391)..(391): n is a, c, g, or t
  misc_feature (551)..(551): n is a, c, g, or t
gaggatcccccgncatgtcgtggctgggaaggaaagaaacaggatggcaggcctggagtgatggctgctctccaccctncatcatcaccctaggcaggaagccaaactgccctggctacaaaagggctcaagatgcattgtgtgcccctcgtggaaaagcttgggatttgcacactgggaaaaaaaagggtatctcagaaggctccaggtgtcctgtggatgaagggttactaacacttccttgtgctaatttgcttatgcaaagtaggtcagccctcactttaatgccacagtagaaactgcaagtcttttttaggctaagatacatgataattataggactgcctattatttgcttcataaaacaacagacacaaaaggaaaaaggagnccaagtttgtgagaacatgaaactcattttggaaagcacagtttcgataagaggctctttctgaacttgttactacagttattagtaaatggaaataaagagtcatattgaggcttcataatgctgattccgaagaagtacacacagccacctgaatcangagactggaagacactcaaagctacttgagagggcttaattgacaaggcatcactaagaagcaatgaaccaggccaggcgcagtggctcatg

SEQ ID NO: 511123 - DNA, 705 bp, Homo sapiens
gctatggtttgaatgtttgtgtccttgaaaaatgcatatgtgaaatcctaacccccaagatgatggtattaggagataggaccttgggaatcaaagccctcatgactgggattagtgtccttataaaagacaccccagagataccatgtgacaacatagtgagaaggcaccatgtgtgaaccagaaagtgggccctcaccagacaccaaatctgctggcaccttaatcccagctttcagaactatgagataaatcatatagtatcactcatgccacattctgttggttacaagcccgtccagattcaaggggaacgaacatagattcccaattctcaatgggaggagtgtcagatttgcaaccatttttgaaaactgccacagacttctcactagtatcagaaattcaacatatgatcttcataaaacatttcatcagcattttttcttctctgttcagtagtaccatcattatttcactcttctgggcttgaaaacttaatcatccttgctttttttcatccaaatccatttgtactacaatttctttttatttttttttaaatctttggatgtcacgtgttttctcactgacatcacagaccctgaaccatgtagtaacaccccaaatgcactctctgctcacggttctccaaccaggtgtatgtgcagcgatagggttggcgtaatcggattctcattcagg

SEQ ID NO: 511124 - DNA, 339 bp, Homo sapiens
ctgtgatggcgtatcgtgaaggtctcctgtggagtaacgtcccagtctggctttcccttgataatgcagaaaggaagcccgcattttaggacacagggcaggcaagaagacaagcagctcgatgggatccacgtcgtgtgcaatcaccaccagctgagctttctggttctccaccatggtgttgacggtgttaactcctgctcgaaggacaggtggtctctccgttgggacgtcccctttgccagcagccttcttctcggcccggggcaacagtctctgcttcttctcttgcttagtctctggtctgtacttgtgggccaaagacaaggtagagccgag

SEQ ID NO: 511125 - DNA, 310 bp, Homo sapiens
cctcgctttctccgcggtcttccgagcggtcgcgtgaactgctttctgcaggctggccatggcggttcacggtcccaaggctctcgggctttgcccaaatgctcaagggggggagcccaaacactttttcagggttagaaggggctcttttatagaaacatacaaactttcaaggagctttccaaaccactcgtgacagcatatgggccccatgggatgaacaaaatggttatcaaccactttggggagatgttttttgacaaagatgcagcaactatttttagagaactagaagtacagcatcctcctg

SEQ ID NO: 511126 - DNA, 336 bp, Homo sapiens
ggtagatgctgaatagcctagacatcaaagttggtgtgaacccaaatagagtcagctgacccagcatcagccacactctgggttggaaaatgtttgcctgttggaattaatttaagctcaagtatatatcaacaccctcctattgtgcaacccacccaatacacactcatggccccccaaagccccccaccctaaccactgtaacaacagtttttgtgtcattttctgtattaaacatcttgttgcacgcatttgaggtcatcagggtgcaaaatttgtattcctgaaaatgtcatatattttcattaataaataacctaaatatgataaaacaaa

SEQ ID NO: 511127 - DNA, 963 bp, Homo sapiens
ttctgccgtcatgtctgctacgcctgcagcagaggtcctcctctaggatggtgtctctcctagatctgtgacacctctacgcgcggtgggggccctctttctggaagcgcgtttctttctgtccccccccttttggcctcgttgccttgccctttcttgcttggggtttccccccccgcgcctggggagccctcccgggtccagcgaagctcccaccggtattgctgttgccaaggcccatgaaggtccgacactggtggctcccggagcttttgttcaacccggatgttccgccgatgaccaccggagccagaggtccatggacccaagactgagcgttgcccaacgagccacggcccagccgagagtggttcccagaacgcaatcccggttatgtccgctattctatcccggcgcttccccccaccctgcgattggagagtctctggtactaaccgctgtagccgggcccctctatccccgcccctttatggagtctttggaccccttcctgttctcctgggagtcccctgcccccgcccccttctctcttgagatgaccttttaaaggggaaaaaacacccaccatgatttcaggagtctggcattcctggatccctcttccctgcccggtgcctgtcacccgtcttcactgcctccttttccctgtcatgctcatcagcttatggcttctgtctaagcacctgaaaggaggactgaaaacctcccctgcacggctggttttaggtcttgaattatgtaagaatcttgcacccgcacctgctaaatgtaatttcaattgtttttccctctaggaccaacacttacccaaatatgccacttttttttggtgggaagagagattgtcctgtgatttctacccctttcctgaggcctgtggaaataacctttatgtactttaagttataccagaaaatagaattaagttatacccaaccttga

SEQ ID NO: 511128 - DNA, 268 bp, Homo sapiens
tgacactccatctcctcggttctagcaattctcctctgcctcccaaagtgctgggattacaggcgtgagccagcacgccagggcgccaatgtgtagtcttttatccctcagccttctccccaagtccccatagttcattgtatcattcttatgcctttgcctttgtgtcctcatagattagctaccacttataagtggaaacatacgatacttgtttttccagtcctgagttacttcacttagaataatggtctccaattccatctac

SEQ ID NO: 511129 - DNA, 166 bp, Homo sapiens
  misc_feature (35)..(35): n is a, c, g, or t
  misc_feature (81)..(81): n is a, c, g, or t
tttcagcccccacctcaggttagggctctgccgcnagcctgacctctagccctggtggcagaggtccctcagctgcaaggntaattggttgaccaccgattccagctgcggttaatccagcttgggcctgtttgcactgcaatccttttgggctctcctaggatcc

SEQ ID NO: 511130 - DNA, 148 bp, Homo sapiens
  misc_feature (148)..(148): n is a, c, g, or t
taaacaaaggtggtttttaattccccccaatttgggaaccagtccaaaccggggcctggggggtcttttccggaccagtttgccaaaagcaagggagggggggtcccggccccaattccgtattcggggcctaagttggccaaaacgn

SEQ ID NO: 511131 - DNA, 892 bp, Homo sapiens
atgttttcttgtttccctttgttgtctgttccttgttgttatgctctggtgttccatgttcctggtcatcgtccgccccggtctttctggtcggtccgggcattgtgtgttttcatggcttcgttgtcgccgggcttccgacgtccgtggtgctccttcctttttatctatccctactctgttcagtgttggtgtttcgaggttcccatttgtctgcctgctttctgtcgtgaacgtgattgttgtggccctctttgtccgaggaggcctgtgtgccctggtttctcatcttccttatggtcgcggttcgggtgactgatatctcttcgtcgtttcgcttactcgtccagacgagcatgctcgtctactgtcgtccacaccacgatctcatccacgtgtcacccgtcgagcgttgccctcagaccacaagggcctggatctatgatgggtaggttgcctgccgtttccctgcgatctacgacttgtgttgatctcctccccgtaggttaggttctggtgcactcctgctaccccggtcctgcctcacccactgaccagcgaggggctgcctacgtatccttgggcacacgctacatcatggtgtccatttgtcgaccccgtgacactcaaccactctgccaaacctgccctgccattgtgcctgtgtttagggggcctggccccacgtcctgggagcttcgggggatgggtctctcatgtctcccacacttcctgagattcaatgttccgcgatgaccatgaacgtgaatatgtcaccttgactctccaagaacacggcccttctcatggaagcgtcccggagtccccgcctgtcggtcgtccgtccgcccacaggggcttcgagtgcacagggaattctggggactccccg

SEQ ID NO: 511132 - DNA, 85 bp, Homo sapiens
tcgctccatttgctttggacagatttaaagactagcacagccatttgtgttaattaaaatctctcgcacctttaaaaaaaaaaaa

SEQ ID NO: 511133 - DNA, 269 bp, Homo sapiens
gcggccgcctactactactactgctcgaattcaagcttctaacgatgtacggggacatgttcctgctgcagataactagccagacccacccctttatttcaggccatcccttcatttcccataagggatacttttagttaattgaatatctatagaaacaatgctaatgactggtttgctgttaataaataagtgggtaaatctctgttcggggctctcagctctgaaggctgtgagacccctgatttcccactttacacctctaaaaa

SEQ ID NO: 511134 - DNA, 131 bp, Homo sapiens
  misc_feature (33)..(33): n is a, c, g, or t
taatcacgtgcattgtggactcctggagagtanttctactcacacacacgtcgcgccgtagacactggagaatccttctagtcactacacatcccgctgtggatactggagaatccttctcgccacacact

SEQ ID NO: 511135 - DNA, 131 bp, Homo sapiens
tatctacgaatagggtttgatgagtcatagaaaccttgcggcactatatcatattgcgccaggtttcaatttctatacgactatactttatttagggtaaatggtcttggctaagtgttagggtttgatga

SEQ ID NO: 511136 - DNA, 1229 bp, Homo sapiens
ggagagagagaactagtctcggtttatttatatttttttttttgggtaaaaaggaggtatggctattttccccaccattgttcttcaactcctggcctacaaacaatcttatctgccctggcttcccaaattgtttacaggcttggcccatgtggtccccagccatattatatttattatggtatttgctgggaagaaacttgtgattgacagtccccacattatctagaaaaaattcgcagggcttcacgcaacattcttggagctgcaatgtggacagaacctttgccctgggaaaaccaccttttgtagatctgaggatatttctccctgtacacgagtgtataaactacgtatttgcgcctgtgattataacagttgcgcttgcattaacagtcccccaacttgtgtaattggatttgtgagccacaccaataggataacatggaaaaaccctgtgatgggggataaagtggggtggccccacctggtgtataaagccaagtgcctccttatgccactacgatttcacaacaaccagagaacagccccccgtgtgtctgaacgcggggcgcactctttgtggagagaaggaaggcaactctctcctataagacggagaaagtgctctcccacgagaggacacgctccatgtgttgagtaaaatagttccgctcctatgaaagcgctgcgtcgacagaggtggtgaaacaacttgttggctgtggttgtggggaccacacccttgtgctcacaagcctctctgttgcgaggcacacatacttcaccacaaaactctctccccaggagtgccccctcgctgtattatcaccacaatttcttgtgacgacgtctaaaagacaaaaatgctgaagtttatttgtccccacactttgtgtagaagccccaagaggtaaaaaagaacgacaacatctctcttcaatgaggagatcacagctagtgtgtaagagatccacaggatacacccccctttctttggaaagaaactaatctccctctatagggctctatttatcccaaagatatattttcttctcaacacagcgctatctaagtagaagcgctcctcacccatagttgtcatagggccatcattgggcccccattgcacagcgcaacccacaaagccctgtgaaatatatagttgaacacctcttttaatttacccagtataaggggttacaaagagaacggctacagtaaagacc

SEQ ID NO: 511137 - DNA, 272 bp, Homo sapiens
gggtgagagccatctcctctaagcaatgcagggcggcagggccaccacatactgtgcaggcaggagcgtattaattctcctgagtgacacaggcttgggcaaagaagtgtgcttcgctgtacagaaagacacatcacctattaccatccatcatctgaagctaaacccctggatcccgccttgcactgtagggtgggcacattccccccatcccatattctttcctgatcactcttcacggccgccagccaaatgccacttccctctattat

SEQ ID NO: 511138 - DNA, 248 bp, Homo sapiens
  misc_feature (141)..(141): n is a, c, g, or t
gccttttcccccaagcccctagtaaaaaaaaaacccggttgggggccccccccttttttcaaattggggggggaaaaattttttccagccccctttttcaggggcccccccttaaaaaaacaaaaaaatcccggttttganctttttaggttaaaaaaaatgggcccggttttttggggcttcctttttttttactaaaaattcttttttcttttagcctgaataaaaattttccttgggggctggta

SEQ ID NO: 511139 - DNA, 281 bp, Homo sapiens
  misc_feature (133)..(133): n is a, c, g, or t
aaggcaagaaattagccttgttaagaattttaagtgtaatgggaagccattagagggttttaaacaaggaaagatgtgatgtgacttatattctaataggattgccttgattcacctatggagaatggatttntgggatctcagtactgggatactgagatcccagggggaaaatatcactaaggttggaattgcttttctgcacattaaaagcaattctctttttccttgaaacctccatgtgatgttaattaggtaaatgggatttcaaggaaaaaaaa

SEQ ID NO: 511140 - DNA, 109 bp, Homo sapiens
agtcgaaacgataacagataccagtgaagctgcagaaaaaaaaagggaatgtttatacagctgtaggctggagaatgtaaataacgttcagccactagtggaaatcagt

SEQ ID NO: 511141 - DNA, 200 bp, Homo sapiens
aagaacggtcatatctctggtgcagagaaacgataagtcccgtataagaatgtcaatgtgcagaacttccacagtcagtcatggcaaggatggtctcccttcaatgccctgatccaccggcacagaccagagctgattgagtatgacaagctgaggaaggacgaccctgtcaccaacctgaacaatgtcctctattggct

SEQ ID NO: 511142 - DNA, 311 bp, Homo sapiens
  misc_feature (121)..(121): n is a, c, g, or t
  misc_feature (154)..(154): n is a, c, g, or t
aggtaaggaagtaggtaggtggagagagaggagggggggggggcttggtttgactgggcaattcgctttggactcgtgtattctcatttgtcataccgcatcacactaccactgctttttnaagaaggggcagtggggcggtgcagaataaaanaaataccatgatttagtgaattctgtgtttcaggatacttcccttcctaattatcatttgattagatacttgcaatttaaatgttaagctgttttcactgctggttctgagtaatagaaattcattcctctcggggggggtaaaattcaagcacatt

SEQ ID NO: 511143 - DNA, 342 bp, Homo sapiens
cactatcctgcgctaagggaagctgtcaaggccgacgaccttgcctgcgataaggcattgatggctagcccccatgtaagccatgaaacacctcgccgacggggtttcgctacgatttgacggcgccgacctacgatgtacctgatcgatacaatgaatcagcgccgggtacatggcgagctcgtcatggagatgggtgaggcttggcgaagtgggaatctcccccacttctgaggtcatgaccttagggaaacgatgccgagaagcccaccaaactgtggtgtccaactcgaggacttaggtttggcgagtctggagcaggcagagtctcgtctagctgaa

SEQ ID NO: 511144 - DNA, 851 bp, Homo sapiens
agcggcttcctttttctctgtgcatcctcagtgacgcggggcacagctctgcccgggggcctaccagagcccacctggaccccacactgggtcagccctggtgcggaggaggccgctgtaggcgcggccaggtcacagtcggcaccagaagtttggcagatctcagtgaggcgttagtttgcatttccttgtgacggagtctcactctgttgccaggctggagtacaatggtgccatcttgactcactgcaacctccgcctcccgggttcaagctattctcctgcctcagcttcctgagtagctggtactacaggcgtgtgccaccatgcccaggttttgactggaatgccaggcttaacgttgctcagaagttgcttctatgaggacgtctcccagcagctgtcagtgtttccaatgagtcatcgccagcccctgcaatgagcctctcaggctggtaagttttgtttcagaaccgcttcctcaagcttcttttgcctttaaaagcttcctcttgccccagcctcccagggaatgcctgtggtctgtcatggctcacacatcctggttgataatccactgctgttctccacggaatgccttcattttgagagctgctcgctgcctgttgtggtttcagttgacggccaccgtgtgtgcagagttcaccagccgctgtggtgtgcagtgcagcagctgaccttgctgccttgttggttttctaatcccatgacgggaccgtcttaagtggttctcaccaagaatggaccaggaacacgtgctgggtgggccacattcttcctcaacgttggtgcccaccagtttatagcacttcgcacacgggggtttatgg

SEQ ID NO: 511145 - DNA, 901 bp, Homo sapiens
gggccgggcgcggtggctcatgcctgtaatcccagcactttgggaggccgaggtgggtggatcacctgaggttgggagttcgagacagcctgaacaacatggagaaaccccatctctactaaaaatacaaaatcagacaggcatggatggcagcacgcgtgtaatcccagctactcgggaggctaaggcaggagagtcgcttgaaaccccaggaggcggaggttgccaggtgagccgagatcgcgccaattgcactccagcctgggcaaccagtacatgataactccgtcccaaacaaaaaccacactaataaccaaaaccaaagaactgtcaggcgccaccgaggagccagagaaaaacctgtaaacgacacgcaatcggcaaggggggagaccgggcccaatagatagaaacgtgagaaaagggggccatagcgctgcttaacacaaaagaaactcgctgggtcacacgacaacaggggggcggtgaggctcacccaaaaataacaaaacgcccggggggcacaactagacgcgatccaagctaaacaacacctcactggggaccaaccgaagggggcactactagggggacgcctcacacacaaagaggggtccaacagcgaacaccgaatatcatcataattaggccccccgctgggatgagacaccttaataagccaatatgttcgacaagtccaccaactgaggaagcaaaatagctattaggccggcacgacagactttcaaaacttcggcgcgggtatcgacatacgcacgccctcgctactttctaaaccccctgatcaacaaatacgcaacccgttcaagtatcattcactatcagcattcataaaggtcaatctgcataaacaaataaacgctggatgatacacaaacag

SEQ ID NO: 511146 - DNA, 1369 bp, Homo sapiens
  misc_feature (769)..(769): n is a, c, g, or t
cctctcactatgctggtgcgtgtgtcgcagtgttgttccggcgtgtaagctctgtaggcgactactgtttggctgtgggtctccttactcagggtattgtcgtgcctctccccggttgggtggtactcctttcagccgatcaatcccctccccctgtgtgttgggtgagtgcaacccccttttgcggcagcaacttctctctccttctcctcgggggtatttctccacgctggaggatttcctcttcacagataggtgggtggtcccctctgcttacccccccccgtgcaggtttgtcaacaccaggaagtggttcaaaaggcgttttctggcacagtgtgtgcgccgtggacgccccacaaagtggggatctctttgcctacgaagagaggtgtgcccccttgttggaagcagacatctcccctcggagagagaggaatatttccacggagccttccacggcttcacagactctctagggacacgcacatggtccccaaatcggaaggttggatagttttccccacaccctggacccttcaccgggtttgccccttgcgtgtgactgttactgttcagcccattatgtgaaaattgtgtggcttcccccaagggtaccctcccccggtaggtccagatagaatatgggtgacccaaagagcccaagtgttgctggaccttttcttgaggctttgccccacccgggaccaattgacttcccttgcgcgcccagccctaaacgccacggaggtgccccctggaggtgtcnccggaggcaccaggtggccagtcccctctaccctggttgagaatgtggattgcccccttaaagggaacccccatggagtcccctgggaaccccccagaatagcgctgtacatatgtggaagaagagaactttggcaccttggaagactgtcttaaacttccccccgacaccacttattgcgccgctcctcgcccggagtataggagaattccagagaattatgtaagaggaggaaatggctctggtccaccattctgtgaatatccccagaacctgcctccaatagttttaagaatggccccttgcaccattggagaattgtcccaccctcaccagggaagcctgcctgtgaaggcgaggagacccaggatttcttcttgcctctttccccaacattttccctccctgaacctgagggaaacataatctggattcactccctcttggttgataccccacctcccaaaaggacaacttcttgattaagaccggttgtaaactagagatggaccggttatccacggaacttttcagcctcccgatgacccttggaattaaaattgccccaccctccgggccacccatatattaccccgccca

SEQ ID NO: 511147 - DNA, 304 bp, Homo sapiens
cgtgaccttccataccgaccgatacgcctgaacgtgtcgcttgacggaaacctaagtacatcaattggtcagcaaagatcacggtatctttaagacctaatttacggtagcaagagttaatcaacttagagatgtttttcttggtcatctcaacgttgatttgttggaaatccataccttctggcacaacttcccaaagtaagcagcgacctggtgtggtatccacaacaatggtttgctgttcacggttaccattttcatcaatcacagtctggtgtacacgtgcttttacgcgagtcgacgc

SEQ ID NO: 511148 - DNA, 450 bp, Homo sapiens
aggcatgtgattatagcgaggacgactaaccttgaatccacgcagaaaggcttagagataaaagtaggagtttgatcagtagccacgtttgcgttacacttgtctgggtacaaataatgggaacattgacgaatggcatgtcatcatagcatagccctcaatacttctgtctctagaatcacacttctccaatctggaccagttactccctaagatctgcagtcatggtctgtcagttctgtgcgttttccttacgcaatcatttctggagtttcttctctttcctgtctcccatatctttctcctttcttggcttgaggaagacttaagtccttactctattatcttccggaatcctgaagcgtttgtgattccgtgcgtctctgaagcggtcttgtgctctttgctcatatttgattggtagactggcttgttgtgtggcgacttggc

SEQ ID NO: 511149 - DNA, 821 bp, Homo sapiens
tgggattataggcatgcacagacatgccggcgactgcgcgctctcgcccgggagctgctcggggaagcgccggagcgcgggtcccgcgccggcgcccctccctggcgtcgaggagaaccccagcggtccgcagagctgagccgaagacccgcccgatccccgccaggaatgcgacgtcctctgcctgccctgctgtatgggtgccaggctgctcagccagggcacagaatctgggacctggtgggctggaggggccgaagctggctggtgggctggctgtgcgagggtgagggacttgtcctcgcggagtgtggcgtggccagacgtggggttgcttgggtgtcagtggtgcgtgtgccagcttctcggggcttgaggcgtgagtgtgtgcggtggccatctccgggagtggtcctggccgacgcgggtgggggtcgctctgccgcagttcctgggtgctcctggttcagcgcgggcctcgcctccaactcgagctggtgctccgggagacggaaggctggcgtttgtccatgtgcaatgtctggtggtggcccctgcccacggatggtggggcctcaacctgacctccacttccttcaggaaaaccccagcgccgacgaccccgaacccatgctggctggcacgccacgcgggggtccctcgggtcccacagcctaccggagccccccacccgcaggccggcaccatactccgagcccacgtgctgccgaccgacctacgaaccagcacgcgctgtgacacaagccagggccagcacgggcccctggcgaggacatcccgcatgccacccacctaccgcc

SEQ ID NO: 511150 - DNA, 645 bp, Homo sapiens
gggtagaagcagagtctttgacccgacagtcaagcccagtggatgtgggtggggacgagccacaggagaaggtatgttacctctgaaaacgaggaaggataggcggtacttggaacaactggttagtgtcattagcaagtatccacactgtcatgagaggagtcacccatcaggtgacaagagaggcgtgcagaggcctcgagcttgtagtaggtctggatcggagtaagtctctgagaaagccatgtcgcagcgaggctccagtactccctaaggatggtgcagtcaatggaccgtcagttgtaggagatcagactcctattgaagcactagacttctatagaaagactgactagaaacaaaagatggctcgatggtactagaggagaaggtctagggcaacagctggttccctactcacggtaggatgatctaagactgatctgattggaagagttgtgagtgcagtgtggcaggatgggggttgatactaaggataggccagggagatatttgagaaaatcagtctgtatgatacaagttcagaactagctggtacatgataggagacacaaggaagaataggaagatcatgaatgacgaagaagggtgaagaaaacgtgaaggtgtcaaaaaagagtgatg

SEQ ID NO: 511151 - DNA, 1015 bp, Homo sapiens
ctttaaagaaatgcaagtagcaattgaagaaccactgctgctggtggtagtccctggctagactgaattacatctacgaaatctaggtcagaaggaagcgtccttgggatcccagatcactctttttttattgttatgtgttcttgaagcggggcatgatccctttggatgtgcctctatcgttcttctgtgcagatgaagagctcccagctcatctaatttttccagttccggaatgccgcatgttttgtcacatcagtgcaggccatgttagccaccttccagcctcacctttaagtcaatctgtgctcctcccctctctgtggtcaggttccagttatcccgactgactcaggcgcgcctccttgggcaagcaagtggtgtagctgtctctgggcgcaggtgggcctgtcctcccgtagtgtttgtccttcctccaccagcgttctcctgggcgtgacgtggccctgtatcaggcaaacgtcaatcgggtagcatgatcagtactccaccgggtggggctacgttgtatgtgtcacgcccgtattttctcatcaagtagtagcctggtggttgcggaacatttgaggtttccttcggggtggcccactatactcaggcccactctgagaggaaatcgtcgcttggggtctgaccactatccctggtcggcgtatatggctgcttgctcccccgctgcaattttcccgggcgtccgttatgcccgtgggtcagcctgcactatcgaagatttttgcggccgagaaatgtcttgcggcagggtgtgcgaactccaccgcagagccttctggtgtgttgaccaggggtttttcccagactgcgaggccttggttccactgcagaacttggggcgcctaagttcaacgtttttcgggaagagagggtaaccctctcagcccaatagatctgaaggggcgctaagcaaggcgtttgaaggtgcgaccacgtgcaggtgtcacgtgcgtcaccccgctcccgtcatgtacctcgtttg

SEQ ID NO: 511152 - DNA, 265 bp, Homo sapiens
  misc_feature (33)..(33): n is a, c, g, or t
  misc_feature (148)..(148): n is a, c, g, or t
gccaatagctgtatggcccagcaatcaaaattnatcggtacgttgacacttgcttatctgtcttctcggttggcttgcatcattccacttagctgcatcagcagaatccttgttcagaccagcgcgtgttgcagtcaacaacgcttgncaccatcttggtacatgacataagttcccccaggattgaagccgacatcatgccgtacctgaagtcaaggcttccccagctgcttcgtaacttgtgccacctttgatatcaccgttt

SEQ ID NO: 511153 - DNA, 390 bp, Homo sapiens
gggcaggtacgtaactgacatgaccagcagacaggctaaagacactgagctgaaaaccctggactctattgctaaaccaaggctcctgaatccgttccctctgagcaactgttgctgtggtgctgccttcacaagcactctgtggagcactgagattgaggggctgtgctatccgtcatcagacaagctgcagccagaactgttcagctgacaaactgggagcagtccagaaatacagtaatggctgcatagtgaaaaaaagccaatttagattctttttatagagagaaaaacataaacatgtgattgaacaagtctcctctattagactaattggtttagatttgatatttaattgctaaaaatacatttagaatataaaccttactg

SEQ ID NO: 511154 - DNA, 147 bp, Homo sapiens
acaatcaacattggggggaattacctaccaagatgtaatggtgtgttaatttgggcgctctcttgcgattctaccgctgagagaggaggcgcgtggtgagaggagagctccaccatctgcgcgctcgtgtacgctggaatggaattg

SEQ ID NO: 511155 - DNA, 531 bp, Homo sapiens
ccagagaccctcatgaggcacgtgttacgatgatgggaagacatacctacgtatggagaacagtggcagcaatggaatatctcggtgccatttgctcctgcagcatgcttgtgtgaggccagcgtggtgctgtccgctgtgacaacgtgccgcagacctggggagtgaacccagtcccgaaaggcaactagtggccagtcctacaaccagtattctcagagataccatcagagaacaaacactaatgtaaatgggccaattgagtgctgcatgcctttagatgtacaggctgacagagaagattcccgagagtaaatcatctttccaatccagaggaacaagcatgtctctctgccaagatccatctaaagtgtagtgatgtatagcagacccagcttagagtccttctttctttcttaagccctttgctctggaggaagtgctccagcttcagctcaactcacagcttctccaagcataaccctgggagtttcctgagggttccctcataaatgagtgtctctgggcaag

SEQ ID NO: 511156 - DNA, 399 bp, Homo sapiens
  misc_feature (384)..(384): n is a, c, g, or t
aagctttgcacctggagaggccgtcgagagaaaggagctgttccaggagaggctgacttgctgatcttccaggcctaattccagaccgactagacgacgactggggccttcacaggccgtcgagaggccggacctggccctggagaggccgacttcggcacgctttggacctgcataggccgacgggaggcccaagctgatcctagaggagcccaccgaccggaggccattagagcgctgcagatgccatcggagggcaggagctgagccgggagaggccaccgtgaggcctgagctgggcctgcggagcttggcttcaggaagttgtgggtctaccagggccgctgcgagctgggcaggagctgagtccatagacgttgttgngaggccagagtcggt

SEQ ID NO: 511157 - DNA, 143 bp, Homo sapiens
tctacaggatccttagagttaagcgggtcgagtacaagcggttagttttcaaagaagttcgatgaagaatacacagctcgacaggaagctcaagcagagcttcaaaacagagatgagaaaatcaaagaacttgaagcagaaat

SEQ ID NO: 511158 - DNA, 388 bp, Homo sapiens
cgatgcgatagcggctcattagaatccgcggccagatcgctcatcgttcatagtctctccctgtgtgataaagaaacgcaagtcataacaaatctgcggattgattctccagcccttccattccacaagcaaacgcctacacccagcgacataacgctgatgctcgttcgcataacgaaacaaatgccgcttatcgtacgtctccaaccgtccctctggagtcgcccataacaaccgattgaataccccctcaggcgtacataaccgcacacttcccgtcaccacagcctctaaagacgccgcctgctcaagaacccaagcgaccgtcggaccatccatcccctccacatcctcaaggacatcgttagaaaaaccactggtaaacgtc

SEQ ID NO: 511159 - DNA, 107 bp, Homo sapiens
tatcgtgtactattctgcaaacaacaaatttttattagaaggttaagatttttcaatggcacaaaactatttggaatgaacccaaaagatagcaggaaagattggga

SEQ ID NO: 511160 - DNA, 166 bp, Homo sapiens
  misc_feature (39)..(39): n is a, c, g, or t
  misc_feature (46)..(46): n is a, c, g, or t
  misc_feature (48)..(48): n is a, c, g, or t
  misc_feature (56)..(56): n is a, c, g, or t
  misc_feature (133)..(133): n is a, c, g, or t
  misc_feature (150)..(151): n is a, c, g, or t
cctcatcgcacccgagataccctcggcgtcgacagccgncctgtgntnttgagtgnaaaatacggcttcctgattgaattcctttaagactcttcgtgagaccacagaccccttccttcccctgagtctggcnggttcagatgcgtctgnncgtctggttgctcgg

SEQ ID NO: 511161 - DNA, 353 bp, Homo sapiens
tatggctcgctctagagtatccaccgccagcacactgcaacaaaaacaaaaatagacaaatgagactatattaaactaaaaagcttctgcacagccaaagaaataacagattgaagagacaacatcttgaatgggagaaaatatttgcaaactattcatctgagaagggattaatatccagaatttataaggaattcaaggaattcaaacaacagtaaaaaaaaaaaaaaaaaaccacccccctttaaaatcgggccccaaattttggggggtacccgggcccaaattcgaaaccttgtcaatggctgttcccggggggaaaacaaagaaccaggaatccctaaatttgggca

SEQ ID NO: 511162 - DNA, 719 bp, Homo sapiens
ccagctccgacgtaagtccctctcgcgcgccacctccatccgctgcccctctgcccacgggcctgggctcagtgtgggtaggggtttgaccccttcctgctcctctccgccccccatccacgcccacatctctctgcctcctctcctggtgctacatgtgggcctgctctgcctcgctccctgccctgcctgcctcagtctccccatgctctctgccacccccctctgtgaccatgtgcctcttagtgtctctccagctgctgccatccctgcaatggctggcccctgacaccaactcactttttcctctgatgcgctgggaggctgttactcactcttcctccttcccctcctcgcctgactccctgggctctgtggcccctgtggggatgtggaagatggcctcctatctactcctctgccccagtcccctccttgcgtcagtcccagtgagggataatgcgcctggcggaatggctgcagggaggtgttatctctgcttcaggagtgcccgccggcccttgcagctgctggaagacccatatatctcatgcttcattgtaacttttggggacctgcagtgtgaaggaatgcagggtgacggtattggtatccccacctaagaccctcccctatccctgatgccagacgtcagcccctggcagggggtcttggaagccagaggtaatgacaagcatagaaaggctgaagatcccggg

SEQ ID NO: 511163 - DNA, 341 bp, Homo sapiens
aagaagctgcatatctttcaaacagatccatgaattccattatcatcatatactaggtagcttatatccagtgggagaaagcacatgcgggtaaactgctttccagaggacacactatccagaacagaatgaacaaagaacaggctgtagcaaaaatatatagtccctttacacatatagtcaaacttcattaatgcacaatactgtcgtggtccttaaatgtctgaaagagatcagtatgtatcattgaaattagttaatctctgagtataacccatatagtgcatctcagagtagttaggtgataaagccgtggcgttaaaaagctttgagggttccga

SEQ ID NO: 511164 - DNA, 617 bp, Homo sapiens
  misc_feature (522)..(522): n is a, c, g, or t
cgatcatgtctgggttggagtacagactaggttacaccgtggtggtcaggctgtgctcgaactgctggccttaagcgatctgcctgccgctacctgccaaagtgctgggattacccgcgtgagccacctctcccagcctgaagccacattcataatctaatgacaagggatggtggcatgacatgctcatcactcattcgctgcattgctctattcctcgttacgcatggggtggactgctcctgacactggacactacttctccactctctgctacacataatgtctctgtactcttccctcaggatgtggcacatgggctctgcctgaaagtcctgcctctctgctacttccctccctatcactagctacctgcaattccaccaggagcctaagactgtcatttctttaattctgcaagaagacccgctttctcggtgccctacacatccccctgccacatggctacaccatcaggcatttcccagcatctgctgcctgctctgctgctcaaggggctgngcgagaagacagcccagttctgttgggatcacagttttgtcctcagtgcgtagcacaggttctagaacacagctacaacaccatactttgtgtga

SEQ ID NO: 511165 - DNA, 396 bp, Homo sapiens
gctttgatttgagaacatgaagcgcaacagaagagtctttggagaagctgagcagtgattgtggcgccccaagcccctgctgcccagctgtgttgttctcttgagggtcagatctctgttcccacagttccatacccactcattgatcactgacaaattcttaacgctagcgatggcttgggagatggggggttggatagcatcctctttctttggcccttcttatccttaggaaaagagggttcctctccttgtgtgtgtctcttccccccacccctaattctctgctctgtttgggaagacgtggaggaaaaggtgacttctggcccacgtcttaccccatgtatggcttgagatgcccctcccacatgttgaaacggctcccaatatatcctg

SEQ ID NO: 511166 - DNA, 217 bp, Homo sapiens
taacagggcaggaaaagctttatggggggtcggggggaatttggttggccttaaagggaatttggggtcctgttcctaaatttgggaggcagcaagcatgtaaggcttaaagggggtttggccaaagcatggggtggggggcttcccccctgctacccgggcaaagccccagtttcccttttcccaacttttttttttaataaaatggggcccccca

SEQ ID NO: 511167 - DNA, 157 bp, Homo sapiens
tccgtgtgagtagcatgtggttgtgctatgtatctaccgcatccggcatcaccatcatctgctacaagtgatagcttccagttcatctgaatattccatctgtttgcaccgctcatagcacggcacatttcgggttaccagaaattgttggcctgtg

SEQ ID NO: 511168 - DNA, 326 bp, Homo sapiens
  misc_feature (275)..(275): n is a, c, g, or t
tttccaaggctggaggtgggccaaagccaggactctgtccttccccacatactgtgtgcatacatggctgtgactggggtgcaggggagagaagggggtataataggcccatagtgactaattaagtttcttcctcaaccctggggcccctggtggtgtgaatgtggtgccaagtagattgctggtgcctctgcccttcctagagatagcaactgggccctggggtacaacgaaggtgagggtggggagtgattgctgtgttggctcctccaaancctggggctctcagagtaacccccagaaacacccagagccaataactacaa

SEQ ID NO: 511169 - DNA, 88 bp, Homo sapiens
aatggcacagtcatgggtgctgaactccgccatgttctagccaccctgggtgaaaagatgaaagaggaagaagtggaagccctgatgg

SEQ ID NO: 511170 - DNA, 312 bp, Homo sapiens
  misc_feature (19)..(19): n is a, c, g, or t
  misc_feature (51)..(51): n is a, c, g, or t
ccagccccacggcagtgtncccagggcaggatcccgtgattccccgggacnccaaatgggcgtgtgttacagtgtgctcttttagccttacccatcagctgacggcttaagtgttaaccagctcaatagaccctctgcctttttgcaagcgcagagggtcagtgtgacagtttctgtatctcagctcttgtctcacctcccagaagaatcaggtcacacatggacttgaaggatgcctggtgtctggagtttatacgggtacaggatagggggtcatggagggccaaaagacgggcctgtctaattgcagga

SEQ ID NO: 511171 - DNA, 321 bp, Homo sapiens
  misc_feature (197)..(197): n is a, c, g, or t
  misc_feature (205)..(205): n is a, c, g, or t
  misc_feature (239)..(239): n is a, c, g, or t
  misc_feature (260)..(260): n is a, c, g, or t
  misc_feature (288)..(288): n is a, c, g, or t
  misc_feature (305)..(305): n is a, c, g, or t
  misc_feature (318)..(318): n is a, c, g, or t
ttcccatgaaaaatacaataaagactctgaaccaggcttttcctgatccaaactggttcttccctatgtagccctgaatgaaatggcatgtcttctcctgtcagtaaatgtacataacaataatcttcttttaaagggcattagtctcaatatgtcatttgtcacctccataaattaaaatcctacagacatttttngacaattnacaaagccctttcccacttatagacatagatgtntgaaaacccccaaatccagtnttagtgaattgagtttactagcatattnaaaataatacatcctgntcaaaagggtttnagc

SEQ ID NO: 511172 - DNA, 180 bp, Homo sapiens
gatcagagatcgagtaggcaccttcaaatgtcttgttggacggtcatcaggatcaacataagtagtatgttccttattttcttaacctgtggtgttgtcaaatggtggtttttctacttccattatcctttttgcatgtgtccccattaaaattttccctataagtgatggtgggggggc

SEQ ID NO: 511173 - DNA, 123 bp, Homo sapiens
gcggccgcctactactactactgctcgaattcaagcttctaacgatgtacggggacatgcatcacggatcaatcatcggtacttattttccaataaaattttcaaactttgtactgtaaaaaa

SEQ ID NO: 511174 - DNA, 274 bp, Homo sapiens
tccgctgtgtgatggcggcacagtcggggttgatctcgggtggtgatgagcctcgccccttgttgacggcaggcggggcattcggacagttgagtagccacagtaggcccccagctccagcagcacggagggctggtgctcctgaatcacggcgtccacgatcttgcctttcttgtcgcccacgttcatgggccactccttctgctcgcagtaggtgtcaatggcctccagcacgctctgtgcgttcccgggctccgttggcctacagcacatg

SEQ ID NO: 511175 - DNA, 950 bp, Homo sapiens
cgtgggcctcggggacaggtcgccctaaagtgaggacccctagaaggagagaagggagggtggcatgggagaggtgaccgggccctccagtacggtagacaagccccaaggtagaccacaagtctccaggactagagctgccggttccctctgggccagagggcccaaggagccccctgggttctccaaccagtgcaagcaaggtctaggggacaaccttggacaagccccgcagccttcttgctgggctggctcgctgagtgccactcaaaataggacataggacaagcttgtctgacatcagctactgagttaaattatgggctttataggactcaaacctgttgtttttcccaactctgttctctccctccaatccaacccctgccacagtgcatggcgcaggctagccttgaatggactgacagacaccaacagctgcatcccttggcatggggctccatgtcaaatatgccaaacccagggagatggagggggctggagacccgggggcctcctcatagagataactctgcactgggttcaatatggccctgatgtgcagccgcaaagtagatgctcataaatgcgcacatgcgctcatcacacagacaccgggagaggtgctggactccagctggtagcacgtgcaagccaggactgaaaggagggggttccaggaggacctctggcagaagggcacgaagtgcatgacagtcacacggccagtgctgtcctccaggctctggtgcgacgcaagcacgggagccaacgcaataaagtgacctcgaattcgggaggtggccagtgacgtgtggacaagggggccgggccgatgggtaaccggcgagcggggggaccaggaggggccggaaaggagcaaagggggcgaacaggaaggtgaagaaactccggggaagggaaaagggcggacgaagaaggtgaaacaa

SEQ ID NO: 511176 - DNA, 236 bp, Homo sapiens
ttagggctacctagatggtggtatctaatcccagttgcggtctagctactagtgtgttcagatacgtgaaagccactttcgtagtccatttagtgtcaccgggagtttataccccctcaggtgagttccagcttcattggggaggatgtgactgatggaggtggcgatttgctgctgtgaaatcgttttcggtcctagctcctcccggcaggtaaggtctaggaggagtaggggca

SEQ ID NO: 511177 - DNA, 136 bp, Homo sapiens
atggctaagggtcacaagcagccagcaggcatggctactgtccattgcattcatgcaactgcattgcacccaagcatgctcgcggcatctctcatgcacgcatggcagtgcaagcaggcaacggcaactgcatgtt

SEQ ID NO: 511178 - DNA, 92 bp, Homo sapiens
tttgaaacttttaaactggtttcggcttttgcggcttttgatcccccctttgctcctgacaaccctcattcaataaagaccagtgaagccca

SEQ ID NO: 511179 - DNA, 206 bp, Homo sapiens
ttaaaaaaaagtcccccctcattccccaaggtggagggcagggggcccaatcaaagcttacagtagcctcgaaaagcgatccttttgcctcagcctccaaagaaattgggattacaggggggccccccaacccctggccaagggttttttccaaatcattccctaatggggtgggggtccggtaaaaataaaaaaattaaaattta

SEQ ID NO: 511180 - DNA, 421 bp, Homo sapiens
  misc_feature (193)..(193): n is a, c, g, or t
attcagaaaagagagtggtagagataactatattacaaatctgttaggtattattctttaacaagtaggtgttcaattcttgccttcctttttttttttaaatatctggtcatcctgggcacggttcctaaaaaaaaaccccattatcccaagcaaaaagcacagaagggggagtggggctccaaaagatgtnacctcaaaatctaaggcctagcagagaatcaccaaattaagggagagtcaccaggggtgtaaccagggaaggacgtgccttaagtaggtcctcaggccagaggcgggaggcaccagctaattcagaggacagaatcctcgagggaagggtgagccatccgggggggcatgtcaccccgggattaaacacaatttaaaaccaattgattccgaaggaaagcccagtgcc

SEQ ID NO: 511181 - DNA, 190 bp, Homo sapiens
gatccccgttatagcaccgtgatagggcacgtcctcctgctctttgtaaggaagaacaggaacgacgatacagctttattttgtagcgccaaggtctcactatcgctcactccgtgtaatcccgtgctttgtatcaatgaggatctggctaccagacgcggtctggtagcacagaaagtgcgtgacctgg

SEQ ID NO: 511182 - DNA, 677 bp, Homo sapiens
tatcgtgtcttaccacagtgttcatatgtaaatgatcatcacatttcgtgaatggaggccatgtcaggtgctaaggaagttcgccttttacacagaagattgagaaaatttcctagatataaatacagataaattcagaaggttaaagggggtgcaggtatagataacaatactaaggtggcaagtggaagaggagtcacaaatacatagcctaaaacttcaagatgtattctataggagtcagattttactgaatatgttacccacaaatagctgcctatatgtaataataaaatatatataaatatatagttataaaactttctttaaactgtaactatgggaatttattttctttacatagttgcgcagacacacaaacatatatatatatttaaaatatattgtggggcttatagaccacctactcctaagtttggtgtggttgttaaattaaatatttaattgaatagacttatcttacatcatgtgaactgacacatgggggcatggtggtcactgcaggaggaaaccaatatagggaaattaagattatcaagtacaacagtgtgggcatattctcctcttttctaacaaggttccacatggttcctgaggtaatggagagacaggttgtaactgtgacttgccatcaagttgattggtctgcctttctt

SEQ ID NO: 511183 - DNA, 674 bp, Homo sapiens
  misc_feature (230)..(230): n is a, c, g, or t
  misc_feature (368)..(368): n is a, c, g, or t
ttgtcttcttgtcctcaaaagcaggtggtgtaccgtggaacctgaccggggaccacgggtgtccaaaataattgtggcgtggccccaaaacatagtgcggtctcctttttcgtggagccagttttagttttaaagccattagttaagatcagctccttgtgtggaaaacgcccttctgttataaagctcaggggcaataaggaagcagaggccctttgggggtgccctcntgaagagagcgtcaggccatcagctctgtccctctggtgctccaacgtctgtccttcaccctccatctctgggagcagctgcacctgactggccacgcgggggcagtggaggcacaggctcagggtggccgggctacntggcaccttatggcttacaaagtagagttggcccagtttccttccacctgaggggagcactctgactcctaacagtcttccttgccctgccatcatctggggtggctggctgtcaagaaaggccgggcatgctttctaaacacagccacaggaggcttgtagggcatcttccaggtggggaaacagtcttagataagtaaggtgacttgcctaaggcctcccagcacccttgatcttggagtctcacagcagactgcatgtgaacaactggaaccgaaaacatgccgcagtataaaacaaacatta

SEQ ID NO: 511184 - DNA, 104 bp, Homo sapiens
taagggaccaatcttcctctctcacggattatagtcagccagcagtggggcctaattaaactctgcattcattataccctctatagccctggaatgagctaagc

SEQ ID NO: 511185 - DNA, 628 bp, Homo sapiens
  misc_feature (1)..(1): n is a, c, g, or t
  misc_feature (87)..(87): n is a, c, g, or t
  misc_feature (102)..(102): n is a, c, g, or t
  misc_feature (108)..(108): n is a, c, g, or t
  misc_feature (123)..(124): n is a, c, g, or t
  misc_feature (126)..(126): n is a, c, g, or t
  misc_feature (172)..(172): n is a, c, g, or t
  misc_feature (190)..(190): n is a, c, g, or t
  misc_feature (211)..(211): n is a, c, g, or t
  misc_feature (290)..(290): n is a, c, g, or t
  misc_feature (302)..(302): n is a, c, g, or t
  misc_feature (329)..(329): n is a, c, g, or t
  misc_feature (333)..(333): n is a, c, g, or t
  misc_feature (420)..(420): n is a, c, g, or t
  misc_feature (497)..(497): n is a, c, g, or t
  misc_feature (516)..(516): n is a, c, g, or t
  misc_feature (597)..(597): n is a, c, g, or t
nagaaaaaaaaaaaagaaaaaaaaaaatataaatataaaaaaaattaaaaacttaaaatagaaaaaaaaaaaaaaaaaaatcaaaanaccaacagaaaaaangaaganaagaatactttaagnngngcccaacctccaggggggatcaggggggtcagggggggtcactganaccggcagtttttcttgntttttgcattagtgccctcanctggaactgtttacgggacagaagacgtacatgcttcaggaagacatccaggtctatcacgccccttctcaaggcttcncccaagtaaaanatagtgtcttcaatagcgttttcttcngcanacagattcaggatctgtttgtataagggagctgggggaatgataacttcatcgatatcattgttttcagactgattttccatttttnccagagcagaactgagttcttcatccttctttttcaaaagttctatgtttttatcaaccccggctacttcttgatcnaaacgggaaaccatctctnccagtttctggggaccctttttcaggtcttcttctgttcgtttcaaggcattgagctctgcctgggcacgatccatttccnccttcatccgccatctcagtttgtcattttt

SEQ ID NO: 511186 - DNA, 85 bp, Homo sapiens
tggataagtgggtgtaaggctatgtgacttgatcaaaacaaatgcaggggcctctctataaataaagggagatctcatctcttag

SEQ ID NO: 511187 - DNA, 451 bp, Homo sapiens
catagcctgggaacatacatctagcaactgtcgtccatattgtcacaatcttacaatatgtagctaggtcaaactatgtctactgtcacttctagtagagtacatattgatggtgttctccgataacttctccatggctggatagcgcattccttcatagggtggaaagcgttttccattatctggtagattacctacaggtgtaccattctactgtgggacccctcaatttgcttccaagtttaggctaattatgaacgaaactgctagaatgtgtgagtgtgcaggcttagtgtggacatacatataggtctccttgggggtaaataccagacgaatgcaatcactgtgtgtgcatggccagagcctgtaaagtcttgtaagacgttgaccagactgtcttccaaagtgcttgtaccattttgtattcccaccaccagtgtggagagag

SEQ ID NO: 511188 - DNA, 440 bp, Homo sapiens
ggattcgacggcagggaaattcctcgggtagtatactgcttggggagatatattcgccttagaagaaagagactgtagcaataacaaaatcaagcgtagagctttattacctgagtatgaaatagagccgatatgtcttatatctttatcaataaaaccaatgtccagaaacaagtctttcattatctttgtaagtaaggctctattggctgtttacacccatgaataatggcataggtatctatttttcttttttacattgaaaaaaatcctgtgattactattgaatgcatcaagtaaagaaaaagaaaagaatacatccgatgcgtagattcttgaccatatagtattctataacatagctatatccacctgatagccatggcaaaacattataagaaggtcatttatttcgcagtaagaattataccaagctcaaa

SEQ ID NO: 511189 - DNA, 347 bp, Homo sapiens
gctcgacctgaaatagaacttggggaagaataaaataggggtaaaattgatagttccattctaaacatagtatctctaagaagcccactatgaatattgtctaattagaaatatatgaatctgaaatacttcaaaggaatacaggctggaggcttgcatttggatgtgatagggaagtttaagtcattgggctaaataagatgagctgcaacaagtgttccaaaatagaatagatgagcagagatggtttaagcagagatagagcaacctgaaaaagtgactggtaaagagtggtgagagaaaaaagaggaatgatgacagaattttaaattccttttctcaaaggg

SEQ ID NO: 511190 - DNA, 826 bp, Homo sapiens
ggcgaggaggcgctcgctccgtctgctcggccgctcctacgtcgcctctggggagatgatggtggggggcctgggtcctggccgccggctgggtcctgggaccccgcctgtccctggctcgaaatgggcccctccactcccgagccgagcgtggctctagcttcccatgtgcatggggacacctcagatgtctggactctcagagggagaccctcgggggcacacgctgaggcgaggcacggacggagtgagtgtggggcttcaaaatgacctccgggtttgctcagcttatcattctgacgatagggttcgctgtcgcctgtggattagcaagtctacatagagcacaccgggcagcgtcgcgcgtggcttgaagccttgtacacacaaagcgtgacgggggacgcatagggcatggcacacgagcaccatcgccatgcgactatgcaatcgatccttaaaacccaggggcaatggaggaccgtgggacagaaacggaaggccgttggccgggcgtagtccgtggcctcctggagttccaacaacccctttcaaagcaccagatacaacaattggattggacagactccccagaggcccctagggcaatggagatcataggaacagaacgggggagatccgataaataccttggggagcaacccaaaggagactcgctagtgagcacaaaccaatgtgtttggaacggggcaacagaagaggtcctgaccccaaggggcattctgacaaacaaaccagaaaaacccctcggaaggaggcctaaggggaaagacggcgcaggtatgaaaaaagcaaaacacccctg

SEQ ID NO: 511191 - DNA, 345 bp, Homo sapiens
  misc_feature (263)..(263): n is a, c, g, or t
cttttggggtctttgctcaggatgtcaagggaacccaggaccagatgcataaagtgataaaacaatctaattgtatcacaaatgtataaaacaaccacagcgatggggtggatgaaattgttgtggacctaagtaattttggaaatagagtctataaaattaaaggcaaaagaaactgtatataagtactgcactctagttgaaaagttgtttcctgtgggatatgggttaacaattatgatactgctgtacaggtatgctgngactgaacaaataaatgcaaagatggtggatggtgcaagccagcttttatactcttagaggggagtgcatagataagcaaga

SEQ ID NO: 511192 - DNA, 144 bp, Homo sapiens
ttcattataatttattttccatactaaatgacactcccaccagggccatgacagtttataatccccatggcaatggccagaagaaattatgaaagggcaaaaaggaaggccccaactccggttttgaggaattctccacccatt

SEQ ID NO: 511193 - DNA, 389 bp, Homo sapiens
atcagctgtgccctcccaggtacccctaagtcagcagactctctaaagatcgatcatgcatgcttgtcagcttggtactggtcgtcgattcaacaatcatcgtgattggtgatcatcccggcgtcatcaccatcaccatcatcatcactgtcatcaccatcatcatcactatcattacatcaccatcaccaccattatcactgtcatcatcacctttctccatcaccatcatcatcatcatcatatcatcctcatccccatcatcatcaccatcaccaccgtcattgctgtcatcaccattcgccatcaatgtcgtcatcaccatcatcatcactatcatcattatcaccatcatcaccatcaccatcatcattactgtcatcatcacc

SEQ ID NO: 511194 - DNA, 227 bp, Homo sapiens
agctaggcggtagtagtcgcccttcgggtgcgcaggatgtgccggctcaaatagagggtcggcagatcgagcagtttgcattcgatgaggtagaggaggttgaggatgctgcccgttctgccgttgccatccgagaagggatgaatggcttcgaatttgataatgcaggatggccatgcggatcagcgggtcggaccgtgtcgtcttagcgagtgatcgtccgattt

SEQ ID NO: 511195 - DNA, 1124 bp, Homo sapiens
ggacgcgtgggtcgacccacgcgtccggaagttccctgtgggaggctgttttctgagggagctgagtgtttacagccactcagccctgctctgctcagctgaagcagaaaacagagaccttttgcattactttggttcaagagcaagacaggaggcgactgcatgagaccatggctgagacacctagtcctccaggcactgaggaactccagggcattctgtgggtctcatgggaagccagcacctctacctgttcctcagaagatcgtggccacctgggaagccatcagcctgggaaggcagctggtgcctgagtacttcaacttcgcccatgatgtgctggatgtgtggagtcggctggaagaggctggacaccgccccccaaatcctgccttctggtgggtcaatggcacaggagcagagatcaagtggagctttgaggagctggggaagcagtccaggaaggcagccaatgtgctggggggtgcatgcggcctgcagcctggggacagaatgatgctggtactcccacggctcccggagtggtggctggtcagtgtggcttgcatgcggacagggactgtgatgattccgggtgtgactcagctgacagagaaggacctcaagtaccggctgcaggcgtccagggccaagtccattatcaccagtgactccctagctccaagggtggatgccatcagtgccgaatgcccctccctccagaccaagctgctggtgtcagacagcagtcggccaggctggttgaacttcagggaactcctccggtgaattggggctctccagaacagcagaaaaatgaagtcatttcccctttaagcaacaaaagatgaaatgcattgctgattccacacatagagagcgaatcagagaggagcactcccattggcagccaggctgacctgagcataatcctggtccctaccttaatgttcaaggtccctcattcagtcagtgctggatttgtcagcagcttttctgtgcttcatttgcttctataatgcggtggtagttattagagctaccattcagagtacatgaaataaccaatatggtgcatttagcacatagcaggtggtcagttaataataaactagtggccatgt

SEQ ID NO: 511196 - DNA, 459 bp, Homo sapiens
  misc_feature (326)..(326): n is a, c, g, or t
  misc_feature (361)..(361): n is a, c, g, or t
  misc_feature (370)..(370): n is a, c, g, or t
atttatttattctatgagtacactgtctgtgttcagacacaccagaagtggacatcagatcccattacagatggttgtaagccaccatatggttgctgggaattaaattcaggacctctggaagagcagtcagtgctcttaaccactgagccatctctccagcctgatacagaatcctataagcaacactatttgcagcttttaagttagaaatgttatttataacggttgctaaaaacattacataaacatttttgcttaaacttacagtcctgcctggggttagggtccactgccacatggactcggttacaggtccgacaganaatataccagcttttaatgggcagaaattagaggnaccattacnactcctcatggaaagctacttggaagtgggttcagaactttaaggcaggccagcagcacaaagaattaatggggaataatagcctcccc

SEQ ID NO: 511197 - DNA, 3479 bp, Homo sapiens
  misc_feature (2766)..(2766): n is a, c, g, or t
  misc_feature (2776)..(2776): n is a, c, g, or t
  misc_feature (3317)..(3317): n is a, c, g, or t
ggacgcgtgggtcgacccacgcgtccggaagttccctgtgggaggctgttttctgagggagctgagtgtttacagccactcagccctgctctgctcagctgaagcagaaaacagagaccttttgcattactttggttcaagagcaagacaggaggcgactgcatgagaccatggctgagacacctagtcctccaggcactgaggaactccagggcattctgtgggtctcatgggaagccagcacctctacctgttcctcagaagatcgtggccacctgggaagccatcagcctgggaaggcagctggtgcctgagtacttcaacttcgcccatgatgtgctggatgtgtggagtcggctggaagaggctggacaccgccccccaaatcctgccttctggtgggtcaatggcacaggagcagagatcaagtggagctttgaggagctggggaagcagtccaggaaggcagccaatgtgctggggggtgcatgcggcctgcagcctggggacagaatgatgctggtactcccacggctcccggagtggtggctggtcagtgtggcttgcatgcggacagggactgtgatgattccgggtgtgactcagctgacagagaaggacctcaagtaccggctgcaggcgtccagggccaagtccattatcaccagtgactccctagctccaagggtggatgccatcagtgccgaatgcccctccctccagaccaagctgctggtgtcagacagcagtcggccaggctggttgaacttcagggaactcctccgggaggcttctacagagcacaactgcatgaggacaaagagtcgagacccgctggccatctactttaccagcggaaccaccgggggcccccaagatggtcgagcactcccagagcagctacggactgggttttgtggccagcggaagacggtgggtggccttgaccgaatctgacatcttctggaacacgactgacactggctgggtgaaggcagcctggactctcttctctgcctggcctaatggatcttgcatttttgtgcatgagctgccccgagttgatgccaaagttatcctgaatactctctccaaattcccgataaccaccctctgctgtgtcccaaccatctttcggctgcttgtgcaggaggatctgaccaggtaccagtttcagagcctgaggcactgtctgaccggaggagaggccctcaaccgtgacgtgagggagaagtggaaacaccagaccggtgtggagctgtacgaaggctatggccagtctgaaacggttgtcatctgtgccaatccaaaaggcatgaaaatcaagtctggatccatggggaaggcgtccccaccctacgatgtgcagattgtggatgatgagggcaacgtcctgcctcctggagaagaggggaatgttgccgtccgtatcagacccactcggcccttctgtttcttcaattgctatttggacaatcctgagaagacagctgcatcagaacaaggggacttttacatcacaggggaccgagctcgcatggacaaggatggctacttttggttcatgggaagaaacgacgatgtgatcaattcttcaagctaccggatcgggcctgttgaagtggaaagtgccctggcagagcatcctgctgtcctggagtcggctgtggtcagcagcccagaccccatcaggggagaggtggtaaaggcatttatagtccttactccagcctactcctctcatgacccagaggcactaacgcgggaactccaggagcatgtgaaaagggtgactgctccatacaaataccccaggaaggtggcctttgtttcagaactgccaaagacggtttctggaaagatccaaaggagtaaattgcgaagtcaggagtgggggaaatgaggtgcaccccaggaaggccccgtagacctccgaagactccacaagaaactaatggatcactggtcagtccccatggggagcatcatctcttcgaccctaaagatgtcaaaggtgtgcagcttccaaacggcatccccaggatcactgggcaatgctggaaagagcaaaagaatatcattggccctgatcacatagatgctgcgccgcctagcaaatgcttggtggttcgacttctccctctgtctgggggcaggctcagcatctgcccactggtctcactaagagctttcagatttccctccataggacaggttaccatagacttggggcacttgtgggtactcattttctgccagtgggaatgtaaaggcttcatcctttgtatgtaaccatttggcaaaagtatgcaggaacataaaataaaatatcctttagctcagaaattctatcttcgggagtcaccacaaaagaaaaaaatcaaaatgcagaaaatgtgtggtgcactaagatgatcacacagcattaaaactaaaaaaaaaaaagaaaaaattaacaattaacatccaaacaacaaggaaatgattaacaaaattgtagtagattaactcaattacatatgatgtagccactaaaatatttgagagcagtttagtatgtcttgggaaaagtgtaagctatattaattttaaaaatcagagcaaaaatattcatactggagaatcccaactctgaaaaataaagggaaaactgtggttaattgtaatcctcctggagattgaggagggagggagagaaaataatggatggtagtttttcttcttcctttttccattacatttctgtattttccaagtttttgtacnaagcacatanaactattttaatgaaaaagttatgttaaagaaagcatactctgcttcatgtctagttcttcctccacatactcatacatcaaccccaaagactgctgtattatgtctgtattagtcagcattctccagagaaggagaagcaataggacatatatagacataggagaggggatttatgatgggaattggctcactcgattttggaggctgagaagttccacaatctaccatctgcatgctggagatccaggaaaccccgtggtataattccatctgagtccaaaggccgttgtggaggctggaggtctaggatcaggggttggcaaggttggtttcattctgaggatgtttccttggtttgtagatcgccgtcttctccctctgtcttcacgtggtctttcttctgtgcatgtgtgtctggggcccaatctcctcttcttctaaggacacctggtatttgtcatatgcctcggctcctcaaactgcagcaaacaaactctatggaagagaaaaaaatgggactccagagacttgaaatcacngccacttgtcagatgcagcccccaactcagctgcaggagcttagccaaatttctagtcctctctgagcctcaatttccttatctataaaatggggctctggatacctctcttgtagagttcttgtttagattacatgtgagcacttctataaaacactgaac

SEQ ID NO: 511198 - DNA, 378 bp, Homo sapiens
ggtcccatgccagttgggacatggcttaggaggaccaggctgcaggcaatacttggcccagtggccagatttccagcacttgaagcaagatcctggggcaggtggtcctggaggaatgcctggccgctgcagttcaggcgttttgaagttcttgtatgctggagatgcggctgggttttgtctcacagcagaggcaagtaattgtaactcagaaatgtgttgctgtctggctgcctcctttctattattgtacaccttgaaggcaaggttgattaattcccattgcgaggtttgagggccggattctaatttttgaagctttttctaatgtcaggggctgactgggtgataaaatgcatattgagaataagacagcct

SEQ ID NO: 511199 - DNA, 3316 bp, Homo sapiens
  misc_feature (2766)..(2766): n is a, c, g, or t
  misc_feature (2776)..(2776): n is a, c, g, or t
  misc_feature (3154)..(3154): n is a, c, g, or t
ggacgcgtgggtcgacccacgcgtccggaagttccctgtgggaggctgttttctgagggagctgagtgtttacagccactcagccctgctctgctcagctgaagcagaaaacagagaccttttgcattactttggttcaagagcaagacaggaggcgactgcatgagaccatggctgagacacctagtcctccaggcactgaggaactccagggcattctgtgggtctcatgggaagccagcacctctacctgttcctcagaagatcgtggccacctgggaagccatcagcctgggaaggcagctggtgcctgagtacttcaacttcgcccatgatgtgctggatgtgtggagtcggctggaagaggctggacaccgccccccaaatcctgccttctggtgggtcaatggcacaggagcagagatcaagtggagctttgaggagctggggaagcagtccaggaaggcagccaatgtgctggggggtgcatgcggcctgcagcctggggacagaatgatgctggtactcccacggctcccggagtggtggctggtcagtgtggcttgcatgcggacagggactgtgatgattccgggtgtgactcagctgacagagaaggacctcaagtaccggctgcaggcgtccagggccaagtccattatcaccagtgactccctagctccaagggtggatgccatcagtgccgaatgcccctccctccagaccaagctgctggtgtcagacagcagtcggccaggctggttgaacttcagggaactcctccgggaggcttctacagagcacaactgcatgaggacaaagagtcgagacccgctggccatctactttaccagcggaaccaccgggggcccccaagatggtcgagcactcccagagcagctacggactgggttttgtggccagcggaagacggtgggtggccttgaccgaatctgacatcttctggaacacgactgacactggctgggtgaaggcagcctggactctcttctctgcctggcctaatggatcttgcatttttgtgcatgagctgccccgagttgatgccaaagttatcctgaatactctctccaaattcccgataaccaccctctgctgtgtcccaaccatctttcggctgcttgtgcaggaggatctgaccaggtaccagtttcagagcctgaggcactgtctgaccggaggagaggccctcaaccgtgacgtgagggagaagtggaaacaccagaccggtgtggagctgtacgaaggctatggccagtctgaaacggttgtcatctgtgccaatccaaaaggcatgaaaatcaagtctggatccatggggaaggcgtccccaccctacgatgtgcagattgtggatgatgagggcaacgtcctgcctcctggagaagaggggaatgttgccgtccgtatcagacccactcggcccttctgtttcttcaattgctatttggacaatcctgagaagacagctgcatcagaacaaggggacttttacatcacaggggaccgagctcgcatggacaaggatggctacttttggttcatgggaagaaacgacgatgtgatcaattcttcaagctaccggatcgggcctgttgaagtggaaagtgccctggcagagcatcctgctgtcctggagtcggctgtggtcagcagcccagaccccatcaggggagaggtggtaaaggcatttatagtccttactccagcctactcctctcatgacccagaggcactaacgcgggaactccaggagcatgtgaaaagggtgactgctccatacaaataccccaggaaggtggcctttgtttcagaactgccaaagacggtttctggaaagatccaaaggagtaaattgcgaagtcaggagtgggggaaatgaggtgcaccccaggaaggccccgtagacctccgaagactccacaagaaactaatggatcactggtcagtccccatggggagcatcatctcttcgaccctaaagatgtcaaaggtgtgcagcttccaaacggcatccccaggatcactgggcaatgctggaaagagcaaaagaatatcattggccctgatcacatagatgctgcgccgcctagcaaatgcttggtggttcgacttctccctctgtctgggggcaggctcagcatctgcccactggtctcactaagagctttcagatttccctccataggacaggttaccatagacttggggcacttgtgggtactcattttctgccagtgggaatgtaaaggcttcatcctttgtatgtaaccatttggcaaaagtatgcaggaacataaaataaaatatcctttagctcagaaattctatcttcgggagtcaccacaaaagaaaaaaatcaaaatgcagaaaatgtgtggtgcactaagatgatcacacagcattaaaactaaaaaaaaaaaagaaaaaattaacaattaacatccaaacaacaaggaaatgattaacaaaattgtagtagattaactcaattacatatgatgtagccactaaaatatttgagagcagtttagtatgtcttgggaaaagtgtaagctatattaattttaaaaatcagagcaaaaatattcatactggagaatcccaactctgaaaaataaagggaaaactgtggttaattgtaatcctcctggagattgaggagggagggagagaaaataatggatggtagtttttcttcttcctttttccattacatttctgtattttccaagtttttgtacnaagcacatanaactattttaatgaaaaagttatgttaaagaaagcatactctgcttcatgtctagttcttcctccacatactcatacatcaaccccaaagactgctgtattatgtctgtattagtcagcattctccagagaaggagaagcaataggacatatatagacataggagaggggatttatgatgggaattggctcactcgattttggaggctgagaagttccacaatctaccatctgcatgctggagatccaggaaaccccgtggtataattccatctgagtccaaaggcctggtatttgtcatatgcctcggctcctcaaactgcagcaaacaaactctatggaagagaaaaaaatgggactccagagacttgaaatcacngccacttgtcagatgcagcccccaactcagctgcaggagcttagccaaatttctagtcctctctgagcctcaatttccttatctataaaatggggctctggatacctctcttgtagagttcttgtttagattacatgtgagcacttctataaaacactgaac

SEQ ID NO: 511200 - DNA, 3425 bp, Homo sapiens
  misc_feature (2712)..(2712): n is a, c, g, or t
  misc_feature (2722)..(2722): n is a, c, g, or t
  misc_feature (3263)..(3263): n is a, c, g, or t
ggacgcgtgggtcgacccacgcgtccggaagttccctgtgggaggctgttttctgagggagctgagtgtttacagccactcagccctgctctgctcagctgaagcagaaaacagagaccttttgcattactttggttcaagagcaagacaggaggcgactgcatgagaccatggctgagacacctagtcctccaggcactgaggaactccagggcattctgtgggtctcatgggaagccagcacctctacctgttcctcagaagatcgtggccacctgggaagccatcagcctgggaaggcagctggtgcctgagtacttcaacttcgcccatgatgtgctggatgtgtggagtcggctggaagaggctggacaccgccccccaaatcctgccttctggtgggtcaatggcacaggagcagagatcaagtggagctttgaggagctggggaagcagtccaggaaggcagccaatgtgctggggggtgcatgcggcctgcagcctggggacagaatgatgctggtactcccacggctcccggagtggtggctggtcagtgtggcttgcatgcggacagggactgtgatgattccgggtgtgactcagctgacagagaaggacctcaagtaccggctgcaggcgtccagggccaagtccattatcaccagtgactccctagctccaagggtggatgccatcagtgccgaatgcccctccctccagaccaagctgctggtgtcagacagcagtcggccaggctggttgaacttcagggaactcctccgggaggcttctacagagcacaactgcatgaggacaaagagtcgagacccgctggccatctactttaccagcggaaccaccgggggcccccaagatggtcgagcactcccagagcagctacggactgggttttgtggccagcggaagacggtgggtggccttgaccgaatctgacatcttctggaacacgactgacactggctgggtgaaggcagcctggactctcttctctgcctggcctaatggatcttgcatttttgtgcatgagctgccccgagttgatgccaaagttatcctgaatactctctccaaattcccgataaccaccctctgctgtgtcccaaccatctttcggctgcttgtgcaggaggatctgaccaggtaccagtttcagagcctgaggcactgtctgaccggaggagaggccctcaaccgtgacgtgagggagaagtggaaacaccagaccggtgtggagctgtacgaaggctatggccagtctgaaacggttgtcatctgtgccaatccaaaaggcatggtggatgatgagggcaacgtcctgcctcctggagaagaggggaatgttgccgtccgtatcagacccactcggcccttctgtttcttcaattgctatttggacaatcctgagaagacagctgcatcagaacaaggggacttttacatcacaggggaccgagctcgcatggacaaggatggctacttttggttcatgggaagaaacgacgatgtgatcaattcttcaagctaccggatcgggcctgttgaagtggaaagtgccctggcagagcatcctgctgtcctggagtcggctgtggtcagcagcccagaccccatcaggggagaggtggtaaaggcatttatagtccttactccagcctactcctctcatgacccagaggcactaacgcgggaactccaggagcatgtgaaaagggtgactgctccatacaaataccccaggaaggtggcctttgtttcagaactgccaaagacggtttctggaaagatccaaaggagtaaattgcgaagtcaggagtgggggaaatgaggtgcaccccaggaaggccccgtagacctccgaagactccacaagaaactaatggatcactggtcagtccccatggggagcatcatctcttcgaccctaaagatgtcaaaggtgtgcagcttccaaacggcatccccaggatcactgggcaatgctggaaagagcaaaagaatatcattggccctgatcacatagatgctgcgccgcctagcaaatgcttggtggttcgacttctccctctgtctgggggcaggctcagcatctgcccactggtctcactaagagctttcagatttccctccataggacaggttaccatagacttggggcacttgtgggtactcattttctgccagtgggaatgtaaaggcttcatcctttgtatgtaaccatttggcaaaagtatgcaggaacataaaataaaatatcctttagctcagaaattctatcttcgggagtcaccacaaaagaaaaaaatcaaaatgcagaaaatgtgtggtgcactaagatgatcacacagcattaaaactaaaaaaaaaaaagaaaaaattaacaattaacatccaaacaacaaggaaatgattaacaaaattgtagtagattaactcaattacatatgatgtagccactaaaatatttgagagcagtttagtatgtcttgggaaaagtgtaagctatattaattttaaaaatcagagcaaaaatattcatactggagaatcccaactctgaaaaataaagggaaaactgtggttaattgtaatcctcctggagattgaggagggagggagagaaaataatggatggtagtttttcttcttcctttttccattacatttctgtattttccaagtttttgtacnaagcacatanaactattttaatgaaaaagttatgttaaagaaagcatactctgcttcatgtctagttcttcctccacatactcatacatcaaccccaaagactgctgtattatgtctgtattagtcagcattctccagagaaggagaagcaataggacatatatagacataggagaggggatttatgatgggaattggctcactcgattttggaggctgagaagttccacaatctaccatctgcatgctggagatccaggaaaccccgtggtataattccatctgagtccaaaggccgttgtggaggctggaggtctaggatcaggggttggcaaggttggtttcattctgaggatgtttccttggtttgtagatcgccgtcttctccctctgtcttcacgtggtctttcttctgtgcatgtgtgtctggggcccaatctcctcttcttctaaggacacctggtatttgtcatatgcctcggctcctcaaactgcagcaaacaaactctatggaagagaaaaaaatgggactccagagacttgaaatcacngccacttgtcagatgcagcccccaactcagctgcaggagcttagccaaatttctagtcctctctgagcctcaatttccttatctataaaatggggctctggatacctctcttgtagagttcttgtttagattacatgtgagcacttctataaaacactgaac

SEQ ID NO: 511201 - DNA, 125 bp, Homo sapiens
tcctgctacaccaggcacgaggtgaatgaatgtcaggcgtattataccatagcccccatcgctgggtcaatagtacttgccgcagtactcttaaaactaggcggctatggtataatacgcatcac

SEQ ID NO: 511202 - DNA, 148 bp, Homo sapiens
cacgaggtgttctgctttgactcagagatcgtcaatgcaccaggtgttgtcaccgagggggtcacaaataacgttcctacgatagtcagggaggcggtcatggaggaacagatggctctcgacattgaccggggaagaaagctcttgt

SEQ ID NO: 511203 - DNA, 937 bp, Homo sapiens
  misc_feature (65)..(65): n is a, c, g, or t
gagaaggtttaggtgaagagggcagaggaaacccaattaattgaatatcatctatgtgacccagntttaaaatgtgctaaggcatgagttggtgagagtattagcatatcagagttgaccggtacagggatgagttatgagagtgacaggactcctacgagaaattggcctgagggccaaaatggggcacaaaggatagatttatgattcaaaaagtaccacccgccacttctctagtaacgagtccggcagcagagaagttcaacgtgtcccgcagcgcaaggatcaaatatctggccgtcggagcttcgattctcatcacgttctcactcggcagtagtacatggcttgattctgagcacccgtagcaagcgtctggctcttttgcagacctggccgacgtgaaaacgcccttgatgtgatgccggtgtattctcccccccacaaagcaccacccgccgctcgtagtcatcctggctttttaaacaatgtcaaaccagagcaagtggttttcaattactctccttgaactaggccttcccattcctccgacccccaactcatcattgatcgcgaccctggcccttcccaaggccacaggcacccgccgccagctcgcccaccccgcggctgcccagcccggcccgccgccccccctcacctgtcaggcgcagcttgacgggcccgttcctccggcctccggggttagacatgtccccggcggcgggggcggcgggggcggcgggcggcacgggggcgacggcgaggcgcggcggagtcaccacagcggccggggctggggcccgagcagccggcgcctcggccgccacggccggagggtcccggatgtgccgagagtcgtcgccatgagccgcggagggagcgggacgccgagctcccccctcctcccacttctccttcctcggcccgggccgca

SEQ ID NO: 511204 - DNA, 3565 bp, Homo sapiens
  misc_feature (2852)..(2852): n is a, c, g, or t
  misc_feature (2862)..(2862): n is a, c, g, or t
  misc_feature (3403)..(3403): n is a, c, g, or t
ggacgcgtgggtcgacccacgcgtccggaagttccctgtgggaggctgttttctgagggagctgagtgtttacagccactcagccctgctctgctcagctgaagcagaaaacagagaccttttgcattactttggttcaagagcaagacaggaggcgactgcatgagaccatggctgagacacctagtcctccaggcactgaggaactccagggcattctgtgggtctcatgggaagccagcacctctacctgttcctcagaagatcgtggccacctgggaagccatcagcctgggaaggcagctggtgcctgagtacttcaacttcgcccatgatgtgctggatgtgtggagtcggctggaagaggctggacaccgccccccaaatcctgccttctggtgggtcaatggcacaggagcagagatcaagtggagctttgaggagctggggaagcagtccaggaaggcagccaatgtgctggggggtgcatgcggcctgcagcctggggacagaatgatgctggtactcccacggctcccggagtggtggctggtcagtgtggcttgcatgcggacagggactgtgatgattccgggtgtgactcagctgacagagaaggacctcaagtaccggctgcaggcgtccagggccaagtccattatcaccagtgactccctagctccaagggtggatgccatcagtgccgaatgcccctccctccagaccaagctgctggtgtcagacagcagtcggccaggctggttgaacttcagggaactcctccgggaggcttctacagagcacaactgcatgaggacaaagagtcgagacccgctggccatctactttaccagcggaaccaccgggggcccccaagatggtcgagcactcccagagcagctacggactgggttttgtggccagcggaagacggtgggtggccttgaccgaatctgacatcttctggaacacgactgacactggctgggtgaaggcagcctggactctcttctctgcctggcctaatggatcttgcatttttgtgcatgagctgccccgagttgatgccaaagttatcctgaatactctctccaaattcccgataaccaccctctgctgtgtcccaaccatctttcggctgcttgtgcaggaggatctgaccaggtaccagtttcagagcctgaggcactgtctgaccggaggagaggccctcaaccgtgacgtgagggagaagtggaaacaccagaccggtgtggagctgtacgaaggctatggccagtctgaaacggttgtcatctgtgccaatccaaaaggcatgaaaatcaagtctggatccatggggaaggcgtccccaccctacgatgtgcagattgtggatgatgagggcaacgtcctgcctcctggagaagaggggaatgttgccgtccgtatcagacccactcggcccttctgtttcttcaattgctatttggacaatcctgagaagacagctgcatcagaacaaggggacttttacatcacaggggaccgagctcgcatggacaaggatggctacttttggttcatgggaagaaacgacgatgtgatcaattcttcaaggtcaagctgtctgcacttccctcctccctttgaaatttcatgggggttgagggaagcccacttgaagagttgtttttcccttccagctaccggatcgggcctgttgaagtggaaagtgccctggcagagcatcctgctgtcctggagtcggctgtggtcagcagcccagaccccatcaggggagaggtggtaaaggcatttatagtccttactccagcctactcctctcatgacccagaggcactaacgcgggaactccaggagcatgtgaaaagggtgactgctccatacaaataccccaggaaggtggcctttgtttcagaactgccaaagacggtttctggaaagatccaaaggagtaaattgcgaagtcaggagtgggggaaatgaggtgcaccccaggaaggccccgtagacctccgaagactccacaagaaactaatggatcactggtcagtccccatggggagcatcatctcttcgaccctaaagatgtcaaaggtgtgcagcttccaaacggcatccccaggatcactgggcaatgctggaaagagcaaaagaatatcattggccctgatcacatagatgctgcgccgcctagcaaatgcttggtggttcgacttctccctctgtctgggggcaggctcagcatctgcccactggtctcactaagagctttcagatttccctccataggacaggttaccatagacttggggcacttgtgggtactcattttctgccagtgggaatgtaaaggcttcatcctttgtatgtaaccatttggcaaaagtatgcaggaacataaaataaaatatcctttagctcagaaattctatcttcgggagtcaccacaaaagaaaaaaatcaaaatgcagaaaatgtgtggtgcactaagatgatcacacagcattaaaactaaaaaaaaaaaagaaaaaattaacaattaacatccaaacaacaaggaaatgattaacaaaattgtagtagattaactcaattacatatgatgtagccactaaaatatttgagagcagtttagtatgtcttgggaaaagtgtaagctatattaattttaaaaatcagagcaaaaatattcatactggagaatcccaactctgaaaaataaagggaaaactgtggttaattgtaatcctcctggagattgaggagggagggagagaaaataatggatggtagtttttcttcttcctttttccattacatttctgtattttccaagtttttgtacnaagcacatanaactattttaatgaaaaagttatgttaaagaaagcatactctgcttcatgtctagttcttcctccacatactcatacatcaaccccaaagactgctgtattatgtctgtattagtcagcattctccagagaaggagaagcaataggacatatatagacataggagaggggatttatgatgggaattggctcactcgattttggaggctgagaagttccacaatctaccatctgcatgctggagatccaggaaaccccgtggtataattccatctgagtccaaaggccgttgtggaggctggaggtctaggatcaggggttggcaaggttggtttcattctgaggatgtttccttggtttgtagatcgccgtcttctccctctgtcttcacgtggtctttcttctgtgcatgtgtgtctggggcccaatctcctcttcttctaaggacacctggtatttgtcatatgcctcggctcctcaaactgcagcaaacaaactctatggaagagaaaaaaatgggactccagagacttgaaatcacngccacttgtcagatgcagcccccaactcagctgcaggagcttagccaaatttctagtcctctctgagcctcaatttccttatctataaaatggggctctggatacctctcttgtagagttcttgtttagattacatgtgagcacttctataaaacactgaac

SEQ ID NO: 511205 - DNA, 988 bp, Homo sapiens
gacgcgactgatctgtggttcatggtatggacagggctgcttatcagtatctcatgcactaagtactttatgtcgctctctactgtcgttagaccttctgggtgtccttggaggacgtatgagtagattcagatccaagatatagggtgaattatgagttgctcgttagtggaccaatgttttcgaaggtggggtgaaaaactatctggcaaataggataagtacagtagacaatctcaagaggaagtctgaggatgggtactgaattgtgggtggtgagatctctatctcagtcatgacctattagtgtatagtacatgtagctagtctgtgacctggaggtagttctaattggtgagaaattgaatgtcaagtgggtggtgctctgtgaggtgaggggggaagatgaatgctatgaagcaatagtggaagattaagtctataatagatgtagagttgacttggtaattcaagagatcataggtcaccagaattgagtgcataggagctttagatgtcctatgggaataacttattcagactactcttccttggggtgtgtaaggtcatacatagtgagcaatgatgagtgagtgggtacatatagaccatgtctgagcatccacaggaaagtataacgggtatgtaaagggggatttgtgaccagagcgtaggtggggaatgaaccgaaatcaaggagtataaattacgactgaggtctgggggaactagaattgcggttgaggcactctgtgcgattggtacagtagatcgagtgcggtgtacatctaggagggtgaaaagggaatatgaggtgggattccgaagttttgagtaatttattgagaccttggattggactttagtaggctgtaaaattaaaggtgtgtgaggggctcactgtgcaaggccggaggggggggaaaagggttgaggaagagattgaaatgtgagaaaatggggaataaaagacgtggttagtgttata

SEQ ID NO: 511206 - DNA, 233 bp, Homo sapiens
gtcgacgggattacaggcatgagcaccatgcttggcccccattaagtgccttttgtattattttattgtgtcccctgccaaggattttagcacttaaaaaatcttctggccagcactttgggaggccgaggcgggcggatcacgaggtcaggagatcgagaccgtcctggctaacacggtgaaaccccgtctctactaaaaatacaaaaaattagccgggcgtggtggcgggc

SEQ ID NO: 511207 - DNA, 3485 bp, Homo sapiens
  misc_feature (2772)..(2772): n is a, c, g, or t
  misc_feature (2782)..(2782): n is a, c, g, or t
  misc_feature (3323)..(3323): n is a, c, g, or t
ggacgcgtgggtcgacccacgcgtccggaagttccctgtgggaggctgttttctgagggagctgagtgtttacagccactcagccctgctctgctcagctgaagcagaaaacagagaccttttgcattactttggttcaagagcaagacaggaggcgactgcatgagaccatggctgagacacctagtcctccaggcactgaggaactccagggcattctgtgggtctcatgggaagccagcacctctacctgttcctcagaagatcgtggccacctgggaagccatcagcctgggaaggcagctggtgcctgagtacttcaacttcgcccatgatgtgctggatgtgtggagtcggctggaagaggctggacaccgccccccaaatcctgccttctggtgggtcaatggcacaggagcagagatcaagtggagctttgaggagctggggaagcagtccaggaaggcagccaatgtgctggggggtgcatgcggcctgcagcctggggacagaatgatgctggtactcccacggctcccggagtggtggctggtcagtgtggcttgcatgcggacagggactgtgatgattccgggtgtgactcagctgacagagaaggacctcaagtaccggctgcaggcgtccagggccaagtccattatcaccagtgactccctagctccaagggtggatgccatcagtgccgaatgcccctccctccagaccaagctgctggtgtcagacagcagtcggccaggctggttgaacttcagggaactcctccgggaggcttctacagagcacaactgcatgaggacaaagagtcgagacccgctggccatctactttaccagcggaaccaccgggggcccccaagatggtcgagcactcccagagcagctacggactgggttttgtggccagcggaagacggtgggtggccttgaccgaatctgacatcttctggaacacgactgacactggctgggtgaaggcagcctggactctcttctctgcctggcctaatggatcttgcatttttgtgcatgagctgccccgagttgatgccaaagttatcctgaatgtaccagtttcagagcctgaggcactgtctgaccggaggagaggccctcaaccgtgacgtgagggagaagtggaaacaccagaccggtgtggagctgtacgaaggctatggccagtctgaaacggttgtcatctgtgccaatccaaaaggcatgaaaatcaagtctggatccatggggaaggcgtccccaccctacgatgtgcagattgtggatgatgagggcaacgtcctgcctcctggagaagaggggaatgttgccgtccgtatcagacccactcggcccttctgtttcttcaattgctatttggacaatcctgagaagacagctgcatcagaacaaggggacttttacatcacaggggaccgagctcgcatggacaaggatggctacttttggttcatgggaagaaacgacgatgtgatcaattcttcaaggtcaagctgtctgcacttccctcctccctttgaaatttcatgggggttgagggaagcccacttgaagagttgtttttcccttccagctaccggatcgggcctgttgaagtggaaagtgccctggcagagcatcctgctgtcctggagtcggctgtggtcagcagcccagaccccatcaggggagaggtggtaaaggcatttatagtccttactccagcctactcctctcatgacccagaggcactaacgcgggaactccaggagcatgtgaaaagggtgactgctccatacaaataccccaggaaggtggcctttgtttcagaactgccaaagacggtttctggaaagatccaaaggagtaaattgcgaagtcaggagtgggggaaatgaggtgcaccccaggaaggccccgtagacctccgaagactccacaagaaactaatggatcactggtcagtccccatggggagcatcatctcttcgaccctaaagatgtcaaaggtgtgcagcttccaaacggcatccccaggatcactgggcaatgctggaaagagcaaaagaatatcattggccctgatcacatagatgctgcgccgcctagcaaatgcttggtggttcgacttctccctctgtctgggggcaggctcagcatctgcccactggtctcactaagagctttcagatttccctccataggacaggttaccatagacttggggcacttgtgggtactcattttctgccagtgggaatgtaaaggcttcatcctttgtatgtaaccatttggcaaaagtatgcaggaacataaaataaaatatcctttagctcagaaattctatcttcgggagtcaccacaaaagaaaaaaatcaaaatgcagaaaatgtgtggtgcactaagatgatcacacagcattaaaactaaaaaaaaaaaagaaaaaattaacaattaacatccaaacaacaaggaaatgattaacaaaattgtagtagattaactcaattacatatgatgtagccactaaaatatttgagagcagtttagtatgtcttgggaaaagtgtaagctatattaattttaaaaatcagagcaaaaatattcatactggagaatcccaactctgaaaaataaagggaaaactgtggttaattgtaatcctcctggagattgaggagggagggagagaaaataatggatggtagtttttcttcttcctttttccattacatttctgtattttccaagtttttgtacnaagcacatanaactattttaatgaaaaagttatgttaaagaaagcatactctgcttcatgtctagttcttcctccacatactcatacatcaaccccaaagactgctgtattatgtctgtattagtcagcattctccagagaaggagaagcaataggacatatatagacataggagaggggatttatgatgggaattggctcactcgattttggaggctgagaagttccacaatctaccatctgcatgctggagatccaggaaaccccgtggtataattccatctgagtccaaaggccgttgtggaggctggaggtctaggatcaggggttggcaaggttggtttcattctgaggatgtttccttggtttgtagatcgccgtcttctccctctgtcttcacgtggtctttcttctgtgcatgtgtgtctggggcccaatctcctcttcttctaaggacacctggtatttgtcatatgcctcggctcctcaaactgcagcaaacaaactctatggaagagaaaaaaatgggactccagagacttgaaatcacngccacttgtcagatgcagcccccaactcagctgcaggagcttagccaaatttctagtcctctctgagcctcaatttccttatctataaaatggggctctggatacctctcttgtagagttcttgtttagattacatgtgagcacttctataaaacactgaac

SEQ ID NO: 511208 - DNA, 296 bp, Homo sapiens
ttgtgaggacactagtgcccaagaagtcaaggctgcatgcagtgggccatgttcccgccactgcactccagcctgggggacagggtgagaccctatctcccctccaaaaaaaaaaaaaatttaaaacctgatctggtggtttcaaaaaactacgctaccaccctcaaagaaatcagacatacttgacaccacatagctcccaaaacactctctggtactgagttaagatcaaaactatttaagcacctactcttctcttcctccccgtctaaactcccttatttccagcgctaagt

SEQ ID NO: 511209 - DNA, 456 bp, Homo sapiens
tagtctgcagttcccggtggcgggtcctggtgccttaactcctggatgcagcgatgaatgccctaacttggaattggcaggcgttgggctccgggcttttacatcggtaaggagtgcagatgtcagatgctagagctcctatacctcgcggtaccctcgttggacctcctggatggtctggcctcctgcgaagagcatgtgagagaaatcgctccaatatgacccacgatgaagtggacttgggcttccagatcatctggatacagtggatggcaccagacggttatctggtgtctcatctccatcagggtcccactcatgcatacatgcctctggatcatgatgactcgttgggccttgctcagcatgagatcgagggtgcgggcctttaagagatccgagagtgctaaattggagagcccagaggccccatgatagatcaaaggggtctaccta

SEQ ID NO: 511210 - DNA, 3371 bp, Homo sapiens
  misc_feature (2658)..(2658): n is a, c, g, or t
  misc_feature (2668)..(2668): n is a, c, g, or t
  misc_feature (3209)..(3209): n is a, c, g, or t
ggacgcgtgggtcgacccacgcgtccggaagttccctgtgggaggctgttttctgagggagctgagtgtttacagccactcagccctgctctgctcagctgaagcagaaaacagagaccttttgcattactttggttcaagagcaagacaggaggcgactgcatgagaccatggctgagacacctagtcctccaggcactgaggaactccagggcattctgtgggtctcatgggaagccagcacctctacctgttcctcagaagatcgtggccacctgggaagccatcagcctgggaaggcagctggtgcctgagtacttcaacttcgcccatgatgtgctggatgtgtggagtcggctggaagaggctggacaccgccccccaaatcctgccttctggtgggtcaatggcacaggagcagagatcaagtggagctttgaggagctggggaagcagtccaggaaggcagccaatgtgctggggggtgcatgcggcctgcagcctggggacagaatgatgctggtactcccacggctcccggagtggtggctggtcagtgtggcttgcatgcggacagggactgtgatgattccgggtgtgactcagctgacagagaaggacctcaagtaccggctgcaggcgtccagggccaagtccattatcaccagtgactccctagctccaagggtggatgccatcagtgccgaatgcccctccctccagaccaagctgctggtgtcagacagcagtcggccaggctggttgaacttcagggaactcctccgggaggcttctacagagcacaactgcatgaggacaaagagtcgagacccgctggccatctactttaccagcggaaccaccgggggcccccaagatggtcgagcactcccagagcagctacggactgggttttgtggccagcggaagacggtgggtggccttgaccgaatctgacatcttctggaacacgactgacactggctgggtgaaggcagcctggactctcttctctgcctggcctaatggatcttgcatttttgtgcatgagctgccccgagttgatgccaaagttatcctgaatactctctccaaattcccgataaccaccctctgctgtgtcccaaccatctttcggctgcttgtgcaggaggatctgaccaggtaccagtttcagagcctgaggcactgtctgaccggaggagaggccctcaaccgtgacgtgagggagaagtggaaacaccagaccggtgtggagctgtacgaaggctatggccagtctgaaacggttgtcatctgtgccaatccaaaaggcatggtggatgatgagggcaacgtcctgcctcctggagaagaggggaatgttgccgtccgtatcagacccactcggcccttctgtttcttcaattgctatttggacaatcctgagaagacagctgcatcagaacaaggggacttttacatcacaggggaccgagctcgcatggacaaggatggctacttttggttcatgggaagaaacgacgatgtgatcaattcttcaagctaccggatcgggcctgttgaagtggaaagtgccctggcagagcatcctgctgtcctggagtcggctgtggtcagcagcccagaccccatcaggggagaggtggtaaaggcatttatagtccttactccagcctactcctctcatgacccagaggcactaacgcgggaactccaggagcatgtgctgccaaagacggtttctggaaagatccaaaggagtaaattgcgaagtcaggagtgggggaaatgaggtgcaccccaggaaggccccgtagacctccgaagactccacaagaaactaatggatcactggtcagtccccatggggagcatcatctcttcgaccctaaagatgtcaaaggtgtgcagcttccaaacggcatccccaggatcactgggcaatgctggaaagagcaaaagaatatcattggccctgatcacatagatgctgcgccgcctagcaaatgcttggtggttcgacttctccctctgtctgggggcaggctcagcatctgcccactggtctcactaagagctttcagatttccctccataggacaggttaccatagacttggggcacttgtgggtactcattttctgccagtgggaatgtaaaggcttcatcctttgtatgtaaccatttggcaaaagtatgcaggaacataaaataaaatatcctttagctcagaaattctatcttcgggagtcaccacaaaagaaaaaaatcaaaatgcagaaaatgtgtggtgcactaagatgatcacacagcattaaaactaaaaaaaaaaaagaaaaaattaacaattaacatccaaacaacaaggaaatgattaacaaaattgtagtagattaactcaattacatatgatgtagccactaaaatatttgagagcagtttagtatgtcttgggaaaagtgtaagctatattaattttaaaaatcagagcaaaaatattcatactggagaatcccaactctgaaaaataaagggaaaactgtggttaattgtaatcctcctggagattgaggagggagggagagaaaataatggatggtagtttttcttcttcctttttccattacatttctgtattttccaagtttttgtacnaagcacatanaactattttaatgaaaaagttatgttaaagaaagcatactctgcttcatgtctagttcttcctccacatactcatacatcaaccccaaagactgctgtattatgtctgtattagtcagcattctccagagaaggagaagcaataggacatatatagacataggagaggggatttatgatgggaattggctcactcgattttggaggctgagaagttccacaatctaccatctgcatgctggagatccaggaaaccccgtggtataattccatctgagtccaaaggccgttgtggaggctggaggtctaggatcaggggttggcaaggttggtttcattctgaggatgtttccttggtttgtagatcgccgtcttctccctctgtcttcacgtggtctttcttctgtgcatgtgtgtctggggcccaatctcctcttcttctaaggacacctggtatttgtcatatgcctcggctcctcaaactgcagcaaacaaactctatggaagagaaaaaaatgggactccagagacttgaaatcacngccacttgtcagatgcagcccccaactcagctgcaggagcttagccaaatttctagtcctctctgagcctcaatttccttatctataaaatggggctctggatacctctcttgtagagttcttgtttagattacatgtgagcacttctataaaacactgaac

SEQ ID NO: 511211 - DNA, 3367 bp, Homo sapiens
  misc_feature (2654)..(2654): n is a, c, g, or t
  misc_feature (2664)..(2664): n is a, c, g, or t
  misc_feature (3205)..(3205): n is a, c, g, or t
ggacgcgtgggtcgacccacgcgtccggaagttccctgtgggaggctgttttctgagggagctgagtgtttacagccactcagccctgctctgctcagctgaagcagagaccatggctgagacacctagtcctccaggcactgaggaactccagggcattctgtgggtctcatgggaagccagcacctctacctgttcctcagaagatcgtggccacctgggaagccatcagcctgggaaggcagctggtgcctgagtacttcaacttcgcccatgatgtgctggatgtgtggagtcggctggaagaggctggacaccgccccccaaatcctgccttctggtgggtcaatggcacaggagcagagatcaagtggagctttgaggagctggggaagcagtccaggaaggcagccaatgtgctggggggtgcatgcggcctgcagcctggggacagaatgatgctggtactcccacggctcccggagtggtggctggtcagtgtggcttgcatgcggacagggactgtgatgattccgggtgtgactcagctgacagagaaggacctcaagtaccggctgcaggcgtccagggccaagtccattatcaccagtgactccctagctccaagggtggatgccatcagtgccgaatgcccctccctccagaccaagctgctggtgtcagacagcagtcggccaggctggttgaacttcagggaactcctccgggaggcttctacagagcacaactgcatgaggacaaagagtcgagacccgctggccatctactttaccagcggaaccaccgggggcccccaagatggtcgagcactcccagagcagctacggactgggttttgtggccagcggaagacggtgggtggccttgaccgaatctgacatcttctggaacacgactgacactggctgggtgaaggcagcctggactctcttctctgcctggcctaatggatcttgcatttttgtgcatgagctgccccgagttgatgccaaagttatcctgaatactctctccaaattcccgataaccaccctctgctgtgtcccaaccatctttcggctgcttgtgcaggaggatctgaccaggtaccagtttcagagcctgaggcactgtctgaccggaggagaggccctcaaccgtgacgtgagggagaagtggaaacaccagaccggtgtggagctgtacgaaggctatggccagtctgaaacggttgtcatctgtgccaatccaaaaggcatggtggatgatgagggcaacgtcctgcctcctggagaagaggggaatgttgccgtccgtatcagacccactcggcccttctgtttcttcaattgctatttggacaatcctgagaagacagctgcatcagaacaaggggacttttacatcacaggggaccgagctcgcatggacaaggatggctacttttggttcatgggaagaaacgacgatgtgatcaattcttcaagctaccggatcgggcctgttgaagtggaaagtgccctggcagagcatcctgctgtcctggagtcggctgtggtcagcagcccagaccccatcaggggagaggtggtaaaggcatttatagtccttactccagcctactcctctcatgacccagaggcactaacgcgggaactccaggagcatgtgaaaagggtgactgctccatacaaataccccaggaaggtggcctttgtttcagaactgccaaagacggtttctggaaagatccaaaggagtaaattgcgaagtcaggagtgggggaaatgaggtgcaccccaggaaggccccgtagacctccgaagactccacaagaaactaatggatcactggtcagtccccatggggagcatcatctcttcgaccctaaagatgtcaaaggtgtgcagcttccaaacggcatccccaggatcactgggcaatgctggaaagagcaaaagaatatcattggccctgatcacatagatgctgcgccgcctagcaaatgcttggtggttcgacttctccctctgtctgggggcaggctcagcatctgcccactggtctcactaagagctttcagatttccctccataggacaggttaccatagacttggggcacttgtgggtactcattttctgccagtgggaatgtaaaggcttcatcctttgtatgtaaccatttggcaaaagtatgcaggaacataaaataaaatatcctttagctcagaaattctatcttcgggagtcaccacaaaagaaaaaaatcaaaatgcagaaaatgtgtggtgcactaagatgatcacacagcattaaaactaaaaaaaaaaaagaaaaaattaacaattaacatccaaacaacaaggaaatgattaacaaaattgtagtagattaactcaattacatatgatgtagccactaaaatatttgagagcagtttagtatgtcttgggaaaagtgtaagctatattaattttaaaaatcagagcaaaaatattcatactggagaatcccaactctgaaaaataaagggaaaactgtggttaattgtaatcctcctggagattgaggagggagggagagaaaataatggatggtagtttttcttcttcctttttccattacatttctgtattttccaagtttttgtacnaagcacatanaactattttaatgaaaaagttatgttaaagaaagcatactctgcttcatgtctagttcttcctccacatactcatacatcaaccccaaagactgctgtattatgtctgtattagtcagcattctccagagaaggagaagcaataggacatatatagacataggagaggggatttatgatgggaattggctcactcgattttggaggctgagaagttccacaatctaccatctgcatgctggagatccaggaaaccccgtggtataattccatctgagtccaaaggccgttgtggaggctggaggtctaggatcaggggttggcaaggttggtttcattctgaggatgtttccttggtttgtagatcgccgtcttctccctctgtcttcacgtggtctttcttctgtgcatgtgtgtctggggcccaatctcctcttcttctaaggacacctggtatttgtcatatgcctcggctcctcaaactgcagcaaacaaactctatggaagagaaaaaaatgggactccagagacttgaaatcacngccacttgtcagatgcagcccccaactcagctgcaggagcttagccaaatttctagtcctctctgagcctcaatttccttatctataaaatggggctctggatacctctcttgtagagttcttgtttagattacatgtgagcacttctataaaacactgaac

SEQ ID NO: 511212 - DNA, 122 bp, Homo sapiens
gcgcactatagggcgagttctccatcacctacaagcccgtaaagcatggcctggcccggcatcggggcacccactcctcccgcttcatccctcccaagtattgctcagcggggtaccgagct

SEQ ID NO: 511213 - DNA, 135 bp, Homo sapiens
gtagtcaatcaaagctgtggtgtataccttaatgaagaacagcatgtcaaaagacaagatgaggcagaaagctaggcctcttttgcaaaacagccaatgttgtgaattcacaggaaaagtctccagtgaaattta

SEQ ID NO: 511214 - DNA, 2887 bp, Homo sapiens
  misc_feature (2725)..(2725): n is a, c, g, or t
ggacgcgtgggtcgacccacgcgtccggaagttccctgtgggaggctgttttctgagggagctgagtgtttacagccactcagccctgctctgctcagctgaagcagaaaacagagaccttttgcattactttggttcaagagcaagacaggaggcgactgcatgagaccatggctgagacacctagtcctccaggcactgaggaactccagggcattctgtgggtctcatgggaagccagcacctctacctgttcctcagaagatcgtggccacctgggaagccatcagcctgggaaggcagctggtgcctgagtacttcaacttcgcccatgatgtgctggatgtgtggagtcggctggaagaggctggacaccgccccccaaatcctgccttctggtgggtcaatggcacaggagcagagatcaagtggagctttgaggagctggggaagcagtccaggaaggcagccaatgtgctggggggtgcatgcggcctgcagcctggggacagaatgatgctggtactcccacggctcccggagtggtggctggtcagtgtggcttgcatgcggacagggactgtgatgattccgggtgtgactcagctgacagagaaggacctcaagtaccggctgcaggcgtccagggccaagtccattatcaccagtgactccctagctccaagggtggatgccatcagtgccgaatgcccctccctccagaccaagctgctggtgtcagacagcagtcggccaggctggttgaacttcagggaactcctccgggaggcttctacagagcacaactgcatgaggacaaagagtcgagacccgctggccatctactttaccagcggaaccaccgggggcccccaagatggtcgagcactcccagagcagctacggactgggttttgtggccagcggaagacggtgggtggccttgaccgaatctgacatcttctggaacacgactgacactggctgggtgaaggcagcctggactctcttctctgcctggcctaatggatcttgcatttttgtgcatgagctgccccgagttgatgccaaagttatcctgaatactctctccaaattcccgataaccaccctctgctgtgtcccaaccatctttcggctgcttgtgcaggaggatctgaccaggtaccagtttcagagcctgaggcactgtctgaccggaggagaggccctcaaccgtgacgtgagggagaagtggaaacaccagaccggtgtggagctgtacgaaggctatggccagtctgaaacggttgtcatctgtgccaatccaaaaggcatggtggatgatgagggcaacgtcctgcctcctggagaagaggggaatgttgccgtccgtatcagacccactcggcccttctgtttcttcaattgctatttggacaatcctgagaagacagctgcatcagaacaaggggacttttacatcacaggggaccgagctcgcatggacaaggatggctacttttggttcatgggaagaaacgacgatgtgatcaattcttcaagctaccggatcgggcctgttgaagtggaaagtgccctggcagagcatcctgctgtcctggagtcggctgtggtcagcagcccagaccccatcaggggagaggtggtaaaggcatttatagtccttactccagcctactcctctcatgacccagaggcactaacgcgggaactccaggagcatgtgaaaagggtgactgctccatacaaataccccaggaaggtggcctttgtttcagaactgccaaagacggtttctggaaagatccaaaggagtaaattgcgaagtcaggagtgggggaaatgaggtgcaccccaggaaggccccgtagacctccgaagactccacaagaaactaatggatcactggtcagtccccatggggagcatcatctcttcgaccctaaagatgtcaaaggtgtgcagcttccaaacggcatccccaggatcactgggcaatgctggaaagagcaaaagaatatcattggccctgatcacatagatgctgcgccgcctagcaaatgcttggtggttcgacttctccctctgtctgggggcaggctcagcatctgcccactggtctcactaagagctttcagatttccctccataggacaggttaccatagacttggggcacttgtgggtactcattttctgccagtgggaatgtaaaggcttcatcctttgtatgtaaccatttggcaaaagtatgcaggaacataaaataaaatatcctttagctcagaaattctatcttcgggagtcaccacaaaagaaaaaaatcaaaatgcagaaaatgtgtggtgcactaagatgatcacacagcattaaaatcgattttggaggctgagaagttccacaatctaccatctgcatgctggagatccaggaaaccccgtggtataattccatctgagtccaaaggccgttgtggaggctggaggtctaggatcaggggttggcaaggttggtttcattctgaggatgtttccttggtttgtagatcgccgtcttctccctctgtcttcacgtggtctttcttctgtgcatgtgtgtctggggcccaatctcctcttcttctaaggacacctggtatttgtcatatgcctcggctcctcaaactgcagcaaacaaactctatggaagagaaaaaaatgggactccagagacttgaaatcacngccacttgtcagatgcagcccccaactcagctgcaggagcttagccaaatttctagtcctctctgagcctcaatttccttatctataaaatggggctctggatacctctcttgtagagttcttgtttagattacatgtgagcacttctataaaacactgaac

SEQ ID NO: 511215 - DNA, 2234 bp, Homo sapiens
ggacgcgtgggtcgacccacgcgtccggaagttccctgtgggaggctgttttctgagggagctgagtgtttacagccactcagccctgctctgctcagctgaagcagaaaacagagaccttttgcattactttggttcaagagcaagacaggaggcgactgcatgagaccatggctgagacacctagtcctccaggcactgaggaactccagggcattctgtgggtctcatgggaagccagcacctctacctgttcctcagaagatcgtggccacctgggaagccatcagcctgggaaggcagctggtgcctgagtacttcaacttcgcccatgatgtgctggatgtgtggagtcggctggaagaggctggacaccgccccccaaatcctgccttctggtgggtcaatggcacaggagcagagatcaagtggagctttgaggagctggggaagcagtccaggaaggcagccaatgtgctggggggtgcatgcggcctgcagcctggggacagaatgatgctggtactcccacggctcccggagtggtggctggtcagtgtggcttgcatgcggacagggactgtgatgattccgggtgtgactcagctgacagagaaggacctcaagtaccggctgcaggcgtccagggccaagtccattatcaccagtgactccctagctccaagggtggatgccatcagtgccgaatgcccctccctccagaccaagctgctggtgtcagacagcagtcggccaggctggttgaacttcagggaactcctccgggaggcttctacagagcacaactgcatgaggacaaagagtcgagacccgctggccatctactttaccagcggaaccaccgggggcccccaagatggtcgagcactcccagagcagctacggactgggttttgtggccagcggaagacggtgggtggccttgaccgaatctgacatcttctggaacacgactgacactggctgggtgaaggcagcctggactctcttctctgcctggcctaatggatcttgcatttttgtgcatgagctgccccgagttgatgccaaagttatcctgaatactctctccaaattcccgataaccaccctctgctgtgtcccaaccatctttcggctgcttgtgcaggaggatctgaccaggtaccagtttcagagcctgaggcactgtctgaccggaggagaggccctcaaccgtgacgtgagggagaagtggaaacaccagaccggtgtggagctgtacgaaggctatggccagtctgaaacggttgtcatctgtgccaatccaaaaggcatggtggatgatgagggcaacgtcctgcctcctggagaagaggggaatgttgccgtccgtatcagacccactcggcccttctgtttcttcaattgctatttggacaatcctgagaagacagctgcatcagaacaaggggacttttacatcacaggggaccgagctcgcatggacaaggatggctacttttggttcatgggaagaaacgacgatgtgatcaattcttcaagctaccggatcgggcctgttgaagtggaaagtgccctggcagagcatcctgctgtcctggagtcggctgtggtcagcagcccagaccccatcaggggagaggtggtaaaggcatttatagtccttactccagcctactcctctcatgacccagaggcactaacgcgggaactccaggagcatgtgctgccaaagacggtttctggaaagatccaaaggagtaaattgcgaagtcaggagtgggggaaatgaggtgcaccccaggaaggccccgtagacctccgaagactccacaagaaactaatggatcactggtcagtccccatggggagcatcatctcttcgaccctaaagatgtcaaaggtgtgcagcttccaaacggcatccccaggatcactgggcaatgctggaaagagcaaaagaatatcattggccctgatcacatagatgctgcgccgcctagcaaatgcttggtggttcgacttctccctctgtctgggggcaggctcagcatctgcccactggtctcactaagagctttcagatttccctccataggacaggttaccatagacttggggcacttgtgggtactcattttctgccagtgggaatgtaaaggcttcatcctttgtatgtaaccatttggcaaaagtatgcaggaacataaaataaaatatcctttagctca

SEQ ID NO: 511216 - DNA, 130 bp, Homo sapiens
agaatggcttaacccgggaggcagagcttgcagtacgccgatgagaggcacggcggatcacaaagtcaggagttcgagagcagcctgggctattcaagcgcctctcggggtaccgacgctcgaagttcga

SEQ ID NO: 511217 - DNA, 1071 bp, Homo sapiens
aggagaccatgtccgggggcagcagctgcagccagaccccaagcctgggccatccccgccactcgccggcgtggtgctcggcgacggcgtgcagcatcccgccccggggactacagcacagaccccggccgtccaacgctctttcagcaaccaccccgggagggtaccaggcatcatcctctgaccgggaacattcctgatgcgcacgtgtcggaactcaccttgtgaccaaaaacaaccccccaagggaatctgcccaaccattccgggggctcaccaaggccccttttccagtgatgaagccccgcctatggaaacgccatgcccaagaagcccaccttgcgccacataagccgccagaagagcattaccgcgagcccgcgacctggttcgacacgacgtccacacgtttgtgcacacattgcgcccattgcacacccgccacccaggccaatccgttgctgcacgcacactaccccaagggggcgcccccttccagcgccccctttcccttggcggcacgggagcagtttccccaagccaaggccccatggcgcccctctcactgcgaaccgctgaactccactacccttggctccccaagaccgttatccagccgatttgcgccgctccagcagaagaaccccgaaacgcccccctatatctctcccccccatcacaacattcaagggcgcacaccccactctcccacccccatctccccatacacttccccatcagaaaaccacccataatgccacagaaatatacctcacccatcattttgaccgccccatcacaaacattcgcatatccccatgcacacacccctgccccaccaccccacaaaagggctgcgacctcggataggaaacccgccgcacgtggccccaacgacacacacgccccccctatcgacaacgcccaacacgagggacgccacagaggcggacacacgccgtggcgaccaaccgcgcgtacacgcgaaaagacggccgcctgttgaccgcatttaccccggacagcaggttggacactcccgtgccataatagtgtcgccgaggacgcccc

SEQ ID NO: 511218 - DNA, 456 bp, Homo sapiens
ttcatccagtagatatggatgggattggtgtcacccttgacatgatctacagagaacatacttcatttctattctcttaaatattttgacactctgttttctgaaaatcagattttaatttattgaaggaatcatttattgaagaattgtaaatggtcatctccttccaactgtcctaaatattcattagctctggtcgagccaggtgttaattcagtataaatgattcaacaagaaggggtctgatagtgctgtatgtacagaaagtgggttgtcctgggaaataaagtttcccatttttgcatagccaagggaatagcatgctacagtgtaaaagagcaatcttttgagttgttttttcagatattttcctctattttttatggttcttttgttatgttttttcggtttctaacatgtttttgattacatatttagcattgtttccatgtgaaa

SEQ ID NO: 511219 - DNA, 116 bp, Homo sapiens
agtttcttcactcctaagcttcatatgtgtccttccggcctcaaaatttctgctatcattactgttctttcctcctttggatcttcctttggttccccagatgccagcaacttcca

SEQ ID NO: 511220 - DNA, 107 bp, Homo sapiens
aagccgcttgttgtagacaagtagtgtaaggaccagaggctaccatcctccccgaagggatctgagtccaagatctgggttatagctggtagatgtttagagttcga

SEQ ID NO: 511221 - DNA, 656 bp, Homo sapiens
aatgggaaagctgtcttcaagctaccaagggaatttgtgaaactagaagaactagcccttatggggaggagagtataacgagccccctctgtgtccacacacacgtggcctacaaacccacttttctatgaggtttcgcactaagcttctctggaaaatgtacacggaaggaggctgcttcctgaagcgcaccggtggccaaaggaggcttgcccaacacaccggggagtcccgagcctcaccctgaggctaacctgtccaagtggctgcaccagccctaatgtggaggaagcgacacgcacggctgcatctggagagcactgctgctggagacaggccacccgagctctctgacgtcctgagacggctgcggacactggctccttccacgtctcaccaggcagacacgtctgcctaggagcccacgtgccgcaggcctggagtcagaaccccacggagtcagagcctttcttggggttcttcctggccacgagcttgtgcacccagccccatggcctcttccaggcgtgctcatgcgccacaaacccgcggccagccccaccggggtggccgctcagaccttctctgcccctccttgggaattctgtcaattcgtgggtgctttcagagtaaaatcaatgagttttctgagcaga

SEQ ID NO: 511222 - DNA, 373 bp, Homo sapiens
gcacgagcaaagtttaaaaaatttatatagattagataatgaaaatatttatgctcataaagatgaattaattgcaatgtttgataatgatttaacatttcttacttcaacatgcggtgatgtagttgaatctgaatatggttcaaagtacttgttttgtcaatcaggtatagaaaaacttcaaacttatgaaggacctttgtatgaatcaccaaatgaataaaagggaaatatctacatagatattatcaaactataaacattcaatttatgaaattcttttggtaaaggcaatgaacatgaatactggttatgacactcggaccttattctttttggaacttacattctgaacaacaattaaaaaaaatta

SEQ ID NO: 511223 - DNA, 287 bp, Homo sapiens
cctcgaccaagacggttgatggcctccagtcatgaactgtggctcatgccatgcagagctctctcctcgtcgagcaggtcgccatgccatggcgtgctataagacctccagtgcatcaacatccatcttgcagagagaacaggggcactgaagcagctatgtctgccatggtgctaggggctcccttgcagactcgccaactgtctacaatatacgtgacacagaacggtgggggaggtgggaggagccctactttttactcaccagagtccaatcagcatcttgtg

SEQ ID NO: 511224 - DNA, 152 bp, Homo sapiens
agagacagatagaatgagctggacctagctgatatggtgttgtagcactgtgaacgctctgtgtgctgtgtgttgatacgcaccgtgtgaagctctctggtcctgggtgttgatagcaccgtgtgaagcgctctggatctgggtgttgatag

SEQ ID NO: 511225 - DNA, 413 bp, Homo sapiens
caaaagttgagcagtagctgtgagttgctggcgctggaggaatttcggtggcacgtggaagcaggcgttggaaggtagggggctgaaggaaggcaagagcgggcaagggccttcttgctaagccgcttgggtctcgggaatacccggtttcttcctgtaggtgtgggacgtgcgtgcggcgagatggacactcccccgctctcggattcggagtcggaatccgatgaatcccttgtcacagacagagagttgcaggatgcgttttcccgagggcttctgaagccaggcctcaatgtcgtgctagaggggccgaagaaggcgtgaacgacgtgaatggctgaagcaatgtttggcagaattcaagcgggatctggaatgggttgaaaggctcgatgtgacactgggtccggtac

SEQ ID NO: 511226 - DNA, 281 bp, Homo sapiens
  misc_feature (41)..(41): n is a, c, g, or t
  misc_feature (65)..(65): n is a, c, g, or t
  misc_feature (85)..(85): n is a, c, g, or t
  misc_feature (114)..(114): n is a, c, g, or t
  misc_feature (117)..(117): n is a, c, g, or t
  misc_feature (137)..(137): n is a, c, g, or t
  misc_feature (166)..(166): n is a, c, g, or t
  misc_feature (185)..(185): n is a, c, g, or t
  misc_feature (194)..(194): n is a, c, g, or t
  misc_feature (223)..(223): n is a, c, g, or t
gccccatttttcttaaaatggcttccaaaaaagaatgtaancaatttgtgatctggccagttgtncttttagctcccaaaggganagttggtggtattatgagttgagtaaaanccntccaggggaacttgagggancagtttgttgccagtaatgttccttgtgngccattaaaccccctccanatgagtggnggaacatccctttttaattttttaattgnatttggaattgttgccgggtattaaaaacttgccctaaataaaatcccccaaagtata

SEQ ID NO: 511227 - DNA, 128 bp, Homo sapiens
  misc_feature (85)..(85): n is a, c, g, or t
  misc_feature (90)..(90): n is a, c, g, or t
gagggcatcccgttggggatccttccgcacactgaagagtacgtcttcgggtctacccctaatcacataatgaaaagtcccctcnctganggctgtttcggatatgaccaaagagtttcgaatttttt

SEQ ID NO: 511228 - DNA, 86 bp, Homo sapiens
gaagaagatggggaaatgagagaatagcatctttgtgggggatttttttatatatatttctagacaataaagattgtatgtttttc

SEQ ID NO: 511229 - DNA, 320 bp, Homo sapiens
tgcctctactggacaggccctttgatgagactacctatgaagagacagaagactgagcctttctggtgctcctagagggggataattcctcccaggacagtgtgtggcctttctgagccaattccaggaaccacacttcagtgaccacttcatgtgaaagacatttctgaagctactgaaggtggccaccttcactccaaatggcattttgtaaatagtaaaaaaaccaaactgcttcacattcttcctctgtttgctaagtctcacacacacacacacacatatgattactttgtccattaaaaatgttttattttata

SEQ ID NO: 511230 - DNA, 126 bp, Homo sapiens
  misc_feature (54)..(54): n is a, c, g, or t
ggtgatctagaggatcccggccggtatgaaatactatctacctaatctctaggntctggcatagacttataacattcatcacacactatgtatttattgagctggcaagttagatggtgatatcta

SEQ ID NO: 511231 - DNA, 325 bp, Homo sapiens
acatacaaaaaaaggcctctgattgtctggatactgacctcctcggcatctctccccttcccctctgcttgcgtttgcctgtgctggcctgttcctttttcgctcctgctcatccccctgtgctgcctgtgtgctctgcctgcgtctgctacttctcctccggcctctgctcttcttccctccgcggtttggcctccctgtcctcttgctattgtctcccctccccctccccacccctcctctataatcatcaccctagtttattttcttcatagcacttaatcactatctcatactacattatttatttgtttacttatcatct

SEQ ID NO: 511232 - DNA, 1020 bp, Homo sapiens
  misc_feature (967)..(967): n is a, c, g, or t
  misc_feature (989)..(989): n is a, c, g, or t
  misc_feature (996)..(996): n is a, c, g, or t
  misc_feature (998)..(998): n is a, c, g, or t
  misc_feature (1000)..(1000): n is a, c, g, or t
tgtacgcactcgaaatatgtcccactcatgagtcttaaacacactcctcggcaagtgggcagcggtaagattcacctccagaagttcccttggtttggtcaaactcgcttatttgagtgcgtaatagggaaacacggcttgtttgggccactgcttagggccaagttcgcgagctcgataatgtcctgccatcttaaaggggaacattgtagcgccgtaccgtgtagttacctgtgccaagatcttttttttcacactgtccaattgacgaataatgtatcttcggacggaaatccctttgggattaaagttgtggttacaaactgttcggttaacgtgaaagcctgttgattccttgcagaactcaaatcgtgtgggtcctcggtatccaagtccaggtatcacacttgcctagtgcgaagccatagcttagatcttgtctgggtaaagctgtctttgtggaagttaataacaagtacttgaggcatagacttgcggtatagttccagttgcaaacccactggttaaccatgtgcttatcccatgggaagcagttggttaccgattcttattctataagaaacagttgagaggctatctcatggattagtcttctgaatgaaggtaatatttgtttgtttatccttttttttttttttttttctttttttttttttttaggcatagaagccagttcagggtccataatatttagtgaccaacattttaaagtatagcagcaacctggttcttaaacacaaagtaagttgcccattaacaaatggcttttatctttagcatgaaaactttccacaggtctaaaaattgcttccattttataatttgaggtgttgcatgggaattctaagctgatccatcatgatgtaaaagttcacaatatggttcaaatgtaacagtgcagaattgaatatggaggcatgcataaccttcctcttagaaaatggcnggtgttgtaatttccaattttngtgcatnanantaaatcataatgccaccgta

SEQ ID NO: 511233 - DNA, 861 bp, Homo sapiens
  misc_feature (446)..(446): n is a, c, g, or t
  misc_feature (453)..(453): n is a, c, g, or t
  misc_feature (464)..(464): n is a, c, g, or t
  misc_feature (474)..(474): n is a, c, g, or t
  misc_feature (487)..(487): n is a, c, g, or t
  misc_feature (490)..(490): n is a, c, g, or t
  misc_feature (808)..(808): n is a, c, g, or t
  misc_feature (830)..(830): n is a, c, g, or t
  misc_feature (837)..(837): n is a, c, g, or t
  misc_feature (839)..(839): n is a, c, g, or t
  misc_feature (841)..(841): n is a, c, g, or t
ctgctggccaaatcttttgttccgtattgaccgggtcgtctgccatctataggcagattgggatccaagaatcccccatttagggacctttagacccgacacttggagttaccgccagattttttttcaacgtcaatgtgaaaaatgttttgtggagaacccgtgggataaaattttgggtacagagtggttcgtgtaagctggaacccgtgtgtttccggccacagctcacaatctgctgtggagcgttggggacccaagatccaggtatacacactccctagttgtgaacccacacattatattttcttgtaaaaggcttttgaattataaaatattagcataattgggtatagtcagttgaacccccgggtgacccctgttcttatcccctgggaacccttgggttacacgagtcttattttatacagagcccctgagaggcnctatggnttagtcttctnaagtgaaggnaatatagatgtcnccnaagtgatagttaacccttttttttttttttaggcatagaagccagttcagggtccataatatttagtgaccaacattttaaagtatagcagcaacctggttcttaaacacaaagtaagttgcccattaacaaatggcttttatctttagcatgaaaactttccacaggtctaaaaattgcttccattttataatttgaggtgttgcatgggaattctaagctgatccatcatgatgtaaaagttcacaatatggttcaaatgtaacagtgcagaattgaatatggaggcatgcataaccttcctcttagaaaatggcnggtgttgtaatttccaattttngtgcatnanantaaatcataatgccaccgta

SEQ ID NO: 511234 - DNA, 623 bp, Homo sapiens
aagttctgattctggattaccacttcccataccacggctggaatattgaaatctcccacgagctcatatttcactctccctcgagtgtcacgcccacgtgaggagaaaatccacgtgtaccacctctcttaaaaggagattgtccacgtgataaaagttctccgattatccaaacatttgtatagcccgccttttaaacccagttgctgttgacgccagaaagaggagttaagagccgccatttgtggctacctgtgaaaaaggacttatgaataatgatcacccaaaactcaccagaacgccacaccagacctggagctgtccaccccttgacttaaagaagagagaaactcgccgcgccggacgccaatatccaaatttccacccatagcccagattttatgaagaaatggaccttggaaagggaattcttacaccagagaagagcgttaatatccgggagaaattttaggaagatgtcttgttaacccctgatgtctagagattgggggctggtgaagggggtttggcttccatgaactggataatgatatctttcactgagagagattataagaagaagggccgataaatatatgaataagttccgccccaaggatcca

SEQ ID NO: 511235 - DNA, 609 bp, Homo sapiens
  misc_feature (252)..(252): n is a, c, g, or t
  misc_feature (286)..(286): n is a, c, g, or t
  misc_feature (302)..(302): n is a, c, g, or t
  misc_feature (324)..(324): n is a, c, g, or t
  misc_feature (348)..(348): n is a, c, g, or t
  misc_feature (397)..(397): n is a, c, g, or t
  misc_feature (441)..(441): n is a, c, g, or t
  misc_feature (469)..(469): n is a, c, g, or t
cggctaacggaactttcgtgacacatgattaaaaagtcatggaacattcaaaaacgtaaacagaaacatcaggacataggcatgagatgtgccacacaacagttcaacacatgccacctattgtttaagagagtacctgagaacacctgctctgtggaactagtcgtgtaaatactagattaaaaacggcacttaagtatcaagcaatcatgtactcatctatgttccacccgtgtttactttgactaaagncagtgttattactgtgacaatgacttatgggccnatttctaagaatacanagcttccccatgtaaaatgtgntgatgaaacaaggtacatctaaanactgcagaaaggaattcccagaatgattctaagtgattctccacaccgnatccctgtggtcacatttaagcgagattaacttctcgtcatganacgccttcttgtggacaacagatcacanctattttgatgtagaaattgttttcaaactagggaccctacctgacatttacatggattaaaagaagaaacaggttgctataattactaaccctaaactcctctgatttgaaagtccgttgaagccgtcgggtaccgagc

SEQ ID NO: 511236 - DNA, 626 bp, Homo sapiens
  misc_feature (211)..(211): n is a, c, g, or t
  misc_feature (218)..(218): n is a, c, g, or t
  misc_feature (229)..(229): n is a, c, g, or t
  misc_feature (239)..(239): n is a, c, g, or t
  misc_feature (252)..(252): n is a, c, g, or t
  misc_feature (255)..(255): n is a, c, g, or t
  misc_feature (573)..(573): n is a, c, g, or t
  misc_feature (595)..(595): n is a, c, g, or t
  misc_feature (602)..(602): n is a, c, g, or t
  misc_feature (604)..(604): n is a, c, g, or t
  misc_feature (606)..(606): n is a, c, g, or t
aactcaatttttgtgagctttggtcccagtccccgggtttaactttcctttttgaaacccatactttttttttcttgtaaagggcttttgatttattaaaaatttagcacattgtgttgtagtcatttattccccccgtttgccctgttttttttcctcggggggcagttggttgccccttttttttttttttattaacagctgttaggcnctatggnttagtcttctnaagtgaaggnaatatagatgtcnccnaagtgatagttaacccttttttttttttttaggcatagaagccagttcagggtccataatatttagtgaccaacattttaaagtatagcagcaacctggttcttaaacacaaagtaagttgcccattaacaaatggcttttatctttagcatgaaaactttccacaggtctaaaaattgcttccattttataatttgaggtgttgcatgggaattctaagctgatccatcatgatgtaaaagttcacaatatggttcaaatgtaacagtgcagaattgaatatggaggcatgcataaccttcctcttagaaaatggcnggtgttgtaatttccaattttngtgcatnanantaaatcataatgccaccgta

SEQ ID NO: 511237 - DNA, 402 bp, Homo sapiens
  misc_feature (326)..(326): n is a, c, g, or t
aaatatcaatatagaggtttctcaaaagattaaacatagaactaccatacaatgcagcaatcccatttctggatatataaaaagttgaaatctggaactcaaagagatatctgcactcccatgtccattgcagcattattcacaaaagctaagatacagaaacgacacagacatccatcaacagatgaatgcagaaagaaactgtagtagatgtagtcatacaatggaatagtatccagccttgaaaaagaggggaatcctgttacgtaagacacatagataagacttgaggacattatgctaaatgcataaatcagtcacaaagngacaaatgctgcatgattccacttcaataaggactctaacgtcatcaaactcaaagaaaacagaagtagaagggta

SEQ ID NO: 511238 - DNA, 597 bp, Homo sapiens
agagcggggacgccgagcctcccccgcaacctcccccgccgcgccgcgacgccgcgccgggagagcctggccccggtccccgcggcccgcgctacctgccgccgctgcccgcgtcccccgagacccccgagcgcgccgcggggccaagcgagccgctaggggaggtggccccgcggtgcaggggagcggacgagctgccgccttccgccccttgcccccttgcagcccggccggccaggaatgtggcgggcgggccggggactccggggaaggtccgagggcgccttcccggaggcggcagcagcgaagggcgggccccgggggagtctgagggccgggcgcggtgcggcagagcgcagaagcggagggaggcggccggaaaaccagcccgagacgcgctcggttgttgcagcagccgcagaaggcaaggcagttggcggggacggagaccaagcggcggctggggcacccagcacccagaaccaaccagcccattctggcaagatctggctccaagggccgcggagcagggataggttggggacccccttgccgatgtgatgggccagatcggtatacccttcggtttgtcctgta

SEQ ID NO: 511239 - DNA, 460 bp, Homo sapiens
ggccccagctgatactattaacctcgttgggtctcaggcatgctagcctgttcatctgtaattcacacaggcataaaaatgagttcagaatctatttcactaattatttagctgggatttggatttccctgacatgcttaatacaattacaatacctgtgtacaaacagaggcctgaggaaagaggcaaaatttgcttttcatccaaacagcaacaaaaggcagttgaaaccttcaagcctgttggttgcttttaaacctttgtgttattatgatatatattctttgttgagcactgaggtcctgagggatacatatctcttgctgttttctgcctacttttgactagctgtatgtaacaaaggctctacttttgctctgtcactgttcctacagtcctgttctttactagctagattagcctattttgcacctattaaattctaaaaaccttgtttaaa

SEQ ID NO: 511240 - DNA, 1572 bp, Homo sapiens
  misc_feature (990)..(990): n is a, c, g, or t
gcaagaaaccacaagaccccgagagtctgctgcataacttgttcctgatagacttggctctactccttgggtgcatattgggttcacaccctcatgagaattctataagtgccatttacagctaccaatctcataagagagagaggttgacatgaaagcagcgcgtcgatgaatctgaaggcactactcctcacgtaagccatggcatgtgagccccgagacatctcctagcactgatgcttctatatatgtgatgctgtcttcatactcgtcagttgacttaggggactgacaaggccttccttaattttgtcgctcaaaaacatggtgccgattcgcagatagtacggacatatggcatcgataagggccagcgaggcaatcgcatcttcgtctcgagacatttcagttaccatcttcgttcccgtgggtatcggcgagcggacgcgagaggctagtcactagggggacccctccccgagaaagtcccgcagggactagtcgccactgtcatcagacggagaccggcacgcaatgtttaaatttctcctgaacgttatcgttccacccagttggaagaactttgtaacttagtgggatttccccaaagtggcccagatgtttacagtggacaaccaaactgagcggcatcacatccatacacacaattgacctcttccttctaaaagtgttcattacacaaacagattaccagaagattgtccttttgggggggtcaccttgtccgaatagcaataggccccattaaatttgaaggagagaacaggaaccgttcgcgaaaatcgtatgaggaattcccaccacagagttgagttaccttgggcgacgctgataataaggataccttctcccctttggaatacgttaactttacgttgtggaggcacaacattttcctctaggtagtaggctatcattggggtggggaacttggggtacccaaaaacggtaagggtttacacggtgcgnccgctgggacgtatggaaccacataggataggcaatgacagaacggctatagaaaagtaacctacggagggggatatacaacggaaaatctgtttgcccccattgtaatgattggtgcttcagttaacacacaacacgctctaaagtaggtcactttccacagggtgcaaccgaactgcatacacccagaagaggacatctgacagacgaccatgtgtactccaacaacagtggtagcacataaaacaaagtggtataccccgcgttctcaccagtcagctaaaacatttccacgtgtgtgtcttccagccacacagggtataagttgagactcacgcgaggggcaaacatcaccgtaaagtggaaagtatgcgttggaacacatcctcccaacagcgtacatgaacccctaggtgttgcaagcaatggcttggatagtctcacgacacatggtgtgaccccccgcagatgtcccaccccatattgggaaagttggttactacacgcataaattggagaccctgcgggaaataacacaccacccgatgtcaataatacacccgcgcatatttagtaactccg

SEQ ID NO: 511241 - DNA, 419 bp, Homo sapiens
catagtagggtacatggattggctgtgtccccatccaaatctcactttgaattgtaatcatccccacgtgtaaaggatggggctagggggagctaactgaatcatgggggcagttgcccccatactgttctgtggtagcaaataagtctcacgagatctgatggttttatcaatgggagttctcctgcagaagctctcttgcctgccactatgtaagatgtgactttgctcctcattctcctttcactgtgattgtgaggcctcccaaagtgctgggatacaggcacaagccactgtgcctggccaaaattaatttttgagcccagcacagtggcccacacctgtagtcccagttactcaggaggctgaggcgggaggattgcttgagcccaggagtttgagtttgtggcatacgatga

SEQ ID NO: 511242 - DNA, 394 bp, Homo sapiens
cgcggccgcgcgactacggctgcgagaagacgacgagggtacggtaggagactcaccgcggtacgcacctcccacttccccaagatggttttagctgctgggggtggtggtggctcacatctgtaaccccagcactttgggaggctgaggcaggtagattgcttgagcccaggagttcgagagcagcctggccaacatagtgagaccccgtctctacaaaaaatacaacaaaaacaataaaaattagcctggcatggtggcaaacacctgtagtcccagcttcttgggaggctgaggtgggagaattgcttgagcccgggaggtcaaggctgcagtgagccgagatgcgccactacattctagcctgggtgacagagtgagaccctgcctcagg

SEQ ID NO: 511243 - DNA, 487 bp, Homo sapiens
  misc_feature (9)..(9): n is a, c, g, or t
  misc_feature (15)..(15): n is a, c, g, or t
  misc_feature (61)..(61): n is a, c, g, or t
  misc_feature (65)..(65): n is a, c, g, or t
  misc_feature (85)..(86): n is a, c, g, or t
  misc_feature (88)..(88): n is a, c, g, or t
  misc_feature (90)..(90): n is a, c, g, or t
  misc_feature (109)..(109): n is a, c, g, or t
  misc_feature (112)..(113): n is a, c, g, or t
  misc_feature (121)..(121): n is a, c, g, or t
  misc_feature (153)..(153): n is a, c, g, or t
  misc_feature (159)..(159): n is a, c, g, or t
  misc_feature (174)..(175): n is a, c, g, or t
  misc_feature (178)..(178): n is a, c, g, or t
  misc_feature (180)..(180): n is a, c, g, or t
  misc_feature (195)..(195): n is a, c, g, or t
  misc_feature (206)..(206): n is a, c, g, or t
  misc_feature (209)..(209): n is a, c, g, or t
  misc_feature (227)..(227): n is a, c, g, or t
  misc_feature (232)..(232): n is a, c, g, or t
  misc_feature (272)..(272): n is a, c, g, or t
  misc_feature (280)..(280): n is a, c, g, or t
  misc_feature (327)..(327): n is a, c, g, or t
ggtttcctnttttcntcctacatagaagtgaggacatgaaatatttgtcattctgtgctgncttntttcatttaatatacagacnngnantctcatccattttgtctgnagnngagaggantttcttcctttttaggctgaataatacttcantgggtntgtataccacagttnnttnantgaaacaaatttctnaagagcaaatnttnttaaaatgtctcggaatntgaancttcagggatactgtgcccattttattcttttctatttcncatcttangtatatgcaagtgtataacaaagcagcaatcaatgtgtgtataaatntataacttcaacaaatgtaaaatgtaaatgctaagtggtggctgggcgcggtcgctcacacatgtaatcccagcaatttgggaggcggaagcgggcggatcacctgaggtcggaagttcaaggccagcctgaccaaaacggagaaacactgtctcatact

SEQ ID NO: 511244 - DNA, 894 bp, Homo sapiens
cgccatgtccgccgttcctgctgcggcggggcctggcagctgctgtgccggcgctccgaggccccccgtggcaccctccaggtcaggccaagccgcacgaggggctccggtgacaaccggccccggaagacgacacgccaatccaggccccagaaactgcgcgaactcgcgccaaggcgaaaggtgcccaacgtcggcaactggaccgagctaccgcgaagccgacgagctgctcgagaccacactcagagctaacaccctgcaccgctccccctggaccaagggcaccgccagcaagccaaccgcacggcctgcagctcctgccgcagccgaacgccagcactccctgggcgcaccacgcacaccgcggcgcccgccacagccaccatcgtggacaccgagcccctggaatgcggccccaaggcacccaaaggcaccggaacacgcaaaagggctccgacccggccacccggcggccaccaaccccgcaaccggccaaggacgctgacccaaggaaacgccatatacccacggcgcaagccgcacagacttaccgctaatcggcgcacaagaccataagcgcgcaacaccccctatggacgccaccggcgccacacccgaggataggacaacgccaagggggcgcccaaactcacacaagcgccccgcgactggacgacggcgcacccgtcccagcgtaaaagccaccacgatggcaccagagaagcaaccacaccacacgagcgaaacgagcgcggggcacaccggaccgcccacctggtgagagactcgggcacaccaaaaggggcaaacgtaaaatatggcgcgcacgagaacagcaggaggcaagtgcaggcacaccccgacaggccccccaatgatggcaacagaatc

SEQ ID NO: 511245 - DNA, 309 bp, Homo sapiens
gaacacattttgatagaatcagagtagaggacattggtgtcttctaaaaagacacgatatggaaaatgacaatccctttcgtctccttcctccgcgtggttcaactaaagcagactcctgactccgcctttgtttcatagtggaggattttattttgcacgggggcctccctcttaatatctaacctaggattattttatccttggcgctcacttcttaacatattcctgtgtctttgtaatggggcaatttttcctttcactcgttcgcacggtacgtcctcctgggggtcattttattccctaccgg

SEQ ID NO: 511246 - DNA, 408 bp, Homo sapiens
ccaggccgagaaaacgcataaggtggaatatcatgagggtgcaacacgcagccctgcatccttaaggcatactgggcctaacataagcatgggcgcatgtgagtggaaagtgcataaaacacagccaacgctccactattctacgcaggagcaggcctcctagtgttaacacatgtgcactggagtctacctaccctcacaggcctggatgttactatagctctgttttctcagtatgcttcctcttcaaatcctctgtaaccacagatggctgctgccaaaaacctggatgacaatcacagagatgacccagtgcagcgccatctttatgactgaaccagttgaggtacctcctgggtagtatttacatgatgcaaaacacgctcaagcatcgccaatactgaagct

SEQ ID NO: 511247 - DNA, 1283 bp, Homo sapiens
gaaggtttcagcctctccccactccccttgccccagcagcctttactccccagtccagagagatgctgcttttaccaggaaagactattgaaagatgttgttattttatgtttctctgacctttccatccttgaacaaacatggggaaataacgaagaagaaaagacataaattcgaccatagagatgagcctaaagattatgatgagaaagaacagatcagagaactgctcccacagcttagtcttccctcgagaacgatatacgtggttttatcccgccatccccttggcatgttgagcgtcatgtggtattctcggacagttactttacttcttgtgtatgcagcacagtgttggcgctttacttgcgtcggatgctggcgcactctctagatacttcccgccacattctagcccatggtcttcaccctccgcgctgggatttccagatccctgatagacccctcgcctatcctttcgtcctgggttgtgtcgccttgggcttgcgtaagcatggtccataggcatatcttcatatatacctccgtggggacccgtgttttggcattgtttaccaatgtgtgccccttcacaactccccgtgggcaagggccaccacgcacgacacgtctctggagaaagttggtctctcgaataatttctagaaagcccccgttgtccccacaaagaaaattatttccccctgtgcctgtgcttgagccaatctcgtgagtctcgtggatgtcgcctgtgtaatcagtttccgccagtcgtgtggctattccgttgtcgtcacccccgtcgttgcctgtcgcccccacctgttgacttgtgtcttgtcttcccctttccggcacatctactattgcctcttattgcctagtcgttgtgtggacgcctttacagacggcccccatagtgtgtgtcccccgcgggtcttctcctgttgtcctcttgtgttgaactcaacccccccttttctcacatatcctctaattaagccgccactgtttgtgagtgaatacaccccacccaaataagggggggtcccccaacaagtagtagtggtggtcttactccacaaccaacagtgtgtgctttgtgcggaaaagaaacacaccaaaccgacataggttttggggcgccacccttgcgacaattttcccgttgggggaaaacaaccaaccacatctgcttttgtgtgttccctctctcacaagtgttgtttattaaacccccaaatagtcgattctccccgtttcacaaccaaccccctgctcat

SEQ ID NO: 511248 - DNA, 437 bp, Homo sapiens
aggacagagaaggcagaaagaaagagagaggggtaacagatgagaagcaaagcagaagggagaagcgcacaaacaaagcaaaaggaaagagaaagaggaggacaagagacagcgagagaaagagcgagagaaacaagacaagaaggagaagaggagaaaagaggaacagagagacaaaggggcggaagagagacaaaagaggaagaataaaagaaggaaatcagagagaaagcgaaaatatagggaggagagaaagagcagggagataaaaataggagaggagagagagaaggaggaaggaagagatacaggtatgagagaagggtgtctgtatgatctctctatgactactcactctctctctgtctctctctctctatctctctctctatctctctatctctctctctctatctctctctactactctctctcta

SEQ ID NO: 511249 - DNA, 579 bp, Homo sapiens
ttgcatagatattaccgaagaggatacatagatggcattagcacacaaaaagatactcaacatcattagccattggaaatgcaaattaaaaccacatgtggtatcattacacacatctatgtgaatggttaagataaaaaatagtagtaataccaaatgctggtgaggatgtgaagaaactggatcaatcatacattgctgtctgaattgtatgagtggctgtatgtaaaaagtagagccactctggaaaaagagtagggtagtttcttacaaaaatatatgtgtttaccatacaacccaacagttgcccttttgagcatttatcccagaagatgaaaatgtatgttcacataaaaacctgtacatgaatgttcacagcagctttattagggcaaaaaactgaaaacaactcttatgtcctttagtgggtgaatggttaagcaaactgtggtacatccataccatggaatactactcagcaatcaaaaggaactgcccccacttcaccacgatacaatatatgcatgtaagaaatctgtacttatacccccattccccccccggtaatatctatgctgc

SEQ ID NO: 511250 - DNA, 353 bp, Homo sapiens
cgatggtagtaagacgtatacgcccagatggtctgaagtaactgaagaatcacaaaagaagtgaaaaggccctgcccaagcttaactgatgacattccaccatcgtgatttgttcctgcccaaccttaactaagtgattaaccctgtgaatttccttctcctggctcagaagctcccccactgagcaccttgtgaccccccagccaaatcctataaaacagccccaccctaggtcccttcgctgactctcttttcggactcagcccacctgcacccaggtgaaataaacagccttgttgctcacacaaagcctgtttggtggtctcttcacatggacgcgccatcgtgcgctt

SEQ ID NO: 511251 - DNA, 205 bp, Homo sapiens
ttctcgtactgtcatggtctggagtcagtaacgggaagttcacccccaagtcttaattaatcaaaatgctgaactctgttcaatcttcatgttaacagcagctttaaagctgggtgatttcttagtccaatgtataacgaagcttttacttatcaatttctttttgggagggagaatgggctgaagtgtgttctggtcgttgtct

SEQ ID NO: 511252 - DNA, 551 bp, Homo sapiens
cggtccgaatacattccagcgtacgtggaggctgggggctcagtgcctggttatcagcagtttgggagtgcgaggcgagctagatcacaaggtcaggagatcaagaccattctggctagcacagtgaaagcctctgtctctactaaaaatacaaaaatattagccaggtgtggtgggatgcacatgtaatcccagctagtcagaaggctgaggaaggagaatcgcttgaacccgggaggcagaggttgcagtgagccaaaattgtgccactgcactcccgcctgggcgacagagcaagactgtctctgaaaaaaaaaaaaaaaaaaaggaccggtggaagagaaattaagggggtcaaacttgtttcttatcagagttatagaagagaaaggtgttagaacattattggaggaattatccctgagatttccaggattatggagggatttaacagaatcgggaagccaaaggattctgaggtgggaaaattcaaaagaattctgcttttagacacttattaaattcctagagctttagggacaaggagatta

SEQ ID NO: 511253 - DNA, 128 bp, Homo sapiens
ggtcactctagagagatcccctccatattgtgtgccagctattatttatgtatatattagtagagacggggtttcaccactgttggtcagactggcctcaatactccaaacctcaggtgatccacctg

SEQ ID NO: 511254 - DNA, 151 bp, Homo sapiens
aggcccgctcctggacttccatctgtcatcaggagaacatgaccatctggcgtcagtacagatcatcaatccttccacatatccagttcattttaaatttttaaaaatattatacaactgagacgtcttcattaaattgttctggtggtac

SEQ ID NO: 511255 - DNA, 891 bp, Homo sapiens
ggaccgacgagtagtaggatctgacagcaagtgtcgtagaatgggtttagtatgagtacaagcgtctttatgaactcttgtgatagatgcccctttgttcaacgcgcattgtgtatttccgtgtatctcaattgtggcaatcttggtaccctggtttcaacgcggcaaccccgtgatattccgtgacttgcctttggaagccgcaaacaggcaatgttacggggcgagtcgcacaccgtcgtgggtctgtactcccacctgctggggattatttggcccccgctaatggggccatttattcctccatgggtcagcagctccccaacgggtaaagagtccgtgtcccccccaatggctatgtctagaagctcgtacgtgggagggcactacttcgcccccacagccgcacttttgttatgaagatgggggcgcaataccaaatactagtgcaaattgccgccacgcagttctgttatgtagcccgccacgaataatttgtgtggagaggagacgaaaaatgcaacatttgggcgcgccccctgttgttctccccacagttcaaaggaacgcgtggtgtttaagagccccccccgctaagagcagcacggttatctgcaattaggacaagccccctcatattagtgatgtgacattgtcccgcgacttggcccccccgtatataggttattggcttctcaaccaaaaccagtgtacttccgcatatgaaaagaggcagcaattttaaatgtggagactcacagatttacagtgcaaggcttggggaaaagcccataggttagaataagtcgctctttcaacccacggccccgcgtttttcccagtggcctaaacaaaggggcgccaaccaaaaatttttcaaacaaaaataac

SEQ ID NO: 511256 - DNA, 214 bp, Homo sapiens
aaggcatcattagcttctgtggttagcaagagtcaggctccctttcaccctccccaatcttctctgcagggtgagccatctcagtcatcattcattcattcattcctactgcaagagctgcacgcagccacagacacaaggcagtccaggcctcagctcaggagggacatgtggagacagagagagctactgctagggttgatcagcataccag

SEQ ID NO: 511257 - DNA, 1661 bp, Homo sapiens
  misc_feature (756)..(756): n is a, c, g, or t
  misc_feature (1319)..(1319): n is a, c, g, or t
tggtgaaaaaaaaaaatttaattaggcacaaaggggaaggggtaggcagttacaaaagggtctagggggtcttctcctctcccaagcgctgtggaaagtatagtataccccgagggaaaaggaagggcaaaggaagcgtgtgtgtgtttttcttctgtgcctttctctccctttcagaggcgtgtgcattacaatatgtggccccatctccagcgcggaattaacctctctctccatgttgagaggaagagtgggttctctctcgagagatgagagtggcgctgtgtcctagcgggaggtgtggacccatatcactctcagcgagaggggtctccccccgagcgctgcggcctatgagggaagagtggccccactgtggcgcgtgtggcccacaaacaagtggtgttgtctcacacacctgttactctcgctgtgtgagagagagcgcgtgtgcctactacgccacgacggtgtggggtgtggtcaccacacacagagaacctcctgatgtgtgtgcgcagcccccacagaatctctcgcgagagccacaagagtgtgggcacgagcgtgtctctagtgctctccaccactttatctctcccgccctctgtgtggacacacgcccgagagagtgtgtgtgccaagcctgtgtgtctctcacacactctgtgacacactctctcagagagagcggcaaacgcccacacacagtgtgcgccgagagtgtcgtgtgacagttgactagtgaccaccccnccagagctgtgtgtgcggcctctccgcgctggtggggtctccgtcgggcatcaccaatatctgtagtgagcgccacaccatactctgctacacccacaggggcacaacacacaagggggcggagagacacttcaccacaattttgtagacaggtcgttgtcgcccaccagtgtagaagaaaatttcatcacacatttctcaacagaagaaaatctctccgggtgtggagaacaatgttctctcctccttccacccagaggggcgtctcttgtggggcgtttctggggcgccccgctctctctgtctacaacaaggtcgtggtggacaacgacgcgccttcagttgtggacctattaagcacccacaaccgccgacgagaaaaagatgccgcctgttgaacaaacatgaggtgttgtagaaaccaggttctgtctacgacaatttccacccacacacagcggtgggcacacaaaaacattatttatcccccaattaatgctggcggcagcatcaagaagaagcgcccctaaacgagaaagcccccgtagtcttatggcgacgancacaccaacaacttccgcagatcctactcatcacaagagaaggcgggtgttccacccgacgcttcatgcggaagcacgtgggaaggtgagcagaacaacaagcggcgcagcaagtgtgtggatctaccaccaataacaacactcattgtgaacgcatactgtgagggacccccccccccaccaacccccggaaaagattgggcgcacagacggggtccaccaactaacacacaccacccacgcagacagagaagcgtctcaccactgtacgccgcacaaaaaaagagtgactgccacctcacccggctgggtgccccaggaggcacccaatgtgccccaggg

SEQ ID NO: 511258 - DNA, 529 bp, Homo sapiens
cagtgggttcgagatcctaattcttgtctttgatttccttttttgtcttcccttttcaaacaagcacatcctgtaggcttttttttggggaatagcctccaagaacagaattcccagttgaagttataacaaagaaacatgagacccagtgcctgagcccaaagtgtgggtgctgctccgagggactgcagggaacatagctctactgtcttcttatctcaagagagagcagtgtgcaggaggagactagaacgtgggacctggaaggaaactggtgcagcctcacatggactcacagaagcaggaactcttggctcccaagtgaacaagactttttcagtccacccaaaggctcaaggctagctgaaaattcatgacacgacaattctcctacattctcatttttctctgttaaaatataactcctctgaacacaagccattccaaagcttgagttcacagctctgatacttaaacaccaattctgacttcataagaggggtagaaaaatacaaagccattttggggg

SEQ ID NO: 511259 - DNA, 342 bp, Homo sapiens
cacgaggatggatgcgcatccggtgaacgacttattgccacggtcggcgcgcgcccggaccatgcgcacaactcatcttcccgggtccgcatcatgatcacgctgcgccagctctaccgctaccccgtcaaaggtctgtccgccgaaccgctggtgcgcgtcgaactgcgcgccggcgaaggcatgccgctggaccgcctgtacgcgctcaccaacggcagctgggacttcgatgccggcagctaccagccacgcccgaagaccgacttcatcgcactgatggaccacccggcactggccgcgctgaccacccatctcgacgacgacgcgcgccgcctcacc

SEQ ID NO: 511260 - DNA, 1029 bp, Homo sapiens
gccgagctggaggagctgggtgtggggtgcgttgcggctgtgtggcggatgtgcctagtttgggtgcaagatagttgtctgattgagcttgtgttgtgctgagagggacagcccctgggtctagtggtagagagtacctgagctgtgatgagcccagtcgttccaccgaggtccccagacgcgctcacgaagtatcctccgcctccatggtgacggggtcactatccctgtgatcaccgcagacagtcgaatagacactgaggtgacagttaatcaagcgcaagtgtcggaaagttgtcctgggaacggctggcagcttgtggggacacatagtttggggaacgtggcacccagtgaatcctcatggagacgtcgtccaagtgtgtgactagtggctcagagggagaagtcaagccttgtccacatcgttacctagccagtgttgaccactcgagagaacggcttgagaacgagaataacgaagcttgcgatgagagcatagtgcgctcaatgtggaaggtgcgatgggttctcacatgtttcccttgctctggagtcattggggacggagcctgggataggatgtcgacacagaccatggcacttacccaaagaccaaaggaaattgggggagtaaaattttctttgtgcagaggccagtgtggcattgatctgctcgcctctcgcaggggatatctccccaaaagcattggcaagccatcagtgtcaatgcgctggaagggtccgaaaccaaaccaaggggatgagagactttgggcgacccaacataatttgtaggaccgaaagcgacgatattaatcgttggcacttaaccaaatcgggaaggaagtttcctaaaagaacgcaaaaggcaactgtcaagaattgaaacgaaacttccgttgtgaaggaacagggggaagcatcccgttgataaaaaggcacctcctgagagaaggggtattcccaagggacagcaggatttaactttgaaacatgtccccactcactttacccaggagacagaag

SEQ ID NO: 511261 - DNA, 336 bp, Homo sapiens
  misc_feature (64)..(64): n is a, c, g, or t
tgctgattaatggagcacttgtgacccgtcccaccttctgctggtagagaggtaagatcacctnaattatcatctctctagtgtgctcacattggctcagcagtcccagcacgatcacaggtcaccctctcttcttgcactgtcccccaacttgctgtcaattccgagatctaatctccccctacgctctgccaggaattctttcagacctcactagcacaagcccggttgctccttgtcaggagaatttgtagatcattctcacttcaaattcctggggctgatacttctctcatcttgcaccccaacctctgtaaatagatttaccgcatttac

SEQ ID NO: 511262 - DNA, 283 bp, Homo sapiens
atcgctctataggatcccaactgcatccgcactgataggaagagccgacatgaaggatcacaaaagcgacgtctcgagtaacgcatgacagcacaaccgagtatatccctagtggtaccttttctgacacctcctgcttaacacccaaaaggtcagaaggatcgtgatgccccagcgttcacggtctgtattcgtactgaaaagtcacgatcgagcgagcttctgcccttctgctccacgggaggaatagcgtgttcatccgcgagctcgccttagagacatc

SEQ ID NO: 511263 - DNA, 509 bp, Homo sapiens
  misc_feature (184)..(184): n is a, c, g, or t
  misc_feature (208)..(209): n is a, c, g, or t
ggcccagtcatcgaatgtgacatcgtgaagattatgcctttgtacacatggagcgggcagaggatgcggtggaggcccatcaggggcctcgacaacacagagtttcaaggtgggatgtgtgtgggctgaaatccccaagctgcggttgtgcatgagaaataccacccttcgtggtgccccatcntccggggacgttctcggctctgtnnattcagtccccaggaaccgtggaccttaatttaccttgttaagttctttctctttcctattctctctcctgctcaatttcctgttctcctgtttgctcttctgtagcttcccctttgagttctgctctcccagcatgcctcctatgcagaaaccggtggggctgtgctgtctcctcccttcctcctgactgcagtcagtgggtattggatttgggagtgaccttgttgagaatcactgctcctagttttcttattttggcccaaagactagacttagaaatttggagcaccttcccagtg

SEQ ID NO: 511264 - DNA, 457 bp, Homo sapiens
aataagtccctactcgcggatgaagaggcctccgaaagggaacgagattctggagtaaatatcacagccaaaggaattcctgtccacggcttcaaaataggtgatagagtggagtttttatctcgttaggcttatggtcagtgatgctcggaagctgggctggcatgattgccaactcagatctcggtgtcatcagaggctcctcagccttcagacagcccgacgacgacgcttgacgctagcggcttgctgtgcttgctcactcccctgcactcacgagatgttattactgttacttgagggcgtctttcctcgtgtctgtcatgctgtgagcaaatcataaaaagcttatattatttttcactataaagttactttattaaagcacctaataaactgaactgttaatcatatatattaataatattcattgcattattatatttctattgtattg

SEQ ID NO: 511265 - DNA, 251 bp, Homo sapiens
  misc_feature (202)..(202): n is a, c, g, or t
  misc_feature (214)..(214): n is a, c, g, or t
  misc_feature (237)..(237): n is a, c, g, or t
cggaaaagaagagaaatttaaattagattatttatgacagcttagaagtgagaccacaggaacaaatttaaataccaagaaaatgttcctgtagccaaatgaataaataaaatcttcagcttttagaaattcagtacttgggtaaaaccaccaccaagagacaattaataattaatatgtatacttaaggtaggagctttcntatctccaagtncttgaaaggacaggttgcagganaagaaggaaggagg

SEQ ID NO: 511266 - DNA, 1449 bp, Homo sapiens
aattgtattatccttttacatatatatttcccggggatatattatagaggaatcacccaacttttgtggggataatcacaattatgggtgtatacagtcggtatccctttgaacgcactattattgtaagtatgtttaccaaatgtttggggcgcctttatccccttatatgagggcctacttaacacgtccgcttgtgttgtggtggccaatcatcactccgctaagtagtttatggtgtgtaacaacacggtgttactgcgcaacatttatacaaatgctgcttagtgtgctcacccagtgggagagagcccatataaattatttttcccaccactcgctttcgctccggctgtttagcccccatgatagaatgtgtccagttgccggcagtaaatattcgcctccactacttcttcgggggacgtgcttcacaacaataaggtgttacgtgtttttaatcgtctttggagacgcttcgctcgacccccacacaacactgttgctccatcccctgggtgtagatatgccgccataatttatttgcgacacaagtgtggaacattctatctgagcttgcacaacagatagctcttctctttggaagagttcccccttatatggcgaactgttccaactttactggttgtcctcttcttgttcccacccactgttaatcattatgtggcccctgtgggaatacgtgggcgccacctgctcgtataacattttatggccacaaaatacttggcatgtgcacctctatgagaaactctttcggttaaacttaccccgccgcacacacccggtgaaatattaacacgctttcgctaatgccacccaacgcttgtggccccaccactaaatggggttcccctaatatcccgagttaaggggagagcctcggtgatatttttgtccacatctctacatatagggaggggtcctttacacatgtcactctcggagctttttcccccctaattgtttctcccacgggtgtatcacccgcctaggagccccacaaacccctacgcgccccccaagattcccactgtgtgcacctatctccactatcttccactcgcggggcgttataatattgtaacgcgtggttgtttcccacacaacaaccgttgttctcggcccatatttccgcgaatatgcccccgcgagacggttacactccggagcgtatccctcgatgtggcaataccacccaccgacgtggaaacactgcctattcactctgtaggctcacttcactttctctaaccacgcacgtaaatatttacactaacttttcatgatttgatgaacgccttcgccttcgaagcgaaaaagtcctaaatacgtacgtacgaacccctccataatacctggagtgactatatggatgccccccaccctttccacacattcgaaaaacccgataatacataaaattta

SEQ ID NO: 511267 - DNA, 477 bp, Homo sapiens
acgcgcgggaggaaaaggcggcgtggagagacgggacgcgcgggagcaaaaggcggcaccgagacgggacgcgcgggaggaaaaggctcccaaggaagatctctggaagaaaagggactccgtgcaatacacgatgtaccacagagaggctggatacaattgataaagacattcaagaaaaagaggcaagtagaaaccccaggagatgggattggaaggcagacaaaatcaaaaacaacaaaagataaagaaactccaggaaaaacaaagagctgtacaataaatgttacaaatatgatgcaaagtaaaacataccatgattataagaaactgacagttaaaaaaaaaaaaaagcaagcaagaaagaagcctggccttcatgctacgataacctaacaaaaatgctccgataatatgaacagtcaattcataggaaaaaaaatacaatgatcagtaaatatctggaaagatgctaga

SEQ ID NO: 511268 - DNA, 137 bp, Homo sapiens
ttataactggatatttcttcaaacagatgtctggagatggtcataagggtggtgaagaagtaagttaaaatgtatggacagattttccgcaaatttgtagcattatgtcttggctaatagtcaagggtaatatgggc

SEQ ID NO: 511269 - DNA, 842 bp, Homo sapiens
  misc_feature (36)..(36): n is a, c, g, or t
  misc_feature (104)..(104): n is a, c, g, or t
  misc_feature (140)..(140): n is a, c, g, or t
  misc_feature (186)..(186): n is a, c, g, or t
  misc_feature (215)..(215): n is a, c, g, or t
  misc_feature (217)..(217): n is a, c, g, or t
  misc_feature (277)..(277): n is a, c, g, or t
  misc_feature (332)..(332): n is a, c, g, or t
  misc_feature (384)..(384): n is a, c, g, or t
  misc_feature (418)..(418): n is a, c, g, or t
  misc_feature (422)..(422): n is a, c, g, or t
  misc_feature (426)..(426): n is a, c, g, or t
  misc_feature (438)..(438): n is a, c, g, or t
  misc_feature (460)..(460): n is a, c, g, or t
  misc_feature (462)..(462): n is a, c, g, or t
  misc_feature (501)..(501): n is a, c, g, or t
  misc_feature (519)..(519): n is a, c, g, or t
  misc_feature (533)..(533): n is a, c, g, or t
  misc_feature (542)..(542): n is a, c, g, or t
  misc_feature (587)..(587): n is a, c, g, or t
  misc_feature (656)..(656): n is a, c, g, or t
  misc_feature (674)..(674): n is a, c, g, or t
  misc_feature (679)..(679): n is a, c, g, or t
  misc_feature (685)..(685): n is a, c, g, or t
  misc_feature (720)..(720): n is a, c, g, or t
  misc_feature (723)..(723): n is a, c, g, or t
  misc_feature (755)..(755): n is a, c, g, or t
  misc_feature (842)..(842): n is a, c, g, or t
gggagaaaaggtctcatccaaaatatagaaatctgntacatgtttgccacaatcaatatacttgaactgtacaaatttacaccagttcataatttaccgaaatnatagttgactaacaaagttcacaaaatagatggtgngttgtggaaaagacttttacccaattaagtactaggaaagttacanaccagacctccactttctaaaaataagangnttactcagtcttagaaaactacaagctagcaaatgtacagagagctggctggtgctaacnccacagttgagacagtgtctttttaagggtcttttttaaagcctgttgccatggnaggattctggtcacttgctactttcgaaggccaaaaacacaatacaaggtcngaccatttccccaggtcatgcttactagtttgtncttntgtnactttctcactntttaagtgctaggtcaaaagtncntgtaaaatttccagtatctaccatgtttaaaaacgtttnaactttcctattgaaagnctgccggaaaaggnataacaatnaacaacttttcaagtcgtaatagttgcaaattcccctgcgagagnttactgcagagaaagattctttgaaatacagattttctttaaaaggattgatgtaaaaatttaggtatntctgggagaaactgaaancaccntagganttccctccctagcaaataaagtgatcatttacttngantcacaggcgataaattaatcattgaaaggtangtccaaactatggcactgtcacttaaaatttttttttttttttaccattctatcttgtgccagatcttcacagctgtgacatggttn

SEQ ID NO: 511270 - DNA, 140 bp, Homo sapiens
ccgccagtgtgaggggatgtagctatagtggagcatgggacaagcgacattcatgagctctgacttgatggtgccaggttgctgtgagcctggacccggcccactcagcggcccacattggccagcattcatctgcacgt

SEQ ID NO: 511271 - DNA, 320 bp, Homo sapiens
tagctgcatacactggtctggagtactgacgactccttagtcacaaatgcaccatatcctgagacttgctggcgtcgtccgttgagtccacttggatttctgtcctccacagctccattgccactgttgatcactagctttttcttctgcccacaccttcttcgactgttgactgcaatgcaaactgcaagaatcaaagccaaggccaagagggatgccaagaggatcagccattctggaatttggggtgtccttataggaccagaggttgtgtttgctccaccttcttgactcccatgtgagtgtccatctgattcaga

SEQ ID NO: 511272 - DNA, 377 bp, Homo sapiens
gagttttgagttggctaggaaaacccaaggcccaatggacatggggcaaagtccccttggtggacattggtcccttccccttccaagctgtccatcaggctgaaagatttggaatgcatccccccccctttgaaaatgaggaagggcgagtttctcaaagtgggggggtgtgtttctcttttaatctgtaatggtttctgccttttgaggtaaaaccaaaaatctcttttttgagtgggccccctcgggggcggctttttagtcttgttgatataataaagcccatgccccccccccatggagtggaaaggagaaaattttaagggaacgtcctctgaatgcaaatgtttttgagattaacccctagtcccttgtta

SEQ ID NO: 511273 - DNA, 516 bp, Homo sapiens
  misc_feature (109)..(109): n is a, c, g, or t
  misc_feature (397)..(397): n is a, c, g, or t
  misc_feature (475)..(475): n is a, c, g, or t
  misc_feature (507)..(507): n is a, c, g, or t
cccaaaatatttttttcactcttttcaaccattttttagttgattattattgttattattatacttgcttttgctttgaattttctatatatttttgaatattaagctnttctgatatatacagtttgctgttgtgaacatgctgcaataaatgtgcaagtatacgtatcattttcatataataaactatttttctttgggtagatacccaatgatgagatttctgaatcaaatgatggttctggccaggcgtggttgtcacgcctgtggtcccagcactttgggaggtggaggcgggcaggtcatgaggtcagaggtttgagaccggcctgggcgatatggtgaaaccccgtctctactaaaagtacaaaggttagccgggcgtggtggcagcttntgcggccccggctcctcgggaggctgacacggaagaattgcttgaacctgggagtcagtggttgcagtgggctgagantctgccactgcactccagcctggacaactaantccgtctca

SEQ ID NO: 511274 - DNA, 645 bp, Homo sapiens
gatagcacgcttcgaggtggaccgcgcgtgaccaggttcgtaaatgagaaatgcccagtaggtgttgcctagcgaacactggtggtgcagtgccgagtgctggcggtcgtcaccatgtgcaaacagccggggaaacgtgggaccgttctgaagaaccatccagatgacgggtacatgagggtcgtaactgggagtctaatacacccctggagtccacaagctgaagcctgggataatcacacctgagggcccctgaaaatggcgggtttgccgcagaagggaagccccagagaaaagcgtcaccgggcggagcccaggagggacccacaaagaggagagtcccgaaagggctccccttacgcccataagggaacacacgcgaggaacacacaaaagtgccggacccaggaaggggggtgccccaaggagagaccaagaagagcggtatggcacccgaaagatggggccagacggagtcttacaaaatcctggcgagacagacacaagacccggaaaaagcttccggaaacaaagcggggccagcaaataaggcgaacagaaccgcaagaggggcaacacacaggcaaatttaacccgagactatacacaggggccacagaccacacacaagactcacagcaatac

SEQ ID NO: 511275 - DNA, 216 bp, Homo sapiens
agcgataccggactgtatacttcaattgcaaaatcattattatttttttttcaaaacttatatgtcattgatatgtatgttgcgaatttttaatcttctatttctgactatgcatctactgtctccggtccggtacattatattcttcgggacaatgtctcaagattctccttctgaattgcattttatttcatgccggataatactctgggatac

SEQ ID NO: 511276 - DNA, 295 bp, Homo sapiens
agtagtccctgtgagattacttgccctgtacgtctctccgatctggtggatctgcacctgctgtgcgttggccagcgcgtagtgcagggcctgcggctgcaggctgtggctgcgggagctcgctggcaggaggtggggtgctcatcatcggctctgaagggcagtaggaggacgagttgggcgttctccgcgagaagctctcggggaaggccccatcggcgaagaccatcagcagcgacgtcttcttgcagccgccgtcgcccaccaggaccaccttgacggaccgcacgcctgg

SEQ ID NO: 511277 - DNA, 706 bp, Homo sapiens
ggggctgaggacctgcattaatgaatcggcatgtagacggcgtgccgggtcatcatagaaaagtactacacgcgcctgggcaaagatattccactacgaacaagcgcgtgttgcgaggaggatcgccagttatccccgagcagaagaagcgtccgcaatcaagatagcaggttagtgtcacgcagtcttgagtgaagcgatagttcagagcagggcccagttaagaggtatctccatcaagctgccaggcgggagagagagagacaaggagtagacacattatgttccatgaggatctcagctctatgggatcagcgaggattattgaagtagatcctggacagctaaggaaatgctgaaagtgctctaccgggcaccactcgagtcaaggtcctgatccaaaacacatatcagggtccaaatcaaggccctaccagagtatgggtattgagagtatccaacaaaacgcacatcgaggagaaccatagccattgacattattaacacactgatagatgcttgctattaaattgtaatccaagttagaagctcgttgaggacaaaaaccgtgacacagacaacaaagaatagatcagaaacaatcaccaccacaagaagacacaaacaatgaataactcacgatgcaatagacaacgaaaagatagacaaaaaccgacgcacaccacctagtccagaatagaggaaa

SEQ ID NO: 511278 - DNA, 565 bp, Homo sapiens
  misc_feature (565)..(565): n is a, c, g, or t
ctagaggatcctatgagaccaggctgagcctactcagctgtactgtctgctggactgtccctgtcccgcatctccctgggacagctggagggcacatgcacacacagcctagctgcccccagggagctctgctggccttgctgggcctgcccttcccacaggtgaacagggctcctgtccaaccagcacactcagttctcttccctgcagtgttttcattttattttagccaaacattttgcctgttttctgtttcaaacatgatagttgatatgagactgaaacccctgggttgtggagggaaattggctcagagatggacaacctggcaactgtgagtccctgcttcccgacaccagcctcatggaatatgcaacaactcctgtaccccagtccacggtgttctggcagcagggacacctgggccaatgggccatctggaccaaaggtggggtgtggggccctggatggcagctctggcccagacatgaattactcgtgttcctcctccctctattactgtttcaccagagctgtcttagctcaaatctgttgtgtttctcan

SEQ ID NO: 511279 - DNA, 331 bp, Homo sapiens
gatccactacctaccccccgccgggcttggggtaaacacaggatcagttgttcacaatcagagaaagcaggtcgtcattgttgttcgtagggaggtcgtttgggcccaagtaggacagtcgctcatcagggttggtcagttccgggagcaagtccagagctggttctgcggcctccccggctccagacatgctgatgggccccatcacgcctgtggcaggactgaaggccagttcacccatagcttctaagctcgcttggcccaagtactgccagaacgctgatggagggtttgaatgttgcagctggcgacctggagccgccccaaggtt

SEQ ID NO: 511280 - DNA, 267 bp, Homo sapiens
  misc_feature (170)..(170): n is a, c, g, or t
  misc_feature (240)..(241): n is a, c, g, or t
aagactctgctagtacaggatgctgcagagaggggggccatatataccggggccttcctggagggcagtttattccccttcttgaatcggaagcaggatctgaagaagctgaagaaaaacaggacagtgagaaaccacttttagaactatgagtactacttttgttaggntgtgaaaaaccctcacagaaagtcatcgaggcagaaagaggcaggcagtggagtctccctgtcgacagtnngcgttgtgctggtgacgaccactact

SEQ ID NO: 511281 - DNA, 91 bp, Homo sapiens
cactgtctcccaggctggagtgcattggcacatcttagctcactacacatactgtcacagtatgggtgacagagtaagaccatgtctacac

SEQ ID NO: 511282 - DNA, 317 bp, Homo sapiens
ctaccagatcccctttcatcctggggataagccactgagtggtagatagcattttgaggtgatgctggattcaatttgccaatattttattgagaatttttacactgatgttcatcaggaatattggcctgaagtttttttcttttgttgtatctctgccgggttttggtatcaagatgatgctggtctcatagaatgagggaggagtccctccttttcaattttttggaatagtttcagtagaaatggtaccagctcttctttgtacctctggaagaattccactgtgaatccatcttgtcctgggctttcttttt

SEQ ID NO: 511283 - DNA, 593 bp, Homo sapiens
agcacagtttttgatgccaaacgtctgattggacgcagatctgatgactgctgttgtccaggtctgatatgaaacataggccctttactggtggtgaatgatgctggccggcccaaggctccaatgatagaactaccagggggagaggaaccaaaaaggcttcttaatccagggagtgcaggatgtcttactatgtgattctgagctacagactgacaggagaattgcagaagcctaccatagggaagactgttaccacgtgctgtggtcacagtgccagcttacatttaatgactctcagcgtcaggctaccaaagatgctggaactattgctggttctcaatgtacttacgaattattaagtgagccaagctgctgctgctattgcttactggcttagacaagaaaggttggagcatgaaagaaacgtgctcatctttgacctgggaggtggcacgttctgatgtgtcaatcctcactatagaggatggacatctttgaggtcgaagtctacagctggaggacacccacttgggtggacgacgattttgacaagcgaatggtcaagcattttatagctgagtttaagcgca

SEQ ID NO: 511284 - DNA, 317 bp, Homo sapiens
ccccccggtttttccccccgggggttaaagggtaaagttttaaaagggtccaattttaccccccgcccccccctttttgggggcgggggggggttcccgttaaaaggggctttttggccccttcccaatttttggggggggggggaaattgtttcttttcccaaaaacccagggggggcagggcttttgggttccccccttttttcccccccttttgggggggtgggggggggggtttttttgggcccaaagtttaaaacccccctgggtcaatttaccgggccccgttttttttttaaaaaattttgggcgggccg

SEQ ID NO: 511285 - DNA, 687 bp, Homo sapiens
gtactaaaaacttaagggacaccagaaaatttgtactgaagagaaagacatgcatatgattaaaaccctgtgtccaacagagaaacctgcagcagagataatggtgaaagttgaggcacattttatacgtaattagtgggaacgagaaaatggagtgcctgttatttagattgctaccaccagtagagtctgggatgatcttcgccagtgaacaagaaagaattaggtggtagatattggcaaaggaacagataatgacatagatgagatggtcatctacagactaatatgaagactcctgtggtagttgattgaagcagagcagaagagatttgacagaagaagacctatgcatttattacgaatgggaatatgatacagtgtggcactcaggaaatgaggaagataatggaacgtatttgttcaaaagtggaggatagtccagttctcgaagggggaaaaatagaccatgaagtatacatcaagagagtgaatcgatgagattaaaagacagacactatgtgaaaatgctaggtactagaatgatatgagccttgggaatagggaacaggttcctttggaagcaagtttgggaaatacttagcggttgctactttatgagtatgaggtgttcaggaaatagcggcactgagggatattttagtgggggttagatttggtgaaaca

SEQ ID NO: 511286 - DNA, 1037 bp, Homo sapiens
cccaatttgaccgtccctcaattcccgtcacaggcttgaagactgccggaatacctagggcgtcgtatcacaatggtcttttggtgtggttcctcaggagtcgtgtcaaaccaacgtgcaactctatgctcacgagccagccgggcatactgacgtggaaaaacgctgcacggacgcttcaccatttccggcttgactcttcggttacctcgtgttcctagtcatctacaagtggatgtgtactctgagctgcccagggccgcctcggcccccagcatcctcatccacttcatcaacatgttcctcttctcccacagccccagcaacaggctgctcgtacccccggcaggaggtggtccaaggcacacgctagctggtcctaggcgttggccataggtgcccatcctgctgcttggacacacccctgcacctgctgcaccgccacccgctcgtccgcctgcgagaggacggccacgctgaccgacaggaggaaaacaaggccgggcttgctggaccgtgccatgacgcatctgtgaactggctggagtctccgatgaggaaaaagggcagggggctctggatgatgaagaggaggccgaagctcgtcccctcacgaggtgctcatgacaccaggccatcacacaccatacgagttctgcactgggatgcgtctccaacaccgccatcctaccttgcgccatgtggggcccaagagcctggccaacagccacagactgtccagaggttctgtgggaccatgttcgatgcagcagtaggccatagggccatggcgccagggaaggctgggcgtggcggctgtggtgctggtcacccatctttgccgccatattgccgtggtgaccgtgcgctatcctagactgtggtgatggaggacatcatcagccttcactagacgaccctgcagagcatgcactaggtggaattccagaacaagttctaataaggcacgggctacaagctgagtcccttaccttcgctgcacagatactagggcaaccgcgggcgctgcaagcctc

SEQ ID NO: 511287 - DNA, 364 bp, Homo sapiens
ctagtactaataaattcgcggggctcgacgacgcgactcatgcttgtgatcccagcactttgggaggctgaggctggagaaacacttgagcccagaggtttgagaccagcttgagcaacatggtaagaccctgtctctaaaagaattgttttaaacattagccgggttgccaggtgcagtggctgacgtctgtaatcccagcactctgggaggccgagatgggcagatcacctggggttaggagttcgagactagcctggtcaacatggtgaaaccccgtctctactaaaaatacaaaaatttagccgggtgtggtggcgcacactgtaatcccagctacttgggaggctgaggcaggagaatt

SEQ ID NO: 511288 - DNA, 749 bp, Homo sapiens
cagagactcatgctgactcgtggatccaccgagtaagctcaatggctctaacttggtggctgctatgatgtaaagaaagcattattctggggaaccattcctcgactcaggatccagatgtccaccacccaagagtgaaattgcaaggaaaggaagttggtgttttatgaagctctgaaagatgaccctggctcacagggagaatttgtcacgactgtgccagccagcgtggcgctgctgtcatccaggctcgaaactatcccgtgccctgtctgctgccaaagccctctgtgaccccgtcagggacctctggtttggagacccccgagggagagtttgtgtccctgggtgttatctctgatggccactcctatggtgttcctgatgatctgctctactcattccccgttgtaatccagataagacctggaagtttgttgaaggtctccctattaatgatttctcacgtgagaagatggatcttactgccaagggactgaccgaagaaaaagaaagtgcttttggatttctttcctctgcccgactagaccatgatgttactaaatgcttccaagctgaagaatctaaatgtcgtctttgactcacagtacccaataataataatgctatacttaaattacttgtggaaaaccacaccttttaaagattacgtgcttcttggtaccggtttgtgaatgaccgtttatcgtcatgctgttagtgtgccttctaaataaatatatattcca

SEQ ID NO: 511289 - DNA, 357 bp, Homo sapiens
tttttaaaatccccccgggagtccgggaatggtgggcccatttttccctccccctcagcttggggaaaaaaaagggcttggggggcttccgaagttgggttttgggcttttcctgcccccttttatttttttgtaaagccgttgcccccattttgcccattaaggggttagggttggaacccatttttaggtttccaggggaattttgaggaaaggaaaaaattcccctccccgttccccttcccctttgggttcaaaaaaatttgttttgttgtcatttgtttttcctttttccctgtgtggggaggggccctcaggtgtgtgttttttggacaataaatggtgttatgactgcca

SEQ ID NO: 511290 - DNA, 243 bp, Homo sapiens
gctcgacgttcaacagcgtgatcttcgacggcgcgcgtttcgaccagtctatctatacctggatggaaatcggcggcctgaagatggaggtcggtttcctgatcgacagcatcacggccatgatgatgtgcgtggtgaccttcgtgtcgctgatggtgcacatctacaccatcggctacatgcaggaagatgacggctacaaccgtttcttctcctacatctcgctgttcaccttctccatgt

SEQ ID NO: 511291 - DNA, 854 bp, Homo sapiens
cgccgaaggttgtggggcccagttcccgaggggcgtccccaaagttctgggacctcccggctccacagagtttgggccttccctcccccccaggggtggctctgcccttccgcttcccaggagcaacgcgccgggtgtgccaacgctgcctgttcttttggggcgccaaagtgttgcagcgtcgttctattggtgctacattgggcgaaaccccggtgttactgtgtgctcgttccttcgggggcgaagacattggaagcccatttccccctccaaaggggtctctcataactgggtcttttttgatttgccccgccccgcagcgtgtgttgcagtcgtagatttgaccaacgcccgtctctccgagcgcctcgtgaagtaaaacaggttgttgttggtgaacgcgcctcgtgttgagaattcgtttcgtctccgccgaacaaccctcttgttgggggatattccccccccccgctcggtgccagcctttgataatgtcccctcgcgagtgcaatacccggcatttcatcttgcgagaaacatcaaatagaccaccaacccgctgtacggggggcgaagaccccctgtggggctgcgggaccctggatctctcagtaccacacagtccgtgtgcgccccacattgcccccctaatagaggggtcacccccgcaccatgctcggggcgggggtatcaaaaatgcgaatgtggacgccacaccctcagcccaaaaaggctacaaatagggaagaactgggacccagacaatagacagatacaagggggggagagagacctgggagcgaccccttcttcctggcgccccaccgccagtaattcctccaacaaaacgc

SEQ ID NO: 511292 - DNA, 414 bp, Homo sapiens
ggtctatctagaggatccctaagagaccgtgttgcaatgattaactttcaaatatgaagaggagctgtagagcagtgagctccacttccctctaagcaatccgcacgcttctaggagctcctggctgtacagctctgggcatccccaggattaatgctcaccggtcagtgctggtgtgacatgatggctgagcaccggaactgtgtccagcgcattgctaggccactagacacgtgctctttcatttattcctcaaattgctttgtgctgtaaacgctacccagaacggctcatgttcattactcaagtcacttcaccagaaagtgacagagccagacttcaaccccaggtctgccagattccaggtcccttgcttcttctgttgttgctcattgcaccacggtctctcaggta

SEQ ID NO: 511293 - DNA, 531 bp, Homo sapiens
tgagatttgggggcgaataaccggagtaggtttagttcctgttgccttggcgagtcgccggcctgctgggaacgggatcttctaaaaggaactgatgtctggatacggctgtggtccaaggccattattctgctggctataatgacggggtctccggaaccatggggagcgacacagctcttcttagtacattgaaggtgtttacgcgccgagatgaaacagacattctatttgggccaagagatgcgcttatgtatatcaaagcaatagaataacgactagtcgactcctggcggcgaatcctaaacggaaaagcagagtctatctggggaaaagtaactcgggcccatggaaacggtggcatggttcgtgccaaaattccgaagcaatcttcctgctaagggcattggacacgagaatccgagtgatgctgtaccgccgtcaagggatttaagactaacgaaatgatcaatataaataaggatgtggattggtgctcttgtatatggaagtggattaaaaaagttacta

SEQ ID NO: 511294 - DNA, 298 bp, Homo sapiens
tttatatgctgtctcatcttttaaaaatcaaagtacatgataagtgatactttatatatgtaacatgtttacctattatacatttctaatttttttttttgggagacagagtggcactctgtcactcaggcgggagtgcaagggtgctatctgggctcactgcaacctctgcctcccgggttcaagcacttctcctgcctcagcctcccaagtagctggaattacaggcacccaccaccatgcccagttaattaaagtttccttttcatttaccataagggaatctggacactaaata

SEQ ID NO: 511295 - DNA, 178 bp, Homo sapiens
cctgaggatcccccctcacggattactcaagacccgctgtcatcagtagtttcactggtatacaagacctggtagaaatatctcaaatggaaaacttaatgtctcacaatgcttaagtatgttacctcatggtacaattaagtggggactactagtcttacaaccgggctctgtgctg

SEQ ID NO: 511296 - DNA, 274 bp, Homo sapiens
gtgataaaaatcgcaaatctatacctataacgccaggtgggagggcgtttttaaaaaaagccatgtcaaagggcattaagttggcagacatcagtttgtggggctagagggataaaaaacgctgtgtgaggtggcaaaatttaaaaaacgcaggcccacttggcgttttaaaataaccccggcccaggcagctttatttaaataaagctctgtcatacacctttattttccaccctagaactttgtaggtaatataattacgctggtttgtaaa

SEQ ID NO: 511297 - DNA, 149 bp, Homo sapiens
caattccattccagcgtatctaaaggcctgcaggaaaagaagagggaaaggagtggattttctggctctggttatagagagcccaaaaggagggcaaccggcgtcccggccacgcccggctgggatttaggtacgcgggaatggaatgg

SEQ ID NO: 511298 - DNA, 505 bp, Homo sapiens
tggtgatagggggaatcctgggtgtagaaggaagatgagtgtgaggtgatggatgattactcggggggtgatgaggattaagggagagagaatgatttcgagtccttcggttgcttatggcttaaagcaagacagagctaaggctctgtgcgtgtctttgcattctttatattgctgtcctggttgggttgggactctcgacccagcataatgctacaggttctcctcagattcaagttctgaagaagagaagaaacccccaactaaggcagtagtctctaaagcaaccactaaaccacctccagcaaagaaagcagcagagagctcttcagacagctcaggtaaggcatatggaggccctcagttcagtgagatgctctcaggcagctgctaagggctcccctgaatccaatttggggagctgttgattccatcccttctgtgtctagactctgacagctctgaggatgatgaagctccttctaagccagatcaccaccaggaa

SEQ ID NO: 511299 - DNA, 502 bp, Homo sapiens
  misc_feature (11)..(11): n is a, c, g, or t
  misc_feature (31)..(31): n is a, c, g, or t
  misc_feature (51)..(51): n is a, c, g, or t
ttcccaagccngggtacttttggtgacgtanggaggtaacttatgataggncttactttcttctcctaaagttatttacggatttggctttaaatataaaagttcagtaagtgtataccgaagcaaaaattagtcacttgagtaacttggccgctaatatttaaccatctacctctgtttttaattttctttcctaaaggcagcttgagatgtcggtcctaaccttgtctttctttttcctctttggtagacttatgaatgtccatattacttcttttttcctaaatgggacaaagacataggcaaaaaacatggatcctaagtagaatcagatatttatctctttttctaaaaaaataaaataaataaatttgggtgtttttttttaatttgcttttatcagatatttatctctttttctaaaaaaaataaaataaataaatttgggtgtttttttttttttaatttgcttttaaacaacctcgactatgcaaacactgaa

SEQ ID NO: 511300 - DNA, 864 bp, Homo sapiens
gaggattgaggcagccagcgcagggttctgtgagggggcaggggagtttgaggaaaccgagataagttttctctttgaaagatagagattaatacactattaaaaaatatcgtcaataggttcctaagatatggctaaagcgtcaagttttcaacgtaatttaatagcttaagatttaggagaacatatgaagacttagaagagtcgcatgaggccggaacacgatcccaaaggtttctaaaacatgaggagggttgagatgacgcttcttcatgggtcaccaccactgtctttaaaagaccttctgagagaaaggactaagagcccgaattaatcccaatagaagggcaatgttttagattaaacctgagggtgacttaacgagctcaagtccagttcacaagtgtcggtgatcacatactgtgaaggcgatctttacaacaggagattcccgcgaggtgattaaagactgaaatcatgagcaggaacattgcgtcatttaaaggctagtaacgctatttataaccggcagaccgaacattgcacgatcattcccagcggtcgccctcgccccctgtggcgcaccactacgacgttcgccgtgccactggacccgaagtcgggcagggcacacaaacacacaccaaaacaacactcgtgggccgctcgccccgacaaatactacccactgtgggcgcggccagcagtaatgaaccgtccacgtgtccagaacctgctcgtctgtgtcttcccaccaaaaacgccgggcgcgtctcacaccacggtcggcccggctcacgcccgctaccccccccgtccctacacgcacatctaaacacaaacaatgacaaaccccgcctcaca

SEQ ID NO: 511301 - DNA, 650 bp, Homo sapiens
ggagtcgaggccatggctgagaagttcctggagggcgaggtgcccctggaaacgttcctggagaatttttcctccatgaggatgctgtcccacctgcgccgggttcgcgtggaaaagctccaggaagtggtgaggaagcccagggcttcccaggagctggccggcgatgcccctccagccagtccagcaggccctgggtgcgcccagtcccgcaggggaacacgccctgtggtgtgaagagcaggcgcagccaccatcagccatgcctcccatacccttatgcgcctacagtccatccccacagactgccgtgtgggcccaactgcccatggagccgctgacagcggatccctttcccagtagtgtaccagacctccttctacagcggggcctctgggccccacttagcccggaaagacccagacttggacccaggggtgctgacgggttacctcctggatccacagagaggagcatgtccaacccggacggtgctatactgggaaccccaatggggtggctcctgggccaagggtacccctttgcggggaaggcatggggcccacccagtacactggtatccttcaacaagtccccgtaccccaggaaacaggaggagacactccctaacgcatactgtctcagatcac

SEQ ID NO: 511302 - DNA, 260 bp, Homo sapiens
  misc_feature (191)..(191): n is a, c, g, or t
  misc_feature (212)..(212): n is a, c, g, or t
  misc_feature (231)..(231): n is a, c, g, or t
  misc_feature (251)..(251): n is a, c, g, or t
agcagcccggatcattatttgatttttcatagagaaggggcttcatcatcttgccaggctgctcttacactcctgggctcaagcagtcctcctgcggcggccttccaaagtgctaagattgcaggcgtgagccaccgtgctggcctcatatttggctctattccttgttaaatgatggtctgccctccagnggcctttggcaccttcacctngaggttatgctcagctggngagtctgcgcctctagcggngatcctcta

SEQ ID NO: 511303 - DNA, 261 bp, Homo sapiens
tggcggcctccttgggaacgtgtaggccacgctctagccaacactagatacctgatgagggcgctgctctgcagatcagaacaacggaggatagctttgtgcctggacccagagagtgtgagaatacccgcttaatccccaccgtcacactccacagcattccagaaacattccctggcaaacaaagagaacactaggagaaaaaatggaataacccttacagtaattaaaaaggaagaaaccaaagaaagaaaaaaaaaa

SEQ ID NO: 511304 - DNA, 470 bp, Homo sapiens
  misc_feature (362)..(362): n is a, c, g, or t
tattttccacagggaggatcttagtgtgctgcagtcagccagaagaattttggtgatgtccattattgatgaggtttattgtcatctttatacatttttattctattcattttgtttataggtagaatagagcatgaggtacataacaggatgtggaatcaggactatagtggttaaaagtaaataaaattaaaaagcaattttaaaatagaattacattgttgggttgggtgacagaagtggaaggccagttggccatctcgatatgttcttatagtgtggcattatcctggagggttcactacagtacagggtctggccctcaattttatagggccagacagtatatcataggggttaanagcaaagttgggagccaaactgactttcgaatccttgccctgtctttaattgctatgtgaccttactcaaattgctcaactgttctgtgcctcagttcctaattcaaa

SEQ ID NO: 511305 - DNA, 391 bp, Homo sapiens
  misc_feature (110)..(110): n is a, c, g, or t
aaagttaattgcttgtcaacgctataaccacaaaaataatgaattgatgagaaatccattgaagagccaatgtccttctcaaaatccggctttcacaaaacgcagattanaagcgaaaagaaatgaaaatgtcacttcacattaatcctgaaataaaagaagccgaaataattgagagataagttgggctcaagtgaattgagaagcttgtcctgtgtgccaatgtttcgtttgcctcacacaggtatctcttcgttctcagaagagttgctccatttcatctgaacgcagaaaacagcagcacagctgttcacagataagtttaacgcgcatccacagtagcgcatgataggtatgagtgcatatttataagatctgtagagctcttaaa

SEQ ID NO: 511306 - DNA, 268 bp, Homo sapiens
aaaaaaagggggtggtggggccggacatgcccccaatgttgaaccgaccaaatgcctttcccctgtagggtaaagtggcccctatggatccctatgtatgagaggagggaggcaggcttcagcttccgccccagaatgggggctatggaaggcagccggggctcctttcctttgccccttttgggtgtttgacccgggggggggttttaaaaaaaagaaggccggggtccccttttgggttttaatatttaaaatgattccccctgga

SEQ ID NO: 511307 - DNA, 221 bp, Homo sapiens
ggctcattctgtccactttttctttctagtatctggaatctctctctaccctcttcttgtcatctctatggtgaagcaaaaaaaaaaaattctttggctctatttctacccccaccatgattggctatgtggccttggataagctgttaaccttcggtgtcagatccctcatccggtacagggcgaaaataccagaactcaaccttataggggtgtggaag

SEQ ID NO: 511308 - DNA, 215 bp, Homo sapiens
  misc_feature (206)..(206): n is a, c, g, or t
tcggcccttttttgttgcctacagattttcacacgcttttctctgccatattaatctcgcagtcatgccctctcgtgccatcctacgccgttcaacgtgctgcagctgaggttattacttctttgacgccacagtggatgtcattctcctgctgagtattcctctcatattcttcatgctgcatcactgccggagtgagggatccntcctacgaa

SEQ ID NO: 511309 - DNA, 326 bp, Homo sapiens
  misc_feature (163)..(163): n is a, c, g, or t
  misc_feature (297)..(297): n is a, c, g, or t
  misc_feature (304)..(304): n is a, c, g, or t
gcaaatttcaaactgtatgccagacctggccctttgcagagttaaaagaagccaggtgtggtggctcacacctgtaatccctggactttgggaggctgaggccagagaatcacctgaggtcaagggtttgaaaccagcgtggccaacatgacaaaaacccatntttactaaaatagaaaaattagccaggagtgatggcgggcacctgtaatcccagctacttgggaggctgatggaggagaatcacctgaacccaggaggtggaggttgcagtgggccaagattgcaccactgcantcctgtntgggcaacagagtgagactgtc

SEQ ID NO: 511310 - DNA, 818 bp, Homo sapiens
  misc_feature (643)..(643): n is a, c, g, or t
gctcccgccagttgcgggactgggaggtgctggtcctaggtgaagctcaagtgggacctggttgctgtgatttgcacatgatttcctggccttcattctgcagccggctctctctgccccgtgatcgacaggccttggtcaaaaagcatgccccagacctttttggccctctgtgctacagattataccttggccatgtacccgccatccatgatcgccacgggcaggattggggctgccagtagcaaggccgtgggtgcctgtttccatgtgcggggatgagctcacagaggctgctggcagaggaatcactggcactgaacgtggacttgctgcgggcctgtcaggagcagatctgaagctgcatcgtcacgggagagcctcagggaagccgtctacagagccagctccagcccagcggcgccaaagccccccggggctccagcaggcaagggcccagcagaccagcactcctacagatgtcacagccatacacctgtagccctggagaggccctctggagtggccactaagcagaggaggggccgtgcaaccagctccctggctccaggaaaccagaccagatctaagcctgaaggggcgtctgttcccccttcacaaagcccaagggatctggttctanccatccccgcagtgtgcactaaggggccctggcagcatgtctgcatttcggtggctagtcaagctcctcctcctgctttgacaggaaggcttccaatctagctgggggtgggccgttgtgggccgaattggtcattaaccagggttctttgaagccccccacctggggcctcagt

SEQ ID NO: 511311 - DNA, 258 bp, Homo sapiens
cgaggaattcgtctggttgaaattcagtgattctccataggcgttgcagttattatggatccagctatcaaattttactgacatttcccaatctgattctggtatagggcattggagaccggtttcactctgtcgcgcaggctggagtgcagtggtgtgatcacgggtcactgtagcctcgaattcccaggctctggtgatcctcccgactcagactctcaagtgggtgggactacaggcacgcaacaccattactgg

SEQ ID NO: 511312 - DNA, 161 bp, Homo sapiens
tatgctggtgaacagcctgtatgctgatggctcaagcccggtgaacgtgcccgagaacccaccctccatggctcttcaagcagcactgcgagcaggtacctcagttcctgaaggcggctgaggactatggggtcatcaagactgacatgttccacactgtt

SEQ ID NO: 511313 - DNA, 151 bp, Homo sapiens
agaagcctcaaagcagacataacccttaactgtgtgtactccatggacgaagaaggaaagatcaatgcttgaataccttagattgatttccaggaagagggcggcagagcaaatgacacttaacccctggccggccctgctgacagcatcc

SEQ ID NO: 511314 - DNA, 1480 bp, Homo sapiens
  misc_feature (80)..(80): n is a, c, g, or t
cgagttctatacctccattaccgcgtgcccgattgtgaagaagtgaatgcatgagctctgttccgtggacaccccgtggnatcccaggtagacgaaagccgcgtgtcgagagtggccaacatgctagaacaacggtcatgcagagttgcattgaataattgctccgtggattggatggcttctaacatcgttcatccccaaggattcatgatacgctctcgtcgcaaggcacgttcgttcaagtggagagaaggaacctgacatgtgatgaggtcgagtcagagccgcatggagtgagaggcttgtattgctttaatggatgcacgcttgatccatgcgctagcctagtcattggtctggcagacaaggtcgtgaacggagatggttctagagatttgggtgactcgttgtggatgtccacttccctcattctccgcttggtttatctggacaatctgtcttgggatggcagttcatggacctattcgcgtcgatcaatagactgctagtacacaccaagtttccataccacaagcgaggagcacacagactcgttcacttatctcgtaattctagactatacccaatgctcttcggatagttgcgtatagttccatggtctcaaatagaaagcgggtgagagctggtgctcaaatagatcatacacgggaaattacacgaacccgtgactattggggcaccgaatatttagtagacttcaatcaggggccattgaaaccttcgcatgacgatacaccgcatgggtggtgtccattcgaggaatatggacacgtccacctttttgtggcatccagttagaattgccccaattggggttaataaccttccaaattgattctgcgttggctttgttgggggagccatatgaaggttaacgaggggacaaataagtaggataaccaaaggagttttaggctgaatatcactttcatttggagcatatgcggacccggttaatgagagaccaacgggacatgacctctttgtagaggggtcaattgaagtccgcagggaaaggactggcggacagttagagaacggctctggaattagtggacggaaaggcaggaaccgcgaccaacagggtgggttcacatccgaaaggaactttgcccctatggaagattccctatagtgcccctttgaaacaattggagagccccaccttggtctgagcagaatcgcatcaaaactcggaacggcaaaggagagtccaccaatcacggagccaaccagcagacaatcctgaggaagggaccggaaatcatacacacgacgtcacgagagaaaacagctcgcgggaaggcaaaatatggacatgcacccaacaaaacgcggcccacgatcagcaccccgacatacgagcagcacaacgagaggcatcacgcaaaagcacggcagacaaaggacagacccacgaggggcaggcaccccgaaaggtgacgcgaggacgagcgac

SEQ ID NO: 511315 - DNA, 320 bp, Homo sapiens
  misc_feature (216)..(216): n is a, c, g, or t
ccaacacagtttgctcacatgccagttactccagcataaagctgaaatctattcaatactactgtcccataactgatctgactttgtatgtaaatacagaaaaagcttgttcacctgtttttcctctattttgtccactggctgaattcaagctgtgaagctcctgtcatatagtctgagagaataccatgctgaaagcaactagctggttcccanatccccacgatctaaacatggaattgtttgcgtttatttaaacgtaaattaggctattttttctgtactagggtctggctttctactggcccttcgtcatacgt

SEQ ID NO: 511316 - DNA, 206 bp, Homo sapiens
tacaggaaagtgtcctttatcaggactccactaactcacatctctagaaaatggagtctgagaattccttgcaaaaaaatatatactgttcctttgctgattataaaaggaagacatattcattgtaaaaaaaagacttgcaagcacagaaaagcagaaagaaatatcatgattttcctaccattcaggatcttgcactgttcata

SEQ ID NO: 511317 - DNA, 121 bp, Homo sapiens
ttactggcatttagaaaccataatgtctgaatgcctttcccattaatattcttctccctacccccaaacccttcaaatactacagagctgtactgcaaatgaacaacaatcgaaaaagtct

SEQ ID NO: 511318 - DNA, 280 bp, Homo sapiens
gcacagtggcagccccaggtggctacacagcatggtgctggtggtggcggtggtggagcacggcatacagccttgtgctggcagctcgtgagaccctcgggggcacatgtggcggctcctgctggcctgggagcagggccatgagcatccagatctgcaggaccaactggtgcacctgcgcgttctgcagcagcagcagctccaccatgtcatccttaatacttcctgaccgttgagcagagaaggcctggcgaggagcaatctgtgctatgagtgcctg

SEQ ID NO: 511319 - DNA, 177 bp, Homo sapiens
tgtgttcttcagaggagccggaagtaatcacattggaaatgataatggaagaccaggaggagctcttcgtagttccagaaacggtagaatgctgggacgtagtattacttaacttcttagctgtcactaccatgactattcacctgtcactcccttgtgctggcagcggcgcagttc

SEQ ID NO: 511320 - DNA, 121 bp, Homo sapiens
  misc_feature (102)..(102): n is a, c, g, or t
  misc_feature (106)..(107): n is a, c, g, or t
tgcgcatcttctcccatcagcggatttctatacattgacctcttattggttatcaaacagcagtccaacgacgtgtcacacaatgagctggtctgatggganaaanncgggatcctctaga

SEQ ID NO: 511321 - DNA, 257 bp, Homo sapiens
  misc_feature (25)..(25): n is a, c, g, or t
  misc_feature (33)..(33): n is a, c, g, or t
  misc_feature (42)..(42): n is a, c, g, or t
  misc_feature (75)..(75): n is a, c, g, or t
  misc_feature (96)..(96): n is a, c, g, or t
aaagaggctggcccagaaggcaggntaacaggngccaccggnggttccaaactggttaaaaattggatcaggggnccatggaaaaggaaacttggngcttcaccggaggaaaaatatctaaacatcgaaaaacttaaatattaatgggaaaaaaacattggcaaaatataaaaataaataaaaaagggaaagggaaactttgaaccttatgtaccgagcaaatgccaggctaggcaaacataatgctagcctagatt

SEQ ID NO: 511322 - DNA, 102 bp, Homo sapiens
ctcccagatgaggaattgctcagagaccctctgtacatctggctgaaacaccagcgcgtgcacggcgaaggcatacgatgacttgctggatgagttcagtgc

SEQ ID NO: 511323 - DNA, 994 bp, Homo sapiens
  misc_feature (21)..(21): n is a, c, g, or t
  misc_feature (103)..(103): n is a, c, g, or t
  misc_feature (165)..(165): n is a, c, g, or t
  misc_feature (181)..(181): n is a, c, g, or t
  misc_feature (237)..(237): n is a, c, g, or t
  misc_feature (245)..(245): n is a, c, g, or t
  misc_feature (247)..(247): n is a, c, g, or t
  misc_feature (249)..(249): n is a, c, g, or t
  misc_feature (257)..(257): n is a, c, g, or t
  misc_feature (264)..(264): n is a, c, g, or t
  misc_feature (299)..(299): n is a, c, g, or t
  misc_feature (308)..(308): n is a, c, g, or t
  misc_feature (312)..(312): n is a, c, g, or t
  misc_feature (318)..(318): n is a, c, g, or t
  misc_feature (323)..(323): n is a, c, g, or t
  misc_feature (326)..(327): n is a, c, g, or t
  misc_feature (335)..(335): n is a, c, g, or t
  misc_feature (349)..(349): n is a, c, g, or t
  misc_feature (358)..(358): n is a, c, g, or t
  misc_feature (362)..(362): n is a, c, g, or t
  misc_feature (366)..(366): n is a, c, g, or t
  misc_feature (370)..(370): n is a, c, g, or t
  misc_feature (375)..(375): n is a, c, g, or t
  misc_feature (383)..(383): n is a, c, g, or t
  misc_feature (386)..(386): n is a, c, g, or t
  misc_feature (397)..(397): n is a, c, g, or t
  misc_feature (399)..(400): n is a, c, g, or t
  misc_feature (402)..(402): n is a, c, g, or t
  misc_feature (417)..(417): n is a, c, g, or t
  misc_feature (419)..(419): n is a, c, g, or t
  misc_feature (421)..(421): n is a, c, g, or t
  misc_feature (424)..(424): n is a, c, g, or t
  misc_feature (426)..(426): n is a, c, g, or t
  misc_feature (430)..(430): n is a, c, g, or t
  misc_feature (492)..(492): n is a, c, g, or t
  misc_feature (653)..(656): n is a, c, g, or t
  misc_feature (670)..(670): n is a, c, g, or t
  misc_feature (682)..(682): n is a, c, g, or t
  misc_feature (695)..(695): n is a, c, g, or t
  misc_feature (703)..(703): n is a, c, g, or t
  misc_feature (711)..(712): n is a, c, g, or t
  misc_feature (719)..(719): n is a, c, g, or t
  misc_feature (722)..(722): n is a, c, g, or t
  misc_feature (726)..(726): n is a, c, g, or t
  misc_feature (746)..(746): n is a, c, g, or t
  misc_feature (751)..(751): n is a, c, g, or t
  misc_feature (761)..(761): n is a, c, g, or t
  misc_feature (784)..(784): n is a, c, g, or t
  misc_feature (788)..(788): n is a, c, g, or t
  misc_feature (790)..(790): n is a, c, g, or t
  misc_feature (795)..(795): n is a, c, g, or t
  misc_feature (800)..(800): n is a, c, g, or t
  misc_feature (811)..(811): n is a, c, g, or t
  misc_feature (830)..(830): n is a, c, g, or t
  misc_feature (859)..(859): n is a, c, g, or t
  misc_feature (864)..(864): n is a, c, g, or t
  misc_feature (876)..(877): n is a, c, g, or t
  misc_feature (885)..(885): n is a, c, g, or t
  misc_feature (890)..(891): n is a, c, g, or t
  misc_feature (894)..(894): n is a, c, g, or t
  misc_feature (899)..(899): n is a, c, g, or t
  misc_feature (903)..(903): n is a, c, g, or t
  misc_feature (915)..(915): n is a, c, g, or t
  misc_feature (923)..(923): n is a, c, g, or t
  misc_feature (938)..(938): n is a, c, g, or t
  misc_feature (946)..(946): n is a, c, g, or t
  misc_feature (951)..(951): n is a, c, g, or t
  misc_feature (953)..(953): n is a, c, g, or t
  misc_feature (957)..(959): n is a, c, g, or t
  misc_feature (978)..(982): n is a, c, g, or t
gtgtgacgggggtggtgggantgtggacgtggcatggggagtgagaggttgctctggtgcagctggaggaagaacagggaacctagggttggggagagatgtntagaggaaaactcccccaggcacacagcctccgctctggaccaacgcaggcttcagtgagtncacacaaaggaactgntgtcaaggccctttctatgacccttcccattctagcaagacctcccaccccagtcntcttgggntntncagccacntgaaatncagacacatcgttcccccaagtcaggccagttttnggccattgngttntggggnaatgnttnntgggatgnatgaaaaacaaatnaaataaatnaatnaatnaatncactnaagccttnttngccaggcgtgntnncntgcccaacactcctncntnccngnactntgcacagttcacggctcatatgcaaagtggaagacacgtgggacaagagcaaagcacaagtnacacatggtccctctctaacacctcagcacaccaaccctgacgctcccatcacagatgctgatcattcttccacggacccccttttataataatcctcattcacatttctagtttcttagggaagagagaaagagaaaggaagaagtggaaagtgcggaannnnaatgagtagggcanagaaaggagggngagaagagaaagnaagaggtnaggtaagnnaaggagnagngganagggtaaataagggaagttntgggnaaaatggggntaaggggatataagggggtgaantatnanagatnagganagcaaggttcnaggaggatgagaaagaggntaaaagtataaaggaaagaagaggaaatnaaagnaaaatggggatnnagggagtnatgtnnggnaaagngagnttaataaaaaanatattaanaaattataatgagangggggggnggggnanaagnnnagaaaggaaaggggaaaannnnngggggggagggg

SEQ ID NO: 511324 - DNA, 116 bp, Homo sapiens
tgacaggacgattgttattcatggtgatgagatgtatgacattgacgtgtgctgactgtccaagttggtttctacaggcgatccgcacgacccccgcagctgcatgccttgtccct

SEQ ID NO: 511325 - DNA, 305 bp, Homo sapiens
ttttttccattcccgattttttattttaggggtcccgggaagaaaggggggtagaacctttttcctccttttttcaaatcctttcttgccccccccccattccccgggaacattcctggagctggtccccctccccgatgggtttttccatagcccagggggaaagaacggtctttttttttgattttttaataaattttctttttagaataggccccagtttttttcccccccggggttaaggtttttttaatggggaggccccttaatgttttggaataaatatttggctctgttttatgcca

SEQ ID NO: 511326 - DNA, 458 bp, Homo sapiens
  misc_feature (49)..(49): n is a, c, g, or t
  misc_feature (239)..(239): n is a, c, g, or t
  misc_feature (329)..(329): n is a, c, g, or t
  misc_feature (404)..(404): n is a, c, g, or t
gtgatgtgtgcctgtagtcccagtttctcaggacgctgaggtgagaggntcactagaccccaagaggtggaggttgcagtgagccacgatcatgccactgcactccatcctggacaacagacgcaaccctgcctcaaaaaaaaaaccaaaaaaaaaacagagtatgtccaagatggccgaataggaacagctctggcctgcagctcccaatgtgattgacacagaagacaggtgatttntgcatttccaactgaggtagctggttcatctcactggaactggttggacagtgggtgcagcccatggagggtgagctgaagcagagcggnggcatcgcatcacccaggaagtgcaaggggtcgggggatttccctttcctagccaagggaagccgtgacagactntaccaggaaaatcggggtacttccgcccaaatatttgtgcttttccaacggtct

SEQ ID NO: 511327 - DNA, 261 bp, Homo sapiens
  misc_feature (69)..(70): n is a, c, g, or t
gaacctcctactcctcattgtacccattctaatcgcaatggcattcctaatgcttacctaacgaaaaanntaggctatatacaactacgcaaaggccccaacgttgtaggtccctacgggctactacaacccttcgctgacggcataaaactcttcacctaagagcccctaaaacccgccacatctatccatgaccctctacatcaccgtcccacctctagctctcaccatcgctcttctactatgtagcccccctcccca

SEQ ID NO: 511328 - DNA, 783 bp, Homo sapiens
  misc_feature (39)..(39): n is a, c, g, or t
  misc_feature (46)..(46): n is a, c, g, or t
  misc_feature (51)..(51): n is a, c, g, or t
  misc_feature (198)..(198): n is a, c, g, or t
  misc_feature (216)..(217): n is a, c, g, or t
  misc_feature (229)..(230): n is a, c, g, or t
  misc_feature (234)..(234): n is a, c, g, or t
  misc_feature (256)..(256): n is a, c, g, or t
  misc_feature (301)..(301): n is a, c, g, or t
  misc_feature (305)..(307): n is a, c, g, or t
  misc_feature (310)..(310): n is a, c, g, or t
  misc_feature (315)..(315): n is a, c, g, or t
  misc_feature (318)..(319): n is a, c, g, or t
  misc_feature (322)..(322): n is a, c, g, or t
  misc_feature (325)..(325): n is a, c, g, or t
gtatgttgcagaaatccggcaatcgagctgaggacttgngagccgntcagntcccgggacgtatggagctgctgctaaataatttctgctcagccatgtcgccggctccagatgcagccccggctcctgcgtcgatctccctgtttgacctcagctgcggatgctccggtctttcagggcctgagcctggtgagccangcgcctggggaggctctnngcccgggctccnngtanttcctgttcaggctcagggganagagaaagcccagaaagaaagctactccagggtcctatggatatntcannncangtcantcnngtncancttgtgaccagaccttccagaaccaccaagaacagagggaacattatacagcttgcactgggcatcggtttaacctagaagcaacgtcctcaaggaccaagccgtctccttgtactgccctgggactttgcaacacagcagagctccaccaggcagatcttcccaagcattctcgggatcagaagactcagactcaggcaagtgcaggaggacttggcacgacacactgggatcggggacgagggctacattggagcaagttgagccgaaccctaaggctttgtaccctcattcgcagttccttttccagaatggccagtggcaagtatcttaatgccctaccggttggtgccctagggcctccatacggatccccagaaagaggcacaactgctgctacatgaactgcaatgtataggtccagaagctgggtggtgtcctggtgcagctgggatcta

SEQ ID NO: 511329 - DNA, 300 bp, Homo sapiens
ccagaggattcgtcgaccggaagcatattttgtaacagccactgtgccacgtataaaaagacctggtttttgctattcaggagcttgtgctctggttaaactgagtgctaagaagtgctggcagactgctgtgaaggtgaaacaggaatacagagaatagagaaatggggaagggcgtctgtgttcgaaacccaggtctgctcagaggtcaagcaagtcggagtcagaaaaagtaaagtctttaacatcgagttttccatatttatttgtttacaatgcgtcacattctgcttccggtcg

SEQ ID NO: 511330 - DNA, 867 bp, Homo sapiens
agcggggggtgctggaccagagctggagtgcatgtggcgcgatctcgagctcactgcaggccatccgctctacacaggggtgcaggcgattcttctgcctcggcctcccgagtaggtgacagcgggcatggacatatgccccaggacttgcctgctggaggtccatccatgagcactgacatgggttgcctcttcatgagatgtcgcccgatgacactgaccctggaatggcttggcttgagaagtcttctctgtgaggaggagcttacggcgtcaatgctgagctgagccagctgcagatttaccgcgatgccttgtcgtgagcatcatctacaatcgcgcagtggcagtatagcgattgggagccagatctgcaactacgtgacttcgcgtactagccaagggtcgcacatatggaaggtactcattctcttgggcctggaatcgcctggaccattgtgtgtgtcatggcccatgacctggcggtgcccaatgtggcggaaggtaaagcatgggtccgggaatcggggtctgagaggcagtcgatggagggcatgatggcttgatgccctctccgcaaaggagtcactctcgtaacaccgaatgcagattgcaatgggcgagcctggaatgatggcgcactagcgagttcgagacagttgagtgagttgcccgatgtatctggcgcgctttgtctcctggaaacgcatcctgatgggaacacgtcctggaggtcgtatcttccgagcagctggttggtccaccaatctatgccctactgggtattggcctggctcccccagggggcgcacgccttactcctgcttgagctgactggccaagccgggagaacagcttctagggatc

SEQ ID NO: 511331 - DNA, 286 bp, Homo sapiens
agcggctcatcatctagtctcattctgccttttatactggtctaacacagcaaagtatacagtgcatttgaacaactgtacactaacatctgaaggctatatatcctttaatcacatatatatattagatctacacaatactaaccttagaaaatattataactggatatttcttccaaaccagcatgtcctggcatgcatggtcccatcaagcactaatgcaagcaagtcagtaaaaaatgtatggcacagtttagcctggcacacaatttgtagctatatggtc

SEQ ID NO: 511332 - DNA, 410 bp, Homo sapiens
cccaccgaaatatccgggcccttgcagttcagcaaagaggcagaccagggcccaactttggaacagttatgccttggagccttttccagatgccttggagtcaatccccatggccctttcagaaaatagtggcatgaatcccattcagaccatgactgaagttcgagccagacaggtgacggagtctaaccctgccctggggattgactgcttgcacaagggcagtaacgatatgcagtatcagcatgtcatagaaaccttgattggcaaaaagcagcagatctctcttgccacccagatggttaggatgattctgaagattgatgacatccgtaagcctggagaatctgaagaataaactgtaccatttaccactgtgactaaataaagggtgtgtctgttgtgctgaa

SEQ ID NO: 511333 - DNA, 368 bp, Homo sapiens
taaagcctgaagtagaagtcaacaaatgtatttccatctacgtaaattgggggtacatgctcaaaagcttttttactgaatatttaataaataaagaaagtttggagaccaccgtatcagcctacagatgccaaagttcatcttttctctcgaggtgtccgctgacgctacagcctcagcccaagaaaggaaaggttgggaaatgataactaaagggtacaaggtctcctttcaaagtcataaaaataatccaaaattgatatgggtgatgcttgcacagctctgtgaatatactgaaaagcatgatttgcatattttaaattgataaaatgtgtgttatatgaattatttctcaataaaactgttac

SEQ ID NO: 511334 - DNA, 152 bp, Homo sapiens
gggccaaagctcatctcagaggaagcagcttcaggaaagggccaaaggccatgcaggagcggggtttcaaagtcataaaacaacactggggcaaggggtttcaatgcaaagcagcaacaacagcaacagaagcaggggcaagggcaggccct

SEQ ID NO: 511335 - DNA, 116 bp, Homo sapiens
cacgaggtttttttcatttttcttattgtctttttttcagactgaaacaggagtgctttatggtctgattgccctgtttgggaggattttctcccggttcctgacttctggctcac

SEQ ID NO: 511336 - DNA, 213 bp, Homo sapiens
cagacgtgggcgtcagaagctctctggcctggtccgaccagcatcgtctaatgtgaacttgtgacactgtggtcttcctttccccagcgcccgtgagggccagaggcagatgtggggtacaggctgcacagcccgagggtctctgtatgcgggcgctgggccccgtcatggggctcacatggtggattcacattaagccggtttctgtgggca

SEQ ID NO: 511337 - DNA, 210 bp, Homo sapiens
ccgagcgcccctcggctgccacccgcctcgctcccgctttcacgcctcgctgcctaagcctagccgcccgctcgctcgctctccccttcagctcgcccatcatgcattatctaccggggcaccctcatcagcccacgcatgcagcatgctttctccgcacaatctaacaagcatcccgggcgcatcgcggcacgggtttgctgccctggc

SEQ ID NO: 511338 - DNA, 1272 bp, Homo sapiens
tgcccccttctgagggtctccctggcgccccgggcgcctttctctgggttatcctttcgcgggcccggtccgttggacgctttcgcgtgggccttgcaccccccttcccgcctcgtccccttgtcgggccccgtttatgcccgcctttctgtatcgccggggccccgtaggcccacggtttccgcttggccgccactttctcccgggggcgcaaccctctcatgcctttgtccgggcattcctcccattccggcgtggttcccattccggggttaatacctgggccccctcccccgattgggcccctttgtgaaagcttctttgtcgtagattttttccgggtccacgttcgcccccgaccgaatcccgactgggttccttgtttacaccgcccacggtgattttgggccgttttgtcttcctctgagggtagatggccccctgcggggtgaactttttcccccccccctaatctcccccaaggggcgtatgtcctggcctttgcaatgcccgcgggcccccctccccccccccccgctttaatttcgccccctctccgtgtctttttgtccccccccctctttgggaactcttcccccggtttcgcggtccccagtcccactgcggtggggtccctcggttagaggccccacggagttgacgcccccggttgccccccctttttccggggctcttgggggttgacccccctgcgcccgaggcgccccttgggcccgcgtgtcccgagacctgcttggaaagagatatgagataatggtccacccatccccgcgcgtctcttgggacgcccccttctcacccctccaagcccccctgggccccacgcgataacctccattcttctgcacccgccgcgcctggtgccccccccaagggcccggatcccctccccccctgtgaagggccccccttattgtaatggaaggtgcgccccttggtgagagcctctgttccccgatcccgatagtgtggcgacaccctggccatccactgggtccacacccccctgggccagccttttaccccggggtcaccccgagagagatgtgggaaaccccccctgtagaccttcctgtgagagaatgtttgggatccgaccagggatccccatgcaccagctttgtagggcctctatcacccaggcctatggccgggtatgaagcgtcggggccggggtcttataccttcctgagattctgggaaaggtgctccaagatgtactgagaggaggggtaaatatatgttttgaga

SEQ ID NO: 511339 - DNA, 276 bp, Homo sapiens
  misc_feature (69)..(69): n is a, c, g, or t
tgaggaccccactaccgctaagaaaccctcttgaaagcccttgagcatttgttctgtgtttagaaaggnttgagattcagagcaagttcagagttggatggtctaagaatggaaaagccctccattctattagaagagccaggtagcaatttctggttatggaaccagaagctctcaggcttcaaataaaacagcatcacttgtactcttataaaactgtaaaaacagaaaaaccgaaaccgtatctacatctgtcctataaggcagagagtactt

SEQ ID NO: 511340 - DNA, 349 bp, Homo sapiens
caatcaatcagacctgagctagctctaagtggacggagatgctgaacttgactccctctgcagctcacaccatttacccagcttcctcaatatttatagcatgaatagccatgaagttttctgtgctcttgatgaaaggaggaagctggtgacttctgaaaaatattttgccactgtctcatagcaacagatgttccagttaaatatttgggagtcgtgaactgaacatcttctgtactgatacggtgtgatgttagtcagtggctccagacagttagcaggaggctgccaactctaagctttttggcagtggggctgcaacaggtccccagggttctctgcttcatct

SEQ ID NO: 511341 - DNA, 1039 bp, Homo sapiens
  misc_feature (667)..(667): n is a, c, g, or t
ggccgctggttccgtctgttggggggcgaagcaagccgggtcctcgtcgtgtgaagtaagaactctgctatagaggaaatggtgcttcactcatgcatcctacctcagctggtgcgggatcatgtggaaggattctgtgcacgtggcatctggattacagtggtctcaacgaccgtatgccctcactgccagcggaaatgctcgcttttctcaccttaactcccgaaatggcaatgccttgggagagcatgttactaatgatgcgctctgagaagattcactctggcgaaagttctgtattattagacatatcacagtggtcatccaaggcttaaagcagggtgaacacatcgatcagtcaaaagttaagctcgggacttggatgagatactacgctggattatgcgcgctagaaatggatgcatcggaatgggcatagaactggaagtggccagtggtgttaagacacactagtacgaagctatgcgttgcttggtgactttcaaccacccttcctattcaatgcgttttgaagtaacttgccatgagaattgggttcagcgctcctggatggcgtcaacgtcacagttggtccaaacatgcccattgggggcggggaactattacatgcatcaaggacatgtgaaccaattagtccaattgcccnagtaaggattctcatcaggacataacgattcacttgaaattgtgctgtgaggtggccgaccaattttggttactgtgggtttaacctccagttattctaatttcaccaaggtgagaacaaaatgactttattattgatggtgcaattcttgttcatggggaaaatgctgcgagcgattattttgcattggtttaaaagaagcttattgtgggaaaaccaggatttaagaggaaatcccagtttgtcaagtaggaacccaggggagggaatggagggatataaggaaagaataattcccaaaaaaattttttcccacaaaagtccaaaggtaaaggccattaatattccaggaatttagggcgaaactggaag

SEQ ID NO: 511342 - DNA, 184 bp, Homo sapiens
gctcgtaccgacgacagggcgactcctcgaacacgtggcccgcttcttcaaaccccgtagatgccaccgatcacctgctctggacactggatctccacataggtagatgtggctccatgacggcgtggctgggcggtcagcacactggcgtagatggcagcgcctgtgctgtggcggatgatct

SEQ ID NO: 511343 - DNA, 1276 bp, Homo sapiens
  misc_feature (357)..(357): n is a, c, g, or t
gaccacgcttttcatctgtcccgctgcgtgttttacctcttgatcgggaagctcctgcttctccttgccctcgatcatgtgagccccaaactgtctccgtggctcgaccatgtttggtctactcattgtgccactgatgtccgtgctccgtagcagaatgtcatacacgcagtagctagagatgtcgaccttcgctgcaaggatagagcttgcttgctcgcatgctgccactgctggggctgtgacgcgaaggtgttgcctccagggacttgcatcatgcgaagaagggacgtgtccggacgaagtgcagtcctgtctgtgcgctgtatgcccgggacagattgtgtgactctcagnatgctgacgatagagacataatctactttaaatgctggcactttctacttcttttcatggtgtcatcgtggggagcaccccgtgtagcaccgggtttgtttgcaccttagaccttaatgtttcccttgtgagtgaactgcctctttgtccagtatgcgggcttgtcaccattggccaatgtgtgacatactttagagccaacatatatcaaggccctttataaaccctttttggcatgggaggcttttgtggcttaattgggccaagacttagtccacccggaatgatgagggccaattctttgccaaacacggccatgtttgtggcccatgtggccattgtgtggggacaacgccctccagttggagcgccatttgtgttgtggaacctagttccatgtacccctattggagacggacaacctctcggagttgggtaattggccccttcgttattaggcccattctttgtcgcttgttggtcaagttgtcccaatttccaggtcttttcaacacaaactttacacgggacaggacaaaataaacccagggaatttacacgcttcccaaatttgggattggtgaaccaaggtacccggttgtccttttcccttgcgttgatgagaaattcccaacagaaggggaagatatctgatttttctctcacacgacaaagagttttgttcaacactcaccttatgtgggaaggggcacacgaccaagggggttcttcgagaagaaaggcgccacccccacgccagcactctgcccagatgacgagaattttgtgagagacaacacactgtcggcggagattctcccaaaaatatttcctctgggtgtgcagagtcttcaactgggggggaggttgtggccgtccccccaacgagtccctgtgttcatcaagcgacgcgacaccg

SEQ ID NO: 511344 - DNA, 232 bp, Homo sapiens
cagcacagcacagcgccgacagcacagaacagacagcacagcacagcacaacacagacagcacagcacagatagcacagcacagcacagcacagcacaggacagacagcacagcacagcacagacagcacagcacagcacagcacagcacagacagcacagaacagcacagacagcacagcacagccccacgaaagacaccaagcagtattgtgataacatcaggtcgacgc

SEQ ID NO: 511345 - DNA, 184 bp, Homo sapiens
ccttccgctggccaaatggcagtgatctcattctgcatctgtcggcaatgcaggatacattgtggtgctgcagacagcactgtgttggcgtacaggtctttgcggatgtcacgtcacacttcatgatggagttgaaggtagtttcgtggatgccacaggactccatgcctaagaaggaaaggtg

SEQ ID NO: 511346 - DNA, 112 bp, Homo sapiens
ctagtctttggtaacctttgtaactggtaaactttgttgtgctctctgtctgtgtgaatttgcctattctaggggcctcatataagtgtaatcatacagtatttgtcttttt

SEQ ID NO: 511347 - DNA, 372 bp, Homo sapiens
  misc_feature (34)..(34): n is a, c, g, or t
  misc_feature (67)..(67): n is a, c, g, or t
  misc_feature (84)..(84): n is a, c, g, or t
  misc_feature (149)..(149): n is a, c, g, or t
  misc_feature (154)..(154): n is a, c, g, or t
  misc_feature (227)..(227): n is a, c, g, or t
  misc_feature (300)..(300): n is a, c, g, or t
  misc_feature (331)..(331): n is a, c, g, or t
  misc_feature (347)..(347): n is a, c, g, or t
  misc_feature (364)..(364): n is a, c, g, or t
aattgatctgttttggagggtgctatagtgccangcagttatatattttgtttttaaaagggggggngccaaaaaaaccccagngttagcttaatcttaatgtctggggtttgtcatggggaaattataactattccagggttgggganccccnaatatgttctctgaatgagcctttgtgctttttgtcatgttatgcagtgaactatttttaaggtctaaccagngattatttttccagccccgggtttttttaaggaattttttcccccccgggccctctttagcagtttccccagngatggaatatcatgaatgtgggtccttatgnagctgtgggcccttgngcaaataaacttccagntttgccca

SEQ ID NO: 511348 - DNA, 316 bp, Homo sapiens
cagtgtgatgactgaagacgatggagtgatgtggccaccaggaaggagccaaattatgtctgcagtaggagtgggaagaggcaaaagatggaagcgctgaagcccgccaaaagtcaatcagacctgcggacaccttgactgtagaccattgatatgggtagtggacttctgatgtccaaaactctaagataatagagtcgtgttgtcttaagccaccaagttggtggtaactagttacagcagtaatatgaaactaatacacatgtctaccatgtagtacatgggaattcaatcaaaccagtcacatccgtactgg

SEQ ID NO: 511349 - DNA, 1208 bp, Homo sapiens
acagagcctcgccatttgccagatcctgccgccctgtccacaccctgccgccagctcaccatggatgatgatatcgcctgctgctctgtcgtcgacaactggcatccgtgcatgtgcaatggccggcttcgctgtggcagacgatgcccccctgggccgtcttccccatccatcgtggggcgccccagtgcaccagggcgtgatggtgggcatgggtcagaaggattcctatgtgggcgacgaggcccagagcaagagaggcatcctcacccatgaagtaccccatcgagcacggcactcgtcaccaactggtgacgacactggacgaaacatctggcacgaaaccttctacaatgagctgcgctgtggctcccgaggagcaccaccgatgctgctagaccgaggcccccctgaaccccaaggccaaaccgcgcagacgatgagccagatcatgtagagaccttcaacacacccagccatgtacgtctgctctccagcgcatgtgcatactccctgctactgccatctggccgtaccactggcatcgtgatggactccggtgaacggggtcaacccacactgtgaccatctacgacgggtatgccctcccccactgccatcctgcagtctggacctggctggacgcgaaccttgactgataacctcatgaccgatcctcaccgagccgcggactacaagcttcacaacacggccgagcggaaccgtgcgtgacacatcacgcagaaagccggccacgcacaccccgggacccgacgcacatgatggcccacgagcggcaccagcacaccaggagaagaagaaacgccccccaccggcacggcatcacagcgccacccaccgaaccgcggcgcgagagcccgccacacaccaccggaccacaaccggggacccccgaagagccctcaagcccaccgacgcggcggccggccgtccgcaggcacggtagcgccgagcgcgcttcggcggcccaccgtgtcacgacgtgcgcggggggccgcggcccgtgctccaccgaaggaccagagatccggcgcgacaggagcacacgcggccaccaagagtgatgaacggccgactggcagcgctgattaacgtgtttgttctgccactctctcggtcgtcggccatcaaagcgacccgacagcgacagcggaggaaacgagagaacagccggccacgcggcaagc

SEQ ID NO: 511350 - DNA, 106 bp, Homo sapiens
gctgttctagaggatcccaagtacgcactgactttcccgtattgaatacaagtataatattaagtatgcatggacctctagagctaatggaactcggtcagaggtg

SEQ ID NO: 511351 - DNA, 364 bp, Homo sapiens
  misc_feature (359)..(359): n is a, c, g, or t
gatgcctagcttccgataactctcacagtggaagaaggcaggaatgtcaggcctctgagcccaagccaagccatcgcatcccctgtgacttgcacgtatacgcccagatggcctgaagtaactgaagaatcacaaaagaagtgaaaatgccctgccccgccttaactgatgacattccaccacaaaagaagtgtaaatggccggtccttgccttaagtgatgacgttaccttgtgaaagtccttttcctgggctcatcctgggcttcaaaaaccacccccacttgaggcacctttgcggacccccattccttgccccgccaggaggaacaaaacccctttttgattgttattttttccntttac

SEQ ID NO: 511352 - DNA, 848 bp, Homo sapiens
  misc_feature (9)..(9): n is a, c, g, or t
  misc_feature (70)..(70): n is a, c, g, or t
  misc_feature (158)..(158): n is a, c, g, or t
  misc_feature (174)..(174): n is a, c, g, or t
  misc_feature (201)..(201): n is a, c, g, or t
  misc_feature (215)..(215): n is a, c, g, or t
  misc_feature (228)..(228): n is a, c, g, or t
  misc_feature (247)..(247): n is a, c, g, or t
  misc_feature (253)..(253): n is a, c, g, or t
  misc_feature (256)..(256): n is a, c, g, or t
  misc_feature (283)..(287): n is a, c, g, or t
  misc_feature (296)..(296): n is a, c, g, or t
  misc_feature (298)..(298): n is a, c, g, or t
  misc_feature (305)..(305): n is a, c, g, or t
  misc_feature (315)..(315): n is a, c, g, or t
  misc_feature (347)..(347): n is a, c, g, or t
  misc_feature (350)..(350): n is a, c, g, or t
  misc_feature (353)..(353): n is a, c, g, or t
  misc_feature (355)..(355): n is a, c, g, or t
  misc_feature (381)..(381): n is a, c, g, or t
  misc_feature (421)..(421): n is a, c, g, or t
  misc_feature (430)..(430): n is a, c, g, or t
  misc_feature (456)..(456): n is a, c, g, or t
  misc_feature (462)..(462): n is a, c, g, or t
  misc_feature (472)..(472): n is a, c, g, or t
  misc_feature (474)..(475): n is a, c, g, or t
  misc_feature (492)..(492): n is a, c, g, or t
  misc_feature (503)..(503): n is a, c, g, or t
  misc_feature (505)..(506): n is a, c, g, or t
  misc_feature (510)..(510): n is a, c, g, or t
  misc_feature (512)..(512): n is a, c, g, or t
  misc_feature (590)..(590): n is a, c, g, or t
  misc_feature (628)..(628): n is a, c, g, or t
  misc_feature (631)..(631): n is a, c, g, or t
  misc_feature (648)..(648): n is a, c, g, or t
  misc_feature (710)..(710): n is a, c, g, or t
  misc_feature (737)..(737): n is a, c, g, or t
  misc_feature (753)..(753): n is a, c, g, or t
  misc_feature (793)..(793): n is a, c, g, or t
ccacacaanacggggtcacacaaaaatttgaaaaggcggagtgaggagacgacggtaggaggcgccacancctggccggcgcgcgagacccaggatgtctgcctccaggaaggactccatctgtctccccgtaatgccctccacgcgtcccaggcccnccacctggctgaaggngccgtggagcccccgccagcccacgantagctgggcctccnccgggccaatccnctgaagactgccgagaccncgggcngancctccgtccagcagacccagtattttnnnnngcccataancnagtagcnccgggctganctgtagcccccagcagtcctcagccttctccncangcncnagggcatccagggactccagcctccnctcccggccttcatcctccaggatgtggatctcggcattnggggatgcngcctgcccctgaataagctgtagggncatcancacacccttnannaggggctttgccctgtnaactgtccgangnnaaangngccggaccattgtgggacaatggttctcctttccctcagccttctgggccaacaccttggcctccagtcctctttgcntcgcctaaagcctctcaatctctaggtcctcctctccnacngtcttcattagcaccanccgctctcgctttggggtactcaacacacgggccccctggctcccctggcaggcaagccganggtccaagccgaggaggcgctccagcntggccgggtccatgcngcttagcttctgtcgggggctgagtttctgggaggcagangctggagccgccatgggctcagggctcccaatctcctctccctcagggcctcggg

SEQ ID NO: 511353 - DNA, 112 bp, Homo sapiens
ctccaatggaatccaagacctggttgttttggaaggtctgctccaccatctaagagcactgttttttttttttggtgatggtgttgtttacgggctttggaaggaattttat

SEQ ID NO: 511354 - DNA, 341 bp, Homo sapiens
gttgatattgaatatgcacttcatgcagcatggacagcacaggtggctgcagtcccagcaagggcatgtctggcattgttctgtgcgctgctgtccctcctcacagcaacaacaactggcagcagcatggtgtgtgggcatgcccgcagcatctctgtggaagtcttgcaagcaaagtggtgcggtcacgtgcaggtggcatcagcagccatcagctgtgtgcagatggttctggccacacgcctggcaagcagttcctcccaatgcaggcagccgggatgctctattcatgcagagttatgttgtacaggcacagcatctcgcactcacccagaccacac

SEQ ID NO: 511355 - DNA, 320 bp, Homo sapiens
cagagatgatgccactgcactccagcctgggcgacagagcaagactccatctcaaaaaaaaaaaaaaaaaggctgttgaattcaggcagggcttttaaaattccgggcccaggtgattcggtaactctgggggcaccctgggatacgggccctttccataggcccttgcaattaacccttctttccttcaatttatatgcacttggggcccattgtctcttaacattctcctttacccatgttttaacaggggccggtgtaaagagccttcacccatgggaaccagtacaacccggcggggggggggggatcctctaaga

SEQ ID NO: 511356 - DNA, 1060 bp, Homo sapiens
aagttctagtagtgatgcttggttgttaatctggcactgaggctagccttccattgcttcctgctccacctgccgcctttgacaatgcagcctgcagagcctgctgagctgctggatcacgctcgatcttgggcttctcgtgcttctcgtgtgcctgctgccctgtgcgcctgctgtgtctgtctttgccctgatgttccatgtgcatgctgccctgatgtgcctgagccctgatgccctggtgctgatgccacgttgcattcatgtgtcactgctgtgtctgacttgcccctgtgtgcactgcctccctcatcctggaccatcatctggtgctgtgtggcccagatcattgatcttgatgatgcttggtcatctgattgtgaccaatggggattgcatgaacccatgtcatgctgtgaattgccttgttgatcttgttgccatgattgcactgccagaatgcttggtctgtgtgtgcttgaaacaaaaatagacctcttacctgacatgtgaaatgatgacatgtgcaagacaaattgataaagatgaccaagaaaatgcatgaatgaccctatgagaacaaccaaatgttcctgatgtgcaacctgagttatagccctgtggatgttgccaatgcaccgggtaggtgaaccatgatgtgacccctgaaaagcattgaaaagctaccagacatgtggcaattcccaagaaggcatcaattatgaggctccatgaacgtacacaagaaataacccagacaccaaaaactaagatgaacaccatctgtaagaactgttccatcattgtactgtgagaccaacatggtatcatccaagtcaaattggccattggcacttggtttatggaattgacccaaccattaaaaggatccaatacaaagtacaggtatgaaaatgtaagaaaacaagaccacaaaggtagagaaaaaaagaaaaagcacaagaaaataataacatatcacaaagaagaagaagagacgaacagattgactacaagattcttatgccttaatataaatgacagtagtatagaaagacga

SEQ ID NO: 511357 - DNA, 229 bp, Homo sapiens
cgaatccactgtcaaatgctccctgctggggtttcctggagtctctccccaagccaggggcttccctagtgccagctgaacatctttcccaagcacgacaaactcactggccacctgaacaaattccttagctgatgtctttctctatcgaggccagggtccccagtgccattcccacctctcttaaatctctaataacacactggctcgccatcttggtgttcctggg

SEQ ID NO: 511358 - DNA, 648 bp, Homo sapiens
agaagtatttagaaagaataggatggtcggaaaaggggagatgctggaaagatttggggaatttaactgaaaaagtcctctttgaacataagcccttataatgatatagtatccccaaaatttctctatttcaagagatatgaccaaatctcaagaaatggaaatatcctatatccaacaaataatcaaatgtaagtcccaaaataaaagagtataaatctgaatttacctaacggagatatgctaaacatgctttcttttaaaaatcatggctcacacctgtaatgccaacactttggaaggctgacatgggcagtcacttgaggtcaggaattcgagaccagcctggccaacatggtgaaaccccgcatctagttaaaaacacaaaaattagctgggtgtggtgctgcatgcctataatcccagctacttgggaggctgaggcgggtagattgcttgagcccaggagttcaagaccagcctgggcaacatggcgaaactccatctctacaaaatatacaaaaaattagccaggcatgctgatgtgtgcctcttgtcccggctactcaggaggctgaggtgggaggattgcttgagcccaggaagttgaggctgcggtgaattgagatcgctgcactacactccagc

SEQ ID NO: 511359 - DNA, 154 bp, Homo sapiens
ccgactctatgaggatcccctgccatttactccatggctgggcaacagagtaagactccgtctcatgataaaaatataaaccaaacaaaaaaaacggggggcttttttgcgggggtaaaaaaacacgtgagcggggcgaccccgtctttggggg

SEQ ID NO: 511360 - DNA, 876 bp, Homo sapiens
tacccggtgaccgggaccaacagggcccacggccccggcccgcaagaagggggtcccccacccgggttcgccaaatgggggcacaccggactggccgccgcgctaagcctgtctttgacggggtcgcccgaaagggggacaaaaccatcgcgcaccgggggtccaaatagcaacaacaaagacaatgtgccgccgcctggcgcaaacggcgacggcacaccccgtcgagggttcgccgccccgggtccggtgaataccacgcccctcctgcggataagaacagtgcgccgctggcgaaacgagtgagtagtagcaaggccgccccgggcgagtggtaaaaacgacgtttggcggaagttatcgacgccgtcgttgaggaatatgcactggttggctccccctcgggatattaaacacggggcaagagggttggtatggtctctgcggagatttcttattacaagcgctggccaacgacacccggggttggatgttccctcttcgccgggggtctagtcacagagggtgtgaaaattccgaccacgcctttgagcgtccccgtaccctcctttctttgcggaaatactacatgggcgccagaaaacccgcgcgcggtgttaaccatgcgcttgagtcgggagacccgctgccgattagcccgcgctaaagggtagagtcacgagtgatacattaaatgtataaagggtttcttgtgcagaccacacatctgtggagtctcctttagaagaagagcgagcccacccaattgttgcgggattatcactcggtgatagcgcgtgcgaaacaccattcggcccccccgcaccacaccccctcctgtgcaggaggaaaaatcaaaacccgccgccccacata

SEQ ID NO: 511361 - DNA, 719 bp, Homo sapiens
  misc_feature (323)..(323): n is a, c, g, or t
  misc_feature (345)..(345): n is a, c, g, or t
  misc_feature (467)..(468): n is a, c, g, or t
  misc_feature (537)..(537): n is a, c, g, or t
  misc_feature (543)..(544): n is a, c, g, or t
  misc_feature (553)..(553): n is a, c, g, or t
gatagcccctggtaatgactagcaggagaaagaacagaatcaccggatgtttgggtttggtattgtgcttattttcctctgtattccttccaagttccttctttgataatatctgatggcgaaacttcctcaatactagaagacctgtagtgtgattatgtgctaacactcagcaaaaactaggttgttgtatgtgtcgcaatagggatgaatttaccaagacattcccttctttatgttgcgcctcttatatatttgtgcatgttccataaatcgacggtacatagacttccgtctgtatttgtctcggaagtatgacacancgttctgatatggtgaggactngctcttaataacgtcgtggaccagaatttctgtctatttgtagattagacgtggatctacgtttgagtgtaatagaatatttacaataggctctctactttaatagaaatgatcctatctcnnattagatttggtgttccttgctgatatgcaatataattccttttggcgaaatatgttatggaacccaangtgtcnnattttacangcgttaagagaccacagagcatgggcaaatttagatagtcccttgatttacatcctttgataacggaggtctgtgatcacaaagcttgatctaacattagccaggtcatcattagactagtcacatgcgtgttacctcattatcctttaaaacggttaaataccgt

SEQ ID NO: 511362 - DNA, 322 bp, Homo sapiens
catgataagtaaaatcctctgttgatcattatgctatggtcatgaattgaagatttatctatgtaataatccccaggtctcagctacgaagtatgaagagcgaaaagctgatttggcttagttgctaaactgttgggaaagctctgtagagcatggttccagtgaggctaagattgaaatatggtactaaaaaggccaactagctttttgcagataacaatacaaggaaagctattccaagactcagatgatgccagctgtctcccacgtgtgtattatggttcaccagggggaactggcaaaagtgtgtcaggggagaaga

SEQ ID NO: 511363 - DNA, 183 bp, Homo sapiens
agaatagcttatgggaaattactcttcaaaaggtctaggctaatttacatatcaatccagcagcctctcgtagacaagcttggttttctaatagcttcttttgggggcttttccccggtcctggaagaaccttctgggattttagtggtggattggtcccagcccttttggatttcgagagca

SEQ ID NO: 511364 - DNA, 856 bp, Homo sapiens
cgcggtggctcacgcctgtaatcccagcacttgggaggccaaggtgggcggatcacgaggtcaggagatcgagaccattctggctaacacaatgaaaccccgtctctaccaaaaaatacaaaaaaagttagccgggcacggtggcgggtgcctgtagtcccagctactcaggagactgaggcaggaaaatggcaggaacccgagaggcggagcttgcagtgagccgagatgagccactgcactccagcccgggcaacagagcgagactctgcctcaaaaaaaaaaaggaccggggggccaggcacggggctcaccaccggtaaatctcaagcattgtgggaggccaaggcgggaggatcacctgaggtcaggatgttcgagaccaacctggccaaattgaaaaaccccatctctactaaactatacaaaatttagctggcaaggtgggggggcacctgtaatcccagctactaaggaggctggggtgggagaatcgcttgaacccaggaggcagagttacagtgagctgagattgtgcaatgcactacagcccgggtgtcagaagcaaagagtcctctcagaaaaaagaacaagaagaggaagaaggcccccgcgcgtgaaacacaatatgggctttcgcagggtccaaccattctcacgtggtgtggcacatacaacggtttgtaaccggcccaccgtggggacccttaagaaacaggccggtgggcccgcgatcagcccaaaaccccgatttggggcaggccggggtaaagggtggttggaccgcggccaggggacctccttaacacacggggggcgggcgacacacagaggggactacgggggggacatcctc

SEQ ID NO: 511365 - DNA, 771 bp, Homo sapiens
  misc_feature (597)..(597): n is a, c, g, or t
gaggagctgaagccgtggccagctcgacgccggacagtccagcgagcagacacggcgggaaccggtcagccggagcagtcccggagcagaagcagcaggagcagcagtagccctcgtccgtttcgcggcgtcggctccgaggccggccttggtcgttgtcgatgccgctgaatgtggctgacgggcgcgagtgcacagggatgcccctcatcgggctcttcgtcaaggctggcagtgatggtgaacagcataggaaactgccccttttcccagaggctctctcatgattctttggctcaaaggagtgtatttagtgtgacgactgttgagcctgtaacagggaagccagcaggacctgctagaactgtggttcccggtgagccagcccagccattttataactttcaaccatgtgaaacgtcaacatcggctgttacaattaaggattggacggaatttctctgaaggaaagtcttatgccctcccaagtactttaaatgctttcacgcaaataatcacccagaatcaaattacctgctggaagtgggacgatctttgacaaaattcttctgcatatatcgaggcatattcccgggngcagaaggcttaatgcaaggcacttgcatgagggtggtctcctgaataaacctgtagaaactggcatgaaatatctgaaattctcctctccctttatgacacttgctgcaaattaggtttgggggacataaggtttagcgacatgttacctttcttggggtgggcatgacatgc

SEQ ID NO: 511366 - DNA, 319 bp, Homo sapiens
tcgatacgactttttttattttgtatgttattatgtgagacagtgtctctcacccagtctggaatgcaacagcgtggtctcggctcactgcaacttccacctcccaggttcgaaggattcttgtgcctcagcctcctgagtagctgggactacaggcatgtgacactatgcctggctaatttttttgttatttttaagtagaggcggggttttgccatgttggcccaggcaggcggatcacttgaggccagaatttgaggccagcctggccaacatggcgaaaccctgtatcactcttttagacccttctgtcgtcttc

SEQ ID NO: 511367 - DNA, 440 bp, Homo sapiens
ctccatataaagcctccatgctgaaataaaggaggagtcccatcttcgggtcattccacttcaggcttagatataactaatcccttttcttcttactttcctgtatggaagctttcggaaacaaaacaggcaacattttgtgatcataaatatcatagttgccacgcaggccagcaggaatgctatcgcatccaaagagtggtactggatccaggtgaggttgtgggctgcgacccgaacggtgcttggctcctttatggcgcatgacacactcaatccagaagacctgctcgatccagggcactacaccgcgaagatcactgctgaactacttgactactctcatgatattctcttaactagactcggtcattactgactgacttccatgccttgagcaaatctctacttgacaatggtcctgatagtcacactgcggg

SEQ ID NO: 511368 - DNA, 227 bp, Homo sapiens
caatgagacattgaggacacacactgatgtctgcatatgtggatcagagcagatacctagatctgttctagtctgtcataccggcttgtgtgatctcagcaaagttaataatcaaggtgggtgcaaaagtacatggtggtttttttggtcatatttttaaatgggcaaaaaccgcaattacttttgcgccattctaatatcccagagactcagttttatcatctgta

SEQ ID NO: 511369 - DNA, 714 bp, Homo sapiens
cgtaccgccttactgttccccctatgggttcttccccccgagccgtggccggagcttttgcgtggacccccgtaacttgggttggcaccacttcgagttcacttccgggccccgcaaaattcccggatctgccccctctctcgcgcggtggccacgagacttccgttgtaccccgcggggcggagagggtccacatgaacacaaacacaaggcccgattcaccaatcagcccttcgtggtcacacccgcaaggtcctcctttcccaaaagtaaaaaaaaaaaaaggccccggcccactggctcaaacgccgtgtatccccgcaaccttgggaggcttaagcgggcggatcacccgagggtcacacgaattttgagaacaagccctggccaacacccgtggaaccccctcctcgtgctggaaaatacccaagtagcccacgcaatgctggcacacagcccgtatccccgctactcgggaggctgaggtatcgagaatcgcctgaacccgggagggccgaggaaaccgtgaggccgaggagtcacgcccttgcactcccacccgggggaccaagagtgaatctgcgtctccccccaaaaaaaaagagaaaagaaagaatgcttaaccaaggttactctaagcccccaattcatgaccaccttatccctccctttcacatagaaaaaattcaaacccccaaaaattttccccgcttt

SEQ ID NO: 511370 - DNA, 142 bp, Homo sapiens
gccttcctgcagggctttctcggcgcggcctggggcaccaggacacgagggagcatgctcccgggtacgccatcgacacggtgcaggtccatggacaggagaagtacttgatcctctttgaggtgggcccagattgtctgct

SEQ ID NO: 511371 - DNA, 143 bp, Homo sapiens
  misc_feature (4)..(4): n is a, c, g, or t
ctanggggcacctagaagcagagttgaggctgggagcataatgctgtcctcaaagtgaagagtcaccacttcttgtcaagtcatgtcatctctgcagcctcgtgcattttgtaaactgggaagaataaacagacatttctgac

SEQ ID NO: 511372 - DNA, 203 bp, Homo sapiens
tgatcaaccaggacatataccagcagttgctgaacggaggttctgtgctgctatatactgtgtcgcaactgctgatgtgagcactgtgctcgcttcctggcttgaccgcttcgtggagggcgtgtgtcccttcagtggactataggaggctcggggagaccagtgtgacaaggtgtgtgcaacgctcaatcaatgaagacaga

SEQ ID NO: 511373 - DNA, 287 bp, Homo sapiens
gggttttaaaattgggggggggggggttttcccccctttgaatttattaaaaccccgggattggccccgtttaatgggggaattgggggggggttgaatttttttcccattaacccccccaaagtgggggggtccccccattgggaaagggggtaataccttttgggcccttttttttggcccattttttccccccctttaaatagggggggggttttttgaatttttttttcccctttctcttgtcccggggtgggtttttggttttttacccagaggccgaaata

SEQ ID NO: 511374 - DNA, 294 bp, Homo sapiens
taattttgcggccggtcgacctcttatgcctactatacattaggcactgtgctgcgtatcaagagtatagcaatgaaccattatcatagacaatggaattactgcaatagaggtatgaatagactacagcagtgggacaaaagaggaaaccatgataactcagagacccatcggtgataataggtaaccacagagaaggtttgatttcatgcctggtgcgtgtgaagcttcccacccaacttcaaggaactgggaacaaagtggagcttctcgtctcaaaaaaaaaaagtcgac

SEQ ID NO: 511375 - DNA, 472 bp, Homo sapiens
tctctactaaaaatgcaaaattagcagagcttggtggcatgtgcctgtaatccctgctactcaggaggctgagacaggagaatcacttgaacccgggaggcggaggttgcggtgagctgagattgcaccaatggaattccggcctgggcaacaagagtgaaatccgtctcaaaaaaaaaaaaaaaaaaaaaaaaaaaaagaagctcagcaccaccaaccccatcccatccctatttcttgtcttatgcatcttttccatttggctgtttctgagttgtatcctttataataaactggtaatagtaaagccatttcttgagttttgtgagctattgtagcaaactatcaaacctgaatgtgagtggatggtcataggaactcccaatttatacccagttacagttagtaagaagtacaggtggcaacctgggacttgtgactagtgtctggagtgagggtggtcttgtaggac

SEQ ID NO: 511376 - DNA, 1423 bp, Homo sapiens
gtaatatagcgtcatactattgtcataaggacactgtctcatacttcttctggttactaacgacgggtctttatataatgcccgttaatcgctctcgagatatctagtggcacgacacgcttcaatctaccacacggggttcttattggcggcgcacaaagaattttatgggaacccagcagtgtttttatcatcttgctcccaaattacggtgtatttttccccggggatcattaggaataatgtctcgcatacccctatgtttctctcctacaaaacacatggtatgcgtctttataatacttcgtccatgggtgtgtggatacgtcttacgattcaagggaatatatggcccccaaagtatttcgtctaaccgggcgggatgatagttaaaagctttgtcccctcttgtaaaaatcgcatcttttagaagcttcatggggatgcctctgccatgctaattccggcgctggaactctgtttaggggcccttataccatggtacaggcttcttcaatgccagggtttgtttctccctgtggcttttaccaataaagtccaggattttaataaatccgcgcctaaacctgtggatataacatcattcgggggcctcctgtgtctttcccataaattttaccggatattggtactctactggcctggaagtgcttaccaacttccctaggcaagtattaactggagcatctaaaaaggttttttggtggaagtctccatggacctatgaagggcaaaagtctgcctcaagctcctggactaattacaatggctaattttggctacaaagcgcactggaacagcaaccccagggtcgcataagaattatccttggcgcgctaagaggatactaggcaaaaactatgaggattatctgagattattcctgctggtactatttatctggagggatcgctttaggcttctattgcgaaataactactcgtaataccctttaaaagagccttgaagagcttaagccgagtactacagagttgatgccacgtgatgggataccctgagctagtagccattaggtaaatacacggtaagtaagagtgtttcaaagaagaaagatgaatggaatgttaagccattacttgatttggagcctcatagctctatctcgatgttaatctttcacattcgtctgggtagcacgttacacaccttaggtacagaattggtcgattctgcctgatacagtaaataggtgagtaggggatggtgcaagttgtaactgcgctttcatctatagaagcccctctgtacagatatatcacaattgcataagttgtaaagaatcactaagcagccacagttatgtaggtctgattttgaatgtctataattgcagtcgagctgagatcacgccattgcactccagcctgggcaattaaactcg

SEQ ID NO: 511377 - DNA, 259 bp, Homo sapiens
cccgactagccgacaggtaggcacacgctgagccagtcagtgtagcgcgctgcagcctataacggcgttgcctgcggcctgggacggcactctgatgaccgggtcttgttggatctgtgtgccttcctcaagaccattgcactgaatggttgtggaggacgtgcgaaccgtgcttgagcaactatgccctggaggatgacccgctgtcgggctagacggggcccaaattagccagaaggaaaggcatcaaaaaccccgg

SEQ ID NO: 511378 - DNA, 416 bp, Homo sapiens
tggaggaaaggattttgcactgttgcagaacgggcgagttttgaaagaagcaggcccacttgtggtgcccagggtcgactcaagaaagaagataccgccccacaattgcaagctttaactctcgggttcaaacgattatcctacctcagcctcgcgaaaaactgggattacaggggggcagcactatgcctggataacgcttaaatcctcagaccaggaagggtcctactatctagtccagtttcgtcttaaactcccggcctcagacaacccacccgccatggactccgaaatcgcttttattccaggcctttgccacccaccgggacaactttaacttttgaaatttgatttgtccggccttaaacccccgcgcttatattaaccactccccccttctccccatcatcttcttc

SEQ ID NO: 511379 - DNA, 272 bp, Homo sapiens
gttattattttttttatactccaggtagtgttctagatgagacagaggtaagaattaggggaatgggcacaattttggacatcaatcccaaagagccttagttaattacaggcactacgcaaatgacgccaggagtaacaacggaacttcacttttgttacgggatttttatttttgctctttttatagtatcagggagcaactgccttttaccaagcagagaatgcctgtttgatctagttgaccagggatacagagcgagccatatgtgg

SEQ ID NO: 511380 - DNA, 171 bp, Homo sapiens
agactatgccactcttctgctcaaaaacttcccaaagcttgtcacctcactcaggataaaaaaaaaagacctcagccaggcacggtggctcacgcctggtatccgagcactttgggaccccaaggcgggcagatcgcctgaggtcaggagttcaagaccaacatggccaac

SEQ ID NO: 511381 - DNA, 138 bp, Homo sapiens
aggaccgggaagagatagcgtgcagatcctctctatcagattgatctgcaggcatatctcacagatttcctctgcctgttttgcagctgctagaagatccctgccttccagaagtggtctgataccaacgctatctct

SEQ ID NO: 511382 - DNA, 170 bp, Homo sapiens
cggtcgacctctacgacggactccccaccactgacgagcttacctacgacacgtgtgacacacaccgtacggcttggacttaacggcgaccacgcgactttctacggactacgtcacgtacgacacttacgacacttgtgaccgactgactaacgttgtacgacggagac

SEQ ID NO: 511383 - DNA, 113 bp, Homo sapiens
  misc_feature (48)..(48): n is a, c, g, or t
gagacacggagcgccagggacaccgcacagattttccgagttaatctncggacgctgcgcggctactacaatcagagcgaggccgggtctcacaccctgcagtggatgcatgg

SEQ ID NO: 511384 - DNA, 1111 bp, Homo sapiens
aggtttgttatttgtagttattggtatgtaatgtattttttagtgtgtagatatttttgtgggtatttttttttggtgtattctatgtgaggtgtatagtttatttcgagtatggggggcatatatttttgggtgtatatttgtacatgttgtaatgtttgaggaaaacgttgtgagaatttagatggatacgggatcgggtgatattgcagagcttccctggtctggatatgatcgctgaccgatacttgggttatgccatttaatgccagcggattttctggaggaccacgtgtaaagctgcgatgtgactaatataaggtgcacacttccgggattcctttgttcttcaattttgagcctgagtgttttgaattaaagaggggtaaaggtaaagaagttgttgtttatctgtatcttttttgtttatgtctctttctgaattactaattatagtttataacatcactttcttcaaacaagactccaggtaatttgataagatgtgcttactgtatgcatggaattcaattgcatattgtgaaagagggacacatagaaaacagtgtctgtgaataatctaaattactttgaagcctactgaaaacttttatttatttgttttatttattctattttttggagacagagtcttgctctgttgcccaggcttaagtgcagtggtgcagtctcggctcactgcaacctctgcctcctgggttcaagctattctcatgcctcagtctcccatgcacctggaattgcaggtgcgcaccaccacacccaactgatttttgtattttatctgtagagatagggttttgccatgttggccaggctggtctcaaaattccatggcacgtcaaggtgatctagcacgtgccgtccggcgctactcacataagatgccatgcggtattactacggttgatgatgccaacatatagcaccatgcctagtgtgtttatatatctactgatcattagtatctgcagctttttgtgtggaaaaggaaaatgtgttaatgccttaataactgttattatggaggtaaggatttattgacttatctattatgccccaatacctcctgaggcaacacctatgtact

SEQ ID NO: 511385 - DNA, 205 bp, Homo sapiens
tgtggtctacaatcacttaataaccataattagggtggatgtggtggctcatgcctgtaatcccagcactttgggaggccgaggtggaaggatcatgaggtcaggagatcgtgaccatcctggctaacacggtgaaacccatctctagtaaaaatacaaaaatcagccgggcacagcggcacacacctgtaatcccaggtcgacg

SEQ ID NO: 511386 - DNA, 423 bp, Homo sapiens
cttctttctttttttaaagagacaaggtctgtgtcacccaggctggagtgcagtgataccatcgcggctcgctgcagcttcaaccttctgggctcaagtaatcttcctgccttagcttccctagtagctgggactataggtaccactgtgcccgactgatttttttaaagctttttagaggtggagggcttgttatgttgcccagactggtctcaaacccctgacctcaagcaagcctcctgcctcggcttcccaaagtgctgggattacaggcatgagccaccacacccagcctcaaaatatggcccttgttaaagagtgcttactatgactctgtgtccatagaaacattaaagaaaggtcacatagggctgggtgtggtggctcacgcctgtaatcccaggacttatgggacgcagaggt

SEQ ID NO: 511387 - DNA, 114 bp, Homo sapiens
gcgtcgacagatccttcttcatgtcctttgtgaagtagacattacgctctccccatcacgacgcaggagatgacatgtgacagtaagagggttacagcaattccccatctggag

SEQ ID NO: 511388 - DNA, 512 bp, Homo sapiens
ctcggtcctgtacctgggcgtatgactgcgtgtctcactcgaaggtactgggcataaatactatacgacatgtgtaagagtcataggagagagcagtgccttctacaacgccaaggacgtagaggcatgcgcagacggcccttccttgccgacctcagtaaagaaccaactctgctggaatctacattcgggatttccagcccacagtacggcaatacaatcacacgttctagactcagcaatctatgatgctttgctatggaagccctagcaaatgaatacaaagacattctaagtacaaagaaggggaaagaaacggaacgagatggtctcagtagagatcgaactcaggtgcagaatctgagtctcagcacaagggctactatgcagaagtgggtcacggactgagaacactcaggagctcggtgggcacaccgtcatggggactaggcagttccaaggattgaaatacggataagcaggtcgagaacagcgacatccagagaacttgt

SEQ ID NO: 511389 - DNA, 269 bp, Homo sapiens
ggccgagaatgtgccaggtctttatttaatcatacaatgaaatattacgctccattgtggatgctacataaatagcattatataggccgggtgtggtggctcatgcctataatcccagcactttagtgaggctgaggcaggtggatcgcttgaggccaggtgttcgagacgcagcttggtcaacatggaaaaagcccatctctactatcataaaaaaataatagaaaaatgggcggggtcgccgtcggtgagcggggtacgcgaaggct

SEQ ID NO: 511390 - DNA, 382 bp, Homo sapiens
  misc_feature (12)..(12): n is a, c, g, or t
  misc_feature (17)..(17): n is a, c, g, or t
  misc_feature (26)..(26): n is a, c, g, or t
  misc_feature (30)..(30): n is a, c, g, or t
  misc_feature (104)..(104): n is a, c, g, or t
  misc_feature (136)..(136): n is a, c, g, or t
  misc_feature (139)..(139): n is a, c, g, or t
  misc_feature (150)..(150): n is a, c, g, or t
  misc_feature (190)..(190): n is a, c, g, or t
  misc_feature (205)..(205): n is a, c, g, or t
  misc_feature (207)..(207): n is a, c, g, or t
  misc_feature (296)..(296): n is a, c, g, or t
  misc_feature (345)..(345): n is a, c, g, or t
cgcacttcggancaaanggtgctgtncttnctggcctccctctttggcgggaagattgccgtgttggagatcaacccggccgcgctagtcagggctcagcagtncccagcatggggcaggagcctctcggtgccanccnagctcctgtgntcctaccgacctctccactgtatctgggaattgccaaggngaagagtaccaaggntnttagttgaacagcggacgtggtcagtacagggtgctgtgagatctaaggaatacaaggcttgttgcgttcttcattgtggttagggctnctgcatttgctttgcggattcttatgttaaaatatgcattccgtacttnccttccatccttctgtccttcatgtctctgcctctcg

SEQ ID NO: 511391 - DNA, 291 bp, Homo sapiens
ctaatgctagaataggtctgaaggattagattataataatacattaatgcaaatttcctgattttaaacattggagattgattgcacaaggagaatggctttatgtgtggaaaatacatagtcaacattgtgtcttaaagcttctgaaaaaaatcttcttttagggcataaatagaagtggatgataattgacctgttgatttgctactaattgagctgctatctgtttccatggctagctcatgggatgagagaatatatgtagtttggtatgtttcaattctgctctct

SEQ ID NO: 511392 - DNA, 608 bp, Homo sapiens
  misc_feature (25)..(25): n is a, c, g, or t
  misc_feature (72)..(72): n is a, c, g, or t
  misc_feature (82)..(82): n is a, c, g, or t
  misc_feature (280)..(280): n is a, c, g, or t
  misc_feature (318)..(318): n is a, c, g, or t
  misc_feature (361)..(361): n is a, c, g, or t
  misc_feature (402)..(402): n is a, c, g, or t
  misc_feature (421)..(421): n is a, c, g, or t
  misc_feature (431)..(431): n is a, c, g, or t
  misc_feature (480)..(480): n is a, c, g, or t
  misc_feature (607)..(607): n is a, c, g, or t
cgatgcttgggatacaaccgctagnttctgccttccacacacagtggattttactgtaactgtcttgagttnctctggtgcnactgggttccgagccatgtctacggccgccactggctgctgtggctatttctgtggcctgactgtgtacactgggcttcgcttgttctttcattttacaaatgtgacgaggggctgggcgtggggccactcggggtacgactgtgtgtctctgcccatgggtactctctatctaacagcgagacgcggcacaaacggntagcgcaggatagcataacaagtgccacccacggtacnggctcagggtgctacgggggcctgcgagatggccgcctgggcntcgggtagctgggaaggcttcctggaggaggtgaggccctnggtgggggtgtgcgtgggncaggcaaaangcaggcctctcggcgcccatctgtggttcctcaacaccctgtgtgtgcnggcccctcagctgacctgtcttctgtgaaattcttgatcccgctctgttctattcacactgtgctgctttgccttggtggttagcatggttagctttcacaagcacaagctcacactcgaaaactang

SEQ ID NO: 511393 - DNA, 112 bp, Homo sapiens
gagaagtgactttatatagcttagttgaaataggttaatatggttgtgagtttatacagagacatgtgtggtttatctacgttgaagataataggagaattggtgctttagg

SEQ ID NO: 511394 - DNA, 804 bp, Homo sapiens
  misc_feature (10)..(10): n is a, c, g, or t
  misc_feature (63)..(63): n is a, c, g, or t
  misc_feature (67)..(67): n is a, c, g, or t
  misc_feature (73)..(73): n is a, c, g, or t
  misc_feature (76)..(76): n is a, c, g, or t
  misc_feature (80)..(80): n is a, c, g, or t
  misc_feature (86)..(86): n is a, c, g, or t
  misc_feature (167)..(167): n is a, c, g, or t
  misc_feature (171)..(171): n is a, c, g, or t
  misc_feature (175)..(175): n is a, c, g, or t
  misc_feature (207)..(207): n is a, c, g, or t
  misc_feature (221)..(221): n is a, c, g, or t
  misc_feature (270)..(270): n is a, c, g, or t
  misc_feature (299)..(299): n is a, c, g, or t
  misc_feature (305)..(305): n is a, c, g, or t
  misc_feature (309)..(309): n is a, c, g, or t
  misc_feature (331)..(331): n is a, c, g, or t
  misc_feature (339)..(339): n is a, c, g, or t
  misc_feature (434)..(434): n is a, c, g, or t
  misc_feature (591)..(591): n is a, c, g, or t
  misc_feature (607)..(607): n is a, c, g, or t
  misc_feature (637)..(637): n is a, c, g, or t
  misc_feature (691)..(691): n is a, c, g, or t
  misc_feature (791)..(791): n is a, c, g, or t
tgtgctgggngcgggggggctgcgggggcctttgtcatgtttctcagatgcggggggtctgcnaggntttggnggntgcngggctngggcccggccccgggcgggggctccgtgttccggggggggggctggcctgcgtgtgttggggtgggggggggggtgggggngggngggngggcggcatgcctgggcctgggggcgggggcnatgcccttcctggngcccccgcgtacacagctcctccaggggggtttctgggttcctggggcncttggggtcctgggaggcgtgtgggaggnggggcnggcnttgcttctcaccaggggcgganggggaggnccatgcatcccctgcctcccgcagtctcagggacatggcagatgtctgcgacagataatgggctgccctcgaactgaggcctgtctctgaggggnggctgtgaccggattcttccccgacagagtcaccctgggattcctcagagcaagtgctccggtcgcattccagatcatccactggcaaaagcatcacttcttacacgtggttttcagggaagtacctaatgcagaacgcaagggtggggtggcaggngcgaggctgtacaganacacagaggtacactgtacaaggccggggnggcctgggggtcactcaggtggccaaaggcagtggcagtgctgctgaagtgggntgctcccacccagggcccacatcttccgactgccccagaatctcggggggagcggcctgaaggcggcccgggtctcccgtgcccgggtctccgcacccgngacgtgtgcctaa

SEQ ID NO: 511395 - DNA, 1919 bp, Homo sapiens
  misc_feature (1457)..(1457): n is a, c, g, or t
ggcccgccgtaactgactcgctcgctccccgctctggagtctgccatcagtggatgttctcgcatgaagacaaatggaacctttgaacttaagaaccttatgaaaacgctgggtaaaagaccagactcgacagacactggtgatattatcttcaagccgcaattgaagccaatgttcctgtgaccctttggccatgggactacattgggcggcacaacggggaaaccgagcgtttagtacagcaatgcgccccaggaatactttccatataacaatatacagaaggttgcacagggtgagctaggaagaagaattacacaaccccacagtggcatttcctaagatacatcttgctacgaagccgacaacagcgtggaatcacaacgaacgttgagacaccaggccaggataacatagtggcttctcacgcggcatgaggaactacaaccacagggaagatacaagtacatagggggcgggaacacaacaccacgctcacgtccagaatatgagcaactgctatgcacagatccgtgcacaaagtccagatacagatgtagagcaaagaaccttacccccgtatggcaccgcgaggagaccaaaaatagacatacacacgcaaaaacagcacaggacgcacagaaactacagggacggccgaaacgcgacaaaaacgaaaccggtaggagaaactgccagacagccaagccaccacggctacacgacacgaacacacgattgagccaagcacagaacacaacccgaccacactaagaggaagccagccccagatagggagcaggggacagacgcccattgaaaccaaccaacggcaccgccagggacaccgagggcacacaaaccaccaccgccacgagcaaaagcattaggccagtaccagacaatcacccgagaggcgccgccacaggcggcggacacacagcccacatcaggactcgaaaacacggtcatcgggagtagcctgggggcttgcagaacttgtccgtgggttcccttcagtctacactaccggtaatcgggaacaccatccttgtgtggcaactgcacccaccaaggtgttatatggacaccagcagtggatcacaaaaacgcgcaccacagtaatgagcacgtaaagagaacctggtcggtgatcacaaagcatctagaggcaacagtgaacacttgacagaggaatgcaaaaactcccctggggtcgacgacgaccgtggtcagctgcgataagactaccaggccgagcgtccgtagcgccgtgtctgtcagccagcacaacagacgagcacccgcgaacagtaaagaaaggcggagcagacacagcacagactagtctacacgacagacagaaagaccacaaatgacgagcaaagcgacgcacgccaaggaagaacactcgtccggggccgaacagagtgtagacaactcgtagcgaagaactnacgtaagccgacactagcagacatgagggcagctagcccagcgagtgagcacgccagagcagcagccagacgacacgacgttctagaacaacacgagcggagctagctaagcacgaaggaagacagagatactgagtacgagagagaaaggaaggcagagcgagaagagcagacggagcagggtacggagaacagtaggagctgagagcgagtcgaggggcgtaggaaggctcgtccacgcgcagaggggcgagcagggagcgacagctagcgaacaaggagagcaatagtagacaagcagaggacgacagcacagcaaggcaggatcacggctagacagcagactgacagacaagaagatgaaggagcagagaaagaggtggtagagcagacgaggaggagtcgaacaggaagagaagagagaaccggacgaggagagaagccgaacgacgtacagcacgg

SEQ ID NO: 511396 - DNA, 533 bp, Homo sapiens
cggttgtgcaacgcagagttgccacatttaatcagatatgtattggtgctaaatacctgatgaattattgccgcctccgagttagacgcaggctgttcgcatattccacacgacctaccatcaaaatcgcctctatcacttcgtaatagtcacgccagcacccacttaacaccaggactgtgccctgctctttacacatgaccaagcctgccaatcccgcaaaaacacaacaacggtttggccccaaccccttgaagaaagagattaaacgcaatagaaaacctgattttcctctagaaccacatcacagaataggaaattaagaatcctcaggagatatgagccataagaaattcttatctatggaaaacacgcaaaaaaacgccggaagcaggtacttccggcgttacgagaacgatctctaatgagaccctagattacagaacctgaacttggtcagcctgcatacctttctggccttgcacagcaacgaaagaaacttactgaccttcctgaagggacttaaatgggta

SEQ ID NO: 511397 - DNA, 100 bp, Homo sapiens
gagttttacctgagcttcagagaggttagaaagaagggacagcccgaatcatctcttttcctcttccagtggcctccaggcctctcttaagagttgcaaa

SEQ ID NO: 511398 - DNA, 897 bp, Homo sapiens
  misc_feature (19)..(19): n is a, c, g, or t
  misc_feature (193)..(193): n is a, c, g, or t
  misc_feature (211)..(211): n is a, c, g, or t
  misc_feature (239)..(239): n is a, c, g, or t
  misc_feature (249)..(249): n is a, c, g, or t
  misc_feature (264)..(264): n is a, c, g, or t
  misc_feature (300)..(300): n is a, c, g, or t
  misc_feature (349)..(350): n is a, c, g, or t
  misc_feature (364)..(364): n is a, c, g, or t
  misc_feature (384)..(384): n is a, c, g, or t
  misc_feature (420)..(420): n is a, c, g, or t
  misc_feature (547)..(547): n is a, c, g, or t
  misc_feature (555)..(555): n is a, c, g, or t
  misc_feature (592)..(592): n is a, c, g, or t
  misc_feature (601)..(601): n is a, c, g, or t
  misc_feature (628)..(628): n is a, c, g, or t
  misc_feature (644)..(644): n is a, c, g, or t
  misc_feature (712)..(712): n is a, c, g, or t
  misc_feature (728)..(728): n is a, c, g, or t
  misc_feature (736)..(736): n is a, c, g, or t
  misc_feature (747)..(747): n is a, c, g, or t
  misc_feature (753)..(753): n is a, c, g, or t
  misc_feature (760)..(760): n is a, c, g, or t
  misc_feature (768)..(768): n is a, c, g, or t
  misc_feature (805)..(805): n is a, c, g, or t
  misc_feature (853)..(853): n is a, c, g, or t
tataagtcagaaggcaganaaatattaacttcaaagagtttaatgatgaattagtactgtatttctgaaaacattggtgaaactgaaataatacaccaatagacatgaccaatatgatcctggcaaaatgcacatgtcgctggtcaagcagaaatatatccttttacaaatgtgctgaggaacaatgcttaanattatacaagggtttaanatataattttaatgaagtatatataaantgtacatganaaggggaaatatganagctggcaaaagtgttttggctttcttacaaatggnatccttataattccccaactatcagaggatgagatatttttctagaaannataaaacgactgcnatggtatttcctatgaggcnttatgtatgagagtgacttgcagagtctggtctgcngtgatctggcccatcactttccttgtgccagtgtttcatagatgcgcccatcaggaaatcatcacgtaggagcgtccaacctgggcctgcttctgagttcacttcagtgtgtgtggcttttggtttnttcctgcntgaagcagtttcatttgtacttccatccatccctctnaaaacactnatgaaatctttcttggaaacagttganatcaacttagcacgcnttctcatagaacttccagcttccttaaccttttcatcaacattcttttgatgtttctgaacagcattnaataattgcaccacancccttgtngcaattctctnaagaanttctctntgtttctntgttttggacaacatctggctttactctgcacaacanttcccacttcagcctcttatcaagctgttttattttctctagtttttnttgcattaacttttctttttccttttccagcctcttatttttga

SEQ ID NO: 511399 - DNA, 367 bp, Homo sapiens
gaaacttagaacatcatcaatgaaggaacaaaagcagaaatagaaaatgtctgggtagacataacagactattattcttctcttgagttccttaaggtatgtttgatggttgaaagcaaaaattgtaactttatctgatgcagttgtcattgtatctagatgtactacatacataagataaaagggtaaatgtaatgggactaactcttgatgaagtttctatattcaacttgaatggtaaaatattgattcttagtatactgtgaaaagttatatatgtatatggtaatccctagaccacttaacaaccagattgaaataaaccaaaacaagatagacagaggaacatagaagaattaaaaaaaaa

SEQ ID NO: 511400 - DNA, 88 bp, Homo sapiens
ccccccccccccccccccccccctggttccgctttttttaatagtttgtgtgaagggggaagggccggtccgttattaactggggttt

SEQ ID NO: 511401 - DNA, 306 bp, Homo sapiens
tggctaatttttgtatttttagtagagacggggtttcactgtgttagtcaggctggtcttcaattcctgacttcatgatccgcctgccttggcctcccaaagtgctgggattacaggcgtgagccaccgcacccagccctgtttattcttttcctaaggtactcgtcaccatcggccatcgatcacttccttttctctcctccctctggaaggttccatgagggcagagcctcgtacctgctctgtctccagtgcctgttaacagcctctcattcataacaagatcctggtaaatagttgttgaat

SEQ ID NO: 511402 - DNA, 123 bp, Homo sapiens
tctagaggacccccgggatatagccaaaaatatattatataattacggtttcatatctaccttgagtcaaagttctgtcttatagatgggtgactagagtaatactaacactatgggtgtatt

SEQ ID NO: 511403 - DNA, 1118 bp, Homo sapiens
gtgtgccctgtgcatggccctgtgcaggacgcctcgtgaagccgtgtccacctcctcagccccgcagtgcggctggtggcctgtgcagctgctggtgcgtggctccgagaagaaagagtgtggccctggggcgggcgggagtgggatgtgtgtctgatggcctgtggccctgggaaggtggtcggggcctgctgctgtgacgtgaaggggctgcctgtccttcggtcctgctcgtgcggtggcccatgccatgggccctgctgggactcagaccaagccgggggatgctgctggccttcccgcccttgggggcccttccctgcctgggcctgtgagacccaatgcccccgaacggccatgtgcccctgcccttggaaaggctggctctgcgtgccctgggctgccttggcactgtggtgggaggtttgtgacgttggaacgcggaccgagggtagccttgggcggaggggtctgggcggttgtcgggggccgggtagtcggccgtggcagcgcgaagctattcttttagtaggggattgcgcgtggaaacggtcgggccgagtacccggcctttcgaggagctcagttaagacttcaaagacgttgttacctcccgccgaaacgtttaaccccgaggacttccccggtgttgccgaaatctaattcgtgggcggaccttagtggacccgcttggtgggcaattaccggggcgcccgaccttaaatggaacccgagaagtccacgtgggattgtgcccccgtaaggcctccagggttatgcacctgggtggttataccccccgaagaatgggcgcgaccgcgaatttaaccgggagaaacgagcgctcacaggaatcagagataggggcgacgggtagacaaaaccgatttggaaagagctagaggcatttgatgtggacgactttggaaatgactgcggcgaatatgaagcgttgattagcgtttgaaacatgtgggatagtgattatgaagaaaactagagagggaaagacgtagtagatcggtgagagaggagaaattgggagtgaacgaagatagatggcgcccgcatcatacccatcccatgagacaattttagatagataaaagattggatga

SEQ ID NO: 511404 - DNA, 107 bp, Homo sapiens
attggcagatggagttttgcccttgttgcattgagctgagatcgtgccactgcactcggcctgggtgacagagcaatgatctgtctccgataaagaataataaaaaa

SEQ ID NO: 511405 - DNA, 247 bp, Homo sapiens
  misc_feature (34)..(34): n is a, c, g, or t
  misc_feature (137)..(137): n is a, c, g, or t
gcaggaaaaggggatggagctgaaatacacagtncactgtatcagttacctcaaacttaaaacgaccaaaacccacctctgatctccacatcacccagacccgacagtctaccgcaaagcaataaatggccaccttntccctcttcctctggccccaaacccctgagttacatttgccttttccgtctctgccttatgttccatgaccagtaaccgcagtgggcttcacgttccaaacacatccggg

SEQ ID NO: 511406 - DNA, 317 bp, Homo sapiens
tacacgatttgggggaaacccaaatgaatttgatggccaaatggaaacattttcagcaaatctgtaagcagttggtttgtttagtgggggaaatgaagtttttaagttttgggaatagatgacctgtttttacttcctaaccctgaattcgttttgtaaatgtagagttgggatgtgtaactgaggcgggggggagttttcagtattttttttggggggggggggggcaaaatatgtttaaagttttttttccttaaggtctgcctagaatcctaagggcaaatgactcagggtgtaacagaaaacaggaaattcca

SEQ ID NO: 511407 - DNA, 209 bp, Homo sapiens
ccgttatcccaggttatcattacaaatggatccactacacttcagacgttgctaatcctgtcagaatcaaatacatgcaaagatggcaggacacgctgaggagggatccgacgatgagagatattatcaacagcacacgctctattctgtaccctacaatatataccattagttggatattgctttcctccccgcgccggcaggccctg

SEQ ID NO: 511408 - DNA, 493 bp, Homo sapiens
ttgagacgaagtgtcacccagtctcccaggctggagtgcagtggcacgctatcggcgcactgaaacctccacctcccaggttcaagcaattctcgtgcctcagcctcctgagtagctgagattataggtgcccgccaccatgcccagctattttgtagttttagtaaagacatggtttcatcatattggccaggctggtctcaaactcctgacctcaagtgatctgcccgccttggcctcccaaagtgctgggattacagatgtgagccaccacgcccagccatattaagctatttacatcagggacttgagcatcctcggatttggtatctacaggaggttctggaatcaatcccccaggaataccaaagaataaatatagagtgagagtgtgcgtgtatgtgtgcatgtgtgtgtgtgtgtgtgtgtgtgtgtgtataaccacatatataaacatacataaacatatgaacatacacacatatatacatat

SEQ ID NO: 511409 - DNA, 599 bp, Homo sapiens
  misc_feature (58)..(58): n is a, c, g, or t
  misc_feature (176)..(176): n is a, c, g, or t
  misc_feature (388)..(388): n is a, c, g, or t
  misc_feature (492)..(492): n is a, c, g, or t
  misc_feature (561)..(561): n is a, c, g, or t
aggaccatcgcacacttcagctgctgggtctcatcagagatcgaccaaacagagctcnttggggctttaaatcaccatggtgactcagttgttatccgattatatacaagcactcaactttcagcattccatttgatgagtggtatgccattccctaaaagggtatcacatctganattttttgtaaccttctaaaagaagtcatacttaatacagtaactaggaaaaaaacctcatctttataaagatcaaaaaaccaaaacctactaggaatgtgtgttttgctaaacagcttacttatgtttatagttgctacttacaaaagtgacaccaaaaaagaacctgtattctgaatacagtgaccagagcagaatgtctacagccctgnccaatataacaacactaatcatgtgcttatggaaaaggacttccaaacatgtcaggcttctggtttatggaccagcagttggagctgtctgtctctctcacgtnttcaatgctgtcttctttgttttctggttgaatttcgccttcatcctccttgtgttgagttggatcttnttcagcaacctggtctttggtttggggttcatgtgtag

SEQ ID NO: 511410 - DNA, 942 bp, Homo sapiens
ttctaccacaatgttctgcgtgtcgtgcgaccaaaacagcattatgtagaacatgatctagtggcgcaaggctctgttagatgtaaggccatgatggctaaagcaatcacaagagggcatcttacacagattggggatgtcatggaaggccagacatcctgagtggaatcctgcaaaatgtaaaacccaaataggcaaagaaagacggactaaaaggatttccaggacaaactgaggtcacatctagatcctgactttattgtgtctgtttaaagtatctacagtaacctgtatcaacttagtcagtgtattaatacgtaaatttagctccttcaaagcaggttggaactatgtgctacataaatttcagcttcacacaaggaagggaaggagctgaaattaggtgaacaggcagttacagcaaaagaggtacaacataaaaattgaatagctggctctggtgaaatgagacaaggactgttagagtcaaactggcctggactcttgaatcctgatcctcaattgcttgtagctgtatgatctggacaaacgacagtaactgtttctaacctcgagtttctcatactgctaagaatgacgcaatctgtaactcctaaggatagcctgaggattttatctcaaagtgcgtgtacagttccggaaccaagtggtttgtgcctaatgactttatatacaaacatatattacccaaggtacacaaaccttgagaacatagagctgatagagacgttatagcttaaataattccattacttgttaggatagcaaactaacgtgcattgagaaaattaaatcgactttacatgttttagattccagacagatagtgttagacttacaaaggttacccacaaaaaatcacagcccaggcatgtaggctcacagcctggcacttggaggaaccgagctgggagcatacgc

SEQ ID NO: 511411 - DNA, 278 bp, Homo sapiens
  misc_feature (64)..(64): n is a, c, g, or t
  misc_feature (76)..(76): n is a, c, g, or t
  misc_feature (105)..(105): n is a, c, g, or t
accgtcgcatgcccaggtgacggaacagagcccattgggtgagggagcctggctcaattgcccngtgccatagtgnaatgcatgcccccaagccacccggacccntgccttctccatcttcccacctgatgcccctaagctaccttgagaaccagacgtcgccaggcgagtcaccttgagcgtggaaggtccagcagaggttgtccatgacagccagtcccagaggtaacctgggggcctgaaggatgaagaactttggaggaaattgtccttccgca

SEQ ID NO: 511412 - DNA, 885 bp, Homo sapiens
  misc_feature (481)..(481): n is a, c, g, or t
  misc_feature (487)..(487): n is a, c, g, or t
  misc_feature (574)..(574): n is a, c, g, or t
cctgtcatcgagtgactgatttccgcctttcagagcctcagcaggttaaaaaacaaataggacatggagacagtggaagccactgtgcactcctgctacggaaagacggctgtgccttgttgaagatgatactatatgattcgctaccagagtggggccatccctgcttcaggctgttcctagatgtttaaaagaacattccaaacgacgttaagaaactttgtgctgccattggtgtattcctttccaaatcttttctaaaatgttagaattcagaccacagttcctgagctttggatgcaaactccttggccctgaatccctggaagccctcccctgtggatggtatcagccatcacagcaggatgtgctttaagaatccaaatgaattcagttataccacgtggcgggacttttaaacttgagctgagcttactcatttctggccgactattaatcctatagctaaatcatgtacgtnaagganggggaaaaaaatccaacctgggtaaccacacaacaaacactaaataaaaccaaggtaatgtggtaaccacacaacaaacactaaatnaaaccaaggtaatgtatggggcatctctgtgctgcttagtaaaacttgaagtttcttaatgtcgcgaagtaacagaaattacttgggggaatttcaggtgtttttggtaaactctttggggaagtaaacagtcagtgaactttcggaatgctgggacttttgactgcagcaaaacaaagctaagacaagtggattccgtaaaaaagatcactggcagcagaggagaagcagagctgagaagagacaggctggtgagctcaggggatatattctaccccctctatgcatcattgcggatacaattctacatc

SEQ ID NO: 511413 - DNA, 103 bp, Homo sapiens
  misc_feature (26)..(26): n is a, c, g, or t
ttttaaaattttttttttaaattttnccaaaaggggaaatttggggggggggtttttccccaattttagcccaaaggaaaccttcccttttgccttttgggga

SEQ ID NO: 511414 - DNA, 231 bp, Homo sapiens
ccggtcctctcagctttcaagtgctgggatacatgagccacgtgccggccgcctggtctcttattctctaaatcttactatggacgtccaagttactatttatgagagagggtctcactctggaaccccatccccactaaaaatacaaaaaattagctgggtctggtggcacatgccagtaatcccaactacttgggaagctgaggcaggagagctgcgtctgctgaggag

SEQ ID NO: 511415 - DNA, 841 bp, Homo sapiens
tcgggaaaaaaaaagcttaacggggagaaaatacaacaaattccagaagtgcttggtttttagcccaccctatcaccccaccagcaataggaacacaaaccattcgatcaccacacattccctacctcagggagtaagtacagcagccaacatctgggtctcagagctgcggggcaaaaggggcatggaggaagaatgtatctgggagaataccattctctcactcttttcccctccttccgggcctagattaagaaagaatctagactgtcccaggatacagaactctgggtcgggatcttgtgagaactggggggcaaaaaaattacgccgcagaaagccacttaggggcaacgaaatatcagcgtgggaacctttacagaactcagttgacccaggtgcattaagaacaagtgtgcaccaatgctccagaccaatgtgataattcagttcctatagaatctaatatgagctgtaatatcctcaaactcctaaacattatcaagcaggtggacaaggtttacagttcaacacccaaggaaagtacttctcccttgatcaacctccttgcctattacaacagaaggggaactcgggcccctcgaaagctggggagggagcctacaacgggactccaacggccagctacaggagacaccgacgacgaacggccggtgcagaacacagtagcggaacagacaatgcagaaccgcacggtgctgtgaccaaggcatatcgccccacacaggaaccccagaagaccgcgaagcaggcagccacacccccaacaagcactacactacacgaccggcccgccccggaacacaagcacccaccttga

SEQ ID NO: 511416 - DNA, 125 bp, Homo sapiens
gagaagcaggcatcaagattacgcgagaagccataacatggaactattcacatgtcgtatatttgtactgaattaaaaaattaggatctttagttccagtattggaatttaagaactttcgagaa

SEQ ID NO: 511417 - DNA, 597 bp, Homo sapiens
ggcaaaaagaaggacgataaaaaaaagggccggggggagggaaaaaattttttttttaaaaaaaaagaccccccaccaccccccgggaaagaaaaatataaaaaccccccgcttttttattttttttttccaccaacagtgttggtgttaagagtggggcccccaaagtggggtttttctcccccgaccctctcccctatttttttgttggggagcgccccttttttaaaggggggggggggggacacccccctcttttaaaaaaaaagaggggggggatatttttgtggggggacataaaccaaaattttttttcccccccccacacccccccctcttttaaaaaaaaaaaaggggggggggagccccccccccaagaaagagacccctctttttttatttaaaaaaatttttttttacaaggaagaggaaaacctccccccaaaaaaaaggaacaccccccaacccccaccattttaatggtccccttaaaaaaaacccaaaaaaaaggggtttttttatcctctccccccggggggggaaaaagttcctttaaagggggttttaaatatccccccttcccccttgtagaggccc

SEQ ID NO: 511418 - DNA, 220 bp, Homo sapiens
actaggaagagcataatttagattatagaacatggattcaaagtgactggaacaattggtgacacttactggtaactgctatacttctggtgttatacctatcagcggacttgcttcccactaacatttatgtttcaaaaaatttacttcacattattctatgtaagtgatgactagtccagtgttcccaggctgatatacttcaggctaacaactagag

SEQ ID NO: 511419 - DNA, 272 bp, Homo sapiens
atcagtacaagttcctccaacgttttctgtctgtaaacaactttactggccaggtgcagtggctcatgcctgttatcccagcaccttgaggagaccgaggcgggaggattagcttgagcccaggagttgacgaccagcctgggcatcataaggagaccctgtctctacaaaaaaatcttaaaaattagccgggcatggtggcacacacctgtggtcccaggtactacgaaggctagaggtgggtggattgcttgggcctgggaagttgaggc

SEQ ID NO: 511420 - DNA, 361 bp, Homo sapiens
agccagcacttatttcttcacctgactgattcctcggatttacaattcgtccagcatctcacccccacgcgaggtctgtcaaccaggcactgctgaacggaaagccagccttcaccacgcaccagtcagggatgtcagtggagcccaacatggaggcgatgttgatcacggggttccgggccacgcaggccctgtaggtctctgggtactgaccaatcaagtggcaggaaatgaagccaccatgggaaccacccataagggccacatggcttgcatcaaagtgttcctcctggagcacctgttccactgcaaactggacatccttcacatcctggtggcccacattgcctgggagggagag

SEQ ID NO: 511421 - DNA, 1460 bp, Homo sapiens
  misc_feature (64)..(65): n is a, c, g, or t
  misc_feature (76)..(76): n is a, c, g, or t
  misc_feature (87)..(87): n is a, c, g, or t
  misc_feature (94)..(94): n is a, c, g, or t
  misc_feature (109)..(109): n is a, c, g, or t
  misc_feature (112)..(112): n is a, c, g, or t
  misc_feature (143)..(143): n is a, c, g, or t
  misc_feature (179)..(179): n is a, c, g, or t
  misc_feature (181)..(181): n is a, c, g, or t
  misc_feature (185)..(186): n is a, c, g, or t
  misc_feature (192)..(192): n is a, c, g, or t
  misc_feature (214)..(214): n is a, c, g, or t
  misc_feature (305)..(306): n is a, c, g, or t
  misc_feature (316)..(316): n is a, c, g, or t
  misc_feature (325)..(325): n is a, c, g, or t
  misc_feature (337)..(337): n is a, c, g, or t
  misc_feature (347)..(347): n is a, c, g, or t
taagtaaaatctttttaattcagaaaaaaaaaaccccaaaaaacaaaagtttcccaaccacacnngggggggatangggtagggggngtgtgtngtccactccagcccntgncccccagcccaggttggttttgggcagcaantaaggggtagtggggttaagtggcccaaaaaataanangtgnntggggntgtgtatggggaggaaaggggntgcaaagcttggggggagcgggtgaaaggggaagagggcacagaacgagaggctcagtagcggggaaacgccgaaagggtgggagaggccnnttccaaaacnattccgtgngtggcatcaacnccaccggggnaccaccttcttgggccccaatcaccacgacaagcgaatcaagggctgtctctcgcgtgcccacgcctcctcgcggggagaaccgccgggaccctcttggacagcggggggggggcgcccccaacgccggggggctcctcgggcacacagacaagaacccaccgggcccaaaacacccccccctaatactctgtgcagtacacgtgtggatgccccccgggatatacccacgcgaaacctatttactctgggggcccccccaagtgtgtgtcccatgccccactatttacacgtgtttataaaaaactctttctgacccccggggtcttttttgcggccccaaactcctcagagtgtcacccacgctcaatcactacaaacaccctgaggcccgcgcgcactggtccccgcaccgcacacgcggtctatcacccccgcgggcgcgaccgccggagagtgcgccccaccacaaccgggcacggggcgacagaagtacccctctggtagcagcaccccccaccacctggcggcgcgggcgccgcccgcgcacacaggccccccccgcacaccgcccccaacgacagcgctacggcccgccactgccaacgacgcgttcaccacaccccgcggcacacatgggcccccttgcccccactgcaggcgcccgacaccctccgcagccacagcctccctagtgacccacggacaaacgggcgcccccaacgcgcccccaccacaagatccggacacgagacagcccagccgccgcaaccaccccgccggcgccacccgccacgtaccacgacccgcgaaactccggggctcccaccagccacgaaaatcgcccccccacgagccccccgctcacccacaagacccgccgcaaacacatacagcggcggcagcccatcaaaccacccgcgcctctcgcggccccaccctgccgggcgcacactcccaacacccccaacagggcgccccacagcccgcgccgccggtcgacacgcacccacgcgtgtacatgaccgccgtaccgcctcctcaccgcgacacagtcacagacaccacgaacccactcgcccgcccctcgccaacacaccgcccacacagcaca

SEQ ID NO: 511422 - DNA, 146 bp, Homo sapiens
gtgttgtgggtagggatgcagatcgtgtcagacctggcaccaccttgggcatggcactctgcctctggactgtctttcatcgggagaaacactcagagatggatcccattccctaaatgtctcaagctaagtttagtattctccct

SEQ ID NO: 511423 - DNA, 207 bp, Homo sapiens
  misc_feature (41)..(41): n is a, c, g, or t
agctcggtacccggctcatttgtgttctatccactgttctnggcacatgagattgtcagtgaacaaaacagatacagatccttgcccttgtgtagctaacattctagtgggggcagaggaatacgtatcaaacctaataagttgtatatgatgttaaaagagagtaagtactatggaaacgaaaaataaaaataaagcatagcatga

SEQ ID NO: 511424 - DNA, 264 bp, Homo sapiens
agtgaaccagttgcagcaccccccccccccccaccttggtcatacaagcctcaaaaggccttccagcctgggcaacataatgagaccttgtctctaccaaaaaaaaacttaaaaattagccaggcatggtgactggtgtctatagccccacctgctcaggaggctgaggtgggaggaccacttgagcccaggagtgtgaggatgcagtgaatgccatgatcacaccatacactccagcctgggtgacagagtaaggccctgtta

SEQ ID NO: 511425 - DNA, 191 bp, Homo sapiens
aagaccgtaccattgcactccagcctggacaacggattgagactccatctcaaaaaaaaacaaaaacaaaatgtttgggccagcggggactccaggttcataagcccagcaacagctcacaccctcagtacagaaaagctacaggcactcgagaccaatccagcccatgagagcagccatgggggctacac

SEQ ID NO: 511426 - DNA, 564 bp, Homo sapiens
  misc_feature (1)..(1): n is a, c, g, or t
  misc_feature (5)..(5): n is a, c, g, or t
  misc_feature (26)..(26): n is a, c, g, or t
  misc_feature (110)..(110): n is a, c, g, or t
ngccngccatttagggcttcccattntatgcaaatgcttccaagccattcacttccccaattcttgtcgttgatgggtatgtgtttaaaacatgccggtaaggccgggcncagtggctcacgccctgtaatcccagcactttgggaggccgaggcgggtggatcatgaggtcaggagatcgagaccatcctggctaacacgtgaaaccccgtctctactaaaaatacaaaaaattagccgggcgtggtggcgggcacctgtagtcccagctactcgggaggctgaggcaggagaatggtgtgaacccgggaagcggagcttgcagtgagccgagattgcgccactgcagtccgcagtctggcctgggcgacagagcgagactccgtctcaaaaaaaaaaaacaaaaaaaaaccatgcatggtgcatcagcagcccatggcctctggccaggcatggcgaggctgaggtgggaggatggtttgagctcaggcatttgaggctgtcgtgagctatgattatgccactgctttccagcctgggcaacatagtaagaccccatctctt

SEQ ID NO: 511427 - DNA, 354 bp, Homo sapiens
atgaatacccgaagtctgataaggaattgctgtatgttagggaagctggaattaacgggagctgatgccagttcatggttgtggcgtgtgagtccggagacctaggtttcagcccctctctactgtcagcgagctgtgcaacgtgggcaagtcattgtcctctgagctgcagtttcctcatctgtcacatcgctacagacaagacctccctggaacccttctgactgtcttagacgctgtggttgcaaaacccacggaaagcctcatttgtgtggaaagtcagaggaaaaatgatccagtggacacttggggattatctgtcattcaagatccttccttcaaccccaaggtcag

SEQ ID NO: 511428 - DNA, 1719 bp, Homo sapiens
  misc_feature (29)..(29): n is a, c, g, or t
aatgccaggctgtacggagcggggtgcgncgtgtgggcgtggcgggggctggggtctgcgggcgaaggtggtagcccattggaggtcccgggagcgaagtccagctgccgttaggcgctgggatagtcgcacgctggatgcatctacgtccgccgagcccctggggcgaagaggccgcgtccgccttcagttgtggccggtgcttcgccccctgacccttcgcccccaaagaccagctctaacgtgagcgcctcggccgccctgccccagcctcgtacacgccgccagcctcgcccagccggtgtccggagaccctcgggccgtgtccatttgtgggcaaagccagcggggcaggcttggccagagtgcaccactcggcgccgtcccaggcccgacgctctgggcgcgcccggaaccccaggttcgcggcccgtgtttccgaccggcggagggggctcagcggcccgatcccacggaagcgcgctcggaggggtgggacccggccggaccggagatggcgccgccagcgggcggggcggcggcggcggcctcggacttgggctccgccgcagtgctcttggctgtgcacgccgcggtgaggccgctgggcgccgggccagacgccgaggcacagctgcggaggctgcagctgagcgcggaccctgagaggcctgggcgcttccggctggagctgctgggcgcgggacctggggcggttaatttggagtggcccctggagtcagtttcctacaccatccgaggccccacccagcacgagctacagcctccaccaggagggcctggaaccctcagcctgcacttcctcaaccctcaggaagctcagcggtgggcagtcctagtccgaggtgccaccgtggaaggacagaatggcagcaagagcaactcaccaccagccttgggcccagaagcatgccctgtctccctgcccagtcccccggaagcctccacactcaagggccctccacctgaggcagatcttcctaggagccctggaaacttgacggagagagaagagctggcagggagcctggcccgggctattgcaggtggagacgagaagggggcagcccaagtggcagccgtcctggcccagcatcgtgtggccctgagtgttcagcttcaggaggcctgcttcccacctggccccatcaggctgcaggtcacacttgaagacgctgcctctgccgcatccgccgcgtcctctgcacacgttgccctgcaggtccacccccactgcactgttgcagctctccaggagcaggtgttctcagagctcggtttcccgccagccgtgcaacgctgggtcatcggacggtgcctgtgtgtgcctgagcgcagccttgcctcttacggggttcggcaggatggggaccctgctttcctctacttgctgtcagctcctcgagaagcccagcccagctggtcctgtccttcctgcaccttcatcaatgccccagaccgccctggctgtgagatgtgtagcacccagaggccctgcacttgggacccccttgctgcagcttccacctagcagccaccagaggttacaaggggagagtggcccttccctcacaagtccgacatctccaggcccccactgaactccggggacctctactgactgcttgctgggacagtcaccagggttggggggaagggccacaaaatgaaaccattaaagacccttaagagccaaaa

SEQ ID NO: 511429 - DNA, 233 bp, Homo sapiens
tcccaaacccagtttccctgccccctgacgctgttgattcgggctgtggcctccacgtatttatccagtacagtttgcctgacgccagccctccctttgggccctgggggctgggctgtagaaaagtttttggggaagaagggactttaggagggggcatttccccccttctcccttttggaccctgccgaagctccctgcctttaataaactggccaagtggggccttgtta

SEQ ID NO: 511430 - DNA, 1984 bp, Homo sapiens
  misc_feature (29)..(29): n is a, c, g, or t
  misc_feature (1957)..(1957): n is a, c, g, or t
  misc_feature (1973)..(1973): n is a, c, g, or t
  misc_feature (1978)..(1978): n is a, c, g, or t
aatgccaggctgtacggagcggggtgcgncgtgtgggcgtggcgggggctggggtctgcgggcgaaggtggtagcccattggaggtcccgggagcgaagtccagctgccgttaggcgctgggatagtcgcacgctggatgcatctacgtccgccgagcccctggggcgaagaggccgcgtccgccttcagttgtggccggtgcttcgccccctgacccttcgcccccaaagaccagctctaacgtgagcgcctcggccgccctgccccagcctcgtacacgccgccagcctcgcccagccggtgtccggagaccctcgggccgtgtccatttgtgggcaaagccagcggggcaggcttggccagagtgcaccactcggcgccgtcccaggcccgacgctctgggcgcgcccggaaccccaggttcgcggcccgtgtttccgaccggcggagggggctcagcggcccgatcccacggaagcgcgctcggaggggtgggacccggccggaccggagatggcgccgccagcgggcggggcggcggcggcggcctcggacttgggctccgccgcagtgctcttggctgtgcacgccgcggtgaggccgctgggcgccgggccagacgccgaggcacagctgcggaggctgcagctgagcgcggaccctgagaggcctgggcgcttccggctggagctgctgggcgcgggacctggggcggttaatttggagtggcccctggagtcagtttcctacaccatccgaggccccacccagcacgagctacagcctccaccaggagggcctggaaccctcagcctgcacttcctcaaccctcaggaagctcagcggtgggcagtcctagtccgaggtgccaccgtggaaggacagaatggcagcaagagcaactcaccaccagccttgggcccagaagcatgccctgtctccctgcccagtcccccggaagcctccacactcaagggccctccacctgaggcagatcttcctaggagccctggaaacttgacggagagagaagagctggcagggagcctggcccgggctattgcaggtggagacgagaagggggcagcccaagtggcagccgtcctggcccagcatcgtgtggccctgagtgttcagcttcaggaggcctgcttcccacctggccccatcaggctgcaggtcacacttgaagacgctgcctctgccgcatccgccgcgtcctctgcacacgttgccctgcaggtccacccccactgcactgttgcagctctccaggagcaggtgttctcagagctcggtttcccgccagccgtgcaacgctgggtcatcggacggtgcctgtgtgtgcctgagcgcagccttgcctcttacggggttcggcaggatggggaccctgctttcctctacttgctgtcagctcctcgagaagccccaggtcagtcctcgatgggggtggggtgtgggaggtggggtgcagccccacagtcctgagctccaccccctcagccacaggacctagccctcagcacccccagaagatggacggggaacttggacgcttgtttcccccatcattggggctacccccaggcccccagccagctgcctccagcctgcccagtccactccagcccagctggtcctgtccttcctgcaccttcatcaatgccccagaccgccctggctgtgagatgtgtagcacccagaggccctgcacttgggacccccttgctgcagcttccacctagcagccaccagaggttacaaggggagagtggcccttccctcacaagtccgacatctccaggcccccactgaactccggggacctctactgactgcttgctgggacagtcaccagggttggggggaagggccacaaaatgaaaccattaaagacccttaagagccaaaaaaaaacaaaacaaaaccaaaaaaaaaaaaaaaaaaaaaaanaacaaacaaacaacanaaacnaacaaa

SEQ ID NO: 511431 - DNA, 174 bp, Homo sapiens
  misc_feature (139)..(139): n is a, c, g, or t
tggtaccctagtttagaagttcaatagcacagcagattctcagcagaaaccttacaagccaaaagagattagggtcctgtcttcaacctctttaaacagaacaacggtcagccaagaattttttatcccacaaaactanagtttggtaaactgaagggagaaataaacgtcatt

SEQ ID NO: 511432 - DNA, 1787 bp, Homo sapiens
  misc_feature (29)..(29): n is a, c, g, or t
  misc_feature (1760)..(1760): n is a, c, g, or t
  misc_feature (1776)..(1776): n is a, c, g, or t
  misc_feature (1781)..(1781): n is a, c, g, or t
aatgccaggctgtacggagcggggtgcgncgtgtgggcgtggcgggggctggggtctgcgggcgaaggtggtagcccattggaggtcccgggagcgaagtccagctgccgttaggcgctgggatagtcgcacgctggatgcatctacgtccgccgagcccctggggcgaagaggccgcgtccgccttcagttgtggccggtgcttcgccccctgacccttcgcccccaaagaccagctctaacgtgagcgcctcggccgccctgccccagcctcgtacacgccgccagcctcgcccagccggtgtccggagaccctcgggccgtgtccatttgtgggcaaagccagcggggcaggcttggccagagtgcaccactcggcgccgtcccaggcccgacgctctgggcgcgcccggaaccccaggttcgcggcccgtgtttccgaccggcggagggggctcagcggcccgatcccacggaagcgcgctcggaggggtgggacccggccggaccggagatggcgccgccagcgggcggggcggcggcggcggcctcggacttgggctccgccgcagtgctcttggctgtgcacgccgcggtgaggccgctgggcgccgggccagacgccgaggcacagctgcggaggctgcagctgagcgcggaccctgagaggcctgggcgcttccggctggagctgctgggcgcgggacctggggcggttaatttggagtggcccctggagtcagtttcctacaccatccgaggccccacccagcacgagctacagcctccaccaggagggcctggaaccctcagcctgcacttcctcaaccctcaggaagctcagcggtgggcagtcctagtccgaggtgccaccgtggaaggacagaatggcagcaagagcaactcaccaccagccttgggcccagaagcatgccctgtctccctgcccagtcccccggaagcctccacactcaagggccctccacctgaggcagatcttcctaggagccctggaaacttgacggagagagaagagctggcagggagcctggcccgggctattgcaggtggagacgagaagggggcagcccaagtggcagccgtcctggcccagcatcgtgtggccctgagtgttcagcttcaggaggcctgcttcccacctggccccatcaggctgcaggtcacacttgaagacgctgcctctgccgcatccgccgcgtcctctgcacacgttgccctgcaggtccacccccactgcactgttgcagctctccaggagcaggtgttctcagagctcggtttcccgccagccgtgcaacgctgggtcatcggacggtgcctgtgtgtgcctgagcgcagccttgcctcttacggggttcggcaggatggggaccctgctttcctctacttgctgtcagctcctcgagaagcccagcccagctggtcctgtccttcctgcaccttcatcaatgccccagaccgccctggctgtgagatgtgtagcacccagaggccctgcacttgggacccccttgctgcagcttccacctagcagccaccagaggttacaaggggagagtggcccttccctcacaagtccgacatctccaggcccccactgaactccggggacctctactgactgcttgctgggacagtcaccagggttggggggaagggccacaaaatgaaaccattaaagacccttaagagccaaaaaaaaacaaaacaaaaccaaaaaaaaaaaaaaaaaaaaaaanaacaaacaaacaacanaaacnaacaaa

SEQ ID NO: 511433 - DNA, 1551 bp, Homo sapiens
  misc_feature (29)..(29): n is a, c, g, or t
aatgccaggctgtacggagcggggtgcgncgtgtgggcgtggcgggggctggggtctgcgggcgaaggtggtagcccattggaggtcccgggagcgaagtccagctgccgttaggcgctgggatagtcgcacgctggatgcatctacgtccgccgagcccctggggcgaagaggccgcgtccgccttcagttgtggccggtgcttcgccccctgacccttcgcccccaaagaccagctctaacgtgagcgcctcggccgccctgccccagcctcgtacacgccgccagcctcgcccagccggtgtccggagaccctcgggccgtgtccatttgtgggcaaagccagcggggcaggcttggccagagtgcaccactcggcgccgtcccaggcccgacgctctgggcgcgcccggaaccccaggttaatttggagtggcccctggagtcagtttcctacaccatccgaggccccacccagcacgagctacagcctccaccaggagggcctggaaccctcagcctgcacttcctcaaccctcaggaagctcagcggtgggcagtcctagtccgaggtgccaccgtggaaggacagaatggcagcaagagcaactcaccaccagccttgggcccagaagcatgccctgtctccctgcccagtcccccggaagcctccacactcaagggccctccacctgaggcagatcttcctaggagccctggaaacttgacggagagagaagagctggcagggagcctggcccgggctattgcaggtggagacgagaagggggcagcccaagtggcagccgtcctggcccagcatcgtgtggccctgagtgttcagcttcaggaggcctgcttcccacctggccccatcaggctgcaggtcacacttgaagacgctgcctctgccgcatccgccgcgtcctctgcacacgttgccctgcaggtccacccccactgcactgttgcagctctccaggagcaggtgttctcagagctcggtttcccgccagccgtgcaacgctgggtcatcggacggtgcctgtgtgtgcctgagcgcagccttgcctcttacggggttcggcaggatggggaccctgctttcctctacttgctgtcagctcctcgagaagccccagccacaggacctagccctcagcacccccagaagatggacggggaacttggacgcttgtttcccccatcattggggctacccccaggcccccagccagctgcctccagcctgcccagtccactccagcccagctggtcctgtccttcctgcaccttcatcaatgccccagaccgccctggctgtgagatgtgtagcacccagaggccctgcacttgggacccccttgctgcagcttccacctagcagccaccagaggttacaaggggagagtggcccttccctcacaagtccgacatctccaggcccccactgaactccggggacctctactgactgcttgctgggacagtcaccagggttggggggaagggccacaaaatgaaaccattaaagacccttaagagccaaaa

SEQ ID NO: 511434 - DNA, 1376 bp, Homo sapiens
  misc_feature (29)..(29): n is a, c, g, or t
aatgccaggctgtacggagcggggtgcgncgtgtgggcgtggcgggggctggggtctgcgggcgaaggtggtagcccattggaggtcccgggagcgaagtccagctgccgttaggcgctgggatagtcgcacgctggatgcatctacgtccgccgagcccctggggcgaagaggccgcgtccgccttcagttgtggccggtgcttcgccccctgacccttcgcccccaaagaccagctctaacgtggttaatttggagtggcccctggagtcagtttcctacaccatccgaggccccacccagcacgagctacagcctccaccaggagggcctggaaccctcagcctgcacttcctcaaccctcaggaagctcagcggtgggcagtcctagtccgaggtgccaccgtggaaggacagaatggcagcaagagcaactcaccaccagccttgggcccagaagcatgccctgtctccctgcccagtcccccggaagcctccacactcaagggccctccacctgaggcagatcttcctaggagccctggaaacttgacggagagagaagagctggcagggagcctggcccgggctattgcaggtggagacgagaagggggcagcccaagtggcagccgtcctggcccagcatcgtgtggccctgagtgttcagcttcaggaggcctgcttcccacctggccccatcaggctgcaggtcacacttgaagacgctgcctctgccgcatccgccgcgtcctctgcacacgttgccctgcaggtccacccccactgcactgttgcagctctccaggagcaggtgttctcagagctcggtttcccgccagccgtgcaacgctgggtcatcggacggtgcctgtgtgtgcctgagcgcagccttgcctcttacggggttcggcaggatggggaccctgctttcctctacttgctgtcagctcctcgagaagccccagccacaggacctagccctcagcacccccagaagatggacggggaacttggacgcttgtttcccccatcattggggctacccccaggcccccagccagctgcctccagcctgcccagtccactccagcccagctggtcctgtccttcctgcaccttcatcaatgccccagaccgccctggctgtgagatgtgtagcacccagaggccctgcacttgggacccccttgctgcagcttccacctagcagccaccagaggttacaaggggagagtggcccttccctcacaagtccgacatctccaggcccccactgaactccggggacctctactgactgcttgctgggacagtcaccagggttggggggaagggccacaaaatgaaaccattaaagacccttaagagccaaaa

SEQ ID NO: 511435 - DNA, 112 bp, Homo sapiens
  misc_feature (108)..(108): n is a, c, g, or t
tgaggtcattcgtagtatcggatggccgtcattcccgggcgacactcgtcgatcagctagtcgagtgatgtcagtgcgtgcggcgcggcgtcatgagtcgcagtatgntgag

SEQ ID NO: 511436 - DNA, 1796 bp, Homo sapiens
  misc_feature (29)..(29): n is a, c, g, or t
aatgccaggctgtacggagcggggtgcgncgtgtgggcgtggcgggggctggggtctgcgggcgaaggtggtagcccattggaggtcccgggagcgaagtccagctgccgttaggcgctgggatagtcgcacgctggatgcatctacgtccgccgagcccctggggcgaagaggccgcgtccgccttcagttgtggccggtgcttcgccccctgacccttcgcccccaaagaccagctctaacgtgagcgcctcggccgccctgccccagcctcgtacacgccgccagcctcgcccagccggtgtccggagaccctcgggccgtgtccatttgtgggcaaagccagcggggcaggcttggccagagtgcaccactcggcgccgtcccaggcccgacgctctgggcgcgcccggaaccccaggttcgcggcccgtgtttccgaccggcggagggggctcagcggcccgatcccacggaagcgcgctcggaggggtgggacccggccggaccggagatggcgccgccagcgggcggggcggcggcggcggcctcggacttgggctccgccgcagtgctcttggctgtgcacgccgcggtgaggccgctgggcgccgggccagacgccgaggcacagctgcggaggctgcagctgagcgcggaccctgagaggcctgggcgcttccggctggagctgctgggcgcgggacctggggcggttaatttggagtggcccctggagtcagtttcctacaccatccgaggccccacccagcacgagctacagcctccaccaggagggcctggaaccctcagcctgcacttcctcaaccctcaggaagctcagcggtgggcagtcctagtccgaggtgccaccgtggaaggacagaatggcagcaagagcaactcaccaccagccttgggcccagaagcatgccctgtctccctgcccagtcccccggaagcctccacactcaagggccctccacctgaggcagatcttcctaggagccctggaaacttgacggagagagaagagctggcagggagcctggcccgggctattgcaggtggagacgagaagggggcagcccaagtggcagccgtcctggcccagcatcgtgtggccctgagtgttcagcttcaggaggcctgcttcccacctggccccatcaggctgcaggtcacacttgaagacgctgcctctgccgcatccgccgcgtcctctgcacacgttgccctgcaggtccacccccactgcactgttgcagctctccaggagcaggtgttctcagagctcggtttcccgccagccgtgcaacgctgggtcatcggacggtgcctgtgtgtgcctgagcgcagccttgcctcttacggggttcggcaggatggggaccctgctttcctctacttgctgtcagctcctcgagaagcccagcccagctggtcctgtccttcctgcaccttcatcaatgccccagaccgccctggctgtgagatgtgtagcacccagaggccctgcacttgggacccccttgctgcagcttccacctagcagccaccagaggtaccagaggtggcacaggcaggggaggtggggggcagggcagaatccacaggaatgacccagctcctcccccacaggttacaaggggagagtggcccttccctcacaagtccgacatctccaggcccccactgaactccggggacctctactgactgcttgctgggacagtcaccagggttggggggaagggccacaaaatgaaaccattaaagacccttaagagccaaaa

SEQ ID NO: 511437 - DNA, 1377 bp, Homo sapiens
agcgggctttgccactgttggctgctggtcaaaaagggcaggacctgcgacggctccgtgaaagtcaactctgcgggcaggaactggaagttctgccacctacagcctcaggatgcagagagaaccatgaagcatgcttcccccaggttccactgaagggcgcggcagtgtgacctccgagatgccagcccccccagcctgcctcacctgccaatgatgtgggcatctccggtctccacagtcagcggttaatttggagtggcccctggagtcagtttcctacaccatccgaggccccacccagcacgagctacagcctccaccaggagggcctggaaccctcagcctgcacttcctcaaccctcaggaagctcagcggtgggcagtcctagtccgaggtgccaccgtggaaggacagaatggcagcaagagcaactcaccaccagccttgggcccagaagcatgccctgtctccctgcccagtcccccggaagcctccacactcaagggccctccacctgaggcagatcttcctaggagccctggaaacttgacggagagagaagagctggcagggagcctggcccgggctattgcaggtggagacgagaagggggcagcccaagtggcagccgtcctggcccagcatcgtgtggccctgagtgttcagcttcaggaggcctgcttcccacctggccccatcaggctgcaggtcacacttgaagacgctgcctctgccgcatccgccgcgtcctctgcacacgttgccctgcaggtccacccccactgcactgttgcagctctccaggagcaggtgttctcagagctcggtttcccgccagccgtgcaacgctgggtcatcggacggtgcctgtgtgtgcctgagcgcagccttgcctcttacggggttcggcaggatggggaccctgctttcctctacttgctgtcagctcctcgagaagccccagccacaggacctagccctcagcacccccagaagatggacggggaacttggacgcttgtttcccccatcattggggctacccccaggcccccagccagctgcctccagcctgcccagtccactccagcccagctggtcctgtccttcctgcaccttcatcaatgccccagaccgccctggctgtgagatgtgtagcacccagaggccctgcacttgggacccccttgctgcagcttccacctagcagccaccagaggttacaaggggagagtggcccttccctcacaagtccgacatctccaggcccccactgaactccggggacctctactgactgcttgctgggacagtcaccagggttggggggaagggccacaaaatgaaaccattaaagacccttaagagccaaaa

SEQ ID NO: 511438 - DNA, 1545 bp, Homo sapiens
  misc_feature (29)..(29): n is a, c, g, or t
  misc_feature (1490)..(1490): n is a, c, g, or t
aatgccaggctgtacggagcggggtgcgncgtgtgggcgtggcgggggctggggtctgcgggcgaaggtggtagcccattggaggtcccgggagcgaagtccagctgccgttaggcgctgggatagtcgcacgctggatgcatctacgtccgccgagcccctggggcgaagaggccgcgtccgccttcagttgtggccggtgcttcgccccctgacccttcgcccccaaagaccagctctaacgtgagcgcctcggccgccctgccccagcctcgtacacgccgccagcctcgcccagccggtgtccggagaccctcgggccgtgtccatttgtgggcaaagccagcggggcaggcttggccagagtgcaccactcggcgccgtcccaggcccgacgctctgggcgcgcccggaaccccaggttcgcggcccgtgtttccgaccggcggagggggctcagcggcccgatcccacggaagcgcgctcggaggggtgggacccggccggaccggagatggcgccgccagcgggcggggcggcggcggcggcctcggacttgggctccgccgcagtgctcttggctgtgcacgccgcggtgaggccgctgggcgccgggccagacgccgaggcacagctgcggaggctgcagctgagcgcggaccctgagaggcctgggcgcttccggctggagctgctgggcgcgggacctggggcggttaatttggagtggcccctggagtcagtttcctacaccatccgaggccccacccagcacgagctacagcctccaccaggagggcctggaaccctcagcctgcacttcctcaaccctcaggaagctcagcggtgggcagtcctagtccgaggtgccaccgtggaaggacagaatggcagcaagagcaactcaccaccagccttgggcccagaagcatgccctgtctccctgcccagtcccccggaagcctccacactcaagggccctccacctgaggcagatcttcctaggagccctggaaacttgacggagagagaagagctggcagggagcctggcccgggctattgcaggtggagacgagaagggggcagcccaagtggcagccgtcctggcccagcatcgtgtggccctgagtgttcagcttcaggaggcctgcttcccacctggccccatcaggctgcaggtcacacttgaagacgctgcctctgccgcatccgccgcgtcctctgcacacgttgccctgcaggtccacccccactgcactgttgcagctctccaggagcaggtgttctcagagctcggtttcccgccagccgtgcaacgctgggtcatcggacggtgcctgtgtgtgcctgagcgcagccttgcctcttacggggttcggcaggatggggaccctgctttcctctacttgctgtcagctcctcgagaagccccagccacaggagcccacccccagcacccccatctgttaataaatatctcaactccanggtgttccacctgaaaaaaaactagacataaaagagagaaaaaagtaggaataaa

SEQ ID NO: 511439 - DNA, 206 bp, Homo sapiens
ggaattcgcttaaatggattagtttctttgtggaaaagtaactgatgttataatgtatgatgttgactatttcactattccaataaaaccagtcagctttaaacaagcagcgtcatattaagagagataaacatttgccgctgttggtcctcgcaggccatttacgcggcaaaattccacacgtaatcctggtataagcacttctg

SEQ ID NO: 511440 - DNA, 224 bp, Homo sapiens
agcccaattttttacccgaaagaatcattgccttggcccctccctcccgggggcccccatcccctttagtgtttcccccctgggttaaccaggggaaaaacgggttgggggtagcctgaatgtgggccaagtcccctgtcccccttgggggcaaaagcccattgaaaaaaaacccccccccccccccccctattttgtcctggaaaatttttggggttggaacc

SEQ ID NO: 511441 - DNA, 188 bp, Homo sapiens
ttattaaatcacgtaaaataatgactttactatcatctgtaaagtaagattaattttaatctctctactaaaatggtttatattaaagtagattagggtaggaaaaaatcctaggaaatattagaatttaatgtatatttctaaactgaccccaaaaaaggcttttaatcagaaatatgacacgctat

SEQ ID NO: 511442 - DNA, 1929 bp, Homo sapiens
  misc_feature (29)..(29): n is a, c, g, or t
aatgccaggctgtacggagcggggtgcgncgtgtgggcgtggcgggggctggggtctgcgggcgaaggtggtagcccattggaggtcccgggagcgaagtccagctgccgttaggcgctgggatagtcgcacgctggatgcatctacgtccgccgagcccctggggcgaagaggccgcgtccgccttcagttgtggccggtgcttcgccccctgacccttcgcccccaaagaccagctctaacgtgagcgcctcggccgccctgccccagcctcgtacacgccgccagcctcgcccagccggtgtccggagaccctcgggccgtgtccatttgtgggcaaagccagcggggcaggcttggccagagtgcaccactcggcgccgtcccaggcccgacgctctgggcgcgcccggaaccccaggttcgcggcccgtgtttccgaccggcggagggggctcagcggcccgatcccacggaagcgcgctcggaggggtgggacccggccggaccggagatggcgccgccagcgggcggggcggcggcggcggcctcggacttgggctccgccgcagtgctcttggctgtgcacgccgcggtgaggccgctgggcgccgggccagacgccgaggcacagctgcggaggctgcagctgagcgcggaccctgagaggcctgggcgcttccggctggagctgctgggcgcgggacctggggcggttaatttggagtggcccctggagtcagtttcctacaccatccgaggccccacccagcacgagctacagcctccaccaggagggcctggaaccctcagcctgcacttcctcaaccctcaggaagctcagcggtgggcagtcctagtccgaggtgccaccgtggaaggacagaatggcagcaagagcaactcaccaccagccttgggcccagaagcatgccctgtctccctgcccagtcccccggaagcctccacactcaagggccctccacctgaggcagatcttcctaggagccctggaaacttgacggagagagaagagctggcagggagcctggcccgggctattgcaggtggagacgagaagggggcagcccaagtggcagccgtcctggcccagcatcgtgtggccctgagtgttcagcttcaggaggcctgcttcccacctggccccatcaggtgaggcctgggggctgcttcttcaccttgtcctcgtgaccatcccaggtccccatccatccctgaacccacattctggcacaggctgcaggtcacacttgaagacgctgcctctgccgcatccgccgcgtcctctgcacacgttgccctgcaggtccacccccactgcactgttgcagctctccaggagcaggtgttctcagagctcggtttcccgccagccgtgcaacgctgggtcatcggacggtgcctgtgtgtgcctgagcgcagccttgcctcttacggggttcggcaggatggggaccctgctttcctctacttgctgtcagctcctcgagaagccccagccacaggacctagccctcagcacccccagaagatggacggggaacttggacgcttgtttcccccatcattggggctacccccaggcccccagccagctgcctccagcctgcccagtccactccagcccagctggtcctgtccttcctgcaccttcatcaatgccccagaccgccctggctgtgagatgtgtagcacccagaggccctgcacttgggacccccttgctgcagcttccacctagcagccaccagaggttacaaggggagagtggcccttccctcacaagtccgacatctccaggcccccactgaactccggggacctctactgactgcttgctgggacagtcaccagggttggggggaagggccacaaaatgaaaccattaaagacccttaagagccaaaa

SEQ ID NO: 511443 - DNA, 1877 bp, Homo sapiens
  misc_feature (29)..(29): n is a, c, g, or t
aatgccaggctgtacggagcggggtgcgncgtgtgggcgtggcgggggctggggtctgcgggcgaaggtggtagcccattggaggtcccgggagcgaagtccagctgccgttaggcgctgggatagtcgcacgctggatgcatctacgtccgccgagcccctggggcgaagaggccgcgtccgccttcagttgtggccggtgcttcgccccctgacccttcgcccccaaagaccagctctaacgtgagcgcctcggccgccctgccccagcctcgtacacgccgccagcctcgcccagccggtgtccggagaccctcgggccgtgtccatttgtgggcaaagccagcggggcaggcttggccagagtgcaccactcggcgccgtcccaggcccgacgctctgggcgcgcccggaaccccaggttcgcggcccgtgtttccgaccggcggagggggctcagcggcccgatcccacggaagcgcgctcggaggggtgggacccggccggaccggagatggcgccgccagcgggcggggcggcggcggcggcctcggacttgggctccgccgcagtgctcttggctgtgcacgccgcggtgaggccgctgggcgccgggccagacgccgaggcacagctgcggaggctgcagctgagcgcggaccctgagaggcctgggcgcttccggctggagctgctgggcgcgggacctggggcggttaatttggagtggcccctggagtcagtttcctacaccatccgaggccccacccagcacgagctacagcctccaccaggagggcctggaaccctcagcctgcacttcctcaaccctcaggaagctcagcggtgggcagtcctagtccgaggtgccaccgtggaaggacagaatggcagcaagagcaactcaccaccagccttgggcccagaagcatgccctgtctccctgcccagtcccccggaagcctccacactcaagggccctccacctgaggcagatcttcctaggagccctggaaacttgacggagagagaagagctggcagggagcctggcccgggctattgcaggtggagacgagaagggggcagcccaagtggcagccgtcctggcccagcatcgtgtggccctgagtgttcagcttcaggaggcctgcttcccacctggccccatcaggctgcaggtcacacttgaagacgctgcctctgccgcatccgccgcgtcctctgcacacgttgccctgcaggtgttctcagagctcggtttcccgccagccgtgcaacgctgggtcatcggacggtgcctgtgtgtgcctgagcgcagccttgcctcttacggggttcggcaggatggggaccctgctttcctctacttgctgtcagctcctcgagaagccccaggtcagtcctcgatgggggtggggtgtgggaggtggggtgcagccccacagtcctgagctccaccccctcagccacaggacctagccctcagcacccccagaagatggacggggaacttggacgcttgtttcccccatcattggggctacccccaggcccccagccagctgcctccagcctgcccagtccactccagcccagctggtcctgtccttcctgcaccttcatcaatgccccagaccgccctggctgtgagatgtgtagcacccagaggccctgcacttgggacccccttgctgcagcttccacctagcagccaccagaggttacaaggggagagtggcccttccctcacaagtccgacatctccaggcccccactgaactccggggacctctactgactgcttgctgggacagtcaccagggttggggggaagggccacaaaatgaaaccattaaagacccttaagagccaaaa

SEQ ID NO: 511444 - DNA, 256 bp, Homo sapiens
ccctggtcgtaacagagcaggtgtggaggccttctgagtgtcagcgcctttcagatcatggtcatgcgaagtagtaaagtgaatttctacacccgtggttcatttagctagaggagtaacaatgaatggaatgcagaaggtccatggttgtcttctcttatctctagtatttggtgagtgcacaggtgacccacgtggccatggtgtgccttgatgtgtgatctgctgctcttctcagcacgggcgacagctccca

SEQ ID NO: 511445 - DNA, 108 bp, Homo sapiens
atggtctggaaaagggcctctggggaccatggacctgagctcgtagtcctcagccacctgctgttgccgttcctctcgttctgccagtttccccctttccagagcctt

SEQ ID NO: 511446 - DNA, 169 bp, Homo sapiens
gacacaccactaagactatacccataaccttccatagcacacctagatccagcctcaggacctaacaaagttttgagaaagaagctgtaagagcagagcttcgtgctctaaccgtgactggatggattctttcattagccattgtgtgccaccttccatattgatccca

SEQ ID NO: 511447 - DNA, 798 bp, Homo sapiens
tattattcattcctccaatctttttcttttaatgcctattctttcctaaaccttcccactacaccccctacacaaactcaataaaactccacacaattctccctaaagcaatcacatctatctctattttctgcatacctatttccctccaaatatactatcacgattcaccacactacctcacaccatcttcctcctctctatctacccattatttacaaccccaccactatatatatgactctcaatcatccatacttacttatataataaactactaacactactttgactaaagcatttatatatcactactatcttctctcaataatacaataaataaaactatcaactgtctcaccaaatacaaaacttcactatcctatctggaaaataacaacccccaccccaattactgccatcatctaatccattgcttcacaatctctacatcctctcgttactccctatgtatatcacctcttcatcgtcgtacatctcccccccaaccactccccccactaatcatatcatatttatagacaaatttcaccaatacaccaacacacaacccccacactgcccccacctcacctaataatcacagtactcaaattctataatagattgtgcacattaacacctagaaccacttatttaatcataccgcatccaccctaacctctattcatccaaataacaaacagcgataaataagaacacgaacaaaattccatcgctacacaacaaatcaacataacacaagtcacacaaacaaccaatcctcaccccctcacg

SEQ ID NO: 511448 - DNA, 205 bp, Homo sapiens
  misc_feature (51)..(51): n is a, c, g, or t
atccgtacgcccaatgacaacatctatggttatgtgaacagggccagttgncacaaagaggggaaatggctttttccctagactatggaagatttcactgaggaggcaaataggggcagggtcttgaagtcagagttgtccaaggaggcacacggctcaaaagcacgagatgcatgcatgtagcaagtggttgggcgtacgggga

SEQ ID NO: 511449 - DNA, 477 bp, Homo sapiens
tccttaattgcttttatggtattggaataggaattaaaagaaattaaagaatgtgtaaggagaaactcagttgtatgtaagaaaacccaattccccctgagaaagagaaagagttggagtcctttaaaaattaactgcctgtttttctgtggctagtgagccttatctctcctcctttcccagacattgtgaagaccctgtttctctagctgtgcagctgcaaggtcactagacagataaactcaagttgtaaaacatgtttttccttgaaaagtaagaaatgctgtaatgcatttctcaattaattaaataactgtctttgtttctcgcttctgtaatatgcttccccctgcacagatctccacccaccctacaaaatgcttaaaaggtaacttaactctttgttctgggctcagtcctttgggctgagtactgggccggtgcacctaaataataaatatcttcctgaaaaaaaaa

SEQ ID NO: 511450 - DNA, 700 bp, Homo sapiens
catccaaatggaatcagataagagtgcagtggtgcagtcatggctcactgcagcgtctgcctcctggactcaaagaatcctcctacctcagcctcccaagtagctaggaccacaggtatgtaccaccacacccagttattattatttttttttttcacagagacagggtctcactatgttgcccaggctggtctccaactcctaggctcaagcgatctacctgcctcaacctcccaaagtgctgggattacaggcgtgtgccactgggcctagcctggcattactcttacaaaggatacaccacggtaaggttataaaaaacatttctatgaatttgtgaattttgttcctagtagttttatactttgcttctttttttgagacagagtctcgctctgtcacccaggctgcagtgcagtggtgcaatctcagctcactgcaacctccacctcccaagttcaagtgattctcattcctcagcctcctgagtagtagctgggattacaggtgtgtgccaccatgcccggctaatttttgtatttttagtagagatggggttttgccttgtttgccaggctggtctcgaactcctggcctcaagaaatccacccaccttggcctcccaaggcgctgggattacatacatgagccaccgtgcccgactatactttgcttttttattaagggatttatattattt

SEQ ID NO: 511451 - DNA, 811 bp, Homo sapiens
ggtcaagagtgaaaaggtttacactcgccatggggtccccatctcagtcactggcattgcccaggttacaaatccaggtcgcacgaacacgggagatgttggtggccgtctgtcacatgttcctgcgcgaagcacggaccgctgatattgcccacattgccctgtagacgttcgagggccaccagagggccttcatggcccacatgactgtggaggcagatcgtataaggacaggctacgaaattctcagaacaggttttcaaagtggcctcctcagacctggtcaacatgggcatcagtgtggttagctacactctgaaggacattctcgatgaccaggactatttgcactctttgagggaaggctcgaacagctcaagtccaaaaagatgcacggattggagcaagcagaggccaacgagcagatgctgggatcctgggaaagctaaagccatagcaggaaaacggtgtctgctcagtacctgagtgagatcgacgatggccaaggcacacgagagattacgaactgaagaaggccgcctatgacatcgacggtcaaccacccgccgtagcactatggctgaccttggcctatctgcttcagagtggccaagactaagcagcagattgaggagcagcgggtgcaggtgcaggtggtggagccgggcccagcaggtgggcagtgcaggagcagggagatcgcccggcgggacaaggagcttgaaggccgggtgcggaaagaccagcgggagcggagcgctacaagcttggaacgctagccggagggcgcagaagtcccataattatgccg

SEQ ID NO: 511452 - DNA, 171 bp, Homo sapiens
  misc_feature (14)..(14): n is a, c, g, or t
  misc_feature (51)..(51): n is a, c, g, or t
  misc_feature (95)..(95): n is a, c, g, or t
  misc_feature (139)..(139): n is a, c, g, or t
cgggtgccggcgtnaggggcggctggcgggcatggcgtccggagcgtctcncttgctagtattggcacccgtcagtccggggctctccggagcgngcctagcttgaggaaagatggcgatgtctccgccgcatggagcngtctaggccggagcctggtaccgtcgaggtca

SEQ ID NO: 511453 - DNA, 560 bp, Homo sapiens
ctagtgggggcgtctgtggaagttctggtgggtctgggggctctgtggagggttgggggactgtggcattctaaggagggtctgggggactgtgggattctaaggaggatcttggggactgtgggattctaaggagggtctgggggactgtgggattctaaggaggatcttggggactgtgggattctaaggagggtctgggggactgtggggctctatgaagggcccagcaccccccgcctcgccctgcccgtggcacctggctctccgccggtgggtcgtactgtcgcagctgccccaggaactccaggtggcgcttctcctcctccagctgggccacggactcctcgctggcccgaagccgccgctgcgtctcctccagttcctcccgcagccacacgttctcctgggccagccgccgggcctgcgagcgcagccgctgcttctctgcctccagtgcacccacatgtgccgacagggccagcagcacctgcccggggtgggggtcccaagtcgaggttggttcctgccctgccagacggcccctgacccagcccagg

SEQ ID NO: 511454 - DNA, 578 bp, Homo sapiens
  misc_feature (79)..(79): n is a, c, g, or t
  misc_feature (93)..(93): n is a, c, g, or t
  misc_feature (104)..(105): n is a, c, g, or t
  misc_feature (111)..(111): n is a, c, g, or t
  misc_feature (114)..(114): n is a, c, g, or t
  misc_feature (118)..(118): n is a, c, g, or t
  misc_feature (121)..(121): n is a, c, g, or t
  misc_feature (123)..(123): n is a, c, g, or t
  misc_feature (127)..(127): n is a, c, g, or t
  misc_feature (131)..(131): n is a, c, g, or t
  misc_feature (153)..(153): n is a, c, g, or t
  misc_feature (168)..(168): n is a, c, g, or t
  misc_feature (171)..(171): n is a, c, g, or t
  misc_feature (177)..(177): n is a, c, g, or t
  misc_feature (183)..(183): n is a, c, g, or t
  misc_feature (201)..(201): n is a, c, g, or t
  misc_feature (210)..(210): n is a, c, g, or t
  misc_feature (212)..(212): n is a, c, g, or t
  misc_feature (214)..(215): n is a, c, g, or t
  misc_feature (217)..(217): n is a, c, g, or t
  misc_feature (220)..(220): n is a, c, g, or t
cgaggtcccaacgcgccacagagagtacatttgtgaggaaaagtcagatgagagatataaatgttgagggaagcagtangctaatcaaggaantagcctgcctnnaggttnggnatgngantnctgncatnagtcatgaaccatcagctcagntgccctcagggttgntcnggtaangaaatnaatgaagggtgccagtanggactgtcncncnntntanacagtgagagccatcaagatggaacactatccctcagctacagctgttcagtgccatgagcaaataccagcccattcttgccagagctttggctttttgaaaattattttttaatgttggcaactagttcacagtgttttacccccatgaattccacacaaaacagttctagggaccaacctttgggttatgatgtgtgctgtcttaaaattccattctatatgctttatctcaggctgttacaggttaggcgctctagaaagcagattctgagacagtgtagtaagcagggggtttactcagatagctgtctgtggtaggaatgggaaggaagcaggtgtgagagcgttgggggtac

SEQ ID NO: 511455 - DNA, 159 bp, Homo sapiens
atagcaaaggggcacatgggaagccagattcccctgagatttgacaagttatggacaaggctcaagtgaggtgtgtgggcagaggggcccgatttgcccaggatatctgccctccaactctccccctgaaatcatcccttgggtgggtttagtttcttt

SEQ ID NO: 511456 - DNA, 108 bp, Homo sapiens
  misc_feature (19)..(19): n is a, c, g, or t
atcgtaaccccgctggacntacgggtacaacctggtgtccctgcacgtaccgaacatgacactggacgggacctttttggacaccccgcgtggacacgtcgtgtctaa

SEQ ID NO: 511457 - DNA, 778 bp, Homo sapiens
gctctaccttgagcagggccaagctgaaggcctccagcaggacctccggccctcctctccggctttgccatggtggccatggtggaggtgcagctggagacgcagtaccagtacccgcggccgctgctgattgccttcagcgcctgcaccacggtgctggcggccgtgcacctgttcgccctcctcatcagcacctgcatcctgcccaatgtggaggccgtgagcaacatccacaatctgaactccatcagcgagttccccggcattggaagcgccattggaccccttacattgagctgggctgggggtttttcacacggggtcttgccggattctcaatcttctctctcgtggccgagtgtggtgtcgtgctctgcgtggtaatcagatgttcctcccgcgtggtatgcccggcgccagtctggacccccacctggccctgggagtcacacgggctggcaggccgcctggtgtccaccatcatcatggtgcccgtgggcctcatcttcgtggtcttcaccatccacttctaccgtccctggtgcgccacaaaacggagcgccacaaccgcgagatcgaggagctccacaagctcaaggtccagctggacgggcatgagcgcagctgcaggtcttgtgaggggccgagggccgggctgggagcggcctgtgcccgggagtccgcaaggcgggatttgtcagatgcagacatttgcaagctgcggtagtaaaaacaaagttctctgtctatacataggatgataactttctaaaaaacg

SEQ ID NO: 511458 - DNA, 967 bp, Homo sapiens
  misc_feature (501)..(501): n is a, c, g, or t
gtttactccgcaccttgtgtgtcggtgacgaacgagcgccttatgagcttgccgcaaccggggagcagcgcagagcaaatatgcttgatccatgtccgttagaggaattgatctgatctgagggccacctgctatgttcgatgtgcgaaatgttgcagcaagactctgatgacccgaatcatggtctgccgaattagcggtatgtattgtgtccttacacgcgtgtcgtgatgagtttgcactgttgacgatacttgggctgatgtatggcagtaccatgtgagtgaacaggttcgtgcgtacagatagtattacaaggaccgtgtgtggttgtaaagactgctcgcacgtggataattcaccccggccgtgactacaccttacaatgtgcgctgcggcatcttgacagcgttccatcagagactgcttgtgtttacattggcctccaaatcgtgtgaggcagccagagggtatagcatgtgtcctggtacgatcgcttgnaaaagtacacagtgggcttgcctcctgctatagatgtgctagcgtagccgatttgcgttgtgtctctcaatacacaagaggcccttcattacgagagtaacgcgcaagcattctgcataagttgcctcctatggaaacaacaaccagtgttctcggccgaagacgtctggggaaagaaacactcgcatcggggacatatttctatgaaacgctgagcatggtagcggaagaaccataatgtaccatatagggacgaggatcgatcgcgaggcccaatggagtccggctgtaaccccaaaggacgtgatcgaggacctggtacccctttggtagttacgggcttggtttcaattctttatcccttttagcatgtgcgtgctggaatccgtttttcgctggagtaacctagtcattaaagggagctccgttttaatactttgcaagacgtggtgggggtaattggaga

SEQ ID NO: 511459 - DNA, 726 bp, Homo sapiens
cccccaaacccttttctctctcactctctgcctccaacttcagattgactttcaatagtttttctaagacctttgaactgaatgttctcttcagccaaaacttggcgacttccacagaaaagtctgaccactgagaagaaggagagcagagatttaaccctttgtaaggccccatttggatccaggtctgctttctcatgtgtgagtcagggaggagctggagccagaggagaagaaaatgatagcttggctgttctcctgcttaggacactgactgaatagttaaactctcactgccactaccttttccccacctttaaaagacctgaatgaagttttctgccaaactccgtgaagccacaagcaccttatgtcctcccttcagtgttttgtgggcctgaatttcatcacactgcatttcagccatggtcatcaagcctgtttgcttcttttgggcatgttcacagattctctgttaagagcccccaccaccaagaaggttagcaggccaacagctctgacatctatctgtagatgccagtagtcacaaagatttcttaccaactctcagatcgctggagcccttagacaaactggaaagaaggcatcaaagggatcaggcaagctggggcgtcttgcccttgtcccccagagatgataccctcccagcaagggggagaagttctcacttccttctttagagcagctaaaggggctaccccagat

SEQ ID NO: 511460 - DNA, 799 bp, Homo sapiens
gatggcgttggtcgcggctggccctgggggtggccgtgcgcgttcgccgcgcgtgctggctcctcctcgtcctatgtcctctctcctacttgtgagcctctgggctgcgtgcgcggaggggtcttcgcgcggtctgctcatgcgcgcagcgactcccgggtgctgctcttccgagtcgggatacgatctgtgcccccgtggctggctccggggtacctcttctaccgacaggagctgcgcagggctcaggcaatcgcgtacccctagagaggcgcacgtcggaatagaccgcagccccgcctcttcagatggaggtgaagggtgcttcccatcgcctgtcctctcggacaactacaggtatctcatcatcgacatccaggccgttggctggggttgtggacccttcaaaccctcgggctgtgcaggtttccattgaaaaggaaggagtgtcaccttggtctgcacattctgtgtactcacaagtcgactgggaccactagtggagggaaccgtgacctcatgccggcggtagccgggactgtcgaggttgtacgggagtgccctcacggaacggcactcccctaaccttcacccgatccccttgtgctcatcaacgactgtggtcaggcgtgggacggcttcagactccggggcctggctacacctggccacacacaaggccatctggtctacctactggattggggagccctacaagggtccctcctgcctcttctcagggagacctgctcttcctctctggctgtgggcggacctttgagggcaatgcagagaccag

SEQ ID NO: 511461 - DNA, 414 bp, Homo sapiens
  misc_feature (3)..(3): n is a, c, g, or t
aanccctccgaaatgtatttgagcttggacccccctgtgatgcttgatgctgcaacaccttaaacccatgaagatttcccgttttgaaaggcatttatataactctgcagctttcaaagctcgaacaaaagctcgaagcaaatgccgagataagagagcagatgttggagaattcttgtagatgtctgaatttgatggctgttttctaatctcttcctttattattatttttgctacttctaatgtatataagcttttagagacagttttttatcttggtcaacttaaataatttttgatgtaggggtgggttgtattttaatttaatgtacagtgttacaaattaatgagttctttattctctgtaaaaataactggtaaccacaaataaagtgtttgtgatgtttggtcgta

SEQ ID NO: 511462 - DNA, 1216 bp, Homo sapiens
  misc_feature (507)..(507): n is a, c, g, or t
  misc_feature (604)..(604): n is a, c, g, or t
ggaggttacagtgagcccagatgtaccattgcactccagcctgtgtgacagagcgagattctgtctcaaaaacaaaaacaaaaaaaacaaaaaaaaacacaaaaattagcgggcatggtgacacgcacctgtagtcccagctactcaggaggcagagaggtggtaggattgcttgagcccaggagtcaacactggagtaagccatgacacttttatccagctgggtgacagagcaagaccctgtcaaaaaaaaaaaaaaaaaagatttggcttggattttggaaaccaaaagcccctcgtttaaacaacggttttggaaaaacttggtgggcccaatgtgggggcccatacacaattacctttccagaagcgttcaaagcgtgctaccttctcccattctcttggggccttggaacaccaccccaattattcttccagaggaatttcgccgagctcaacagagtttcacaaggccattccacgtggggggcgtgccggaaagattgncccccaggggcccttcttcgtggctacaaaccgggtcgctccctgggcgaacaagcgccggggcttcgtagacaccaacttttggagactccccctngggcgattggggaccaggaactctccacaaaattatacctccttacacccggagagaaccccttagggtggtatcaacttggcggctaacaggcaacggtggacccgggggaagagtcatctccctgagagaatgatctagtgtgacaaccattcttttcacaggggggggcaactggggagaactactttccgcgttgtgataaaaacactttccatatggggcgaggttttatgagggatttttacacctccaaccacagtggagaagtccccgggcgttatccaatccgtataccccaacttttttcccccaggttggattgcgactaccatatgagaagtccccccatacattaggatttcctccgacaatctcgacccaacggacacgttggggaaacattttttaaacggcctaccaaaaacacacaggctacattctctggtgaaccgcaacgaaaacacatctgcgtcggacaaattttcctttgacaaagcgtgttcctttcaccagcgtatacaaacacacccaccaaacgtgtcaactcaccggaaggagggaccctgctgccttctcacacgtgttccaagggccagtatccccacatag

SEQ ID NO: 511463 - DNA, 497 bp, Homo sapiens
tttttttgagaaggagtctcattctgtcacccaggctggagtgcagtggcgcgatctcagctcactgcaacttccgcctcctgggttcaagtgattctcccgccttaccctcccgagtagcagggaccacaggcacgtgccaccacacccagctcatttttatatttttagtagagacggagtttcaccatgttgggcatggtggcgggcactgtaatcccagctactggggaggctgaggcaggagaatcgcttgaaccccggagcggaggttgcagtgagctgatatcatgccattgcactccagcctgggcaacaagagcaaattctgtctcaaaaataaataaaaataaaaagactttttaaatctgattgctgtcaggtatacatggataacacttttctgaaaggttaatttggcaaaatgtcaagtttttaactgaaatataccaaaatacttacctggaagatgcttcaaaataatgcaaaagtaggtg

SEQ ID NO: 511464 - DNA, 102 bp, Homo sapiens
tatagaacgtgtgactgtgatttatcctcccatcataaattatagcgagaaaactggacctcatatattacataacacttttcaagactttccgtatgggct

SEQ ID NO: 511465 - DNA, 103 bp, Homo sapiens
ttgatcatgctgacaaggctgtgtggtgggacacccaacgacacgcgggtgctcacccctccgcaacgtccttgctggtgcagacgacagcggcgggctctgg

SEQ ID NO: 511466 - DNA, 1055 bp, Homo sapiens
aagtggtggcagggaaggcctcattgaggtgacactggagtgaaatttgaaggtcatggcatgaaccatgtgaccaaggaagcagcaaacaaaccctgaggcagcaagagcaactcaccaccagccttgggcccagaagcatgccctgtctccctgcccagtcccccggaagcctccacactcaagggccctccacctgaggcagatcttcctaggagccctggaaacttgacggagagagaagagctggcagggagcctggcccgggctattgcaggtggagacgagaagggggcagcccaagtggcagccgtcctggcccagcatcgtgtggccctgagtgttcagcttcaggaggcctgcttcccacctggccccatcaggctgcaggtcacacttgaagacgctgcctctgccgcatccgccgcgtcctctgcacacgttgccctgcaggtccacccccactgcactgttgcagctctccaggagcaggtgttctcagagctcggtttcccgccagccgtgcaacgctgggtcatcggacggtgcctgtgtgtgcctgagcgcagccttgcctcttacggggttcggcaggatggggaccctgctttcctctacttgctgtcagctcctcgagaagccccagccacaggacctagccctcagcacccccagaagatggacggggaacttggacgcttgtttcccccatcattggggctacccccaggcccccagccagctgcctccagcctgcccagtccactccagcccagctggtcctgtccttcctgcaccttcatcaatgccccagaccgccctggctgtgagatgtgtagcacccagaggccctgcacttgggacccccttgctgcagcttccacctagcagccaccagaggttacaaggggagagtggcccttccctcacaagtccgacatctccaggcccccactgaactccggggacctctactgactgcttgctgggacagtcaccagggttggggggaagggccacaaaatgaaaccattaaagacccttaagagccaaaa

SEQ ID NO: 511467 - DNA, 1635 bp, Homo sapiens
  misc_feature (29)..(29): n is a, c, g, or t
aatgccaggctgtacggagcggggtgcgncgtgtgggcgtggcgggggctggggtctgcgggcgaaggtggtagcccattggaggtcccgggagcgaagtccagctgccgttaggcgctgggatagtcgcacgctggatgcatctacgtccgccgagcccctggggcgaagaggccgcgtccgccttcagttgtggccggtgcttcgccccctgacccttcgcccccaaagaccagctctaacgtgagcgcctcggccgccctgccccagcctcgtacacgccgccagcctcgcccagccggtgtccggagaccctcgggccgtgtccatttgtgggcaaagccagcggggcaggcttggccagagtgcaccactcggcgccgtcccaggcccgacgctctgggcgcgcccggaaccccaggttcgcggcccgtgtttccgaccggcggagggggctcagcggcccgatcccacggaagcgcgctcggaggggtgggacccggccggaccggagatggcgccgccagcgggcggggcggcggcggcggcctcggacttgggctccgccgcagtgctcttggctgtgcacgccgcggtgaggccgctgggcgccgggccagacgccgaggcacagctgcggaggctgcagctgagcgcggaccctgagaggcctgggcgcttccggctggagctgctgggcgcgggacctggggcggttaatttggagtggcccctggagtcagtttcctacaccatccgaggccccacccagcacgagctacagcctccaccaggagggcctggaaccctcagcctgcacttcctcaaccctcaggaagctcagcggtgggcagtcctagtccgaggtgccaccgtggaaggacagaatgccgtcctggcccagcatcgtgtggccctgagtgttcagcttcaggaggcctgcttcccacctggccccatcaggctgcaggtcacacttgaagacgctgcctctgccgcatccgccgcgtcctctgcacacgttgccctgcaggtccacccccactgcactgttgcagctctccaggagcaggtgttctcagagctcggtttcccgccagccgtgcaacgctgggtcatcggacggtgcctgtgtgtgcctgagcgcagccttgcctcttacggggttcggcaggatggggaccctgctttcctctacttgctgtcagctcctcgagaagccccagccacaggacctagccctcagcacccccagaagatggacggggaacttggacgcttgtttcccccatcattggggctacccccaggcccccagccagctgcctccagcctgcccagtccactccagcccagctggtcctgtccttcctgcaccttcatcaatgccccagaccgccctggctgtgagatgtgtagcacccagaggccctgcacttgggacccccttgctgcagcttccacctagcagccaccagaggttacaaggggagagtggcccttccctcacaagtccgacatctccaggcccccactgaactccggggacctctactgactgcttgctgggacagtcaccagggttggggggaagggccacaaaatgaaaccattaaagacccttaagagccaaaa

SEQ ID NO: 511468 - DNA, 796 bp, Homo sapiens
ctctacaggatccttaaggtggttgtgggtagggggcagcccaagtggcagccgtcctggcccagcatcgtgtggccctgagtgttcagcttcaggaggcctgcttcccacctggccccatcaggctgcaggtcacacttgaagacgctgcctctgccgcatccgccgcgtcctctgcacacgttgccctgcaggtccacccccactgcactgttgcagctctccaggagcaggtgttctcagagctcggtttcccgccagccgtgcaacgctgggtcatcggacggtgcctgtgtgtgcctgagcgcagccttgcctcttacggggttcggcaggatggggaccctgctttcctctacttgctgtcagctcctcgagaagccccagccacaggacctagccctcagcacccccagaagatggacggggaacttggacgcttgtttcccccatcattggggctacccccaggcccccagccagctgcctccagcctgcccagtccactccagcccagctggtcctgtccttcctgcaccttcatcaatgccccagaccgccctggctgtgagatgtgtagcacccagaggccctgcacttgggacccccttgctgcagcttccacctagcagccaccagaggttacaaggggagagtggcccttccctcacaagtccgacatctccaggcccccactgaactccggggacctctactgactgcttgctgggacagtcaccagggttggggggaagggccacaaaatgaaaccattaaagacccttaagagccaaaa

SEQ ID NO: 511469 - DNA, 1418 bp, Homo sapiens
  misc_feature (29)..(29): n is a, c, g, or t
aatgccaggctgtacggagcggggtgcgncgtgtgggcgtggcgggggctggggtctgcgggcgaaggtggtagcccattggaggtcccgggagcgaagtccagctgccgttaggcgctgggatagtcgcacgctggatgcatctacgtccgccgagcccctggggcgaagaggccgcgtccgccttcagttgtggccggtgcttcgccccctgacccttcgcccccaaagaccagctctaacgtgagcgcctcggccgccctgccccagcctcgtacacgccgccagcctcgcccagccggtgtccggagaccctcgggccgtgtccatttgtgggcaaagccagcggggcaggcttggccagagtgcaccactcggcgccgtcccaggcccgacgctctgggcgcgcccggaaccccaggttcgcggcccgtgtttccgaccggcggagggggctcagcggcccgatcccacggaagcgcgctcggaggggtgggacccggccggaccggagatggcgccgccagcgggcggggcggcggcggcggcctcggacttgggctccgccgcagtgctcttggctgtgcacgccgcggtgaggccgctgggcgccgggccagacgccgaggcacagctgcggaggctgcagctgagcgcggaccctgagaggcctgggcgcttccggctggagctgctgggcgcgggacctggggcggttaatttggagtggcccctggagtcagtttcctacaccatccgaggccccacccagcacgagctacagcctccaccaggagggcctggaaccctcagcctgcacttcctcaaccctcaggaagctcagcggtgggcagtcctagtccgaggtgccaccgtggaaggacagaatggcagcaagagcaactcaccaccagccttgggcccagaagcatgccctgtctccctgcccagtcccccggaagcctccacactcaagggccctccacctgaggcagatcttcctaggagccctggaaacttgacggagagagaagagctggcagggagcctggcccagcccagctggtcctgtccttcctgcaccttcatcaatgccccagaccgccctggctgtgagatgtgtagcacccagaggccctgcacttgggacccccttgctgcagcttccacctagcagccaccagaggtaccagaggtggcacaggcaggggaggtggggggcagggcagaatccacaggaatgacccagctcctcccccacaggttacaaggggagagtggcccttccctcacaagtccgacatctccaggcccccactgaactccggggacctctactgactgcttgctgggacagtcaccagggttggggggaagggccacaaaatgaaaccattaaagacccttaagagccaaaa

SEQ ID NO: 511470 - DNA, 1251 bp, Homo sapiens
  misc_feature (29)..(29): n is a, c, g, or t
aatgccaggctgtacggagcggggtgcgncgtgtgggcgtggcgggggctggggtctgcgggcgaaggtggtagcccattggaggtcccgggagcgaagtccagctgccgttaggcgctgggatagtcgcacgctggatgcatctacgtccgccgagcccctggggcgaagaggccgcgtccgccttcagttgtggccggtgcttcgccccctgacccttcgcccccaaagaccagctctaacgtgagcgcctcggccgccctgccccagcctcgtacacgccgccagcctcgcccagccggtgtccggagaccctcgggccgtgtccatttgtgggcaaagccagcggggcaggcttggccagagtgcaccactcggcgccgtcccaggcccgacgctctgggcgcgcccggaaccccaggttcgcggcccgtgtttccgaccggcggagggggctcagcggcccgatcccacggaagcgcgctcggaggggtgggacccggccggaccggagatggcgccgccagcgggcggggcggcggcggcggcctcggacttgggctccgccgcagtgctcttggctgtgcacgccgcggtgaggccgctgggcgccgggccagacgccgaggcacagctgcggaggctgcagctgagcgcggaccctgagaggcctgggcgcttccggctggagctgctgggcgcgggacctggggcggttaatttggagtggcccctggagtcagtttcctacaccatccgaggccccacccagcacgagctacagcctccaccaggagggcctggaaccctcagcctgcacttcctcaaccctcaggaagctcagcggtgggcagtcctagtccgaggtgccaccgtggaaggacagaatagccttgcctcttacggggttcggcaggatggggaccctgctttcctctacttgctgtcagctcctcgagaagcccagcccagctggtcctgtccttcctgcaccttcatcaatgccccagaccgccctggctgtgagatgtgtagcacccagaggccctgcacttgggacccccttgctgcagcttccacctagcagccaccagaggttacaaggggagagtggcccttccctcacaagtccgacatctccaggcccccactgaactccggggacctctactgactgcttgctgggacagtcaccagggttggggggaagggccacaaaatgaaaccattaaagacccttaagagccaaaa

SEQ ID NO: 511471 - DNA, 160 bp, Homo sapiens
gctggcccgcctttccgatggccatgctttcctggtagccctgggggtcttcagcaccaggaggtctgggtcacctgtttgttccaatgccagccagtgagccccaatgtctcccttactcccctgcctcccagtgaagtcctggagggccaggggggcc

SEQ ID NO: 511472 - DNA, 1331 bp, Homo sapiens
  misc_feature (29)..(29): n is a, c, g, or t
  misc_feature (1188)..(1188): n is a, c, g, or t
  misc_feature (1199)..(1199): n is a, c, g, or t
  misc_feature (1211)..(1211): n is a, c, g, or t
  misc_feature (1218)..(1218): n is a, c, g, or t
  misc_feature (1223)..(1223): n is a, c, g, or t
aatgccaggctgtacggagcggggtgcgncgtgtgggcgtggcgggggctggggtctgcgggcgaaggtggtagcccattggaggtcccgggagcgaagtccagctgccgttaggcgctgggatagtcgcacgctggatgcatctacgtccgccgagcccctggggcgaagaggccgcgtccgccttcagttgtggccggtgcttcgccccctgacccttcgcccccaaagaccagctctaacgtgagcgcctcggccgccctgccccagcctcgtacacgccgccagcctcgcccagccggtgtccggagaccctcgggccgtgtccatttgtgggcaaagccagcggggcaggcttggccagagtgcaccactcggcgccgtcccaggcccgacgctctgggcgcgcccggaaccccaggttcgcggcccgtgtttccgaccggcggagggggctcagcggcccgatcccacggaagcgcgctcggaggggtgggacccggccggaccggagatggcgccgccagcgggcggggcggcggcggcggcctcggacttgggctccgccgcagtgctcttggctgtgcacgccgcggtgaggccgctgggcgccgggccagacgccgaggcacagctgcggaggctgcagctgagcgcggaccctgagaggcctgggcgcttccggctggagctgctgggcgcgggacctggggcggttaatttggagtggcccctggagtcagtttcctacaccatccgaggccccacccagcacgagctacagcctccaccaggagggcctggaaccctcagcctgcacttcctcaaccctcaggaagctcagcggtgggcagtcctagtccgaggtgccaccgtggaaggacagaatggtcagtgccctgtaatggatacaattacaatttggaatagccttggccccccagtcctggttggggaagtggatccaccttccccactgctggatgtctgggaaggcttccaggagggagtaggtggagcctggagtagcttggagtacttggagtggctgctggagtcagtctcctacaccatctgaggccccagccagcacaagttgcagctccaccaggaagccctggaacctcagcctgcacttccttaaccctcaggaaggatgagagggcaagcatgaacgaggcagagcanggcagggtcangacctgtgtgangaagacntcatnccaagagcagacgaacagttgaccggaatgggcaccaactgcaagactcatacaccctgctaaaaccggttcgcactgccaggtcgggcccaacaggtggcgacaaag

SEQ ID NO: 511473 - DNA, 190 bp, Homo sapiens
agcttgaaaacttgggtcattgagccagcgggagtcatgtggctctgttcggagacttggacgttgccctaggctgtgagaagatggtaaatgtctcgtccgcatgaggtcttgctgccaccccctgagtatacgctcctccccgcaccagacacggagtgcagccctgatgcctggtggtcatagagga

SEQ ID NO: 511474 - DNA, 435 bp, Homo sapiens
tccgatgtgctcagatagaatcttatagaatcttacaaaaccctatcttagtatatgggattcatataaaacataacaatttctttttggggggcaggagtggagtctcactctgtcacccaggctggagtgctgcggcctgatctcggctcactgcaacctctgtctgttgggttcaagcaattctcatgcctcagcttctcaagtagctgggatgacgggtgcccacctccacacctggctaatttttgtatttttagtagagatggggtttcaccatgttggacaggtatgttcctgaactcctgacctcagatgatctgcccgcctcggcctcccaaagccctgggattacaggtgtgagccatcgtgcccagcccatttgccaactttttaattggatttttatttttttatacctgtaattagagtctc

SEQ ID NO: 511475 - DNA, 397 bp, Homo sapiens
ttttttttttaggccgtggcaaagattttattatgaagactccaaaaacaattgcaacaaaaataaaaattgataagcaggacctaattaaactaaagggcttctccacaggaaaaacaaaccagtaaaacaaaaacaaacaaacaaaaaaaaaaactcgagactagttcgagatgtgtagcacccagaggccctgcacttgggacccccttgctgcagcttccacctagcagccaccagaggttacaaggggagagtggcccttccctcacaagtccgacatctccaggcccccactgaactccggggacctctactgactgcttgctgggacagtcaccagggttggggggaagggccacaaaatgaaaccattaaagacccttaagagccaaaa

SEQ ID NO: 511476 - DNA, 383 bp, Homo sapiens
agtacttggtacccacttttggtgaggacaggatgaatgtatggactgggcaagaaaactagtgggtgtgtaaggttctcacgctggagatcgttgaccacgacgccgtcgagctccagggttgtgtgcggtgagtgcgttgccacagtacccttgactccaagcagcgccccacctggactaatgctgcctgcagttgtcttacaagacaacaccagctagagctggggtagccactctaccctctcaagaaaccaaggggaacaatgcacccctgttgcccatgaccaccagtttggccgtaggtctctctctgatggtagcaatacactgggggctgcctctgggcgcccctgctccattgtcctcccaccacaaacgtg

SEQ ID NO: 511477 - DNA, 134 bp, Homo sapiens
atcaggcgagctgggttcagtatcctctttcttgctccaataatcttgctcatccccactataccaaacgtccctttctgagcctagtgggtatgggtacaaatcacagtgtcagtctgggtaactggtgccac

SEQ ID NO: 511478 - DNA, 754 bp, Homo sapiens
  misc_feature (281)..(281): n is a, c, g, or t
  misc_feature (435)..(435): n is a, c, g, or t
  misc_feature (484)..(484): n is a, c, g, or t
  misc_feature (752)..(752): n is a, c, g, or t
  misc_feature (754)..(754): n is a, c, g, or t
gctggcccacaggaattctgttttatttaaatggggggtagaaccaaaattgagccaagcaggctggcttctggagtttgaacccttaatttccctccttaaaccaccctttgggagaaattggggtctctggggtccagccttgggttttttgccctgggggttttaagggggcggggggttggggcgcctctttttggggggggttttttggggggggccgagagagggccccttttttttttggggagagtttttcgcggggggtgttttactaaaanggggggggggggaaccacccggggtgttttttctttttttaccccccaaatatgggggtcttcatataggatggggggggggggggggggggcttcttcttttttttttattttttttttttgggaagaaaaaaaaaaaatttttttttttttnttttttctccccccccttttttgtttgggtgggggggggaggggggggngggagaaaaaactccctctttttttttttgttgacccccccacccccccggggggggggtttttttttttttttttggggggggggggtttttttttttttttcccgcccgccccctataaaaggggggggggggggggggacacccccaaccttttttttttttttttttttttttaaccaacaaacaaaaactctttttttgttgaaacaaaaatacggtttttcttttgtgtgtgagcggggttctttttatttttttttttttngn

SEQ ID NO: 511479 - DNA, 455 bp, Homo sapiens
cacgagggcttcgatgccgcggccgtcatgcggccttgccggcgaacaggccctgcggccggatcgacaggatgattaccagcagcacgaaggcgatgatgtccttgtagtcggtcgacacgtagaagccgccgaagctctccgccatgccgatgatcaggccgccgaggatcgcgccggggatgctgcccatgccgccgaggatgatgatcacgaaggccttggtgatgaccaggtgccccatcgccggatagaccagattgatcggcgcatacagcgttgcggcaatcgccgcgagcgcgcccgagatcgcgaacaccagcagcgtgacgcgcgtggcgtcgatgccgaccagcgccgcgccttcgcggttctgcgccatcgccacgatggtcgagccggtgaccgtgcgggtcaggaacagatgcagcaccaccatcagcgtgaaggcggcg

SEQ ID NO: 511480 - DNA, 681 bp, Homo sapiens
  misc_feature (546)..(547): n is a, c, g, or t
  misc_feature (586)..(586): n is a, c, g, or t
gctcccggggcgtttgagcgggctcaccctgagcccgcgtggccaacgcggatccaggcccgactggcgggaccgccccggattccccgcgggccttcctagccgccatggaggacggcgtctatgaaccccacagacctagactcctgtgagtgatgctggatgtgatgcttgtgatgaagcatcctgtgctggctgtgaagcatggatgcttgcttgtgttgtgacgattcatgcgcctgctggtgagtgagctcagtgaagccatgagcgatggtgtgaggtggcttggagtgccaatgatgggcagtaagaccttgcaactggaacctggaagatggcaatggtgcatggaatgaagttcaacattggaccccaagaatggggatccagttcttgtgtcgtgagaatgaactgctgcagaacacaccctgatggagatctgccctgcttcctgtacaagggctgacggggctgaacaagacagccatcggggactacctgggggagacgggaagaactgaacctggcagtgctccatgcttnngtggatctgcatgagttcaccgacctcaatctggtgcangccctcaggcagtttctatggagctttcgcctacccggagaggcccagaaattgaccggatgatggagggcttccgcccagggatactgctgtgc

SEQ ID NO: 511481 - DNA, 497 bp, Homo sapiens
  misc_feature (6)..(6): n is a, c, g, or t
  misc_feature (18)..(18): n is a, c, g, or t
  misc_feature (78)..(78): n is a, c, g, or t
  misc_feature (87)..(87): n is a, c, g, or t
  misc_feature (100)..(100): n is a, c, g, or t
  misc_feature (138)..(138): n is a, c, g, or t
  misc_feature (207)..(207): n is a, c, g, or t
  misc_feature (210)..(210): n is a, c, g, or t
  misc_feature (301)..(301): n is a, c, g, or t
  misc_feature (362)..(363): n is a, c, g, or t
  misc_feature (402)..(402): n is a, c, g, or t
ttaggngttacccttgtntgcctacgtgggtagcatggggatcattggagagaggtgacagtaggtagcatacatgtntgcggcatnactcccaactgtncaaaggtctggcctaagcagggttcccaagccagatancctcccaagagtgtagtctgaggatcccccaccctgggggcaggcctgtgtgggagtcagcaggaaacncancctcggcagtgggcagctgtggtgcattagagagggcacgacttccccagggcatagccctttgcccattcctgccccatcctgaccaaantgtatgtgtctttgtcccatccttccagggaagaactgaacctggcagtgctccatgcttnngtggatctgcatgagttcaccgacctcaatctggtgcangccctcaggcagtttctatggagctttcgcctacccggagaggcccagaaattgaccggatgatggagggcttccgcccagggatactgctgtgc

SEQ ID NO: 511482 - DNA, 396 bp, Homo sapiens
cagtagtaaatctcagcaatatatattaggcaagccacgcatctgtgcacatcccataaaggatgcctctatattcactaacattggcttaagactcgatttcagggtctactcctatgtccaggaccagtaccatggtgtagtccatgatagtgttaacacgctgttcaatggtcaggacagtccaggtatctaactgtgtccgaatggtagcctggatgaggctgtcagtatccagggcgatgtcaactgtgacctggtctagacctaggatgagtatcgcacggcgcagggctcggcccaggcactctagatgcctatggagcacgctaagattcaccccgccctttgagctctggaagtccaggactgccggctgagagctctcaaacatgt

SEQ ID NO: 511483 - DNA, 970 bp, Homo sapiens
  misc_feature (768)..(768): n is a, c, g, or t
agggaacaacttgtcagtaatcgtgcgttatcctgccctatgtaatcttctaatcaggtcctgcgtgaccttgcatccgtggatgttggacgatgttataactcacaacacgtctctatgcgattgtctgggctaagctttaagatgtgagttcgaggcacttgatgaagcagctcgtctctctgaaccgttatgagaaaaccactgaacgatcgtcgtcagaccgtagtaaccaaccatgtctcagagagggaatattataaatgcaatgacataggccaaaagagtgggtccgcattgcttgtgtcgcacgcgaaggcggataagacgctgccttataaaatcgaatagtagaagaaatgtgtcacgagaaacaccattaaggaaccgagatgacgaggcagtactacgacattgtgcactgtagtaaaagagccatgctcgagttgagactagagagagtctatgtggttggggcgcctgcatgaccgctcccacactgaacatgatccggatcttgggtgagactcatgtctcttgcagtactattaagttggcgactttgccttggcttttgtctaactttgtcctccttcattgccttagtctagagacttataggagtgacacacgctgctgtcaattgcgagtctcgagaagtatgagctgctgggttctatcagtacacttatgtaggacggcataactctgagatatatccaactgacatactgacttatatggccttatagatagcatacaacaggnttttcccctcttgcattattattcttataacaatttattatttatgtacctttaatttttactttcaagtggccaggacattcgaacctattgggcactatggttcttttgggattggattacatgtacaaatccagaagagggtagaaaccaggccacaagcagcttcgctttttctctggcatgatacttcctgtttatg

SEQ ID NO: 511484 - DNA, 107 bp, Homo sapiens
  misc_feature (4)..(4): n is a, c, g, or t
ggtnagggtaccagtatagcctcattaacacacactcccatgacacagcggcatggcactgcagccatgggacacttgagctccccacagtcagctccagtgaaacc

SEQ ID NO: 511485 - DNA, 188 bp, Homo sapiens
  misc_feature (173)..(173): n is a, c, g, or t
tatcctaagtattctagtattctgatgcacagcttactagaaatacttctaaaatggtatataatcatcatgattacctactttaaaaagaggggtatctgtttctcttacattaataacctgaaatgagtctatgcaatattttaagaaatacagtaacactgctgagtgtngttaggtctagctgg

SEQ ID NO: 511486 - DNA, 469 bp, Homo sapiens
gacaaacacaaactcgcgtgccggtgcatccgcccaggttgttttgctcactgccgctctgagcgcagttactggccagattagcgcgaaaattatcatcgttattagtaggttaactctcattctcttctcctgtctcggtcaccgccgcccacgatgagaggccgctgcagaccacatcaccgacccagatcggcaccgcgcgcctggttgagttccagagccacttcgcaggttttattgccactgtagcgaaaatcgatagtggggtatttcttatccacgtccatgacaaactcgccgttttcatcggttcgggttcggccgatatggttgttaatccgtgcgttagccagcagtgtgccgtcttccgcacggatacgaccggagacggtaaccatctgcttcacctctggctcaatgacagcgacattgcctggatagagagtcagacgacttttgcggccgc

SEQ ID NO: 511487 - DNA, 285 bp, Homo sapiens
  misc_feature (168)..(168): n is a, c, g, or t
agaggatccccgccttagggagcggtcttagggatgttaatgggctccttcaggtctcccttcaggtggggcgtccgctcctggatgagttcgcggccatgctttatccagtcctgcttgttctctatgctggaagccttaaggacaattttattatctgaagtcggngttctccccacccacagtgcaaattttgcaagggctccttcaacatgttctgtgacacccaactctgaggtaaacaatttgcttttataaaggtacttgcttctccctaagacccta

SEQ ID NO: 511488 - DNA, 337 bp, Homo sapiens
  misc_feature (295)..(295): n is a, c, g, or t
  misc_feature (328)..(328): n is a, c, g, or t
tagtgatgggggtctcactatgttgcccaggctagtcttgaattcctggcgtcaagaattctcccaccttggcctctcaaagccctgggattattctacatgtgagccatgatgctcggccctgatttatgattgccttttttttttttaagacagggtctcacttcgtcactcaggttggagtgcaggtatgtgatctcggctcactgcaacctccacctcccgggttcaagcaattcttgtgcctcaatctcccaaattgctgggatatgccaggtgcaatggctcacacttntaatcccagcactttgggaggctgaggttggtnggataactt

SEQ ID NO: 511489 - DNA, 306 bp, Homo sapiens
ttttggggtcccttttttaaaagtttaaaaaaatgttgccaagggagttcggtttttaacccatgccttgggggtgatgccaaccattcccgtcgttgggatttaaagggtattagtcccgccagtatggggaagtagtttcggggatcctgttgtgaaatttaaactgtaaaagtaaatggtttaaaggactggggtgttgctctgtttgggaagacctaattttgtttggtcagggacaaaatttttaatccctttttttcccccttccagcccaaaaaaagtttgggtttttaacccctttta

SEQ ID NO: 511490 - DNA, 857 bp, Homo sapiens
gtaccctttctcaaagggtgcctataaggtgcgtgccaaattttaaatgatgttgaccccctgtgtgaatttttccgaaagttcttggggaaaactctttgtatatgggaaggactgccccttcatgcccacttagatgagatgggatctgttgaccctcctcgtttgttaccccgatatacgtgggattttcttctcacttgggagaacccgtgggggtacagaattgtggtaaaaggacccaacgacgccgaccgcaggccgttatgacgaagtggtagtggtttgattaagctcctgacatgaggtctccttagcatgccgctccctgtaaggaaagaatgagactacatgtggccagattggattcttaggggggtcccagaatgactcttctgtaggagggggacctactggatgcatgaatttcatctcatgccagatcgcgggggatgacccgactgggagttgtatcccagggatgtgatgctaaaagaggctgcaggtaatggatgaggatgtgccggaggccgcgcccatggcgatggatgactcttagagcaccctatgtggggtttatgaaatcttatcccagttagttctgttaccctaaggcgcttgtctaagatccaatttttcacccgagcctctcccctagtatcttcagcacatgctcactggtgtcgccactccttgtccttcccatgttcattaattcattttgccccgcgcctatccccttttcacttcctttgacgctcctagtagttttggttaattcttaaccctgtaatattttgcattttaattttgaaacctttttatgacttaaccataaaaaggctgtatggttttta

SEQ ID NO: 511491 - DNA, 300 bp, Homo sapiens
  misc_feature (27)..(27): n is a, c, g, or t
  misc_feature (60)..(60): n is a, c, g, or t
  misc_feature (90)..(90): n is a, c, g, or t
  misc_feature (99)..(99): n is a, c, g, or t
  misc_feature (141)..(141): n is a, c, g, or t
  misc_feature (239)..(239): n is a, c, g, or t
  misc_feature (297)..(297): n is a, c, g, or t
ctgctccttccttgggggacccggttncttcctgtggcaacagcaggggggaaaaaaagnctcagttcagaaagaaaaagagagagcaanagttgaganaaatggcatggagcacaatgaagcaagaacaaagcacaagantgaagccccggggggaactcagatggagaagtatccagtatgcatctcggggagagagacattcagcctataatgaatggaaaaaggccctcttcaancctggtgaggaaatgcttcagatgaggctccactttgttaaataaaatggatgatacntaa

SEQ ID NO: 511492 - DNA, 581 bp, Homo sapiens
  misc_feature (38)..(39): n is a, c, g, or t
  misc_feature (41)..(41): n is a, c, g, or t
  misc_feature (44)..(44): n is a, c, g, or t
  misc_feature (46)..(47): n is a, c, g, or t
ttcatcacagataaaaatatatttcagggcagcctctnntnctnannttcaaccctcgacgttaggtttggatacaaagttcttctcaagtgcgcatcatcagctctccaggtgggacctgtgatgggttttgaaggggagggccaactctctgtgttgggcctaggtcctgatgtgtgactaggacacagcatgtctcagtgccgtgccagactgccacattgctacaaagagatgatgcttcctcatgccatcttatctgctttaatgcaaagtgttccttgcacctcttagaaatggggagttgagccgggcgtggtgactcacgcctataatttcagcactttgggaggccgaggcgggcggatcacctgagatcgggagttggagaccagcctgaccaacacagagaaaccccgtctctactaaaaatacaaaattagctgggtgtgatgacgcatgcctgtaatcccagctactcgggaagctgaggcaggagaatcgcttgaacccggggagtggaggttgcagtgagccgaaatcacaccattgcaccactgcagcctgggcaacatctgtct

SEQ ID NO: 511493 - DNA, 233 bp, Homo sapiens
gctcgaccttaattttaaaaatactttattgctaaaaaaaaggtatatacattgttattttatacataatgctattgcacacttaatagactacagtatagtgtaaacataattattgtctgtttgtttttgagacaaggtctcactcttactgggggacctgccccgataatcacgtaggttcttttctattttcctaagtgtcggctggcttgagaaataaagggacgtcg

SEQ ID NO: 511494 - DNA, 250 bp, Homo sapiens
ggaagacggggcccaaagtcaccgtcaaggtgtattttgacctacgacttggagatgaagatgtaggccgggtcatctttggtcttttcggaaagacttttccaaaaacagtggataatttgctggccttagttacaggagagaaaggatttggctacaaaaacagccaaattccatcgtgttatcagggacttcatggatacagggcggagactttcaccagggggagattggcacaagagggaagagc

SEQ ID NO: 511495 - DNA, 191 bp, Homo sapiens
ctcaagacatcttgcaatgacctagacaggaacggtgattcccactaatttttatccagataaacaaagctgatgagccagaggttaggtaacctgttcaaaatgacacaactagtatatgactagtcacagcttatagccggattcatctgacttcaaagcctacattcactactagtatgctatacagg

SEQ ID NO: 511496 - DNA, 2419 bp, Homo sapiens
  misc_feature (19)..(19): n is a, c, g, or t
  misc_feature (24)..(24): n is a, c, g, or t
  misc_feature (38)..(38): n is a, c, g, or t
  misc_feature (44)..(44): n is a, c, g, or t
  misc_feature (48)..(49): n is a, c, g, or t
  misc_feature (53)..(54): n is a, c, g, or t
  misc_feature (59)..(60): n is a, c, g, or t
  misc_feature (64)..(64): n is a, c, g, or t
  misc_feature (69)..(69): n is a, c, g, or t
  misc_feature (74)..(74): n is a, c, g, or t
  misc_feature (87)..(88): n is a, c, g, or t
  misc_feature (92)..(92): n is a, c, g, or t
  misc_feature (100)..(100): n is a, c, g, or t
  misc_feature (111)..(111): n is a, c, g, or t
  misc_feature (118)..(118): n is a, c, g, or t
  misc_feature (123)..(123): n is a, c, g, or t
  misc_feature (135)..(135): n is a, c, g, or t
  misc_feature (137)..(137): n is a, c, g, or t
  misc_feature (139)..(139): n is a, c, g, or t
  misc_feature (141)..(141): n is a, c, g, or t
  misc_feature (143)..(143): n is a, c, g, or t
  misc_feature (146)..(146): n is a, c, g, or t
  misc_feature (158)..(158): n is a, c, g, or t
  misc_feature (177)..(177): n is a, c, g, or t
  misc_feature (191)..(191): n is a, c, g, or t
  misc_feature (199)..(199): n is a, c, g, or t
  misc_feature (219)..(219): n is a, c, g, or t
  misc_feature (221)..(221): n is a, c, g, or t
  misc_feature (223)..(223): n is a, c, g, or t
  misc_feature (227)..(227): n is a, c, g, or t
  misc_feature (244)..(244): n is a, c, g, or t
  misc_feature (252)..(252): n is a, c, g, or t
gcacgcctgtaatcccagnacttngggaggctgaggcnggcggntcanntganntcagnngttngagancagcntggccaacatggnnaaancctgtctntactaaaaatncaaaaantagcngggcgtggtggngngngncngtnatcccagctacncgggaggctgaggcagganaatcacttgaaccngggaggcngaggttgcagtgagccgagntngnccantgcactccagcctgggngacagagngagtctccgtcttcaagaaaaaagtaatagagatagagaagtagacatagaataataaagtaacacatgtcccaggtaactgcatattcgataggtctctgtcttctcaaacgttaggtgtgctgtgaagttaggcaaatgtattctctcgttaaaacaagaaagttatcttggtcctagcgttacttgctcgtgtcgcgagagtgataacacccgtcgtgcgtgggagctagaatgtgtacaggtagaaacataagcaggagaacgagcgtctggcggcgaatctagctgctaccaagtgttaagaggtcaggccgtaggccggcgcggagaatctgctgtcgcctgcagctgctcgcctgtctccgtcggaagggagcccaagctttgcagagaacatgaacgattggatgcccatcgccaaggagtatgatccactcaaagcgggcagcattgatggcaccgatgaagacccacacgaccgcgcggtctggagggcaatgctggcacgatatgtccccaacaaaggtgtcataggagatcccctcctcaccctgtttgtggccagactaaacttgcagaccaaggaggacaaattaaaggaagtcttttcccgctatggtgacatccggcggcttcggctggtcagggacttggtcacaggtttttcaaagggctacgccttcatcgaatacaaggaggagcgtgccgtgatcaaagcttaccgagatgctgatggcctggttattgaccagcatgagatatttgtggactacgagctggaaaggactctcaaagggtggatccctcggcgacttggaggcggtcttgggggaaaaaaggagtctgggcaactgagatttgggggacgggaccggccttttcgaaaacctattaacttgccagttgttaaaaacgacctctatagagagggaaaacgggaaaggcgggagcgatctcgatcccgagaaagacactgggactcgaggacaagggatcgagaccatgacaggggccgggagaagagatggcaagaaagagagccgaccagggtgtggcccgacaatgactgggagagagagagggacttcagagatgacaggatcaaggggagggagaagaaggaaagaggcaagtagaggcccaacagcagaaccccaaagtgaagttacagtggaaatgagtggagggggattgtctttcaacgcagcgtgagtctaatggttgaataaaacttactgatgatcaaaaaaaaaaaacacacaaacacaacaaagagacaacaacaaaaaagaaccacgaaaaagacaaaacaacacagaaaaacaaacacaaacaaagaaagaaaaaaaagaaaacaaacaaagcaaagagacagggacaaacgagaaaggagagaagagaagagacgagaagcaggaaggaagagagagaagagaggaagggaggagagcggagcaagaggggggagagagcggacagacggcaagaggggacggccggcggcggagcggcaagaagcagaaaggagaggcggagcaggagggagcgacgccagcacggcggagacacaggcggagcacgagaagaagaggagagagagggcggaacgcgaagcggagagagggaagaacgaagggggcgagaggaaacgagagagcaggagacgaagcgagagcaggaagaaggagagagaaggagaagaaagaggagagaaggaggaggaagaaagagaaggaagagggagagcaacaggacgaggagaggagagcggacaggccgagaggggaggaaggacgcgagaggagaaggggaaggacagcgaagagagaggagaggcagagccagagagaaaaggacgacggaggggaagagcaggatgcgagggagaaggagagaggaaagatagagagagacagagaaagaaaaggaagaggcgaggaggagccgagaaagagaggcgagggggagaagggaggaggcgagaggggagaaggagggggggagagggacggcgacgagagggaagaagggggagagaaggggggaaagaagagggggagcggagggaggaacgagagggggaacggggcagggggaggggaggggagagagaaggggaaggaagaggagaggaaggaggaaaggaaagcacgggggggagggg

SEQ ID NO: 511497 - DNA, 324 bp, Homo sapiens
gtcgagtgcctggtgctataaggacactcacctattaggcagaatcaaagaatatctggatcagctacctgattggccctacaaagatgacctcctggccttggactgccagctggctcctgtccagtgtacttgatgttcttcgccttattcatcatttttaaggcttatctaattcactgtgtttggaactgctataagtacatcaacaaccgaaacgtgccggagatggctgtgtaccctgcctgtgaagcacctccgtcagtacgttttgccaacctatgaatatggccgtgaaaatgcctgaaaaggaaccaccagctc

SEQ ID NO: 511498 - DNA, 1982 bp, Homo sapiens
ctgacatcaggagtttgaggccggcttggaacatggtgaaatcctgtctgtactagaaatgcaaaaattagctgggcgtggtggtgtgtgtctgtgatcccagctgctcggcctcccaaggtgctgggattacaggcgtgagccaccgcgtctggcctcagccaaggtttttaagtaacatatttcagcattggctctacagcgttgcagaacatgaacgattggatgcccatcgccaaggagtatgatccactcaaagcgggcagcattgatggcaccgatgaagacccacacgaccgcgcggtctggagggcaatgctggcacgatatgtccccaacaaaggtgtcataggagatcccctcctcaccctgtttgtggccagactaaacttgcagaccaaggaggacaaattaaaggaagtcttttcccgctatggtgacatccggcggcttcggctggtcagggacttggtcacaggtttttcaaagggctacgccttcatcgaatacaaggaggagcgtgccgtgatcaaagcttaccgagatgctgatggcctggttattgaccagcatgagatatttgtggactacgagctggaaaggactctcaaagggtggatccctcggcgacttggaggcggtcttgggggaaaaaaggagtctgggcaactgagatttgggggacgggaccggccttttcgaaaacctattaacttgccagttgttaaaaacgacctctatagagagggaaaacgggaaaggcgggagcgatctcgatcccgagaaagacactgggactcgaggacaagggatcgagaccatgacaggggccgggagaagagatggcaagaaagagagccgaccagggtgtggcccgacaatgactgggagagagagagggacttcagagatgacaggatcaaggggagggagaagaaggaaagaggcaagtagaggcccaacagcagaaccccaaagtgaagttacagtggaaatgagtggagggggattgtctttcaacgcagcgtgagtctaatggttgaataaaacttactgatgatcaaaaaaaaaaaacacacaaacacaacaaagagacaacaacaaaaaagaaccacgaaaaagacaaaacaacacagaaaaacaaacacaaacaaagaaagaaaaaaaagaaaacaaacaaagcaaagagacagggacaaacgagaaaggagagaagagaagagacgagaagcaggaaggaagagagagaagagaggaagggaggagagcggagcaagaggggggagagagcggacagacggcaagaggggacggccggcggcggagcggcaagaagcagaaaggagaggcggagcaggagggagcgacgccagcacggcggagacacaggcggagcacgagaagaagaggagagagagggcggaacgcgaagcggagagagggaagaacgaagggggcgagaggaaacgagagagcaggagacgaagcgagagcaggaagaaggagagagaaggagaagaaagaggagagaaggaggaggaagaaagagaaggaagagggagagcaacaggacgaggagaggagagcggacaggccgagaggggaggaaggacgcgagaggagaaggggaaggacagcgaagagagaggagaggcagagccagagagaaaaggacgacggaggggaagagcaggatgcgagggagaaggagagaggaaagatagagagagacagagaaagaaaaggaagaggcgaggaggagccgagaaagagaggcgagggggagaagggaggaggcgagaggggagaaggagggggggagagggacggcgacgagagggaagaagggggagagaaggggggaaagaagagggggagcggagggaggaacgagagggggaacggggcagggggaggggaggggagagagaaggggaaggaagaggagaggaaggaggaaaggaaagcacgggggggagggg

SEQ ID NO: 511499 - DNA, 234 bp, Homo sapiens
  misc_feature (117)..(117): n is a, c, g, or t
  misc_feature (122)..(122): n is a, c, g, or t
  misc_feature (140)..(140): n is a, c, g, or t
tcttcacgtactgcaggtcaggggactctttgcaggcgtgttttagaagggagctgtttgattgaaaggaaagaactaatagaaaatttatcgtcagatatccgagcttatgacatnttatnttggagatacaccgcggnctgctcaagccgaagatctttatgaaattcttgattcctttactgaagagtatgaaaatgaaggacaacgaatcaatgcaagacggcaagcggg

SEQ ID NO: 511500 - DNA, 2151 bp, Homo sapiens
  misc_feature (19)..(19): n is a, c, g, or t
  misc_feature (24)..(24): n is a, c, g, or t
  misc_feature (38)..(38): n is a, c, g, or t
  misc_feature (44)..(44): n is a, c, g, or t
  misc_feature (48)..(49): n is a, c, g, or t
  misc_feature (53)..(54): n is a, c, g, or t
  misc_feature (59)..(60): n is a, c, g, or t
  misc_feature (64)..(64): n is a, c, g, or t
  misc_feature (69)..(69): n is a, c, g, or t
  misc_feature (74)..(74): n is a, c, g, or t
  misc_feature (87)..(88): n is a, c, g, or t
  misc_feature (92)..(92): n is a, c, g, or t
  misc_feature (100)..(100): n is a, c, g, or t
  misc_feature (111)..(111): n is a, c, g, or t
  misc_feature (118)..(118): n is a, c, g, or t
  misc_feature (123)..(123): n is a, c, g, or t
  misc_feature (135)..(135): n is a, c, g, or t
  misc_feature (137)..(137): n is a, c, g, or t
  misc_feature (139)..(139): n is a, c, g, or t
  misc_feature (141)..(141): n is a, c, g, or t
  misc_feature (143)..(143): n is a, c, g, or t
  misc_feature (146)..(146): n is a, c, g, or t
  misc_feature (158)..(158): n is a, c, g, or t
  misc_feature (177)..(177): n is a, c, g, or t
  misc_feature (191)..(191): n is a, c, g, or t
  misc_feature (199)..(199): n is a, c, g, or t
  misc_feature (219)..(219): n is a, c, g, or t
  misc_feature (221)..(221): n is a, c, g, or t
  misc_feature (223)..(223): n is a, c, g, or t
  misc_feature (227)..(227): n is a, c, g, or t
  misc_feature (244)..(244): n is a, c, g, or t
  misc_feature (252)..(252): n is a, c, g, or t
gcacgcctgtaatcccagnacttngggaggctgaggcnggcggntcanntganntcagnngttngagancagcntggccaacatggnnaaancctgtctntactaaaaatncaaaaantagcngggcgtggtggngngngncngtnatcccagctacncgggaggctgaggcagganaatcacttgaaccngggaggcngaggttgcagtgagccgagntngnccantgcactccagcctgggngacagagngagacttgtctcgagtaaaaaaagagaatgtaacaaatcgaaagagattgttgtaggaaatctcaacctaatgctgccggggaggaagtgcacctagaaagattaatgagaaacaatgaaaccagctaacatgaacgattggatgcccatcgccaaggagtatgatccactcaaagcgggcagcattgatggcaccgatgaagacccacacgaccgcgcggtctggagggcaatgctggcacgatatgtccccaacaaaggtgtcataggagatcccctcctcaccctgtttgtggccagactaaacttgcagaccaaggaggacaaattaaaggaagtcttttcccgctatggtgacatccggcggcttcggctggtcagggacttggtcacaggtttttcaaagggctacgccttcatcgaatacaaggaggagcgtgccgtgatcaaagcttaccgagatgctgatggcctggttattgaccagcatgagatatttgtggactacgagctggaaaggactctcaaagggtggatccctcggcgacttggaggcggtcttgggggaaaaaaggagtctgggcaactgagatttgggggacgggaccggccttttcgaaaacctattaacttgccagttgttaaaaacgacctctatagagagggaaaacgggaaaggcgggagcgatctcgatcccgagaaagacactgggactcgaggacaagggatcgagaccatgacaggggccgggagaagagatggcaagaaagagagccgaccagggtgtggcccgacaatgactgggagagagagagggacttcagagatgacaggatcaaggggagggagaagaaggaaagaggcaagtagaggcccaacagcagaaccccaaagtgaagttacagtggaaatgagtggagggggattgtctttcaacgcagcgtgagtctaatggttgaataaaacttactgatgatcaaaaaaaaaaaacacacaaacacaacaaagagacaacaacaaaaaagaaccacgaaaaagacaaaacaacacagaaaaacaaacacaaacaaagaaagaaaaaaaagaaaacaaacaaagcaaagagacagggacaaacgagaaaggagagaagagaagagacgagaagcaggaaggaagagagagaagagaggaagggaggagagcggagcaagaggggggagagagcggacagacggcaagaggggacggccggcggcggagcggcaagaagcagaaaggagaggcggagcaggagggagcgacgccagcacggcggagacacaggcggagcacgagaagaagaggagagagagggcggaacgcgaagcggagagagggaagaacgaagggggcgagaggaaacgagagagcaggagacgaagcgagagcaggaagaaggagagagaaggagaagaaagaggagagaaggaggaggaagaaagagaaggaagagggagagcaacaggacgaggagaggagagcggacaggccgagaggggaggaaggacgcgagaggagaaggggaaggacagcgaagagagaggagaggcagagccagagagaaaaggacgacggaggggaagagcaggatgcgagggagaaggagagaggaaagatagagagagacagagaaagaaaaggaagaggcgaggaggagccgagaaagagaggcgagggggagaagggaggaggcgagaggggagaaggagggggggagagggacggcgacgagagggaagaagggggagagaaggggggaaagaagagggggagcggagggaggaacgagagggggaacggggcagggggaggggaggggagagagaaggggaaggaagaggagaggaaggaggaaaggaaagcacgggggggagggg

SEQ ID NO: 511501 - DNA, 819 bp, Homo sapiens
  misc_feature (5)..(5): n is a, c, g, or t
  misc_feature (119)..(119): n is a, c, g, or t
  misc_feature (121)..(121): n is a, c, g, or t
  misc_feature (226)..(226): n is a, c, g, or t
  misc_feature (289)..(289): n is a, c, g, or t
  misc_feature (396)..(396): n is a, c, g, or t
  misc_feature (410)..(410): n is a, c, g, or t
  misc_feature (419)..(419): n is a, c, g, or t
  misc_feature (513)..(513): n is a, c, g, or t
  misc_feature (518)..(520): n is a, c, g, or t
  misc_feature (526)..(526): n is a, c, g, or t
  misc_feature (537)..(537): n is a, c, g, or t
gggantcagagcatggtgccatgctaccccttccatcattttgctgtgttagagatgcaaaggatccagtggaggtctctgaggcctgggagatggtagagccacaccatgaaggtgcntnggtccctgaatgactgcatggagctcactctacattggactctacaaagcaagaaaggtgcgcattagagtgaatgctagtacataacagtaatctatgtttaanatatattgaggagctgccaaactgtttccaaaaatggctgcaaacattctaatattatccatnagcaagaagggcccatgtggcaaggaactaagggcagtctctgccaaaaccacaataacgaatttgcaataacataatttgaagtgatcctcccattcaagtctcanatgagtccccagcnctggccaanatcttatgtgtgtagagaagacttaacaaagaccagcaagcctgccaagatgccaatccaaagaaaaagatactaatggtgttgtgtgggaagntgctnnnatttgntgtggtttganatgcggaataagataataaaagctgtaattcttctatcaactatcggaaatactcccttgtgctacaatacataacatgtatttggataattccaagcctagaagatgtcagctaggtaggaattaattgaaaaataaccaataatgtctctcaaaattaaagtaaaaaagaaacaagtagaatgtcataattctcatttcttgcaataagttcagtacatgaaaaatatcaaagttgaagcaactagtcgcatgtcttttgatttctaccataaggggaaa

SEQ ID NO: 511502 - DNA, 1991 bp, Homo sapiens
  misc_feature (143)..(143): n is a, c, g, or t
  misc_feature (145)..(145): n is a, c, g, or t
gtaggagtgggtaaggccttctctggagcacaactgcctggctttggtgctgtctcccccacttactagcagggaggacttagcctctgtgggtgtcccttcctttcctgtttttaagaagaggtgaatgatagtatcctttncntggcattgttgtaagggttgaatgagtggctcagagtagaggctccatccaacgcttgctcttatcattcatagaacatgaacgattggatgcccatcgccaaggagtatgatccactcaaagcgggcagcattgatggcaccgatgaagacccacacgaccgcgcggtctggagggcaatgctggcacgatatgtccccaacaaaggtgtcataggagatcccctcctcaccctgtttgtggccagactaaacttgcagaccaaggaggacaaattaaaggaagtcttttcccgctatggtgacatccggcggcttcggctggtcagggacttggtcacaggtttttcaaagggctacgccttcatcgaatacaaggaggagcgtgccgtgatcaaagcttaccgagatgctgatggcctggttattgaccagcatgagatatttgtggactacgagctggaaaggactctcaaagggtggatccctcggcgacttggaggcggtcttgggggaaaaaaggagtctgggcaactgagatttgggggacgggaccggccttttcgaaaacctattaacttgccagttgttaaaaacgacctctatagagagggaaaacgggaaaggcgggagcgatctcgatcccgagaaagacactgggactcgaggacaagggatcgagaccatgacaggggccgggagaagagatggcaagaaagagagccgaccagggtgtggcccgacaatgactgggagagagagagggacttcagagatgacaggatcaaggggagggagaagaaggaaagaggcaagtagaggcccaacagcagaaccccaaagtgaagttacagtggaaatgagtggagggggattgtctttcaacgcagcgtgagtctaatggttgaataaaacttactgatgatcaaaaaaaaaaaacacacaaacacaacaaagagacaacaacaaaaaagaaccacgaaaaagacaaaacaacacagaaaaacaaacacaaacaaagaaagaaaaaaaagaaaacaaacaaagcaaagagacagggacaaacgagaaaggagagaagagaagagacgagaagcaggaaggaagagagagaagagaggaagggaggagagcggagcaagaggggggagagagcggacagacggcaagaggggacggccggcggcggagcggcaagaagcagaaaggagaggcggagcaggagggagcgacgccagcacggcggagacacaggcggagcacgagaagaagaggagagagagggcggaacgcgaagcggagagagggaagaacgaagggggcgagaggaaacgagagagcaggagacgaagcgagagcaggaagaaggagagagaaggagaagaaagaggagagaaggaggaggaagaaagagaaggaagagggagagcaacaggacgaggagaggagagcggacaggccgagaggggaggaaggacgcgagaggagaaggggaaggacagcgaagagagaggagaggcagagccagagagaaaaggacgacggaggggaagagcaggatgcgagggagaaggagagaggaaagatagagagagacagagaaagaaaaggaagaggcgaggaggagccgagaaagagaggcgagggggagaagggaggaggcgagaggggagaaggagggggggagagggacggcgacgagagggaagaagggggagagaaggggggaaagaagagggggagcggagggaggaacgagagggggaacggggcagggggaggggaggggagagagaaggggaaggaagaggagaggaaggaggaaaggaaagcacgggggggagggg

SEQ ID NO: 511503 - DNA, 350 bp, Homo sapiens
ttagcagtggctcacgcctgtaatcccaacactttgggaggctgaggcgggtggatcacgaggtcaggagttcaagaccagcctggccaagatggtgaaacccccgtctctactaaagatacaaaaattagccggctgtgatggcgggcgcctgtaatcccagctactcgggaggctgaggcagagaattgcttgaatctgggaggcagagattgcagtgagccgagatcatgccactgcactccagcctgggcaacagagactctgtctcaaaaaaaaaaaactactcccaaggccctgcttattgtaggtcattcaactctttttaggtctctattaactttttttct

SEQ ID NO: 511504 - DNA, 1869 bp, Homo sapiens
gccctgccggctgtctcggcgctcgtcccgcggttcccaccgggcgcccaccgactgtccgtcaggaggaaacgactcgacaacgcagtctgggcacttccccgagtccacgcccagcacgtactcgagtccgacgtccacatcgtggggcagcattgatggcaccgatgaagacccacacgaccgcgcggtctggagggcaatgctggcacgatatgtccccaacaaaggtgtcataggagatcccctcctcaccctgtttgtggccagactaaacttgcagaccaaggaggacaaattaaaggaagtcttttcccgctatggtgacatccggcggcttcggctggtcagggacttggtcacaggtttttcaaagggctacgccttcatcgaatacaaggaggagcgtgccgtgatcaaagcttaccgagatgctgatggcctggttattgaccagcatgagatatttgtggactacgagctggaaaggactctcaaagggtggatccctcggcgacttggaggcggtcttgggggaaaaaaggagtctgggcaactgagatttgggggacgggaccggccttttcgaaaacctattaacttgccagttgttaaaaacgacctctatagagagggaaaacgggaaaggcgggagcgatctcgatcccgagaaagacactgggactcgaggacaagggatcgagaccatgacaggggccgggagaagagatggcaagaaagagagccgaccagggtgtggcccgacaatgactgggagagagagagggacttcagagatgacaggatcaaggggagggagaagaaggaaagaggcaagtagaggcccaacagcagaaccccaaagtgaagttacagtggaaatgagtggagggggattgtctttcaacgcagcgtgagtctaatggttgaataaaacttactgatgatcaaaaaaaaaaaacacacaaacacaacaaagagacaacaacaaaaaagaaccacgaaaaagacaaaacaacacagaaaaacaaacacaaacaaagaaagaaaaaaaagaaaacaaacaaagcaaagagacagggacaaacgagaaaggagagaagagaagagacgagaagcaggaaggaagagagagaagagaggaagggaggagagcggagcaagaggggggagagagcggacagacggcaagaggggacggccggcggcggagcggcaagaagcagaaaggagaggcggagcaggagggagcgacgccagcacggcggagacacaggcggagcacgagaagaagaggagagagagggcggaacgcgaagcggagagagggaagaacgaagggggcgagaggaaacgagagagcaggagacgaagcgagagcaggaagaaggagagagaaggagaagaaagaggagagaaggaggaggaagaaagagaaggaagagggagagcaacaggacgaggagaggagagcggacaggccgagaggggaggaaggacgcgagaggagaaggggaaggacagcgaagagagaggagaggcagagccagagagaaaaggacgacggaggggaagagcaggatgcgagggagaaggagagaggaaagatagagagagacagagaaagaaaaggaagaggcgaggaggagccgagaaagagaggcgagggggagaagggaggaggcgagaggggagaaggagggggggagagggacggcgacgagagggaagaagggggagagaaggggggaaagaagagggggagcggagggaggaacgagagggggaacggggcagggggaggggaggggagagagaaggggaaggaagaggagaggaaggaggaaaggaaagcacgggggggagggg

SEQ ID NO: 511505 - DNA, 136 bp, Homo sapiens
aaaaaaaaaaaaaaaaaattttaaatagcctcccaccaatacccctggatggggggcagggccccgggagccagggctgggatctcgtggggtgtggctggggcctggggaggggccacggaatgtacaggtctgg

SEQ ID NO: 511506 - DNA, 1266 bp, Homo sapiens
tgctgcctggccctccgcctgccgcgccctgcctacaaggccctgagggatgactgcggagggtgagtgcgcggtggtgctcggcttgacctgttggccctgctggccggcgccctagcgctacctcccttcgcctccccgtgcctccccgcgcctccccgactacgcgtctccacggctcctcggttctggtacaagcccaaacgccaagaccgtgtggaagagcggatggaggtaactatctataagaagatgagcagagacgggaagcacatcacgacatcgttacacgacaccgaaggtgagcgtgagagagggaaggagcaatgagaaaacattaagaaatcagagacatggaagaaacgaaaataatacaacaacaaaccagagagaacacaaaaaacacagaacaagggcgaagagaaagagaaaaacaaaaagtaaaacagaataacatagacagagacaaacagagaacacagaaggcatagaaaacaaaacacacaatagaaacaatacaaataggacaacaagactagcaatgacagaagaaagaaagacataaaaacaatgagaaaaacaaagacaccaaacaaaaaaaaagaaacaaagaaaaagaaacagatagaaaaaaaggacaagaaaaagccaaacaaacaaaaacaaaaacaagaaaaaaaaaaaaaacaacaaaagaaaaaacaaccaaaaagaaaaaaaacaacaacaaaaaagactaaacaaaaagaaaaaaacaaaaaaagaaaacaaacgaagaaagccaaaccaaaaaacaaaaagacaagaacaaaaacaaccatcaagcaacaaaaataaaaaaagacacagaacaaaaaggaccgaaaacaacaaaaccaaacaccgcaaacaaaagatgaaaatagaaaaagaacagacaacaacaaaaaaaaaaaacaaaaaaaaaacaaaaaacacacaaaagaaaaaaagcacaaacaagaaaaagaaaaacagcagaacaagaaaaaaaaaacaaaaaaacgaacaaagaaggacaaaaagagaaacaaaaacaaaaaaagaagacaacacaaacaagcaacaaaccaaaacaaagaaaacagagaacaaaacaaaccaaacaaaaaagaagaaaagcaaaaaaaacaacgaagaagaacgacaacaacagaaagaaaaacgaacaccagaaaacaacaagacaaagaaacaaaaaacacagacaaaggaaacaaaagaaaaaacaaaaagaaacagcacaac

SEQ ID NO: 511507 - DNA, 226 bp, Homo sapiens
agtactgccccatatagtaccatccatattctcctttccttggtttttcttttgattggatacggattctggctcagtcacccaagcgggagtacagtggagtgatctcggctcacggcaacctcgcgcctccagggttcaagagattctggtgcctcagcctccccagcacctacgattacaggcaagtgccaccatgcctggccaatttttttgtattttaagt

SEQ ID NO: 511508 - DNA, 97 bp, Homo sapiens
cgatgctttggatgttgccaacaaaattggggtcatttaaactgagtccagcgccttattttgaatatatatatatatatttcttttccccataaaa

SEQ ID NO: 511509 - DNA, 338 bp, Homo sapiens
tgctgctccctctacagttcacgatcttctaattgcagcgatgagtgcacgagtgagatcaagatccagaagaagaggagatggtcaggaggctcccgatgtggttgccttccgtggctcccggtgaatctcagccagaagaacccacaactgacaatcaggatattgaacctggaccagaaaaaaaaggaacacctccgaatcgaagaacgtaaagtaaaaggggattgccaggaaatggatctggaaaagactcggaatgaacgtggagatggctctggatttaaaagaagaagaactcacctaatcctaagcattaagagggaggcagcaggggt

SEQ ID NO: 511510 - DNA, 154 bp, Homo sapiens
cacgagggcggtgtgcggccatccatggagcgctcttggcccagcgaagtgacaggttcatatgcatcgggaccggaccccgcagcttgtggtcaccatgggcttcacggggttcggggttcggtaataaagctcacatatttgctttggtagc

SEQ ID NO: 511511 - DNA, 511 bp, Homo sapiens
  misc_feature (2)..(2): n is a, c, g, or t
  misc_feature (4)..(4): n is a, c, g, or t
  misc_feature (97)..(97): n is a, c, g, or t
  misc_feature (106)..(106): n is a, c, g, or t
  misc_feature (143)..(143): n is a, c, g, or t
  misc_feature (156)..(156): n is a, c, g, or t
  misc_feature (166)..(166): n is a, c, g, or t
  misc_feature (184)..(184): n is a, c, g, or t
  misc_feature (189)..(189): n is a, c, g, or t
  misc_feature (203)..(203): n is a, c, g, or t
gngngcccgttggaaaccgggaaaaataaaggggtaaagccccctctttcttttttttttcattccaattgcgccgtgttttcatgatggacacagnggatatgcngtagatgttttatgccagttgacaagctgcttttgangctggtggttctntccttgacanacgcacttttatattacngttangccatatgacaaangctctgattcctagtgccaaggttcaatcagtgtatataactgaacacactcatccattgtgcttttgtttttttttatggtgcttaagtaagagcccatcctttgcagtcatccatgttgttacttaggcattttatcttggctcaaattgttgaagaatggtggcttgtttcatggtttttgtatttgtgtctaatgcacgttttaacatgatagacgcaatgcattgtgtagctagttttctggaaaagtcaatcttttaggaattgtttttcagatcttcaataaattttttctttaaatttcg

SEQ ID NO: 511512 - DNA, 1075 bp, Homo sapiens
gtaaatcttatcaacttaaagtttagttcctgccctcaaaaaagggtcacaatgtactagaggaagatacaagtacattgtgacccttttcgagggcaggaactaatcttatcaacttaagcttattaacaatacttgagcatccattaaatcattgatacttggctaagtcccccttcacggcctgtatcgtgatggaccccgtttttacatttctgtaacaatgtacaaagccattaccacacacaaaggaggacacacaaacaaacgcggcagacgagtatggccacgcgcacagtgggccacacacaagcccctgaccgatactgcactcacagcattcaagtattgcctaaccagccacaccatcttcgctgcaataccgaacaaagaccatctagaacgtagaatgtcctaccataaacaggcgacaccagaaaacccacctcacacggtgacgcccgcaacacagacacgggcgcggaccgcgcccgactcaagacacaccacgacccccgacagaacccgacgacacgaccgaccgacacgaaccacccacacctacacaccacccaacacacgcaccaacaccacgaccaacaccaaaaggccagcacaacacacaacactaaaacacgccctgacgcgagcacacccgacgccatccaccccaccaagcgaccaaaagcacgcgcatgaaacagacgtcgcggaagtagctcgtccgcaacaggaggcgcagcagcaacatacaagagcgcaaggaccggtcagactaaccaacagggcgagtcgcgtattcagcaacaagcagcagcgccgagacaaggtagcacagaagtgcagcccaatgacgccaaggggccagcgcgcacaagaccagaacccgaagtccccgacggccgacatacgaccccggccgcgctggctctaagcgccatacacgcgaaagcggcacgcaacaggaagccgagaaataagggccagcgccgcacccgcgcccaccaccacgcagtggagaagcccgagcgacgggcagacacgcattattgccctcgcagggaaacgacgcgac

SEQ ID NO: 511513 - DNA, 169 bp, Homo sapiens
ccgagagaaaagatatcacaggaaattcaggagttttgtttgtctttttttcttttaaggtggagttttgctcttgttgctcacgtctggaatgcaatggcacgatctcagctcactgcatcctccgcctcctgggttcaagcaagtctcctgcctcagcctccctagt

SEQ ID NO: 511514 - DNA, 1068 bp, Homo sapiens
  misc_feature (360)..(360): n is a, c, g, or t
gtaacaatcaatctgtaggctcttatctcattgatccacgaagtcctaggcctacccgacgcatctacctgcaggtcatatctactctcttcccaccttctactatgactctcacacaacactctcacagataattcatctactgcaatcaagcgcagatcataaatctcaccatcgaagactacatggactttagattctaaaatcatgaaaccctcaaacagcaaaatcaattatacactattaccagcaactagcttataatggacaagaacctgatgctctttatactagttatccttctcatatccatgccctcatgagctcacctatagtaagatccttccctctggacactcntgccgacagcgtcattttaacgagctacaaacaatccaaactgaatctcactaacaaggcttatcccaatggacctattcaccgcttttatggaaggggcgtcgacagttgtactttactaacgtgactctgcgtctccataccgaatctaaacctaaatgactctcttcagctctctaactatctctaacacaactacaggtctacgaggcttacgaaccagcctgtatgccctgaattataggtcattatgtaaaatcctgtcagtcgctatacattctcgatactgtatttgcccacttgtgatcggatcgaggtgatactcgacataacattacttgcaggccacctactcatgcacctaattggaagcgccaccctagcaaatatcaaccattaaacctttccctctacacttatcatcttcaccaattctagtttcttactggaactaatccgtagaaaatcgcgtgtcgccctttaattccaaggccttacggtttttcacgaacttctagtaagggcccttctaccttggcaccgaataacaccattagcggcgcgggagagaacacaacagaagtcgctcaaaaacatccttccgggggcgccgtgcgccccccggcgaaaaagcgtgttctcgtatacacaccaggggggtggggccggggggggcccccattatgtttaatgtcgccccgtgtggtg

SEQ ID NO: 511515 - DNA, 91 bp, Homo sapiens
ctcgacagtctggcacgaggaaactccgaggacagagggctaaatccatgaagtttgtggatggcctgatgatccacagcagaccttacta

SEQ ID NO: 511516 - DNA, 929 bp, Homo sapiens
  misc_feature (928)..(928): n is a, c, g, or t
gaatggagtgagacctaacccaaactgtttataattatggtagttattagaatggaccttatgtgtctgtctaaaccagaagccttactgtagtttgttttttttaatgagatcctattgaaaatttattagtgaccagaaattttgagacccgtgtttaaaaaaaaaaaaaactttagccaacgtaccaggggctcattaccgtggtagttcatagctgctggggaggatccacttgtgagcccaggagttggaggccaaaaattaaccttcccggggattgccacgtactattctcccagaatttgtcattggaatcaaacaggtctctcattaatattggactgggtaaatggacttctttggttaagtccacacattttgtccataaatcctttcccctgtgaaaaaactcagaataaatattattcccgaggataggatgtgccatttgtggtgacaaactattttcttgaatccggtaagtaaatttgtttcacaggcgtgagtattcccaagttaactccaaggccttgcttatctggaaaaagcaaagttcctactgaggaaaggacccaatgtctgaatggtaaatacatctggtttaggccctaggataagtacctggcttattcgaaggcattcccggtaagtctgggggcaccgggtcgactaggcaccgcggggtcgaaccattttatcgcgtaactcggatctggaatcccttaaggactggccccgtgaacctcctaccagatttaggtcctggattctaatacgaagaggacggctatgccgcaatgacggctcttggggaggtacaggtggacacaccgtcaatcacagagaccgtacaggaccggcaaacaggcacggctgagaacacacacagaacggtactgaaacagtatacagtggagtgctagcng

SEQ ID NO: 511517 - DNA, 606 bp, Homo sapiens
  misc_feature (603)..(603): n is a, c, g, or t
agacagatgaggcgagaggaggaggaggaggaggagaaggctctgggctcctctacaaaaaaaaaaaaaaaaaaaaaaaaaaaaaatttggggggcgggcctggggccccggaaaaggttttgctaagacaccattggcggtgagggagcgggggggccccaagtgaggtaagagggaacacgtggggccaaagagcgggttccccaagaggaagaacgcggggccagaggaacaagaggggcggggatctctcccaaccaaatataaaaaaggccgcgggggggacaacgcggagagggttccgggagaacaaactcccagagagaggggagtccgaggagaggctcatatacgagggggactttatcacaagagaggggagtcccaagaggggaagagcctcgcgagatctatctaaaaaaatttaaagcgccccgccgcgcgccgcgggggtgtgtccgaacgagaggaatatggagaggggacagaaaaaaaccacacaatcaaaaaaaaaagagaagcaaaaatcaagggagaagtgaggaagaagaagaaaaaagagaaaaaacgaacacgaggaacaaggaggagagagaaaaacnagc

SEQ ID NO: 511518 - DNA, 384 bp, Homo sapiens
ccccctgcatactatcactctgctattcaataccattatcggtataatgcatagttgtgagatcttatttatacatttacttaacagtgtccttcactgctcctaggtctactttgcagtattatataattctgcgctttgattaaagggtgtggttggcactgacgtatagtttggtctgcaggaactatgttcctcaagatatgagtatacttaagaagtcttctcttgaaccattacatcacttaactacagatacttattatcagtcatcatccaattcaggatggcaatatatagtatagttctgttagttatatccacttaccacaggcagagagcacaaatgaattattaatcagtttgtatcttgatgcactgtgc

SEQ ID NO: 511519 - DNA, 185 bp, Homo sapiens
ctagctactttattacatattcccaccacgataacgactcctttaattaaactaaaaaccatgcaggattcctgaagagggtggcaagaaaacgaaaggaaaagtcaaagactgcaggacagtgtgggggagggaactcagcgaactcgtcgttgacatggtgctcattgaacgtttgctaggca

SEQ ID NO: 511520 - DNA, 678 bp, Homo sapiens
agcgggcgcccgggaggcgccggagcccagcgggtggcggtaaggccgcctccgcggggctgtgggaagcttgggctgtcccaggaccgtcagtctcctcctctgaccctccctttccccttgtgtgtagggccgccgtcccaccccgcacctcgctcggagtccaggggcggtccctcgtgtcccctccggagcctgctgcgactccacgtcgcccctaccagggactccagcgcacccagggaaagtctccgagcaggcccgcccaggagccagatcgcaggcgcctggaagaagcatgtccggcaactactggtcatgccaggcacagactgcggcccaagaggagctgctgtgtgaatcatctgtgaatgtagggaagaggaatgccagagctgccggctgacagattacccaaccaagagaacatctgcaggatggactttctggtcctcttcttgtgctacctggcttcggtgctgatgggtctagttcttatctgacgtcgtgctcgaaaatccataggttgataaggcctggccaggggaggagcacagatatggcaccgggtgataattccagaaggtcttcagagagccatgcatggattgcttgcattacctattgcatacgagaaagcacaccttcagtgtcctgcacctggtctagcaagggatg

SEQ ID NO: 511521 - DNA, 1729 bp, Homo sapiens
ctgggttctgagccggagtggtcggtgggtgggatggaggcgacttggagcagcacttggaagacacaatgaagaatccctccatagttggcagtccatgtgcacagcattcaccaaggcacttcacatctgggttgccagcgggcacccgtgtcaagcatgcagccatgctggcagtgatcatctgttctcagccccagcaagcagacataagctcaaccatcggcacccccactggcatattcctgtgtgtgtgtctcagacatccagcatcaatgggcaacaattcatgcatcccagcaaaccacgataggcatccacaggatgcgcccagtgcaacaacacatgagcctctatgcatgcgtccatcatctgtatcttacacgacacggcctcgatcactacggaccactgagaactcactaccactactgattacatataaccttactacgacaactacctacaacgttgccacgatacgatagacgagccacactatacactattaattggtgacaattaacgagcaacctatatactccatgtctctacgtcttgtaacaccgaccggtacccacactcacgcgccattactcgtacacattgacctacatagtgaggagacccggccgccatacttacacacgcactaactcacagatcaacagacaacacgcgtactgcactggatacaagcagacacaggcacgaccccgcgctcccacgtgatccaccccatcaacggcacaacctacctcagacacactttagctgggacctcgtcaaccttttcccaccaatcacaacaatccgtgggctcatggcggaaggagacacaaaaaccacaacagacaagcgaacacacacaacagaaacgcacagaccacaacgagagcaacacgacccacgacgacacgaggagcgaggccccgcacaagcaaaccaccgacacagcagtcgcagccacaaaccacgagcgcgggcacaaacacaccggagaaccaacatctaaacaccgacaccaaacccagagaacacgccaacagcaacacatgactcaaagaagaagaaaaaaaaaacagcagggacacaaaaccacacgaacgcaccgagtgaacacaaacaccacaaagaaagacagaagcgagcagacaaacaaagtcaacaggacaccaaccacaaccaaaacaaccagaagcacaaaaaaacaccagaagaaagagatagaataggaaaacgacacaacaacacaaaaagagaaaagaaagcgccgaaaaacacaaaaaaagaacgcaacagaacacaaagacagacaacaaaaacgaaacacaggcgggacaacaaaaaacctaacacacacgaaacacaaacaacgaaccgagagacacgaagagaaaagagaagaaaaacaacaagagaaacacaaggcaaaacaccacgcgagcgccaaggacatagtgagagcacgaggaaagccgagcaggccgcacagcacaagagtcgagcacagacgaactgcgagccgaggcaggagagcgacgagaagcgagagacacgatcacagacgaaagcgcagaagaagaacgacagaggaagaaggaaaaaggcagaagacaacgacgacgcacaacgcggagaacagaagcgagacggagacgagggggaccacaagacggagagacagccgagatagagcccgaacgacaaggacagaaagcagaggaag

SEQ ID NO: 511522 - DNA, 442 bp, Homo sapiens
  misc_feature (17)..(18): n is a, c, g, or t
  misc_feature (316)..(316): n is a, c, g, or t
  misc_feature (359)..(359): n is a, c, g, or t
  misc_feature (396)..(396): n is a, c, g, or t
  misc_feature (404)..(404): n is a, c, g, or t
  misc_feature (426)..(426): n is a, c, g, or t
ggtaaaaatctggcggnngattcgcgatcactatccgcgtcccgtagtgaagttctattgggttcaggcagaaattattgcgatggcaaccgacctggcggaatttattggtgcggcgatcggttttaaactcattcttggtgtttcgttgttgcagggcgcggtgctgacggggatcgcgactttcctgattttaatgctgcaacgtcgcgggcaaaaaccgctggagaaagtgattggcgggttactgttgtttgttgccgcggcttacattgtcgagttgattttctcccagcctaacctggcgcctggggtnaaaggaatggtgatcccgagtttacctacttcggaagcggtcnttcctgtgcagcaggcgtgttaaggggcgacgattanggccgcangttgattttatttggcactccntcgctcactcagcatt

SEQ ID NO: 511523 - DNA, 358 bp, Homo sapiens
ggacactggtgagatgcttacggtgcaagtatcctacggtctttttataatttcacagcccccactcagaggcagttactagagtccctgtttttcaacaagagccatgggtgacgggtgactcgtcatatttgccctaagtggtccaaagtggatgtcatatagtcacatctgtcacagagcaaaatcttttaaagtaactggcccttaaaaataagtatgtctggcacaggcacggtggctcatgcctgtaatcccaggacttagggaaggcggaggtcaagagttcgagacgaggcggaggttagcctgatgaacgcggtgaaagctcgtctgtagtaagaaatatagaaaaaat

SEQ ID NO: 511524 - DNA, 193 bp, Homo sapiens
tcagtagcgagctgcatcggtatatgcaaacggacatctgagttagcgacagcctcaggaaagtggtgtgtctggggctgtccacagggacgagtgcagctgggaaagggcggtgctgctcagccaggtcgggctgcgctttcgagaccttgctctgaataggcccctatgtgaggtaactgggttgagtccg

SEQ ID NO: 511525 - DNA, 673 bp, Homo sapiens
  misc_feature (9)..(9): n is a, c, g, or t
  misc_feature (13)..(13): n is a, c, g, or t
  misc_feature (15)..(15): n is a, c, g, or t
  misc_feature (157)..(157): n is a, c, g, or t
  misc_feature (162)..(162): n is a, c, g, or t
  misc_feature (179)..(179): n is a, c, g, or t
  misc_feature (194)..(194): n is a, c, g, or t
  misc_feature (207)..(207): n is a, c, g, or t
  misc_feature (213)..(213): n is a, c, g, or t
  misc_feature (217)..(217): n is a, c, g, or t
  misc_feature (233)..(233): n is a, c, g, or t
  misc_feature (245)..(245): n is a, c, g, or t
  misc_feature (251)..(251): n is a, c, g, or t
  misc_feature (257)..(257): n is a, c, g, or t
  misc_feature (268)..(269): n is a, c, g, or t
  misc_feature (277)..(278): n is a, c, g, or t
  misc_feature (284)..(284): n is a, c, g, or t
  misc_feature (307)..(308): n is a, c, g, or t
  misc_feature (311)..(311): n is a, c, g, or t
  misc_feature (314)..(314): n is a, c, g, or t
  misc_feature (326)..(326): n is a, c, g, or t
  misc_feature (330)..(330): n is a, c, g, or t
  misc_feature (333)..(333): n is a, c, g, or t
  misc_feature (343)..(343): n is a, c, g, or t
  misc_feature (349)..(349): n is a, c, g, or t
  misc_feature (363)..(363): n is a, c, g, or t
  misc_feature (375)..(375): n is a, c, g, or t
  misc_feature (382)..(382): n is a, c, g, or t
  misc_feature (384)..(384): n is a, c, g, or t
  misc_feature (388)..(388): n is a, c, g, or t
  misc_feature (393)..(394): n is a, c, g, or t
  misc_feature (400)..(400): n is a, c, g, or t
  misc_feature (405)..(405): n is a, c, g, or t
  misc_feature (407)..(407): n is a, c, g, or t
  misc_feature (412)..(414): n is a, c, g, or t
  misc_feature (428)..(428): n is a, c, g, or t
  misc_feature (431)..(431): n is a, c, g, or t
  misc_feature (434)..(434): n is a, c, g, or t
  misc_feature (438)..(438): n is a, c, g, or t
  misc_feature (448)..(448): n is a, c, g, or t
  misc_feature (451)..(451): n is a, c, g, or t
  misc_feature (463)..(464): n is a, c, g, or t
  misc_feature (566)..(567): n is a, c, g, or t
  misc_feature (581)..(581): n is a, c, g, or t
  misc_feature (584)..(584): n is a, c, g, or t
  misc_feature (644)..(644): n is a, c, g, or t
acgcgcctncgtntncgcgctcgcggttctggcgctgctggaaaggaataatgctgacagcatgtctgcacattccatgctctgtgaacgaatcgccatagccaaggaactgatcaagagagcagaatcactttctagatcaagaaaagagtggcanaaaangtggtgcaaagctgtgnagcaaattgaagganagaattaaaattnttgaanaaantaaaagctggagaaantagctattaaanagtctnatttanagagcaataanntaaaaaanntgaaancaattatggaataaaaaaaaaanntgnaanaagattgtaaangttnttnatgatctttngattanaaagataacttaanaaaaaaaaaaancattgtngnaganaaaannaaaaanaatantnaaaannnggatagaaaaaaanaanaangaangctagaaaanctnaaaaaaataatnnctgggcaggggccaatatggtgacaaaagcatcattgagcaggctgaagacttcctccaggccagtcaccagcagccagtgcagtatagcaaccctcacatnntctttgcattttanaanagtgtctccagccccatggcagagaagctgaaagaaatgggcatatctgtgagaggaganatagtagcagtcaacgctctgttagatca

SEQ ID NO: 511526 - DNA, 584 bp, Homo sapiens
  misc_feature (204)..(204): n is a, c, g, or t
  misc_feature (254)..(254): n is a, c, g, or t
  misc_feature (296)..(296): n is a, c, g, or t
  misc_feature (330)..(330): n is a, c, g, or t
  misc_feature (388)..(388): n is a, c, g, or t
atacgttgcggcaatcaacgtattccggatcttcaatgtagcaaatggcttcaaatgacgcaggtagaggtgccgttcatcaaacaagaagtctgtcccgtgctcttttggcgtgatgggataatcatggctttcaccaatgacttcaataccagataccgccatttcatagccaaatgatgatcgcgcatcttcacggatttnccctgtcacgtacagacttgtttcttgctttaaccctttagccagttcanaaactgattccggcacatctgctttggctaccacagcttganagaatgctgtcccatcgcgtaattgcaaaaaggncaacttacctgaaccgcgcttttgacgagccaagctccaatcttgaccgtttggccancatagttttagcatcgataatttgaattgtgggaatatcttgtgacatgatcatatacacgtggtttgttaccgaccacctgcttctctctattttaattaatgtattgtgaaaaattcagttaaacgacgacagcttcgtccaaactgcttggtctttggcatagccatccgcaaatacctggcatccgaacctt

SEQ ID NO: 511527 - DNA, 210 bp, Homo sapiens
cgtcgataagcatctggtcatgtgtctatttcctcaagcccagactcagcttccaagtgccttactcagcacaggtctagacctcaagagcacctcataaatatgtgtgggttgatggatctgatgccaggagtactctagaactatacaactcagtatgagtcaaggtagcccactaaagttgtagaaaatcagtatcctaaaagaatg

SEQ ID NO: 511528 - DNA, 920 bp, Homo sapiens
  misc_feature (30)..(30): n is a, c, g, or t
  misc_feature (67)..(67): n is a, c, g, or t
  misc_feature (69)..(69): n is a, c, g, or t
  misc_feature (75)..(75): n is a, c, g, or t
  misc_feature (81)..(81): n is a, c, g, or t
  misc_feature (100)..(101): n is a, c, g, or t
  misc_feature (103)..(103): n is a, c, g, or t
  misc_feature (144)..(144): n is a, c, g, or t
  misc_feature (157)..(157): n is a, c, g, or t
  misc_feature (164)..(164): n is a, c, g, or t
  misc_feature (173)..(173): n is a, c, g, or t
  misc_feature (197)..(197): n is a, c, g, or t
  misc_feature (226)..(228): n is a, c, g, or t
  misc_feature (231)..(231): n is a, c, g, or t
  misc_feature (246)..(246): n is a, c, g, or t
  misc_feature (253)..(253): n is a, c, g, or t
  misc_feature (264)..(264): n is a, c, g, or t
  misc_feature (266)..(266): n is a, c, g, or t
  misc_feature (269)..(269): n is a, c, g, or t
  misc_feature (286)..(286): n is a, c, g, or t
  misc_feature (289)..(289): n is a, c, g, or t
  misc_feature (301)..(301): n is a, c, g, or t
  misc_feature (310)..(310): n is a, c, g, or t
  misc_feature (317)..(317): n is a, c, g, or t
  misc_feature (319)..(321): n is a, c, g, or t
  misc_feature (324)..(325): n is a, c, g, or t
  misc_feature (330)..(332): n is a, c, g, or t
  misc_feature (349)..(349): n is a, c, g, or t
  misc_feature (354)..(354): n is a, c, g, or t
  misc_feature (367)..(367): n is a, c, g, or t
  misc_feature (381)..(381): n is a, c, g, or t
  misc_feature (389)..(389): n is a, c, g, or t
  misc_feature (400)..(400): n is a, c, g, or t
  misc_feature (419)..(419): n is a, c, g, or t
  misc_feature (429)..(429): n is a, c, g, or t
  misc_feature (512)..(512): n is a, c, g, or t
  misc_feature (538)..(538): n is a, c, g, or t
  misc_feature (552)..(552): n is a, c, g, or t
  misc_feature (825)..(825): n is a, c, g, or t
  misc_feature (893)..(893): n is a, c, g, or t
aaaagtgatctataatacccaagttctatnttcaactaccagttaaacaaggaaaacattttctgtntnattctnttttanaaccagtataaacccagannantcaagatctgattccttttccacacatctgctaggtcagtnaactatcaaacangtatctngtcattttnacatactccttatattcctatttngtacaatctctatatcctatactatcttnnnganagctaaatatctganagagggnggggatcccangngcnagaggggccccacagangcngtaacccaagtnatcgtaagnccatagncnnnccnncccannncaaccatggcgtcccanccccncataaattctccnccattacccttgtncgtctgtncattagtagtnaggtctcgtcaaatgacantcaaaaatcnttgtattatccctagttgcaaatgttccaaataagacagtgccataactacacgacaaaaacaaaaaaaaaatcatataagtnggggtagttcccctaatccaacaacncaagtctgtttccnttgagaacattatactattggctctagtctccaaaccaataaaaaactaaaacttgtttccaagactgggaggtaaagtaggcttataaaacaatacagcaaaagaaagccaagtggcccaattgtttccagtgtgcttgccatcttagcatggttactttccagatgtcactcataagttttattctacaactaaactgtttgtgggataagccaccaccaaaaaatgtttcacttactgacagacacttcactagatacagctaccacttntatccatcatttttataattcaacttaagttctaaattgaagagttgtccccatgactttagctaaanaaattgaaagccaaagctgtataatct

SEQ ID NO: 511529 - DNA, 274 bp, Homo sapiens
gcaactgccggcgaagcgatcggcaatagtgttcccggccaaagcttggtacgaccttggatggccgctgggaccgtcggctgggacgggcagtgcacagcccgacagcagcatcgatctgcacggccacacgttccatacggcctatcaagtccttgatgcaggcctggcccgggcaattgcgcgcggtgatcggatcttgctgctgatcaccggcaagccgccgcgacccgaaagcgagcggccgcaccaaagagggcgcatccgcgactca

SEQ ID NO: 511530 - DNA, 129 bp, Homo sapiens
tttgcgctctgaatccgctatttctccgtgactccacttggtcattgagccaagagatcagctcttcttctggagatttacgcacaggaacgggcaatttacacttgcgtctatcgttatccgattcca

SEQ ID NO: 511531 - DNA, 404 bp, Homo sapiens
tgagttcttacactccagagagtagcgtcggcagtacaattactgtgcaaaatctcttgggaacaactttagcatttacatcattggaggactcacacaggaatagcaatgagcctggcagatccgtggcagagctttcaggcactaatccgtccaattcatcagcgagcagtgccttgatgacgaagaaggtcgaaaagtcgtccagctcttctccatatcgaatgtctcagtatccacagtgatatatagacttcaagcgctgcaggagttcagggtctattcatattcccatttgagcattaatcacattatagtaggagtttacaggtacggacatcttgcgccccagtccaagcattgattcggtacgtatctattgagtgaataaagctacaggcaat

SEQ ID NO: 511532 - DNA, 477 bp, Homo sapiens
  misc_feature (38)..(38): n is a, c, g, or t
aaaaaaagctgtttccctttgaaaaaaactttttgcancctcagaagagaaagaacttccttcaaacctgaattgggttacatataaaaagtcaacagactccatactcagtaagtgaaaatattaaatctttttccccctaaaattgggactgggaaagattctcccattcttggctgtgtgcaatggctcatgcctgtaatcccaacactttgggaggccgaggctggtggatcacaaggtcaggagatcgagatcatcttggccatcatggtgaaaccccgtctctactaaaaatacaaaaaattagcccaggtgtggtggcgtgtgcctgcagtctcagctactcaggaggctgaggcaggcaaatcacttgaagccaggaggcagaggttgcagtgagccaagatcatgccactgaactccagcgtgggtgacagagtgaaactccattgccttgagagtttccaggggctg

SEQ ID NO: 511533 - DNA, 621 bp, Homo sapiens
ggtgaccgactactggcaatgcctcctaatgaaacttgtaccgtgaaaggaatcactctgcatgatgaacctgtcgactgggcggcagaggcgatcatgttagtcttacttgggtctgggatggatatcatcaaaatcaagtgtggtgctggcataatttggtggccccaaagtacccattaaacgcttgcactcgtttcagagcccgaatcctcatctttaatattgaagattcctatcaactaagaggatttaccgtgtgcttgttacactacccaaaacctgtcagtgaacccgccgttattaaacgattgattagtgtcttaaacaaaagcacgggtgaacgtcacaaaggaaaaagcctaagttttgcgactaagaggccagaatgcattggtagaagctacaggacacaaagacccaatagctcttgacgctaattaataagagacttcaaagagctggggaggttcatgctacgtaacgggtggttctacaatagctgctggtgtgtcactgagataacaagaatgatggggtcagaatttctaaccacgtttcttggatacagtgaaactagctaaaccctcatgttcacccaaggaaatggcccggctacaa

SEQ ID NO: 511534 - DNA, 440 bp, Homo sapiens
  misc_feature (6)..(6): n is a, c, g, or t
aatagnccccagcctccttgggaggcctgaccgtgggaggaatccgtttgagtcctgggaagttgaggccttcagtgaacctatgatccatgcccatgacactcccagactgggcaacagaacaagacccctgtttcaaaaaaataaataaataaaattttaaaataaactatttttatttaatactcaaagttcaaatcacaaaagtactgaggatcaaacataagtaacactagcaaagccagccaatggcaggcaacaggcagttgcaagccacctctcaccatataactctgagatggagcaactgattgagagaaagtcctctaaccacagccatctacttgtcatagtttgtaacactgatcttccacacattttgtgtatcttccatgaactcactgtcagtgctgctcaatgagataaactaagtactaagg

SEQ ID NO: 511535 - DNA, 437 bp, Homo sapiens
gggagcgcacattcgggcaggagagaaagcctaaataagcaatagatgattagttcttcaataacagtggtgacaaggtctatggataatatttggtaatcactaatattcatataaaccgggcacaaccatggattggagtgcattaactcacacttcatgagcaggcacggccgtcatctcatttaatagatgaggaaacggaggcacagaggggctgagagaccgggcctagtgacagagccaggattcaaagccatagatcagggccccgggttatgtaggtcatgacggcatctgtccaggggagatggggtacggtgaggctcgtcaggggaagccgggttgggtctcaggtcagggaaggcagatgtgaggaaatgacttttagggtacaagtcggagggtggagtgggtaggtggggaagaccattcca

SEQ ID NO: 511536 - DNA, 289 bp, Homo sapiens
gggtttgggggggggggggggttttttttttcctgcccccccatccccccccagggggtttggggggggggggaaccccccccaaaacaaccacccttttttttatggggggggggggagagggtggggggtgtttttcccccccccccttttttcccccggcgggggttttttgggggggcccctttccccctttttggccctgggggccccccccccccccccccttggcccccccttttttttcccctttttgattaaaaatttttttccccttttgggtttttta

SEQ ID NO: 511537 - DNA, 659 bp, Homo sapiens
  misc_feature (81)..(81): n is a, c, g, or t
  misc_feature (114)..(114): n is a, c, g, or t
  misc_feature (138)..(138): n is a, c, g, or t
  misc_feature (151)..(151): n is a, c, g, or t
  misc_feature (154)..(154): n is a, c, g, or t
  misc_feature (159)..(159): n is a, c, g, or t
  misc_feature (161)..(162): n is a, c, g, or t
  misc_feature (183)..(183): n is a, c, g, or t
  misc_feature (186)..(186): n is a, c, g, or t
  misc_feature (212)..(212): n is a, c, g, or t
  misc_feature (222)..(222): n is a, c, g, or t
  misc_feature (232)..(232): n is a, c, g, or t
  misc_feature (293)..(293): n is a, c, g, or t
  misc_feature (315)..(315): n is a, c, g, or t
  misc_feature (319)..(320): n is a, c, g, or t
  misc_feature (340)..(341): n is a, c, g, or t
  misc_feature (370)..(370): n is a, c, g, or t
  misc_feature (425)..(428): n is a, c, g, or t
  misc_feature (435)..(436): n is a, c, g, or t
  misc_feature (439)..(439): n is a, c, g, or t
  misc_feature (441)..(441): n is a, c, g, or t
  misc_feature (448)..(448): n is a, c, g, or t
  misc_feature (451)..(451): n is a, c, g, or t
gggccgaggaacgccagccgttcacgcgttcggtcctccttggctgactcaccgccctcgccgccgcaccatggacgcccncaggcaggtggtcaactttgggcctggtcccgncaagctgccgcactcagtgttgtnagagatacaaaanggnattantnnagagctacaaaggagtcggcnttngtgttcttgaaatgagtcacaggtcntcagatttgncaagattatnaacaatacagagaatcttgtgcgggaatgctagctgttccagacaactataaggtgatttntctgcaaggaggtgggtgcggncagnncagtgctgtccccttaaacnntcattggcttgaaagcaggaaggtgtgcngactatgtggtgacaggagcttggtcagctaaggccgcagaagaagccaagaagnnnngggactnnacnanatccgtncancctacacttgggagttatacaaaaacattccagatcctgagacacctggaacctcaacccagatgcctcctacgatgtattattgcgcaaactgagacggttgcatggatgatggagtttcgacgtttatacccgatgtcaagggagcagctactggatttgtgacatgtcctcaaacttcgtgtccaagccagtgggatgtttccaa

SEQ ID NO: 511538 - DNA, 182 bp, Homo sapiens
gcgcagtgcacagtatttgagttgtacatgtcggcggatgtaggtatgatgggcagtgaggctcgcatatgatctaggctatatatacgagatacgtagcggtaatgtaaaacgtactctagaatatagtagatggaaattaaagcgtgatatcgatcgcgcgcagatctgtcatgatgatc

SEQ ID NO: 511539 - DNA, 421 bp, Homo sapiens
gacgcatcaagtatccggggagcccagttagcgagggagagaaatccacagagcctctcttgctctctccagtccaaaaatccaacgtaggcccaagaaggctctggcatgtgccaggcacttgctgatcttttggtcttagggggatgcctctaagccatttgatcccgttctaggaacaaaaaaaggcagtggtgacaatcgctccttttatcatctccctccagcttcccaggatggtccccttttccctgttctctctagcctaacctcggttatgggaaatttcaggttttccattccaaaggacatccttctaggctgcctcataagaaaacctacgaacctcaggcctcagtcaagatatccgtgccttgtcttgttttacaattcaatctggccacaatacgaattggataat

SEQ ID NO: 511540 - DNA, 933 bp, Homo sapiens
tatcctcattttcttccgtcttctcaaggggatattccccggtgactcgaaagcaatcttaaacccttgggaccaattgtcatcttcgccccaggaggatgatttgccccatgggatgccttttattgccggcccctgggtggatggaaacccgccctattgtgtggaaactatgactgtagcttcccacaggtttccaaacttgcgggttttctcgtgacttccctggagcccgggggctccatccttggttatgcagttatttcacatcgatgtactccagtagaacactgaagcaagcgacgcggcgatcatttagacgacaagagcatgtcctcgtccgtggaataactgttcccggggaaccccttcggacgtgagggcgcaatgcctcgctaccgctgcgttgcaacatgctgcgttcaaacgaaatatccccagtctcttcatcttgtccggagagggctcaacagagtgcccattgatggtgtgtgtgccatggaatcttaagagaccggagcccatgacttcgcactcattggttgttctccgtcagcacgagaccgacgctcctgggacatgcagatcacgaggtataatgacgcgatagtaacggcaaagtctgcttgtaaccatcagacatcgtccgggtagatatctcttcacgcggtgattagccgtgaaggactctctagcctgatagactctgtggtggcaatcacatgaacacgctgaactggtggctcagcttcatgcactcaccggtgccggtcaacatcctagtgtccaggtataaggccaaaagaatgctctgtttcataacaaactccacaaatagaccctcgagattcaccgtcttacagacataggcctgtcttccacccctcgtctgacccgtatagtgtgccagcaggacctgggtcggtctagtta

SEQ ID NO: 511541 - DNA, 157 bp, Homo sapiens
tcctcggaagtcgttgtgcttcctccagctgtgagaataacgtcctaatctccagagaaatgggggggggatggaggaggcttattgcttcccgagcattctggggggaacatgatccatacccctgtgcctcctgtccaccgcatctgcccttgct

SEQ ID NO: 511542 - DNA, 316 bp, Homo sapiens
ctacaagcaatgcttcttgaaaaaggtgtaagctgtcagattagtttctgaaatttgcatttgcctgtctcccgcttgaaaataacaatgtatattaacttattagagataataagtttgaaggttgaaggttggtttgaaggttggacaggaagggtacaacagatctgtttgcatttagagaaacacttccacagatcaaacattaagaaatactggcttaaagtgttgttttacgaataactttgcctcctttcttttcctgctttgcctaacttagactatgaatgactctgacattaatatctcccccttc

SEQ ID NO: 511543 - DNA, 517 bp, Homo sapiens
gatagtagtgagaacctgccctctctgtctttctgtgcccggctcatttgatgttacatcatgacctccagtgtctgtcattttgctgccaatggcaggattccacttttttttttaattatggctgtgtttgttaataatgagtgtcaacttgattggattgaaggatgcaacgtactcatgctaggtgtatctgtgatggtgttgccaaaggacataaacatttgagtcaataggctggggaaggcccacccatacttaatctggtgcgcacgatctaatcagttgccagcccatataaagcaggcagaaagacgtgaaaaggggagagtggcttagcttctccacctacatctctctcccatgcctgatgcttcctgccctcttaacattggatttcaagttcttctgttttgacccctggactagctgcccttcctcctcatgcttgcaaacagtgtattttgggactttgtgattgtgtaagttaatacttaataaacttctatgtgtgtga

SEQ ID NO: 511544 - DNA, 195 bp, Homo sapiens
atctgatgagcatgctgtggtccgcaacacccagatcgacaactacctgggggtctgaggagcgaagtctggcccgaaaaatgcccttcgtccgtggccagagcttctcagtgtggatcttgtgtgaagctcagtgcctgacaggaggatggacttggatgggtacagcccccccagaatggtggtgataaaagg

SEQ ID NO: 511545 - DNA, 2859 bp, Homo sapiens
gggagtagagcgggcgctgtgggagggaacgccagagcgaggtggtgaggagagctggttgcgtgagtctcctcagctctgcttaccggtgcgactagcggcagcgacgcggctaaaagcgaaggggcgagtgcgagtcccctgagctgtacgaacgcggtcgccatggaccgcccagatgaggggcctccggccaagacccgccgcctgagcagctccgagtctccacagcgcgacccgcccccgccgccgccgccgccgccgctcctccgactgccgctgcctccaccccagcagcgcccgaggctccaggaggaaacggaggcggcacaggtgctggccgatatgaggggggtgggactgggccccgcgctgcccccgccgcctccctatgtcattctcgaggagggggggatccgcgcatacttcacgctcggtgctgagtgtcccggctgggattctaccatcgagtcggggtatggggaggcgcccccgcccacggagagcctggaagcactccccactcctgaggcctcgggggggagcctggaaatcgattttcaggttgtacagtcgagcagttttggtggagagggggccctagaaacctgtagcgcagtggggtgggcgccccagaggttagttgacccgaagagcaaggaagaggcgatcatcatagtggaggatgaggatgaggatgagcgggagagtatgaggagcagcaggaggcggcggcggcggcggaggaggaagcagaggaaggtgaagagggaaagcagagagagaaatgccgagaggatggagagcatcctgcaggcactggaggatattcagctggatctggaggcagtgaacatcaaggcaggcaaagccttcctgcgtctcaagcgcaagttcatccagatgcgaagacccttcctggagcgcagagacctcatcatccagcatatcccaggcttctgggtcaaagcattcctcaaccaccccagaatttcaattttgatcaaccgacgtgatgaagacattttccgctacttgaccaatctgcaggtacaggatctcagacatatctccatgggctacaaaatgaagctgtacttccagactaacccctacttcacaaacatggtgattgtcaaggagttccagcgcaaccgctcaggccggctggtgtctcactcaaccccaatccgctggcaccggggccaggaaccccaggcccgtcgtcacgggaaccaggatgcgagccacagctttttcagctggttctcaaaccatagcctcccagaggctgacaggattgctgagattatcaagaatgatctgtgggttaaccctctacgctactacctgagagaaaggggctccaggataaagagaaagaagcaagaaatgaagaaacgtaaaaccaggggcagatgtgaggtggtgatcatggaagacgcccctgactattatgcagtggaagacattttcagcgagatctcagacattgatgagacaattcatgacatcaagatctctgacttcatggagaccaccgactacttcgagaccactgacaatgagataactgacatcaatgagaacatctgcgacagcgagaatcctgaccacaatgaggtccccaacaacgagaccactgataacaacgagagtgctgatgaccacgaaaccactgacaacaatgagagtgcagatgacaacaacgagaatcctgaagacaataacaagaacactgatgacaacgaagagaaccctaacaacaacgagaacacttacggcaacaacttcttcaaaggtggcttctggggcagccatggcaacaaccaggacagcagcgacagtgacaatgaagcagatgaggccagtgatgatgaagataatgatggcaacgaaggtgacaatgagggcagtgatgatgatggcaatgaaggtgacaatgaaggcagcgatgatgacgacagagacattgagtactatgagaaagttattgaagactttgacaaggatcaggctgactacgaggacgtgatagagatcatctcagacgaatcagtggaagaagagggcattgaggaaggcatccagcaagatgaggacatctatgaggaaggaaactatgaggaggaaggaagtgaagatgtctgggaagaaggggaagattcggacgactctgacctagaggatgtgcttcaggtcccaaacggttgggccaatccggggaagagggggaaaaccggataagggttttccccttttggggatcacctctctgtatcccccacccactatcccatttgccctcctcctcagctagggccacgcggccccacattgcacttctggggggtgaccgacttcgtacacgggtttaaagtttatttttatggtttagtcattgcagagttcttattttggggggagggaaagggggctagtccccttcttttggccctccgcccccgcaggcttctgtgtgctgctaactgtatttattgtgatgccttggtcagggcccctctacccacttctcccagtcagttgtggccccagcccctctccctgtgctgtgtggagtggacaccctgacccccgaagcggggagggccgctgtggccttcgtcacagccgcgcagtgcccatggaggcgctgctgccaccttcctctcccaagttctttctccatccctctcctcttcccgccgcgccgctagcccgcctcggtgtctatgcaaggccgcttcgccattgcggtattctttgcggtattcttgtccccgtcccccagaaggctcgcctctccccgtggaccctgttaatcccaataaaattctgagcaagttcaaaaaacacaaa

SEQ ID NO: 511546 - DNA, 272 bp, Homo sapiens
  misc_feature (2)..(3): n is a, c, g, or t
  misc_feature (5)..(5): n is a, c, g, or t
  misc_feature (53)..(54): n is a, c, g, or t
  misc_feature (57)..(57): n is a, c, g, or t
  misc_feature (63)..(63): n is a, c, g, or t
  misc_feature (75)..(75): n is a, c, g, or t
  misc_feature (104)..(105): n is a, c, g, or t
  misc_feature (126)..(126): n is a, c, g, or t
  misc_feature (130)..(130): n is a, c, g, or t
  misc_feature (139)..(139): n is a, c, g, or t
  misc_feature (164)..(164): n is a, c, g, or t
  misc_feature (194)..(194): n is a, c, g, or t
  misc_feature (214)..(214): n is a, c, g, or t
  misc_feature (237)..(237): n is a, c, g, or t
gnnanattgagaagcacaagcaaactggccgaagaacagttgagaattgttgnngcncaaagnaaagattcatgnaggaaaggatgaaactagaacaagaacgnncaacgtcaacaaaaagaggancaanaaattatcntgggcaaggggaagtcaggccaaantgtccttctcattaaaaacccaggattaanttgcaaactctgaacttttnacaaagaaaaatggaaaactttntatggtagcttcatgttgaagtggttttccgtttt

SEQ ID NO: 511547 - DNA, 2253 bp, Homo sapiens
tccccgctcctccgacggggtggattgagctggaaaccatggggacagatggcaggtatagagggtcatgcagtggaggatgaggatgaggatgagcgggagagtatgaggagcagcaggaggcggcggcggcggcggaggaggaagcagaggaaggtgaagagggaaagcagagagagaaatgccgagaggatggagagcatcctgcaggcactggaggatattcagctggatctggaggcagtgaacatcaaggcaggcaaagccttcctgcgtctcaagcgcaagttcatccagatgcgaagacccttcctggagcgcagagacctcatcatccagcatatcccaggcttctgggtcaaagcattcctcaaccaccccagaatttcaattttgatcaaccgacgtgatgaagacattttccgctacttgaccaatctgcaggtacaggatctcagacatatctccatgggctacaaaatgaagctgtacttccagactaacccctacttcacaaacatggtgattgtcaaggagttccagcgcaaccgctcaggccggctggtgtctcactcaaccccaatccgctggcaccggggccaggaaccccaggcccgtcgtcacgggaaccaggatgcgagccacagctttttcagctggttctcaaaccatagcctcccagaggctgacaggattgctgagattatcaagaatgatctgtgggttaaccctctacgctactacctgagagaaaggggctccaggataaagagaaagaagcaagaaatgaagaaacgtaaaaccaggggcagatgtgaggtggtgatcatggaagacgcccctgactattatgcagtggaagacattttcagcgagatctcagacattgatgagacaattcatgacatcaagatctctgacttcatggagaccaccgactacttcgagaccactgacaatgagataactgacatcaatgagaacatctgcgacagcgagaatcctgaccacaatgaggtccccaacaacgagaccactgataacaacgagagtgctgatgaccacgaaaccactgacaacaatgagagtgcagatgacaacaacgagaatcctgaagacaataacaagaacactgatgacaacgaagagaaccctaacaacaacgagaacacttacggcaacaacttcttcaaaggtggcttctggggcagccatggcaacaaccaggacagcagcgacagtgacaatgaagcagatgaggccagtgatgatgaagataatgatggcaacgaaggtgacaatgagggcagtgatgatgatggcaatgaaggtgacaatgaaggcagcgatgatgacgacagagacattgagtactatgagaaagttattgaagactttgacaaggatcaggctgactacgaggacgtgatagagatcatctcagacgaatcagtggaagaagagggcattgaggaaggcatccagcaagatgaggacatctatgaggaaggaaactatgaggaggaaggaagtgaagatgtctgggaagaaggggaagattcggacgactctgacctagaggatgtgcttcaggtcccaaacggttgggccaatccggggaagagggggaaaaccggataagggttttccccttttggggatcacctctctgtatcccccacccactatcccatttgccctcctcctcagctagggccacgcggccccacattgcacttctggggggtgaccgacttcgtacacgggtttaaagtttatttttatggtttagtcattgcagagttcttattttggggggagggaaagggggctagtccccttcttttggccctccgcccccgcaggcttctgtgtgctgctaactgtatttattgtgatgccttggtcagggcccctctacccacttctcccagtcagttgtggccccagcccctctccctgtgctgtgtggagtggacaccctgacccccgaagcggggagggccgctgtggccttcgtcacagccgcgcagtgcccatggaggcgctgctgccaccttcctctcccaagttctttctccatccctctcctcttcccgccgcgccgctagcccgcctcggtgtctatgcaaggccgcttcgccattgcggtattctttgcggtattcttgtccccgtcccccagaaggctcgcctctccccgtggaccctgttaatcccaataaaattctgagcaagttcaaaaaacacaaa

SEQ ID NO: 511548 - DNA, 2174 bp, Homo sapiens
ggtgactctataggatcggctctgtggggccttaaccctggaggcggcggcggcggcggaggaggaagcagaggaaggtgaagagggaaagcagagagagaaatgccgagaggatggagagcatcctgcaggcactggaggatattcagctggatctggaggcagtgaacatcaaggcaggcaaagccttcctgcgtctcaagcgcaagttcatccagatgcgaagacccttcctggagcgcagagacctcatcatccagcatatcccaggcttctgggtcaaagcattcctcaaccaccccagaatttcaattttgatcaaccgacgtgatgaagacattttccgctacttgaccaatctgcaggtacaggatctcagacatatctccatgggctacaaaatgaagctgtacttccagactaacccctacttcacaaacatggtgattgtcaaggagttccagcgcaaccgctcaggccggctggtgtctcactcaaccccaatccgctggcaccggggccaggaaccccaggcccgtcgtcacgggaaccaggatgcgagccacagctttttcagctggttctcaaaccatagcctcccagaggctgacaggattgctgagattatcaagaatgatctgtgggttaaccctctacgctactacctgagagaaaggggctccaggataaagagaaagaagcaagaaatgaagaaacgtaaaaccaggggcagatgtgaggtggtgatcatggaagacgcccctgactattatgcagtggaagacattttcagcgagatctcagacattgatgagacaattcatgacatcaagatctctgacttcatggagaccaccgactacttcgagaccactgacaatgagataactgacatcaatgagaacatctgcgacagcgagaatcctgaccacaatgaggtccccaacaacgagaccactgataacaacgagagtgctgatgaccacgaaaccactgacaacaatgagagtgcagatgacaacaacgagaatcctgaagacaataacaagaacactgatgacaacgaagagaaccctaacaacaacgagaacacttacggcaacaacttcttcaaaggtggcttctggggcagccatggcaacaaccaggacagcagcgacagtgacaatgaagcagatgaggccagtgatgatgaagataatgatggcaacgaaggtgacaatgagggcagtgatgatgatggcaatgaaggtgacaatgaaggcagcgatgatgacgacagagacattgagtactatgagaaagttattgaagactttgacaaggatcaggctgactacgaggacgtgatagagatcatctcagacgaatcagtggaagaagagggcattgaggaaggcatccagcaagatgaggacatctatgaggaaggaaactatgaggaggaaggaagtgaagatgtctgggaagaaggggaagattcggacgactctgacctagaggatgtgcttcaggtcccaaacggttgggccaatccggggaagagggggaaaaccggataagggttttccccttttggggatcacctctctgtatcccccacccactatcccatttgccctcctcctcagctagggccacgcggccccacattgcacttctggggggtgaccgacttcgtacacgggtttaaagtttatttttatggtttagtcattgcagagttcttattttggggggagggaaagggggctagtccccttcttttggccctccgcccccgcaggcttctgtgtgctgctaactgtatttattgtgatgccttggtcagggcccctctacccacttctcccagtcagttgtggccccagcccctctccctgtgctgtgtggagtggacaccctgacccccgaagcggggagggccgctgtggccttcgtcacagccgcgcagtgcccatggaggcgctgctgccaccttcctctcccaagttctttctccatccctctcctcttcccgccgcgccgctagcccgcctcggtgtctatgcaaggccgcttcgccattgcggtattctttgcggtattcttgtccccgtcccccagaaggctcgcctctccccgtggaccctgttaatcccaataaaattctgagcaagttcaaaaaacacaaa

SEQ ID NO: 511549 - DNA, 412 bp, Homo sapiens
ccaatctctcgcagctcaacaggtctgggcatctgtctcagagagcatgcagatattcttcatccctccacagtgaagagacacacactcgctggacatgacggaatgtgtcagagcgaatgtcatcttcacggctccgtccatattgctgctggtaggtttggcttatgcgctggatctcctcaggtgtctgggaggccaggatctcaattaggcagccctcatcagtgccggctcccttcatggcccttcgcagctcttgcacgtcatacagcaccgtgggcgtcatcatccccacaatcacctgctcgaagttgccactcagttctgacttcaggtcgtctatcaagtccctgccgatggtgctcttgtaggctggcctgatctcctggcgctgggcggtgttgcggta

SEQ ID NO: 511550 - DNA, 2196 bp, Homo sapiens
gtattcctgaagacaatacaagaacactgatgtacaacgaacagaaccctaacaacaacgaggaggcggcggcggcggcggaggaggaagcagaggaaggtgaagagggaaagcagagagagaaatgccgagaggatggagagcatcctgcaggcactggaggatattcagctggatctggaggcagtgaacatcaaggcaggcaaagccttcctgcgtctcaagcgcaagttcatccagatgcgaagacccttcctggagcgcagagacctcatcatccagcatatcccaggcttctgggtcaaagcattcctcaaccaccccagaatttcaattttgatcaaccgacgtgatgaagacattttccgctacttgaccaatctgcaggtacaggatctcagacatatctccatgggctacaaaatgaagctgtacttccagactaacccctacttcacaaacatggtgattgtcaaggagttccagcgcaaccgctcaggccggctggtgtctcactcaaccccaatccgctggcaccggggccaggaaccccaggcccgtcgtcacgggaaccaggatgcgagccacagctttttcagctggttctcaaaccatagcctcccagaggctgacaggattgctgagattatcaagaatgatctgtgggttaaccctctacgctactacctgagagaaaggggctccaggataaagagaaagaagcaagaaatgaagaaacgtaaaaccaggggcagatgtgaggtggtgatcatggaagacgcccctgactattatgcagtggaagacattttcagcgagatctcagacattgatgagacaattcatgacatcaagatctctgacttcatggagaccaccgactacttcgagaccactgacaatgagataactgacatcaatgagaacatctgcgacagcgagaatcctgaccacaatgaggtccccaacaacgagaccactgataacaacgagagtgctgatgaccacgaaaccactgacaacaatgagagtgcagatgacaacaacgagaatcctgaagacaataacaagaacactgatgacaacgaagagaaccctaacaacaacgagaacacttacggcaacaacttcttcaaaggtggcttctggggcagccatggcaacaaccaggacagcagcgacagtgacaatgaagcagatgaggccagtgatgatgaagataatgatggcaacgaaggtgacaatgagggcagtgatgatgatggcaatgaaggtgacaatgaaggcagcgatgatgacgacagagacattgagtactatgagaaagttattgaagactttgacaaggatcaggctgactacgaggacgtgatagagatcatctcagacgaatcagtggaagaagagggcattgaggaaggcatccagcaagatgaggacatctatgaggaaggaaactatgaggaggaaggaagtgaagatgtctgggaagaaggggaagattcggacgactctgacctagaggatgtgcttcaggtcccaaacggttgggccaatccggggaagagggggaaaaccggataagggttttccccttttggggatcacctctctgtatcccccacccactatcccatttgccctcctcctcagctagggccacgcggccccacattgcacttctggggggtgaccgacttcgtacacgggtttaaagtttatttttatggtttagtcattgcagagttcttattttggggggagggaaagggggctagtccccttcttttggccctccgcccccgcaggcttctgtgtgctgctaactgtatttattgtgatgccttggtcagggcccctctacccacttctcccagtcagttgtggccccagcccctctccctgtgctgtgtggagtggacaccctgacccccgaagcggggagggccgctgtggccttcgtcacagccgcgcagtgcccatggaggcgctgctgccaccttcctctcccaagttctttctccatccctctcctcttcccgccgcgccgctagcccgcctcggtgtctatgcaaggccgcttcgccattgcggtattctttgcggtattcttgtccccgtcccccagaaggctcgcctctccccgtggaccctgttaatcccaataaaattctgagcaagttcaaaaaacacaaa

SEQ ID NO: 511551 - DNA, 150 bp, Homo sapiens
ctacaagaaagtttgcctatctggggcgcctcgctcacgagggtggcctcgcaagctaccaggccagctaacaacccaccccttgcaggcgcaagcaggcaaagcaaaaagcccaagcttcccactaccccgagcgagcaaacaactcta

SEQ ID NO: 511552 - DNA, 2986 bp, Homo sapiens
gggagtagagcgggcgctgtgggagggaacgccagagcgaggtggtgaggagagctggttgcgtgagtctcctcagctctgcttaccggtgcgactagcggcagcgacgcggctaaaagcgaaggggcgagtgcgagtcccctgagctgtacgaacgcggtcgccatggaccgcccagatgaggggcctccggccaagacccgccgcctgagcagctccgagtctccacagcgcgacccgcccccgccgccgccgccgccgccgctcctccgactgccgctgcctccaccccagcagcgcccgaggctccaggaggaaacggaggcggcacaggtgctggccgatatgaggggggtgggactgggccccgcgctgcccccgccgcctccctatgtcattctcgaggagggggggatccgcgcatacttcacgctcggtgctgagtgtcccggctgggattctaccatcgagtcggggtatggggaggcgcccccgcccacggagagcctggaagcactccccactcctgaggcctcgggggggagcctggaaatcgattttcaggttgtacagtcgagcagttttggtggagagggggccctagaaacctgtagcgcagtggggtgggcgccccagaggttagttgacccgaagagcaaggaagaggcgatcatcatagtggaggatgaggatgaggatgagcgggagagtatgaggagcagcaggaggcggcggcggcggcggaggaggaagcagaggaaggtgaagagggaaagcagagagagaaatgccgagaggatggagagcatcctgcaggcactggaggatattcagctggatctggaggcagtgaacatcaaggcaggcaaagccttcctgcgtctcaagcgcaagttcatccagatgcgaagacccttcctggagcgcagagacctcatcatccagcatatcccaggcttctgggtcaaagcattcctcaaccaccccagaatttcaattttgatcaaccgacgtgatgaagacattttccgctacttgaccaatctgcaggtacaggatctcagacatatctccatgggctacaaaatgaagctgtacttccagactaacccctacttcacaaacatggtgattgtcaaggagttccagcgcaaccgctcaggccggctggtgtctcactcaaccccaatccgctggcaccggggccaggaaccccaggcccgtcgtcacgggaaccaggatgcgagccacagctttttcagctggttctcaaaccatagcctcccagaggctgacaggattgctgaggtggggcccttcctggcatcaccagagaaggccttgctaggcttgttcctgggtgcgtggggaattaagaggaggatctggagcttgtactaatggctgtcttattccttctcccctttttcaacagattatcaagaatgatctgtgggttaaccctctacgctactacctgagagaaaggggctccaggataaagagaaagaagcaagaaatgaagaaacgtaaaaccaggggcagatgtgaggtggtgatcatggaagacgcccctgactattatgcagtggaagacattttcagcgagatctcagacattgatgagacaattcatgacatcaagatctctgacttcatggagaccaccgactacttcgagaccactgacaatgagataactgacatcaatgagaacatctgcgacagcgagaatcctgaccacaatgaggtccccaacaacgagaccactgataacaacgagagtgctgatgaccacgaaaccactgacaacaatgagagtgcagatgacaacaacgagaatcctgaagacaataacaagaacactgatgacaacgaagagaaccctaacaacaacgagaacacttacggcaacaacttcttcaaaggtggcttctggggcagccatggcaacaaccaggacagcagcgacagtgacaatgaagcagatgaggccagtgatgatgaagataatgatggcaacgaaggtgacaatgagggcagtgatgatgatggcaatgaaggtgacaatgaaggcagcgatgatgacgacagagacattgagtactatgagaaagttattgaagactttgacaaggatcaggctgactacgaggacgtgatagagatcatctcagacgaatcagtggaagaagagggcattgaggaaggcatccagcaagatgaggacatctatgaggaaggaaactatgaggaggaaggaagtgaagatgtctgggaagaaggggaagattcggacgactctgacctagaggatgtgcttcaggtcccaaacggttgggccaatccggggaagagggggaaaaccggataagggttttccccttttggggatcacctctctgtatcccccacccactatcccatttgccctcctcctcagctagggccacgcggccccacattgcacttctggggggtgaccgacttcgtacacgggtttaaagtttatttttatggtttagtcattgcagagttcttattttggggggagggaaagggggctagtccccttcttttggccctccgcccccgcaggcttctgtgtgctgctaactgtatttattgtgatgccttggtcagggcccctctacccacttctcccagtcagttgtggccccagcccctctccctgtgctgtgtggagtggacaccctgacccccgaagcggggagggccgctgtggccttcgtcacagccgcgcagtgcccatggaggcgctgctgccaccttcctctcccaagttctttctccatccctctcctcttcccgccgcgccgctagcccgcctcggtgtctatgcaaggccgcttcgccattgcggtattctttgcggtattcttgtccccgtcccccagaaggctcgcctctccccgtggaccctgttaatcccaataaaattctgagcaagttcaaaaaacacaaa

SEQ ID NO: 511553 - DNA, 1966 bp, Homo sapiens
  misc_feature (116)..(116): n is a, c, g, or t
tccgtctgatagtctctctggcgggtaggggatgtttgattgtgtgtctgtgtgtgtgtctgtgtatgtctgtgtgtgtgtgtatgtctgtgtatgtaacggtgtgtctctgtgtngggggggggacagattccaccatcacccccacctggagcaggtacaggatctcagacatatctccatgggctacaaaatgaagctgtacttccagactaacccctacttcacaaacatggtgattgtcaaggagttccagcgcaaccgctcaggccggctggtgtctcactcaaccccaatccgctggcaccggggccaggaaccccaggcccgtcgtcacgggaaccaggatgcgagccacagctttttcagctggttctcaaaccatagcctcccagaggctgacaggattgctgagattatcaagaatgatctgtgggttaaccctctacgctactacctgagagaaaggggctccaggataaagagaaagaagcaagaaatgaagaaacgtaaaaccaggggcagatgtgaggtggtgatcatggaagacgcccctgactattatgcagtggaagacattttcagcgagatctcagacattgatgagacaattcatgacatcaagatctctgacttcatggagaccaccgactacttcgagaccactgacaatgagataactgacatcaatgagaacatctgcgacagcgagaatcctgaccacaatgaggtccccaacaacgagaccactgataacaacgagagtgctgatgaccacgaaaccactgacaacaatgagagtgcagatgacaacaacgagaatcctgaagacaataacaagaacactgatgacaacgaagagaaccctaacaacaacgagaacacttacggcaacaacttcttcaaaggtggcttctggggcagccatggcaacaaccaggacagcagcgacagtgacaatgaagcagatgaggccagtgatgatgaagataatgatggcaacgaaggtgacaatgagggcagtgatgatgatggcaatgaaggtgacaatgaaggcagcgatgatgacgacagagacattgagtactatgagaaagttattgaagactttgacaaggatcaggctgactacgaggacgtgatagagatcatctcagacgaatcagtggaagaagagggcattgaggaaggcatccagcaagatgaggacatctatgaggaaggaaactatgaggaggaaggaagtgaagatgtctgggaagaaggggaagattcggacgactctgacctagaggatgtgcttcaggtcccaaacggttgggccaatccggggaagagggggaaaaccggataagggttttccccttttggggatcacctctctgtatcccccacccactatcccatttgccctcctcctcagctagggccacgcggccccacattgcacttctggggggtgaccgacttcgtacacgggtttaaagtttatttttatggtttagtcattgcagagttcttattttggggggagggaaagggggctagtccccttcttttggccctccgcccccgcaggcttctgtgtgctgctaactgtatttattgtgatgccttggtcagggcccctctacccacttctcccagtcagttgtggccccagcccctctccctgtgctgtgtggagtggacaccctgacccccgaagcggggagggccgctgtggccttcgtcacagccgcgcagtgcccatggaggcgctgctgccaccttcctctcccaagttctttctccatccctctcctcttcccgccgcgccgctagcccgcctcggtgtctatgcaaggccgcttcgccattgcggtattctttgcggtattcttgtccccgtcccccagaaggctcgcctctccccgtggaccctgttaatcccaataaaattctgagcaagttcaaaaaacacaaa

SEQ ID NO: 511554 - DNA, 2801 bp, Homo sapiens
gggagtagagcgggcgctgtgggagggaacgccagagcgaggtggtgaggagagctggttgcgtgagtctcctcagctctgcttaccggtgcgactagcggcagcgacgcggctaaaagcgaaggggcgagtgcgagtcccctgagctgtacgaacgcggtcgccatggaccgcccagatgaggggcctccggccaagacccgccgcctgagcagctccgagtctccacagcgcgacccgcccccgccgccgccgccgccgccgctcctccgactgccgctgcctccaccccagcagcgcccgaggctccaggaggaaacggaggcggcacaggtgctggccgatatgaggggggtgggactgggccccgcgctgcccccgccgcctccctatgtcattctcgaggagggggggatccgcgcatacttcacgctcggtgctgagtgtcccggctgggattctaccatcgagtcggggtatggggaggcgcccccgcccacggagagcctggaagcactccccactcctgaggcctcgggggggagcctggaaatcgattttcaggttgtacagtcgagcagttttggtggagagggggccctagaaacctgtagcgcagtggggtgggcgccccagaggttagttgacccgaagagcaaggaagaggcgatcatcatagtggaggatgaggatgaggatgagcgggagagtatgaggagcagcaggaggcggcggcggcggcggaggaggaagcagaggaaggtgaagagggaaagcagagagagaaatgccgagaggatggagagcatcctgcaggcactggaggatattcagctggatctggaggcagtgaacatcaaggcaggcaaagccttcctgcgtctcaagcgcaagttcatccagatgcgaagacccttcctggagcgcagagacctcatcatccagcatatcccaggcttctgggtcaaagcattcctcaaccaccccagaatttcaattttgatcaaccgacgtgatgaagacattttccgctacttgaccaatctgcaggtacaggatctcagacatatctccatgggctacaaaatgaagctgtacttccagactaacccctacttcacaaacatggtgattgtcaaggagttccagcgcaaccgctcaggccggctggtgtctcactcaaccccaatccgctggcaccggggccaggaaccccaggcccgtcgtcacgggaaccaggatgcgagccacagctttttcagctggttctcaaaccatagcctcccagaggctgacaggattgctgagattatcaagaatgatctgtgggttaaccctctacgctactacctgagagaaaggggctccaggataaagagaaagaagcaagaaatgaagaaacgtaaaaccaggggcagatgtgaggtggtgatcatggaagacgcccctgactattatgcagtggaagacattttcagcgagatctcagacattgatgagacaattcatgacatcaagatctctgacttcatggagaccaccgactacttcgagaccactgacaatgagataactgacatcaatgagaacatctgcgacagcgagaatcctgaccacaatgaggtccccaacaacgagaccactgataacaacgagagtgctgatgaccacgaaaccactgacaacaatgagagtgcagatgacaacaacgagaatcctgaagacaataacaagaacactgatgacaacgaagagaaccctaacaacaacgagaacacttacggcaacaacttcttcaaaggtggcttctggggcagccatggcaacaaccaggacagcagcgacagtgacaatgaagcagatgaggccagtgatgatgaagataatgatggcaacgaaggtgacaatgagggcagtgatgatgatggcaatgaaggtgacaatgaaggcagcgatgatgacgacagagacattgagtactatgagaaagttattgaagactttgacaaggatcaggctgactacgaggacgtgatagagatcatctcagacgaatcagtggaagaagagggcattgaggaaggcatccagcaagatgaggacatctatgaggaaggaaactatgaggaggaaggaagtgaagatgtctgggaagaaggggaagattcggacgactctgacctagagacagcgcatccggaagagggaaaaccggataagattctcccacccactatcccatttgccctcctcctcagctagggccacgcggccccacattgcacttctggggggtgaccgacttcgtacacgggtttaaagtttatttttatggtttagtcattgcagagttcttattttggggggagggaaagggggctagtccccttcttttggccctccgcccccgcaggcttctgtgtgctgctaactgtatttattgtgatgccttggtcagggcccctctacccacttctcccagtcagttgtggccccagcccctctccctgtgctgtgtggagtggacaccctgacccccgaagcggggagggccgctgtggccttcgtcacagccgcgcagtgcccatggaggcgctgctgccaccttcctctcccaagttctttctccatccctctcctcttcccgccgcgccgctagcccgcctcggtgtctatgcaaggccgcttcgccattgcggtattctttgcggtattcttgtccccgtcccccagaaggctcgcctctccccgtggaccctgttaatcccaataaaattctgagcaagttcaaaaaacacaaa

SEQ ID NO: 511555 - DNA, 1923 bp, Homo sapiens
gtagcgctcgggttaagtggcagtaccagagtaaatccatgttccccccctcaatctgtccttgttttgtcccatctccatagccttctctctccctaggccggctggtgtctcactcaaccccaatccgctggcaccggggccaggaaccccaggcccgtcgtcacgggaaccaggatgcgagccacagctttttcagctggttctcaaaccatagcctcccagaggctgacaggattgctgaggtggggcccttcctggcatcaccagagaaggccttgctaggcttgttcctgggtgcgtggggaattaagaggaggatctggagcttgtactaatggctgtcttattccttctcccctttttcaacagattatcaagaatgatctgtgggttaaccctctacgctactacctgagagaaaggggctccaggataaagagaaagaagcaagaaatgaagaaacgtaaaaccaggggcagatgtgaggtggtgatcatggaagacgcccctgactattatgcagtggaagacattttcagcgagatctcagacattgatgagacaattcatgacatcaagatctctgacttcatggagaccaccgactacttcgagaccactgacaatgagataactgacatcaatgagaacatctgcgacagcgagaatcctgaccacaatgaggtccccaacaacgagaccactgataacaacgagagtgctgatgaccacgaaaccactgacaacaatgagagtgcagatgacaacaacgagaatcctgaagacaataacaagaacactgatgacaacgaagagaaccctaacaacaacgagaacacttacggcaacaacttcttcaaaggtggcttctggggcagccatggcaacaaccaggacagcagcgacagtgacaatgaagcagatgaggccagtgatgatgaagataatgatggcaacgaaggtgacaatgagggcagtgatgatgatggcaatgaaggtgacaatgaaggcagcgatgatgacgacagagacattgagtactatgagaaagttattgaagactttgacaaggatcaggctgactacgaggacgtgatagagatcatctcagacgaatcagtggaagaagagggcattgaggaaggcatccagcaagatgaggacatctatgaggaaggaaactatgaggaggaaggaagtgaagatgtctgggaagaaggggaagattcggacgactctgacctagaggatgtgcttcaggtcccaaacggttgggccaatccggggaagagggggaaaaccggataagggttttccccttttggggatcacctctctgtatcccccacccactatcccatttgccctcctcctcagctagggccacgcggccccacattgcacttctggggggtgaccgacttcgtacacgggtttaaagtttatttttatggtttagtcattgcagagttcttattttggggggagggaaagggggctagtccccttcttttggccctccgcccccgcaggcttctgtgtgctgctaactgtatttattgtgatgccttggtcagggcccctctacccacttctcccagtcagttgtggccccagcccctctccctgtgctgtgtggagtggacaccctgacccccgaagcggggagggccgctgtggccttcgtcacagccgcgcagtgcccatggaggcgctgctgccaccttcctctcccaagttctttctccatccctctcctcttcccgccgcgccgctagcccgcctcggtgtctatgcaaggccgcttcgccattgcggtattctttgcggtattcttgtccccgtcccccagaaggctcgcctctccccgtggaccctgttaatcccaataaaattctgagcaagttcaaaaaacacaaa

SEQ ID NO: 511556 - DNA, 1723 bp, Homo sapiens
  misc_feature (150)..(150): n is a, c, g, or t
  misc_feature (157)..(157): n is a, c, g, or t
  misc_feature (160)..(160): n is a, c, g, or t
  misc_feature (163)..(164): n is a, c, g, or t
gggtaaagactagtgtaacacaggatttatggagccaaaaagggacctttgagataatcccagtggaatatgttttacaagtgggaaatcatgcccagaaatggcttgaggttacacagtcaggggcagaagtgggactttacccacccnagccccnttnctnngatcccttatagcctactgcttccccagttacttcccacctttgagtgctatgagtacaccacctcccaccaaccctatactcagccacagccttccttacagtaaaaccaggggcagatgtgaggtggtgatcatggaagacgcccctgactattatgcagtggaagacattttcagcgagatctcagacattgatgagacaattcatgacatcaagatctctgacttcatggagaccaccgactacttcgagaccactgacaatgagataactgacatcaatgagaacatctgcgacagcgagaatcctgaccacaatgaggtccccaacaacgagaccactgataacaacgagagtgctgatgaccacgaaaccactgacaacaatgagagtgcagatgacaacaacgagaatcctgaagacaataacaagaacactgatgacaacgaagagaaccctaacaacaacgagaacacttacggcaacaacttcttcaaaggtggcttctggggcagccatggcaacaaccaggacagcagcgacagtgacaatgaagcagatgaggccagtgatgatgaagataatgatggcaacgaaggtgacaatgagggcagtgatgatgatggcaatgaaggtgacaatgaaggcagcgatgatgacgacagagacattgagtactatgagaaagttattgaagactttgacaaggatcaggctgactacgaggacgtgatagagatcatctcagacgaatcagtggaagaagagggcattgaggaaggcatccagcaagatgaggacatctatgaggaaggaaactatgaggaggaaggaagtgaagatgtctgggaagaaggggaagattcggacgactctgacctagaggatgtgcttcaggtcccaaacggttgggccaatccggggaagagggggaaaaccggataagggttttccccttttggggatcacctctctgtatcccccacccactatcccatttgccctcctcctcagctagggccacgcggccccacattgcacttctggggggtgaccgacttcgtacacgggtttaaagtttatttttatggtttagtcattgcagagttcttattttggggggagggaaagggggctagtccccttcttttggccctccgcccccgcaggcttctgtgtgctgctaactgtatttattgtgatgccttggtcagggcccctctacccacttctcccagtcagttgtggccccagcccctctccctgtgctgtgtggagtggacaccctgacccccgaagcggggagggccgctgtggccttcgtcacagccgcgcagtgcccatggaggcgctgctgccaccttcctctcccaagttctttctccatccctctcctcttcccgccgcgccgctagcccgcctcggtgtctatgcaaggccgcttcgccattgcggtattctttgcggtattcttgtccccgtcccccagaaggctcgcctctccccgtggaccctgttaatcccaataaaattctgagcaagttcaaaaaacacaaa

SEQ ID NO: 511557 - DNA, 385 bp, Homo sapiens
  misc_feature (14)..(14): n is a, c, g, or t
  misc_feature (54)..(54): n is a, c, g, or t
  misc_feature (107)..(107): n is a, c, g, or t
  misc_feature (113)..(113): n is a, c, g, or t
  misc_feature (136)..(136): n is a, c, g, or t
  misc_feature (139)..(140): n is a, c, g, or t
  misc_feature (154)..(154): n is a, c, g, or t
aggaggaggcggcncgggctgttgctcgggcagcccagcagcggcgcgccggangcccctggaggaagacgaggaaggggacgatgagtttgacgatgaggccccgnagagcntgactttcgccagcgcccaggcnaannagagaagaggaggncgagtggggagacgtgcgcagggataaaacgctcctgaaggagaagaggaagcaacagagtgatgacaatcgaacagaagagaagaaaactccttccagacactattttggagaagttaaccacagcttcacagactaacatcaagaaatcgccggaaaggtgaaagaagttaatttgcaaaagaaaaatgaagactgtgaaaaaggaaatgactccaagaaagttaaagt

SEQ ID NO: 511558 - DNA, 1561 bp, Homo sapiens
ctagaggaccccttatgtctcgatcgttagggttctcttcgttgtcatcagtgttcttgttattgtctccaggataaagagaaagaagcaagaaatgaagaaacgtaaaaccaggggcagatgtgaggtggtgatcatggaagacgcccctgactattatgcagtggaagacattttcagcgagatctcagacattgatgagacaattcatgacatcaagatctctgacttcatggagaccaccgactacttcgagaccactgacaatgagataactgacatcaatgagaacatctgcgacagcgagaatcctgaccacaatgaggtccccaacaacgagaccactgataacaacgagagtgctgatgaccacgaaaccactgacaacaatgagagtgcagatgacaacaacgagaatcctgaagacaataacaagaacactgatgacaacgaagagaaccctaacaacaacgagaacacttacggcaacaacttcttcaaaggtggcttctggggcagccatggcaacaaccaggacagcagcgacagtgacaatgaagcagatgaggccagtgatgatgaagataatgatggcaacgaaggtgacaatgagggcagtgatgatgatggcaatgaaggtgacaatgaaggcagcgatgatgacgacagagacattgagtactatgagaaagttattgaagactttgacaaggatcaggctgactacgaggacgtgatagagatcatctcagacgaatcagtggaagaagagggcattgaggaaggcatccagcaagatgaggacatctatgaggaaggaaactatgaggaggaaggaagtgaagatgtctgggaagaaggggaagattcggacgactctgacctagaggatgtgcttcaggtcccaaacggttgggccaatccggggaagagggggaaaaccggataagggttttccccttttggggatcacctctctgtatcccccacccactatcccatttgccctcctcctcagctagggccacgcggccccacattgcacttctggggggtgaccgacttcgtacacgggtttaaagtttatttttatggtttagtcattgcagagttcttattttggggggagggaaagggggctagtccccttcttttggccctccgcccccgcaggcttctgtgtgctgctaactgtatttattgtgatgccttggtcagggcccctctacccacttctcccagtcagttgtggccccagcccctctccctgtgctgtgtggagtggacaccctgacccccgaagcggggagggccgctgtggccttcgtcacagccgcgcagtgcccatggaggcgctgctgccaccttcctctcccaagttctttctccatccctctcctcttcccgccgcgccgctagcccgcctcggtgtctatgcaaggccgcttcgccattgcggtattctttgcggtattcttgtccccgtcccccagaaggctcgcctctccccgtggaccctgttaatcccaataaaattctgagcaagttcaaaaaacacaaa

SEQ ID NO: 511559 - DNA, 1754 bp, Homo sapiens
ctcaagcatcaacttcagctcttctttcggaatgacaagtactacgccaaacacataaaaaaaaaaaaaactcctacagtatagcctggcaacaaagaccctagaatcaccagatattcaagggtcctccgcgtactaactacattgcaggtcagccgcctcaccagaaacctaagaaatgcacactaacacccagtctcaccaacactcccataacaagtctaacctcagaagatctgttagaagtctcggcacatcagtgtaacctaggcctattctacacactggaaacccgtgaccccaaagtccactccaagaggcacaaccacgcgcaccacactcacgcgctcacatactacatgaccacttctgatccatctccacataattccaggaaccactatacacgacacaccactcctcaaaagagcacttgtcttgaatctcaatccaccaattaaaactggcatcccaccaacaacacacagcatcaaccaacctaatccatgcacccctcgcagtatcgcctcgcgcgcctcacaaactccatcacagatctgaccaccatcatcatctcatccacacccaaactttcctatcacatccaaccaacagaggctactctcacacaaacttcacaccaaaacaccaccgtcacgcacacacctactccctatccggcaagcagcatctccacgacacatccaggcacacccaataccgtacatacaacgtgagcacctcaccaatcgagcaaagacagcactacatatcaacacatcaccgcaacgcataacgatgatcatccccaacaaaaagaacgaccatatcccaccttacaagcacagaggagaaatcacacacgcatacaaaacgccaggtggttacaacacccaccagcaacaacgaccacacacccaacatacacagccaaccaaaacctagagcacacgcgccaccagatgaccagcaaagaccattcacctacacacaacagaacaccacgaacacgacagcagaacacacacattgggaaccaaacacacacaccatatcacaccagaaaaactacagaagatcgatagcaccaccacgtcattcacaaccacccatacacatcatcgacaccgccccaatacatcactcaacgcgatcaacaaaaactaaccaacagacaccagatgagccaatactaacaaaactaacttgttcacccaacacgaaagtgaatccacaaatcgtgcacccacacacaagataagctgacgacgaaaatcaggaaacacgcatacatagcgcacagaccacataggaaacaacacaacacaaaccagaccagccgaagcacgacacaatgcacacaaccatgaccaactactacgcacgaccagcacaatcacacaaacacacacaccaccactctaagcacaccaacagtgacgctaacaagcgagaggcacaaaataaacagagagtaacaaaacaaacagacgagacacaaacgagaaaaaccaacacacaccgcaacctacatcacctacagaaactctgtacaacgctcaccatcacgccgaagacacctcactacttagtcaaaaccacaacaaccagaacagaaaggacaaacacacagagatagacgagaactcgacaaccaaacacactaacagaaaaacaaagatcaaatactcagctctactagaactcaaacaacatcacaacagcccactacatactatcataaacacaactag

SEQ ID NO: 511560 - DNA, 451 bp, Homo sapiens
gagaaaacacatacttgaaaaacttccaaattttttttttatctgtagtattatctatttttttaaaagcataagaaaagtacaggctggatgaggtggctcacacctgtaatacaacctggacaacagacagagcaagactctgtctcaaaataaagtctagattcaaggtcctaaaatggaacatttgaaccattgctggaaaacagtactaggtttacagtttgaaaaactcttactaagggaaagataggtggtagatagtatattgtgaagaggtttccataatttcagcatgtatatgaagaattagatggatatgaagttaatctgcccatagaatgccatcccgttgaacattggaactgattcagctgaagcacaggacatggaacatttgtttgctcacactgggcgacagtgtgagactctgtcacaaaaaatatatatt

SEQ ID NO: 511561 - DNA, 288 bp, Homo sapiens
tcaggcccgttcataatatcccccaggtttagtagttggacttagggaacaaaggaacctttaatagaaattggacagcgagaaagcgagcgttacgtgatacttgtgggccagagcattagtgcacaccagcgcgaccactttctgataggcagcctgcactggtggggtgaattctttgccgagtggtgagtgggccagagactacagtaccagtctatggttgcccaaggagcctgaggttctcaggatccacgtgcagctggtcacagtgcagctcactcagtg

SEQ ID NO: 511562 - DNA, 310 bp, Homo sapiens
actctacaggatttaccacagtgcctggggctatccaaaggctactcgcattcttgtattggagcctgtcagccccagctacaggacgacatcttgtttgatgcggatgacgtggaaggggtggagcctgcacccggatatggaagccatctatagccacaactatttaccatgtacttatatggaacaaattcgggcagactccagggcttcagaggaacagctgctcaaattcatctgacaccatgtggccataaaagcggaaactcatcctacttttacctatcttccgacccatgtcaaaaatgcg

SEQ ID NO: 511563 - DNA, 464 bp, Homo sapiens
  misc_feature (110)..(110): n is a, c, g, or t
  misc_feature (120)..(120): n is a, c, g, or t
  misc_feature (205)..(205): n is a, c, g, or t
  misc_feature (228)..(229): n is a, c, g, or t
  misc_feature (461)..(463): n is a, c, g, or t
tctgtcaccccaggctggagtgcaggggcacgatcttggctcactgcaacctcagcctcccgagttcaaagcgattttcctgcttcagcctccccaagtagctgggactnacaagcatcngccaccacacccggctaatttttgtattttttagtagagacagggtttcactatgttggccagcctagtctcgaactcctgaccntcgtgatctgcccgcctcggccnncccaaagtgctgggattgcaggcgtgagtcaccgcgcccagccccgcccttttatttttagggcacagggttgggaggctggcatatttaaaagcaaatcccagatactgtcatttcaaatacttcaagcatgtctgtgataaatactttttaaaaactagaaggttttttttgtttgtttttgtatttaaatgtataatctttcttttgcaagtaattctgacactaaatnnnt

SEQ ID NO: 511564 - DNA, 322 bp, Homo sapiens
  misc_feature (32)..(32): n is a, c, g, or t
  misc_feature (60)..(60): n is a, c, g, or t
  misc_feature (262)..(262): n is a, c, g, or t
  misc_feature (281)..(281): n is a, c, g, or t
  misc_feature (283)..(283): n is a, c, g, or t
  misc_feature (313)..(313): n is a, c, g, or t
cggcgagctgacgcagcgttcgaacgctgggngttgccgcggctgccagtgcgtagtggngacaggtacggtccggacatcttgtagccacgggcacgcagcgctggtatgacctcggcgtcgcggagtggtccgcggccgggtgggcaaatcgtgtcgaacagccggttgaggcgcgccgcgaaggtgcccgaatcgatcgagtgctcgcgccgaccatgttgctggctatggtcatcgcgaatccagagtgtctggattnaggcgtgtgggccaccggntngcggcggaacaacggtagtcgcctcgggtntcacgtcgg

SEQ ID NO: 511565 - DNA, 207 bp, Homo sapiens
  misc_feature (44)..(44): n is a, c, g, or t
  misc_feature (54)..(54): n is a, c, g, or t
  misc_feature (62)..(62): n is a, c, g, or t
  misc_feature (86)..(86): n is a, c, g, or t
gtcgctgctgagtcgatctaaggatccccgcgctagcggctaantgacggaccnacgcatgncaggttctcagccaggcaaagtcntcatggggggaggggagaaaaccacatctgtgctctggcggccggcaagtatctgcagggtccagcccaaaggccgccgggtgcttgagtgtggctgcgttcacttaatgccgctagcgcg

SEQ ID NO: 511566 - DNA, 243 bp, Homo sapiens
ggtatgtgaatgtcctcgggggatactgatggatggaagtcctgtgcccctttgtcaagtggtccatgtgactctacttttactgttcctttgccttcgccctccatggtcagtggtgtgacgtttcttcgtgtttttggtgcctttcttcgtgttttcggtgcctttggcagaaatcctttactaaactgctgcttctaattgtctgtcctggaaaatcaagaaatcatgcttgaaacagca

SEQ ID NO: 511567 - DNA, 429 bp, Homo sapiens
  misc_feature (54)..(54): n is a, c, g, or t
  misc_feature (57)..(57): n is a, c, g, or t
  misc_feature (361)..(361): n is a, c, g, or t
  misc_feature (382)..(382): n is a, c, g, or t
aatgtcaggtgtcacctgggcccatatcacatggcccacctgagaacgggtggnganggggtcaggagcagtgatgagcatacctgatgcttacgctgtttcctgtgtatgccaagagcaacaaaatcctttgtgtctgaccataaagtctcatttcttctgccacatgaaactggcaggctaacttgttagcttgcaagtagggtaagatgtcagaccctttacagttgtttgttttttggagacagggtctcattctgctgcccagactggagtgcagtggcatggtcatggctcactgcggtctcaaacttctgggcttaagtgatccagctacctcagcctccagagcagctgggantgcgggcattcaccaccatgncctgggctaatttttaaaaaaaaattaattttttattaggaggatag

SEQ ID NO: 511568 - DNA, 900 bp, Homo sapiens
  misc_feature (47)..(47): n is a, c, g, or t
  misc_feature (67)..(67): n is a, c, g, or t
  misc_feature (73)..(73): n is a, c, g, or t
  misc_feature (100)..(100): n is a, c, g, or t
  misc_feature (109)..(109): n is a, c, g, or t
  misc_feature (115)..(116): n is a, c, g, or t
  misc_feature (122)..(124): n is a, c, g, or t
  misc_feature (126)..(126): n is a, c, g, or t
  misc_feature (131)..(131): n is a, c, g, or t
  misc_feature (142)..(142): n is a, c, g, or t
  misc_feature (144)..(144): n is a, c, g, or t
  misc_feature (156)..(156): n is a, c, g, or t
  misc_feature (159)..(159): n is a, c, g, or t
  misc_feature (169)..(171): n is a, c, g, or t
  misc_feature (189)..(189): n is a, c, g, or t
  misc_feature (196)..(196): n is a, c, g, or t
  misc_feature (210)..(210): n is a, c, g, or t
  misc_feature (248)..(248): n is a, c, g, or t
  misc_feature (263)..(263): n is a, c, g, or t
  misc_feature (287)..(287): n is a, c, g, or t
  misc_feature (292)..(292): n is a, c, g, or t
  misc_feature (319)..(319): n is a, c, g, or t
  misc_feature (321)..(321): n is a, c, g, or t
  misc_feature (328)..(328): n is a, c, g, or t
  misc_feature (336)..(336): n is a, c, g, or t
  misc_feature (357)..(357): n is a, c, g, or t
  misc_feature (381)..(381): n is a, c, g, or t
  misc_feature (389)..(389): n is a, c, g, or t
  misc_feature (395)..(395): n is a, c, g, or t
  misc_feature (400)..(400): n is a, c, g, or t
  misc_feature (402)..(403): n is a, c, g, or t
  misc_feature (407)..(407): n is a, c, g, or t
  misc_feature (411)..(411): n is a, c, g, or t
  misc_feature (432)..(432): n is a, c, g, or t
  misc_feature (448)..(448): n is a, c, g, or t
  misc_feature (452)..(452): n is a, c, g, or t
  misc_feature (478)..(478): n is a, c, g, or t
  misc_feature (482)..(482): n is a, c, g, or t
  misc_feature (515)..(515): n is a, c, g, or t
  misc_feature (523)..(523): n is a, c, g, or t
  misc_feature (531)..(531): n is a, c, g, or t
  misc_feature (544)..(544): n is a, c, g, or t
  misc_feature (585)..(585): n is a, c, g, or t
  misc_feature (653)..(653): n is a, c, g, or t
  misc_feature (670)..(670): n is a, c, g, or t
  misc_feature (721)..(721): n is a, c, g, or t
  misc_feature (862)..(862): n is a, c, g, or t
aaaaaaaaagtgtttaacaacataatcatgtgtacattttaacaagnggaaacatcaccacaagtanctttanttatgtaatcaatatttttaacttttnttatatatntacatnntatttnnntngtggnatatacaagtnanccgttctccttnaanctagcttatnnnctattttcttttatttcnttttgtnttttttaggctgtntttttccatttctcttttaaatatattagtatctgcangtagcttttgaaganctagtatatgctaattatttactntacantatgattagaagtgtttcatgatatantnattgtcntaggacangttattattatagtacaagtntttactgtgtagaaaaatataaanttacagtnaataantaaananntttntatntcaagttatgtatggagtatnaaaagtagttactatntatntatacatatacatatatatataaatntgcntgttctagagtataaatatactatatacttaantatttcangtgtcagnacattatttcatntggtttcagttttgtacattaaaatacttctggcagtgggngtctcccctgatctctggagacccagggatcctcttcccattccaagggtagacgcaccagcagaatnccgcctctccatccatngatgtctcacactgtctgctgtgataaaatccattcttgttgcagtttggnaggtaaaatttggaaatttcttctcctgatgtctcctgtgccttggctaaactctctacgactctgtagagttctattcggcagggctccttccattttttgatgttggtgacatggagagccttcgagccatcataggtnctgatggcgtcccaaaggatggaatgatcctcttcaga

SEQ ID NO: 511569 - DNA, 1591 bp, Homo sapiens
  misc_feature (946)..(946): n is a, c, g, or t
  misc_feature (990)..(990): n is a, c, g, or t
gtgcccctagcacaggagctctcgcagtgatgggaagcatgtggctgagtggcttcaataggcccatggtgacacccgtccacaggccgtagtggggtggtccgtagaatgctgtcgcctcctcccatggtcttccccttgtcccatgggcagcccctatgaccatgcattcatgatcgctccgatggcaccgctgtgcttcttgctacgccttggcggcgctgggacttttctgagtgtcgtctagggagtctgatactcaagtctaagggtccacgcagtcttcgtcacgtggtcctcctcgcgtttgcgtgcaaactagaagggacttggaagcacacggctacaacaggagagaagagaagagacggaggcggtgcacgccagtcgaagacagagatcatcacccgctgcggggaggggggagcgcccagagggagctagagcgcgcgatttagccaccgaggaggatcacgcggaggggataaccccaagaaggtgcgtcatcccctgagagagaggtgggagatctcgagagaagagaagaaaagggcgcaaaacgagagcaaccgggggggccccagccgtgcgatcgcgagatgtatggcgacaggacaaagaaaacagcaactcaccgtagtatgcaaccacccttgtgggggcgtatacacacaagaaagcgtgggacaaaaacaagacagtagaggcggcggacaaacgacccgctggggggggtgcagacaacgaagggggagaacaaacaccctagagaaaagcagttgcacccgatcgacagaggcggtggtgtgatgaaaacgcgaaattacagaacttctggcgggaggcaggcagaacacaacgaatcgatgaaccatctgatacataccgacgaaggaagcagaattgtgttgcacgaacaaacagagccaaatactgattaagaccngaggggggtgcaccaccacacattgtctttcctacacaggcatnattggcttgtgcaggagcaaccacgacagctgggtggtcgacaactaacaacagattggcggcgccgtttgatttgcacacccaacgagagtagtgaagaatgcgatatgaggagaaaaatataatcattactagcgcgatgggggcggcacagcggccaccccattagttccgaacaagaaccacaaaggaaatgatagtggcaggagcagcatagatacaaccaggtagaggggacaacgacaatatagatgtaggcaacaacctcattagatcagccgctcggacaacacaacacgaatgtacactattgaaagtaatgacccacaccctagggggcagggacgcgtaagaaaagaaagcgggcaggacaagaagaagcacaaccagtacgcaagcgaacacccgcgagcacagcgacaaccactcaaacaaattgaaccacacagatcgcacccaccagcgcggacacaaaaaacaacaggaagagcaggagaaagacgcacaaccaaagcggcagcgcgagcaaagaacagctacaggaggcggccccgaccacacggagctcgtagacacgcctaggacaaaacaacccaccacc

SEQ ID NO: 511570 - DNA, 190 bp, Homo sapiens
gcgatgtcagctatgcttatcccaccagaactatggaagtttcacctgcagaacagactctggagctggactggttagagcccctacctcctaacttatctcctgtccgttattaacctttctgaactagtttcccatttatggaatgaaacgaataatactcactgcaaagggagacagtacggttgca

SEQ ID NO: 511571 - DNA, 273 bp, Homo sapiens
  misc_feature (43)..(43): n is a, c, g, or t
  misc_feature (73)..(73): n is a, c, g, or t
  misc_feature (169)..(169): n is a, c, g, or t
  misc_feature (204)..(204): n is a, c, g, or t
attttacagaggcagacattgcacataggtatgactgcaaaantgggtggctaactctgggaagatacttgtnttaaactttatatgacatttaataacccttcatcataaggcaatgttttttacaaaaagattgaaaaaatcatgtaagtcatttactctgcaaaantggcacattaggtggggttccaaaatccataatgnaacaatgtgttttgcaactaagtaacattcattatgatatatggaaaacactgtctgtctacttgtcct

SEQ ID NO: 511572 - DNA, 566 bp, Homo sapiens
  misc_feature (1)..(1): n is a, c, g, or t
  misc_feature (25)..(25): n is a, c, g, or t
  misc_feature (56)..(57): n is a, c, g, or t
  misc_feature (109)..(109): n is a, c, g, or t
  misc_feature (112)..(112): n is a, c, g, or t
  misc_feature (115)..(115): n is a, c, g, or t
  misc_feature (140)..(140): n is a, c, g, or t
  misc_feature (205)..(205): n is a, c, g, or t
  misc_feature (216)..(216): n is a, c, g, or t
  misc_feature (337)..(337): n is a, c, g, or t
  misc_feature (356)..(356): n is a, c, g, or t
  misc_feature (393)..(393): n is a, c, g, or t
  misc_feature (398)..(398): n is a, c, g, or t
  misc_feature (455)..(455): n is a, c, g, or t
  misc_feature (533)..(533): n is a, c, g, or t
nggaaattttggaaaggcctttttngggcttatttcggatcagattaataattcgnnattttggggcagggccgggcagggctagcattgtgttaagcaaatttgcggngtnttnttatcctagttggggaccaataccnaacaacctaaggggattttggtgcaagtagtgtttgaaacacactgaagattactgccctattantaagacatttntcaaaaagcatgttttaaatcagtgtagtccaggatcacactatattaaatataaagataacttaaaggatcattggatcattcattttggccaaatttttagcttctccaaagtgactancatcagggcctacaataanatctgtaattctccaagtttagtaattttatattgangcagnaagggctcattaagtactaataagtacataatttattaaaaacatacataagtgtcntcaaaaaggtccacaattgttagtaaaaaaaattaaattgaagtagtaaatgctgttttataacatacatttttctgntaattcattctgttttgtgtgacctaataaagc

SEQ ID NO: 511573 - DNA, 347 bp, Homo sapiens
gtttttttttaaattgggggaatagtcccccccaaatttttaaaaaaccccttgttttaaattttgctttaaaacccccccgccccccgcttaaccaaaacctttattttttcccccaactttttttagtccccctttttaacccccctttttaaaaaaccgggccccgtttaaattttttgtttttttttttcccaaaaaaggcccggggttgttttttttttaaaaggtccttttaaaccccccccctccctttaaaagttaattttttttttttttttaacccaaatttcccaccctgggaaaatccccccttttaaattttttttttaaaaccccccttccca

SEQ ID NO: 511574 - DNA, 643 bp, Homo sapiens
  misc_feature (66)..(66): n is a, c, g, or t
  misc_feature (88)..(89): n is a, c, g, or t
  misc_feature (94)..(95): n is a, c, g, or t
  misc_feature (100)..(100): n is a, c, g, or t
  misc_feature (102)..(102): n is a, c, g, or t
atagtgccagagagactctgtgaaagtaaagaaggtggtcaaggtgaagaaacctgcagccagatnccagatggtattctgacaagannctccnngagtnangccgtgtgaaagcagtgtgtgtggagaagttggcatgggtccttcatcacttaataggcacatcagagatcacactggacgtgaaccaaatgaatatcaggaaatttcaagtgtttcctgttattcgtagctcaatgtaatgcctcagttcattttcagttgtttgattatatgtgactaatatgtattttttattcaaacaagacttctgtacatgtttcttcaaaacagtttattaactgtcttcagtcttggattacatcaagtttataattttggcaaattgttgagacactgtgaagtcagcgttaaccatgtgcatacaacttaaggaattttttcctcctcatgtaaattttacttttcatgcttatatagtttcaacttttatcttcatagtaatttctcatctactcataataccaaaagttaagtcatgctgttttgtgtgctctcttgctaaagaccgcagagaccatacctgttgtcaaagagggtgtaataaactgtaataataatcatgaccacaaaccataaaaaa

SEQ ID NO: 511575 - DNA, 2446 bp, Homo sapiens
  misc_feature (66)..(66): n is a, c, g, or t
  misc_feature (88)..(89): n is a, c, g, or t
  misc_feature (94)..(95): n is a, c, g, or t
  misc_feature (100)..(100): n is a, c, g, or t
  misc_feature (102)..(102): n is a, c, g, or t
  misc_feature (766)..(766): n is a, c, g, or t
atagtgccagagagactctgtgaaagtaaagaaggtggtcaaggtgaagaaacctgcagccagatnccagatggtattctgacaagannctccnngagtnangccgtgtgaaagcagtgtgtgtggagaagttggcatgggtccttcatcacttaataggcacatcagagatcacactggacgtgaaccaaatgaatatcaggaatatggaaagaagtcatatacacgtaaccagtgtggacgagccttgagttatcatcgctcttttccagtacgtgaaaggactcatcctggaggaaagccctatgattgtaaggaatgtggagaaacctttatttctcttgtaagcattcgaagacacatgttaacgcataggggaggtgtaccttacaaatgtaaggtgtgtgggaaagcctttgattatcccagtttatttcgtatacatgaaagaagtcacactggagagaaaccttatgaatgcaagcaatgtgggaaagccttcagttgttccagttacattagaatacatgaaaggactcacactggagataaaccctatgaatgcaagcagtgtgggaaagctttcagttgttccaagtacattcgaatccatgaacgaactcacacaggagagaaaccctacgaatgtaaacagtgcggtaaagcctttaggtgcgccagttctgttcgaagtcacgagaggactcacaccggagagaaactttttgaatgtaaggaatgcgggaaggctttgacttgtcttgcnagtgttagaagacacatgataaagcacactggcaatggaccttataaatgtaaggtgtgtgggaaagcctttgatttccccagttcatttcgaatccatgaaaggacccacactggagagaaaccctatgattgtaagcaatgtgggaaagccttcagttgttccagttcgtttcgaaaacatgaaagaattcacactggagagaaaccctataaatgtacaaaatgtgggaaagccttcagtcgttccagttacttccgaatccatgaaagaactcacactggagagaaaccctatgaatgtaagcaatgtgggaaagccttcagtcgatccacttactttcgagtacatgaaaaaattcatactggagagaaaccctatgagaaccctaaccctaacgcttcagttgtcccagttctttcatgagcatgaaaggagtcacatagagaaaccccatgaaagtaagaaatttgggaaagccttcagtcctttctgtttctttcaactacgtgaaaggattcacagtggagaaagaccctgtaagataattggctttaaattacgagagacttgtgataggacagtaaaacctagagttggagttggatctctggattgtgttatgtcagtgttggtaggttaggaactagatttcccagaatccattccatttgtgattccatgatacaattcaccagtaacctatcttacatgagattcggaagtaagttaagaaggcattagtcatggtttggaagcaccatacagggagacagctgtgtgaatacaggctgtatggacacttgcttccatcccattttcctgcttctttgggttgccaatcaagagtatcctcaaaacgacttgactttaattttctcggaggtgataggcttccacacaggtctccagaagccctgcattgaatatccatccacactttggttttccttcagacattattatgtctgtactaggcaactaattcagactgtcctggttgggaatattctgtgatgctctgactcccctagtctgtaggacggaattggcatacggtctaatttgtgtagtaagcacctttgttcatactagtagtgactgtattcttgattcagcctgatagctaccatgctgctgtcaaaaccaaccagaggggagcttgttcttctgctgtagtgtgcagtgactggcctcacccaggactttgatgtgagaatgagcactttcctctatcaggaaatttcaagtgtttcctgttattcgtagctcaatgtaatgcctcagttcattttcagttgtttgattatatgtgactaatatgtattttttattcaaacaagacttctgtacatgtttcttcaaaacagtttattaactgtcttcagtcttggattacatcaagtttataattttggcaaattgttgagacactgtgaagtcagcgttaaccatgtgcatacaacttaaggaattttttcctcctcatgtaaattttacttttcatgcttatatagtttcaacttttatcttcatagtaatttctcatctactcataataccaaaagttaagtcatgctgttttgtgtgctctcttgctaaagaccgcagagaccatacctgttgtcaaagagggtgtaataaactgtaataataatcatgaccacaaaccataaaaaa

SEQ ID NO: 511576 - DNA, 2432 bp, Homo sapiens
  misc_feature (66)..(66): n is a, c, g, or t
  misc_feature (88)..(89): n is a, c, g, or t
  misc_feature (94)..(95): n is a, c, g, or t
  misc_feature (100)..(100): n is a, c, g, or t
  misc_feature (102)..(102): n is a, c, g, or t
  misc_feature (766)..(766): n is a, c, g, or t
atagtgccagagagactctgtgaaagtaaagaaggtggtcaaggtgaagaaacctgcagccagatnccagatggtattctgacaagannctccnngagtnangccgtgtgaaagcagtgtgtgtggagaagttggcatgggtccttcatcacttaataggcacatcagagatcacactggacgtgaaccaaatgaatatcaggaatatggaaagaagtcatatacacgtaaccagtgtggacgagccttgagttatcatcgctcttttccagtacgtgaaaggactcatcctggaggaaagccctatgattgtaaggaatgtggagaaacctttatttctcttgtaagcattcgaagacacatgttaacgcataggggaggtgtaccttacaaatgtaaggtgtgtgggaaagcctttgattatcccagtttatttcgtatacatgaaagaagtcacactggagagaaaccttatgaatgcaagcaatgtgggaaagccttcagttgttccagttacattagaatacatgaaaggactcacactggagataaaccctatgaatgcaagcagtgtgggaaagctttcagttgttccaagtacattcgaatccatgaacgaactcacacaggagagaaaccctacgaatgtaaacagtgcggtaaagcctttaggtgcgccagttctgttcgaagtcacgagaggactcacaccggagagaaactttttgaatgtaaggaatgcgggaaggctttgacttgtcttgcnagtgttagaagacacatgataaagcacactggcaatggaccttataaatgtaaggtgtgtgggaaagcctttgatttccccagttcatttcgaatccatgaaaggacccacactggagagaaaccctatgattgtaagcaatgtgggaaagccttcagttgttccagttcgtttcgaaaacatgaaagaattcacactggagagaaaccctataaatgtacaaaatgtgggaaagccttcagtcgttccagttacttccgaatccatgaaagaactcacactggagagaaaccctatgaatgtaagcaatgtgggaaagccttcagtcgatccacttactttcgagtacatgaaaaaattcatactggagagaaaccctatgagaaccctaaccctaacgcttcagttgtcccagttctttcatgagcatgaaaggagtcacatagagaaaccccatgaaagtaagaaatttgggaaagccttcagtcctttctgtttctttcaactacgtgaaaggattcacagtggagaaagaccctgtaagataattggctttaaattacgagagacttgtgataggacagtaaaacctagagttggagttggatctctggattgtgttatgtcagtgttggtaggttaggaactagatttcccagaatccattccatttgtgattccatgatacaattcaccagtaacctatcttacatgagattcggaagtaagttaagaaggcattagtcatggtttggaagcaccatacagggagacagctgtgtgaatacaggctgtatggacacttgcttccatcccattttcctgcttctttgggttgccaatcaagagtatcctcaaaacgacttgactttaattttctcggaggtgataggcttccacacaggtctccagaagccctgcattgaatatccatccacactttggttttccttcagacattattatgtctgtactaggcaactaattcagactgtcctggttgggaatattctgtgatgctctgactcccctagtctgtaggacggaattggcatacggtctaatttgtgtagtaagcacctttgttcatactagtagtgactgtattcttgattcagcctgatagctaccatgctgctgtcaaaaccaaccagaggggagcttgttcttctgctgtagtgtgcagtgactggcctcacccaggactttgatgtgagaatgagcactttcctctatcaggaaatttcaagtgtttcctgttattcgtagctcaatgtaatgcctcagttcattttcagttgtttgattatatgtgactaatatgtattttttattcaaacaagacttctgtacatgtttcttcaaaacagtttattaactgtcttcagtcttggattacatcaagtttataattttggcaaattgttgagacactgtgaagtcagcgttaaccatgcgaaccacatcaccccattttttcatccctattgaatgcttaatggtgaagcttgagatagggggttaagagcatcagtcagggcccttctgttctactgcttataacatgtgttacgtaacactatccacttcgtgcttttgggcatccatcatctgtcaatccgggtaatagtgcccccagttggtgcctcataaaggattaaaaaac

SEQ ID NO: 511577 - DNA, 415 bp, Homo sapiens
gcctattggagggtggagggtggagggggagcagcagacataataactatcgggtactagcctgggtgatgaaataatttatacaacaaacccccgtgacacaagtttacccaaagaacaaaccggcacatgtgcccttgaacctaaaagtttgttttcttgagagagactctcgcactgtcacccaggctggagtgcaatggtgcaatcttggctcgctgcaacctccacctcctgggttcatgcgactctcctgcctcagcctcccgagtagctgggattacaggagcacaacaccacacccggctaattttttgtagttttagcagagacaggggtttcaccatgttagccagactggtcttgaaattctgacctcgtgatctgcctgcctcggcctcccagagagccggaa

SEQ ID NO: 511578 - DNA, 138 bp, Homo sapiens
cctttcagagtagcatttcagagtgctgggatacaggtgtgatccactgcacccagcaaaaccagacttcttaccaacctcatgaggcctgtgtgatctggtccgggctgcccctccatcattctgtctctcccttct

SEQ ID NO: 511579 - DNA, 349 bp, Homo sapiens
agctttttatctggcactgtatggaagcattttttggtatggttagcatggcacatggcgaagcatatagcagtttactgtacaggtaaggaatgagccatgatgttttacctatctctctttctctctcactaccatgcacacatactgtgtgtattcagagaccttcagaaacattcatattcattctcatgagtcagctaggttttacgaaatttgtgtggtaggtgtacaagaggctcatagtaactgtaccatattattaacccctacatccgttttttgtcttgtgtatcttgataattctgcgtgctttatagggaagcaggcgacacgagtcggtggtctc

SEQ ID NO: 511580 - DNA, 99 bp, Homo sapiens
  misc_feature (2)..(2): n is a, c, g, or t
tntcttccctcattcttttatttttgaaaaggcttcacggcatttagaggaactcgcgctcagaagcataatcgatacacagagacgcagcacatataa

SEQ ID NO: 511581 - DNA, 349 bp, Homo sapiens
cggctggtaaagacaatatctcttaaacgcactatcgcaggtccgtgcatttaaggatatgttatagcaaacccagtattctgaccgtcataaaagcgcctcgcgtttccatgctttaagtcacttgccatgagtgtcatactaaagcccaagtgttagttagaacgccacagtgcatggatgctctatctaaataggggccgcatcgagtgttcatccgagagaatgcaggtttatcgccatgttagttgaccatgttcaattcgtgaccacacttagcacggtgtcttaatgtctaccattgatatatgtgaagctctgagctgatatatgtgcatctctctctcct

SEQ ID NO: 511582 - DNA, 618 bp, Homo sapiens
  misc_feature (226)..(226): n is a, c, g, or t
  misc_feature (374)..(374): n is a, c, g, or t
  misc_feature (384)..(384): n is a, c, g, or t
agaggatcgctttctgcccacgactcgatacatgctgtgagaatcgaatgaaatattagtttgaaaacacctggtgtggaccgggtgcagtggctcacagctctaatcccaagcactctgggaggccaaggcaggtggattgcttgagctcaggagatggagatcagcctgggcaacaacagcctgggtgaaactctgtctctacaaaaaattagctgggtgtggnggtgtgtgcctgtagtcccagcgactcagtaggctgaggtgggaggatggcttgggtccaggagaccaaggctgcagtgaaccttgatcacaccactgcacttcagcctgggtgagagaaagaccatgtctcaaaaaagaagaaaaanaaaaagaaancaccggggtgtaccgaaataccttagccggaaggaagaaagaagggagggaaaaggaaaaggaagggagagagagaaataaagaaaacaccgggggaatccttcagggcacaaggcaaaagtcagttatccacaataggagaaagacaaggcctccacctggatcctcagtcttctacgtagagctccaggcgcatctcaggacagagtgccactccttctccagggctgactc

SEQ ID NO: 511583 - DNA, 118 bp, Homo sapiens
ggacgcataatattatcgattccacatgttgctcatggtcagagccctatatactcccttccctttcacctcacagggaactccttatgtatgtagccacacactcatcattagtgtg

SEQ ID NO: 511584 - DNA, 584 bp, Homo sapiens
  misc_feature (32)..(32): n is a, c, g, or t
  misc_feature (66)..(67): n is a, c, g, or t
  misc_feature (94)..(94): n is a, c, g, or t
  misc_feature (133)..(134): n is a, c, g, or t
  misc_feature (140)..(140): n is a, c, g, or t
  misc_feature (150)..(150): n is a, c, g, or t
  misc_feature (176)..(176): n is a, c, g, or t
  misc_feature (189)..(189): n is a, c, g, or t
  misc_feature (198)..(199): n is a, c, g, or t
  misc_feature (210)..(211): n is a, c, g, or t
  misc_feature (332)..(332): n is a, c, g, or t
  misc_feature (382)..(383): n is a, c, g, or t
  misc_feature (387)..(387): n is a, c, g, or t
  misc_feature (404)..(404): n is a, c, g, or t
  misc_feature (418)..(418): n is a, c, g, or t
  misc_feature (583)..(583): n is a, c, g, or t
tccacaaagaaggaagaggaaaaaccccaggncttccaagggtgaagctgtcccctcgcgtgcgcnnggcgcaccctcccaggctcattagtgnccttgggaggggcagagggctcagaggggatgagtctcnngggggnctggggtggngggggtgagggagagagtcctgaggncacagagctgggnaacctgagnngcctctctggnnccctcccccaccactgcccaaacctgtttacagcaccttcgcccctcccctcttaacccgtccatccactctgcacttcccaggcaggtgggtgggcaaggcctcagccatactcctgggngcgggtgtcggtgagcaaggcacagtcccagaggtgatatcaaggcctanncggnacagaggagatgcaggnagacagagtggggnaaatgtgaatggggacagtggccaacgccgatgcaggcagatcccaaagtcagggttaagctatcctggccagcagaagccagcgcccgcactccaccaccacaccctgtcacttcgcgtccctccccaatatccagaggagggtggactctgtacttgcaagcng

SEQ ID NO: 511585 - DNA, 903 bp, Homo sapiens
gcgcctcggaggcgtacagctgcttcaatgatgaacgctgagcatctcctatcccagaccactgggtgccagaacctcatagaagtgatagagatgaacggtcacacttcgtactgttctatgtagtaagcgtatggccagcacgaagtgagctgctgacgctctgggtgaagactggaagggttatgtggatcctgaagtcaagtggctgggaaaccgagaaaacaaaggttgtccccatgaaagccataggatgtcctctgacccactgctcgtgtccgacttgcatactgagatacgggcgttatgttccctgttatatacagacccaaggaataacgtggcagactgaccgagaacattcaggactctgcgtgtagctattgtcgtgggtgcaaattctgagacgctgctccaatcatctggttctatttgtaataaaatccggagagaccgatagttcctggatcgtgagcatgtatactacagtgcactcgaacgcctgggccccaaaagagctcgcagaatccgcaaagactttgcaatcgtgctctatagagaagatgatgtccgcagtcatgttgtaatgaaagcccttgagataaagaaggtaagaaacctaggaccaaagcacccaagattcagcgtcttgttactccacgtgtcctgagcacaaacggcggcgtatttgctctggacagaagcagcgtaccaagaacaatcaccggaagaggctgcagaatatgctaaacttttggccaaggagaactgacggaggctccggagacggcgcaggaacaattgcgaagagacgccgacttcctctctgcgagcttctactctaggtctgaatccagtccgaacttcgatctttgagttaaaattaattagatcagactttgg

SEQ ID NO: 511586 - DNA, 140 bp, Homo sapiens
tctagcagtatcccccccgttacccagcttcatatactattttcaaacattattttttctcttgtaaagttattatatataaatactctcttgtctctaaattcgaatttctaataataagtaggtataacttagcagta

SEQ ID NO: 511587 - DNA, 205 bp, Homo sapiens
aaaaaccgggggccccaaaaaaataaaaaaggggggccggattttgttaacctttgggcccaagaaataaggggggttaggggaagggccccgggccaatttgggaaaggccccggccttcccccctggggggcttttccttttaggtttgatccccgcccaaaaaaaatttttttggggacccaataataagggccggggttga

SEQ ID NO: 511588 - DNA, 205 bp, Homo sapiens
  misc_feature (21)..(21): n is a, c, g, or t
tgtttaatttcctcttctggnatcccaatttggatcatttcctctctttctttcctgggagaaacaggatggcaggtgctggagcccagagaggctaaatgacatttagcctccagctaaaatgatttaaatgggaaaggagaatgacagcaaagcctcacgtgaactttaatgaccctatcaatgacctttactaactgactct

SEQ ID NO: 511589 - DNA, 1193 bp, Homo sapiens
  misc_feature (978)..(978): n is a, c, g, or t
ggctgtactggcccgggaatttatgggattccgaggtagaggttggagaggggggtggaagtgagaccgggaggaggcagagcgtgggaggggagcagagaactgctgcagttgggccaaagtgacagccccccctcaggactgatctcgacaggaatgccctgggagaactggggagtgcagagaccccgtgctggcctggatggctatgttggagtggtggggtggccttgtggctgcatgtggctgatggcccgagctggaatgctctaatgcctacctagtgctccccctcatgctgtcctactgcggagcatcgtaacatatgacgtgattggcgctgctgccctgcgtgttccccgcgatgtcccctcggttgcctgccccggatacggcagtgtcgcgtggacaccctatcgtggtgcgccacttagcgtcctctcgccttcatcggctcctctcttccccagaacctcccttgtgcggctgcccatggtcttgtgacggcttgtgaagtcttgtgctcgggttgaactgttccatgacccgtcgcaggtagcagcgtgtgaatctcacctggtctcatggtctcaacctttccctttagcgcctccgcggggttgggacacatttggacgtcgcgtattggtagagtactatagtcatctaaagtaggcccaaagtacgtctcggcgaggggcttcgaacttccgttaggcaaagcaatccggaggatgaatgacaacgactatagggccgacaagacagcaggatccaccacaagtgactcataatcgactaatttcccgcagggggatacaacacctattcagtagcagatggattaagcaccgttgtaagatagctcatagagaagagtgcgtacgtgacaaccgagtggtggattctcccaagggagtttcggacatcagctagcaggaatggtggtggaagcgaccaaggtctcaccgaagagancctaagccgcaattggcgagggcgcagacaccaattgagcaagagcactatccataggcagcaggccgcatgacagaccagcatagggacaaacgcgcgtaggagatcagcagccgaagaagcgaaaactcaggcagaggaagactcggtggagacaaagcacagttcacacaacagagcgagcgcacatccagcgcccctagagacgactcctc

SEQ ID NO: 511590 - DNA, 328 bp, Homo sapiens
ctggctactcaggaggctgaggcaggagaatcgcttgaaaacccaggagacagaggttgcggtgagctgagattgcgccattgtactccagcctgggcaagaagagcgaaactctgtctccaaaaaaaaaaaaaaaaaaatttatttaatatactttttaaagacgtgagccgtggtttaaaaatttttgtgtggggaaacattttcttagccgaggtgatattttgttgtggccctcttataagtggatagccgttagaagaacgaggagagcccttatacaaccttataggccaaagagccatttctcaacattgccgaggcctcc

SEQ ID NO: 511591 - DNA, 244 bp, Homo sapiens
  misc_feature (226)..(226): n is a, c, g, or t
ctagttttagaaagtttcaatagcaacagcagacttctcagcagaaaccttacaagccaaaagagattagggtcctgtcttcaacctctttaaacagaacaacggtcaggcaagaattttttatcccacaaaactaagtttggtaaatgaaggagaaataaagtcattttaaacaaatgccaggggaattggtccctaccaaaccagcactacaagaaatgctatngaaacttctaaaactagg

SEQ ID NO: 511592 - DNA, 85 bp, Homo sapiens
gacagcagcttctacatctgcagtgcacccactggcgggaacaatcagccccagcattttggtgatgggactcgactctccatcc

SEQ ID NO: 511593 - DNA, 108 bp, Homo sapiens
  misc_feature (72)..(72): n is a, c, g, or t
  misc_feature (101)..(101): n is a, c, g, or t
ccctgacccctcctcaccaccgcgctgcacctcagggttacaagaagaactaggaaataacgccggccaccngacccctggagaggggccggctagaacanttctaag

SEQ ID NO: 511594 - DNA, 156 bp, Homo sapiens
gagaagccttaaagcatcctttctttgaccttctgaagaaaagtttctagatctgtaattggacagctctctcgaaggttcttacagactgtttcagtctaatttttaattcaaagtgctataatgccgctgataattgctcatctttgcatttgg

SEQ ID NO: 511595 - DNA, 205 bp, Homo sapiens
  misc_feature (39)..(39): n is a, c, g, or t
  misc_feature (84)..(84): n is a, c, g, or t
  misc_feature (86)..(86): n is a, c, g, or t
  misc_feature (120)..(120): n is a, c, g, or t
  misc_feature (132)..(132): n is a, c, g, or t
  misc_feature (169)..(170): n is a, c, g, or t
accctcctagcttactactaataattattacattttttntaccacaactcaacggctacatagaaaatccaccccttacgagtncngcttcgaccctatatcccccggccttttcctttntccataaaattnttcttagtagctattacctcttattatttttctaganntttcctccttttaccctaccatgagcctacaaaca

SEQ ID NO: 511596 - DNA, 956 bp, Homo sapiens
  misc_feature (954)..(954): n is a, c, g, or t
  misc_feature (956)..(956): n is a, c, g, or t
gagtgaatctctaaaaccaggatataaatgatgctgtatttctctgagaaaatcagacaaatggaagctgttcacacctccccttgcttgaagcatgatctaaattaattgtgacttgcataatgttcttgaggaataaaaacaacagtaacatggtaagcaggatagacataaggaagaacacaagttgatgttgaagtgcatttgactataatgaatcattgaagggaaaaggaagtgcgatattgtcatgaaatgtaatagagctatggtcttaatatactgtaaaatggaaaatgtgtgtgaattctgtgcttgaatccctgcgtgatatttgagactaagatctctgttatgatgtctaccagggaattatatctgtgtgcacttcacatttttcttaacaaaggagagagatcaactaactatcagagcaacatgttgaaggcaaaagtttccaatcatttacagtctgtgatcaggtgcctcttaccttttccttatttaagacaattatttggtacgagaaacacatgacctctctgcatatcaagtgggaggcacttttctaaccacgtattctccaggatgcacccacattaaacaagtagatctgggtttcctgctaaaacgttaccaaaataggtaaggactaaattcagatttggcttccttcatgtctaagacgattcgtgagaaccactgactttggacatctcaacctttagcttatactggggtccttgggggggatcaacgaatgggatcccccccagggtctactgggcacatggcacgacccttgtgtttatgtggccgaccctaccacgggcggggacaaacagcaaccccaagcgggattccaccgaaacacaagcgtttcttggccacgggcgtcacacacacacttctgggaatctccgtcgttagacataacagataatactaagatcngn

SEQ ID NO: 511597 - DNA, 348 bp, Homo sapiens
atatccatactgccactgtaataatagtgggttatatcaccctccttaatcattgagaaacttttgtccaatttttgacatattgtactacgatttgaccagattccagataattcacaaatagttttcttcttcccaagttaactcagttccttctgagcagattacggtacatgcagaggtaaagctgaagctggccaggggtatggctacagttcatgatccccattatctggtgctgattgaggctcacactgaatcacttgacaggttggttctggagattaccagtttccatatggtccacaggtggtttcttcaatcccagttcagtttgttccttccgag

SEQ ID NO: 511598 - DNA, 230 bp, Homo sapiens
gcgggggcgcgcgcgcgcaccgggagcgcgctcggaggcgagtggaactggatcgggttttctgccagcggcgtgagtttcggccgccattttacaacagcttcaacttcgtgccgtacacagggagcagccagccaccgttttcccgcaaccccgttaccattggacaagatttttctcctctcaaccccacggggagagtctatggagacatagctacacacacacgt

SEQ ID NO: 511599 - DNA, 201 bp, Homo sapiens
tttttactgtaccgggttcttcgaatgtgtgtaggatgaggggcatccatatagtcactccaggtttatggaggagttcttctactattagagacttattcgctatcgaagacgaaggcttctcaacatcctgcaaacattcattcaatcattactgctgttaacagcaaatgaatgcaacctcccgcatacataggcatg

SEQ ID NO: 511600 - DNA, 168 bp, Homo sapiens
cacgctttctctcacacagcactagcgctctctcactatcactcttctcacagagctgcgcgcgagtctcactactatcaaatatatctgtctcttctcactctatagctctctcacagatatatatctacatatagcgctctcattatactataatattatactctc

SEQ ID NO: 511601 - DNA, 115 bp, Homo sapiens
gtgactgttttaaaaaaaatagtggtggtggaatgctgtatcagctatcaggaggtgaggaggagaatcattgacccaagagcagaagttgagtgagccagactgtgtcattgca

SEQ ID NO: 511602 - DNA, 149 bp, Homo sapiens
caccttcgtccattgagatttacctccagaccttgacgtgggttttcggcgtgtgcagtgtggacgctcggcgtgtgcagagaccccaggtcagaatggacgaagttgttgccccacaccgccgcaaatcagagtggacgaagttgttg

SEQ ID NO: 511603 - DNA, 306 bp, Homo sapiens
ctgttacggactcccggtgtggcatgatgtccattctatctagcgttggcttgtgccaccctgtgcctcttgctcggtgctctggtttcctcagcacgcactccttgtaaggggcagagactgggtccaccaactccccgatgatgaagaagccccttcagtgccagtcgtgctggctcatgcctataatcccagcactttgcaaggccgagaagggtggatcacttaaggtcaggagttcgagaccagcctgaccaacatagcgaaaacccatctctactaaaaatacaaaaattagcttggcat

SEQ ID NO: 511604 - DNA, 923 bp, Homo sapiens
  misc_feature (282)..(282): n is a, c, g, or t
gctactttctcctgcttccccgtcgccgccggcgacatcatgagggacatcctgctcttgcaggccgtgacagatgcggcaaccaaatctgagcgcctatgtttacgggacgtgatcagcgatgatgcacggcatcgtacccctatcgggcacctatccaacggaggaacagtcggactctgctagcgtggtaacgcatctaatcggtgtactacagatgtaggcactacctgagcgagtgaaagtacagtgccaccgtggccagtgtcgtctgtggaatcntggacagccctcggtcacccattggagctctcgttgcgtctcgtgggcctctatcgggcatgactcttccaggcctggaacaactttgcgttttcaggtccagacgctggctgctgggacacaatctggtgccaacgggtgcactacatcagaaaggcgctgcgagcatggtgcgcacgtctggtgcctggcatgcttcgctgcacgacaagggcacggactgacgcagctagtcgcatctcgacctgcacagtgcgttatcgcaacgcctgtatcctcacgtccctcctggctctgcgggacgcgactgggagtctcggagattcgcggttgagctcgtacgaacaatttgagagtcacaggagctcccgagtgaacgcgaagttgccacccttggaccacgtgaggcttgcacactgtaactacagccgcccctatctgagggttctggttggcgatgtctgccctattctgcccacgaaaatattgactgggttccaacgtactgacacacccattgggcctggcaaggttgcccactaaacacatatcggcaccagtcgcgctgtgcattcaacgatgttctcaccgccagcagcccttcgggtcaccaccgccactgacccacgcaacggcaacac

SEQ ID NO: 511605 - DNA, 887 bp, Homo sapiens
  misc_feature (3)..(3): n is a, c, g, or t
  misc_feature (5)..(5): n is a, c, g, or t
cgnanaagaagatagagaaaaggaagggaaagagcctcgttcccctggccaagttttaagagtagaaggagggttgcaatccaggccgtggtacaggcccatagaatggctcggtcgggttgatcccccgtggaagatctcgccttaagagacgacgcttgtccgccctaacgatgactgcttttgagacaatcgttccttccccgagagggctgaagtacctttttcggagccaagccttttctgtcaaacgcgcgattcctgtcgttatgggcccccgcacgtgagggatgtgcgggaccccagcacagcagggtggagaagccaccggtcttttctacgatgtcccgggccaggtgcgtccgtttgtcgcgcccccccctcctgtctttggggaggaccaacggatgcattcccgacgcgtgcagtggccgccggtggccccgatctcctgcggaacgcagtcgatcattctccgctcatcgttgctccatcagagcggtacagcatcccttgcttcccgttggggcaaggatagaatttagtgattctcccggatactgagctttctgagtcttataatcccgagacagctgtttgtccagtttctgaaaccaccactcccacgtagaatcccacttatatgtcactcccgcgcttattgaaactctcccgccttgtatttcattcaggctatcagtaacaccccagtgctgtcttcttgcttggaagtacaaatgtaactgggaggaaccaccactaccgccacgaccacacatttcaacaagtcgccccccgcacgaagttgaatacccacccccatacaataatgaatgaaaaaccccggcccaaatgttttaaaaaaattagaatgcccgccacataac

SEQ ID NO: 511606 - DNA, 280 bp, Homo sapiens
  misc_feature (188)..(188): n is a, c, g, or t
gacgttccatgatgatacttttctgactatcgtcctatacgaagatcaaaggaaacacgagaatgcacctaacgcatgctaggttggaagggatacatcctatagaaacagctacccaattgaggacagtcatgacggaaaagcagccagggctgtctcttcaaagaggccaaatatcaagatcttgntcttcatcccctgctggaagaccgaattcctcctggtttacagatgaccaagtcgcccactgcaccaccacaatactgctcaatagtggact

SEQ ID NO: 511607 - DNA, 243 bp, Homo sapiens
  misc_feature (151)..(151): n is a, c, g, or t
tctaagaggatccgccttggggaaggcatcagaaccaccaggtaggtttgatggggatacatccgtaagagcaacacccatgtccagggcagtaggtaaaggaaagcagccagggctgtctcttcaaagaggccaaatatcaagatcttgntcttcatcccctgctggaagaccgaattcctcctggtttacagatgaccaagtcgcccactgcaccaccacaatactgctcaatagtggact

SEQ ID NO: 511608 - DNA, 167 bp, Homo sapiens
aagctcggacccattggtttacatgagatattgatgatctgactatatggccagggtgtcaggcacaatacttctggatgggcactgtagaggacacttgagagatgaaatcagtgacgcatgcatgcactatgaacaggcatggcctgctcatcctcactatgagt

SEQ ID NO: 511609 - DNA, 639 bp, Homo sapiens
  misc_feature (22)..(22): n is a, c, g, or t
  misc_feature (178)..(178): n is a, c, g, or t
  misc_feature (438)..(438): n is a, c, g, or t
  misc_feature (579)..(579): n is a, c, g, or t
  misc_feature (624)..(624): n is a, c, g, or t
  misc_feature (628)..(628): n is a, c, g, or t
agggggaaccgcccccaatatntcaagtaggttctttctattttccctaagtgtcagccagctgagaaatacagagaaagagtacaaagagtggaattttacagctgggcctccagggatgacatcacctatcagtaggaccgtgatgcccgcctgagccgcaaaagcagcaggtttntattaaggactttaaaaggggagggggtgtacgaagagggagtaggtcacaaagatcacatgcttcaaacagcaaaaaggagaacaaagatcacatgcttctgaggccagtaaagaccacaaggcaaagggcaaagcaaagatcacaaggccaagggcgaaatcaaaaactcctgatatggctgtattctgcccaactccttaggcagtcacaccttatggttgtcttcccttgttccctaaaattgctgttattctgtnctttttcaaggtgcactgatttcatattgttcaaacacacatgttttacaatcaatttatacagttagatacaattatcacagtggtcctgaggtgatgtacatcctcagcttaggaagataacaagattacgagattaangtaagacaggcatgagccactgcacctgggctattacatctgtantgtnactatatcaca

SEQ ID NO: 511610 - DNA, 106 bp, Homo sapiens
tatattggttgggatgatatcatttacgggggaaggcgcttatgtgaagtaagcctatattactcggggtcctttcagtacacgggaagaattttgaagtagatag

SEQ ID NO: 511611 - DNA, 140 bp, Homo sapiens
  misc_feature (121)..(121): n is a, c, g, or t
cccaatatcagttacatctggaatgtttgaacttgatcggaagatcttacagggctatgggttagagtgactgtgcttgagtaatataaaagcctctgcatggcatcgagacacaatgtcncggcagttatcgatgcgct

SEQ ID NO: 511612 - DNA, 419 bp, Homo sapiens
ccccactttggtcgcgtctgcgtcatgatgactccccaggatgtgcttcagacaggaactacagcaggacgatcgctcctcccggatcgcacccttactctccaaaaattgatggaaccataacactccgagatgagaggagaatagcccagtcacaacgaacgtggatcggatgcggagggaccagatcatcaactggatcgtccagctttcgaatatcattccagactgtaacgcaaactacagccagacgggagcgagtataggagggatcctgtcccaggcctgcgattacatccgggagttgcgccagaccaaccagcgcatgctggagaacttcatagaggccgagcggctgcagatcgatgacgagctcctgaggcctcagatcgagtagcttaataatgagaacgccctgc

SEQ ID NO: 511613 - DNA, 205 bp, Homo sapiens
gatggtcatgctgaaatccagcatactgggaggcgagatgggaggatcacttgaggcaggagttcaagaccacactgggcagagtggcacaaccccgtctctattaaaagtagaaaaaattcagccaggtgtggtggtgggtgcctgtaatcccagctacctggaagactcaggaacaagaaccgtttgaacccaggaggcggag

SEQ ID NO: 511614 - DNA, 876 bp, Homo sapiens
taaaaaaatttttaaataaaaggggaaaaaaggaagaaaaggggggaaggggaaaagagttggggaaacaaaaaaacaaaaaacaaacccactcccggccaaaaaaaagcccccctgggccccacacatcttgctgcagtttccccgcggggaagattctcctggcaattggggggagaaaaaattttaccttcccggccccacccccggtggtggtgtgtgccctccacaccaccccctcgtctctcaacggagatagttaaagggcacctatataattactggaaaacccgcatacccccaatttctacaaaaaattctccatttgtttattgggacaaacatatgacacagtacctttgcggacgtgccccacaaaaaaaaaaaaggggcggggaccaacaaaaatctccccgagaggcgccacacacatgagcgacaccccactatctgtgccacacggccgcccatacacggcgctacttcaaacacaacacaggaccggaacaccacgtcggcggcaacacacgccccggcagcatctttgggaaggcccccacacgggggagaccactgagcgacaaccaccacgaaaaccacgccgccacgatactaacacatcccgtgctctgcgtcacccagcccactcccgcgcaagcatcggcccacacacaacaaccacaactacccgcactgtgccaaaaccgacacaacaaacgccccaaacacaaccacaaaacaacaaaccactacagcaacacccactagcacagccaacagcagccaacaagcactcgacacaaacacgcaccaaacacgacagcaacatccaccaacacagaccacacaacagcataacactcaccccacaccaca

SEQ ID NO: 511615 - DNA, 881 bp, Homo sapiens
gcagcgacgggcaggacgccccgttcgcctagcgcgtgctcaggagtgggtgtcctgcctgcgctcaggatgagggggaatctggccctgggtggtgcgttcataatcagcctggccttcctgtcactgctgccatctggacatcctcagtccggctggacgatgacgtcctgctctgtgcatgagtccttcgtcccctggcgctcaaaggggatgctgggagacgaagggagacataaggctgcccccggacggtctggaatagtcggccccacggggagacaacggtgataagctggagattccggtgacataggacaccctctggtcctaatggagaacgcaggccgtcccatgtgactgctagcacagacgtgctgcaacgggcatccgggggagatcgcgagcaaccatgcgtctctacactcttgagccacacgacgtcatcatagtctcatcactaatgctgtcgccggtgtgcgctgagacggaagagcaagatctacctggctggtgaagtgagggtgaacgcgctgaacgccgcgatcgcccaggtgtcctgtcggggacgtcggggtgccccctgaagcattgaccaaggaccgtaggctgcccatgggcggatagggcgggataccaggacgcaagccggcctgggcccgggtcttcatcggcgatcaacgacctggagacgagggcgccttcgtgtactctgacatatcccccatgcggaccttcaacaaggtggcgcaacggtgagccaaaatgcctacgagaggaggatgcgtgaaaatgtggcccggcgggtggaaagacctggttgtccacccctgtctcctgtgtggtccgaccagagacaattgagcccgggggtgccatgg

SEQ ID NO: 511616 - DNA, 889 bp, Homo sapiens
ctccggttccgaccaggctaatgcttgagcagtggttgagtcagtagcccacagccgagccagctggcccagattgcgatgcggagaacgaggaggatgagcactctggtcaactacaatgcccccggtccagaagagcatcaggagatccagtgagcttggacaaggacgagcgagagcctgcgaagagtaccaggagtggcctgctgggccgcgtgtccgttttccgcagacctcgcaacgttccccaacgtcggggtgacgtgggctgaccctggtgtgcagctcggccccgggccccctggagcttggagctgaacgtgggcgacctgggagagcttcaagaagcattcgttagtgctagaaggagggatgctggagtaccggataataaatctctttccgggttaaccgtagagatagtgtccggcatgagagatacatccgagcatagcgtacaggagaaggtctgtcaagattgacaagactgacgtacatggtacggcgatgcttatgtggccccgggccgagtgagtacgagttcctgacctcccgtggaggggtggcacccaagggtatgctgggccggggcagctacagcgtcaagtcccgcttcacagacgatcgaaaagagcgaccacctgtcctgggagtggacatctcagcatcaagaaggatctggaagtgactgatgcccaggtcagaaggccgggtcagggccagactgacggacgtgacgacgtgatagcgcgtttttttttcccccccataaatgtaaaacctccaaaaaaaaagtagcgagaggacgcgcgatgcgggcccgcaacctggcggcggcctttttgtgggcacagcaagaaaaagcacaatagagcttgtccgtaaccat

SEQ ID NO: 511617 - DNA, 115 bp, Homo sapiens
ccggccctcacagcttcgggctaacccgctcaaaataaagacggatacttggtgacggattctttacaagctgaccagtgttagtgcccgaagctgtgttgaaaccctgtctcgt

SEQ ID NO: 511618 - DNA, 518 bp, Homo sapiens
  misc_feature (29)..(29): n is a, c, g, or t
  misc_feature (34)..(34): n is a, c, g, or t
  misc_feature (126)..(126): n is a, c, g, or t
  misc_feature (138)..(138): n is a, c, g, or t
  misc_feature (145)..(145): n is a, c, g, or t
  misc_feature (153)..(154): n is a, c, g, or t
  misc_feature (157)..(157): n is a, c, g, or t
  misc_feature (166)..(166): n is a, c, g, or t
  misc_feature (250)..(250): n is a, c, g, or t
  misc_feature (262)..(262): n is a, c, g, or t
  misc_feature (488)..(488): n is a, c, g, or t
cccagcctcttttaattttaaatttaagnttgcntctgaaagttttacctgtacgtacatttaaagatattttaagggaatctacgtaactccatccaagtcagaattgccagcttctcggagccnatgtgtctcttnccctacngcaacttnncangctcctttnccagccttccctttttccctttttattttcatgccttgatttgacttgtgtggtgggaacatgtgaactatgaaacttaaaccntgctgcccaccncagagcagctgtgaccaagggctgcctcaaggggttgtccacgcaggttgggctcctctctgctgctggacccaagactctgaaccttccaagggacaggcagttcttctaagaagggctcccctgtgtgtgagcaagaccacagctctccttctatctacagatgcatgagggttggaagagtctgggctgtttttagaccttctggtcagctgtatttgtgtancaacttttgtaataaatagaaaaaccctct

SEQ ID NO: 511619 - DNA, 269 bp, Homo sapiens
ccccggggggggcctttttcgggggggccccccctttttttaggttggggggaaaagagggggcccttttttccgggcttgccccaggggggtttttcccgggccgggggggccccccctttttttttttttcccccggccccttttttttccccggggggttccaggggggtttttttttggggtttgggtttttttttttttttttttttggggaaccccgggcccggggattatttttttttttttgggggggtttttttccccca

SEQ ID NO: 511620 - DNA, 744 bp, Homo sapiens
  misc_feature (744)..(744): n is a, c, g, or t
cgcagtgctcatgcctatcatcccagcactttgggaggccaaggcaggcagatcacatgaggtcaggagtttgagaccagcctgggcaacatggtgaaacctcatctctactaaaaatacaaaaattagctgggtgtggtggctcatgcctgtaattccagctacttgggaggcagaggcacaggaatctcttgaacccaggaggtagtggaggttgtagtaagccgagatcgcgctgctgcactctggcctgggtgacacagcaaggctgtgtcttggaaaaaaaaaaaaacaaaaaaactttaaaccttgaccagaaagggtaaaactactaggagaaacttagaaatacggggtaaaaacttccagtgacattgggtcggggcaaggacttttgggatattgaccccaaaaagcacgggcaaccaagggggattacagtcaacgttaaaaagcttctgcagaagcaaaggaaccagcagattacagagacaatctacagaatgggacgccacggttggtaaaccagaatctcattcactcaggctggagttgcaggcgggtttgcagtggtgcactcacgggctcactgggaaccttcaaactccgtgggctcacagctgatcctccacactcaagctcctgaggtagctgggactacagggcattggcttcaccacgcccaaagtaaatttcgggatattgtggtaagagaccggacttggacaaccgtgcccaggctgn

SEQ ID NO: 511621 - DNA, 1596 bp, Homo sapiens
ttttttaataaacccccttttttttaattattattaaatgtccccattttcataaaaatataaggcaaccaagaggcgtggtcaccattttctataaaaaccgggtcatttaacaaagcggcattccaaaggttaaacgtgggccaacccacacaggtacatctcagagaagaagaagacacaaataatataaaggtgttattatactcaagggtgtacatattatattgtgagctcccaatttatattttaaaaggctcaggaaaagcctgtgcaaataggcggggaccaaatatacgtgtgagtgggtcgcccatgtgtttctccagtgggatgtggcaccagacacagacacactgtgagagtctctcacacacaagagtgagagagagacacacacaaactatctctctatattatccacacctatctctctgtggagaaaaaagagtgtttgtgtggtcacagacatacagagacgcacacaaagagaatagtagggtgtgcgctctcacagcagacacagtaggcgtcggtctgtgtagagaccccaacgtgtgcacaagaaacacacgcagcacacatatatacatacgcgagtacacacaacggggtgtgtgccacagaaaacacacatctgtcgtgcacgcgtgcgcgtagaaaacatccgtgtgggggtgtaggacaaagaggcgcgccgcatacagagaacacaaattgtgttgacccccacagcaggagaagaggggggacaacagttgtggtctgctgacaacaggacgaggcgaactattctataaccagcactgctctcctgcaaacactcctttctattacgaacagaacaccttcacacgtcgggcggcagaccacacactaataaattcaacgaggcgtcttctctcttaaaaacacacgagtgtgtctcctttttgtctgggccccaaccctttttataataatagtagaagcggcgggcgaaagagcgcaacaaaatattcccgagaagatgatcatacaataatcctttcaccgtccactatactctcaccgcggcaacaaaagtatttccacacaagagggggtagtgggaggcggcaccacccaagcagaggtgcgggttcgactgcggcgataatactcttacgagagcgccccaccatatggggggtgtcccccccacacatatgtggagggggcggcgacaaccccactatttaagaagaccccgccccctaatatgtggtgtttgtgctgctcccccctctataaaaaagggcgcccgtggggagtattaactaccaccagagtttggttctcactacaccaatttataccccttttttcatctttttcaccaatattgtcttacggactgaaaacattactcacaacaacagtgtgcacaaatatatatggggaccccaatattcgccgctgcttcccccaatatattcctacacgggtctataaaaaatggcgaagagggggccggctcatataaagaatacaccactctagggggggcccccaagaatatacggcggatcaccacgcgttttttgtgacataaggggtgcccccataagaggagga

SEQ ID NO: 511622 - DNA, 202 bp, Homo sapiens
tcgagctcggtacctacgtttccacagagcataaaggtattatttttacctgccgaaatttccccgcagctcaagcttcctatttacagctttataaaaccaaaaccttcatctgtgggtttaatatggatctaacaatctggtcgaacaatagcattgttataataaaatcatgcactccgtagaaaacctaaccctccct

SEQ ID NO: 511623 - DNA, 146 bp, Homo sapiens
  misc_feature (62)..(62): n is a, c, g, or t
  misc_feature (65)..(65): n is a, c, g, or t
  misc_feature (69)..(69): n is a, c, g, or t
  misc_feature (71)..(71): n is a, c, g, or t
  misc_feature (73)..(73): n is a, c, g, or t
  misc_feature (75)..(75): n is a, c, g, or t
  misc_feature (88)..(88): n is a, c, g, or t
  misc_feature (96)..(96): n is a, c, g, or t
cgcccggtgcactgtgtgacgatgagtcagtggttagtcggcgccaggtacgtgtgcgtgcnggnccgntncngngtcagagctcganccagcggngcccggagagattcggagatgcaggcggctcggatggccgcgagcttggg

SEQ ID NO: 511624 - DNA, 206 bp, Homo sapiens
tatcccaggataatgtatcatcccccttcgtccgcactgtatcggatagacacacgaagggggatagacacacgaagggaggatagacacacgaagggggatagacacacgaagggggataagacacacgaagggggatagacacacgaaagggggataggacaccacgaagggggatagaccacacgaaagggggactcgacaca

SEQ ID NO: 511625 - DNA, 604 bp, Homo sapiens
cgacactcttggtcggtagttttttgttttgttttgtttaatttactgattcaatttctgaacttgtactggtcagttcagattttcactttcttattgtttgaatcttgggaggttgtgtgtttccaagaatttatccatttcctctagattttctagtctgtgcatagagatgttcataataatctctgagaatcttttgtatttctgtggtattggttgtaacgtcatctttgtcatttctgattgcacttattttgatcttctctttttttttctttgttaatcttgttagtggtttatcagtcttgcttattcttttgaagaaccaactcttggtcttatttatcttttgtatggacttttgggtctcaatttcattcagctcttctctgattttagttttttcttctactagctttgggattagattgttctttttcttctagttcctctacatgtaaggtcattaatttgagatcttcctaacctcttgatgaaggcatttttagtgctataaattttcctctctacactgctttagctgcatccaaagatttgggtaaattgtatctctattttcattaatttcacagaattttgt

SEQ ID NO: 511626 - DNA, 390 bp, Homo sapiens
tctctagagtatccccccaacatacgcaggaatgataggtatcagatcgatcatttctataaagtttcagaggtaagctaggctcaggcatggctgagattccagaacttcaatctactagttttccatattctagttgtccacccattcctcttttcagcttgacatcattctctccccttgacaggttttctccacgtggagatcacgtaacatctggcagctccagaactgcgtaccagtcacatttttatgatctttagatcaaaggttatgcttcctccagccccaagcactctgattatcccttcataactacacctgaaaaaaaatcatgtggcaaatatatagagtctgtgactgactagccccgagttacatgcccacctc

SEQ ID NO: 511627 - DNA, 117 bp, Homo sapiens
acaggaaacatatgacgtcatgggaccagatgtcgcagccgaggtgaggtgtgcttagctctccacttctgagggtctcagctaacgtgggtccaaagcacggcttgccaggcttgt

SEQ ID NO: 511628 - DNA, 869 bp, Homo sapiens
agcaggctggtactggccggaattttggatgccagtgccagcctcgtgagccagtcatgtgagcatgggagctgggtggaaactgacgccaggaagagggtatcgcgccatgagaggtgcgactggtggtgctcgggaagcctgacagggcttttgcgcacagctgccggctggctgctacccgcccagtgccatggccccggagaacgcagcgaccaggcacccagtcctggtcacctgcagcggaggagcatcgccgatcgcatgcgagcgaggcccggagcggggccaccgcgagggaccctcgcccagaccgcctggtgccgccctggatgtgcactaaaatggaacaagccacttctaccagcgagcgactcatacacagctacgggatacggccggggccccttgggtggcctctcgtctacgacgacttacaaactcgcgtgaaacctgtgcctggcggtcaaaccatgtgcctgagcccataccgggaggtcgtcaaaatgctgcctggtgggctctgcgggacccctggcccaatgacgtggagcagggacggtgttgggctgtgccatggcttacctttattccattgaggtcacaagggggcttctgggaacagcgacagggccggccggttatacatacaaaggcgttccgagccatcctttaccgggagacgacaatgtgggagaagcggccccattggcaattttgggtcccacgcctatatgcgagggccaataacgtggaggcgcgtttgaattcacctcggtaagtcggaacagggcccgttacgaagccctccgccctgtgggtaatccatgggtacccgttttattaaccgctcgccggcgtgtggtgga

SEQ ID NO: 511629 - DNA, 210 bp, Homo sapiens
  misc_feature (16)..(16): n is a, c, g, or t
gctctgcttagaattnggaagttaacttatgcacgcttaactatcttaacaagcttggagtgcaagagattgaagagttcaaatctcttgcactcaaagctgttaagatagtaagcgtgcataatgatcccgtaatctgcgtagaaggcggaattaaattaggcggtatgaatgtaccgagacattgcttaatcaatatcgtactgaagt

SEQ ID NO: 511630 - DNA, 117 bp, Homo sapiens
  misc_feature (26)..(26): n is a, c, g, or t
  misc_feature (35)..(35): n is a, c, g, or t
  misc_feature (95)..(95): n is a, c, g, or t
ggaacgtaagtacaagcagttaatcncccaccatngggcatgattaacaaagcaacccccttcccccgagtgagcgaaacccccttttcccttcngcttgcttagatgttccaaatt

SEQ ID NO: 511631 - DNA, 160 bp, Homo sapiens
  misc_feature (1)..(1): n is a, c, g, or t
nattgtgctattactcccaaaggtcccaacttttcccagtgccattaccatggtattgtatatccagtggagaaatgtattatttccatgatcaaatgtagtctctgttaaggtcaagttttcttttataagcctttaattcatcctcagtgactctgga

SEQ ID NO: 511632 - DNA, 516 bp, Homo sapiens
acatcccgagccctagccaaccatggattactttccgtctctatagattgcctattctggacaagggattatataatatatggcctttcatgacaggcttctttcactcagcaaaatgttttcagattcgtccatgttgtaacatatcagtacctcattcctttctattgctgaataatctattgtatggatatatacctcattttatttatctattcgtctgttgatagatatttgggttgttttccatttttgggccattataaataaagctactatgaacattcatgtgcaagtttttgtgtagatacatgcttcttttttcttgggtatatgtaagagtgaaattgctgggcaactctgcatttaaccttttgaggaggttagactgttttccaagcagcagcatcattttacattcccaccagcagtctatgagtattccaatttctctacatcctcaccaacacttgttattatctgtcttttttattatagtcatcctagtgggtgtga

SEQ ID NO: 511633 - DNA, 289 bp, Homo sapiens
  misc_feature (165)..(165): n is a, c, g, or t
taccaccttgcgcacttctgcaccaggcgcacttcatgttgggcgacagagtgagactccatctcaaaaaaacacaaaaaatgtaacccagcaacgattcattaattatactagggatgctattaagggaacagtttaacaattatgggccaccagtcaaacggnctgagaaaatacaatagcattagacatgatactagcggcgaaaggtgtagaatgtgtcatgattgggacccagtgttgtactttcatccctaataatactgctcccgagaagtgcgcctgggtg

SEQ ID NO: 511634 - DNA, 879 bp, Homo sapiens
tgacaggatcctggctgattccggaggagtaactaacatcaggatggtagagctctatggctgatctcatgcaagaacgtaggctatgggttgtgtgcagtagtgaagaattgtcgtcaatataatcgtgcacgttggtgtccgggagttcacagcgtgcccgaggttcgcaaggggtttggggactgatggttcagaactctattcagggttaccagtatggcattccattacagagtatttctgctccgggcagtgggatctggagtgatgggaaagataaaagtgatggagcacaggcacacacatggcaatgtagaaagtcttgattgacgttcttaaagaactgaatccaagtttgaatttcaaggaagtaacttatgaactggaccatcctggagtttcaaattcgtgacagtaaaggacttcataatgtggtttatggcattcagaggggttgggtatggaagtgttcccagtagacctcatatatagaccttggaaaccatgctgaaggccagctctccttcattcaagattcccttatacttccagagatcttctgtatgctgactatccctgtcatactgttggcactgatattctgaaagcaccaccagaggtatgaccacattccgatgacaattggcacatggcacagagctggacttttgattggaatctctgcgtgagggttggagaaggtgggcaagatcgagcaagtccaaacagtcttcagttccctatcaacatgtgcagaaatgctgggatggcttacctaagattacacactctggggtaccttgcgcatgacgttactccctctgtgcacatttcctgaaaactcaaaccaggaatttggactcttgatggacagcc

SEQ ID NO: 511635 - DNA, 136 bp, Homo sapiens
ttcgagctcggcacccattcaatgtcttgcggccatgatgcttcgtcgtcgccaaagctaacttgcttttgatgctcgcgtttgttctcaaacgctccgtggtgaacatcatcgtatcgttccctgttggcgggag

SEQ ID NO: 511636 - DNA, 294 bp, Homo sapiens
  misc_feature (28)..(28): n is a, c, g, or t
  misc_feature (30)..(30): n is a, c, g, or t
  misc_feature (40)..(40): n is a, c, g, or t
  misc_feature (50)..(50): n is a, c, g, or t
cactgatattccatcatgctacacgtgnanaggcagtggnactccttagnaaagtctggaggagctccaaaacgcttctcctgaactgtcaccttcatgttcgaatcattgacaaaatggcatccatgacctggatacatttccttccccaacagggctcctaacatcatgtcctccctccccactggccagggaactttttttggaggggcttcctttattttttcctactctttcaaggcgcacttttgataaagggttaatcaaaaataaaggggactttggatttaatgg

SEQ ID NO: 511637 - DNA, 260 bp, Homo sapiens
atttagggcgtctttgggagtagttgtgggtttgatacaaaatctcgtttctcacccagtgtagagtgcagtggcacaatcttggctcactgcaacctttgcctcccaactcaagcgattctcatgcctcagcctcaagagtagctggtattacaggcacacaccaccatgcccatctaattttgtatttttagtagagatggggctttgccatgttggccaggctggtcttgaactgctgacctcaggtgatctgtctg

SEQ ID NO: 511638 - DNA, 206 bp, Homo sapiens
ccgaaagcaatctaacacatgtaattaatgtggccacagtgttcagttagcattcaagccttgtaagacatacaataatttatactggagacaaactttgcacgtataatgactgtagcagcgcctttagctttctgttcaaggcttaataaccgttagctagaccatagaggacagaaactttactaatgtactgaatgcgtccg

SEQ ID NO: 511639 - DNA, 697 bp, Homo sapiens
gcctaaatccgcagggtttgcactatacccagtgtgccacccacgtgcttcaccggagggcatggccgtaaccccagactgccacacgatttttacaaaggtgtcttgtgaataccatccgattgggggcagtcctcgcccacaaaatatctagggggcccccctcccccttgttttattctggggcaggcgcgcccctctgcagttcccccgaccagtttcttttcacgactcgggtggcgccgcacacccccggcggggcacaatcccccctggtgttggctcaccctgcgtgccgcgtcgccacctaatgtgttcggcccaccccgcttcctgcttaggcggcgacgcgtgcggggtgcccctcttcacattttcggcgagggtctccgcgcctagtcctgcccttggttcgcaccagctgtacaaaggatagacatactctactacattggctgtttgttgcacgcccgtcccctctttgtttgtctaccccgtgatgtatcctgagagtgtcgagccacactacccatctagcgagtgtcaaatacgacgagtttgttttgccacaatgcgcggagtgctgctgcgtgttgcggggttacctgtgcgaggcttcttatgatccgcctcaagagaggtcgaggcgcaatgataagaagataattcttcaatcgcccaacaatagcagaaaagt

SEQ ID NO: 511640 - DNA, 595 bp, Homo sapiens
cgactagatcctggggaatcgacagactgagttcacaagggttgaactagtttacagccccataactcttaagaccactgcaatagcttatatatcgctgtcctttccaaccacttttctccctgaaacacatatcttacttacccttagttgcctgctcaaaaccttttaatggcttcaataaccttggaatatcaaattccttaaaaccattcaagatgtgctataaattaaatgccacctagacttatgagcggaattggcacagtctgtgtcccagccaaatcggaacacattcaaccttttctaaaaccatttcatttccctgttctcttctggtgcctatagcccatgacagtctacctccgattctcatcacttttttagtctacttgatatcatactcttttttccaaggatggactcaaatgctaatacgttggtgagttcttatgccaatactagaggaaaaaattaggtcattttccccctcagtgttatcattaacaggaagtccaacttcacattcatcatagtctcatgtacattacaattagttgttaataatctgtctgctccaagtagaattcaagct

SEQ ID NO: 511641 - DNA, 510 bp, Homo sapiens
gcaattttcctgtctcagcctcccaagtagctaggactacaggtacctgccatcacgcctgtggtcccaacactttgggaggcggaggtgggtggatcacttggggtcaggggattgggaccagcctggccagcatggccaaagccccatctctactaaaaatacaaaagttagccgggcgtggtggtgcacacctgtggtcccggctacttgggaggctgaggcaggagaatcgcttgggcccaggagatggaggttgcagtcagccaagatcatgccactgcactccatccagcctgggtgtccgatcaagactgtctcaaaaaaaaattaattatcattttttacaaaagatccatctacattcttcgagacggagtctcacatctgttaaccaggctggagtgcactggtgcgatctcggcatcactgcaacctccgcctcccagattcaagtgagtttcctgccggagcctcccgagtaggtgggactacaggcacgcaccatca

SEQ ID NO: 511642 - DNA, 159 bp, Homo sapiens
actgattatctttaccacaattttcccattcgtcttatcttcaataaaattccacacactatcaaactaaatcaagagtgggatccgtctagagtctgaccgtgcagtgcattgcaatgccttgtgcactgtgcctgtgtcctgttttaccaactgtct

SEQ ID NO: 511643 - DNA, 168 bp, Homo sapiens
atttgtattagaaaagtaaagttgaaggaaataaaatttgcattcttgttttaagtgatctttaattgtatatatcgcggtagtatgttcaaaatccactaagtactgtgacttttagctgcaaatctttgctctttgcttttttttttctttctcccccctccccag

SEQ ID NO: 511644 - DNA, 528 bp, Homo sapiens
gtcaactctgtgagttcacacatcagaaagaagttctgataatgcttctgtctagtttatatgtgaggatatttcgtttttcaccataggcctcaaagcgctccaagtgtccactaccagatacaacgaaaagagtgtttccaaactgctctatgaaaaggaatgtttaactcagtgagtcggatgcaagcatcacaaagaagtttcggagaatgcttctgtctagtttttatgtgacgttattcccgtttccaacgaaatactcaaagctgtcctaatatccacttataaagtctacaagaacagtgtttcaaaactgctgtatcaaaggaaatgtttaactctgtgagttgagtacacgcatcacaaagtagtttctgaaaatgcttctatccactttttatgtgaagatatttcgtttttccctaaaggtctcaaatcgctccaaatgtccacatgcagatttccaaaaagagtgttccaaactgctctatgaaagggaatgtcaagtctctgagttgaaggcaa

SEQ ID NO: 511645 - DNA, 139 bp, Homo sapiens
  misc_feature (31)..(31): n is a, c, g, or t
  misc_feature (39)..(39): n is a, c, g, or t
cttgctctggtggtatcctcctgcgcttgtncttctgcnctcagctcctctccttgatgattttctgtaggttcctccaggtctcctccagtgcctccatggtaaaccaggtgtaggggttggaggagtaccacctagt

SEQ ID NO: 511646 - DNA, 701 bp, Homo sapiens
gggccaatttttcttgtggattttttggagaccccggttggccctttttagaacagtgctcccccttctgtccgggtcattaactccgctgttgcgccttttgtcataatccagggcaatatgtcgtgtgccccgacgtcgtttcccccaattagggtcgtgctgccccacagacaatttgggtttccgccccccatcccccatcccccatcccgttcgttgttaaccccccctcttgtttttcttgcacaaaataactggaaaaccttttttacaaatagttttcttatggcgccatcatacacttttctctatgttctgttcacatacctctcaccccccaccatccccaatactttttttggaattattaaactgccgcgtttcttactcggcgagtagtggttctaacctcttccctgttttataagaagccctctccgctgttgaacattcatggagcgtagcagcccacctccgctctctccaaatatgtgcgaggcataatcacttaatgtgtgagtaacacctccatctatactctccctctcttttcccatctcataattaccttctctcctgttttcccctcacaccaacactttggagcaagcgctcctctctcgatgactctcctcccttgcggtccagacacaatccacaaccgccactttcttcttctccacacaacatgaacaaac

SEQ ID NO: 511647 - DNA, 693 bp, Homo sapiens
atcagttggatcgtggatgcgcggttagaggcctgaatatgatggtctgcgcaggtatgcttctggaccatgctcgactgtcatggttgtgtaatggttggcctgatagattatgcaagtagccatattgtactaggcgtgcatgcttgcgtctctgagatttcacgaattcaggttgggatatggactgagtatcgtgatggagatgagcgaatgtggcaggtgcacgtgggtgattgaataccaagtgtggtcaaaggacactagagtgtgtgagcctcaggtgacattgcgacatgagtgattgggatgggtcggcttggcataaaactggtaagggtacgtaagagagttacggtgcccaagaagggactgcagtggagtggctggatagctataatccactacactagatacgcaaacggactacccgcggaacgacaggctgcgcagcacggactaaattgcacgatgaaccttcaggaagcacgctcatgggccagacgggttcggacgacttaggtgccgcctactcaccgggggcgacccgaccgacagacgcttcccaaagacatggaggccgctcccgttcacactacgaatgccgggggtacttcccacactgtgaccgggcgcccgctggcgacaaacagcaaggtcgcacagcatggacaataacagcaggagcactcc

SEQ ID NO: 511648 - DNA, 154 bp, Homo sapiens
gggtacggagggtccgtcacgatcgaactgctgcgctatttgtatatattcaaataggatattacaattttgagggagagaatgatgtaagtcctaaattacttgagaggtgtgtttggatctagaaatctaaaaatatgggttttgttattgt

SEQ ID NO: 511649 - DNA, 393 bp, Homo sapiens
gctcgacgacagagtcttgctctgtcacccaggcatgagtgtagtggtgcaatcatagctcactgcagtcacttgacctcccggaatcaagtcgtcctcccgcctcagcctcccaagtagctaggactacaggcgtgtgccatcacacgtggcttattttgtaaaacatttttttctgtagacacggggtctcactatgttacccaggctggtctcaaactcctgggctcaagcagtccacccaccttggcctcccaaagtgctgggattacaggggtaagtcactgcacctggcacatagatctcctttttaaggctgaataatgttccgctctgtgtgtgtgtgtgtgtgtgtgtatccatttatctaccagtggacacttaggttgtttt

SEQ ID NO: 511650 - DNA, 373 bp, Homo sapiens
  misc_feature (77)..(77): n is a, c, g, or t
  misc_feature (160)..(160): n is a, c, g, or t
cttgaccgcatcgtgaaggaatctggaggaaagctgaccaggcggcttgtgaacagtcagtgcgaatttgaaagagnaaaccagatggaacacgacgttgggacttctccatctgtggatcccattgtaggagagccaggtactgcctgtgagactggantgacactggaagacttcagtctggagtgtttacggaagaagagtttaacaacaaggataaaaggaacaaagtcactccagtgtgatatctgaattatgggccatacagtttatatgcaccgcattatgagtaccacattcgcaaatatcaggcaaggatgaattcatgatgttaatctattcaacctatggaggaagactctgatattcacaa

SEQ ID NO: 511651 - DNA, 312 bp, Homo sapiens
ctgtccttcccaccagcatactacttcccgcacttcgacctgggccacggtctctgcccaggttaagggccacggcaccgaaggtggccgacgcgctgaccaacgccgtggcgcacgtggacgagatgcccaaagcgctgtccgacctgagcgaactgcacgcgcacaagcttcgggtggacccggtacaacttcaagctcctaagccaatgcctagctgatagaccctggccgaccacctaccccgacagagttcaccccatacagtgtcctaagcctcgagagatcctactagacgtcgacctagcaaga

SEQ ID NO: 511652 - DNA, 117 bp, Homo sapiens
cccaaactctccttcagattacactcatcccactctaagtacccacgccatcacctaatcacactcgaagcagccctgcagaaacatcgcccattatctctccatatcatcccccaa

SEQ ID NO: 511653 - DNA, 230 bp, Homo sapiens
  misc_feature (77)..(77): n is a, c, g, or t
  misc_feature (160)..(160): n is a, c, g, or t
cttgaccgcatcgtgaaggaatctggaggaaagctgaccaggcggcttgtgaacagtcagtgcgaatttgaaagagnaaaccagatggaacacgacgttgggacttctccatctgtggatcccattgtaggagagccaggtactgcctgtgagactggantgacactggagactcagtctgggtcaatacttgcaggtcgtcaaagaggataaaggaccaagtcactcca

SEQ ID NO: 511654 - DNA, 377 bp, Homo sapiens
  misc_feature (15)..(15): n is a, c, g, or t
  misc_feature (61)..(61): n is a, c, g, or t
ctagaacccaattcnctgtcccagcaggagggctcctcatctgctcccaccctggctaaantttgtatttttagtagagatgcggttttcgccatgttggccaagctggtctcgaacttctgacctcaggtgatctgcccgcctcggcctcccagagtgctgagattacaggtgtgaggtcgggagtacgagaccagcctgaccaacatggagaaaccctgtctctactaaaaatacaaaattagccaggcgtaatggcccatgcctgtaaaaccagctactcgggaggctgaggcaggagaatcacttgaacccgggaggcgaaggttgcagtgagccgagattgcgccattgcactccagcctgggtgacaagag

SEQ ID NO: 511655 - DNA, 273 bp, Homo sapiens
gatggatacctaagtggtgtctatgagagatatagaacatactacccatatccagctgatgacaagggagcgtagacaagacaagcatgacaagaaacatgtcctggtcggatgaagctgctggagagcaatatgcgcccatcagcatttgcccacagctcgttgttcctccttcctcttatctggtgacctttctactgattgcattgtacctctttccctgattggactcaagattggggggtatcctcttatgagtctacctgcacgcat

SEQ ID NO: 511656 - DNA, 488 bp, Homo sapiens
cacgctcattatataaatagcatcaaagcaggactcatactccatgtggcagaaagtgtctatgtactttcaagggcctatgctttacaaagaaaattcgtaacatgttctatattatagtggtgggcagaaaaactggagtgaatcattctagaaagtatgattttctgcagcagagaaataccaaagtatttctgtatttttaaaatttttatgcataacttcaaaggcatatgattttcccccatgtaacctacccaatttcagtaactttattattttgaaacaaatctcagatgtaacatcattttatcagtcaatatttcattatgggtctgaaacagaattgaagtactttttcagaacagacggatcatttattatttgaagacctctagaatatgaatgtggaaaattaaaaggtcaaatgggaacccatgaaaatgcaaaagagtgacgtaccaatgagatatttcaggcacccaggt

SEQ ID NO: 511657 - DNA, 176 bp, Homo sapiens
tttagaagttcaatagcagaagtataggggttagtcctggcgatattatgctggatctaatttttcatctttccctgcggtactctatcgtatgcgcccggtttcactttctatcggcctatactttgctattgaaacttctaaaactaggtgctattgaaacttctaaacctcgg

SEQ ID NO: 511658 - DNA, 320 bp, Homo sapiens
aaggatctagacaaggtgttcattgcgagccaaccatcgtcagacgattgcgtgtcttgatcacggtacgggagggaaccgtggcgtacatgagtgaggcccagggatgagacactccaatactgagacctagagtccagatgcttgtaggagccaaggcgttgtctaggtacttatttaaaacaggcgaatcagcgcatgccatttgtacttcagtgctagcctcagatttgcacagacgggtactgtcgagtatgttctatgatgggccaagtgctgtacaacagtgaacagaggactgcagaggtcctcctgcctgg

SEQ ID NO: 511659 - DNA, 108 bp, Homo sapiens
  misc_feature (92)..(92): n is a, c, g, or t
gctcgcgcgcacgagggaaaaggcaaggctttgttccaggtgaatcagtggctaacctggttagaaactgctgaagaagaagaatcagaggnagaagctgactaaaga

SEQ ID NO: 511660 - DNA, 116 bp, Homo sapiens
  misc_feature (98)..(98): n is a, c, g, or t
acgaggatgcagccagtgctgtatctcagcagcgtcatagcatagcagatctgttgttgcaagacagagtaagcatccggactcgtctccgcagcatntcatcagctcctccagct

SEQ ID NO: 511661 - DNA, 400 bp, Homo sapiens
aaaagccatttctactaaaaatacaaaaattagctgggcgtggtggtgcacacctgtagtcccagctactagggaggctgaggcaggagaatcgcttgaacccgggaggtggaggtttcaatgagccgagatcacaccactgcactttagcctggcgacagagcgagactccgtctcaaaaaaaaaaaaaagtgttatttcttcctgaccaaaccttttgtaaatactggaagaacgcggcatactatagggggttaaagagtgtataacctttttatacctggaattggctttgggcctcaaacccccaagcttcgtgccagttaaaaatagtggcggtaaacgccactcccacaatttaaggattttagtttaaaacaacaaaaattagcgtgggttg

SEQ ID NO: 511662 - DNA, 161 bp, Homo sapiens
cctctcttactgtatctaggctagagtcaatggttcatctcggtcactgcaacctctgcttcctgaattcaagtgattctcctgcctcagcttcccgggtagttgggattacaggcacccgccaccatgcctggctaattttttgctgttgttgttgtttt

SEQ ID NO: 511663 - DNA, 136 bp, Homo sapiens
acggaagcatacagaatgctagaataagccgggctcggtgcagtcctggggatctgagtgagtcggggggttgagctgctgcaggaaaagggtcggaacagcagaggggacagggggctctgtacagaggacaagc

SEQ ID NO: 511664 - DNA, 256 bp, Homo sapiens
ggttagtgtcccggggggaagggtggctggtggttaggcagtgctctttggggaagagatacctgacagggtcttcaatggataagcacgacaaggcaaggccacagtgagaaggaaaggagaagagaaggggacttgggcatggtgagccaattgacaaatggccagtatgtgcaatgaaacattggtaccttgggatgtgaactacaatgcatgtcctgtgacttgctagagtggctattgtccgataatgaaa

SEQ ID NO: 511665 - DNA, 783 bp, Homo sapiens
gcggtgagccgaattgccggcgtcttggcgattcggcccgagagctccgttttcgctacagcatggtggcctactgagacaggctgactcagctacatccgatactcccagatctgtgcaaaagcagttgagagatgcactgaagaccagaattcaaagcaaatgctgagaagacttctgggcagcaaccgtaacacacttgtgacaacgtaaacgaaggaataattctaccctgaataaagcttgaaatgctacatttccaccggtgacagattgtgtggggcacattgtttatgggccagacttgacacagggatctcatttccagtgggaacacaacacacacacaaaagaaaaaaacaaaaacactttttgcggggcggcgatagcggcccacgaggaagaaacgtttttcaacgaacacacactttcgggtgggggggcggcggcggggcccacacagatggtgtgctacggtagacaccaggggcggcacacaccgcgtggtccccaagaagggaaaacacccggggcacagaagacaccatagcgccggctggagagtgttcctccaaccaagaataaaaaagaaacggcgccgggggtgagaagcacgccgagcggagttgtgtgcaacaacaaacatcccggggaggaggagagtagcaggaggaggcacacaagcaaggggggggctcacctaacacaaccagggggggagccacacaagagagcgacccctcgatatcaacaaatataagcccccggcggcggagaggcgag

SEQ ID NO: 511666 - DNA, 162 bp, Homo sapiens
caagtttaatttcaaaaaaccctttttttttgagattacttttggggtaatatttaaaatgaaagaccttttgtaaccctgtaaaatacatagggaatataacattccagggtatacaaaaaaggcaaattttttaatcaaataaagggccttattaaatta

SEQ ID NO: 511667 - DNA, 245 bp, Homo sapiens
tagacgtatactcatctgtggacctattttcatatccaaactataaaaccactccttaatctctcccaatggagggcacggctttagagcattagctttggtggtctactttgactggcaaagctgtaaagctatttattactccttcattgcaaatttctgtctccaagtctatgtgcaaattctgcaccgttggacagaggctgagattaggcaaatcagtgtatcaaaatttactctcattt

SEQ ID NO: 511668 - DNA, 1599 bp, Homo sapiens
  misc_feature (214)..(214): n is a, c, g, or t
  misc_feature (1599)..(1599): n is a, c, g, or t
tggggggtaaaatttttaactctctctacaaggtttttccctagggtccaaaagagctggttccttctggggactaacagttaaatttacaagggggattaaagaggggttcggggggcaaattttaaaggtgagaactaaagatcctatctgggacaaccagctatcaccagggctcggataggttggtcggcctcataccataataaattcnttccacaacatatttgggcgtacatataagacggggtggtggctcttttatacgcgtggtgcctatagggtacgctcggtcgtgggtatccggggggtctatacgcttggggcctctccttggcaaaaggtatatttctcataagtataatcttacattatattggcaagaaggggtaatagcggggtatagagtcacttgagcgataatatttatacgcgcgtgggggtataatacatttttgtcacactcgtatctcgcctgtggcggggtactatatatattcatatttggcgcgcacagggttttacaaattttctctatatctcggcctataaatactcttataatgcggcgcgtacacatggggttgcgcgccataaagggggtgggctcctgggatacgatacagggggcgagaagtggggagtttgggggcgcctctttcaaaaaattttattgaaacgccaaatttgtgttagacaccgcttttccgggagcatgcgggacttcatacattggagaacgcacagaattctgggaagacatatgtgtcttgggtcacctgagaaacggcaagtgtttattggtttccggacaaaatgcggtgggctgggatccaatcagaatttttcgggcacgtcacaagggggaacaaggactttttccatttagaaacaagcgcggtccaaggaaaaaagtgggggggtgggagtttccctataaaaaaacaacggctggggcaagtcctctcaacattcgtgtggtcagctcaacacaaacaaccgctcgtcggtgtgttacattatcaccaacgtgttggaacaagaaattgtccgaggaatggcgacctgcggacttcggaacccaagcattggtgcggggggtatacaatcggtcgacaaccacaatcaacacgttaccacacgagacaacacacaacctgtcgtctgtacttttcgtcgcaccacgcatctctgcaccccacacgatgatttgttcgactcaccacgcacgatctgtacgacaccaccccgtcataaaaaacaagtgcagaccaatcacacgcttcacgcacaacccgagagaacacaaccgtgagtcggttgtgggatacaacgcgaccacaactgaggcacaccagctccacacggagaccacagtggccacgcccaacacttgccggggcgccagaacctggcacacaccacagcacgcgtacgacagcggctgacaaagaccacgaacccaagcaggacgatacgcgcccacgacacggaacaagacggagcgcaccgccaaacaagaacaccacaaaaacacgcgactcaaaccagcacatccgcgcatgcacggctagtccccctactacgacgatgcgtacn

SEQ ID NO: 511669 - DNA, 338 bp, Homo sapiens
tgctttggcccacctctgcgaaggttcagagggctgaccctctctgcaaaactctccccttcctctagaccccaccctgggtgtatgtgagtgtgcgaaggacggtgttgcatccccagtggctgccgtagagtgcggagacctcctggactagttcggcgaggagactggccactgggggtggctgttcgggactgagagcgccaagggtctttgccagcaaaggaggttctgcctgtaattgagcctctctgatgatggagatgaagtgaaggtctgagggagcgggccctggggcgaggccatctctgcctgcctcccttgcaggcgccagcggg

SEQ ID NO: 511670 - DNA, 958 bp, Homo sapiens
gggagtcatccggacttctcatgcacccggaggtcatcgggggcctcatgaagtggtacaatccgcatgaaggcgtcttcaaggttcctgcgctctgatgctgtggccctactatggggccaaaaggaagaagaacatcaacatgacctactgacgatacgctgagtccgggccatgaggtactactacatacgggaagatctctggaacgcgttcggatcggccggcgactcgtctaacatcgtgttggcacaaactcaagcggtctggaagcatggaagaggctctcacagagtcggaatccgagcgagttggaactataccctggtacccaactcgcggaccactcgaggcctgcataccttcctgggaggacaggcaggccagatggcccctccactggggaatgctccagctagtgctgctggagagaagctgatttctttggctgtattgtcagccatcgctcctgggactccggagatctatggcctcgcctccccaccctcctcttggaattacaacgccctggggtattgaagctgactttatagctgcaagtgtatctccgtgttatctggtgcctcctcaaacccagtctcagacactaaatgcagacaacaccttcctcctgcagacacctggactgagccaaggaggcctggggaggccctaggggagcactcgtgatggagaggacagagcacggggctccagcaccttctttgctggactggcgttcaccatgccctgcatcagtgcttcgggctccacagggcaggggtcagagcactccctaattctatgtgctatataaatatgtcagatgtacatagagatctattttctctaaacattcccctccccactcctctcccacagagtgctggactgttccaggccctccagtgggctgatgctgggacccttagtatacggctccgagctcctttctccc

SEQ ID NO: 511671 - DNA, 99 bp, Homo sapiens
taagttagtcggaacgcgggtcttcttctggattgggaaacatgccaacgaggaggagaagaacggcgcagcaaccactgcacagtgaatactcaagac

SEQ ID NO: 511672 - DNA, 669 bp, Homo sapiens
gcggagccctgccaggtggcatgtgcgaggacaaggacgaggaggagaaggatgtgagcagtgagtgaggaggagggatgctgtgctgtgaggcccagagtgtgggctgggctgtgtcctgcgttgcactgctgcacaacactgccctgtggccagctcctgctccgtctgcggtgggcccaacgcaggctctcgctgccactggaacccacccccacactgcacatttatgacgggagaccccgacaagaggactgctttgagccaggaatctcaggaccccgcccagggagctgccagccgcaatggggccttcgaggcgttatccccaattgggggtcctcgcggcggaagtggcagtttcacatgacgaagaatccagggtgggaacccgtggcaatgatccgggaccattggtacctagtgccacgtatcgcttgataacgggctacgaacgtacggataagattatcccatttcatgatacaccctcatacggcttgtcgacgcgtgggtaggaggaccgccattcgacctctatgacttctctaagccatttggtcttcaggagccaccgatgaccgatacggctcggcaacaaggaggcagcgctcgattgtctctattgatcgtctagtccctacttttagcttttgatctccacacggt

SEQ ID NO: 511673 - DNA, 568 bp, Homo sapiens
gcacgcgtgtgctcatgaagggcccgtgataccgactgttcgatctctgatgcccgccaaacatggctcgataatgttcctgatgatgggaataaaaggaccctgggtcccgtcacacatatcggatctgaggatcatcctatggtctggcgcgactaccagggcgggtcccagaagtccataccaccatggatagcaccatataaaaggatgtaatctcctgtggagaaaactacaatgtgtacacccttcggcagtacagctgcagagaagtgtcccattccatcagcacacgtcgtgacccattttactcgtgccataaattgggcgacccaagggttgcacgagtacccaattaagtcctgtccacagcttaccctgcaggcttcacggtgcccactcaggtttcagcgcaaaattcgatcttgcacttagtcctctccacaatggtgtctagggcaacctatagcaacatgctgtcacaagcaaaggatgcggtgcccaaccttgaatgcttgccactcattcctccatgtgtcccaagccgcagagaaaaccaaaacccata

SEQ ID NO: 511674 - DNA, 669 bp, Homo sapiens
  misc_feature (617)..(617): n is a, c, g, or t
cgcccggtggggcgccccattttatttttttggcccccccccccttttttggtcccaaaaatcttcgaaatcccccccatatttgcaaaacccccccccccccccccccaaaaaaaacacctcccccccaaaaagccccccaaaaacctttaaaattttgcagaactcccccccccccccctttttggaagtttccccaataccccccccaacccccaaaaaaaacccccccccgcccgaaaatttaaaaaaaaaaaatttttcccccaaatttttttggggcaaaaaatttttaaatttttttttttaaccccctgtgggtttgccaggggaaaaaaaatataaaaccccttttttacccccccaaaatgtctggttttcaaagtttttttttaaaaaaaaatcccaatgtttttcccccccttttaacccctcctttaacccccgtttttttaggaaaaaaaaaaaatttttttccattatatccccccttaagcgccccccccccccccccttttttttttgggggaaatttctttaaaacaacccccctttttttacaaaaaaaaaaacaagagggggggtaataaattacaaaaaaaaccctttgaatcccncttattaaaaaacaaaataataacattaaaagaacaaaaaaaaacaaaaaca

SEQ ID NO: 511675 - DNA, 838 bp, Homo sapiens
  misc_feature (10)..(10): n is a, c, g, or t
  misc_feature (93)..(93): n is a, c, g, or t
  misc_feature (97)..(97): n is a, c, g, or t
  misc_feature (158)..(158): n is a, c, g, or t
  misc_feature (180)..(180): n is a, c, g, or t
  misc_feature (211)..(211): n is a, c, g, or t
  misc_feature (236)..(237): n is a, c, g, or t
  misc_feature (281)..(281): n is a, c, g, or t
  misc_feature (286)..(286): n is a, c, g, or t
  misc_feature (303)..(303): n is a, c, g, or t
  misc_feature (311)..(311): n is a, c, g, or t
  misc_feature (324)..(326): n is a, c, g, or t
  misc_feature (333)..(333): n is a, c, g, or t
  misc_feature (341)..(341): n is a, c, g, or t
  misc_feature (345)..(345): n is a, c, g, or t
  misc_feature (353)..(353): n is a, c, g, or t
  misc_feature (357)..(357): n is a, c, g, or t
  misc_feature (361)..(361): n is a, c, g, or t
  misc_feature (365)..(366): n is a, c, g, or t
  misc_feature (368)..(372): n is a, c, g, or t
  misc_feature (676)..(676): n is a, c, g, or t
  misc_feature (721)..(721): n is a, c, g, or t
  misc_feature (829)..(829): n is a, c, g, or t
tggggaagtnaacacaaaatccgtcagataatcttttctcataagttaaactgaagcaaaacatctacaatttcagctaaaactattaaagtnaggngtgtgctgctggtttcagaatagttgaaaattgcatctgaatccttttagttgttaatgtnaaccttgtttgttttatcaggntggggggggtggggggttcctttccagtggngagctgctcatttccccttccaatnngtttcttacaacatgtgccccaaacgtgagggaaccagccagtnaaggngctatttgccagggtgngggaaagngggttctacaaannngtttggntaataganaatnactctggnatgnttgntaanngnnnnngggggggaggctgatagattcaacagcagattcatatacttctccacccagcctcaaaatacacagaactgaagagcatcttgtgaggcctcaattagaactaaaaggaatcttaaaatgcaggattttgagttcatgtcacatcaaataataagcaaaactgtacgtacatggttccggattgagcctgagacctccactcccagaagggggaaaaaaaattacaaactcaagtattttccacagggatgtgttctcagggacagagctctggaaccagcctctgggtttcgttcagtcagtntaaaataccagaatgtccacctgctagcaagagacttacccagtnttctggaactgattgtactcatcagaggcaaacccagcccttgacacttttaacaccccaaagggctgaaaggtacaacctccacttggcgctccggctccctgagtnaatgtctaa

SEQ ID NO: 511676 - DNA, 127 bp, Homo sapiens
gccgaactcgtctggactttgccgctacgcactccgcctcgagatctccctggactctccctgcgcacatggggtttgaacggtattttcagccttatttctgttcttgtattgatggtcttgtgtc

SEQ ID NO: 511677 - DNA, 222 bp, Homo sapiens
ctgcgccggcgccggctgccacgcctgttcacggcgctcaccaagtaccagcacttgggccacggcggcgtcgaggtggccttgtcggcggacggtatcggcgcggcggcgttgtgggatcccccgggcaagtggcagcagacgcgcggcgccgagctgcgggccgtgcccatgatgctgttgacgttcggcatccgctggtgctgccggccaggcggccgc

SEQ ID NO: 511678 - DNA, 250 bp, Homo sapiens
tcgcaccatcaacaactaaggatcatgttcccgcgcaagtatgttttgtaaatcgcgaatcgcccgagggttatgtcttccctgcgtgcgccgattgcaatgcgaaggatagaaaatctgagcaagttgtggcgttccacatccacgccatctcaggtcacgcgaacgaattttcccgcacctactctggacttaaaaacaacagcccctcggccttaccaaatccctatatgtctctcggcgagaaggc

SEQ ID NO: 511679 - DNA, 1394 bp, Homo sapiens
  misc_feature (218)..(218): n is a, c, g, or t
  misc_feature (966)..(966): n is a, c, g, or t
agcggagtgtctccgggacagcgggactccggcatgggtcgcctctgtacaccgttctccacggaaggaacgtaagcggtgcgcctggtcccacaattcccgaggagacgagaacgccaggcgccgagacaaggtccagtgtctcgaggaagagagatcggagaaggagccgctcgatgatccacagtgccgaagcatgcatctctgagtcatccganagactgacgtagatcccaacaatcgtcccattaccacgctttcgtcgcaactgcaaaccgagaatgacactagtaccttgaagggcggaaagcatagatgagcaccaaatgagaaacctaaatgaggcaatacgtaatctgggcctggacttgacctagaaaggcattgaatcgtataccgaagcgcgtcgcgaaaatgaagaagggacgcagacgcgatgagatgcctgatggaattacttcaataggggccttttgcacgttcccttttggagctacacaagcacaaagaccggttgaactgatccgtgttgagaatagggactcggtgaatcaccacctggcaccttatagcgccagtaccaatgggttcttctgcaggagacagaaagcgaagagcataccaggggcacgtatcaccaattggacaggtccggggaaaccaccaggcgcaaggcacattgcccaagacgaacaagccctctatgcggtcactcacccagaatacgacgcttgcaagttgatagcctgccccggacgccttggcaaagcgggcaatgcgcacattcacccgaccgccgcgcccccattccgaggccactcatgcggactcccaagggagccgcagcaggcacaccattccgcacaggccacacttaccgctcgagcacactacacgcaaaaccgtaacccgccccatgccggccccacccgcaacacgcacacaggcggagacgccctacgcacntgccaccttacaccccctatccaccaatcaccggctgccaacacagcgccccatcccgaccccaccatcccctctcgatcaacacacaccgcgaacccaattcattctcgcccacccacgacccacacgcgtctacaccccgtctggccccattccgccaccgcgggacatcccaaagagccgctctcacagagatccctttcccctaatcacaccaaccaacaattgcaaccatgcagcaacagaccattgccctcgccacaacggacacagcggccacacccccagtacaccaaatgcctgggaccacccaccatcactccccggtgggcacagcacaaacaaggacgcaccagacgagccgaagcaaccagcgattgccccctgcccgccatggcgcgccacatcacccagcacaacctgacaag

SEQ ID NO: 511680 - DNA, 422 bp, Homo sapiens
aataatgtgtgccaatcgaaggggttcagtatatcaaagagatatctgcagtcctatgtgtgttgcagcactgttcattatagccaagatttggaagtaacctaagtgtccatcaacagatgagtggataaagaaaatgtggtacatatacacacaatggagtactattcagccatgtaaaagaatgagatattgtcatctgcaataacatggatggaactggaagtcattatgttaagtgaaataacataatgagcataaagacaaacttcacatgttctcacttatttgtgggagctaaaaattaaaacaattgaactcatggagatagagtagaaggatggttaccagaggctgggaagagtagtggagaggactaaggagggggaagtaggaatggttaatgggcacacattatggag

SEQ ID NO: 511681 - DNA, 215 bp, Homo sapiens
tgagagaccgtgttgcaatgatgcggcataaaaagaaaagaaaataaaacaaaacaaaatgaaaaactggagagtggctgctgtggtgcaatgcctttgtggatcactgggatgcaggttcaatccctggcccggaacagtgaattaaggatctgatgttgccacagctgcggctaaggttgaaattgtggcttggatctgatccttcattgcaa

SEQ ID NO: 511682 - DNA, 464 bp, Homo sapiens
aaaatatatatcaaaatacaattaaaaccctcatgaatccttcatattcactctgatatccacattgataatattcttaacttccctgtttgtataaaaatgttatcctcactttggtttatttttgactctgcatcctttatctctctttctgtctgtctctcaagaattataatccagattttaaaaaaatcctccttaaaatcaatacacaagacaataaaaaagataatcgttataattaataatttattgatttttacagcatttattctaatatagaaatcacaaagacattctcctatatattcttacaatattttaacttattgtttagtctacaggaaattgattgatacagtgtaactacatggatgatttaaatttgtgtaatattccaattttattttgtttcccatagattacctatcatccatggccaagaattgtagttgttggctctt

SEQ ID NO: 511683 - DNA, 1147 bp, Homo sapiens
cgcggtggcgcgtgctgtagtcccagctactcgggaggctgaggcaggaagatcccttgagcccaggaggttgaggctgcagtgagccatgatcatgccagtacttcagcccgggcaatagagcaagaccttatctctaacaaacaactaataaaaagacctcacatttagacaatgtggtagttgtgctggttcagaaggagcccagcttatgcatggctaagggcaaatccctgcaatggcgaacggacagtcgaacacaatggttgactaaccctgagaaacagtctttgggcaacaagggtgatctcaggttctcatgcagggacaattataggaacacaagagagcaacgccaggcacgaaggctgagaactttattccccattcagtcaaacattctgcttttaagtcaaagatcctgcaaatgggccttttcaccaacaagccccttgaaaattcaggcagaacaaagacttgggcctggtgagttgagtgcctacgccagagttcttgctgccgtgattcagtgccagttagaaacctgtgctcttctttagcctggggaaaaaccaaagtcagcaaaaccagatcaactcagcaaaactttcgtccgcgagttattgctaccctataaggcattgtgcgtacgggactggtgcgcctctggcacagacccatacgaataggaaccttcctgtaagccgttacaccttagctggggtacaggggcatcagcgcgattataccccacacacaaacacaacaaacacaaccccactaactaacaataatactcactgacaattagcggaacccccttccattacaggaggagagtagaacgagcaacacaaatctcatttggcacacattattaacgggcccatgggtagcgacctgagtccggccgcactcgccgatcacccgcacttttcacgccgcgtaggttagccccgtagcaggcactaacaacagcgtgccaagtgaaacaagcattaaaacaaaccacgcggggggggaggccgcgacccccacaggagccaagtatccagaggaagagtgacatgaagccctacgacaaaaaaaaaagaaggggcggtgggtcgatgaacttatgacatctcacgcaatactaatcgagaaa

SEQ ID NO: 511684 - DNA, 386 bp, Homo sapiens
  misc_feature (223)..(223): n is a, c, g, or t
tggcaaatgctgaaaggttcaaggtggatctaagcccctaccctaccatcagtcacatcaacaaggagctgctagccttagaggttttccaagtgtctcacccccgtcgacagccagatacccctgccgagctgaggacttagctcccaaaccatgcccattggtacagggaagggagtaggcccagattgctgggtgttctactgctgtgaagagacaccantgaccatggcaactctgacaaagaaagacgttcaattagcttacagtttcagagattcagtccattatcatgatggttagaaagcaaggcacatgtaaggcagtcatggtgctggagaggtagcagagaattcacatctggatccaaaggcagcaagaagagt

SEQ ID NO: 511685 - DNA, 301 bp, Homo sapiens
gcggtagtcctgtaacggctgcactccttttttcttgtgtcgggctctctttaaatcttacgttttttaatcatgggtagatccttgatcttaaacttagactcgcagggaagtctaatctgcctgttctttatctcctaacaacaaaagggcactttcttaatcgttttttactacagatcagactaagggggtttacccttaggcattaatcgaagacgttgttttagaggctacctttttgtcttttatagtttggctatatggaggtcgacctttcttactagactgagactgacta

SEQ ID NO: 511686 - DNA, 100 bp, Homo sapiens
cttctccagaacctccaggcaaatcaggagcacaaacacagagcaaggcaccgtttctttaaacaatggctttaactgtcgaatgagctctgccaggggg

SEQ ID NO: 511687 - DNA, 392 bp, Homo sapiens
caccactcagtacgccaaggccaacgcacatactgaccgatctggccctcgacgaacctgctccgccagtctccaacccatgagcgatggctgggctctcacaccctccacggatataatgagttgcgacatggggcccgacggcacgcctcctcctcgggtatcactagctacgcgctactacggcaaggattacatctccctgaacgtatggtacctgcgctccttcgcacctgcggcggacaccgtggctcagatcaccctgcgcttcttttacgccacaggaatatgcagaggatttcaggacctacctggagggcgagtgcctggagttgcttcgtaaatacttggagattggcaaggatacgctacagcgcgcagatcctccaaag

SEQ ID NO: 511688 - DNA, 190 bp, Homo sapiens
tgctggtatttcctgggtcagctcagcctcctcctcggtaacactttctccgtgaccagtgttgtagagcagtgtgaccacgctgcacgggaagcacctccgtcccttctcctgcaccagtgtcctcaggacttgcagccccccgagcttcaggaactgctgctggcgattaggggaagtggcgcagaag

SEQ ID NO: 511689 - DNA, 122 bp, Homo sapiens
tccatgcatatggtattttcgttggggggcatgcacgcgatagcatgcgagacgctggtggaagggagcctgacaaagccttctgcacatcaaacttgtccttcagagctggtggaagggag

SEQ ID NO: 511690 - DNA, 325 bp, Homo sapiens
ctatagtcatcctatagtgtataaaacactacaacttgtccctcctaattttatgtcctttaacaaatctgtcctttcctcctctcttccctttcagccactagtatcctctattctgtttttacttccatgagatcttttgttagcttccatgaattagaacatgtggtgttaactttctgttcatggcttattttacttcacataatgacctccatatccatctatgttgttgtgaatgccaggatttcctttcttacggctgaatactattccgctgtgtatgtacaacatgttttcttttatccactcatctgttgctgga

SEQ ID NO: 511691 - DNA, 284 bp, Homo sapiens
tggcgggatcctcggtaaaaagctgacattgaaagattttgaagagctttagttaaaaagttaaaaacagcccagcgcagtggctgacgcctgtgatcccagcacttttgagaggctgaggtgggcggatcacttgaggtcaggagttcgagaccagcctggccaacatggctaggccccgtctctgctaaaaatactacaagaaatagccaggcgtgttgatgcatgcctgtaatcccagctactcgggagactgaggcaggaggatcgctttaaccccggga

SEQ ID NO: 511692 - DNA, 879 bp, Homo sapiens
gagactgtggtcaggcggctcggattgagcaggactttgccttatcccagttgattgtgctcaatactactgactgtcgcttgtcttctattcaccatggcttcttctgtagtatccaggtgaatagaactgagaggaagggacgtgccatcagagccagggtcgttatggagctggatttctcgatgccgctcggtcaaaagaatctgttccaggagaattctccccgtttcttcctccaatagaagaacggatcgtttctcctggacggcatattcacgtagacgattcatgtaggaagagctggtcagatagacaagacgcatgtcccatgaggctgaggtctagaaagcagcgtggctggatcaaacgagagctactgagccaagcaagtgcctttcgaaacatggcacctagatagagcaacatacaacttcagttaaaatgggcagcaagagaaactaggagctccactgagacatggagagctactgaagaagaaaccgacgaggcacaagatggtgtgccaagactggtgacgtttgccggagaccagggataaggcgcatgggaaaaacgtgccgggacaaggaaccaagggaatccaaagaccctgctggagcgagactgaaagctgactagtttgtgtctgagaactgactttctcccccatccccttcctaaatatcaaaggactgtactggccagtgtccatttatttttgtccctcctgacaaatattttaagaagcctaagtgtaggactgtatagggtaagatccaggatccaggactgtacgcatggtggttaacggggcaaacggcggcagacaacctggaagggggtttcactccttttctcaagggggtgggcctcaaa

SEQ ID NO: 511693 - DNA, 329 bp, Homo sapiens
gttggcaatctggtgtccagggacgatgcgagcacaattaacagtgacatatcgccagttaggataagggttagtgaagagccccatatcgtgatacatgaaggaataactcatgccatttggaagtccttggtcaacattctcttattagtcatgtcactatgtaaagcatacagtatttcaccattcacgtagatctccaaacctctagcggatactcaaaatccagagtgtcccaagccgtcattagtcggtgcagagtaagtgaaggatccctttccctcgatctcctccctcagtattcgaggcggtcagaactagcgcatgga

SEQ ID NO: 511694 - DNA, 124 bp, Homo sapiens
gagatagtcaaatagaagcggcgtaagagtgtttgagctgcatgtgcgtgcttgatgcttgtctcttttgatcgtgtgatataagcagggtgactcactggaatggggatgcttgccatgtgta

SEQ ID NO: 511695 - DNA, 874 bp, Homo sapiens
tctatgttaggaagaaggtcgaagggcaggaggagggagcccgttgagttgtgccgctgttcgccgtgtgtagtgtgtctgttggcacctttggggcttccttccaacggtgtctgtcacacggggttgcgctgggagtggccacgcctctttgtgccacctgcaggttgggaccaacaacaactctgggacggaagtgttgtgctccctctcccgcaagaggtgtgctgctcgtcctctgctggagacgctaatccaccgcggcgttgttgggtccccctcatgcaggacctcctggcgaggacgctttctctttgcagtcaagaggcccccgcctttctttcattcaaacccgccccccgcttgtaataaattttcaactctgtcgatcggtctcctcccccctatgcaatattctgttccgtttaacctccccagtgttcagtagtcattcaactttttgtccccgctcgtccttcatcacgacctccactgagaaataccctggccagtggttccaataccccaaatagagctggtttttcaggcgtcgcttccccacacattgctgactcacacgctccgtctttttcttgcgcgcgaacttaatcaagggcggtctaatgacgcacccttctttggcgagggacccttctctctatcttcgggaggctgaatccttatggcccccttagtctgggcggggcatatcgcacgccttcttctcgtcggggggattctgctcttactgtgcccccccccgatgcaagctctgtcagtctggccggcgggaggcatatgtttttcgcatagttctaacgaaggaggtgcgcgcctcatcgtgagccacccgcgaagtttttccacagagaca

SEQ ID NO: 511696 - DNA, 241 bp, Homo sapiens
acataagacggagcagctgagccccagccacgacagcgagcagcagcagcactcgccccaacagatcggctacagccccttcaaccgtcccacactacagccccgtcctacccgcccagtcagcgcgctcacagtacgagtacaccagaccaccagagacagccccccaggcaacagctggcagccaccatctaacaccaccttgtagcagccgctgcatcgccgtgctccccagtcgtga

SEQ ID NO: 511697 - DNA, 383 bp, Homo sapiens
  misc_feature (60)..(60): n is a, c, g, or t
cgggtcatgccccaactcgcagtgggaagatgcaagcttgctgccatgcgaggatggggncctaggactattgggtgttctgagttctaaagaaaatgcagaccttggcttggcgcggtggctcacgcctgtaatcccagcgctttgggagaccgaggtgggtggatcacgaggttgaggtcgagatcatcctggccaatgtggtgaaaccccatctctgctaaaaatacaaaaattagctgggcgtggtggcacgtgcctgtagtcccagctacttgggaggctgaggcaggagaattacttgaacctgggaggcagaggttgcagtgagctgagatcgtgccactgcactctagcctggtgacagagtgaggctgtgtctc

SEQ ID NO: 511698 - DNA, 1188 bp, Homo sapiens
  misc_feature (213)..(213): n is a, c, g, or t
  misc_feature (239)..(239): n is a, c, g, or t
  misc_feature (241)..(241): n is a, c, g, or t
  misc_feature (251)..(251): n is a, c, g, or t
  misc_feature (255)..(255): n is a, c, g, or t
  misc_feature (261)..(261): n is a, c, g, or t
  misc_feature (279)..(280): n is a, c, g, or t
  misc_feature (283)..(283): n is a, c, g, or t
  misc_feature (311)..(312): n is a, c, g, or t
  misc_feature (320)..(321): n is a, c, g, or t
  misc_feature (541)..(541): n is a, c, g, or t
aatggttaagggacttgacccaattctgacagccagagcgttagaggggccagcggccctaccaggcgatcttgtgtctactctaggactgggcccgaggatggcttacctgcacctgtgactcagtctagtttaaaaatctgccacctgcacaggtatttttgaaagcaaaataaggttttcttttttcccctttcttgtaataaatgatanaattccgagtctttctcactgccttngnttagaagagngtanctcgtnctcactggtctacactgnntgncgaatttacttgtattcctaactgttcnnatatgctnnattgagacttactgcaatgaaggcgatttttattcatgtattaaagggaaagcaaatctctcgaagatcactgaaggtgactataagatagctgcatatgcctacgaaaagctctgaattcaagtgtcccatgttggctgtcacaagaggaggtgagtgaaactccacaaccttaccccctttttgactattactaaaaggtgccttagcatgtcgttgntatgcgtgtcagcgcacgtacagataaggctggttgcacggatgttctctccatctgagactttcacgaagtaacagaagaagccatgttggccaaacattataaaaaagacaaataaaaggaaaaacataaagataactgtggtgcgtaggcgtgtggcctgtggcttcactggaaaaaaatgctcttctcaagaaaaactcattttgtagtgagtggtgcccggggagtccccacgtttagtgttcttcgtgtgtagcaacgtggcgctccaataggagttgtgacctcatacgaagggaagacaataatccgctgggggcctcataagagacactcaacggtcggggtgtggggagggtttttttccccaactcaccagattatttcagattaacaacacaacggcacgctcggggggagacgagttcaaacgagcagatacggtgtggtctttcagtcgtgaaaaccaagaatatcaacctcacagaagagttcggggtgggagttacttcatgcggaagcggagccccatgtcaaaagacgggtgtggagactgtgccccatgtaaagagcaagccgaggggcggcgttagctcacggagggggacaaactgccagcgaatttccctcgaaagattagaccc

SEQ ID NO: 511699 - DNA, 388 bp, Homo sapiens
  misc_feature (213)..(213): n is a, c, g, or t
  misc_feature (239)..(239): n is a, c, g, or t
  misc_feature (241)..(241): n is a, c, g, or t
  misc_feature (251)..(251): n is a, c, g, or t
  misc_feature (255)..(255): n is a, c, g, or t
  misc_feature (261)..(261): n is a, c, g, or t
  misc_feature (279)..(280): n is a, c, g, or t
  misc_feature (283)..(283): n is a, c, g, or t
  misc_feature (311)..(312): n is a, c, g, or t
  misc_feature (320)..(321): n is a, c, g, or t
aatggttaagggacttgacccaattctgacagccagagcgttagaggggccagcggccctaccaggcgatcttgtgtctactctaggactgggcccgaggatggcttacctgcacctgtgactcagtctagtttaaaaatctgccacctgcacaggtatttttgaaagcaaaataaggttttcttttttcccctttcttgtaataaatgatanaattccgagtctttctcactgccttngnttagaagagngtanctcgtnctcactggtctacactgnntgncgaatttacttgtattcctaactgttcnnatatgctnnattgagacttactgcataataactgtatattcctcacaagttctgaattcacgtcccagcttctgtc

SEQ ID NO: 511700 - DNA, 233 bp, Homo sapiens
gtctctgaggatccccttaaatcgccagaatgttcatgtgaatacgcccctcccattgatcttaatgttcgcgtctttttttttcaggtccgaatggaagttgaagggccccttgtttagcatgcctggacatgcatttcttggcccccttcatctcccttcccgatctgtacttacacttttcacgccccttagtctaagggtatatggaattctagttcccttttcaaggc

SEQ ID NO: 511701 - DNA, 407 bp, Homo sapiens
agtgtaaactccagccgggccagatgtgggtgaaaccccggtctctactaaaaataacaaacaaataaacaaacaaacgaaagtcaggcatggtgctgggctgcctgtaatcctagctactcaggaggctaggcaggagaatggcttgagtccaggaggcagaggttgcagtgagccgagactgtgccattgccctccagcctgggcaaaaagagcgaaactccatttcaaaaaaaacaaaaaaaattataatatgtaccctgcaatcaagagtccctaaaaggaaaacccccatacacacgcatacacacactaaaaatgttaaaaaagtaaaacatatgcaaaatcaaagacacaacacactatgtgggagaacagcataacctttgaaggcagacaccctaacc

SEQ ID NO: 511702 - DNA, 194 bp, Homo sapiens
aaaaaattttttgctggggggggttaggggccataaaaatttagggggaaaaggtgttcctttttggggggggaaaaatggggggccccagggttggggggtccctttttacaatttttggccctccggggggaacttttttacttttgggaaaggtaaaaccccatataaaaaagggcctggtttccttttga

SEQ ID NO: 511703 - DNA, 919 bp, Homo sapiens
acgccccgggtcttaaaggcttttcagcgcactatttgccgtcacaagccagttccacctacccgggcaaggtcccgaccatgaccccgccacgggacccccacaaacaaaaccggggggccccctatccaaatggggtgggccccaaaccatgcagccagaaggggaacgccagcgaccagatggccacaacggacttaaccgggcaaccaaagagaccttttccgaaatcatagggaatcaatcaacaatgacaaccccgtcaccaccggagatttgcatgatagagcatcgatagaggataaccccccagtattaggtcaaaccacaacgcccggtccgtggctcacgcccaaatcccccgcaccttgggagcccagtgggtggatcacactgagggcacagagttcaagacccgcccggcccacaagggtggaaccccctctccgtagctcaaaatatcacaatcaccccggcactggtggcaacttgcctcgtgatccccgcttctcaggaggtcttaggaggagaatctaccttggaccccggaggccagaggttccactgaatcagaggttgccgcgtactgcactcccaccctggccaacagagggagacttccctgtttccaaaaaaaaaaaaaaacctacagctgttcaaggacccagctgaccaggtcaagtgtgcgcccttttctggtctttgaacaccatcatagaaagtgaccaatgctgcacaagccatgaagaacatgaactataaacgggtagactaactgccccgcttagacacttatctatgccaccaaacagctggatttgtcacatttatatcttcccatatgggaagtattgagatccaaaccggattcccttgatctcattatattaagctaataaactaattttttgaattttta

SEQ ID NO: 511704 - DNA, 479 bp, Homo sapiens
  misc_feature (29)..(29): n is a, c, g, or t
  misc_feature (68)..(68): n is a, c, g, or t
  misc_feature (251)..(251): n is a, c, g, or t
  misc_feature (258)..(258): n is a, c, g, or t
  misc_feature (444)..(444): n is a, c, g, or t
  misc_feature (448)..(448): n is a, c, g, or t
  misc_feature (469)..(469): n is a, c, g, or t
  misc_feature (479)..(479): n is a, c, g, or t
ggtggaaatcgaatcaaggttcaaaatantaacccgggttccgtaagcgtaaggccccgaatgatgangaaatccgttcgggaaagcccggtaaccaaaacgccctgaataggccctggtagcgaatttgcttccccagaattcgttgaatgtcgaatgccgtcgcgtccgaccatggggaaaaggcgggtcgcccccttggccatcactttgaacccggtggcgcacacgagtacatcgatctcgtactncgccacntcggtggtgaaccaccgccgccggtgtgatcttggtgatgccctcggtcaccaggtttacgtgcggcaggttataggtcttgaagtattcgttgtgcatcgacggcccttgcagccgagttgatacttcggcgtgagcttctcacgggtctcgcgatccttgacctgggtgcgcatccacagcttncganagcgcttcggcgccaccgatncagcggtccn

SEQ ID NO: 511705 - DNA, 1032 bp, Homo sapiens
ttgtggttggttctctcccgctccaagtttttttttccccttttgttgtggtggttgttcttcctcacccccgcgtgggatgaattctctggtttacacatccagcggcgccgcgcggaagattatttttttgggccctctttttagtatggccgtctgtcatagccagtgtgttgtggggcaccgcgcgttttttcgttctcgtgttgttggtttttccccatcattatttattcctcgcgcacggtgttttttcttctactagggtgggggggacaccttttttgttccgcgccaggattttttggcggctgttgcaggtcgcccccggcaggtttttccccccccgttttttttttcggtgggcgactcatactcctttttcgtgggtgtgttctcccccgccacgcgtttctccccgttcttgttggattcttctcttttttttgtggtgccttctcccccccccctgggtgggtctcttcttgttggagacgctgtcggccccatgggtgtttcttcatcatgttcgttggggagttttttgtatgcaccacttctttggtgggcgttgttttccgtgattaaccctcttggccaagatatttttcctcccgcggaattcactctatctctctgattcccccccgacgaaaataggggggggtgtacaccacgtcgttatcttctttattcacccctcacaacaagagagagaatctccacccaccccacgacttttgtgggggaaataaccattcttgtcccccctctttgtgtgcacggagccactctatagagacccacacatttctttatattgtgggtgttctccgaagacaaaattaattaatcaacaccacctatcatcttggcgtcttttttgtgtggtagccatgctcacacttggtgcacttctttgttctaacaacatatctcgtttctcccgacaaacaccgggggggggggggggggccggggggttcggggtaaaaacccccccccccccaaaaaaaaattttttccccccca

SEQ ID NO: 511706 - DNA, 312 bp, Homo sapiens
actacactatacgtggctacagaggtcctccaccatgacccgcatacctctgcaggcgctgcaatcgcagagactgcctccgaatcaccgaagaaatgctgtcgcatccgccccttgagatcgctgatatactgctcgaccaaaggctcccgtgtatctgcttcacactcgttggtgccctgtctcctgcaccaggttccacttggtatccagctcctgtgtctgctgctccaggaaccgcaccttgtcgatgaaggaggcaaacttgttgttgagggtcttgatctgctcacactcctcggcccgcacccg

SEQ ID NO: 511707 - DNA, 259 bp, Homo sapiens
  misc_feature (256)..(256): n is a, c, g, or t
aggaggaggcagtattttctggcaagggggcatgatggagcatcgtggagtgctggcgctcttcctgtatcttgatctgagtcatggctacatgcatgccttgcttttcttgaagcttcactggagctgtatatcataagacctgtgcactttgcttgtatgtatatcacaccatcaatggaaacttgtaaaaggaatttaattacttttttttttaacagcttctaaggtgaactttaccttaaaggtatatcangta

SEQ ID NO: 511708 - DNA, 104 bp, Homo sapiens
actcacctggctaaatattagtgtgtgactgtgtggagatggggtctcgcatgtgttgaccaggatggtctcaagattcctgggctcgagaaatcctacatgcc

SEQ ID NO: 511709 - DNA, 451 bp, Homo sapiens
ctatctccctagctgcaggggtcacaggcatgagcctgtgtgtcctggcctaaactcaccctttgataatgacactgatctgattggtcagagatggcgcccttgtgccctaatcatctcttaaagatcccagctctaaatactgtaacaaatgggaataaaatttcaacatgagtataggaggggatgttcaaaccctagctcttggatttcacaatccatttgatgttattgaaagttgcaggaattttcttgttggaaattaccttctgtaatctgaatcacttcttcaaaagggtactcttcatctttctatccttaatctttcggcatatgcataggtccttttggcttgtgactaattttgaatggggtagttctgtcagggcttcttatatatcacaggaataatatagatggatttcactgacctttatttaccttggcagtg

SEQ ID NO: 511710 - DNA, 824 bp, Homo sapiens
gctgggacaccgccggcggggagagaagcggatcccgtccgagccccggccccaagtaacgccgccgcccggagacgcttggaggtccccctccccactaagtgcctctttgcatagcaccagtccccacccgcacgacctctctggtaccactacagctggacgggcaatggcgggtcggggaggcgccagaacgacccaatggaccacgctgctgggaacaagatctgtcaatttaagctggttctgctgggggagtctagcggtagcgcaaatccaagcctcgtcctccgccttttgtacaagggacacgtttcacgaggtaccaggagagcacaattggagcggccttcctcacacagactgtctgcctggatgacacaaccacgtcaacgttcgagatctgggacacagctggaaccaggaagcgggtaatcacagaactgagccccatgtactatcggggggcccaaggcctgcatcgtggtctatgacaatcaccaaaacacacagatacaatttgccacgggccaagaacctgcgtgaaaggagcactacagaggcaaggccagaccccaaaatcgtccatcggcactccgacgggtaacccagggcagaaccttggcccacgccaagcagcagctggtggactctcccagcgaagccacaagcactcttcagacgaccgacacagtatgcctgttcatgagaggaaaatcaagcaaatttgcaatgcacgctgcaccaaatcttcatgccacaagctcagaagctcgccaaacgaagccccgatgcactggggctccgcgaaccaaggtgcctcc

SEQ ID NO: 511711 - DNA, 919 bp, Homo sapiens
ctgatgtgaggaatgtggaaaagcttttggtcagagctcaagcctcatccaccatcatagaatccactcagggagagaggccctatggttgtcgtgagtgtgggaaagccttcagatcagatagtcggtgcttggttatgtacacctagcagtaactcacactggtggtagtaggcgctacccttgcaaggtgtgtgggaaggccttcagtctgagctccactcactagcccagcatctaaatggatgcatactgcggtgagtcagaggctctaatatctactagcctcagagcctagtccacgccttgttgtacatctgagacacttcgcgctgtagagaaaccatttaggtgtgatgagtgtgggaagagtcttttagagtggtatcttctctgtcctgtacgttctagcactcctacgcttgattcactactgcagagaagtcgttatataatgccaacacagtgtgcaaatagcctttggtatgtatgttctactggtgtattattgcgtcccactctaggagtaagcatcagacctggcacagaaacatccatgttatgttgtgatgtagtgtggcaacagcgctctgttcgaggcactcactaccttagttcaggctagtcagcgatagtccgacacctggaaggagcaaaagcccctagtgtgttgtactgactgtggaggacgcctttcagtctgaggttcccggcttatttaccatcagaggaatccagagtggagaggagtccatacagagatgtcctccattgcggtactacagccttcgagtatgagcacaacagcttacaataccagtcaagaggggttcagcactggatgcagagcgcctatagagatgtctttgaatgtgggggaaaggctatccgtttcgggaactcgaaccctttttccaat

SEQ ID NO: 511712 - DNA, 854 bp, Homo sapiens
gcaaagctggtgctgcacgcccataggaaggagctggaagtgcctccggcatgcgatgccagcaatgagttgagtacttggcatgcagctgcaggaggaggagggcaaacccgaggagcccatcgatctcttcgaaaacctagctggtgctgagtcctgtttgcgggcacccacacatgagacccctcttcactcaggaggcccgctgggcagacaggggagccggggcgtttgccctggtgctgtgctctcgtgtgatgaccctattgacggtatcaagtagccactactcccccgtgcctggccctgcagagcggctctgtctgtcagtctcaagcagcccctgtccccaggccgttcgccctgtgaggtggtcttcttcagtctgtattcccgcgatggccactaggccttgctacgatgccccatcggatgcttgccgcgatggcactggtgctcatcgcgatcctcgcacccgaacatgacaacagctcgagggactggagtccgaggccatcttgtcagactcctcctttctcctgtggcatcagtgatctcgttcatctgctttttgctcttcttcgcccgcagttcttctttcctcttgagcgccctaccccttccaggtgcggttcctgcatacacatgctccttcggagcacgtttgcgccgtagtgttcctagcctgtgtagcatgctcggttctttttccttaccatcccgttaaggctatcccaacgcggcgattgcgatgccatgggcgtcgatggaggatggctgcgacctctaggcatccatggagaaatccttatcattgctagcctcgtgtgatggtgcactggcttacaaggtct

SEQ ID NO: 511713 - DNA, 1736 bp, Homo sapiens
  misc_feature (1730)..(1730): n is a, c, g, or t
ggggcggggggagcgcggcgagccaagctcgacttgggcacggcgccccgtcccctcagaggccggccttcccgtgacgcacgcgtgcatgtctgctgtgtcgccgttgggtcccgtagttgctccgctcggccgccccgtacccgtgggcccagtcgctctccacgggccgcgctcgtacatggagcgatagagcggtctcctgcacgggcaggggagagcggacgtgagggggcggccacggcagggatttaaccctctcatgtcatgcttaaatcatggtgagagcattaaaggtcgtcgtcctgatttactacactgcgtttacgacggtacacgtgtccctcttcaagacaagggcagttatcttgttcgtgccactgagtggacttgagcgaggttgagacgaattagtgggctgcggcttgcgtgatgcaccgtgcgggaggcccaccacaaggagaagttgaattcatggggttgtccccttccgtcacattagtttgccacatgggctccgctccttggatcctaatgctcgcgtagagcgttggcatagtgagttgcttattttttatatgcactgcgtcaatgaacttgtgtggtgactatcttgtagcttgggcatatgggggcgttttaaccacggggggctataaatgcgggattatttggctaggtttaattcacaatgggttatacagttttggaggaacaccaaatatccttcttaaagagtttcgtggttgaatatggcgcagattgtcctaggcaaagaaagaccgttgttttaaaaggaagcccgacgttattcccctcaatgttccggggaccttgagacaaggaattaccacactccgtatatcatctgtggggcgcacatgtaccgttgtcgggcgcgaaaggcgacgttatcattcggcgcgcccgaggaacagaccttgtgggccgttgcgaaagctatacctcgattccaacgaacagagttgtttccctaggaaggatccgaatattcccccgtaacggtcacctcctggcgaactattacccagtttgaaggctggcacgaggacctccatagttcttctcacaaacgcagaaacgttggcggaaggtaggcgaaaacccagggccttctttggggcgtggcacgtgactatgcctcaattcaacttgtggttccagacacaaagcgtagatttcattggggaacatcttttgtgccaatcactgggccacgagtgttgtcccccctttagtgaatggtgcatgaatgtgcacattcgaactcttccccatggggttagggaccagggggtataagaacaaccggttttcggggctcagacaggtgacccgggcgcttcacacgcaacttttacgccttgacatttggccccgagcttcccttattgtgtgcgaaccccccagcgtaaactttcggggacgcatacctggtaacccaagttacttggccattgctacagtaacagaggcgaggttcaactgacaggatacacaacgcacagcgccgagcggatctcatatccgcaagacaccctggaaggagcagccccacacgtccaacaccagcggcacataacataactaccattggtgcagctgcaaaacagagcttcacaatctagacagtgagcgcaaacagtctacgcagcgctcagttacagtgcagcggcttgttctatcttcttcgtgcactattttcttangcggcc

SEQ ID NO: 511714 - DNA, 187 bp, Homo sapiens
gtttctgtggtgttaccgtcaaatacaacacaatgtatactggcattaaaaaacatacccatgataaaagaaatgaatggagagccccaaataaacccacccatctaggatgaagtgatcttaaacagtagtcaacaatactactctgggaggaaatggagaggtgtttttttttccttttagggcc

SEQ ID NO: 511715 - DNA, 1508 bp, Homo sapiens
  misc_feature (282)..(282): n is a, c, g, or t
ggtttaaaatagtatggattaggatggacgaggacgaacagtaccacaagcctcagtttggacctttccgtcatgtgggacagtgacttcatgactgatccgtgtgcgctggcacgtcctagagtgacgcaggatgtgattgcatcctctgagacggacatagacgcacatcctgaaagcttgttacacgtggtaccgtgcggagtgactgcgataggagccagagtgcctgagtgtttagcgagggcagaactccgctggtccaagtgaagtcagtggacnctgcagcacgcgacacgtctgtgtcctgcatgcgcgatcgaaacatggacagacggtcaacacaacaggagagctctgtcttggacgacgccagtatgacgcattgaaggggcccgcaagaacataggacaagacgcggctaaccaattcacaaggaggtggagacaagatctcacgacccaaatctcctagacgtgggcgtggggactcttctaaaggcgtcctttcggccattcttgccaaggggggtcctcgacagatatgcgagagggacgagattgaacccttacggagagacgttgtacgcggatgccattattcacgccgccacatgcggcagaactcctgactaggaaaacttacgaacttcacgtaggaactttcccttcacctggaacagtccccggccacggatagtcccgaaatcatcggccaagagcctgttgacaccaatttggtccgggcttctagagagcacgttgggatgtttttcccaatgtccacacccaaaacaacaaacgggggaacggcggacctaattggcggtctccgtataccggggagaggttccacggacactggagttgtgtgacccggagagggtcgtggtatggccccctgtgaggggacactaccacacggcattcaacttaagttgtcggcctaagcggcaggaaaccccctgtatgggactgcacctttgtaccccttctgtaaatcgcttgcacaagtgaatgggggcgtctgttttgtggttggaaaaagttcccccggagagggacacggcatttgttactttggcaaccacagctacgtgtttccaatgccccttgtgaaaggaaggtatggaaaactttgtgttggtgcgtacgttgggtgtcgtaccccacggggagtagcggtgtcctcttttgggaacttgaaaagccgcagagatatatcacaagaggccactttgggtcttgtgttcacgtagaataggcaaatgctctttggcaaaagacacctcttggcttcggtgtccaccacgctgacacaagccgtaaccaaggagcggccatattttgcagtaagcagaaagagcgagccaaggaggcccaggcattcgcaacagctttccggggccgcggtgcaaaccgtgggggggggctctttgtgcatttgtggccctcgaagggccccctgggtagggttttctcgccagagacgctggagaacaacttcag

SEQ ID NO: 511716 - DNA, 175 bp, Homo sapiens
  misc_feature (18)..(18): n is a, c, g, or t
  misc_feature (41)..(41): n is a, c, g, or t
  misc_feature (75)..(75): n is a, c, g, or t
  misc_feature (110)..(110): n is a, c, g, or t
  misc_feature (131)..(131): n is a, c, g, or t
  misc_feature (172)..(172): n is a, c, g, or t
taaaagttgggggtgttntgcccagtcccgtcattttgggntaaaaggcaggggcccttggcatgtggctggccnccccaagcaggaagcccaaactcccccaagttgantcatcctaactaacagtcacnccgtgggatgtttctgtccccattaaactaacagcattaangca

SEQ ID NO: 511717 - DNA, 1222 bp, Homo sapiens
  misc_feature (227)..(227): n is a, c, g, or t
gcgccattcttgtgagaagcaaggtgggcgccactgtattccctgagcgtcttcttcgcttagcctcgatcagccccttgaccacagacatgtctcgagatcagtgttccggagtcagatggcggtggcggtggtggcttccacagagcgtggaggaggctggcggtcagtggcgtgtcatccgacgtacttccgtttcatccagcctgacactcgcatggagtccntccgatgtcatagatcgcgagcctcgcattagggtcctgtggtcacgtgggcgagtagcaggtcgctgagcacttcacggatctgcggcactaactgcacatcgcaatagccgagaacgagccaagcctgggcgaggcgctaccctagcgcggccagctacgagcaccagacaggaagatgagctcgcccgagcgagatcaagatcgacgcgtgcagtctgtcgcacgagaccgtcgatccagactagctagtcgaggccgacggccatccgccgcaaggactctttccaaggcccgatcaatcgcctcagggaaccgcgggaccccgcatcccggacgtaaggcatgcggacaccacacagacgcatccagcgtcgagccccagactcgccacgtccagcaagccatcgagggggcccccgccagggtccgaggccaggcccgaactccgagcaccaggcgactgcagtcaccatcggaccctcccggggacgccgacagacaaaccctgcacaaggaagcgggggatccctaacagtacctccatcagagccggaaggccagacacgccgtcacgaccgcgggaggtccccgggacccgggtcccagggcctaagcagaggcgccgcaaggagtccggggtagggatcccaagacgggggggcaacaaatgccttgagggggggccagacaagccaaaggtgggcaggccccggggccataaaggaatacgcccagtttcgcaggagaccaaccgcagcaaaagccacgtccggcgatcgacaggcagggcaggggggaagacccccgtcggtgtggggccacgtaccaagacagcacaacaccaggaacactatgcacgaaacaaaggcaagaatttccacccagggggggccccccagcaaccccggggggagggacccagggacggggcacgacagtcgtagggaagacagcaatctccccggaacgccgcgaagggggcgtttacacgc

SEQ ID NO: 511718 - DNA, 271 bp, Homo sapiens
  misc_feature (5)..(5): n is a, c, g, or t
gttantgttcccactattatttgaaactctgttttaaatagctgcataatattccattgtaatgggcacagtgattcattgaacccaggggtccgcaacccctaggccacagaccggtactggtgggtggcctgttaggaaccaggctgcacagaaggaggtgagcagcaggcgagcgagcattactgtctgagctctgcctcctatcagatcactggcgggcattacattctcttttatttaaattacaaaaaaatttttttttgagaca

SEQ ID NO: 511719 - DNA, 377 bp, Homo sapiens
  misc_feature (274)..(274): n is a, c, g, or t
  misc_feature (276)..(276): n is a, c, g, or t
atggaccttcttctggccaaggggatcccaaagaaaccctgaaccggagtcctcagccatgacggggtagaggtcaggcccctccttctggcccgagaagagatcagagattggttcggagcagtccatggagaatttgctcagctggaccagtacacgcttctcctttcatgaatattcatgactcctcctgaagcttattgaacatctctatttggccatctccttcagcgtaaattcctgtcccctctgtccctcccctccaagtgtctgntntcagcttctggcctgaagctacgcttcctagcctgtcagaagggctccctgctggctgcaatctcttatgagaaataaagctctcctgtgtgcaaaaaagt

SEQ ID NO: 511720 - DNA, 147 bp, Homo sapiens
cgcttcaccacccccgctctctctttaaggaaaagtaagaagtagaagaaagaggcgaggaagaggaggcagctgaagaggaagaagctgccaaggaagagtctgaagaagcaaaagaagaagaagaagggggtgggtggagagcgg

SEQ ID NO: 511721 - DNA, 706 bp, Homo sapiens
ggcgggtaaacagacatggccggcgaaggagatcagcaggacgctgcctgctcaacatgtggcaatccatcctggccgtcctgcctgcagagagtgaggaagaagcatgacatggacgtagaagacgcaggatagtcaagaagccaagaaaagccagcacagtcatcaaattattgacagcagtctgctcgacatcacatacatacctaggtgctgatatggaagaatttcagtggcggaggacttggcacgatgtacgacagctgttcaggtgtattccagtgcttccagcaagtgatgatgatcctgattcccaggagacaagcacgattacctcattcagctattctcagcctcagagagaagtcgagtgatggtgcgggaatttgacttcgaggaaagatagtaacctttgctgtccttgtcatacagcagtgtacaggaaagggaagcacagcttggatacaacgagctagagatcatattgcctatcgagagagaacaggatattggaattgagcatagtgagtagtgagagccattggacagacgaaggttcagaagtccttgagctaagaacacagtcagatggaatccagcaagctaaagtgcaaattcttgcccagaatgtgtgtagccttcatagcatgtctagcagttcaattagaatccctgcaatagagtgccagatatttccttcaaaact

SEQ ID NO: 511722 - DNA, 246 bp, Homo sapiens
  misc_feature (140)..(140): n is a, c, g, or t
gggtcttgctgtgttgccaggctggagtgcagtgtcaccaacagctcactgtagccttgacctcctgggctcaagtggtcctcccaccttagccttctgagtagctaggaccaactacaggcgtgcactaccacacctgnctaattaaaacaaatttatttttgtagagacacgatcttgctgtgttgtccagactggccttgaactcctgcgcctcaggcaattcccttaccctgcccctcccaa

SEQ ID NO: 511723 - DNA, 359 bp, Homo sapiens
cttaagactgctttaaccattggggcttttttaaatatgaattttcaaattattttttctaattgccatgaaaaatgaccttggtgtttgggataggaattatactgaatatgtagggggcaattttaaccatattaatttaagcttttacaatccaagagcttaaaagggcttaccatttgcttttgtcatcactgactaaattggtgttctgttccatgcactaatgagaagaatgcatattctatggctgctgagaatattctgaaatttctaccaggtccatttgatctagagtccaatttaagtccagagtttctttgtagactttctgtcttgatgacccatttagtgctgtc

SEQ ID NO: 511724 - DNA, 479 bp, Homo sapiens
  misc_feature (7)..(7): n is a, c, g, or t
  misc_feature (51)..(51): n is a, c, g, or t
  misc_feature (208)..(208): n is a, c, g, or t
  misc_feature (467)..(467): n is a, c, g, or t
aagtaangccctatgaaatattccctttttgccccctgaacacagggttanaattggaaaacacgggcctataaagtatagtaattgtgtaattgtgaaaaatattaaggccttcaacctcaaaactgaaacacagtagggccttagaaatcctttgaattatttataccccctcagtttaaaaacttcccagtccccggcgcagtgnctcatgccctgtaatccccagaactttgggaaggccaaggcaggcggatcacctgaggtcaggagttcgagagcagccctggctgaacacggtgaaaccccgtctctactaagaatacaaaaattagccaggcatggtggtgggcacctgtaatcccagctacgggggaggctgaggcaggagaatcacttgaacccgggaggtggaggttgtagtgggccaagatcatgccactgcactccagcctgggtgacagganaattatctgtct

SEQ ID NO: 511725 - DNA, 915 bp, Homo sapiens
agcggggtccggcggtgccgtgctcaatagtgccgagccatagagcagatgaatggcctccaagctcggacctttgggatctggacgctgctctcatcagatgattcagaatgacatacgtgatgccattgacattcatcaacaagacgtatgtaatggaatcataataaaaataaaaaatcataggacaatatacataccttgaacaatggaggaaaataatacatcataatgaagatagataagatataatgagaaagatgaaagaaaataaaacaaagaaaatagagaagataccatggaaaaaaacaaatgaaatggaatgagacaaagatatatatacaaataacatggagataatgacatggatcagaggaattaagagatataatagaaaagaataaaaaaaatgattataaaaagaaaacagaaaaagataaaagaaaaaatgaagagacaaagaaaaatttaataaaaaataaaaaggaaaatatataatcagataaatataacataaaaatctgagaaacaatcaatacaatatccaatataagaatcagaataatacaatacaatcaatatataaaaatatataatattatataataatataaaaaattaaaataattgagaacaaatataaaaacttaaaaatatatataagaaaatcattaataaaaaaaaataaatatataaaaaaaatatataaaaagaaattaatagaaaaataaaatgaaaaaaagaataattataaaacatatcgataaaagttatacaaataatataaaaagaaaaataaaatttatttaaaaaagattgaaaataaattaaggataaaaaattacaaaataaaaaagaataaaaagaaaaatttgaacaagaaatatacatcaaagaaaggaaccaacatgaaga

SEQ ID NO: 511726 - DNA, 509 bp, Homo sapiens
  misc_feature (259)..(259): n is a, c, g, or t
  misc_feature (261)..(261): n is a, c, g, or t
  misc_feature (422)..(422): n is a, c, g, or t
  misc_feature (426)..(426): n is a, c, g, or t
  misc_feature (433)..(433): n is a, c, g, or t
  misc_feature (471)..(471): n is a, c, g, or t
  misc_feature (478)..(478): n is a, c, g, or t
  misc_feature (480)..(480): n is a, c, g, or t
  misc_feature (484)..(484): n is a, c, g, or t
  misc_feature (489)..(489): n is a, c, g, or t
  misc_feature (505)..(505): n is a, c, g, or t
taactgaatcttcccagtcttccagcactttcagtgacaatgagcacattagacatacgtcctgtgcttcctctcctggttctcaaaaaattccaactaatcttcccaatgtcccttttactccaagccttccttcacagacttcacgaacttgcttgccacacttggcttccttccttcgggcttccatgccttccttccagggacaatccatctgtctggatggcgactacttgctcacgagtagcacctccttccntntctcgctgcggaaacacaggcatgcggcccgcttcttgtagccgtcgccgtcgtaggtgcgggtctggttcgacttgagcttcatcatcctccgggcccagggtgggggtgcggtgcgggtcgcaggagtcgaggggtggggagcccgctctggacaggcncgtngcgcgcnccccggctcggccaagggaagcagggagggggagcttntccgctnancacntcacngctggcccgccgcggnccgc

SEQ ID NO: 511727 - DNA, 287 bp, Homo sapiens
cgatgttctacgacgaagcttattactcattgtcagatctgtaacctgtgtgaccttgttctcctaatattccgcgagtgctctagtgcagccctgtgtgaggtagtgattcgctgagatcatatgaaaattgcccagcgagttcttccagcttggtgggaggactcagctagtgaatgtgatacaataccagggaggcagtgcatggcttcctgtttctccctggttaaccaaaatgatgatgttacgattgacctcaactcatttaagagttacttctataatga

SEQ ID NO: 511728 - DNA, 750 bp, Homo sapiens
acactctcaatagaatgcataatgttggtttctacgagttacgactccataatgattgttattctgtagtaaaattgtacagaaggtaaatagaatagcttcaatgggaatataattgttaatttatgattagaattttataaaaatttatttccattgctttgaaagaaatgggtagcatgtgtctttcagagaagaggaggctattcggttatgcactttgtcgaatcttaggtctctatattaaatctttaaacaagtttcttcttgtggatgataagaataatataaatgtactgttgctgatcatgactgagtgcctattagttgtcatggcttttgtacgacaactgtgttgtaagaaataccggtttagcctctctggttgacatgtggtgagcatggatggtcaagattatgttgcaactagattattcgagtgttatattgtcttatacttaatagttatgaatacgtccaaatcagtctgtatagaaggtgccgcttgcttgacgtgtggaatatttgaggagcatgaaagagtcctttgttcttggttatcagggggaggctttcacgtgagagaaagtgtaccagaacagtcagaagtttataggttcactatgtccaagactaggactgggttaataaagattccttttgtgaaggaacataatgaaaatttgccataatggattactttagtatggtaactttagattctcttagctgggattttgaggttagaac

SEQ ID NO: 511729 - DNA, 368 bp, Homo sapiens
cgggagagattctcatccgggccatctccatacctggaggcatcatttttaaccgaccagaagtaaacaccgaggagaatcttgaacgcgggaggagagcagtgactcatcccacagaagcaatcctcaataagaacaacagcgtgacttctcaccagaaaccaagttagcaggatggcatggtggtgttggttaacaatgtggcatttgctaatatggtgcttgtctcctgaaactcttatagaatagagatcctgatcttgtctggtgggtgtgtacatttgtttgttggtatggtagagattctcatacaaaaagccacttacaaggaggttccttaggtccatctctcttctctgcagccttgc

SEQ ID NO: 511730 - DNA, 924 bp, Homo sapiens
taacaaactagatagaaacctttatttcacaactttatcatcattcacattctaaaaagacacggacggggggacacagctgaaaacagggggaggccagatgcgggcatcttccaaacgggagcatagccagtggtcactctagccgatgtctccgggggctctcaggcggcaaggaccagatgcaccactactgtccaatcccagttttacttagagccacctcctttttgggggccatatagtccttatttcatgccagattttcactagcggctcccgtgtgcttccaaatcagtccatgaccgtaagtaagcataccatattgccaaaaagagctcccccaagatgtgccgcatgatcaaaaaatttaccaatcccaaggatacattacctggctggtatccatgggcagataaggggctttacagggcattccctgctgtagaactgtcgaacatcggaaggaaaataatgggcaagcctcccttctggggatcttcagtggcacgacagctgcgaggactgtcatagatggccccagatgcaccaagggagggtccatatcttccggtggcaccttgacccaggataactgacaacaatgggaaataacacctgcacaataggcacacggccatgaacggctctgtgacccagaatgtcacctatgcctggaaggagaagctcccacaaaaacataccatattagctgccatgtgaaaacaaggacgaacggcacggaatgtgacagggcaacatgggcaaaacaaaagggaccatggaaggccggaatccatcgtgacaatccggcacatgtgccgctggaaaaaaggtaccctgcccaaagcgaaaccaggaacgtacgacgggaataaaccggccagccgcgggcaccaatagggaaagcccccggggaaaccc

SEQ ID NO: 511731 - DNA, 279 bp, Homo sapiens
  misc_feature (40)..(40): n is a, c, g, or t
  misc_feature (73)..(73): n is a, c, g, or t
  misc_feature (92)..(92): n is a, c, g, or t
  misc_feature (143)..(143): n is a, c, g, or t
tagtggtccccataagattataatggagcctgaaaaattnctatcgcctagtgatgtcatagcctagtgatgncatatgtattgcaatacantcctcacgtgtttgtggtgatactggtgtaaacaaatctattgcactgccngtcaagtaaaagtacagcaattatgtcctgtacataatatttaataatgacaataaatgactatgttactggtttatgtatttactatactatactttttacaatttgtattagttcttgcattgctatgaataaa

SEQ ID NO: 511732 - DNA, 297 bp, Homo sapiens
ggtctcattcctctgagatgatagccataatcagataaaagattagaaatcttctgcacgttaacagcatcattaaatggagtggcatcaccaagtttcaccgcttcttagccgtgtacctgtcccttgaaggcattcaatataagtgaccagatagtcatacggagagggagatggcatggggaattgatagatgatatcagggggtgatacgcttcacagggtgaaagtgcatatcctcgtggtctatactcgtataccacaagttacccgttttgaccgatatcgcactagcag

SEQ ID NO: 511733 - DNA, 342 bp, Homo sapiens
cttgtcatagtccaacgactggcctagacgggtcggctcgacgcgatacgcgacgcgcttgaccggcgagtacagagcgtcgacggcgatcaggccgatcggcgcgtcttccggacggttgcggtcggccgggacatagcccttgccgttgttgaccgtgaactccatgcgcaccgaagcgccgtcgtccagcgtgcagagcacgtggtcggggttcaggatttcgatgtcggcaggcgtctcaatctgacccgccgtcaccggcccggggcccgtggcgcgcagggtcatgcgcttggggccttcggcgtgcatgcgcatggccagttgcttgatgttcag

SEQ ID NO: 511734 - DNA, 392 bp, Homo sapiens
cgatcaacgcacacaggaagccgcattccggcgccgacaggaagcgcttgcggatgaccatctccaccagcctgtcgggcacccgctgcgcgccggcgaactgaaccatcgcctggcccggttcagggtatcaggatctgccggatggcgtggccactggccagcgcatcgagcgcgtcgttgatctcggccatcggccgcacgccggtagcagcttctccaccggcaggcgcccggcccgccacagcgcgatatagcgcggaatgtcgcgcgccggcaccgctgaacccatatagctgccaatcaccgtcttggcctcggccaccaggctcaccgccgggatggtgaacggatcggccggattgggcaggccaacggtgacgatgcggccg

SEQ ID NO: 511735 - DNA, 264 bp, Homo sapiens
ccggcggtgtgttgtgtgttatagtcccagctatctgggaggctgaggttggggaatcacctgagcccagaaggccaaggctgcagtgagctgtgattgagtcactcactgtactccaacctgggtgacagagtgagaccctgtctcaaaaaaaaagaaaaagaaaatactgggggcgagatgtcatgaaaactaattttattatacgttcagcaaaaacaaaactctccttgaccaagattccctctaatgggactagagtgg

SEQ ID NO: 511736 - DNA, 398 bp, Homo sapiens
caaacattcatttgtgagagggtcttgctttcccatgctggactcgaactcctggcttcacacaatcctcttgccttggctctcaaagtgctgggattgcaggcatgagtatacaatgttcataaagtctatagtagtgtacagtaatgtcctaggccttcacattcactctactcactcactgacccacccagagcaatcctgcaagctctattcatggaaagtgctctacacaggtgtaccattttcttatctcactgcatttttactgtaccttttctatgtttagatatgcaaataccattagtgttacagttgcctgtagtattaagtacagtaacatgctgtatagatttgtagcctaggagcaatagtctatgccatatagcctaggtgtg

SEQ ID NO: 511737 - DNA, 145 bp, Homo sapiens
agtaatggacagccaaggaggaggtgttccgcctaccccaagaggaggaggaggggccgggggcgggggatgagagttcctgtgggactggtggaggcacccaccgggcgcagtaaaaaaggccaaagccccttgagaggccggg

SEQ ID NO: 511738 - DNA, 714 bp, Homo sapiens
  misc_feature (644)..(644): n is a, c, g, or t
gtcaaatggtattcagttatagatccttgaggaatcgccacactgccttccacaatggttgaactcatttacactcccaccaacagtgtaaaaacattcctatttctccacatcctctccagcacctgttgtttcctgacttttagtgattgccattctaactggtgtgagatgatatctcattgtggttttgatttgcatttctgtgatgaccagtgatgatgaacattttttcatgtgtctattggctgcataaatgtcttcttttgagaagtgtctgttcatatcctttgcccactttttgatggggttatttgattttttcttgtaaatttgtgtaagttctttgtagattctggttattaaacctttgtcagatgcacagtttgcagatgttttctcccattctgtaggctgtttactctgttgacagttccgttttctgtgcaggagttctttagtttaattaaggcttatttggcaatttttggttttgttgcagttgcttttggagtcttcatcatgaagtctttgccagggctgatgctcaaaatggtatttcctaggttttcttctagtattttcatagttttaggttttacatttaagtctttaatccactttgagttgattttatatatggngaaagatgggggtcagggtcattcttctgctagggtatcagtgatgccacatggggttcgagccgaatcg

SEQ ID NO: 511739 - DNA, 278 bp, Homo sapiens
gctcggtccagaatagggcaacggtaaggaccagaacttgagtatgtcgtggggcaccatcaagttttcaaagctcttcggacttttgtgtgattcctaccttgccgggatttgtcacaggttttggagctattggatggaggggaggcttcagcatgcgagcctgaccgattgacatcatcatcagttttttcaacataggggttgtggaacagagtgaggcattttactaaagtggagaaagcagtctgctcctggagaaggcagcatatcccttt

SEQ ID NO: 511740 - DNA, 294 bp, Homo sapiens
cggtcatacaagcccgacattgctgaagttctggagccacggcgaggacgagatcatctgacgtcgaggttcgagatcattctggcccctatggtgaacccctgtctccactaacaatcgaacgcttacctgggtgtggtgtgtcgtgctttttattgcagctactttggcggcttatgtgcgagaatgacttcaaccccgaaggcagatgttcctaggtcagccgtgatcgcaccatctgtactcctgcctgtcgtatcccgcatgcgaggcagaagctgtgtcggccgctgt

SEQ ID NO: 511741 - DNA, 251 bp, Homo sapiens
gccgaacacagtatgccatgaccgactcagacaattacacccatagccaaccccgttaaacacccctccccacagtcaagcccgaagtgatatttcctattactctccccgtcaaccgaacacagtatggcgtgaccgagctcagacaattacatcctagccaaccccttaaatacccctccgcacatgaagcccgaatgatatttcctattcgcctattttagaccagcccctgttcggttgagcgggga

SEQ ID NO: 511742 - DNA, 325 bp, Homo sapiens
ataccttccctgttttagaattgttatcgcaaatcgtcatcgatggacaatcgtgtgtgatatatggttatactatacccatactgacctctcaattgaggcctttaaatgtcttctgtgcattatgcacttaaacttggaagggcttgggggccttgaaggcagggaagcctttgtcctctgcccaggtgatgggagccacctcctctgccgcaggactgatagctccttcagctttcatggctttcttctttaccttcatgggtcagttggtcatcaggatcctccaggccgtgggcgtcccaggctggggcgtctgctgctg

SEQ ID NO: 511743 - DNA, 99 bp, Homo sapiens
cacgagaactactgggatccctaaaaacgcccctggtccggccctactttgtgcccttcgatctcttaggctttttctgtaggcataccgtgtacccaa

SEQ ID NO: 511744 - DNA, 268 bp, Homo sapiens
gcccccccaggtaaaaaggctgccccgaaaacagtttacagggcccccggggttcccactgttttaaattggtcaggggccctgaaaaaaaacttgtggttccccgaaaaaaaaaattttaacctcgaaaaactttaatattatgggaaaaaaaccttgcccaatattaaattaattaaaaaagggaagggaacttttgaccctatggtcccagccaaagcccggtttagccaacataatggtagtcctagatttctttttggtttta

SEQ ID NO: 511745 - DNA, 333 bp, Homo sapiens
  misc_feature (40)..(40): n is a, c, g, or t
  misc_feature (277)..(277): n is a, c, g, or t
cgcccgaaagtttttgtttcccaggaagcaaaatggcctnaaaaaggaaggttgtgatggttgcccaccaatgtgaatttaatgcccctgaagggggcccttaaaagtccttaaaaaggtaaattttggatgggttttcccattttaaaaaaggaaaaaaagtaaggcccaaagcaacccctttccaaaaagggggttaaaaaccaaatttttagggatgggagaatgctggctaaattttacttatcaatttgaaaataaattgtttttatgttgnccccccaaaaaagcccttattttgaaaaaaaccttttccttttttaaaggttggga

SEQ ID NO: 511746 - DNA, 102 bp, Homo sapiens
  misc_feature (35)..(35): n is a, c, g, or t
tggaaagcgactccaggtggagtctgatgagtctngatttgttggccaattaagaaaggaagggctggctgggcgcagtggctcatgcctgtaatcccagca

SEQ ID NO: 511747 - DNA, 573 bp, Homo sapiens
gtcatcgagtcggcaccatggtgctgcgtacagtgaataaggtggagtatgccctggaaaatccaaaacgtgacaattggttggaccttttaacagctgaagagtgttgtcactagctttttcctgtggtgaaaatacagagctggctgtcttccatgatgaaacagaaatacaaaaccaaactgacttactgagtcttagtggaaaaacactttgtgtgactgcaggatcggctccctctctgatcaacagttctagtactcttctttgtcagtatatcaacctacagctcctgaatgcaaagccacaagagtgtttaatggggacagtgggcactctcctgcttgaaaacccacttgggcagaatggactcacccaccaaggtcttctgtatgaagcagccaaggtgtttggccttcggagcaggaagctaaagctgtttctgaatgagacccaaacgcaggaaattacagaagacatccccgtgaagactttgaatatgaagactgtgtatgtttctgtgttaccaacaacagcagacttctagcatgtactttatcaatgttgttcggt

SEQ ID NO: 511748 - DNA, 256 bp, Homo sapiens
ggctgatgtgtggcagtcaataccaagactgggggcggggtttatttgttgggctgcagaatgaggagatgagagggaactgcaaatccgtcctcctgaggagtttggagctagggttatttaaggattttggagtgggctggaatgtggagattgttgggtggtcagagagagaaaggtgaagtaatgggacccggagatgaaaaaactgtattatgctgattttatttctctctgagggtcttcaaactggttg

SEQ ID NO: 511749 - DNA, 633 bp, Homo sapiens
  misc_feature (497)..(497): n is a, c, g, or t
  misc_feature (522)..(522): n is a, c, g, or t
cacgagcagaaatggaaagtggaggttcctgtgtccattatttcaaactgaagttgctcctttatttagaaaacaaagcaacatgccagacaagtacataaacatttcatgtaattatattaagataggcttggaaagtgctgatggagactttaaaaacacctggttcaaaagcatgtatttatcttctctgaaattaactggtgttttatgtcatttacagtctagtgtgcacacttcttatttagcaaaaaataccacttcattttcattttttccttgttgtagatgtggcacatattactactggaaacttcgatgcccagtatttttttctctattctttttattaaagaatggggtatctttttaaaactctctttgcacactggcatgaacagggaacacagtattggtggagatggggttgggggaggtttagagggaggaattgcattcttttggcattcctgagaggaaaacagctgtattaactnttttttttttttttggaaaaggcanaaggcatttcccctgactctcttccagttctttacaagtgagcacaaacagcatggcatattaattatgcctggagtcagcatggatgtgtgctggcctgatattagccgg

SEQ ID NO: 511750 - DNA, 866 bp, Homo sapiens
tcacaaatcaagggccctccactgaggcatattttcttaggagccctggaaacttgacggagagagaagagctggcagggagccttggcccggcctatgtgcaggtggagacgagtaagcgggcagccctaagttggcagcgcgtcctggccagcatcgtgtggcctctagagtgttcaagcttcaggaggcctgcttccgcactatggccccatctaggactgcaggatcacacttgaagacgctgcctcgtgccgcatccgcgcgcgtcgctcatgcacacgttgtccctgcaggtccaccccccacgtgcactgttgcagctctccaggagacaggtgttctcagagctcgtttcccgcccagccgctgcaacgctgggtcatcggatcggtgcctgtgtgtgcctgagcgcagccattgcctcttaacggggttcggcaggactggggaccctgctttcctctacttgctgtcagctcctcgagaagccccagccacaggacctagccttcagcacccccacagaagatggaacgggtaatttggacgcttgtttcccccattcagtttggggactaaccacccaggcccccagccagctgcatccagcctgcccagtccactcccagcgccagctggtcctgtccttactgcaccttcactcaatgccccagaccggccttggctgtgagatgtgtagcacccagaggccctgcacttgggacccccttgactgcagcttccacctagcagccactagaggtaaaaggggagagtggccgttccctcactagtccgacatctcaggccccccctgaactgccggggacctctacgactacgtctgggcgtcaccacgtggg

SEQ ID NO: 511751 - DNA, 908 bp, Homo sapiens
gcttgaaaaagagtgtgcgcgttatgacaactgtttcgcgcgagtgaactgggacacacgcgctgggggtgtgttgacgcaggtggcgcctttgaaagcgcggagtgacccccgttctaaaagacccgtgcgtgaacgccctgtgagggccccgccaatcggtttctggtgcttatagcgcccgttttaaaaatgttgctggtacaaatgtggttgtgacgccccccggtgtgttcgcgcgccccgaccacctggtaaaaaggtgggggtgaccacagtcaccattgggcccaattgcagctgggtaatataatattacaagcgacatgtgggttcaaaaggaaggatttttttgcccccggggctatcaagatagctataaactgagggtttgcccacagttggaaatatccccgttgtagcaggtacccaattggtgaaatacaaagatattcttagtggttcgcaggggtcccccaagataatattgttcggtccccgcatcggcccccacagtttgtgactctaatatcctgctgctggctcagcccccatcccccattagtagatgtacatgatgtctgtggtacttgcccctgttacctagttatgtgctctcaataatgccaccaacggcggtcacggagctggaacggtcaacaattttgggtaccacgagggttaaattttctcggaacacacggggtccccgctgtatgtatatactatagtatctctcgtgttggtgtcaatacgtgactggccaacaaccacctccactcacggttataactatggtgttgttgcaccctccacgacacgggtgtgttgttgggggggggaaaaaaatccaccgggggcttttttttaaaaaaaaacccaaccaaagaaaaacgccccaaaaaaca

SEQ ID NO: 511752 - DNA, 856 bp, Homo sapiens
  misc_feature (179)..(179): n is a, c, g, or t
  misc_feature (217)..(218): n is a, c, g, or t
  misc_feature (232)..(234): n is a, c, g, or t
  misc_feature (252)..(253): n is a, c, g, or t
  misc_feature (259)..(259): n is a, c, g, or t
  misc_feature (281)..(282): n is a, c, g, or t
  misc_feature (305)..(305): n is a, c, g, or t
  misc_feature (307)..(307): n is a, c, g, or t
  misc_feature (316)..(316): n is a, c, g, or t
  misc_feature (328)..(328): n is a, c, g, or t
  misc_feature (362)..(362): n is a, c, g, or t
gggcatgcacatgcttggagtcagtattcagctgtaagtgtagtatgttttatggctgaaatagaaagctaatgaagaggcctacctggatccagattttatgttaacatggcagcaaaactaggaaaatgggaagaaattacttgcggggtgttctagatctgatttttttttttttnggaaagttccagccggtgggaggaaaagaggtatcttnnaaaatagagatagnnnacttatttccctcatctnnggcggngtcactatggggtgcaaggatnntcatggtgggctagatccatttngntataatcangtatcctctggngtgcgggtagagatttaaccctgattttcccatnaaactatgagtattaagaaataatcccgggtggggagaaccgggagaaatcacccttttagggaagaacccgcggaattttctggctaacaccaagatttttaagagtgtacatagtaggttgctcaccaatttctgatgactggtgatgcaaaacctgcggagtcaaacgtgagcaagaagctccccatttctacttcctgtcacaaccccattagttgtaatagggtccttctccattgactcagggcagagttgttaaagctggggagggattcctttgcaggcccgtcagttttcttccggggtggcacctcggccggcgatgtgcccgctgttgttggcccacacggttctttaggtttcggaacatgtgtcggctaattaccggcgggggaggcgccctgttctctgggaactcttggggagacgggggggggctcctctggggaaccattttgaaagcgccccgggtgttgtgagtgtctacttgcc

SEQ ID NO: 511753 - DNA, 185 bp, Homo sapiens
  misc_feature (157)..(157): n is a, c, g, or t
gaagccaagaccaaaaaaaaaaaaaaaaatggacataggacttgaatagacattccaaagagtggcaggtgccaacaagcacatgaaaagatgatcagcatcatgaatcgttagagaagtgcaaattgaaactgcagtgagataccacttcatggcnagtaggacagccatttcctaaaaaaaaa

SEQ ID NO: 511754 - DNA, 329 bp, Homo sapiens
  misc_feature (104)..(104): n is a, c, g, or t
  misc_feature (122)..(124): n is a, c, g, or t
  misc_feature (131)..(131): n is a, c, g, or t
ctaccagattccagagtcattaaaaagtatcacatggcagagattgggaaaaggcaattcaggacagttcttagatgctgcaaaggctctccaggatggcctcngtagtaaagaggttatgnnnggatggncatgcaggaggatgtttttttcagacccaaaagaagggttaaaagatgttgatactcggaaaatcataaaagcaatgctttcttatgtgtggtccacagacaggccagatctacgagctagagttgccatttcgctgggatttttggggggagcaaggccatgaatattgtgggttctttaatgtttaaatttgttgt

SEQ ID NO: 511755 - DNA, 307 bp, Homo sapiens
caagcagatcacctgaggtcaggagttcgagaccagcccggacaacatggcgaataccccatctctactaaaaatacaaaaattagccagctgtggtggtgtatgcctgttatcacagctactcgagaggctgaggcaggacaattgcttgaacccgggaggtggacagtgcagtgaactgaaattgcgccattgcactccagcctgggctacaaagagtgaaactccatttcaaaaaacaacgaaaaaacaattaaggtgggtagaaaaataattggtatatacgctatagaaagggagtaaaagg

SEQ ID NO: 511756 - DNA, 796 bp, Homo sapiens
  misc_feature (179)..(179): n is a, c, g, or t
  misc_feature (217)..(218): n is a, c, g, or t
  misc_feature (232)..(234): n is a, c, g, or t
  misc_feature (252)..(253): n is a, c, g, or t
  misc_feature (259)..(259): n is a, c, g, or t
  misc_feature (281)..(282): n is a, c, g, or t
  misc_feature (305)..(305): n is a, c, g, or t
  misc_feature (307)..(307): n is a, c, g, or t
  misc_feature (316)..(316): n is a, c, g, or t
  misc_feature (328)..(328): n is a, c, g, or t
  misc_feature (362)..(362): n is a, c, g, or t
gggcatgcacatgcttggagtcagtattcagctgtaagtgtagtatgttttatggctgaaatagaaagctaatgaagaggcctacctggatccagattttatgttaacatggcagcaaaactaggaaaatgggaagaaattacttgcggggtgttctagatctgatttttttttttttnggaaagttccagccggtgggaggaaaagaggtatcttnnaaaatagagatagnnnacttatttccctcatctnnggcggngtcactatggggtgcaaggatnntcatggtgggctagatccatttngntataatcangtatcctctggngtgcgggtagagatttaaccctgattttcccatnaaacctactggatgtcatttacggaaaataatcccctgggtttgggagacagaaacactggggaagaatatcacctcttttaagcggaaaagaacacctctggggaaattctctggcataaacaccaagggattatttaccaagatgtggtcacatcaggtaagtgtgcgctccaaacaaaatattttacctgcgagacactgcgaatatgcgaatggtgcgatgtcgggcgaaacaaaccttgggggggcaagagtcgtccacaaaatagtgtggcaggctaagaaaaggcctccctccccaattttcactcaacgtctcctggggtgccaacaaagtaaccccaacattttttcaaattttcgggtgaatataacaggggggcccctttcctccccaaactttttgggaacttttccaaggcggcaaagaag

SEQ ID NO: 511757 - DNA, 187 bp, Homo sapiens
aagaggggggagtgatgctgaggtgatctagaggatcccggctacatgtgctggagtaggtggattaggcgataggatttctaggcctacgttttcatacttctagtaagcctctaccaactacgtaccaataaaaaaaaaggtgggtttttttttttttttttttttttttttttttttttttttt

SEQ ID NO: 511758 - DNA, 694 bp, Homo sapiens
cacgaagacttatgactgacagccaggacattccttcctgtcctgttcaagtagtgatctttctgattgcatcaggcagtgtagacctctctaaatccgttcatgaaactcctccctgtgaattatacacatactcatcaactctactattagatcatcctcagtttcttgaatgggcttgccacccgtgtaggccccttacatgttgtctactcccaaatgatcgtacatatgctaaatatggcattgagtgtggaaagtgccggctgaagcacatctgtttctacaatacatggtcatagctataagaaaaaacatgggggcaaatcccaaataaggaaaaacccagtatggtgtggtatcagagggtcttgtctagatgagtctactgggaatatattatgtagagtagataggttattgtaaatggtcttgttctcagaggagatcaggttctttaattgtttcattccttgaaggggacaatgtcaaagctgttgagcccaaaatcaccccctttgactcatttagctcacatggaacaattttccctaaagaatgcagaaaggaattctaccaagcaattaattaatcctcttttgccaactgcagcagtagcacatgagctgggcattcctgtagctataacaaaatcagcttttgcctcggtttgacctatgtccagatatgcagc

SEQ ID NO: 511759 - DNA, 293 bp, Homo sapiens
  misc_feature (19)..(20): n is a, c, g, or t
  misc_feature (46)..(47): n is a, c, g, or t
  misc_feature (75)..(75): n is a, c, g, or t
  misc_feature (113)..(115): n is a, c, g, or t
  misc_feature (132)..(133): n is a, c, g, or t
  misc_feature (136)..(136): n is a, c, g, or t
  misc_feature (140)..(140): n is a, c, g, or t
  misc_feature (157)..(157): n is a, c, g, or t
  misc_feature (181)..(181): n is a, c, g, or t
  misc_feature (204)..(204): n is a, c, g, or t
  misc_feature (212)..(214): n is a, c, g, or t
  misc_feature (267)..(267): n is a, c, g, or t
  misc_feature (291)..(291): n is a, c, g, or t
gtaaaaatggaccacagtnncttatttgtagttgttagttgccctnntacctagtttgttagtgcatttgagcanacattttaattttcctctaattaaaatgtgcagtattnnnagtgtcaaatatatttnnctntttngagaatgatttccaccnttatgttttaatatcctaggcatntgctgtaataatattttagaaantgtttggnnntttaagaaataacttgtgttactaatttgtataacccatatctgtgcaatggnatataaatatcacaagttgtttanct

SEQ ID NO: 511760 - DNA, 454 bp, Homo sapiens
aatccaatcagtgccccgagcacgggctgttggaatgcaaactttacaaactggcaatatgagtttctgtaccttttggataacgaaacagtcaatagcaagttggcgcatggggatcggccaggtcgcttataggacggctagtgtgataggaacggaagccattacgacaagaagggtgtctgctgtgacggaaaaaggcttggcgaggctgaaagaagactgaaggtggttctctagtattatctggtagaagacaatacctgtcccactgggcatggaatgaattcgtggaacgttagcttaagacaggccccatttcagaaggttctgctgtccctgggaaagaacaacgaatgcgagaaacatcctggcttcactgcctggggcctgggaatccttgcccatgctaatcacagcaatagctgatgcttacagagtgctgtatactctt

SEQ ID NO: 511761 - DNA, 107 bp, Homo sapiens
  misc_feature (107)..(107): n is a, c, g, or t
gtcagaagtagagcagaagaaggaagcggaccttccgcaagttcactacgcggcgtggactcggaccagctgctggacaagtccttacggagcagctgatgcagctn

SEQ ID NO: 511762 - DNA, 951 bp, Homo sapiens
agcggggttcgcgggtgggtgggcctgggggcgcggccgggtgtgtggcggtggctgctgggacggcggtcgcgtacggcgtcaggctcggggtcggtaagggcgtgcggaatagctgcatcctgcgggagactctgtgtaggacatcgtgtccggtacgaggccccactggctgtgtgtcttgtgcgtgcctggctgatgtgacggtgtgggggcaagtgctggtgtgttcctgtggagctgtgttggggctggtctgtggggctgggtggacgcctgcttgcgtcccaagacagctctgtgggctctccagcatccatttgatcgccacagcgccggtagaccctgctgtgtcaagggagtaacattccgatggtttcctggcccagtgtaatgtcgattcgaaacaacgcgcaaagtcgcgacgagaagaatacctgcagatgtgttgggttgctgagccccttgctagtaatcggaacaagagacgaaggactccaagcagtaaagatagtagcgccttttggcttttaactcccggacggcgtttggagacctatcaacgtttaatgaaaagctcaaacagtggaaagataccagcagacgccgggcgcttcgcgtatggcgtaggcgttccaaagcgagtacggccccatgattccactcgtggcctttaaatttccgtaggcattacacattgagccgcgagcattattccagttccgaaggcaccatcggccccaggtgggacccaagtgcacgtcgccttgtagtcttggtcctgcggcaataagactccagacataaccaatagacagccccagacattgtgaaaccaaatcaccaacttttagacgcccttcaacctggccacaagacaaacatcatcaccgccagcattatgattccgccatctgcctttaaacaacattacgcggtgtacacaacagc

SEQ ID NO: 511763 - DNA, 452 bp, Homo sapiens
  misc_feature (415)..(415): n is a, c, g, or t
gcgtgtattcgacggcagtgtaaacgacggccagtgtaaaacgacggccagtgtaaaacgacggccagtgtaaaacgacggccagtgtaaaacgacggccagtgtaaaacgacggccagtgtaaaacgacggccagtgtaaaacgacggccagtgtaaaacgacggccagtgtaaaacgacggccagtgtaaaacgacggccagtgtaaaacgacggccagtgtaaaacgacggccagtgtaaaacgacggccagtgtaaaacgacggccagtgtaaaacgacggccagtgtaaaacgacggccagtgtaaaacgacggccagtgtaaaacgacggccagtgtaaaacgacggccagtgtaaaacgacggccagtgtaaacacgacggccagtgtaaaccgacggccagtgtaanacgagggccagtgataaaacgaggcgcagtttaaaac

SEQ ID NO: 511764 - DNA, 497 bp, Homo sapiens
  misc_feature (465)..(465): n is a, c, g, or t
cggatctccagaggacagacaggggaagggggtctctgggatactgtctcttcccaaagggccaggcaaaagtaggttctggtttaatttatcatatttaactcatctggctctggggccttgagggagggcaggggtggagggggagatccgatccaggtgtggactgacagctggccagccagtgcagaggctagaggaactcactgacctgaggactggggggctggagcagctgcatcatgggccttgtatttcaggccagagtaagaattttgggctcggggactcttagccggtggatgtacatggccgggtctgtgctgggctctgcagtggccaccagggcgggtgcacgcagaaggcctggcccccacccttccagtgcaaagtcttggggagaaacagcatccacgggtgaagaacaagatagcaacacaagagaagcctccttggtggctctgngctccttggttgctctgggggtaccgagctcg

SEQ ID NO: 511765 - DNA, 184 bp, Homo sapiens
gctggggccttgggcacagaacttcttcgcgcgccaattcctgcttccccacgaaggagaacccgtgaagagaaggttttggcggccgaagacacccagtaaagcagcagggctctggcagccaggggcagccctaccctgcgttgcgctatggggcatcctttgtggcagcacgggtaccgag

SEQ ID NO: 511766 - DNA, 497 bp, Homo sapiens
tcttaagccagcgcaccggacaaacgcccggggtccggggcccggggcaaaagcgcccagcccggcccctcccaggcggcggcggcggcggcggcggcttcccagtcaccctggagggaaaacgcgccgaggggagacgcgcggagggctcgcccgggaccgggctgcaggccgcgcccccaccgccttctccgcggttcctcacccgccgcacatccacgcaggttcaaccccagcgcggggcgaacgcgcgtcccggccccaggcttcccacccgctgaagccaatgggtcgcacggctccggcgccacgtcctcgggggcgaggccctcagggaagggaccctgctctaagtccctccgaacagtggactgggtgcagggggagtccgagcccccccgatcctcggctggcccgcctcctggctgccagtttgtggggtcccggcgtcccgatccgcggcctctgtttagacggaaggcgccaggacgcagaga

SEQ ID NO: 511767 - DNA, 106 bp, Homo sapiens
gagtgggtagggaggagtgctgtggatcatgcatgtattcccagaattttggaaggctgaggagtgtggatcacaaggtcgggagtccaggacgcagcttgaccaa

SEQ ID NO: 511768 - DNA, 383 bp, Homo sapiens
ccgttttttgatttgacttttttcgccggccggtttcaggccgcacaaaggttccaaaggaggagggggacatttttactccctttttgggggtacccatttaagcttttgtacatcacccgggggcggccggagggggcaggggggcgggggcgaggggcgttcccatcaaatttttaactttttgttaattattaatcccccttttacggcgggttcgggggtcatttttaaaatttttttaatttttttttttttttacttttactttttccctcttggggaaatgtagggaatttatagggaaatatgtcctttatggaataaattttaagaactaaaaaatatttttttttaaaaaaagtaagggccctttaatttta

SEQ ID NO: 511769 - DNA, 510 bp, Homo sapiens
  misc_feature (373)..(373): n is a, c, g, or t
  misc_feature (437)..(437): n is a, c, g, or t
ggagacgggggtttggtcggtggaccaggcgggtctagaactcttgagctcaaacagtcctccgggctcagcctcccgaagtgctggggataacaggcatgagccaccatgcctagcctaaacatcttcttttataatgggaccggttcagtccttggctcattttttaatatgggggtggggagtcttttccataaattggtagtagtgcttgggggtttcgggtccttcacaagatacagatatcctataggcaaacgggataggcagattatcttctcctagtcggtgcttggccttttcactctcctaaatggtgggtatacggtttttttcttttaaagacaaggtctcactcggtcacccaggcggnagggcaggggggcaatcatgactcacggcagcctcaatctccccagctcaagcgattctccggnttaagtctccggagtagctgggactacgggaatgtgccaccatgcctacctatttattgattcatgtattcat

SEQ ID NO: 511770 - DNA, 330 bp, Homo sapiens
  misc_feature (32)..(32): n is a, c, g, or t
  misc_feature (165)..(165): n is a, c, g, or t
  misc_feature (219)..(219): n is a, c, g, or t
  misc_feature (249)..(249): n is a, c, g, or t
  misc_feature (312)..(312): n is a, c, g, or t
  misc_feature (326)..(326): n is a, c, g, or t
ggcttgttagtcacgtgtcttaaccaacactnctacatacacgcaccacaacctggtctctcactcatttttgttttaattttaatttttggtagagacggggtcttgctatgttacccagactggtctcaaactcctgggtctcgagcgatcctcccgcctcancctccagaaaggtgctcgtattacagggcactattacagggcatgagccacccncacccagccttttcactcgttttttcacanttacaaccaggaatacagaggctaatcagggggcctctgtgttttgccctaggctttgggagnagggcaaaggattnttat

SEQ ID NO: 511771 - DNA, 180 bp, Homo sapiens
gtgagtctagaggatccctcacacgccgagcctccagacgtccgagaaatccgaatggacgaagttgttgcgcaacaacttcgtccattctgatttgcggcggtatgggtattcggcgtgtgcagcaacaacttcgtccaccccgatctgaagaagtatggagattcggcgtgtgcagga

SEQ ID NO: 511772 - DNA, 234 bp, Homo sapiens
cttttaatttctatgaataaaagaaatttttaaaacctttaaaattttaaatattagtcaaaatcctttttaagtcctgagggcttccaggtagttgttaaaaaaattttaaggccaggcatgggggctcgctcccccctataatcctaggatcttgggaggtcgaggcaagctgatcgcttgagcccaggggtttaagaccggcctgagtagcatagcaaaacccctgtttta

SEQ ID NO: 511773 - DNA, 192 bp, Homo sapiens
aaaaaaaaaaaaaaaaaaaaaaaaaaaaaaaaaaaaaaaaaaaaaaaaaaaaaaaaaaaaaaaaaaaaaaaaaaaaaaaaaacttaatggatcccgtgaacttgaatgatgatgatgatgccaaccgggaaattccggacgggtcccggcaggcgtccaagtttcccttaaagggggtcgatttaaagttgg

SEQ ID NO: 511774 - DNA, 239 bp, Homo sapiens
ttccctcaaaggcatttgcatctttaaataattttttaaaagcctttaaagtgatcaggcccttgaggccaactaaggaaatttgttaagcattgaatttctgaaggctctatgaaaggaaaagcatgatgggctgttaaaatcaaatgttacggctaaaatttacatgttgtgatgtaaattgggtagaaacccattaaatcattcaaaaaaataaactatttttattagagaatgta

SEQ ID NO: 511775 - DNA, 186 bp, Homo sapiens
tccaccaggcagtcgcatctcccaggctggcctgggtgctggcagccaggtcctcttggacctctcgccagcggtgctgccgagccggctccaggctcgcttgttctgggctgctgtccttcttgtgttttctcttgcaatcctcccagcagtggtccaccgcctgttgtccaagtcctcccccac

SEQ ID NO: 511776 - DNA, 588 bp, Homo sapiens
  misc_feature (264)..(264): n is a, c, g, or t
  misc_feature (304)..(304): n is a, c, g, or t
caagtccaaaggtcattcgtggctggccccaccccttggcccaagaagcccagtttagccccacaggaaggagctgaacaagggtggtccaccatccccaaccgcttgtacacagggcccggtggttcccggcccggccgcttcggggctcagggtcccaaaggagggtttggggccggcccccccccttaggaggggatataagggccctttttctttaaaatgtttgtcctttaggggggccgttgggaccccaaaaccttnccgccgttttcccaaggccattttgcctcaaccctttggnggttcccttctttggaaaaataaggtggaacccgaggggaaataaccggcctcctttttttgttgggcccccccaaatggtccttaaaattccttgcctttaaaggtgaaaccggaagggggtttcggtcccctttaaaaaaacccccccccccccccccgggcgaggggggggggtttttttttttttttttttttgcctggcgaaaacccccccaaggccgggaaaggatgtttttaaaatttgtttttttaaaaatgaaaaaaaaaatgtttaccctttta

SEQ ID NO: 511777 - DNA, 1084 bp, Homo sapiens
  misc_feature (242)..(242): n is a, c, g, or t
  misc_feature (288)..(288): n is a, c, g, or t
agcggggggggggacccgcgcacctgcagggcccgctgctcccgccctgtcgtcctgcctgggcatcctgcgcccgggcatgacggcgcgctcattcgccctccgcggtcgtcatatctgcagccatcgttcttggaggacctcgttcgagcaatctgcgggcccgtggtctctgggccagaagaggggcccagaccgcgggaagttgactcattcaaccatatgactagggatctgaccanactgaccgatcctgctggctaaatccatcataactgcgctcaatcngggcagtccctgagtcggcaagaacgttggatagcctcctcgctgttgtgccgcgggcccccatgcttggagcgggaatgtacgagcccagtgcttggattagcgatggctgtcgtcttcgcctggtgagcgaatgttgaacccggcgctgtgagccgcggaactcccaggtggtgaccctagggctgctactggtacagttgaacatgctgagctgccctacctcgttgccccgtggaatccagagcacccaactttcggtctccggcatccctactctccctcgactaccgagaacatagtgttcgtggcgttccagcaccacgcaatcacgcatcccatgacatgcggcagctcgcaagtaggaacccggggcaccctgcgaagtggttcgctagccctgggattcccctggtgaaagtcattttcgccaagggggcattttacgcccgaagggcccacgtctccccggggcctcgcgttggggggagacgcccgcatcggggggccacgacgtcgaatgctgtggccgcaaggacgggggtggactgagtccccgtagtcgtactccaaagtgaaccccctggcggaacgtggccttgcctccgtggagagtttatagcccccttccttttgttccacccaccatggtgatgcaattggcctttgactatggggggaaaggcgtagggataatcccgggggtgggggagagggcacctccggacccctttttgtaccatgcgaacgggggcgccttgggaaatgcccaagtgggagcgtgctatcgttcgcg

SEQ ID NO: 511778 - DNA, 536 bp, Homo sapiens
aacctccgtagtgttttccataatggcaccactaatttacattcccaccagccgtgtgctaggatttctacatttccacatccttatcaccacttacctttgtgttttgatagtagccattccaacaggtgccagctgtcatcttactgtggctttgatttgcatttccctgatgattagtgacactgaacattttttcatatctctgttggccatttgtatatctccttttgagaaatgtctattcggggctggctgcaggggctcatgcctgtaattgtagtgctttgagagtccaggaaggaggatcgtttgagcccaggagttcaagaccagcctgggcaacaaagcaagatcctgtctctacaacaatttttattttttaaaaccaactagctgggtgtggtggcacgtacctgttgtcccagctacttgagaggctgaggtgggaggattgcttgagactgggaggctgctgtgagccttgattgtaccaccgcatccaccctgagtgacagagtgaagaccttgtctcc

SEQ ID NO: 511779 - DNA, 790 bp, Homo sapiens
cgacagcgacgccgcgagtccgagagaggagccgcgggcgccgtggatagagcaggaggggccgggagtattgggaccgggagacagcagatctccaagaccaacacacagacttaccgagagagcctgcggaacctggcgcggctactacaaccaggagctgaggccgggtctcacaccctccagaggatgtacggctgcagacgtggggccggacgggcgcctcctccgcgggcatgaccagtccgcctacgacaggcaaggattacatcgccctgaacgaggacctgagactcctgggaccgcggtcggacacggcggctcagatcacccagcgcaagtgggaggcggcccgtgaggcggagcagctgagagcctacctggagggcctgtgcgtggagtggctccagcagatacctggagaacgggaaggagactgctgcatgcgcgcggacccccataagacacatgtgaaccatcaacccatctgtgatcatgatgtcacctctgaggtgctgggccctgggtttctacctgcggatatcacactgattctggcagcggggatgggggaggaccacaactcaggactagcgtagcttgtggaagaccatgaccagccatggagattagaacccttccagaagtgggcagctgtggtggtgcctttctggagaaggagcagcacaaatacaaattgcccatgtacaggcattgatgggggcttggcggaagcgccatcacccctgagattggggaagcccatctttcccaggtgcacaattcccaa

SEQ ID NO: 511780 - DNA, 220 bp, Homo sapiens
gagaactcatacaagaattttccagataaatgagatttaatgctcggtgttcctcctcgttcttcgtcctggttaatctgggaagtaacgtaattcgtaactctctttgctgttagcaattacgcgcaatcagtcaggtagattattcttcttcaaatattttcgggtgagatatttcagatacctttgggagaagggcaccccgggtgtagaaatagaa

SEQ ID NO: 511781 - DNA, 148 bp, Homo sapiens
atccgtgattgttcatttactatagttgccccattgtgctgccaagacactagatctgtactccgttctatgtcactgtatagtatacccacgagccatcccctttctactcccctttccactacccttgccagcctctgctaaccac

SEQ ID NO: 511782 - DNA, 211 bp, Homo sapiens
tcaagaaatgcaacagagctcagaaaaaaggtacatcagcagtggtcattcgacaacgaaagtcatacccgtagaaaaagatggcggtgtttcttttatttttgaagataatgcaggagtcatagtgaacaataaaggcgagatgaaaggttctgccattacaggaccagtagcaaaggagtgtgcagacttgtggccccggattgcatcc

SEQ ID NO: 511783 - DNA, 162 bp, Homo sapiens
ccactctgtgccctgcgtttcgcctccaggccgggcgggagcagtgcctagcccaggtgtcctcgacgcgagcagctgggcgccgctgcggagggagggaagcgccgcgccggtcccgggcccagcgctgcgcccagtcctgaggcgccctcctgcggccgc

SEQ ID NO: 511784 - DNA, 160 bp, Homo sapiens
cggccacatatattagggaaggaagaggggctacaggcttttttatttttatttttttgaagcagggtctcgctgtcgcccaggttggtgtgcagtggtgcaatcactgctcactgcagccacgacctcctgggttcaagcaatccttccccctcagttc

SEQ ID NO: 511785 - DNA, 576 bp, Homo sapiens
agtgacaaacagaggcctggacagcaggtgcaacttgtgtgcgattaggtcgtaatatctaactccaagaggctcttgggtatgtggcactctgaaggataattttggatcgattgaaacaggcaatcatgataaggaaatctgatcatccattcacagtgagttctctggtgatgtgggatagcctgaaactggagggaacatgggtcgagtatagctatgtacaaaggacaaaggcaacaaagtcagtgcagataaagtgagcaaaacacactcaatgaatggcattagcaagaaggaagcgatcccacaatataaatctgggcaaggaactcaggcccccatgaggacgtgtgcaatccagcacggacggggtaccaccggcatgactcggattgggcaggagaggcagaatagaaagttaggtctatccaatgaaactcgaaggaaggcaagcaagggatgcccgaacagggagacccagtcatgaggtccggacaagacaacacggtaaaaagacctggggacaggaagtggagaaagcggataacgaaagagagggagcagaaagcagaa

SEQ ID NO: 511786 - DNA, 406 bp, Homo sapiens
tgaggatcccgaccactactggctgtgaagaagacgcctgtgtgggagagaagaatgcggacagcaggaggcatctggggcaagtgagcgtacaagtatgctctactaattcagaattcggtggaacaatccaaattcgacttcgacatgatagagaattgatgagaaatagctgtacggtttccaaaatttagtgaatttggaacctgaggttaaaacttataggataagagcaacctcaggttcagactggccttgggatgaaaaggcaatcacagacggtaatgagtgtcagtgcttgagaagaagaattgccaaaggcactctacatatttgacttgactcaaagagaggggaaaacaagtctcatttaagaaggatgagtctgcagcaaaaaatcaaaggg

SEQ ID NO: 511787 - DNA, 999 bp, Homo sapiens
  misc_feature (55)..(55): n is a, c, g, or t
gtagagcagtgcttagtttaaagattgctggagctggtagatagctcttctggantctctgtgtatttaagcatagtctccacgtagtaacgccgagtcttgttggaaatatatccctgtggggtacttacgctaccaagctagaggcaaggggcctctcggacaattcttcgtacagtgcgctccaatagcatatgtgatgtgtactcgtgtgaggatataggtatgaacgagagctcacttcggactgctgcatttctccgcagccgatccgtgggcccactgaggtggctagatgttactgttcacgttgcaggcctggggcagtatgagctagttgaagatcgtcgctagatatatacttgactatttgtttagatccataatcatatgaccaagatgctcacacgcatcccatacacgcaacccttgtgcgcactcggaaggggcactttggggaattgcgcgagatctttgactcggagagtataaccacacaaaagatgattatctagtacacttcttccagagccttatgactcactgcgaccatcataatgttagttgcatcactggtatacatacaatacgataagggcgaagttagggatgatcatactagtgattagagggtcatttggatctaaaatactttcgaggtgtaagttgtggactagcttgttcgggggcatggtttggggcgaagtattgagggtaagtagcgggggcatggggtagaattcactgaaagtaaaattggaagagctttctagtagcagttgtatgggaggaaagggaagctttcgttgcttgaggaataggggacgctgggtgagacccgtggtggaagggtcgaagaggttttggtggataatttggagtgaagggggacgaccaaggtgatttcacataaaatcagtattttgtaaacatactatatcttggactggtgggaagggggggtcggccggttccatattggttgtgaggatggtaaca

SEQ ID NO: 511788 - DNA, 439 bp, Homo sapiens
tcatagtgagtcctagagtatccccctaacaggctttggagctatgacgcgatataaacttcatcctaaagatgtggggacctctaaagacttaaacacaaaactcatgattaagttgtgtttcagaatgatcattctggctgtcgagagtggatatagactaacggtcctggaaggaagaaaagtagggtggaggcttttataatagtccaggtggtaggggacagtggcttggaccagagtagtggcagtagaattggagagtctagagatttgggaggcagaattggcaggacttgggattgacaggcatgtgggagttgaggaagagggagcagtcaaagttgactcccagtttctggcttggacgacggctggatgggagtgctattccctggtaaagggaacatcagagctgtcagcactcagtgctaggtac

SEQ ID NO: 511789 - DNA, 227 bp, Homo sapiens
agtttttcatcgaatgcagcccagaggttctttttactccatggtaccaaatgcaactattcaccaggatccccagtttatttttgttacgaatccagttactttaaccccccctcaaggccccccagctgcagtgcagcttttttcagctgtgaacattatgaatggttttcagatgcacataaacccagcaaataagtttttgccccctttccccccccatccta

SEQ ID NO: 511790 - DNA, 262 bp, Homo sapiens
actttgggggggggttaaaaaaaggaaaaaaggtttttccccccccccccaaaggatttggccccaggaaaaaggggtttaggggggggtcctcaaattttttagggggggggggaagggccaattttttcccctttgttgggggggccctttttttgaatggggggggggggggtttttggccggtcccttttccccccctttttgggggcaatgtggtttggctttttgttttccccccccccaggcccgggttttgttt

SEQ ID NO: 511791 - DNA, 263 bp, Homo sapiens
  misc_feature (96)..(96): n is a, c, g, or t
tcattcggtaagcagaaaaggcacttgaaggctgcctctagaggttgcgggtccccaagaggttatggtagatggcacagggtggggtgtcatcangggagcccagcccgtgatactacagtggtctcagctacagtagttgggtgcagcagcagaaagggcccaaggcagtgtcagtagtgctccagttagagactcctgtacaggcagcacgtgaagatcatgccaaagacctgcacacaggcaagtgccgatcccacaga

SEQ ID NO: 511792 - DNA, 908 bp, Homo sapiens
ctgggcctcggctagcgctcgagggcgggcacaaggccttgaggcctgagctggcccgcgtggagtgtgcagtggcgcgctggtggaggcccagctgggtggcctgcgctcggtctgcgccggtggctcggcctcggtcgcgcgcccagcccagccccgcgtgcagtgccggttcccctgcccgggactgcacccgcaagaaggaagctgggggaaggggctcaacagtcctcgagcagcgttaggaatgcagccctgggtcccaggcaccatctccaggacctgccacctccccagcctctccagacctggacccggaggcagtgcgcggtgggccctccggggaatttccgtgcaaggagctgcggtgagttgcccaaagagggagacggggacggacactatcgggagccccagacccacgttgcccgtgacatctgccgaggctgcgcccgagacttgcacgtgctgacgatgtggcaacaagcgcaggccacaagaccatcagaagacggggctaaggggcagggccttgcctggacacgcggcggggatgggcatcgacagcacgactgagagggcaaccgcccggcggcgacagctggttctattggcacaattgcgcgcgctcagcctttcgattgccgtcggggggtaacccaacgtcgcgtggagcagcccgtacgaggcgcgccatcgcccctagggaacgtagcgaagtaagtatttgttcgccctgcgcgtcccatccactcacgaacctggaggacccgacgggcccgcgggttacgccaccagcccgtcgtggacacccaagagcgattgtgcgcgcagaccagccgcttcgtcgaccacatcggtagcgcccccagtagcagaaggtggcccgaagcgcggcaagacaaggc

SEQ ID NO: 511793 - DNA, 281 bp, Homo sapiens
ctctccttcggaagttgtcggacacggcagtagctgatacccggcgccttaactcgaagccgcaggacctgaccgacgcttacgggccgccaagtaacttcctggagatcgacatctttaatcctcagacggtgggcgtgggacgcgcgcgcttcaccacctatgaggttcgcatgcggacaaacctacctatctttaagctaaaggagtcctgcgtacggtggcgctacagtgactttgtacggctgaaaaatgagctggtgagagatagcaagattgtt

SEQ ID NO: 511794 - DNA, 330 bp, Homo sapiens
  misc_feature (234)..(234): n is a, c, g, or t
  misc_feature (257)..(257): n is a, c, g, or t
  misc_feature (286)..(286): n is a, c, g, or t
  misc_feature (325)..(325): n is a, c, g, or t
aacaccactcagtttcaacaataaagctacagtaatcaagcaatgtggtactggcataaagacagacatatacaccattggcacagaataggaagtgtaaaaataaacccacatatatatatggacaactgaattctgacaaaggtacaacaaagccaatgcaactgatttttggaaataatgataataacctttcaacaaatggtgctggggacaattgggatattcatatgnaaaaaacaggaaaatccttaggntccattacttcggcattacacatttaaanctggtttcccaaatggtttattaaaccttaattggcctnaacct

SEQ ID NO: 511795 - DNA, 722 bp, Homo sapiens
  misc_feature (119)..(119): n is a, c, g, or t
  misc_feature (123)..(123): n is a, c, g, or t
  misc_feature (146)..(146): n is a, c, g, or t
  misc_feature (540)..(540): n is a, c, g, or t
  misc_feature (593)..(593): n is a, c, g, or t
  misc_feature (603)..(603): n is a, c, g, or t
  misc_feature (609)..(609): n is a, c, g, or t
  misc_feature (666)..(666): n is a, c, g, or t
  misc_feature (668)..(668): n is a, c, g, or t
  misc_feature (673)..(673): n is a, c, g, or t
cagtgcggggggggtccagctctggcccacggtctggttacagtcaggagtgcacgtgagcacagacacctcgaaacacctcgggaaacacctcgggaagcctcagcttagcctcgccntgcngttgtgaggccggagggtgaacngcgcccggtggggatggaggtctcgggtcccatgtcctttcccagcccgtagcagcagccacacacacctcaagtctcccaaagctcctcagtgaggtggctgcagggagaagcccagagcctcttccttggcagcccagggccccaggggcctctcctcactggatgccacagggtcaccctgtttatccaacaggcactgactgtctactcccctccctgctgcagggacacagtggaagtggggatgtggggatcaagcctaagtttctgcaccccagctccctcaggattcctccccgctaaggccccagaggcagtggcagggacagtcctcttagcctgccacctattccctctccatgggtgaagcacagccagaggccccaggttngactgtttggcagtttcctcgggaaccgatacagcatgaggcacacacccatnggggatggcnaggggntccttgaagaagtcctttgcggtggaggacactccaaggaaagtcctgacccagggnanccccncactgagggtccttaaagcacacacttcccagggaaccccccccgtact

SEQ ID NO: 511796 - DNA, 1248 bp, Homo sapiens
tgagcagaggacccaaccgtcagcactcctgggattcctccaggagaagggaccaattatgacaaatacgtagagctcaggtatcacttctagtttacttaaaaaataaaaaaatagagacagagtctcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggaagtactataaggggaggggccggtgtggttgacacctactatatgattgatgtagacgaaaagatagtatttaaagaaagaagttggattatttaattagaaggacgggctgcttaggtgcgagaggtatgttcgaatcgagagttagagacagccacgagtgcgagtatgaaagacacagcatgattgggaggagacacacactatcagtggagggaagggcagtgaataatgaaagggaccccctaacacttactgggagagcgataactaatagagcgcggaggaggatcacacaacaaaaaacaagtgaataaaactcagaacccaagcgggaggagacaaaaacacacaggacgagacaaaacgacagggcggcggggagcaaaaccgatcgacgccaaaccacagtgcgcgcacggcgagaacgagcctcccgaccgagcggtactaaaagacgacagaccccaccaacacccggacgcgcgacgacgaacagagaaaaaggcgcaaacagaagaagcgagaacacgcgaagcgcagcagacacggacggacgcaacaagaacagagagcagaagcgggcagagagagacagagaaaccagcagggagctgacgaagacagaacagaggcagcgaagaggagggaggcgagacgagggaggagaaaggcaggggacgaaggcaaggaggagagaaagggaagcagagagacgagcgagaggaggagaagaagagaggagcagacaagagaggagagaggacgaggagaaggacgcgagcggaggagagacagagagagaagacgaggaagaaagaagccaagcaggaaggagcgagcagagcgggagacggaagcgagacgaaggaacgagcgagaacaacgagtggacaggagcaggagacaagccagagagagagagcacagcccgaaaaggagaaggacagagcgagagagagagagggggcgagacgaggcgcgagggaagagaccgaacagg

SEQ ID NO: 511797 - DNA, 191 bp, Homo sapiens
catgatcaacattggtaagatcattgggttacgtgctgaagcacgatacaagatacgtgataagtcatcaataacggcttgacgaatatcagcttcagtggcgttacgttattcatcacacgacgcatcgtgccaaacataatccgacgtccttcattaattaaatcaccagactcacgcatgtaaacaaa

SEQ ID NO: 511798 - DNA, 973 bp, Homo sapiens
ggctggcaggggcgctggaagctggagcggtcctgtgcgctccccgcgcccgagggtgcaggaggctctgaagcggctgctgcaccgcggggcccaggcggccggctggggggctggggggcgctgcctgctgccgccagccgggggcgtcgctaggctcggccccttagtactcgcgcgctccccctcgccgccactcccctgctgtcgcgcggaggggtggtggcaggcggcggtcctccctgcccgaggcagtcgggctcgggcctgggggcgcgcagggggcggggggagcacggccagccgacgagagtggggggcgatggcgaagctccgggtgggattacgagtacacggaagccgaggacaagagcatccggctcggcatggtatactcatcatctccgggcgtcgtgtcagctctacatcttcgggctacatgctggcatagagatcccgacgctgcagggatacaggaagcccacgggaggccaaataggcacacggatgcttgaacaggatgcagcaagaatcggcagaaggatgtaccgacgtgcaaccctttcaccatggtggcagccgacatgccagggtcgcaccattcggacagatagcacactggggttccaagggacaaaccgttgaaagcaaagatcatgacggttccaaagatactaggggcgactgagtgacaccaagcagaaacgaagacaaccaagacatacttgaagccaagccccaaaggttggcttccttaaataattcccattcccaccatgaataaacgaatgcaaggaacaaccttcaggaaaaggaaattttggcgaaaagaagatggcatcaaatgaaacattgaggcacagacaggttaaccgtgggaaacaagcaatatggagcaaagtggagtataccaccaagagcccacatataacctatgcctagaagcatgactaacaaacaattgaagaggaac

SEQ ID NO: 511799 - DNA, 755 bp, Homo sapiens
  misc_feature (17)..(17): n is a, c, g, or t
  misc_feature (624)..(624): n is a, c, g, or t
  misc_feature (667)..(667): n is a, c, g, or t
  misc_feature (670)..(670): n is a, c, g, or t
tatggtacttctgtctntggatcaccaagccattcaaagttattcataaagctgtggaggagattttgttttttaattttctgggactctgggaataatatcagatgactataactatcctgtcaaaaattatcccacttattttgtagtttccaaacaaatacatgctgttagaaaagattacacagtcaaaataagagattttcttttttcaattgtttaccatctgctttgtttttattctttcagatgtaatacacattggatgacatttagcctgatgttagttttgccttgacgttgagaatgttgagccctcattccactgtcgtagtctgtatgtcagttaaatacctcacaatagataatcatactgtaacgttaaacagctccctgaaaatactgacacagatcttaagagtttaggttagaaccataagaattggttcattcagctttcagaaagcactggcaggggagtcaaatgaaattgtgaatctcagcccacacatgaaagaacgattaagattattgtcactaagaagcccagaaatggttatcagccattgataatttaagaagtgtccttgccttcttttgctgtattcacagatttgggaatanttttatgctttagtcatttaactagagaacatatgcttactantantaaacaatcattcgtcataaactttaactttatttgctttacgaagtgtttgaaatggtgtttttatggaataacttttgattca

SEQ ID NO: 511800 - DNA, 306 bp, Homo sapiens
attcctaataaatttagcctactccaatttgtgttacttccacgatggtgccaaagttaatatccattcccacatatctactccagatttctttctgtataattgtgtgtgtgtgtgtgtgtgtgtgtgtgtagaagagggctcgggtgagaaatcagacaatttatctgttagaaaagagagctcatgccttgataagggtcgcagcctgagtgtggccattatgacgggtgggaagtgtggcccagagtccaaggctagagtaggccctccaggagggaaggagaggacggaatttgcgctgca

SEQ ID NO: 511801 - DNA, 354 bp, Homo sapiens
cggtcccactactcggggttgtgctataaggaatacaggggacaattgatggtacttatttaatgaatatgcattcttcttaccaccagggaaccatagttcgtgattatggagagcttgtaagtgtaacttccacagccacttaccaggcagaccctctcttagcttagtgctgagactcattgcctctcccatggaattttccatttgtgttgagggctgtcttgctccttacctacataattctcttgcagatcttactgtgccgagatcgctcactatgtttcctcctagaaccgcttagccatcgtggaaagagctgccctacttgccatcagagtcacttatcccgag

SEQ ID NO: 511802 - DNA, 625 bp, Homo sapiens
  misc_feature (196)..(196): n is a, c, g, or t
tctaaatggctgtgcaggaggtggtgaggttgatcggggttatctgataacagaacaggctcctctagaggatatgaagcaccgccagttctttgagtttaaaggctggtgctcgtagtgttctgccgagcagtttggttgatttaactgttgaggttaagggctaagcatagtggggtatctaatcccagtttgngtcttagctatggggtgtccagatatgtaaaagccactttcgaagtcaatttggggtcactgggagtttttaacaactcaggtgagtttaagcttaatgggggagggggtgatctaaaacactctttaggccggcttctatggcctggggtaaatcgtgtgaccgctggtgctgggcaggaaattgaccaaccctggggtaagtatagctaagttaaactttcgttaatggctaaaggttattcactgcggtttcccgtgggggtgtggatgggctaagggtatggagctgcattgttgcgtgtttaatgcttgccccttttgatcgtggtgaataagagggtgaactcactggaacggggatgcttgctgtgtaatcttactaagagctaatagacaggtaggaccaacctatacagcattaggtagg

SEQ ID NO: 511803 - DNA, 435 bp, Homo sapiens
aaggtgggagaagcacacaggagctgggcacagccacttcaagcccaggaatatgtgaacagaaaggagccattgtctccagatcacttgaagggaacagctcaaaaacacattcaaaggagcctgatgataatgaatatgctaagatggagtggtccactggacgcctgtgctacctccaaaaaaacccttatctgaccttcctcatggattcaaagctttcattgcaagtcgcacaggggattttggttaaaatcaccatgaacagttttcatttaaatggcacaaagctgggagttgtgcattcaagccatgagtatcacattggtcctgacacccctgaacttgctggggcaatgcatagattgtgactgagacttctggaccttctagctattgcctatgggtgggcagcactagcaagcattaagggtc

SEQ ID NO: 511804 - DNA, 761 bp, Homo sapiens
  misc_feature (246)..(246): n is a, c, g, or t
  misc_feature (348)..(348): n is a, c, g, or t
gtggggtcagcacgccggctgcagcgcagtgatgggcctgagatcgggtgccgggccccccatctccacctgtctggacacgcacccctggcctgtccttgcagcttcctcccgacatcccttggcggtgtctgtgtctcggccccagccccagccctcctttcctggggcaccctcccagccatctggtattggggctgcccccattgcctagtcctgggcccagggcagcccactctggctggntttacttgtctgttcctaatggcagggcgtcccaggaacagccccataagagctggtagaaacaggagggagtccttgtcagcaggcatcttcgagcttttngtttgtttgtaaaaagcggttaaccagcaagttacataaaagcttatttgttcccactgaattttccacacctcacacgtgagtcccagccatgcagtgcttgtgagggagcatcaaccccttgcctgctggcctgggcggggccctgggctcagaggggtcagccacagaggaagcgcctgtcctgacgtgtaggcggccaggacctggggcgctggagagggggccagcggggtgaagaccggctcccggggggcactggagcacaaagagggagggggactcatagtccaagctggaggaagacatgagcctgagctccaagtgagggcccttgcattggccaacagcacggggccccagaggctcaaacccgggcaattggcccgtgacagactgaagcagctggcccc

SEQ ID NO: 511805 - DNA, 357 bp, Homo sapiens
tgtccagccggtggtttttccaggcgattacctgtagtatttgagtaaagggcacgtccataccaatactctgtaggcttcgtttgtgggtcctccagcagccagatgacttgaactcctcagtacactcgtttcttgttgaagtgatctactcgaggaagaaggaccatatgcggaagagtgtgttcatctcctgagactggcccatgcccaagcgtttccgctcattagggcagcgcctaccatatcttatggtagacgtgttgtgtgaagccattgtccttaagctattcatgggaaggatgctggaacttgggccatgacctgaggggttcagccttagcttttccctttttg

SEQ ID NO: 511806 - DNA, 438 bp, Homo sapiens
  misc_feature (310)..(310): n is a, c, g, or t
gacggacagcagtcacaaggagcccttgcatggagggagccaatgagaactcattcgctttcacctttggccatggcggcgctggaacaagccagatcccaacttgggcttgccccggttcacaaacaccatgtttggagtgaggcagaagagcgctcgctcattgcccgctatcccaatgaaccgactcaggtcctagccgccgaattggggctcagcgtctatcaggtctatgccaaagccaaacggctgggcttgagcaaaagcgccgagtttcttcgcagtagtctctgtggccggcttgacgaangtttgggcgcagaattccgctttcccaagggatccgtcccatggaataagggccttaaggggctcccctcctctggccgtatgactcagacgcagtttaaggccggcaataaaccggggaactggctg

SEQ ID NO: 511807 - DNA, 449 bp, Homo sapiens
gggatttgaataaattctattaccagttcaaaaaaattaaaaaaaaaaaaaaaaaagaaaaaaaaaaaaaaaaaaaaaaaaaaaaaaaaaaaaaaaaaaaaaaaaaaaaaaaaaaaaaaaaaaaaaaaaaaaaaaaaaaaaaagggaaaaaaaaaaaaaaaaaaaaaaaaaaaaactttggggcccgtttggcccaacctctttttaaattgggccggttttttgtgggggccccttttgggggttttttggcaaatttccccttttgggggggcttttaaaattaaagggcccgttttttaaaacgtctggattgggaaaaccctggggttcccccatttaactgccttggaaaaaaacccctttttcccaggtggggtaattcccaaagggccccaccgaatggccctttcaggttgccaaccctaaggggaaatggttggaccctt

SEQ ID NO: 511808 - DNA, 146 bp, Homo sapiens
ctcctcagctgcggggtgccggcatgtttggctcccacacatcccagcacagcactcgtttctcgggggcaggcattggccacgtggttgtcatgcaccgtgtgtgtgcccgcatgtgtgtgcccagcgcgggcacggctggggat

SEQ ID NO: 511809 - DNA, 1001 bp, Homo sapiens
gtagtcttttatccctcactcccttcccaccctttccccctgagtctccagagttgagtcattcttatgcctttggatcctcatagcttagctcccacttatgagtgagaacatatgatgtttggttttgcgtcagccttttaattttttttttttttttttggaaagggagtctggctcggtcacccaggctggagtgcaggggtggcgatctgggctcacttgcaacctccgcctcccaggtttaagcagttctctggctcagcctcccaagtacgctgggattacaggcgccttgccaccatgcctagctaattttggtatttggagtaagagatggctttcacaccatctgtggccagtgggggtcttgaccgtgctgaccttgtgactccacctgcctgggcctccctaaggactaggattacgggtgtgaaccaccaatgcctggccttttttatttttggaacacagagtcccaccccttgtggcccagggcgtagaaagcgccgagaggcagagagacctgtgggccacaaagaggcccccaacttaaataggggcccaagtgagactacccgaggccataacccccccaaggatgcggggaacaacggggcagcggtatccacaaaaacgggggcactaattcgtgtatactttaaatgaggctactggacgttttgcgccacattttggcgccgcggggtgtctatcggaattcctggaaaccttgtgggtgaacccacccacgtggcgttgtgggggccccccccacaaaggtggtgctggggactatgtagcggcgtgtggtcaaccaaacacacacccaccaagtctttttgggtgaaagcgggtactttttaagtaccatgatggtgcaacaaatatgggcatcttggcgtggcgaacaatatatttttcccaaagagtctccctttatatcaagggcaactacagttgtaggaggacgcaatgttgtcataagagaatatcccgaa

SEQ ID NO: 511810 - DNA, 287 bp, Homo sapiens
  misc_feature (106)..(106): n is a, c, g, or t
ggggggttttttttttttgggccccggggcccccctttcaaggggttgggggtttttccccccccgtttttttcccccccaaagggggggggttataggggggggngtccccggccccccccccaaattttgttttttgtgtgggttcgggggggttttaaaaacccccctttgggggggccccggggggccgggggtccttttttttttttcccccccccgggccctttggtttgccccctgtggttccccgggccgttttttttttttaacgggggcccggggga

SEQ ID NO: 511811 - DNA, 118 bp, Homo sapiens
gagtatgaatatgtggaatgtgtatgtgatatatatatatatgtatatatatacacatatatatattatgagatatatatatgattagaagatatatatcttttaaaaacatagaaac

SEQ ID NO: 511812 - DNA, 274 bp, Homo sapiens
aagcaaaggggcagtccaggctgcaggcctctaaccccgagcacatggtatgcaaacaggagtatcacactctgcagtgcaagagcctgtccttcatcttgggggatgcaggcctgcagtgatgtcccccctgcattccagtactatccccgaaacaattcaccaccctcaaagacgtcctccgtgtgaacagcaagattatcttgaggatccctagaaagtggtccttcacatagtggatggcttgcatttttcggaaggtttggcttgttaa

SEQ ID NO: 511813 - DNA, 877 bp, Homo sapiens
gggccggaccggagatggcgccgccatcgtggcgtggcggcggcgtgcggcctcggactataggctccgccgcgagtgctcttggctggtgcatcgccgcggttgcggccgctgggcgccggtccagacgccgaaggcgcagctgcggcggctgcaggtctgagcggcggatccctgagaggcctgggcgctttccggttggtaggctgcttgggcgcgggacctgtgggcggtataatgtgcgagtggcccctggagtcagtgtcctatagcattccgatggcccctctatgccatgtcacgaggtctacacgtctcgtccaccaggagtggcctaggaagccttcaggccatgcaacttcctcagacctcaggaatgctcagtggtgggcagtcctagtccgaggtgccaccgtggaaggacagaagtggcagcaagagcaatcagccacagccttgggcccagaagcattgccctgtctccctgtccagtccccggaagcctccagactcaagggccctccagctgaggcagatcttcctaggagcctggaaacttgacggagagagaagagctggccagggagcctggcccgggctattgccaggtggagacgagaaggggggcagccaagtggcagcccgtcctggcccagcatcgtgtggccctggagttgttgcaggcttcagggaggcctgtttcccacctgggccccattcaggctgcaggtccacacttggaagacgctagctttgccgcatccggcgcgtcctctgcgacaccgtttgccctggcaggtccaccccaatgtactggttgcaggtcccaggaagcaggtgcctcaaagtcggttcccgcaaccggcaagtggtaacg

SEQ ID NO: 511814 - DNA, 637 bp, Homo sapiens
tccttcagaagacaggactcccgcttctgtctcccaggccggagttgcaggggcacgatcatagctcacttgtaacctcaaacctccgtggactcaagcgatcttcctgccattagccttagcctcctgaggtagctaggactgtaggcattgtaccaccgcgccgtggccgtgtgtctattttatcatctcagattaattcaatttggtatttccgggctcagatgaacttaaagaagcttcaaacttttctttttctatgaaatgttaattttaatagcatcacaggccggtaaaatattttcaagcgtacacagaattatcaaagtctttgggccacaataaactgaacactttatgaaagcatactcatcagggactcacttggaaataatacgagatctcaactttcaaggtgagaaataaaaagcctttattaaagagtggtgctaggaaacgagaacattgcgattaaattttccccattggaaattctgtgatttcagactctaaatgaatacagagttttgaccgtgtgatgttcaccatagtgtccttccttaaaatatctggttatgaaagcaagccttttttcattacacacaatttttctaggacaacctgccaaatagtctag

SEQ ID NO: 511815 - DNA, 325 bp, Homo sapiens
tcgacctactagaggatccctttgtcgattggaggaacagtacttggcttggtcttgaagtggacagaattcaaaaaggaccaagaagaggaagaagacaaggcccacatgccccaggctcagacagggagctgatggaggtagtagagacctgaagtcttgcaggcactcacatggcataaatgttattcaactccttccagttgtcttgaacagcctgactcctgccagccctatggcaagttccttttatgcattggcggaaaaacatgttggcttttctcttgacgtgggagaaattgcaaagaaggggaagggggagaaa

SEQ ID NO: 511816 - DNA, 199 bp, Homo sapiens
gaatctagattctgtcagtcgactcctctggaaaccaggcgcctggcaggctgctcacctttggggtgtcgatgtaggggtattggtgagggtgtggaagctgagagtgcaggcaccccactctggggcaccgcgccttgggggggccccccatgactctggggtgggtgcagcagcatcacctgggggcgggcgaggg

SEQ ID NO: 511817 - DNA, 894 bp, Homo sapiens
tgtgggcactgtgtttcgcgcaccacaccacggtgccttcttaccggggcgataaggatggggatacacccccgtggtttttatgtgattccgccttcctcaggggttcccaagtgaatcctggcatgatggagatctgtccctgacggggacaaccagcgcatcaaagctaggacggtacgtcgtgttcgcacacaccgtcactggggaccaggggcccactgagtttgcctgaggttccctttattctgatgggagtacttgccaaggagttaatcgcagatagttacagccattttgcccgacattatccgactgggacagcccctcccagaaatatggggtctcgtctttgtgatctaaaaggtttgtgctgccagctgatatgcaacttcaggtcttttaagccactcctggatcaaatctaccctggggagcatcccctgagggattccaccccacgaccttttccagggaaccccagcagaattttatggcccaccaaaagttccccaaaaactgcctggcaactgcgattcaccccacctcgtggggtatggtgctagatattactcttacctcatgtcccgagcggtcgcctccctggtttggcaggacgtgttttttaccggagtcccttcacacgggcttgcccgggggcgctattcccgggaggattctggccccccgtggggcgccgggaggcccctgctcactggttgaaggtatgcttcagacagtgtccttctttgagacttcgtaagtgccctcgtttccgacttggatttggacttcgaaactttcctcatggattttggattaaaggaaccctttacaccttttaatcacaggtcatgtagataatgactttgttattaatgctacagctgtgga

SEQ ID NO: 511818 - DNA, 180 bp, Homo sapiens
  misc_feature (43)..(43): n is a, c, g, or t
  misc_feature (84)..(85): n is a, c, g, or t
  misc_feature (88)..(88): n is a, c, g, or t
  misc_feature (120)..(120): n is a, c, g, or t
aggtcgggtcgccgtccagcctgcagcatgagcgcccccagcntcaccccatcttcgcgcccggcagaactgcagccccgcgtnnggnggcagccgcggccttacgacgcagcggacacnacctgcgcatcctgggcaagccggtgatggagcgctgggagaccccctatatgcacgcgc

SEQ ID NO: 511819 - DNA, 332 bp, Homo sapiens
gatttcttgagcccaggagctggaacagcctgtgcaacatagtgagaccctgtctgtatttaaaaaaaaaaaaaaaagagcctctactccaataattgggttttttccacccgtaaaaaacacggagtggctggacaggggggctcatacctgtaatcccaccatttgggtaggccgaggggggcaaatggcctgaggtcaggagtccaagaccagtctgggccaacatggtgaaccccggtctctactaaaattacaaaattaagctggggcatgggtcatgagcgctggtagtcccagctactcaggtagctggaggaccatcgttgggg

SEQ ID NO: 511820 - DNA, 934 bp, Homo sapiens
gtgcaggtgttcgctcctgccaacgccctgcccgctcggagtgaggcggcagctgtgcagccagtgattgggatcagccagcgggtgcggatgaactccaaggagaaaaaggacctgtggaactctgggctacggtgcctgggcattaccatgatggtgatcatcattgtccatcggagctggggatcatcttgggctactcctacaagagagggtggaaggatttgcagaacgaacgagcgatgatcagaaagtatgtgagagggagatgcagcgaatcactctgcccttgtctgccttcatcaaccccacctgtgagatatgtggatgacgaagactgtcgtggtccacacacagccagattccagttgatcctcaggagggcaccaccccccttatgggccaggaccgggactcctggggtcctgagccctcttcgcaggtgggcaggagtcgccatgcagagcactggtgcaggagcagaccaccctcctatcagctaggaggaacctaccactttgtgttgctggttaaaaccggtatccactcccccgctttttgtggtgaatcctagtaagagtgacgaagcaggtggccctgtgggctgagggtaaggctgggtagggtccttaaacatgtgcgcctgtgtccaatcgcctatgagagcagatgttgagtcgtgtggagtggagaccaggggcagctcccacagggatggtggcggtaaggggtgtcgagagatggctggacccccagggaactgagcagcggatagaggggggagctcccccagggcgctctgggccgtgagtaaagaggggcccagccccccgggggtgagggcacacggtccgggcaggaagacgcagggggcccgaaaaattcgttcaaactgggggccccagaggcagggaacggaacgcgaaggaagggg

SEQ ID NO: 511821 - DNA, 513 bp, Homo sapiens
  misc_feature (40)..(40): n is a, c, g, or t
ggaaaacgggaaattctgccctcaagggaccccccctgtngcctttaaggaccaatccctccaaacccctaccccacccagaacccctgaacaacccactggacccatcctcatttcctaaaaaccttgtcatttccatgtaagttaaaataaatggagcccatacgtgtgtgacccttttgggattggcttttttccctcttggcatatttctctggggatcatgtatatacactgatatggtttcaatcttggaggaatcctgattctgaaatccctagagtcccaaatctgatgatttcagggctgaacagttcccttctttgagtgatgaggacctgaaggctgagagacctgaggtgtcatgcccagggatcacccatgcacagcctgagctcacagcagagattccgcctccaggcccggagcactcctccgccatgaggtcttttacagctcagactgggcaaagctctttttaattccaccaaacctagaattgttaaaaaaaaa

SEQ ID NO: 511822 - DNA, 490 bp, Homo sapiens
  misc_feature (197)..(197): n is a, c, g, or t
  misc_feature (237)..(237): n is a, c, g, or t
  misc_feature (293)..(293): n is a, c, g, or t
  misc_feature (387)..(387): n is a, c, g, or t
  misc_feature (399)..(399): n is a, c, g, or t
  misc_feature (417)..(417): n is a, c, g, or t
cagaatttgagatggtagtaccgagaaaggttctgtttctttcttgaaagtcaactctatctttgcaccataaaaacataactatcgatatctataccccagaataatatttgtttgcaacaacttcttatgatgggtgtttaatactgttagtctgtaaattgaaactatttaaaactatatacatgccgggcgcngtggctcatgcctgtaatcccagcactttgggaggctgcngcaagtggattgcttgaggtcacttcaagaccagcctgaccaacatggcaaaaccntgtctctactaaatatacaaaaattcagcgggtgtggtggcgggcacctataatcccagctactcaggaggctgaggcaggagaattgctggancctgggaggcgnaggttgcagtgagccgangtcgcatctctgcactccagcctgggcaacagagcaggagtccatctcaaagactataaagcagaaaagtcgg

SEQ ID NO: 511823 - DNA, 396 bp, Homo sapiens
tttttggcttttgggggggactagttcctgtggaaaaaatgccttaaacttggctttttgttttaattttaattcaaaaacttgagatctttccggggccaccaggggggtaaaccagcttggtttggtttgtccaaaagtggggagtgatgggcaggttcggcaccctaacattgttcgggggcagggcccctggggggggaacccgaactgggttttttttttcctaggaacgccaagggcaggtttttggaaacccccttgggcccgggatggcaagggccccgggggggggtttccccatttgttttcattaccaaaaaagtgatgagggtttttttttccctccccccccggtttgtaataaaaggccaaattttgtcggctatccaacca

SEQ ID NO: 511824 - DNA, 128 bp, Homo sapiens
ctctaaggatcccgcctttcgctattctctttgagctcacacactcttcgcgagcttttttcctttggaggctgggtaaccatttcgaatatcatcagtccgctgatggtttactttgatcgtttcat

SEQ ID NO: 511825 - DNA, 489 bp, Homo sapiens
ggcttccctatgcagtgcacatgtctacctccatacaaatccatccagccagcatatggctgtgtgttaggtgtttcaggagatgtcaagacaaatcatccataaacctgcctgaaaggtcatcatcacaataagtcacattacttacattgtgccaggctccatgctgaactctttatgtgcattatctcatttaattgcagcaacagtccaggtgctgtggctcacacctgtaatcccagcactttgggaggctgaggtgggcagatcgctggaggtcagtagtttgagaacagcctggccaacatggtgaaaccccgtctctacaaaaaatacaaaaattagccgggtgggacacgcctgtaatcccagctactcaagaggctgaggcaggagaatagcttgaacccgggaggcagaggttgcagtgagccgagatcacaccactgcactccagcctgggtgacagagcgaggctccatctcaaaa

SEQ ID NO: 511826 - DNA, 284 bp, Homo sapiens
gcacgccgaaagctcattccattctctgagagctgatctttttagctgaacttgagaggatagtggtgtggggggggtgctgccctctcaaattacaacccgaatgcacttgccctttggtaatcctgctccttctgaatctgttccacctgatcaagcaactggcgggcgcggagttgtagctccgtcagcttatcttttgcagcaatctcagtgtagtttgtggcatgctccccaacctggatgtcgagatgcacacgccagttgccaccagcgaagagagc

SEQ ID NO: 511827 - DNA, 139 bp, Homo sapiens
caggatgttcggatctgatagatgagcgacagcgttcataggctagtccgtgacgtgaggacaaatatcattctgaggggccacagtaattacaaacttagtatccgacatcccatacatgtggacagaacatagattc

SEQ ID NO: 511828 - DNA, 352 bp, Homo sapiens
  misc_feature (172)..(172): n is a, c, g, or t
ttatttttaaaaattattttttcattgcccttggaaaagatatccccgattggggagaaaggctatttaaataatttacccggaaaacccgccgggagagttaggatttctatttttaaataaggtttgccccccgaattgaaaaattgtggggtttttctttttttgggtngggtttttttttttttttttgggcttttgcccccccctttttactattggccaaaccctttttttaggaaggggcttttttttggccccatttttaccccttttcccttttaaaccagggtaagtggtaaattactgttttttatggccaaggacccccaataaatcatatggaaattta

SEQ ID NO: 511829 - DNA, 214 bp, Homo sapiens
agatatacccgatggcgtgcaaaagatcctgcaggactacaaatcccatccaggatatcattgccatcctgggtatgagatgaacttactgaggaaaacaagtagaccgtgtcccgtgcacggaaaatacagcgtatcttgtctcagccattccaggtatgcatagaggtcttcacaggtcatatggggaagctggtaccccagaaaggagcac

SEQ ID NO: 511830 - DNA, 343 bp, Homo sapiens
tggagtgagtggcgcagcagactcggctcacagcaacctctgccttccgggttcaggtgattctcatgcctcagcctctcgagggagcgggaatcacaggcatgtgccaccatgcctggctaactcgtttggtatttcttatagagacagggtttcgctgtgtaggccaggctggtctcgaactcctggcctcagatgatccgactgccttggcctcccaaggtgctggcattacaagtgtgagccaccgctcccagtcctctgcccatgttttacttgggttgtttatttttgttgtcggatattaaaagttcattttatgttctgggcacacattatggag

SEQ ID NO: 511831 - DNA, 372 bp, Homo sapiens
gtgcttgtctggtaagtgcttatggacagcgtttgctctctctgcacccttggcctgagaaggtggtagtgattcgttcggctcttcgagcgtcacagtagtacattgagctcatgtatactggtagtattctcgagctgacgccggcaaggcctcatgtgttaacgtaatacgaaaggttctctgaagtctcatcaaggtgagtctcctttctgcaatgctgatccacgggaagaggagctggataggtatattcatcaatgtcatgaagggtggagcgtttcagttcgtccaatgaggcatcgaaatctgagatccataatgtagacatgcacgctggctagtcgagtctcagatgatgtgtcatctgag

SEQ ID NO: 511832 - DNA, 1041 bp, Homo sapiens
gccaggcttccccgcagcgggccctggaccccagccctgcactcctgaccgcctggccaagcagtgaggagctggagctgggacctgtgcccagcgctcctgaggagcggtgcaagtggtttgagtgccacagacagcagtgaccccagaggtgcctgctggtgagtgggccgcgccggtggcctgggtgcccccctgactgaggaccagcaacaatcggcttagtgaggagatcgagcaagaagtggcaggagctggagaagctgcccctgcgtggagaataatgcggtggtgcccctcactgccctgtctcaagccaatagccgcggagagcgccgagtggcccccaagtgactggccacgaggcactggagtaaggaggttcaggctcttcgggcccagcctgtacggctgtggcgtctccaaggggaggctcctcagaagctgcactgagatccccaggaggactggccacatccccccgtggctacattcttcacatggaggcatgtagagctgcagcccttgtccatgcagatggagttcctctgcaccagcacgggtgaatggaaggagctgccaggccgggcaaccaacagatgccgggagccttgcacgccgcccttgcacgtgcagtgaagaacgtgacgtgggctccttgggcttgagtgcagcacgtggcacgcgcacggtgtccctcaagcccatttgcaatgcccattgacagtaagggccctattcaccgcaacacaggctagatgccctggcggcaaggctggaagggcacagtcaatcacgcagggacagttcatcccaaggacaaggggtgtaccccgtagaagttgggtcccatcccccgggaacagtagccagccacccgaagctcacggacttgcttgtagacccggcaactcttgaatggccgcatgaaggccttgaaaagagattgcgtctatcatcaggagcacgctcactggtaagccttcggcacagtacagcagctgtcgcatatggccacgaatttagtgggcgcctcctctg

SEQ ID NO: 511833 - DNA, 268 bp, Homo sapiens
  misc_feature (172)..(172): n is a, c, g, or t
actgcaacatctgcctcccgagttcaagggattctcctggctcagcctcccgggtagctgggattacaggcgtgcaccacaacgcctggctaatttttgtagttctagtagagatggggtttctccatgttgggcaaggctggtctcgaactcctgacctcaggtgatctgnccaccttgacctcccaaagtgctgggattacaggcgtgagccatcgtgcccagccagatctggtaactttagattccgagagtctccgtcgaactg

SEQ ID NO: 511834 - DNA, 397 bp, Homo sapiens
  misc_feature (383)..(383): n is a, c, g, or t
  misc_feature (394)..(394): n is a, c, g, or t
caggcgctgggccagtctgcagccatctgattagagcaatgtttccggatcgcaggtggggcccattagtgggctgtgaaatagaactcttaaaaaaaaaaattgaggccgggcaaggtggctcacacctgtaatcccagcactttgggaggccgaggtgggtggatcacccgaggtcaggagttcgagaccagcctggctaacatggtgaaaccccatctctactaaaaataacaaaaattagccaggcatggtggcgggcacctgtaatcccagtgactcggaaggctgaggcaggaaaatcgcttcgacccaggagttcggaggttgtcagtgagtcaagatcatgccactgcactccagccttgggcaacaagagcgancctctgtctcngtt

SEQ ID NO: 511835 - DNA, 252 bp, Homo sapiens
tggtctggcatgtaccaggttgcttcaaccattcaccccactcaacaggcaccatccagtgttgttttccagttttttgccctcacatcacagctgctgtgcaacattcatgtcacaggtttttatgtgcaacatcaccattttccattttcatgggcataaatgctcaccaagggcacactgttagggttgtcatggtcaacaccccatcatcatttttgtcaagcaacactcaccctcactactggaggc

SEQ ID NO: 511836 - DNA, 248 bp, Homo sapiens
gtgtaggttggagtgaaactgcagagcagttccagggggtgtccagggaattgtctgggcttcaggacagctgattgtagtgttgaaggagatgatggagttgcagagggacctggtgggggatcgagaggatacaggcagacagcgagagcaggaagacggctagaggtgagaggggcagtgcaatgcgcagccctataggagctctgtgggagtggtcgatgcagctgcggtagatccagaagagc

SEQ ID NO: 511837 - DNA, 196 bp, Homo sapiens
acctcgcgcaggcccatatatagtagagagcttctcagactataccacctttgggatcgctttgctgtacgtgatatagagacagacagttgcggtgggtgtcatcaacagcagtgtgacaagaaggctgcgtggagctaggcaaggtcacccaagtcttgccccgaaaaggctcttatttgcccagtgctagggg

SEQ ID NO: 511838 - DNA, 123 bp, Homo sapiens
ttgatgttaaaagtatttagattctttcctcaggcaaggccagggctgttgctgcagaagccccagagttaggggagggcaggtgccaggcctcagaagagggggtggctgctgtctggctgt

SEQ ID NO: 511839 - DNA, 110 bp, Homo sapiens
agtgcgttgtagtgtgggcctgttgtcatgtgctgtcagtgcttctgtgacactctcctgggagttacccgattggagggcgtcacagagcactgacagcactagacaag

SEQ ID NO: 511840 - DNA, 432 bp, Homo sapiens
ggaagtcttttttttcttttttgtaaaatatatgtaacaggccaggcacggtgtctcacacctgtagtcccagcactttgggaggccaaggtgggcagatcacttgaggtcagtagtttgagaccagcctggccagcatggtgaaaccccatgtctactaaaaatgcaaagattagctgagtgtgtgccaccacgcctggctaatttttgggtattttttagtagagacggggtttcaccacgttggccaggctggtctcggactcctgacgtcaggtgatccgcccacctcagcctcctaaagtgctgggattacgggtcgtgagacaccgtgcctggccagtaacatatattctgtacacacaccctgatcactaatgatttcccatggcagttggtggcccgaattcccgggtatatgtgcccgtactg

SEQ ID NO: 511841 - DNA, 211 bp, Homo sapiens
agtgaacactgcagggccttctgtagggagtcactgataagggtagtacatctgccaacctccattagccagccgagttgggagttgagggcgagttagcttggcttccatgtgctgaccacattgagtagcacgtgacagctgttttggcatgcactaaatattgtgcttcctcgttaagatatttaccgtatgcttcttacttgctacc

SEQ ID NO: 511842 - DNA, 171 bp, Homo sapiens
ggaccgtgcactgaggaaaaaggattgcttgaggcagttcaaagactagcctgtctctacaaaaaatttaaaaattagccaggcatggtgttgcccacctgtgttcccggaacctcacaggctgaggtgggaggatcagttgagactaccaggtcaaggctgcagtgagct

SEQ ID NO: 511843 - DNA, 310 bp, Homo sapiens
ccaggctggagtgcagtggtgtgatctcagctcactgcaacctccacctcccaggttcaagcagttctcatgcctcagcctccccttgtagctgggattacaggcacctgccaccacacctggctaatttttgtgtttttagtagagatggggtttccccatgttggccaggctggtctcaaactcctgacctcaagtgatctgcccttctcggcctcccacagtgccgggattacaggcgtgagccaccgtgcctggccaacagtgtagaaacttgaaaaacagtaacttacccttctgtcgtcttctc

SEQ ID NO: 511844 - DNA, 787 bp, Homo sapiens
ttttttgggcgaagtgaaactgtgtgagaagatggcccagtttgatgctaaaaagtttgcagagacccaacctaaaaaggacacaccaccggaaagagaagggttcacgggaagagaagcagaagccccaggctgagcggaaggaggagaaaaaggcggctgcccctgctcctgaggaggagatggatgaatgtgagcaggcgctggctgctgagcccaaggccaaggaccccttcgctcacctgcccaagagtacctttgtgttggatgaatttaagcgcaagtactccaatgaggacacactctctgtggcactgccatatttctgggagcactttgataaggacggctggtccctgtggtactcagagtatcgcttccctgaagaactcactcagaccttcatgagctgcaatctcatcactggaatgttccagcgactggacaagctgaggaagaatgccttcgccagtgtcatcctttttggaaccaacaatagcagctccatttctggagtctgggtcttccgaggccaggagcttgcctttccgctgagtccagattggcaggtggactacgagtcatacacatggcggaaactggatcctggcagcgaggagacccagacgctggttcgagagtacttttcctgggagggggccttccagcatgtgggcaaagccttcaatcagggcaagatcttcaagtgaacatctcttgccatcacctagctgcctgcacctgcccttcagggagatgggggtcattaaaggaaactgatgtttaa

SEQ ID NO: 511845 - DNA, 789 bp, Homo sapiens
ttttttgggcgaagtgaaactgtgtgagaagatggcccagtttgatgctaaaaagtttgcagagacccaacctaaaaaggacacaccaccggaaagagaagggttcacgggaagagaagcagaagccccaggctgagcggaaggaggagaaaaaggcggctgcccctgctcctgaggaggagatggatgaatgtgagcaggcgctggctgctgagcccaaggccaaggaccccttcgctcacctgcccaagagtacctttgtgttggatgaatttaagcgcaagtactccaatgaggacacactctctgtggcactgccatatttctgggagcactttgataaggacggctggtccctgtggtactcagagtatcgcttccctgaagaactcactcagaccttcatgagctgcaatctcatcactggaatgttccagcgactggacaagctgaggaagaatgccttcgccagtgtcatcctttttggaaccaacaatagcagctccatttctggagtctgggtcttccgaggccaggagcttgcctttccgctgagtccagattggcaggtggactacgagtcatacacatggcggaaactggatcctggcagcgaggagacccagacgctggttcgagagtacttttcctgggagggggccttccagcatgtgggcaaagccttcaatcagggcaagctggtcaagttcccgtctcttgccttcccctgcccgcctgcatcttccgtgcacgctggtgtgtgtcattaatgctgtttgtcccttcaaa

SEQ ID NO: 511846 - DNA, 620 bp, Homo sapiens
ccacaccacactgaggagcatgcatacgttgtaaaagcgcgtacggcgaatccgggatgtatcagaatagttaagccttaattaactaatatagcttggacacttaaaagagctctaaattgcttgtacataaaggcttaattgttttcctgttagggtcaagggtgtcctccactctttaacagctgctggacagacacattagagcagctgttgttattgataataaaatattataaaactaaaaaaaaaaaaaaaaaaaaaaaaaaaaaaaaaaaaaggggggggggcaaaaacccccgagggccaagtttacccgaaccccccagtttcctgtgacaagagggccccaaatggggagccgataaaaaaccaaggcacgggccgcgttaacacacgccggacggggaaaaccggctacctgggaccctgggaagggaccctaacttcgggggggggacctactgggaccaacactacctacagagattaaggcccaggggaaataaaaccttcaccgtgctcaacgggtacccaacgcgccatatgctggcggctggaaagttggctaaccgggatatgatccgggaaaaattcattacacgactatttaaattaag

SEQ ID NO: 511847 - DNA, 391 bp, Homo sapiens
gaataggcctgtcttattctatactcactagcacaaatatatggttacccccaaactgtttctccaacaaccaagttatcatataagaattaaaatcagttcggtaacgtgtttgatctatataactaaaccagggctaaaggggtaacacactttacaatgacttctatcaaaaccattatttaaatcattaattcaaatcttcagaatcttaaaattatccaaaattactcgaatattttggtcatcaagaaaaatacacactcatcaaataaagcacagttcagctatacaaataggataccatacagctgcaaaaaaaaaaaagttgtttttccaggtatggattaggagaaacaaaaaccctgtgtattggaaataaaaggcaagg

SEQ ID NO: 511848 - DNA, 236 bp, Homo sapiens
cattgggggcaagaggcgttgggattggggatttggggtgagattggattgggagccccgctgggaggcttgttctttccctgaaacatgaggcctgggggagacccacccctgttgcccacttggggcccactgtgccgcctacccccacgtgtttcaattttgatttccaaaaatgagtttggcaggatgccttgaacaggaatgcaaagagctgtggtgggccggaagaagca

SEQ ID NO: 511849 - DNA, 313 bp, Homo sapiens
cggcacatggtatcgctacttatgtgcttctaagcagggatatcagttcatctatgtcttaattgctctgtcgtccaaggcaggcatatggttcaagcaaagacttgcaagtatgccagatgaagtgtccacagcccacctttctgttaggtgatcataagcttagagactgcaatgggaagagtggacgtaaacagaagaaaggaatggaaggacaattagtaatgtcatttgctgacagcgatccaccttacatgaaattgtaacaaaaaaaaaaaatccaggtgaatggccaaaatggaaaacagacgag

SEQ ID NO: 511850 - DNA, 433 bp, Homo sapiens
  misc_feature (11)..(11): n is a, c, g, or t
  misc_feature (110)..(110): n is a, c, g, or t
  misc_feature (129)..(129): n is a, c, g, or t
  misc_feature (203)..(203): n is a, c, g, or t
  misc_feature (213)..(213): n is a, c, g, or t
  misc_feature (294)..(294): n is a, c, g, or t
  misc_feature (298)..(298): n is a, c, g, or t
  misc_feature (315)..(315): n is a, c, g, or t
  misc_feature (317)..(317): n is a, c, g, or t
  misc_feature (334)..(334): n is a, c, g, or t
aattcggcacnaggcaatggagcctgaagagttcggcgcagttcctggggtctccacagctgaggcaggttggtcagatcattagggttcctgctcggatggcggcgacntgaatcctggagcctgcgngccgctgctgctgggacgaaccggtgcgaatcgccgtgccggccttagccccggagcagcccgtcacgctgcgncgtccctgcnaccgagaagggcgcctttttccaggcccacgcgcgctaccgccggacactcttggcgagctggacctggagcgcgcgcccnttgngcgcggcaactttcgcngnggcttgagccaatgggnttgcctcctgggcctttggagcccgaagaaaccttttggttgcggctggtgaagcgcgacgttgcgaacgcccttggccgtggagctggaggtgctgga

SEQ ID NO: 511851 - DNA, 121 bp, Homo sapiens
  misc_feature (106)..(106): n is a, c, g, or t
agtcagctcccccaagatgagctgcagcccccagagagagctctgcatgtcaccaagtaaccaggcccagcctccaggcccccaactcctgccaagctctccccgnctctggatcctgcac

SEQ ID NO: 511852 - DNA, 358 bp, Homo sapiens
  misc_feature (1)..(1): n is a, c, g, or t
  misc_feature (16)..(16): n is a, c, g, or t
  misc_feature (21)..(21): n is a, c, g, or t
  misc_feature (93)..(93): n is a, c, g, or t
  misc_feature (137)..(137): n is a, c, g, or t
ngtctgggatatatanagcanagtaaacacaaggaactcagtactgtgtcattcctcgagtcacaagatcactggttggtctgcctcatcctntctcagaggctccctgtgttctccttatgtatagcacaggggtnttagttgtagttagaagaaagaattaaaaagctttttattatgaagaattccaaactaggctggacacagtggctcacacctgtaattccagcaatttgggaggccaaggcaggtggattacctgaggtcaggagttcgagaacagcctggacaacatggtgaaactccgtctctactaaaaatacaaaaattagacaggtgtgatggtagatctcgtgcc

SEQ ID NO: 511853 - DNA, 517 bp, Homo sapiens
cggtgtcgacgatgagcatgccgcggctttggaggcgagttacctggtcattgatggacaacaaggcttgaccggctggggcacccgataacggtatccacaaaagaaatccggcccacttccgagatgactctcggtgcgggccgaacgattgatctgagtgtagcagcggtggtcgcggtgtgccacgcgtctggacagcggcgccgctgcgcgatgtaggttgtggccgcgcaattcgccccgaaaacctacaccggtggtgcgatttgagacgcggcgcagaggggcgccgggtcggcgtcgggggggaacaccttgaacagttccagcctgccgtcactacgtttcaacagtgcttccccggtcctggtgagtgatgtgtccgccgcggcgtcgccacccagcagcgcccttaggtccgtccggtgattgaggcgctggatcaccagttgagggcatttggcggcggcagcttcggcccaaaagcccggttggctgaagatccaaaggtgca

SEQ ID NO: 511854 - DNA, 279 bp, Homo sapiens
  misc_feature (96)..(96): n is a, c, g, or t
ggttccccctggtcccaaatttttttcccagtacaccagttgttcctcccccacctcagccctttcctgcatcctcctgtacccgcaaagaagggntgggctttccccccctccctccttagcaggggccggggtgggaccccatacgggttggtttcccctcctcagtcccttgcctaccccagtgagagtttgattttgtttttattgttattgcttttattattattgcttttattatcattaaaactttagtttttgttttgtttttccgaatga

SEQ ID NO: 511855 - DNA, 1394 bp, Homo sapiens
ggttggggctgacagaagggactgtgagctaatgtcctggttcatagtagaagctcatttggcccagccttgtatttctccctccacgaacatccaacctgtcgtgctgcactccaagacacgtgaggggaaacggcagcagggacaagtggccacgggacgggcttcaggagcgatccagactaaggatggccagatctttcgtcctatgtgagcacgtgtgagagtccaacaagtagttgtgctaagagccaaggacgtggcatcgtgagcaaaacatcagggacttcgtgagatagcccatcctagtagtcccttgatccttacatgacggggttccccattccctgaccaatgatggtctagtacatggagtcacggtcaacaccatagaacctggacagggtaaggacgacctaggtgtccttgacacactcctaggggcagagctcgggcgtgcgagaacactgggtggccagcagcataagagttctagctgggccatttgtcctcggggtgatgcgcggcatctcacacattatcacctggactgtacaggatccaggacaaagccactcaaagctcatctgaggcctgagaacccattgtaggccattgagacactcgagacaagcataaatgcgcccaatatggcccatttcaaggcattcgaggcactgggtaacaaagatacaattacttctgctacacattacgcctggtgaccgtgggcccaacaggaagctagaaaccacctactggaactccatattaccatcctttggtagaattaaacgacagggaattaatggcccatcaacgggacgcccagtgtacatttaagacatgtagtggggttccaatcttaataaagctaccagcttgaacacagtgttggactgtccacacacggagcaagggtagccaccaaagaaaacatcgtgggaccaaccacaacgaggcaagactcagaaaagtgaaataaaatacctatggcccggtagaatacccatagtcgaccacccacacccaattaaatataacaaagcacaccaattacaccacacacaatagacccagaagaacaaaaacaaaaatacaaatacaaaaaatcaaaacacccactacaactctaaccacaaacacttaaccaacatccaataacacaccgcaagcacaataaaataactccagactacacacttccataaacaaaaacatcgtcatgactcttataacctatccccaaacaatacacaaaccttaccaccaatagtaacacacaataaaaacaaaaccaccagatcacccaatcaactaccctcaataccatacaactcacatcaaaccaaaaaacagttgaccaccacatcatcaaacataaactccgacat

SEQ ID NO: 511856 - DNA, 137 bp, Homo sapiens
tcaaactcgtacaaggattgcataacagggctggatgagcaggttatggggctggggggcctggagttggggtccccaggctgagggtcatggttgtgtgtcttcgaagggaaacagggtcctggtatcctaagggt

SEQ ID NO: 511857 - DNA, 206 bp, Homo sapiens
agaataagcattttggaaaatttaacacccttatatgactaaaaaaaacaacaaactagaataggagaaagtacctcaacataataatgtcatcatgtatgaaaatgaacggtgatcattatacttattggtcaagactgaaatagtttctttgagataagaacaaggcaaggatccttccttttggaacttgttttacacatact

SEQ ID NO: 511858 - DNA, 494 bp, Homo sapiens
  misc_feature (317)..(317): n is a, c, g, or t
agactcctgacctggttcaagtgatctgccttcctcagcctccgcaaacagcggggaccataggtgtgagccaccgcgcccagcctcacttaaaaaaaatttatccgggggcacatacttcaaaaagctgtgacaaacacacttcctggtccatgaattatataacctagaggggcagcaggctgctgtaaccggggacggggatatcaccttcctcccactctcctcatcaatctaacttggcttccggctttcctagaacctagagcagctcgggcactcccctttccttcatccgcaaatcacccaaggtcggnaagccccacagtgagtatctaaacttttttttttttttttacaagagggggtcgtggctcggccaccagggcgggagtaggggggtgccatcataggtcacggcagcctccattgcgggggcccaagcaaccctccaacctcagcctcccaagtagcggggaccacgggcaggcacc

SEQ ID NO: 511859 - DNA, 304 bp, Homo sapiens
aggaggagaagttaggaatatgtacttaccagcggactcataaggcagtgattggataggaagaggaataaatataaaaatcagagaacgctgaaattctgtgacccctttttagttaaaaaaaaaaaaaaaaaaaagaaattttactccatttaaaacccctttaaaaaccaaaatttttcccaccaactgtttggggaaaaaccaagagctataaatcaaaaaccggcttccagcaaaagagttagtcctcagagtagggccagctcagcggatacggggactcgggtccggctaatctccg

SEQ ID NO: 511860 - DNA, 198 bp, Homo sapiens
  misc_feature (36)..(36): n is a, c, g, or t
  misc_feature (39)..(39): n is a, c, g, or t
  misc_feature (74)..(74): n is a, c, g, or t
  misc_feature (76)..(76): n is a, c, g, or t
  misc_feature (95)..(96): n is a, c, g, or t
  misc_feature (99)..(99): n is a, c, g, or t
  misc_feature (109)..(109): n is a, c, g, or t
  misc_feature (115)..(115): n is a, c, g, or t
  misc_feature (119)..(119): n is a, c, g, or t
  misc_feature (181)..(183): n is a, c, g, or t
  misc_feature (192)..(192): n is a, c, g, or t
ctgctctggtccgcctcggcccggcggcggccatcnggnccctcggcctcggctcgaggggcggggagctgcgngngcccctcggtccgaccganncgnggggctgggngcccgngcgngcgccccgggcccgcgcccgcagtccgccccgcgcgctccttgccgaggagccgagcccgcnnncggcccgcncgcccg

SEQ ID NO: 511861 - DNA, 362 bp, Homo sapiens
ccagcagtgggatcaacggtagcggctggttgggctaacgtagcgctcactgcgattgctactggagcagcaagtaatgcaacgatcagctttatcaataacggcggcaaccttggagctgtactcaaggatgtgaccgcgaagggagcgctgcgtgactatgtcgtttcgggagtcactgcaggactgactgcaggcttgttcgacaaaatgacgggaacaactaccgcggtagaaggcgcgttgccgaacgctggaaaggtgttggccgaaggtgggttgtcgagcctggaggggattggtcgattcggggctaaccagttgctacagaacggaacatcaacattgctggaccgggcact

SEQ ID NO: 511862 - DNA, 1091 bp, Homo sapiens
caaacattttgctgctgcctcagtggaaagtcagtcccactagacgtccaggttaccagaacaccatatcctgtgccctgggtgacgggaatagcgaggaccctatggagagcacgcatgttgctgcagaggatacctgccaggaagtgtctcatgtgaacgctctaggagatcaagagatttcatgatggccagattaggacaggagagagcaactagagatacgagtccagcgcagacgatgtgcctcgaaccataccaagagcatctcaaggctccaaagtgtcgcccgggcctacctgcaaggaacattccttggccctgccgcgagctgagggaggctctggccattgggacgtagtcaaggccatacccaaacccatgagggcatggagccacatgagggccccaaccgtgcggcatagacagcctggccccccaaacatagaacctcccaccaaaagcaagaccgttatgcccggtgacccgccgcggaccattgtggcaatccactttcgtgggctccatggccccagcagtggctaccgggccttatcgctggccaccgaaagttggctttccagctctctacagcgcccatgcctggacacgtgggcgctaaacgcgggtactcccctgcgctgcgttacaccccttcactttgccagtagtaacagttgcgtcgtgccccttccgccagcctctggtcccacggctcccttaccattggggggctaactaccgttcttcgaacacccgccctttcaagctcgccccacgtggctctatcaatgtcgcggtcctttacagtgcgtcgcagtcccttgtagctccacgggcaagcagcgcgcaacacggcaatacaaaggacatcctcatccggataggcattggcccccaacgaccactggcatccacaggcattagggggataaaaccccccaggagaatgactagtgtaccccccaggaggtggagcccattcaagacacacagccaaacagcgcttcgtctaacacatcggcccacagcggcgactaaacatggtccacggagaagttcatcgcaccacacgagacatccccatccat

SEQ ID NO: 511863 - DNA, 108 bp, Homo sapiens
ggcgtttatgtgactctgtgtgtgtgtgtgtgtagtattctgatggcatggttatataaacactataccaggagaaaaggaggtgtttacctgcccacaattgctggt

SEQ ID NO: 511864 - DNA, 365 bp, Homo sapiens
ctttacttccattatctcacctccttgtcacacctcctccacctgcaatggcctgcaatgttccctgtacaacgtatcactctgggtgacacccctggttcaccctaatcctcaatgcgctatctgctgctgaggggaaagcagtttgggtaggtgttatcatactacttgatgtcgggattgacctacgacagtatctccccaattggttgctttttaatagttcaccagtgcgtatatatatcatttgcttctaaatctgcttcgtaatcacacacacacacacacatacagcacacacgcacacccacaccctctcgaacctggaacagtatcaagggtaacagtgctcttcaaccttaact

SEQ ID NO: 511865 - DNA, 183 bp, Homo sapiens
ttagcagcaatggcataactgggcagaacattggcattttccaatgatgacgagggctgagggggtgtgtaccccaatctatcagcacacaactgcctacttggtggaagtcagctccgtccttctatgtactatggcacagcgctcagcacagcccatccaaccccttgggtaggaagtctc

SEQ ID NO: 511866 - DNA, 500 bp, Homo sapiens
agagacagggtttccccatgttgggcaggctggtctcgaactcctgacctcaagtgatctgcccgccttggtcttccaaagtgctgagattacaggcatgagccactgtgcctggcccagagcagatattttaaacatgacgaattagatctgcatgattcagaatattgctaacctatcggctctaacataagaaacaaggtggcaaaagtaaaacaaccaccaaagatttttaataactttaagacataactttaagataccagttaaagaaatgcctcacggtagttgataattgctaaaagaagagccatgacaattaagttgtaaaaacagattgaaaacttatacttccaacctaacagaatagttggtataggatttaccctagcaactagaaaatggggcggcatgtatgaaactactcttttcagatattacacagcaggcaatgcaggactgcgatccctagaatatagctgtcagctaaatatacaaaa

SEQ ID NO: 511867 - DNA, 130 bp, Homo sapiens
tcgataaggcaatcagcttttcaaattatgtgtgtgtatacatatgtatgtatgtgtgcgtgcatgtatgttgtgtattattgtgtagtattttcctcctctctctccctcttttgctcgctctaaagag

SEQ ID NO: 511868 - DNA, 515 bp, Homo sapiens
gaggtggggcaggaaatcacttgagcctggaagacggaggttgcagtgagctgagattgcaccaccacaccccagcctggtgacagagtgagaccctgtcccaaaaaacaaaccgaaacaaaacaaaactagactaatattttgaagacttgatggacttgggtgtatactcacaccagacttttgggtaacacaaagtgttccaatgtaactttgctgcaaattaattcaatttgtcttaatttcggtgggtacatagtggtatatatttgtatgaggtacatgcgcacattttcatacaggcttgcaatgtgtaagaattcagatcatggaaaaagtggggtagccatgccctcagggattaactcctatgtgtaacaaaccatccaatgatactctttaagttgtttaaaagtgtagaattaaatcattgactataataagctctgtggcgctatcaaatactaggtcttattcatacttaactaactattattggtaccattaaccatcct

SEQ ID NO: 511869 - DNA, 119 bp, Homo sapiens
ctgatggcttgtgtctttgacaggcatcactttgaagacattttttttaaaccaatgttcaaaactgtgcacaccctgaaaccatatttgaacttatttgtatggctctgatcgggtac

SEQ ID NO: 511870 - DNA, 211 bp, Homo sapiens
tctgcaccttcttgtgcaaggaagtccttgcctaaagccttggttctcaaactgggttccttgggactccgggtggggggttccaggaggcacgtagggtacttgcaggtcctggaggaacccggattccggaggatcccggaactgtggcacccattttctgtgtctcccagcccatttccactcctagtttgtcatggataatttttgt

SEQ ID NO: 511871 - DNA, 82 bp, Homo sapiens
tggagtaatccagttgcctctccttctaggaggagatgggtcataaaatttgtattgatccataattttctcttctagtttc

SEQ ID NO: 511872 - DNA, 417 bp, Homo sapiens
catgtcctatccgtgtggtgcccagctcattgccgtggcacggtcaggaatagagggcgtgaccatcctttgtatggtcaaacctagcccttacgcccgtgctgataagggagagaagctgccccgttgtacacgtccaacaacctctgggtggtgctcatgagaccactaggcaagttaagcgaagagctacagggctagcgggggctccctagagggcagcttgacacagaacgatgaggggccatggggtcgccccaggggagcagaggaaggagaatgggcaggacaaatcgtccaggtcactggggatgcaacagttgccagagcggtgcctggtgccacaggaagcccaacatgactctggtccatgctgcccaggggactctccagacacagggcctcaccaggcctggc

SEQ ID NO: 511873 - DNA, 299 bp, Homo sapiens
agactcttacgaggatccccgcacgacacgggcgactccaggccagaggtaccctagcgctgctgtgctgtgttcactgcccacttcagatctgcgctagggaaatgggctttactccctacattttggcacgcaaatcctgctaaagatacagattagaaggaaatgggggcaggtgccagtggctcaccatgtctactacacatacaatacgtagcccgtgctgcactgtctcactcctggtatcccagctatacaggagactgacgcaggacaatccctttagcccaggaagctga

SEQ ID NO: 511874 - DNA, 316 bp, Homo sapiens
ggatcgggagatcctgaggggcggagatcctgaggaagacctggagtggagttaggggacggaatcagagaagaggtcggatcttataagaacttggcaattttcctctgactgaaataagaaaccagcagaagatttagagtccaggaatgacaggttctgacatacattttaaagattcctctgtttgaggcaacctatagaatgggagaaaatttttgcaatctgtccatctgacaaagggctaatacccagaatctataaagaacattaaaaaatttacaagaaaaaaaacaaccccatcaaaaagtgggtg

SEQ ID NO: 511875 - DNA, 157 bp, Homo sapiens
acccctttagtgctagatttgggccatccataaactggttcaaatttctttgctgttagatgaaacacatttcttccaaaaaaatttctaatgtcacttttgcacttttttaaacaaagtatgtttaacctgttgggctccccagaaaaaaaaagaa

SEQ ID NO: 511876 - DNA, 395 bp, Homo sapiens
tttttttttaaacagacaaagcccacatcattgagtctggacaacataactctgccttgtgttgatagaatatcgaattaacattggaatcgtcttacctaagtgatttaaattcaacaaaattgacaaagacaaagcctgagcaactcgtctcgaccaatgatttataatacactagatgactttcgggggtgttgttttgaagtcactgcgcctccatcttggtactccctcacattgtaaaaaagtatttggaagctataggaatgcatttactaatgtctacatttgtttttgccgtatatttattctattacagacaccttaatacataccttgaaattatattatgtcagctaaacatccaaatattagtcgacgcggccgcgaattta

SEQ ID NO: 511877 - DNA, 347 bp, Homo sapiens
  misc_feature (12)..(12): n is a, c, g, or t
  misc_feature (43)..(44): n is a, c, g, or t
  misc_feature (126)..(126): n is a, c, g, or t
  misc_feature (159)..(159): n is a, c, g, or t
  misc_feature (298)..(298): n is a, c, g, or t
  misc_feature (330)..(330): n is a, c, g, or t
tgcttgtttcgncaaggcgggtttttggccgccgagaacacannggtgtcgtggaaagaagcttagcccgcttaaaacaggcccaagaaaatggggggaaaaaaggggacaacaagaactcatatncaacattgtcgtcattggacacgtagattcggngcaagttcccaaccaaacttaacttggggccatctggaattcttaattaaaatggcggtggcatcgacaaaaggaaccatttgacaaacatttcgaagacaggaaaggctggctgaagaatggggaaccagggcttccntttcaagtttatgcctgggggttctttgggcnataaactggcaaagctg

SEQ ID NO: 511878 - DNA, 182 bp, Homo sapiens
ccttggggggaaggctcccttggtatgtgggagagggcttttaacaaccaaattaaccccaaattcccgtaaagttggggctccgtaggccgtcctccttgcccgttgggctccccaaggggcctcctcccctccttggaaccggccctccttgtctttggattaagtcttaattgggggga

SEQ ID NO: 511879 - DNA, 234 bp, Homo sapiens
cccggaggcgatcatcagactaacactttacacactgagttacatttcaaaagacagatctgtaccaggggggatgcctcacgcgtgtaggggcagcactttgtcagtcccaggagcgcggatcacgagctcaggagatcgataccatcctggctaacacagagaaactctgtctgtactaaaaatacaaaaaagtagctgggcgtgatgacggagcctgtcagcccagctact

SEQ ID NO: 511880 - DNA, 439 bp, Homo sapiens
cttgagagagagaacgaattcgttaaaatttgtttatttgccatcctatcataatatgactacctaggggaagaataattaagtggagtcattaactggtgtatttaccacatctttgagcgggaatcataattattggtcttacctggatgtataccaccctcagttgtcccgcagtaagcccacccagcttctctatgttaattttcaagaccatctaagtcttctagggtaatttagtccactacagtagctttacagatcacacacatgatagttatggcgcagacctgtatctccttccttaatattgcgtaatagcatctaccggatatatccagctgactctaagactcccactcctaaatgtcctgcagctccctctaccttaaaatttccaaaactatgtcaattctcttctcttctaatcttgtttttc

SEQ ID NO: 511881 - DNA, 919 bp, Homo sapiens
gcaaacgtgtgacgatgatttaaacagggggtgcacacattatttggtcccctgccttacttgcgcgaaaattcaccccggttagtgtagaccctttccactatggtaatacaccgcgccgttacttctctccagggtccccagccttagctattctaacaaaggggggttgtaataaacaaggataagtgcgtctgttccaaatggtgccgcagtacaccaccgctcgtgaaaaaatttggcgggtaaaccccacccccttgcttctgggtccgctgaccaacaaaatggttgcaacttcattttgttaagaccccaaacactatattgcaataggaactattccctccccccgtgcggggcttctgttcctcaaaaccccccaaaagggttttccaaccctcgcgtttctctccccagaaaaataggaaaccattattattatataataaacaacaccccccgagagtctctggagatatattgtcttataaacccacacataacttcgccattgtctattccccctacacatttcacactcttcttttcaaaagtcaacaagtcagataaaccagtcggttctaccaaattcccatggggaagacattaaaccacagatccctcagcgaccggttcactaaaataaaatccgtgcctcttgctaaatcccttctccccatgcgtataatatttcttcacaagatcttgttcttcagcaattaggtaccaccaccaaccgggtcaacatactcacccgttttcccacaaaagggaaatcttcttcttctaaacacaaagaacataaatagggtaaaatcttttggtggctataattttcgtgatgttcatgcaagcaccaacaccaattttttttaaaaaaacataggcctgttaaaaatggaaaaaaaacaaaaca

SEQ ID NO: 511882 - DNA, 573 bp, Homo sapiens
  misc_feature (31)..(31): n is a, c, g, or t
  misc_feature (70)..(70): n is a, c, g, or t
  misc_feature (74)..(74): n is a, c, g, or t
  misc_feature (80)..(80): n is a, c, g, or t
  misc_feature (90)..(90): n is a, c, g, or t
  misc_feature (106)..(106): n is a, c, g, or t
  misc_feature (127)..(127): n is a, c, g, or t
  misc_feature (186)..(186): n is a, c, g, or t
  misc_feature (225)..(225): n is a, c, g, or t
  misc_feature (251)..(252): n is a, c, g, or t
  misc_feature (254)..(254): n is a, c, g, or t
  misc_feature (261)..(261): n is a, c, g, or t
  misc_feature (264)..(266): n is a, c, g, or t
  misc_feature (268)..(269): n is a, c, g, or t
  misc_feature (271)..(271): n is a, c, g, or t
  misc_feature (280)..(280): n is a, c, g, or t
  misc_feature (282)..(284): n is a, c, g, or t
  misc_feature (307)..(308): n is a, c, g, or t
  misc_feature (372)..(372): n is a, c, g, or t
  misc_feature (503)..(503): n is a, c, g, or t
  misc_feature (539)..(539): n is a, c, g, or t
aggatggggtaaaagaacctaggcagcagangcagctgatgggggttcgggcccctcttcaagttcagcnagtncctgantgaggtcatnccccatcgtcctttcncctcgaaccccacctgaactnagctgaggatcttccggggcagttcaacagcagcacggatgaagaatgcatcatcccgnacatagtttcgctttcgaatgtcctggtgggagatgaanttggggtaacaaagaacagagatttnnanccagggnttnnngnnanggggggggngnnnggaaattcttccagtttgggtcnnggtggaaggtctcagtgacgtgctgtggtttagccagcccagggtcgctctgatccagcagggngaaggtgacacggcgggcaaagggccactcaaggagattgtcaaaggcaccaggcagcacacgaatgtacagtgagaggtgtgtgccctcaccactgccattgccattgaggaatgcagacacctgcagcntgtaaccatacttatgtgtgtagaaggctgggctgnagcactcaaggttgggcttggctttggctcctgt

SEQ ID NO: 511883 - DNA, 1124 bp, Homo sapiens
tggtggtggtgtacttgttatatttatttggaaaccagtttaaggggatacaaccagcatttaaaaaatgaaatagaatacagcatggaaaaaaaaaaaaaaaaaaaaaaaaaaaaaaaaaaaaaaaaaaaaaaaaaaaaaaaaaaaaaaaaaaaaaaaaaagaagaagaaaaaaaaaaaaggcaaaacaaaacagaagaaagggagagaagaaaaaaaatacgagaaaggagaggatgagaacgaaccgggaggagcgaactagcaaacaaggcagatcgaacagggaggaatggaaatgcactgattcagatcggaggcgagcgcgcaggacgagcagggcggggagaaggtctctgcacgatgcagcgaggaagctgcaggcgagggcgagggcaaccagaggagcgcgagcgatagagcgttgagaggtgcagagatggtagatcggcggaggccagcagagatgaagaactgaggcgggatccttgacggaaggtcatcgaacgagcgaaagagtcagtcgagacgaaagaatggaatgtgattagagaaaatcgcgcaagacgtagagcagagcgttcagggacagaagcacagtcgagaaagtaggcaagagaagataagactagaaagaaagagaagagaagggagtacgggggtgggagcggtgtgagccaaggagaagagacaggagcagtgaatgctcgacgacaggcagccgaaagaacgacgagaggagaaagaagaagagtaaggaagagtagtggagcgagggaggggcagaagggtggcgtagagggataagacgagaaaagcgagtgggacttgctgacgtgtaaaggagagggggggcggaaagaaagggagaggcagagggggatgagcggggttcgatggaggggggggagtatgggatgaaaaggagagggggaaggaaggggaggaaaggaaggagtgagagagagaggggcagagaggagaggagggcagagggaggtagaggaagggtgagaggcaaagaggacgagacggggagggagagagcggaagggtaagcgaggaggacggagaaagagagtatcaggtggaggtggggggaggaggaggatggagagttgcaa

SEQ ID NO: 511884 - DNA, 373 bp, Homo sapiens
  misc_feature (312)..(312): n is a, c, g, or t
  misc_feature (360)..(360): n is a, c, g, or t
ttccagtaaacattattttattttatgacactctgcattaatacaataaatatacaaaacttccaaaccactgaaaacatgcaacatgagagggccacatggagggcgtttacacagaaccgtgacataccacaggggcagcgcagtagtacacgcacctacacaatacacaaacatccctagagcaatgaaccgagccccaaatcacaaatcaccaagcaatccgtttccagtgatcagacccgagttttaaataaaacagtcaccatttaacatcgccaactaaagaccgtgacatggatgcctggtccntcgtgcaagctcggtctcatgggctggcagtaacattgggagttggantaggagacggtca

SEQ ID NO: 511885 - DNA, 167 bp, Homo sapiens
aatcaacctggggttcgaaatcagtgagacctggattcaaattttgccttgaaaaattgtgactttgggaatgacaacacctggtttgttttttgttgtatccccagccccaaagacaggtcctggccaaatatcaaggtttcaataaaaatttgctaaatgagtga

SEQ ID NO: 511886 - DNA, 288 bp, Homo sapiens
gaggcaacccagctgtgtgagaagcggctgactgtggtgcttgcgtggtgagtgagcgaggaggactgggcaccatgtgggcccagttcccacttcgggaatctctctcgcagaaccgaggtccccttcatgggggtagatgcccagggctagctgttgccactgtctgtgtggacctgagtcctgaacatgcccgagtgactcaaggagtggctgcttggggcgggcttctgtcaccctaggatgttatacattctgggacctggacaggagtggcttgccttgggc

SEQ ID NO: 511887 - DNA, 1169 bp, Homo sapiens
agttgttggtaaaaacaagtgtttggagacctgcacgcgtgtgcgcagcgatttgtcttcctccatatgggtcactactttctgatgtcctcatgacctccctgtggcaacaaaaagaagtccggtgtgcgtgccaggctctatctgatatgaaggcttgtttacagtgatcgggtcttctcccgcgcaggctaacagtcggtgccccttaattggcgttaacccttcattaggccgtgaatgaacggccccttcaattttttgggccctcctgaagaccctggtaggctgcactcagctgtagcgacgtagtctaatccggctgcagctgacccgatcgtcctggttcgcctggcggttgagtcgcccacgtatagcggttcctgcggatcccctctgctgccccaggccaggcccacctgccctttggctccccagccacgtgaccgtaagcagcacctccagatggcagggaagctggctcccgcggagtaaccccagggttccagccagaagccaggtctcaggctagaatccagctcacagtccctggcagctgcccacagaaactagggtagcagcagccatagaaaggacagaatgagctcatatcctttgcacaccgtggatggagctggaggccgtgatccgtaagtgaaccaacccagaaacagcaaatgaaatgccaataagagggaactacaggatggttcacgtgaacgcaagatggagaacagggacacgggctccagggcgtagagcttgaatgactacctacagggctacagtgttcgtcgctacttggtgtcaggcccactagaacaagggtccccaaccgccaggctgcggaccggtaccgtggcctattaggaaccgggccacgcagcaggaagtgagcggtgggcgggcattgcctgcacggagaactgcaccgtcaggtcagatggcagcacggcaactagatttctcccagcgcacgcacggcgctaagggataccaggctgcgcgctcctgcatgacaatcgttaatgcctgatgatcgggggtggacagttttatccctaaaccattcccgtcaccccagtactatggaaagacttgtcttccacagaaccagtacctggtgccaaaaaggactggggaccactgcctagaaggcaaatcgccta

SEQ ID NO: 511888 - DNA, 194 bp, Homo sapiens
ttgagatcccatcagcagtcagtcagatacaatctcaaaacataggagataggcaggtgcagtgacttatgctgtatccagcacttggaggcaggggcggtcactgaggtcgggagtcagacagctgacaatgggaacctgtctctataaaatacaatagtaggtatgagggcatgctgtatcccagctacttg

SEQ ID NO: 511889 - DNA, 258 bp, Homo sapiens
gccctgacagtttaaagacctctgaccagtgtacgacaaatgtgctgacttcatgcagaaagacgtaaataatggagaatgctttcgtgctgaccatctattaaaagctcatttacagaaattgatgtctgacaagaagagctctgtcgaaaagaaatcagaaatggaaagtgttgttgcccagcttgataactatggacagcaagaacttgcggatctttttgtgaactataatgtaaaatctcccattactggaaa

SEQ ID NO: 511890 - DNA, 158 bp, Homo sapiens
ccggcatgtaggcagatcatggtgactacataacttgtacaagctcaacggctagtaagtgacagagccataatttgaacacaagagaaagaatcaacaccaaggccgggcgcggtggctcacacctgtaatcccagcactttgggaggctgaagtgg

SEQ ID NO: 511891 - DNA, 214 bp, Homo sapiens
ctacacgccaaggtgatctgcgattgctgcaatgggcctgtggtagtgaacccgctacaagtgcagtgtatgcccagactacgacttgcgtagtgtctgcgagggaaagggcttgcacctgtggggcacaccaagctcgcataccccagccccttcgggcacctgtctgagtggtattctcgcacagcctgcttggatccggcaaggtgaaaca

SEQ ID NO: 511892 - DNA, 137 bp, Homo sapiens
  misc_feature (70)..(70): n is a, c, g, or t
ggctatacattatcaagaacagactgtgatactggagagcggctgaatgcaatggagtgtgcattacatntggaaaaaaatgtgaatcagtccactactggaactgcacaaacttggcactgacaaaaattgacccc

SEQ ID NO: 511893 - DNA, 251 bp, Homo sapiens
  misc_feature (123)..(123): n is a, c, g, or t
  misc_feature (181)..(181): n is a, c, g, or t
ctagttttagaagtttcaatagcataaagagacagagaaaaaaggtaagcctatctcaagctacagaatggagggcaactagaaccactgaaggggcttccataattccaaatttagaattgngaataaaaataacagaagggcctcagatttcgtcttaattgtgaccagctttctgggnttttgggtgtgtgggcctgcgttggatggtgacacagaggccccatgacgtggggctattggaaacttct

SEQ ID NO: 511894 - DNA, 475 bp, Homo sapiens
  misc_feature (423)..(423): n is a, c, g, or t
accagtctgaccccattgccacggtgacctttggcttatttcttagcaatgattgtgggcttcctatgggcaggtactcagctcctactggatgcttgtgtggaagccaacgtgccaacattcatctacagcagctcagtgcttgtggctggaccaaattcctacaaggagatcatcctgaatgcccatgaggaggagcatcatgaaagcacatggtctaacccatacccatacagcaaaaagatggctgagaaggcagtgctggcagccaatgggagcatcctgaaaaatggtggcactttgcatacttgtgccttaagactctctttcatctatggggaagaatgccaagtcacttcaaccactgtgaaaacagcactgaagaacaacagcataattaagaaaaatgccacattctccatngccaacccagtgtatgtgggcaatgcagcctgggctcacattctggcttgcc

SEQ ID NO: 511895 - DNA, 687 bp, Homo sapiens
  misc_feature (635)..(635): n is a, c, g, or t
caggagcaggagggtttcttggccagaggattgtccgaatgttggtgcaggaggaagagctgcaggagatcatagccctgttcaggaccttcggtcgaaaacaggaagaggaattgtccaagctgcagacaaagaccaaggtgacggtactgaagggagacattctggatgcccagtgcctgaagagagcctgccagggcatgtgtgctgtcatccacaccgctgctgctattgacccccttggtgccgcttccagacagaccatcctagatgtcaatctgaaaggtactcagctcctactggatgcttgtgtggaagccaacgtgccaacattcatctacagcagctcagtgcttgtggctggaccaaattcctacaaggagatcatcctgaatgcccatgaggaggagcatcatgaaagcacatggtctaacccatacccatacagcaaaaagatggctgagaaggcagtgctggcagccaatgggagcatcctgaaaaatggtggcactttgcatacttgtgccttaagactctctttcatctatggggaagaatgccaagtcacttcaaccactgtgaaaacagcactgaagaacaacagcataattaagaaaaatgccacattctccatngccaacccagtgtatgtgggcaatgcagcctgggctcacattctggcttgcc

SEQ ID NO: 511896 - DNA, 381 bp, Homo sapiens
actctagaggaccccgggcgcgtctgcaggctattggttcactgcagtcaggctgatggttcgcatcaatacactagtcatggggatacgggggtgtaggtgtgccttgtgataagaagtgggctagggcatttttacatcttagagcgaacgcctataatcactgcgcccgctcataaggggctggccatggctaggttaatagatagtggggtggttggtgtaaatgcagtcacaggcaggcagtccgcagaaggtatcagtagtggcactacagcaacatgcattaaggcatactagtatcaagagcatcaggtccgtccttacagtgttgtgtatggttatcattagtataggaggtaggtaagatcagtcatggtg

SEQ ID NO: 511897 - DNA, 743 bp, Homo sapiens
  misc_feature (1)..(1): n is a, c, g, or t
  misc_feature (4)..(4): n is a, c, g, or t
  misc_feature (11)..(11): n is a, c, g, or t
  misc_feature (59)..(59): n is a, c, g, or t
  misc_feature (79)..(79): n is a, c, g, or t
  misc_feature (89)..(89): n is a, c, g, or t
  misc_feature (111)..(111): n is a, c, g, or t
  misc_feature (115)..(116): n is a, c, g, or t
  misc_feature (124)..(124): n is a, c, g, or t
  misc_feature (142)..(142): n is a, c, g, or t
  misc_feature (144)..(144): n is a, c, g, or t
  misc_feature (158)..(158): n is a, c, g, or t
  misc_feature (163)..(163): n is a, c, g, or t
  misc_feature (224)..(224): n is a, c, g, or t
  misc_feature (235)..(235): n is a, c, g, or t
  misc_feature (247)..(247): n is a, c, g, or t
  misc_feature (254)..(254): n is a, c, g, or t
  misc_feature (273)..(273): n is a, c, g, or t
  misc_feature (282)..(282): n is a, c, g, or t
  misc_feature (388)..(388): n is a, c, g, or t
  misc_feature (401)..(401): n is a, c, g, or t
  misc_feature (427)..(427): n is a, c, g, or t
  misc_feature (467)..(467): n is a, c, g, or t
  misc_feature (502)..(502): n is a, c, g, or t
  misc_feature (504)..(504): n is a, c, g, or t
  misc_feature (547)..(547): n is a, c, g, or t
  misc_feature (551)..(551): n is a, c, g, or t
  misc_feature (581)..(581): n is a, c, g, or t
  misc_feature (595)..(595): n is a, c, g, or t
  misc_feature (608)..(608): n is a, c, g, or t
  misc_feature (632)..(632): n is a, c, g, or t
  misc_feature (642)..(642): n is a, c, g, or t
  misc_feature (742)..(742): n is a, c, g, or t
nctntcaaaanttttattgaaaaaagagaaccgaggaggggggcgggaacccttttcanaaaagcccgcgctcccaaangaaaggaggnaaaggacggccaccctccaccngggnngaggacgnccccttcccaaacaaaancnccccagagaacaanaaggnccggactgggggcaagcccctggcaccaaaggccgggcaagagtgtgggaggccagcaaanagggaaggganaaaattggggantgacccnttgtcctgcacagcaccanaaacccccngggccactttgattttgtcagcatcactgaaaaaactgttccggcggcggaggggcttgtccagggcatcgagagaacccaaaccgcgaaaattctttagccggancccaacggaaaanaagtattcaccaggggcctcagtggnggcagccaggagagagcccatcaagactgtggaggccccnagggccaaggctttcgcaatatgacccacattttngnttcctccatcagcaatgaccggaacaccaaagcgccgtgcatnctcngacaccttgtacactgctgtcgcttggggncgcccacaggccanctcttcctgcgtnatgcagaaggagccactccccatncccacccgcnggaatccacacctgcatcaatgaggttcttggcctgggcagcagttaccacattgcctccaatgacttggagattagggtatttgtcttttatgttcttna

SEQ ID NO: 511898 - DNA, 484 bp, Homo sapiens
  misc_feature (57)..(57): n is a, c, g, or t
ttcccctatgtcctatcaataggagcgggttttgccctcatagaggggttcattccntggtttcccctattttcagggtacaccctaggccaaacctacgccaaaatccatttcactatcatattcatgggggtaaatttaacttttttcccccaaccctttttgggcctatccggaatgccccgaggttattggggttaccccgatggataccccccatgaaacatcctatcattgggagggtcattcatttttttaacagcaggaaaattaataattttcatgatttgagaagccttcgcttcgaagggaaaagtcctaatagtagaagaaccccccataaacctgggggggttatagggaggcccccccccctcccccccatttgaagaacccggatacataaaatttagacaaaaaaggaaggaattgacccccccaaagggggtttcaagccacccccagggcctccatggttttttta

SEQ ID NO: 511899 - DNA, 2480 bp, Homo sapiens
gacgctctgtgccttcggaggtctttctgcctgcctgtcctcatgcctctcctcctcttgctgctcctgctgccaagccccttacacccccaccccatctgtgaggtctccaaagtggccagccacctagaagtgaactgtgacaagaggaatctgacagcgctgcctccagacctgccgaaagacacaaccatcctccacctgagtgagaacctcctgtacaccttctccctggcaaccctgatgccttacactcgcctcactcagctgaacctagataggtgcgagctcaccaagctccaggtcgatgggacgctgccagtgctggggaccctggatctatcccacaatcagctgcaaagcctgcccttgctagggcagacactgcctgctctcaccgtcctggacgtctccttcaaccggctgacctcgctgcctcttggtgccctgcgtggtcttggcgaactccaagagctctacctgaaaggcaatgagctgaagaccctgcccccagggctcctgacgcccacacccaagctggagaagctcagtctggctaacaacaacttgactgagctccccgctgggctcctgaatgggctggagaatctcgacacccttctcctccaagagaactcgctgtatacaataccaaagggcttttttgggtcccacctcctgccttttgcttttctccacgggaacccctggttatgcaactgtgagatcctctattttcgtcgctggctgcaggacaatgctgaaaatgtctacgtatggaagcaaggtgtggacgtcaaggccatgacctctaacgtggccagtgtgcagtgtgacaattcagacaagtttcccgtctacaaatacccaggaaaggggtgccccacccttggtgatgaaggtgacacagacctatatgattactacccagaagaggacactgagggcgataaggtgcgtgccacaaggactgtggtcaagttccccaccaaagcccatacaaccccctggggtctattctactcatggtccactgcttctctagacagccaaatgccctcctccttgcatccaacacaagaatccactaaggagcagaccacattcccacctagatggaccccaaatttcacacttcacatggaatccatcacattctccaaaactccaaaatccactactgaaccaaccccaagcccgaccacctcagagcccgtcccggagcccgccccaaacatgaccaccctggagcccactccaagcccgaccaccccagagcccacctcagagcccgcccccagcccgaccaccccggagcccaccccaatcccgaccatcgccacaagcccgaccatcctggtgtctgccacaagcctgatcactccaaaaagcacatttttaactaccacaaaacccgtatcactcttagaatccaccaaaaaaaccatccctgaacttgatcagccaccaaagctccgtggggtgctccaagggcatttggagagctccagaaatgacccttttctccaccccgacttttgctgcctcctccccctgggcttctatgtcttgggtctcttctggctgctctttgcctctgtggtcctcatcctgctgctgagctgggttgggcatgtgaaaccacaggccctggactctggccaaggtgctgctctgaccacagccacacaaaccacacacctggagctgcagaggggacggcaagtgacagtgccccgggcctggctgctcttccttcgaggttcgcttcccactttccgctccagcctcttcctgtgggtacggcctaatggccgtgtggggcctctagtggcaggaaggaggccctcagctctgagtcagggtcgtggtcaggacctgctgagcacagtgagcattaggtactctggccacagcctctgagggtgggaggtttggggaccttgagagaagagcctgtgggctctcctattggaatctagttgggggttggaggggtaaggaacacagggtgataggggaggggtcttagttcctttttctgtatcagaagccctgtcttcacaacacaggcacacaatttcagtcccagccaaagcagaaggggtaatgacatggacttggcggggggacaagacaaagctcccgatgctgcatggggcgctgccagatctcacggtgaaccattttggcagaatacagcatggttcccacatgcatttatgcacagaagaaaatctggaaagtgatttatcaggatgtgagcactcgttgtgtctggatgttacaaatatgggtggttttattttctttttccctgtttagcattttctagttttcttatcaggatgtgagcactcgttgtgtctggatgttacaaatatgggtggttttattttctttttccctgtttagcattttctagttttccactattattgtatattatctgtataataaaaaataattttagggttggg

SEQ ID NO: 511900 - DNA, 155 bp, Homo sapiens
tagtggcgcagatcagggcgtagtatgagttatgatgctcaccttgatcagaggattgagtaaacgggtaggctagagggtggctagaaataaatagggaggcctaggttggaggttgaccatgggggttggggaatagggagaggggggtccat

SEQ ID NO: 511901 - DNA, 217 bp, Homo sapiens
atatgacgattctgtatggtttttcgaccatgattatttggacaaacatgtatggacatgtttaatgaacgtcacctgccaggcgaaagaatagttggctgggtaccacacaggccctaaactacacaagaatgacattgacatctaacgatgctcaatgacaaagatacttgtcctacattccagtattaggtcatcacttgaatgtgaacgccga

SEQ ID NO: 511902 - DNA, 368 bp, Homo sapiens
  misc_feature (125)..(125): n is a, c, g, or t
  misc_feature (232)..(232): n is a, c, g, or t
  misc_feature (274)..(274): n is a, c, g, or t
  misc_feature (313)..(313): n is a, c, g, or t
  misc_feature (321)..(321): n is a, c, g, or t
  misc_feature (339)..(339): n is a, c, g, or t
  misc_feature (356)..(356): n is a, c, g, or t
tccctggagtcctgctcccaccatccagtggggtggtggcgtttccttcttacacgtggcctcttctcaccgccgagctgttgggcggccgcccactgggctggtcctcctcttcccagcatgtntcagcctctccagctcaaccccaggggcagcgtccaggaaggagcaaggaggcccctcctagtccctgacaccttcgctgatggggatggtggaagggaggtttctnggagcggacacctgtccctcaggagggctgggccgctgtcanctgccctgcttctgggctgcagacaggaagacatcattntcctggtnctggaatggagccacgtngagagcggcaagcgctncccttgctccca

SEQ ID NO: 511903 - DNA, 656 bp, Homo sapiens
gggagctgcacgtggtatgtactgtgcggtggcgacaatttgagcaaagaccccaacgggcccatcccattcctcgactctgttcgtgagggacgactggagctccatgtcttctacgtgcggccagcccggccaagcgtcggctgtcgacgctcatcctgcacggcggggcaccgatgtgccgagtgcaggagcccggggccgtgctgctggcccagcccggggaggcgcttggccgaggcctcgggtgatttcatctccaccgcagtacatcctggacttgcgtggagcgcaacgagcaggctggagcttgggagggcctatcgggcattgggtccccgtcgctcgagcggctggacaaccgggattcggaagcaaagcccgggggcccttggccgaggggcgccgcgaaagccaggaagccgacatcgggcaacggccggggcagaaattcgccttttaccccgggaatttgcggcgacccgaacggttaaggccgagttctttgacggatacggtttgcagggcgacacattgccccggcttctgaccccaggattccggtgtccaacccgggttacaccggcctttggcgtggacaaaggggagtgggaccgaccagacagcttcgcattcagcggccaggcaactccgga

SEQ ID NO: 511904 - DNA, 752 bp, Homo sapiens
  misc_feature (70)..(70): n is a, c, g, or t
gaccgtggccggcgatgaaatggcgaaaagtcttttgaagacagcctctcatgtctgggaaggacaaaantgctactatcgaaagaggattgtaagtttatagtacatgcccatggattttatgaggaaggaagtgaaacaaaagacttcagctagtttgcgctggtggatccattggaccattcgagaaggaacgagaatggcattgcacattcttacgtctgaatcaatctcgaagtgagaatgaagtgccgttttcatggtgttactgatggctacaatcttctggatagaaagtatattgaacttggaaatattggacctagaggggaaaaggcctacatatgtaccgtgtgggcagaaagagagtacttgtctcgttcaggatctggatcatgaatgctgtgaacatctaataggaactccacgaggatggaatgcgctcgtatgtcatgttcatgcagaaacacgcgttaacgagagcttgatgagagttgccttgtaactaagctgtggccgctgggttcgacagttgtgggacattcgggttggaggcagcagaaatttatgtacaggcatgtgagtttcaggtttaatgtactccaggagagtcaagatcgagattggtgcacaaagagatgggcataatagcaagctgggggttggacatcgcggcatagttgacaatattcggaaggtagacatagtctgcaaagtgtcgagtgagggccttaaactggattcaaaaaatg

SEQ ID NO: 511905 - DNA, 701 bp, Homo sapiens
ccgaaaaaaaaaaaaaaaaaaaaaaaagaaaaaaaaaaaaaaaaaacaaaaaaaaaaaaaaaaaaaaaaaaaaaaaaaaaaaaaaaaaaaaaaaaaaaaaaatttaaaaaaaaaaaagaacagcagagaaggcagagaagacccagcgaaacaacggaagaaatcaagagaagaaaagataagaagagaatagaaagagaagagaagaaaagaagagaggaaggaaggaaaggagaatagaaaaaagagaagagaacagaaaggacgagaaaagaagcgacagaaacggcacgaaggaccaagagacagagaagaactgaaaaagacgagatacgagacatacggacggcgtcacagaaaaggagagaaaaaagagcaacagaaggaaatgcagagaagagcagaagaacagaagcaagagagaaaaagagaagagaggaggagagagacacagaagcgaagaagacaagacagcacagaaagagacaaagagagagagaagaaagaaagaggaaagagagagaaacagaaaaagatagaagaaaaaacgaaaagaacagaaaaaaagggagaagaacaaggggcagaagacggacagcaagagaggggacagaagaagaggacagacagaaaaagaagagaagagaagaaaaggagacacaggacgaagaaggcgagcaagagaaggagcaagagaaaaa

SEQ ID NO: 511906 - DNA, 555 bp, Homo sapiens
ctgaactctcgtgtgctgccgtctctgccttccatcaggttcggtatgcctgaagtcgcattcttggtaattttaagatgctactcttagtgataaataatagtatccaggttatttactgcagaacagtacagtacgctgtttgttatcctaagttgcacaggtatttcttacagttatctatgttggttcaagtaagctgcccttatttgcagtagcaatcattttgcagtggtttgcatgaagttcatcagggaattgtttctgactcttcatttcaaggtcagacattcatttttgtcagccagttgactataaactgtcatcagtgatttacgtataggcttgggcctgttgacctctgtttttacagcatgctgtgggtactgacatttttactcttttatctggacagggtggaccaagtaagctagtgccaaaacacttagctggttagttaaacaagcatcacaatctttttaccatccttcaaatactgggcgctggctgaacaagttaatgaaactacttcagcggttgccaaacagtgttgtt

SEQ ID NO: 511907 - DNA, 382 bp, Homo sapiens
tgtgagtctttacaacaccgatcttatgtattccaaaacccactgaggaactggacgctgtggctcacgcctgcaaccccagcactttgggaggccaaggcaggaagattgggtgagcctaggaggagttcgagaccagcctgggcaacataatgagacccccgtctctaaaaacaaaaaataataaaaattaaaaattaaaaaattagccagtgcctatagtcccagctagttggtaggctgaggcgggaggattgcttgagctcaggaagtgaggctgcagtgagctgtgatcataccactgcactctagcctgggcaacagaatgagaccttgtctcagaaaaaaccaacaaaatggccgggcgcggtgggtcacgcct

SEQ ID NO: 511908 - DNA, 246 bp, Homo sapiens
actaagatccgctgatcgttaagctcgtattatgtggttttagtaaacaccagacagacgagagtacatcgtagttgcatcacgtgagctcatcatgtctgcatttttgcatggaccatttgtccgggtagatcatgctgcagtagtcagcagttttacctgaacatctcagtatcagctgaatttctaaatgcacttcatcatctgcaatcagcgagatcacttcaacacacgacctctggacat

SEQ ID NO: 511909 - DNA, 376 bp, Homo sapiens
cggtcgactctacagatcccgattccactggtgatacaaaccgcctgcagagttagaagaatttatcaatggaccatatatgctcatatccacaagttggtgaccgttgttactatgaacaaatgtactatgctgcttagttgttgtacaataatgtttccaattttggacgtttggcatctaccctggttcacctgggctaatatcaggcagctgttgatggggctaggaaagctaacagtactcgaacatggaaagaggtctgcttcgcctgtgtagataggacagaattccgtcttgctcagatgtgtggactacatattgttgtgcatgcagatcaattagaagaacttatcaactactatcaaccagtgca

SEQ ID NO: 511910 - DNA, 391 bp, Homo sapiens
gagtatctaagatcccatgtaagtatgtaaccaagctggagaggccttgagtttgtgctcataaaagatattcattctcgtcccaaattcaggtgaatggacatctgtgcagtcgagatcccaggtgtctgcttccgtactgttcgggtgagggtgcgagccccgctattgagctgtgtgcgaccgagtgacctccaccacaccgtgatcaacttccccgtgtccatcccatgtcattccatgaaacagtgggctgacgcataccttcagtaggcccattaggacctctcccagctgctgaaaggccacgtgatggtgatagctcttcacatcccattgtgactccatgctccttgagaggagaaatgccataactctgggaggggctcga

SEQ ID NO: 511911 - DNA, 115 bp, Homo sapiens
  misc_feature (39)..(39): n is a, c, g, or t
gcaccgcgcgtttcaagcacctcatggggagtaacactnggcctcccaaggcagggtagggtgcacgattgagtcccagaatgactgcgaaattgcggcccatcacagcaggcat

SEQ ID NO: 511912 - DNA, 156 bp, Homo sapiens
cccttcccctgcccaatgtggaaacaggggttaatggggctttttatggaaccatctgctttggggacctaaaccccaggtggtctcttggtgttaataatgctggaaaaaaaaaaattactggtttctacttttctaaaaaggcatttctctata

SEQ ID NO: 511913 - DNA, 114 bp, Homo sapiens
tgaagttctcaggaaaccgcttattcttagattcagccgcctaagccatacagagtgcgcccctgacgtttcagggcatatactacatccatggctgttacatttttgcgcttg

SEQ ID NO: 511914 - DNA, 1166 bp, Homo sapiens
gccctgcgggccgcctaagtctcggaggccacgtccgtcaaggatggagaacatggcagagcacagccgcaagctgtggtgctgtctccccgtgacgcccgagcagcaggaggcccttcaggaaggccaagaagtacgccatggagcagagcctcaaggagtgtgcatggtgaagcagaccatcgcgcaccagcacgcagcagctcaccaacctgcagatggcagcaagtgacaatgggctctggagatcctctctcacctttgcaactcgataggccggctccagcggccagcgggcgctggccatcatgtgccgagtctacgtgggctcatatctactatagagcaggagagagcgacaccaatccgccaggcctaagcacacccattaggcaccacaaacaacacgcactcgacactgtccatgggacctccgacacaccatgcaagacacaacgcgcttcgcccttcgcgcgcacgccatgaccgatccccccgacagcctgcaccaccctgcgccacataccggcagccacactgaacatccgcacaacgccacgcacgacgccaagcacacccacacgcagaccccacacacaccccgccccccgccaacgcccacaacacaccgcacagcaccacgaaggcatcccacgacaacgagcccccaccgccgcacaccacgacaaaccccctcagcaacccacaacgcacgacctcaaaacgacgcaacacaacccacgcgcacccacgacccacccaaaccgcaaccgacccccgccaaaaaagacccgacgccccacaagcgacccccacacccacgacaccccacaaccgaccaacgcccacacacacaacccacaacacgcaccccaccccagcaccaccgcacacacacacacacccccacgcaaccacccgccccgcacccacccaaacgccaacgaccacacgacccaaccatccccacccccgcccccccacccacccccaccgtccaaaccaaccccaacgcacgccacacccaccgcccgccacatcccgactcgccaacccaaaccacccccagccacccaacccacccccacccccgccccccccacacccaccaaccaacacacccccaagctacccgcactacccccgcgcccccgacccccccacaa

SEQ ID NO: 511915 - DNA, 404 bp, Homo sapiens
aggctggtcttgaacccctgaccttgtgatcctcccgccttggcctccccaagtgctgggataggcgtgagccaccgtgcccagccaataatagctaaaatttatataatgttcactgggccaggcacagcggctcgttcctgttatcccagcactttggaaagctgaggcaggcagatcgcttgagccaaggagttcgataccagcctgggcaacatggcaaaaccccatctctaccaaaaaaaatatacaaaaattagccaggcgtggtggcatgtacttgtagttccagctactcggaaggctgagttgagagtatctcttgagcccaagaagaggggactacagtgaacggagattgcgccactgcactccagcctagacgacagacagaagatctcaaa

SEQ ID NO: 511916 - DNA, 478 bp, Homo sapiens
actgattagataaatattgaatattgaatattgaacatctggctctcggaaggtcatggaccagggcagaccttggccactaagctctgaaagaagccacgaggctggagcacatgcaaccaggtggtgtccgaaagacaggggctagctcccagagggccacaggagagttttggattgtgttctagggatgggaatccattgaaaggttttaggaaaagagtgaggccaggtgcagtggctcacacctgtagtcccagcactttgggaggccaaggtgggtaaattgcttgaacccagcagttcgagacttgcctgggcaacatggtgagaccttgtctctactgaaaacaaactaaaaaaaaaattggccaaccatggtggtgcgtgcctgtagtcctagctgctcgggaggctggggcaggaggatggcctgagcccaggggagttggggctgaagcctgggtgacagaggaag

SEQ ID NO: 511917 - DNA, 174 bp, Homo sapiens
gaggggagtgtgtctggagttggtgagcaagggggagggagaggggggggagcagggattttagataagggtgaggagctggccttcctctgattgtagagggaagtcacggaaggtttctaagcaggggtggcatgatcagtttttgactgtagatagatcatccagggtgca

SEQ ID NO: 511918 - DNA, 232 bp, Homo sapiens
tctgatagtgagtacactatgggagatgattccgaagcctggtaggataagaatataaacgttcagggatgaccgagaaaatcagaataggtgtaggtatagaatggggtctccatctatcttaggggccatcaagtttcatcacgaacaattatcaatatataaacccccgtgccataaccacaataccacaacgcccgctcttcgtcatgatccagtccgtaatcacagg

SEQ ID NO: 511919 - DNA, 942 bp, Homo sapiens
gggaagatggcggcggtgcaggaggcggagcaggggcccgacaggcgcacgtggatggcgtgccaggtgcggagtgcagacgtccaggtcagagtgaaccatgccattggacagcatcagcggaaggagacgccgtggccgaaggggatcacccaagcctcaagaacccaccggcccatcgcggcacccaatcgcctggcagtgtcactcaataggttgcttgctgttgagcgatcttcatcatcctgggccatcacgcagatatgagtattcgccagagggcacaggcccctcaggcatcaggtgggccccggagggagccgccacgcgatcgaccagacgcgcaaggctggtatcctcgcgaaaggacatcgtttcatgatccgtgcatgtgtagcatcgtcagatgcacgagacacatttgacagagcgttcaagcgccacgtcggcactcttctgtgaacagcacgatcttgtgtattggctgatctggtagctatcggtcgagaacgtcagactggcgtgcgtacagagcactttgctgagctcgatatcccagagagcgtccagcagaacggctccatcgtacatccacgtttacttcaccaagagtggtttccacgcgcaagacccccggcagaaggccctgttaccgccggtttgccacagtccacgattgtcccgggatgatcagacaaatacaagcgcagacgatttcagaaaaccaagaaccttgctgacaggagagacagaagcggacccagaaatgatcaagagggctgaggactatggggctgtgggaagggttgaatctcccattgggaccccaagatcaccatcaaacatcgtggacgaccacacgccgtggggtgaaggggcagtgtgccccctcccctggatcactatgtgaagttcgacggccgtgaacggggactactatcc

SEQ ID NO: 511920 - DNA, 378 bp, Homo sapiens
ggggggtaggtgaaacttgtaaaacagcacctgcttgtctgaccatgaaaccaactctggtaagtaacatctgaaagtcacaaacacacgcaggctgtattaatacacctgcagtaagtttgcatgaccaagtatcagaccacacagactaccgctgtttaccatttccatataatagcacaaagggcaaacaggtcataggtcagcttagtagttatagagtaatgatcttagctacacatagaactccgcgtgctgaaaaatggttcaccggccgagtagtctcatgcatgtaatggcatcaatcaggtagcccaacgttcctgcgtactaacgtcactatatgtacacctgcatggctaacacggtggaatggtc

SEQ ID NO: 511921 - DNA, 319 bp, Homo sapiens
cagactcaaagggatcagagaaggctgaagaaggttggagaaactgaggcacaaaaagagggcagtgaagatgttggcaacctccctgaagcccaggagaagaatgaagaagaaggagagacagccacagaagagacggaagaaatagccatggaggttcggaaggggaagcgaggagtaggaagaactccagaaggagaagagcctcgagaagacgagattcctaggcttttcatgcttcatttcttccactttccagaaaatggagctattagcacattcaattcttcccaaccaactcacagatcttgcttaagcg

SEQ ID NO: 511922 - DNA, 525 bp, Homo sapiens
  misc_feature (187)..(187): n is a, c, g, or t
tacctagagatcccagtagtggacgaccaggtctacgctgctcccactgtctggaaatcgctgcctttctgactgatcctcactgtgagtggcatcaggtatgctgaggccggtgcggtggtcacgctgtatccagcactttgggaggccgaggtgggcagatcagctgaagtcaggagttcgagancagcctggccaacatggcaaaaccccgtctctactaaaaatgcactgggcatggtggtgcgcgcctgtaatcccagctactcggatgctgaggtgggagaatcacttgaacccgagaggcggaggctgcagtgagccgagatcactgagatagcaccactgcacttcagcctgggtgagagcaagacttcatctcagaaaataaaaacaaggctgggtgcggtggctcacacctgtaatcccagcactttgggagaccgaggcgggtggatcagctgaggtcaggagtttgagaccagcctgggcaacatagtgaaaccccgtctctactaaaaatac

SEQ ID NO: 511923 - DNA, 149 bp, Homo sapiens
aatttctcgtcccgctcttcatacagtgcacaagacatatcattgggcacaggaggcgcacaccttaaaaagattcgtgaagaaagcaacaccaaaatcgaccttccagcagagaatagcaattcagagaccattatcatcacaggcaa

SEQ ID NO: 511924 - DNA, 582 bp, Homo sapiens
gggtctgctgcctgattatgtctgtagtacacttcacttatttgagccaaacgctgtgccgctccctctcagacaaccatgtcatgggccccagccctttacactgctgagtacatcatttcatgtcatcctgggggctctgatgaagaacccttacagttcatggatactggaactgctaccagcgccactctgacaggcctcaccagaggtgccacctacaacatgataatggaggcactgaaagaccagcactaggcataaggttctggaagaggttgttaccgggggcaactctgtcaacgaaggcttgaaccaacctacggatgactcgtgctttgacccctacacagtttgccattatgccggtggagatgagtgctaacgaatgtctgaatcaggctttaaactgcagtgccattgctcaggctttggaagtggtcattgcagatgtgattcatctatatggtgccatgacaatggtgtgaactacaagattgtagagaagtgggaccgtcagggagaaaatgtccagatgatgagctgcacatgtcttgtgaacggcgagcggcacatgcgatg

SEQ ID NO: 511925 - DNA, 211 bp, Homo sapiens
ctcactgtctctctcacataagggccagcctgctttcaggtgaccaaatcccgtctcatgactttatttatttatttatttaactttggagatggagtctcgttctgttacccaggctagagtgcagtggcatgatcttggctcactgcaatctccgcctccaggtttcaagcgattctcttgcctcagcctttcaagaagcaggaactgg

SEQ ID NO: 511926 - DNA, 194 bp, Homo sapiens
  misc_feature (16)..(16): n is a, c, g, or t
  misc_feature (58)..(58): n is a, c, g, or t
  misc_feature (99)..(99): n is a, c, g, or t
  misc_feature (118)..(118): n is a, c, g, or t
  misc_feature (148)..(148): n is a, c, g, or t
gaattcggcacgaggnctcgcttggccttcttcttcttgtcgctgttgccattttctncagccccctcagtagagagcacctcctctagttttcgcttnccactctctggctggagcnctgctgtgttttcggggcttgaagcaaatnatgatgcaggtcatgttgtcacacctggtaccatccccagaagtgt

SEQ ID NO: 511927 - DNA, 396 bp, Homo sapiens
tctggcgcccgtgctgcatgatgccatgctgccaatgcccactcctgagcgccgacgccagcagcgtgtgtgaccatgtgaaaaagagcagcgcccagtgctgccctagactggcctgagcgcgccggggtccaggctggctggcgccgccgatcaagctgcacaccaccatgcggcaagatgatcatcctgcagcatgacgcatgcagcatgctcgcccgggaagacgaaggctgctcaatgcgctccgggcccaactgccatgcgcacccccgtgcccctgaacccccagtcccagctgccacgcccggcaccacgggcacactgtcagcagcacaagcaggttggctcgaagggcagcggcgcacctggtcccgggaaccgcagtagccgcct

SEQ ID NO: 511928 - DNA, 1011 bp, Homo sapiens
ggccccggctccctcctgagctgcgccgtgccaggccgccgccgcgatgcagtgggccgtgggccggcggtgtgggcgtgggccgctgctgctcctggctgtcgcaggcggtgctgaccccgaatggtcgtctggctctggctgggttatcgcagagcttctgtcttccagcgctgaagatgatagcgccgctggctgcggcagatacgctgggtcgtggaccacgagctgggccttctctcgtctgatcgtggagctgcggcggctgcacccaggccacgttgctgcccgacgaggagctgcagtgtggtgttcgtgaaatgcgcggtggctgtggatgggcgccactgtgccttctgcacgcctctgcctgtcctgaggtcgctactggtggctgccgaatctcggatatccatctaatctctggcacccgttccaccatgtggagagagggcaccatcaaaagtgaggtcttctacccagggggagactggtaagtacaacgtgaggcctggtgaggctaagtagactgtgcgagtgtggtggacaaacacatggatggtgcaacaacggacggggcatcaatcgcaataccatccaggtcttcgacgatgcaccgatgatggtcatcacgaaccaaaggaaaatccatctaaccctgcgttggaatactcgttagacaaccgtaatgacctcgggagtgcccctcacgcgctggtcgagaccgcaacacaagcctcaagcctcgattgttacgacaaaggaaactcatattagccatcgcaagagtgcgtggagggaaagcaacctggggcgatcgaaacaggggcaacggaagcatgtgcacgacaagtattggactttgatggtaagactcatgttatacaataacaggaagcactaacaccaaatgcgcaatcctgaagataccgtccggtctgaaccgggaaattaccctgcattatatatacaaaaaaacaaagccagtgaacagaagaacacatataaaac

SEQ ID NO: 511929 - DNA, 343 bp, Homo sapiens
aaaaacatttaaaattgtaataaaggctgggcgcagtggcttgcctctaatcccagcacttcaggaggccgaggcaggcagattgcttgagctcaggactttaagaccagactgggcaacacggagaaaccccgtctctacaaaaaaattcaaaaataagccaggcgtggtggtgcacgcctgtgttcccagctactctgaaggctgaggtgggaggattgcttgaacccagaaggtagaggttgcagtgagctgagaccataccatgcactccagcctgggtgatagagtgagactctgtctcaagaaagaataaaaagtaaaaataaaattgtaaaaaaaa

SEQ ID NO: 511930 - DNA, 609 bp, Homo sapiens
  misc_feature (314)..(316): n is a, c, g, or t
  misc_feature (324)..(324): n is a, c, g, or t
  misc_feature (328)..(328): n is a, c, g, or t
agaggggtctccggagaagcgcggccctgccaacatcctgatctcagacttccggcctccagaactgtacgggaatacatggtctttggcccatgcacctgttatggacatttttttctttctttctttctttctttttttttgagacagagtcttgctctgtcgcccaggctggagtgcagtggtgcaatcttggctcactgcaacctccgcctcccgggttcaagcgattcttctgcctcagcctcccgagtagctgggactacaggcgcctgtcaccacacccggctaatttttttttttttgattttagnnnaagaaacngggntacccacattgggccctagaggttacgttttacgaggcttatctatatggggccttctattgccaatttttagtttttaggggaccttataattaactaaaggggtttggggcacttaaaatgacaccccctttatacacacttgtcgggacaccttggcccaaccaaattttaacttcagcaaagttatgcatgcgcgccaaattaggtcttactttgccactttccccctttatagagggggagtgacaattcactgggccgaagttttcaacggtggt

SEQ ID NO: 511931 - DNA, 504 bp, Homo sapiens
ccgggcagtacggatgtgcaggtaaaacaatgcggggcttgcgatgatattggaagtgggggacagtcttgtgggactgagccctcaacctgggggatctgatgctatctccaggtagatagtgtcagagttgaattgaaggacacccagcccaagtctgctaaaggattgcttgcttactggaagactgattgcttgctggaagtgcagggaaaaccccacacatttggtcacagaagtcttctgtgttgactgttgtaaggggtgggggggtgcagagcagaggaaaaacagtttgcttttttttcattcagctttggagcatggagattaggagcatagtctccaggccagactgtctgactccaatcccagctgctctgtcacatcttagctgtgagactggacaagttacttctctgtgactccgattcctgttctgtaaaatggggatgataaaatatctacctcataggatcattgggaagatcacataaagtaata

SEQ ID NO: 511932 - DNA, 100 bp, Homo sapiens
cgtgaccacaggcaagtctcagctccctgctgtctggggccctgcggtgcccttgccaaaacagcggtagcccctggacctaaccaaaatcatcttcaag

SEQ ID NO: 511933 - DNA, 108 bp, Homo sapiens
gggtacatgcctgagcacagaaattcgagacaggctgggcaacatagccagaactcatctctactcaacattaaaaccactttccaaaatgaatttttattttataag

SEQ ID NO: 511934 - DNA, 893 bp, Homo sapiens
ggaggaggcaacaggagcgtaggggagaggtctcgaaagcgtggcaggcgtgtgtaaaaccgtcgtgtggccttttccatgggccatatggtgtggaaagttgtaacaacgcggcgttataaacaatgtagtggccaccgaggtcaaacgcggtccacagacgttcccagcgtccgggatccgagaacagcgagtccgtagcgtgactggcaaaattttggaccggggttgaaggggcccgtgggcgcgccgctcccgctcttgcatgggcgcccaaccaacacgccttttcgtcagggagagctttccccccccccgtcaagcgctgggagactcgcccataggcctcctttccgcgattagggctttcccgtctgggattagcacccggaggtacagcttcagccctttcttttcccaaacatatggtgcgggtttttcccctgtccgaacgatcactcctgggtaaggttgctccccacgcaggatttctcgggtaaaccacgtgcggtgcctcttttggtcgggagccaaagtcaaacaccagccccggatggggtcagtcaaacatcagagcgccgacgagccttaataaaagagttctcttccacaacctctataatgagagacatattttttctctacacgccatgtaacacacatccagaagacctacacaccttttaacaaaaaaatcccccttaattcacattcttataagataacaggctgtctgtagataataagaaggaagtctagccccttctttgacaaaatttgcttccccccaccaccctctaaacccctatagcaccacagtatttctatggcacccaaaaaagaggaaaaattttaataggctgaaaaaaacgaccccaacaccccacataaca

SEQ ID NO: 511935 - DNA, 749 bp, Homo sapiens
gccggccagtaccggtgcaacggaccagctccaagggctccgagcaggccatcatcacgctccggcgttgcgcatgtccagctggctcgccctctgaggccgttcgctggggcatcgatggttgatggttgctggttgcgtggatcgacccatcgatcgttcatcgtacgatgaagcggctcggtaagccacgaggacgtccgtggcatgattgacggacgaccggcgtcatgcaaccccatgtaagagcagcgggcaagcgaccagaatgacaaaggccaagaacagtccagcgctagaggaacgtcattccttgaggcaggtggccctgaggacggctcccgtgcgtccgcggtctggcggcgcggctcggcccaggaagtccaacgtctcctagtgctttgcaaaagcatttcaccaagattcctcggacacttcttttcaccaaggcaaattaacgccactactcccccggtttaaggcatttcccccaaatccatgaccagcgtgtcctttttccttaattttctaaagcaggacatacgttgggggcgccttttccttcaccattttccacggaatttcctggtatccgtttagggatgtttttgtcccgtgtgctggacatgtgttttccatgggaggaggccccgggggtaggctggcttgccacgtgctggtgcgccgctcgttgttgggcttttgtcccaggccttcgtggggggtctgggggttcaattgtggcccgg

SEQ ID NO: 511936 - DNA, 988 bp, Homo sapiens
  misc_feature (369)..(369): n is a, c, g, or t
  misc_feature (373)..(373): n is a, c, g, or t
  misc_feature (503)..(503): n is a, c, g, or t
  misc_feature (507)..(508): n is a, c, g, or t
  misc_feature (516)..(516): n is a, c, g, or t
  misc_feature (518)..(518): n is a, c, g, or t
  misc_feature (534)..(535): n is a, c, g, or t
  misc_feature (554)..(554): n is a, c, g, or t
  misc_feature (573)..(573): n is a, c, g, or t
  misc_feature (580)..(580): n is a, c, g, or t
  misc_feature (583)..(583): n is a, c, g, or t
  misc_feature (587)..(587): n is a, c, g, or t
  misc_feature (598)..(598): n is a, c, g, or t
  misc_feature (604)..(604): n is a, c, g, or t
  misc_feature (615)..(615): n is a, c, g, or t
  misc_feature (617)..(617): n is a, c, g, or t
  misc_feature (622)..(622): n is a, c, g, or t
  misc_feature (654)..(654): n is a, c, g, or t
  misc_feature (656)..(656): n is a, c, g, or t
  misc_feature (694)..(694): n is a, c, g, or t
  misc_feature (745)..(745): n is a, c, g, or t
  misc_feature (813)..(813): n is a, c, g, or t
  misc_feature (825)..(825): n is a, c, g, or t
  misc_feature (934)..(934): n is a, c, g, or t
gcacgagctcgtgccgattcttgtttggctatgccaccacagtcatcctcagggtctatacatactatgtttcaactgtattatttgccattgttggcattagaatgcttcgggaaggcttaaagatgagccctgatgagggtcaagaggaactggaagaagttcaagctgaattaaagaagaaagatgaagaatttcaacgaaccaaacttttaaatggaccgggagatgttgaaacgggtacaagcataacagtacctcagaaaaagtggttgcattttatttcacccatttttgttcaagctcttacattaacattcttagcagaatggcgtgatcgctctcaactaactacaattgtattggcanctanagaggacccctatggtgtagccgtgggtggaactgtggggcactgcctgtgcacgggattggcagtaattggaggaagaatgatagcacagaaaatctctgtcagaactgtgacaatcataggaggcatngttnntttggcgntngcattttctgcactanntataagccctgattctggntttaacgctgcttgtcatntatattnagntaanataggtagtantatctntctgtcatagngnacatnacaactaaaagtgatggaaaaatactggattntngtagcactgattttgtgagtttgaccccattattatgnctgagatataatcattgattctatttgtaacatggagtttaaaagaaaccntgactctagtgtgggtcttcttctctccacataatattgtaatatgggcctactcttctttggtgcanaaccgtgtgcantgggtctaccttgcactttctttaagactgacccctcttaaggatatcaaatttctcctcataactaagggtttaagaagtaacctaaagttttcttgggaagaatgantaatttctttttaaaaattttctgagcccgaaagtagttaatcatggcctgtaa

SEQ ID NO: 511937 - DNA, 187 bp, Homo sapiens
accacccccacgcaatcaaaaacttttttttataatcagtatccgctgggaagctatcacatcccacggcctggctctcaactgctctaccgacctcactgttgtttgagcacatcaagccctgtggactggttgggtcaggcgtcacttccttgagtaaggagctccagaggcacgtcaccgcgga

SEQ ID NO: 511938 - DNA, 155 bp, Homo sapiens
ggatccccaaaaaatttaagtgcttgcttggcccaccacagtggttcacgcctgtaatcccaacacttttggagaccaatgcactcagatcacttaaaggcaagagttcaagaacaacctggccaacatggtgaaaccttgtctttacttaaatt

SEQ ID NO: 511939 - DNA, 116 bp, Homo sapiens
accatactcttgcggcatgccagttcattgatcaggaaagccaggactgaagctttctgtgctgaaagctgtgacgcctgaaaagcttaggctctatcagacattcagtacgggga

SEQ ID NO: 511940 - DNA, 300 bp, Homo sapiens
tgtttgtcaacgactacttggacggcccctgtacgttcgcacagctaaaggagctccccgacgagcgcggccacaaaatgtttgtcatcaaccgctccaaaccgctttttcccaaggggtccggcggaggcgcccccttatttcggcccggcacagggggcggggccgggactccgcgtgccccccccggtcgcctacgagatcccctgctagggccgcgggcgcgcggattacgtgggcgccggagattggccggtgcggcctcgcgcatgctccgtcagtaaaggtggaagccgcgca

SEQ ID NO: 511941 - DNA, 120 bp, Homo sapiens
tctagaggatctcccgggagccttaccctgtagcacacatgagcgcaaactcaagagacaacacacaaactaagcctacatttggcttccagattggttctcctagtttaaaaaaaaaaa

SEQ ID NO: 511942 - DNA, 336 bp, Homo sapiens
gaggtcgtcgctctctttagagtatcttatactagtcacgcacggttatctatacatatactagtaagaaagttattcagaatatcttggagaggcagcgattcaaagactgtgttaaccctatacaacaacgtcaataacaaactaactacccacaaaatattattaaactttcctctatgatatcagatctattggaagaaaatattcttatgattcctaccccctatacctactaagatactccagtacatattacgttcttggtatggctactttcaaagtagtactgtagtataggtcgagtatcctacttgttactacactaggcccact

SEQ ID NO: 511943 - DNA, 771 bp, Homo sapiens
  misc_feature (228)..(228): n is a, c, g, or t
tcggcaaagccttgatggattctacagccatgggatgggagctgagggtcgagaaagtgagagtgagcctgctgacccaggctgacgtggaggaggaggagatggacagctatcactgaagtgcctgcaaactgctctgtcctaaggagctccatgcgctctcttgtctcccttccggaggcacatgctgggggcctgggaaaaatgcagccagctgatgcagtaaantgaatccaccggtagatttcagttctagaaggcttgacaggaggagctggtgtcggaaacaagccactcctcagtctctagaagtaagctctgcaaatgccgaagaggctcagacacccattcagctggtgacgcgaacgggcttgacctctttgcgtgtcacctttcagtaacgaggatctggaggtcagaccagagagaaacataggaatgattcgatcagcagatatgtcacagatctaagcagcagggatttaattactgtacatcagccagttgcctctccattgacaaaagttccactctcgattaagtgaccaatcagccatcctggattggacaattcacggccttcgcacaggtagcttccacaataccagtgctaatctgactgagagtataacagaagagaacattgtgtcctgccagataggcctccggaaagatctgatggggagggccaaagctgtgtgctcagtactcagattaggttgcgcaagagagaaaacaaagaggggcgtcgggggaaggggaaggagaagc

SEQ ID NO: 511944 - DNA, 385 bp, Homo sapiens
ttctgtgctatgtgaaagtctcaattggaaaagaagattaaatgaagatttcttttaaaaatttagagaatgatagtaagttctcctgaaccaagcttcatgtaggggttcatgcctgtggttaatcacagcttttctcagtaactccgtaatgtatatcagaaatgtgtggtagttttgaatgcacagctcaatcattcttttgaattcaccattaaatttttcatagtaatcagagagttggtctgaaaattctccgagtttatatctaactctgctggtggtatctcagaaattattttctttgtcacatatggtgtggcttttaaatatctcctgaacagtgacagagagctgcgctatcttcctcgtgccgtatcctaca

SEQ ID NO: 511945 - DNA, 975 bp, Homo sapiens
gggtggtcacggagcccctgcgccttttccttgctcgggtcctgcgtccgcgcctgcccgcatgaatgaggagtacgacgtgatcgtgctgggcaccggctgacggaatgtatcctgtcaggtataatgtcagtgaatggaagaaagttcttcatatggatcgaaaccttactacggaggagagagtgcatctataacacattggaagatttataccaaagatttaaaataccaggatcacacccgagtcaatggggagaggaagagactggaatgttgacttgattcccaagttccttatggctaatggtcactggttaagatgcttgctttatacagaggtaaactcgctatctggattttaaagttgactgaagggaagctttgttctataagggtgggacaaatctacaaggttcctttccaattgaaagcaagaaagcctgggatcttagcgctaagggattgtttgaaaacgtcgttcagggaaattcctagtgtatgtttgccaactttcggtggaaaaagatccagaacttttgaggcattgattcctagaagaaccccaatgggaagatgtgtttagaacattggtttgggtcacggcggtattacatttacttgggtcatgctctggcacttttacagaactgatgattacttagaatcaacgtgttatgaaaccattaatagaacttaaactttcacagtggaatctttggggcagaattgggaaaagggcaataacattattcatctattgtcttgcgagaacctgtgccccaaggagttggaaggttaggcaaatatgcgggcctaaatgtgagtaagctgaaaatcatggtccaatgatcactgggtacaacagtcgagaatgtctggtagagcattggatcgggtaagaatgagtaagcggtcagcttgttatcctataaagagatcgcaatgataacagtacgaactatcaatcaaaag

SEQ ID NO: 511946 - DNA, 169 bp, Homo sapiens
  misc_feature (48)..(48): n is a, c, g, or t
  misc_feature (55)..(55): n is a, c, g, or t
  misc_feature (77)..(77): n is a, c, g, or t
ctctgtcttaaaaaaaaaaaaaaaaaaaaaatcggttagatgagaaancatgtanattttctatatacaaaacccangaaaggcgttttgagcccctgtgctcaggccaactccacactgtggagtgtactttcattttcaataaatccccttattccttccttgcaaa

SEQ ID NO: 511947 - DNA, 257 bp, Homo sapiens
ggtgctccagatgctggccaggagtgagtgctgagcacggtgacttccatgcacagaaccagcagtctcccctttcctgagccagagttccaggaacactgtggacatctttgtttgcgaaggatcaggttgaggggcagcccccagtctgtcccatctcagtttgcaaaaagcactgacacgtatctcttctattgtaagctttccatttagtttgcttccaatgattaaatctaagtcatttgaaaaaaaaaaaa

SEQ ID NO: 511948 - DNA, 4045 bp, Homo sapiens
  misc_feature (471)..(471): n is a, c, g, or t
  misc_feature (475)..(476): n is a, c, g, or t
  misc_feature (500)..(501): n is a, c, g, or t
  misc_feature (509)..(509): n is a, c, g, or t
  misc_feature (563)..(563): n is a, c, g, or t
  misc_feature (623)..(623): n is a, c, g, or t
  misc_feature (630)..(630): n is a, c, g, or t
ccacccacgactagagagtgctcatgccagcagcttgagccacttagcgctagcacaccagcaacaacaacagttgttacagcaccagttacctcatcttcttggacaagcccatccttctgcttcatataatcagcttggactttatccaattatttggcagtatccaaatggaacacatgcatactcaggacttggtttgccttcttctaagtgggttcacccagaaaatgcagttaatgctgaagcttcattaaggaggaattctcccagtccttggctacatcagcccacccctgtgacctcagcagatggtattggattacttagtcacattcctgtcagaccttccagtgcagagcctcatcggcctcttaaaattacagcccattccagtccaccattgacaaaaactttagtagatcatcataaggaagaattagaaagaaaagcttttatggaaccattacngtcnnttgcatccacatcagccaaaaatnncctggatntaaataggtcacagactggaaaagattgtcacttacataggcattttgtggatncagtattaaatcagttacagaggccaccccaggagactggagagaggttaaacaaatacnaagaggnacacctcgattcttcaagaaagtattgatgttgctccctttacaactaaaatcaagggacttgagggtgagagagagaattattccagagtggcatcatcatcttccagtcctaaaagccatatcatcaaacaagatatggatgtagaacgctcagtatcagatctttataaaatgaagcactcagtgcctcagagtttaccccaaagtaactatttcactacattgtctaatagtgtggtcaatgaaccaccaagatcatacccatccaaagaagtttcaaatatttacggtgataaacagagtaatgcccttgcagcggcagcagctaatcctcaaactctgacttcatttataacatctctttcaaagcctccacctttgattaaacaccaaccagaaagtgaaggtttagtaggcaagataccagaacatcttccacatcagattgcatctcactcagtaacaaccttcagaaatgattgtaggagtcctacccatttgacagtttcttctacaaatacactccgcagtatgcctgcattacatagagcaccagtatttcacccaccaatccatcacagcctggaaagaaaggaaggcagctatagtagtctttcccctccaactttaactccggtgatgccagtaaatgctggtggtaaagttcaagaatcacagaagcctccaactctaatacccgaaccaaaagactcccaggcaaattttaagagttcttcagaacagagtttgacggagatgtggagacctaataataacctcagcaaagagaaaactgaatggcatgtggagaaaagcagcggaaagttacaggctgctatggcatctgtcattgtgcgtccatcttctagtacaaaaactgatagtatgccagcaatgcagttagcttctaaagatcgagttagtgaaagatcttcagctggggcacataaaacagattgcctcaaactagcagaagccggagaaactggaagaatcattttgccaaatgtgaattcagacagtgttcacacaaaatctgaaaaaaactttcaggctgtctcacagggcagtgttcccagttcagtcatgtctgctgtaaatacgatgtgtaataccaaaacggatgtaatcacatctgctgccgatactaccagtgtttccagctggggtggttcagaagtaatttcctctttatcaaataccattttggcctctacatcatcagaatgtgtatcttcaaaaagtgtcagtcagccagtggctcaaaaacaagaatgcaaggtcagcaccacagcaccagttacattagccagtagtaagacaggaagtgttgttcaacccagttctgggttctcaggcacaactgattttatccatttaaaaaagcacaaggcagcattggctgcagctcagtataaaagtagtaatgccagtgagactgaacctaatgctataaaaaatcagacactttcagcctcccttcctctggatagcactgtaatctgtagtacaattaacaaagcaaactctgtaggaaatgggcaagcttcccagacaagtcaaccaaactaccatactaaactgaaaaaggcctggctcaccagacactcagaagaagataaaaatactaataaaatggaaaattcagggaattctgtatcagaaattattaagccatgttctgtcaacttaatagcctctacatctagtgatatacaaaatagtgtagatagtaagatcatagttgataaatatgtaaaagatgataaagtcaacaggagaaaagccaaaagaacttatgaatctggctctgaaagtggagactcagatgaaagtgaaagcaagtcagagcaaaggactaaaagacaacctaagccaacttacaaaaagaagcaaaatgatttgcaaaagagaaaaggtgaaatagaagaagatttgaaacccaatggagttctcagcaggagtgccaaagaaagaagtaaactgaagttgcaaagcaacagtaatactggcattcctcgttcagtattgaaagattggcgtaaagtcaagaagctgaagcaaactggggaatcctttttacaggatgactcctgctgtgagatagggcctaatttacaaaagtgtcgagaatgtagacttattcgcagtaaaaaaggagaagaaccagctcactcaccagtattttgtagattttactactttagacggttgtcatttagtaaaaacggagtagttagaatagatggtttctcttctcctgaccaatatgatgatgaagctatgagtttgtggacacatgaaaattttgaagatgatgaactagatatagagacttctaaatatatcttggatataataggtgataagttctgtcaattagtaacatctgaaaaaacagctttgtcctgggtgaaaaaggatgccaaaattgcctggaaaagagcagtgagaggagtccgggagatgtgtgatgcatgtgaagcaacattgtttaacattcactgggtctgccaaaaatgtggatttgtggtctgcttagattgttacaaggcaaaggaaaggaagagttctagagataaagaactatatgcttggatgaagtgtgtgaagggacagcctcatgatcacaaacatttaatgccaacccaaattatacctggttctgttttgacagatcttctagatgccatgcacactcttagggaaaaatatggtattaaatcccattgtcattgtactaacaaacagaatttacaagttggaaattttcctacaatgaatggtgtatctcaagttttacagaatgttcttaatcacagtaataaaatttctctgtgcatgcctgagtctcagcagcaaaatactcctccgaagtctgagaaaaatggtggcagcagcccagagagtgatgtaggcacagataacaagttaactcctccagaatcccagtcaccactgcactggttagcagatcttgcagagcaaaaagccagagaggaaaaaaaagaaaacaaagaacttacccttgaaaaccaaattaaagaagaaagagaacaagacaactctgaatctccaaatggcagaacatcacctcttgtgtcccagaataatgaacaaggctcaaccttacgggatttgctgactacaacagctggaaagctacgtgtggggtctacagatgctggcattgcctttgccccagtatattcaatgggagccccagtgagtgatgccagatttttggttttaatgtgggccttaaatagagatgatttggagacttagtttttggctctgaactacccagtatgctgatgaaatcaagtgtaccaaattgctaggcatgtttctatttgcattataactctctttaccttgaaagctggcattttctgtctttttttccacgg

SEQ ID NO: 511949 - DNA, 94 bp, Homo sapiens
tgtccagaactcacacgggaggatgcccctcttctttcggaagcggaaagccagtgaggaggctcggaaacgcctggagtaccagatgtgtctg

SEQ ID NO: 511950 - DNA, 125 bp, Homo sapiens
gggatggcaccggactcctgaaggatggggtcttcaccacttcttctgacatgtggtcctttggcgtggtcctttggcgaactcaccagcttggcagaacagccttaccaaggcctgtctaatga

SEQ ID NO: 511951 - DNA, 261 bp, Homo sapiens
gatagaacaatattaccttgccttaaggagaaaaacgagccggaggggaaaaataagagtaaggtattaaagaaatgagaccagaaatcacagtacaagacagagaactctacttgactatacacatgtaaaagttacacatcacaagagatgggacagtagcttagcgtaacatagctatagtgaaaatcatttggataaaaaaataatctagatgcggtcatcagaatgtttggtctgcttaagttaatgtaagagata

SEQ ID NO: 511952 - DNA, 3819 bp, Homo sapiens
  misc_feature (471)..(471): n is a, c, g, or t
  misc_feature (475)..(476): n is a, c, g, or t
  misc_feature (500)..(501): n is a, c, g, or t
  misc_feature (509)..(509): n is a, c, g, or t
  misc_feature (563)..(563): n is a, c, g, or t
  misc_feature (623)..(623): n is a, c, g, or t
  misc_feature (630)..(630): n is a, c, g, or t
  misc_feature (3700)..(3700): n is a, c, g, or t
  misc_feature (3748)..(3748): n is a, c, g, or t
  misc_feature (3764)..(3764): n is a, c, g, or t
ccacccacgactagagagtgctcatgccagcagcttgagccacttagcgctagcacaccagcaacaacaacagttgttacagcaccagttacctcatcttcttggacaagcccatccttctgcttcatataatcagcttggactttatccaattatttggcagtatccaaatggaacacatgcatactcaggacttggtttgccttcttctaagtgggttcacccagaaaatgcagttaatgctgaagcttcattaaggaggaattctcccagtccttggctacatcagcccacccctgtgacctcagcagatggtattggattacttagtcacattcctgtcagaccttccagtgcagagcctcatcggcctcttaaaattacagcccattccagtccaccattgacaaaaactttagtagatcatcataaggaagaattagaaagaaaagcttttatggaaccattacngtcnnttgcatccacatcagccaaaaatnncctggatntaaataggtcacagactggaaaagattgtcacttacataggcattttgtggatncagtattaaatcagttacagaggccaccccaggagactggagagaggttaaacaaatacnaagaggnacacctcgattcttcaagaaagtattgatgttgctccctttacaactaaaatcaagggacttgagggtgagagagagaattattccagagtggcatcatcatcttccagtcctaaaagccatatcatcaaacaagatatggatgtagaacgctcagtatcagatctttataaaatgaagcactcagtgcctcagagtttaccccaaagtaactatttcactacattgtctaatagtgtggtcaatgaaccaccaagatcatacccatccaaagaagtttcaaatatttacggtgataaacagagtaatgcccttgcagcggcagcagctaatcctcaaactctgacttcatttataacatctctttcaaagcctccacctttgattaaacaccaaccagaaagtgaaggtttagtaggcaagataccagaacatcttccacatcagattgcatctcactcagtaacaaccttcagaaatgattgtaggagtcctacccatttgacagtttcttctacaaatacactccgcagtatgcctgcattacatagagcaccagtatttcacccaccaatccatcacagcctggaaagaaaggaaggcagctatagtagtctttcccctccaactttaactccggtgatgccagtaaatgctggtggtaaagttcaagaatcacagaagcctccaactctaatacccgaaccaaaagactcccaggcaaattttaagagttcttcagaacagagtttgacggagatgtggagacctaataataacctcagcaaagagaaaactgaatggcatgtggagaaaagcagcggaaagttacaggctgctatggcatctgtcattgtgcgtccatcttctagtacaaaaactgatagtatgccagcaatgcagttagcttctaaagatcgagttagtgaaagatcttcagctggggcacataaaacagattgcctcaaactagcagaagccggagaaactggaagaatcattttgccaaatgtgaattcagacagtgttcacacaaaatctgaaaaaaactttcaggctgtctcacagggcagtgttcccagttcagtcatgtctgctgtaaatacgatgtgtaataccaaaacggatgtaatcacatctgctgccgatactaccagtgtttccagctggggtggttcagaagtaatttcctctttatcaaataccattttggcctctacatcatcagaatgtgtatcttcaaaaagtgtcagtcagccagtggctcaaaaacaagaatgcaaggtcagcaccacagcaccagttacattagccagtagtaagacaggaagtgttgttcaacccagttctgggttctcaggcacaactgattttatccatttaaaaaagcacaaggcagcattggctgcagctcagtataaaagtagtaatgccagtgagactgaacctaatgctataaaaaatcagacactttcagcctcccttcctctggatagcactgtaatctgtagtacaattaacaaagcaaactctgtaggaaatgggcaagcttcccagacaagtcaaccaaactaccatactaaactgaaaaaggcctggctcaccagacactcagaagaagataaaaatactaataaaatggaaaattcagggaattctgtatcagaaattattaagccatgttctgtcaacttaatagcctctacatctagtgatatacaaaatagtgtagatagtaagatcatagttgataaatatgtaaaagatgataaagtcaacaggagaaaagccaaaagaacttatgaatctggctctgaaagtggagactcagatgaaagtgaaagcaagtcagagcaaaggactaaaagacaacctaagccaacttacaaaaagaagcaaaatgatttgcaaaagagaaaaggtgaaatagaagaagatttgaaacccaatggagttctcagcaggagtgccaaagaaagaagtaaactgaagttgcaaagcaacagtaatactggcattcctcgttcagtattgaaagattggcgtaaagtcaagaagctgaagcaaactggggaatcctttttacaggatgactcctgctgtgagatagggcctaatttacaaaagtgtcgagaatgtagacttattcgcagtaaaaaaggagaagaaccagctcactcaccagtattttgtagattttactactttagacggttgtcatttagtaaaaacggagtagttagaatagatggtttctcttctcctgaccaatatgatgatgaagctatgagtttgtggacacatgaaaattttgaagatgatgaactagatatagagacttctaaatatatcttggatataataggtgataagttctgtcaattagtaacatctgaaaaaacagctttgtcctgggtgaaaaaggatgccaaaattgcctggaaaagagcagtgagaggagtccgggagatgtgtgatgcatgtgaagcaacattgtttaacattcactgggtctgccaaaaatgtggatttgtggtctgcttagattgttacaaggcaaaggaaaggaagagttctagagataaagaactatatgcttggatgaagtgtgtgaagggacagcctcatgatcacaaacatttaatgccaacccaaattatacctggttctgttttgacagatcttctagatgccatgcacactcttagggaaaaatatggtattaaatcccattgtcattgtactaacaaacagaatttacaagttggaaattttcctacaatgaatggtgtatctcaagttttacagaatgttcttaatcacagtaataaaatttctctgtgcatgcctgagtctcagcagcaaaatactcctccgaagtctgagaaaaatggtggcagcagcccagagagtgatgtaggcacagataacaagttaactcctccagaatcccagtcaccactgcactggttagcagatcttgcagagcaaaaagccagagaggaaaaaaaaggtaaacataattgattatctaggcatgtgtgagaggagtatagtataactaaccaacnatgtactattgtacaataaagtactgttaatattgaggtaaacaattnactttggtctttttcntgaattatgggttaggttcaatgtaaaacatttggtcttcacttattaggaacta

SEQ ID NO: 511953 - DNA, 146 bp, Homo sapiens
gagcgttggcggttcaggctatagccacctgttgcctggtcctacacattgtttttaagtaccataccatacagccactaactacattgcttagacaaagcaatacagtaattatgggaacatattggtttagccttaccagaaaa

SEQ ID NO: 511954 - DNA, 227 bp, Homo sapiens
tgctgtagatgtggctcgctaccttgacctatctatcagacttgaacgcacctgctatatggccactgcgtgggtgatccccatgtgcatgtgactgtgcacagcctgtggcatctgtctattgataacatgcttgtaccacgctgtgcaatttttgcccctgtatttgaccccatgacacatgcctgcgacatgctgtcccacccctgacactgtgacctgcgaca

SEQ ID NO: 511955 - DNA, 1036 bp, Homo sapiens
gcagccagaattttatttttgggaatgttttttcgaaaatggggcagacaagaaaccagaaagaaaaattggggggggtcctgtggacacagaatcgtgtgaaccccagttctgaaatttggggagaccacccccttgtggggaatttgagacggcttttgggtgttacccccggccactgtccgccccttcttaattgcctccgcgcaaggagtgtgaaatgtggtctgctcgctccaaaaagagctcccttcttcacttgtgatcaaaaaggcacttccaccggaggtttttcttcacgagagagactttcttctcttttgggggtggcggcccctccacgagcgcaacttttagtggaggccgggggcttttctcaccacaaccaactgcttgtagaaggagagccggcttttggacgcggccagaggtatggcgagactttcctccctgtggaggaatgcacacacatgacgcctccagatgaatgtggaagactttggattgacactaagagtgggaaaatgcgagattgtgtagaagacacacccacacacgaagagggttctaagaccaccacattttctatttttttgtgggagacacactggatattttctccacaccacatggatagagggacaaatttcttcttactacatcttaagatgtgggatttacccagtggcgccgttttttacacccagaaagtttggatacacttgtagatgggctcagttggttaagaccacctgccaaccagatgtgacagttgttgcgatgttcctagggaagaccactgtgaaaagttcttatgagattggttgtagcccggggtgatatggaatcagtatttgttcgcacaactaaaaattttccagagaaaattgggtgttgaacaatcttttttttttatagtgtgggttgtaataatttttgtggggagttttttttaagtaaggggttttttttaagtgatccctttatttgtaaattaatgggtttttccattaaaaaaataaaaatttccgcccga

SEQ ID NO: 511956 - DNA, 746 bp, Homo sapiens
  misc_feature (73)..(73): n is a, c, g, or t
  misc_feature (81)..(81): n is a, c, g, or t
  misc_feature (172)..(172): n is a, c, g, or t
  misc_feature (203)..(203): n is a, c, g, or t
  misc_feature (205)..(205): n is a, c, g, or t
  misc_feature (248)..(248): n is a, c, g, or t
  misc_feature (265)..(265): n is a, c, g, or t
  misc_feature (267)..(267): n is a, c, g, or t
  misc_feature (275)..(275): n is a, c, g, or t
  misc_feature (293)..(293): n is a, c, g, or t
  misc_feature (306)..(307): n is a, c, g, or t
  misc_feature (335)..(335): n is a, c, g, or t
  misc_feature (339)..(339): n is a, c, g, or t
  misc_feature (346)..(346): n is a, c, g, or t
  misc_feature (351)..(351): n is a, c, g, or t
  misc_feature (358)..(358): n is a, c, g, or t
  misc_feature (567)..(567): n is a, c, g, or t
  misc_feature (570)..(570): n is a, c, g, or t
  misc_feature (575)..(576): n is a, c, g, or t
  misc_feature (578)..(578): n is a, c, g, or t
  misc_feature (583)..(584): n is a, c, g, or t
  misc_feature (587)..(587): n is a, c, g, or t
  misc_feature (601)..(601): n is a, c, g, or t
  misc_feature (604)..(604): n is a, c, g, or t
  misc_feature (630)..(630): n is a, c, g, or t
  misc_feature (651)..(651): n is a, c, g, or t
  misc_feature (654)..(654): n is a, c, g, or t
  misc_feature (658)..(659): n is a, c, g, or t
  misc_feature (674)..(674): n is a, c, g, or t
  misc_feature (683)..(683): n is a, c, g, or t
  misc_feature (686)..(686): n is a, c, g, or t
  misc_feature (692)..(692): n is a, c, g, or t
  misc_feature (697)..(697): n is a, c, g, or t
  misc_feature (700)..(700): n is a, c, g, or t
gggcgcccggaaggtcagcgtgtgaagtaggcgctggcaacgcgggttacccgctgttatgaggagtaacggnccagggancacccaggcttgaggcagcgggggaaccactcggtttgctgcgataccatggaaggaggcgggggaagcggcaacaaaaccacagggggantggccggctttttcggagccggggagcaggntnactcgcacgcggatttggctggcgtcccgctaactgtatgaanccctctgtctccttatntnaatgtggntccacgatacctcgtgcnggatacagatganntttattttacctaccggagctaataaanaccnggggcangattngagctgnccttctttacgactggaggatgtcgcatgacatggggctgctgttggtgcagttgaatggtcttcggctaggattgactggagatccagaacatgggctggtccaaaccaagaaatgtacagattcgaatatggtgacttaggcaagggggcaactttgtggtgctacttacgtctaggtttctcggggcttttgctctaatagtgcanttnggtgnncntcatnnggngaaaaccacgaggngcngaagatgagcttaacacagtagcagntgggaccatgacaggcctgtngtntcanntgtcccggtggtctncgagggatngcncgaggnggtcngcnggactacggttaccagccccttgcctattaataatggcgccttgaa

SEQ ID NO: 511957 - DNA, 435 bp, Homo sapiens
  misc_feature (315)..(315): n is a, c, g, or t
  misc_feature (333)..(333): n is a, c, g, or t
  misc_feature (423)..(423): n is a, c, g, or t
gtaaccccgtctctactaaaaatacaaaaattagctgggtgtggtggcgtgcgcctgtagtcccagctgctcgggaggctgagccaggagaattgcttgaacccgggaggcaaagattgcagtgagccaagatcgcacgactacactccagcctggcgacagagcgagactctgtctcaaaaaataaataaataaaaaaggacaggacagtgttaaagatgaagcttgcagtggcagactgcaaggaaatttgcaaggaaaaaattaaccttgtttgtgccttatttgaaggggacaaatgattaacagcaaaancaatagcgacatcacagncatctcaagtgattcagcttacacaattctggctgaaaaatttaaacttgggcaaactttcatctcattgggggccaaaccattgcaccnaatcagctatag

SEQ ID NO: 511958 - DNA, 1072 bp, Homo sapiens
  misc_feature (145)..(145): n is a, c, g, or t
  misc_feature (398)..(398): n is a, c, g, or t
tccaacccatggtgatctgactctgggctacgcgacggggcccccgtcaactgcctcttggtctcatgccacgtgctacccactgtggacctggctgctggtgttgcatccctagccagctagtgtgcgggagttccagatgctnggtcactaagagggagggcttccagcctagacttgtgtacggccaggtcgtagctgccccatgagtgttgcgtgagtagagatccagtggagtgagcatatcccatctcaaatgactggtgggcacttggtccccgtcgttctcagcacattcgtgtgtgagtgcatgctggctggtgtgcgctgtccatactggcggtgtgacgagcatggatccctacttggcacggtcgtccctggttgatgatgcatcngtctcttcttgctgctgggccgtgctgcgtcctccgttctaatttcttgccatcgtatgccggtcgcggagcacgcagtggacaacgtgctttccctggagatcacgagcgagtgagatgctgaccttgatgctgtcgatcccctaccggacactcgaccttggttgggtagcctagcgcgcaccttgtagtacactcggaccgactctaaacgcgacgtagcgaagctcccctagtcaccctcggctcgatcaacgatcgcgtatcttctcccgtggcggcgcccgtccccccgggggttctcccctgcatgtcttcaattggagtcagatgagatgagcgccgactcagggttccatcgccaagcattcgtggtgggtgttcccctagtgttgcccccggtgccccggtttgggacttggtgtcgggccatccgtgtacttgaagtgggtgtgagatgctgatgtccccgctcttgcttgtctggccttcagggcctgtgcctggctccgaaagggcaactggaacctcccctcgctcagctcttcgtggaacaagagccgtttgtgcccggcccttgggaagcttggggccagctggccctctgctctcccgtaggctagaagggtcttacacctataaaaccaaaagtcgtggcccgaggtcctgacaat

SEQ ID NO: 511959 - DNA, 532 bp, Homo sapiens
  misc_feature (58)..(58): n is a, c, g, or t
agttggacctgggtctgccagggttgcctgagacatcaggaatgagaggcgctacccncgcgggaggggctgaaggtggagtagggtagaattcagggcagggtgactggcctcaggcaagagccaagatgccacctgctcgtgtgtgcccagactgctggccacccagcctcgtgggtgagcctcatttgttcttctctgcgtcctgctttctccaggaaccacggggccctccagacctctcggaacgatcgggattccacagagccccggtgccgccgtcgggggcaattgtcccactgttgccagtggaggatgcacttggagtgccttttcccaccttgccagagtggacactgtccgtgggcgctctgcggggctggctgggacagccggctgagaagcgccaccccctcccgcctagggctgtacactttgggtttataatccacatggcagggtccagacgtccagacagcagccgaagcctctaccagccttttcctgaaacccagcagatcttccacttgtt

SEQ ID NO: 511960 - DNA, 260 bp, Homo sapiens
gtaattttgagagaggagagaatcggaggcggaagtttaagggagacaactggtaagcagcagcgggcaggtctcactttctggctcagtgctcgccccccagcgggtccacaaagccccaccctgtatgcgctgatgcttgacaccactgcgccacctcccatagaccacacacagcgtgctcaccaatgatgcgtgtccaccgagaatggcattgctagagctcagacaggtgtctgacgcaatgttcacgtgcctcc

SEQ ID NO: 511961 - DNA, 119 bp, Homo sapiens
actgtcacatgtaatgcctatgaaactgagcctttccctttcttcccagtgtgaaggagaatgaatcctatctcctgccactagctcagtgtggttatggctatgcacagtacccaata

SEQ ID NO: 511962 - DNA, 1590 bp, Homo sapiens
  misc_feature (177)..(177): n is a, c, g, or t
  misc_feature (289)..(289): n is a, c, g, or t
  misc_feature (399)..(399): n is a, c, g, or t
  misc_feature (508)..(508): n is a, c, g, or t
  misc_feature (1228)..(1228): n is a, c, g, or t
  misc_feature (1436)..(1436): n is a, c, g, or t
gggcgtgatgtctctcagacaagttctccgctcccagagatgggtcccgtcggctgtcctgaccctcgtgaaagcagctaactaagccaaggccgactctggtggcgaaacggtgtatacgagcttcaccctaaagcgactgtagctcgcgtacgcgaagactcggtcctatccttncaccaagccattacctgcgtgcactacaagagctagtgacactgattcagattcgtgccgtgtaatgtcaagacagaagctctcgagcgatccgagcacgcgatgatacaangagtagtgatgcctagtgctagagacgtgcgctagttgacgcgcaggagtagcagacacgcgacgcacatagagtgggtgttgtcgggtgcaagtttgttcggagctacnggtgggtacaaagcgcacgcattcgagatgtggcacctgctcagggaaatccttgccaaagcatcatggtgccttatggcttggaagcacctattttctaggctgcatntgagagtagccgatacgaaggtgccggtatcccctttacttagaaggtaaaatttggggcactataaacttcggtaagggagacggagaggcgtctcttttataacacgagacgcttacgtgggcgaaacggcaatagatttggggcaacgtgattggaagcgagttgaggctaacgtaagcggctatgactttggggacggaaaatggagactcttaggggcgagccagttgagcagaaaagttaactgggcccaaaggtgatcaacctcccgggggggatccacttttgctctccaagcgagacgtctcgacgggagattgcgagcccatggcgattttctcattcattggcgtggcccacagaaagagggacaacggggccgccgaaccctgttagacctggggaggcactcccaacgtgtggaaatcgggggaggggcaccctgtggtggtggccctggaatgacaaaggctttggtgaacctctggggaggccacgccgggcggaaacggaagcggccttttggcacgtccacagccaagggaaaacccctgtgggtggtaaaaccccccagtgtttggtgttggcggcgaccggcgcgagtgccgcaagagaataggcactcccgaaaccggttccataccggggggtgtttggaacaccaaaggtggggccaaaaggggctttaaccaaacaaccgcgaggttcaaccccaangagttcagggtatgtgcccaccactaccagagtgaaaaatgctttgggccccctggcagagtagaacccccaacccggaaggggcgcatttggctgcccaaagggggtgtgccccatggtattttgggggggaccatttgggcgaatccccatgcggtcacggatgataagcgccctttcctcactatggaggcgcacacggcacgtnttggggcatagaaaaggcgttaccatctacccggactttaggagaattacaccagcgacacgagtttattacgaaagttgggggccaggagggatacaccttaaataaacggagcgagggaagctgattcggtactcataaaaacaatggctcc

SEQ ID NO: 511963 - DNA, 308 bp, Homo sapiens
gatccgaaataccatcctgtgaatggacacaactgtgaagtagggaaaaccctgtccaagcacgagatggctggtgcttcatccagccaaagacggtcaaagtggttctggaaactttaatggtggttgtgcacgtggttctggtgggaatgacaacctttgatcatggaagaaacattacgtacgttgcagtgacttagatggtagccatagtggtggtggatatggtacgtagtgagtatggctgtaatggattcggtcatgatggactcaactttggaagttgtgtaaatccggcactgattttg

SEQ ID NO: 511964 - DNA, 261 bp, Homo sapiens
acagccggggggcccagagcctctgttgagccacacggacgagccaagggactgcatgcccttagcgtgacccaggctagtgaccaaaagcacacagccccatgggcgctatacaacgcctctgcatggaagacctccgaggacaggacacaccctctgcagctcccatgatacaggaagggcagctgaggcacgtgtgtgaagctcagcttgccgtgacaggctgctgtagaccatgcggattcacatgagtgacctatg

SEQ ID NO: 511965 - DNA, 473 bp, Homo sapiens
ctgcattcaataatataagaatggctcaagtctcttctaataaagcataataaatgaaacatttaaactctggattcagattattttttatttgaaatcctatcatgaaattaaaatattttcgactaacgacaaatttcttaaaaaatatagaaagataagcttcaatggaatgaacaaaagcacagtacaaattattgctaaataataataactggaagaaaaaagatctagttactatccaaacaaggctaatacacagtcagttatctccacttcaaaccttactgtggctctgcgaaggtatgaggataatgtaatgcggagaaagcagagacaagaaggaatctcccctcttatttccttccccatgaagttttggatgcagaagaacagaacagtcatgttgggtatttatcacaatgtacttacttgttcatgctaccactgacaccattaatagaggtaaatgc

SEQ ID NO: 511966 - DNA, 275 bp, Homo sapiens
  misc_feature (218)..(218): n is a, c, g, or t
  misc_feature (222)..(222): n is a, c, g, or t
ccccactccaccttactaccagacaacccttagccaaacccatttacccaaataaagtataggcgatagatattgaaaccttggcgcaattagatatagtaccgcaagggaaagatgaaaattataaccaagcatattatagcaaggctaacccctgtaccttctgcataatgaattaactagaataactttgcaaggagagccaaagctaagacccngaanccagagggctacctaggacagctaaagggcaaccgcttattggcaaatgttgg

SEQ ID NO: 511967 - DNA, 184 bp, Homo sapiens
gttttgtgtcaattggttcgtggcaggaagctattagaaggtcaaacgtccagatgcattactgctatcttagtttaagggggaaagaaaagggaggaggaaggaaagagaatccacctccttttcaatgttttgcttttgaccatgagggtttgtgtgtcagcatgccttttgctgggatgtt

SEQ ID NO: 511968 - DNA, 472 bp, Homo sapiens
  misc_feature (183)..(183): n is a, c, g, or t
ggcgactctacggatccttacttacgccccaaactcactaacccaacaatacaactatttcaccactgggcttactgcagtcacgattttcactttactgactacccatgaaaatgattttagacaggttggaggaagcatactttttaaaaagtatcccttcttatggacgaaggatttggnagtgcggtcatagagattccctacttcttgttgcaggcacagggggattagctcaaatggtagagcgctcgcttagcatgcgagaggtagcgggatcgatgcccgcatcctccaactatttagtttagttcaatcagcacacatagttgtagctctggatagtaaccaatcaatacaagtatatccaccactgggcttactgtaggcactacttggacctttactggattgatcagggaaaatagcttttagacagctgaagcaaggatactttctaaaaagtatcctt

SEQ ID NO: 511969 - DNA, 306 bp, Homo sapiens
agcgcatcttacctgtcgttatgcgggaagtgtctcaccactctgcacttccaggactcttgtatctgcctttaggcggaaattgctgttgtggatttgcaacccgaggtggaatagtctgaagcaatttgctggagacagggggctcgggcaacgccaccccgggatcccttgcaagcagtcgcctgtccacttagccgcaggaagcggccttgcttgctttcttctctggccagctgcaaacgggccgctgaccttcaaccagcaggtaactagggtaacctgtcgctgtgtatttccggggta

SEQ ID NO: 511970 - DNA, 347 bp, Homo sapiens
tccgacgtgttcatggagaaacctgtctctactaaaaatacaaaattagccgggcatggtggcgcatgcctgtgatcccagctacttggaaggctgaggcaggagaatcgcttgaacctgggaggcagaggttgcggtgagccgagatgatgccattgcacttcagcctgggcaacgagaggggaaatctgtctcaaaaaaaaaaaaaaaaaaaaaaaaaaaaaaaaccctcagtggttgctaaaaaactttccaggaccgggcaaccaccggtggttggttaacccattcagagactttgccggtctttccagcaacctcccaggtcacacgtgcctgtggggttg

SEQ ID NO: 511971 - DNA, 363 bp, Homo sapiens
  misc_feature (62)..(62): n is a, c, g, or t
  misc_feature (76)..(76): n is a, c, g, or t
  misc_feature (154)..(154): n is a, c, g, or t
  misc_feature (172)..(172): n is a, c, g, or t
  misc_feature (339)..(339): n is a, c, g, or t
agggtgaggaaaaaatttgtactctccctggcccctacatggggcaggcggggcagtgggtnccccagaagaaggnattcttaagaagtctaggcaggggcagtgctcatgcctgtaatccactttgggaggctaaagtggaggatcacttaanccaggagtttaagactancctggcaacacagcaagatgcccatctctacaaaaaaatttaaaaattagctgggcatgtgtcatgcacccgtagcccagctacttgggaggcttagctgggaggagttggagctcgagagttcaaggctgagtccaggagctggaggctgtagtgagctatgattngcggctgcactctagtctgggtga

SEQ ID NO: 511972 - DNA, 314 bp, Homo sapiens
  misc_feature (16)..(16): n is a, c, g, or t
  misc_feature (42)..(42): n is a, c, g, or t
tggaaaaagggagaanccctacaaaattgtagaggttaaatnctgatcaagtaactgaggctgggcgtggtggctcacacctgtaattgtagcactttgggaggctgaggtggatggattgcttgtgctcaagagtttgagaccagcctgggcaacatagtgagacctcatctctacaaaaagttaaataatcaggcatgatgtgggtcagtttgaggtctgaggtgggagaatcgcttgagcccaggaggtctaggcttcagtgagctatgattacatcactgcttgggtgagagaaagagagaccctgtttc

SEQ ID NO: 511973 - DNA, 175 bp, Homo sapiens
tgaaaaaggttattcgggaaaaaaaaaaaaaaaaagaatgggcaaaaaagtaatcatgtagttgaagtctgtggatccacctgttatgaaaatggttaaacttgaaaccaccaattttaaaaattatttggtctgaaaatgttttactttaaaaaaatgtctattgtaatggcca

SEQ ID NO: 511974 - DNA, 843 bp, Homo sapiens
gggcttgtttggctggagggaaaaaataataaacgtttatattatagtattttctctactgtttgaatttttagagggaatgtggtaattttataatttaaaaaggagttattggggagaggatggtgaataaatgtaaagtaactgatattgagactggttaaactgagaaaatacatatacaatactttatttgtgaagccagacctggacacagaaagatgcaggaagttaaaaaaaattacaaggatgatatgtagaacacatgagttcagagaggtagtacttaagaaaactgattacaaaactgatggtacattgaacaatcttactactaaaagtagagtacaatatgtcacctgatagcatatgcacacgcacacacaattttctcattctggacagatccagaaacaaagaaactgatttacattgcctggctaaggtagggtgaccaaccgtcttagtttgctgagatcaatgggtttcctaggatcaggaaagtactgggcaaatcaggacaagtcagtcatggtaatctagaaagtcccaaaggagttggtctaggccaaactggttcttcatcttacagaaaaacaaaatacactgtatgtcacagtttagagggctctctgaggaacttacagtttcacagttgtgatttatttcttcctttacgaaatgcatccgaacatcacacattgcttgtatttgaagtgtcagtgtaaatttgtcacccaaatttaattcaccatgtcggattatccttgtcctctcttgacctttaaaatgtacatccaaggtgacattaatctcatcattcctttttaaaaatacccataa

SEQ ID NO: 511975 - DNA, 151 bp, Homo sapiens
ctcggtacccgatatttgtggttctggcgcacttagtgtagcttcagggtagggctggtcactgaaaaaccaaggggaggattataacggttaggacttctctgtcccatctcccaacctccaatgagggcatagatgctgacatgatgtc

SEQ ID NO: 511976 - DNA, 203 bp, Homo sapiens
catagaggatcccctatcgattgtagggcacttaaggtcaatcttctacagagccctgctgcttctgtcttgcaccagaaagggacttgcggagcggtgagcacccgaattcttggttcccaccaacacagcctttcagcacgacaaagtaataggtcacttcaacatagtggacaaagccagccagaggctggatgctcttg

SEQ ID NO: 511977 - DNA, 791 bp, Homo sapiens
aaaattaggactagtaagagcccggtgattcaatctggcagaggcagaaagcaaagcatggtagtggctgatccgggcccgttggcggcgtcactgacgcttcgtctccggtcctcgagatcccgagcgcggggaggcagaccggtgagtgaggggcccgggacggacgctagagaggtctgcggggccaagtgtacgccggtacggactggatgaagggcgaggtcattggatggccgtacagccgacatccacagacttgaggcatgggagcattcgtcctggaccgatctggccttgacgcccatggcagaagactcctgccgccagccgaggggctcacgcggggcaagggacaggccgacgacgctggactcccctgggcgccggcactgtctggtctcctactggccaaaacctacgaatgcgcaccgggataactggtagtgcccaaggggttctggattgagagctcggcagatttatcaggagacagcgagcttagggacaaggctgccaccgcttttccctgacggccgtgacgactatcccgggttctgacaccgtgtggaccacatcaatccccgactgatgagctgcatatgtcccccatccctgcggcgcgatccatggggaaacacaggagccccatcacgtgagtgcctcggggttattggacttggaggccaggacctcacatactacatatgtgggatggtcatagacactaaagggtgatggggaaagcccacaaaaggagaatggtgagtcagagaataatacagaacatg

SEQ ID NO: 511978 - DNA, 331 bp, Homo sapiens
  misc_feature (10)..(10): n is a, c, g, or t
  misc_feature (75)..(75): n is a, c, g, or t
  misc_feature (321)..(321): n is a, c, g, or t
ttcccgaacntaaatccttgtttgagtcaaaatcatttttattcaagagggaacaattatattaatctagatttnccctggtaaatccataacatacagacctgaagttcaagcagaacctgaggtaatgtgagccctgggtaaggtatagtaaggatggagaggtaggtaaagaaaggcgagaatgattcatttattgagaaagatgagcaaggtggtcaaatagatttgcttctcaacaaagcgtgtagtttaagcacttagttttggtttcttttgaagctgccttccctttttcccatctctctattccaacataanagaaaaaaaa

SEQ ID NO: 511979 - DNA, 381 bp, Homo sapiens
cattccctgtacatataaacaaactcccctcatgatatctcaggcacatcaataataagaaccaatcatcttaggatcaagcacagtggctcacatctgtaatcctagcactttggtagtccgatgcaggtggactagctgagctcaggagtttgaccccagcctgggcaacatggcgaaactgtctctactaacatacaaaaatcagccgggcgtggtggtgcatgcctatagtcccagctattctgtaggctccggcatgagcattcctcatgggaacctggaaggcagaggttgcagtaagccaagattgtgccattgcactccagtctggataacagaggaaaactctgtctcccacacctccacacaaaaacaatc

SEQ ID NO: 511980 - DNA, 114 bp, Homo sapiens
cgactctaagaggatcccccactgcagcgggcacccccgggaacagtacttcatgtactcgtgcgacggccgtcacttctggtgcctaccggcagcactgacgcaggaccagta

SEQ ID NO: 511981 - DNA, 548 bp, Homo sapiens
acattgatgaagatgagatcacagctagttgtcgtcgctatggccctctgattgtggataggcctcataaagctgagagcaaatcctattttcctcctaaaggctatgcattcctgctggttcaagaagaaagctctgtgcaggctctcattgacgcatgcattgaagaagatggaaaactctacctttgtgtatcaagtcccactatcaaggataagccagtccagattcggccttggaatctcagtgacagcgactttgtgatggatggttcacagccacttgacccacgaaaaacctatatttgatggtggagatccccgaccattacgaagctgtggggcttggcgatgatcatggatcggctatatggaggtgtgtgctacgttggggacggatactgacccctaggcctaaaataaccccaaaaggagtctgggagaattgcgttctctaaatcaacagaagttacctaattagctattcagtgccccgccttaggatcaactcgcactccacgggaggagattatattacaacggggggcg

SEQ ID NO: 511982 - DNA, 464 bp, Homo sapiens
  misc_feature (166)..(166): n is a, c, g, or t
ggcttggggggtcgtgggaaagcaaagcgggtctttgaagaaaaaggtggggataaaagagccagagaagaatttggtgccaaagcccggggagtttttgaagggcaagaaggtttccgaggagccaaaggaggagggggtgcccccaagccccaaggaaaaaagncgaagtttgaaaagcttttgtcccttggctttcccttttccatttgaaaaaaaggcttttggggtttttacggttccctgaccaaggacagacccttttggggccattccaagccagaaaacagtcctggggttcccttggaaaccggttaagttaacatttaaagggcaatcccgggtgggttttgatgggaatttcaaataaactttttaaaaagttgagtgaaaaagctaccccttttcggtaagttttgaatttaaattgtttcatcccagggccaaacccattttttcctcca

SEQ ID NO: 511983 - DNA, 1619 bp, Homo sapiens
cacatcgtgtcagtgaaaattaaccactaatagcccataatggagctatatggatagtaagacctcatatcacacattgtgctgtcatatatacactggtacaattacggttacaacgatctcgtcaactatctgtgactcatcttgagtcctataaagtgcctggggcttgctgcctatacagaagcacatctagtagaacacattctcgatgatagtgaagtgcttgcttcgaaattggtgaagacgagcgcaacctatctcatgttcttggcctttgtggatacatttgggtattgatacttcgacattgcatagcaagctgtagaaactgtggagataatcaacacatatagcataatcctcgcgtctgttgcgaacatattgcacgcacccatgagagagtcacctatggttgacttagtcaatcttcgagtgactcccaatgtgatccaccaagaagggagcatttctcacttcataagcagagccattgcattatcaaagtggcagcattacttccaactcgcctgtgcaccgttgatagctttgtacccctgcattttcggttttggactttggcttagagaatagactcgtagcgattagcaacacttctggaacaaccgcttagatgggttatattcgttcgcgaaaaggcaaacatttgagtgtctacggagcgcgccggaaggacaagccaaattggcacctctttatccctcgaaaccttttaatcaccatacaccttggagaggcttgttttgaaaacagccaacaccctttacaacctgttggcatccgacgggtggcttcataaagcctagaccacacactgcgcggaacatttcacccaagcgttgcaatgtcccccaaacgccgcagttaaacaaggtcgcccatgttaacacggaagtacttaacctggcaagtgtcagcacacatcgcgcttgacacggcggtcgtacaagccttccaaggggcatgcgtatataaaccaactttgttaagcagcacaacccatcattttggtgccagttaaaccaaaagtagccacccgtaagccatgcgccatagagcatcaaacgcccagctttatataggcttgcgcccacaacgactaattccgcttgcggcttatagggccaacaattgcgccttgcgaaccaacatccgatttggccacttgcgtctaagccccactacaagatctgccaatacaacccaatttgacccctcgtgtcgattctcccataccggcagtgggaacttatggcgcaaaacacatgagtaccagacaacccacctggctgacaaacagtcggaccatttgtgcgaccaaactttggccactcaggacttggagcaaacaaccgccccagacagtgccttttgggcacttctttgcacaagggcgacgctttcatttgtgggacacatactgcgacgaagtatcccatgtaatgcacaaaccacaaagaaacgattactgggtacaccaacaaaccattcgagacaaaccagtgcactccacttcttggctggcgcccccatatgacacgtcatacttaccacgggcaacatatcggtctgctaaaccacagaacaagaatatgggg

SEQ ID NO: 511984 - DNA, 638 bp, Homo sapiens
aggatcacttgagttcaggagcttgaggcttcaaagagccataatcatgccactgcaatacagcctgggtgacagagtgagactccgtttccaaaaaaaaaaaagaaaaaaaagaaaaaagaaaatctcaaaatctcataaagagaatgggaaaaggctgcatttgtcttggaatttataaatgtattcaaaaatttttttcatctttgttgatgcatatttctgtaatagttttttcctgtcttaattttctctcataaaaggaaaagatttgatattcctgagtcatcactctcctgaaatctcagttttactcagacctgtgctatatagagtattatgttcatgcccatgtctgatgtggagggagagacacagacaggagagtgggtgactgactcagatgtaaatgatcttattatacttgagctgcaaccacacctagaaaccttgacaacaacagggcctgtgtttgatatatctcacttgttaaatcctgtctggattttagtatgtcatatgtgtgttcatcagcaaaattgaacaggtgctggaacaattgcaaagctttaatcagacttatgattacacttttctcgttatgattaaactgtttctcaattttggccaaggatatg

SEQ ID NO: 511985 - DNA, 561 bp, Homo sapiens
agcgggggtggtgacagttgatagttgtgaaagtcgttgtctctgagatacgtgaacacacgccgctattcacaatgcctctgcaacagaacaacagaatgtcactggcactcgactataatatgctaaaaatgtttctggttccaacagacacacaaaccagttatcagccattctaaagttcttggcaactgcaaactgctaagtccacaacggcattagactcgcagatatatacatgtgcaattccaacaggaaaaagtggatggaacatgttgttatgttacatacactataagagatcatgaccagtacctttgggctcagactagatagaaaaccctaaaaaacaaagctgcacacacaaagattcttacacaacttttctacattcaaaagaaaacccaggaagaatttatttatcggaacgttgaggaggacttcataaccagctccggaggtgctggataccagcaaaggagacagaatcaacataatatgggaacccatgtgcctgatgaaaatggacacattacctggttgggtaccatgtagagaaaa

SEQ ID NO: 511986 - DNA, 309 bp, Homo sapiens
cccttgaggatagcccctttgggcccagtgggggtggaggccctgcctccccctgaagtagcaggccgcatgcttggaggtaaagtccatggttccctggcccgggctggaaaagtgaaaggtcagactcctaagggggcccaccaggagaaaaaaaaaaaaaaaccaggtcgggttaaacgggggatgcagtccacccggggctttgtcaacgttgggcccccctttggcaaaaaaaagggccccaaagcccacttttaagttttttggaatttgggctttttttaaaaaaaaacccccttggttcca

SEQ ID NO: 511987 - DNA, 103 bp, Homo sapiens
ggtccaccttggcgatgggaaagccggtggccttggacgcagcgacgaacgcgacacgcgcgggttcatctcgatgacgatcatgcgtgcgttctcggggttg

SEQ ID NO: 511988 - DNA, 433 bp, Homo sapiens
  misc_feature (76)..(77): n is a, c, g, or t
cacctctaaaaaaaaaaaaaaaaaaaaaaaaaaaaaaaaaaaaaaaaaaaaaaaaaaaaaaaaaaaaaaaaaaaanncctggggttgggcccaaattgaaaaaaaagtttatgaaacccggcaacctaaggggggggccgggaaccaaattcccctaaaagggagggaaaaaaaaaaaaatgggccgggttttaaaaaggggggaatgggaaaaacctgggggtaaccaaattaaaaggctttgaaaaaaatccccttttgacaagtgggggaaaaaaaaaaaaggcccgaacgaatcgcctttccaaaaatttgccaaccctaaagggaaaagggaaaattgaaagcgtaaaaatttggtaaaaaatcgggtaaaattttggtaaaaaaagttaatttttaaacaaaaaggccaaaatcggaaaaatccttt

SEQ ID NO: 511989 - DNA, 493 bp, Homo sapiens
  misc_feature (31)..(31): n is a, c, g, or t
  misc_feature (45)..(45): n is a, c, g, or t
  misc_feature (62)..(62): n is a, c, g, or t
  misc_feature (224)..(224): n is a, c, g, or t
gttcatttctacacagaaatagtagatggcnagtttgtgggtttntttttttacacgaattngaggaaaaccaaatgaattggatagccaaatggagacaatttcagcaaatctgtaagcagttggtatgtttagtgggggtaatgaagtatttcagtttggtgaatagatgaccggtttttacttcctcaccctgaattcgtttggtaaatgtagagttgggntgtgtaactgaggcgggggggagtttccagtattttttttggggggggggggggcaaaatatgtttccagttctttttcccttaggtctgtctagaatcctaagggcaaatgactcagggtgtaacagaaaacaagaaaatccaatatcgggataatcagaccaccacgggtttacagtttatagaaactagagcagttctcacgcggaggtcggtggaagagatgtccatgggcgaaagggtgggtcgttactcttttttccccccac

SEQ ID NO: 511990 - DNA, 238 bp, Homo sapiens
acgggatacaagtgggtagccggtgggttggcagagacatctttaaataatctggggtttgggccatccagaaggtctctttctggctcagggtttctggcagggtctttggggtggactggtgtaagcgagccagtgggctgggaatggttatcatgggtgctcatggtcctttcaccaggaaggggcaatctggctcccagcagctggccggctcccctttcctggcactttggct

SEQ ID NO: 511991 - DNA, 491 bp, Homo sapiens
gtagatgaccatatgaggggacaacaacacatgggctatgcgaaaatgaaagctagtgtagaagatttcgaggaaaagttaaggaaaagccccgaagaagcggatcgggatgagcgtctacaaagggagaagcaagaaagagcagagagagaaaacgaaggggagaggaaaagggaagacagacaagggaacaggcgaggggacgacggccgaccgagaacgagaacgggctcgtgacagagaccgcagacagagaagtcgtccggaagtacacgtccggcgaacctcggcaaagacgcgcagtctcgggcccacaaggtccgaggtgagacgcggggaccgtaggatggcgagagcgaagccgatcgtcgaaggaaacgttcagtgggtcagaaataagacgatgagtcatgacggaaaagggccctgggggcgtgcaacaaggggaaccggggaggggccatgagagggggaatgacatagggatgtga

SEQ ID NO: 511992 - DNA, 252 bp, Homo sapiens
ggcttgaacctaagggagaaggggctgcagtgagcccttgatggaccacttgcatcaactgggagaaaaagtgagacccttcctcaaaaaaattaaaaaataaatataaataaatatatttaccacaaagaaatgataagtgttttgggggatggatatgtaaaatagcttgatttggtcatttcatgatgcatacatgtattaaaacatcatattgtacccatacatatatacaattattatttgtcaatt

SEQ ID NO: 511993 - DNA, 773 bp, Homo sapiens
  misc_feature (11)..(11): n is a, c, g, or t
  misc_feature (133)..(133): n is a, c, g, or t
  misc_feature (202)..(202): n is a, c, g, or t
  misc_feature (297)..(297): n is a, c, g, or t
  misc_feature (299)..(299): n is a, c, g, or t
  misc_feature (306)..(307): n is a, c, g, or t
  misc_feature (309)..(309): n is a, c, g, or t
  misc_feature (319)..(319): n is a, c, g, or t
  misc_feature (335)..(335): n is a, c, g, or t
  misc_feature (338)..(339): n is a, c, g, or t
  misc_feature (342)..(342): n is a, c, g, or t
  misc_feature (350)..(351): n is a, c, g, or t
  misc_feature (367)..(368): n is a, c, g, or t
  misc_feature (371)..(371): n is a, c, g, or t
  misc_feature (379)..(379): n is a, c, g, or t
  misc_feature (381)..(381): n is a, c, g, or t
  misc_feature (387)..(387): n is a, c, g, or t
  misc_feature (390)..(390): n is a, c, g, or t
  misc_feature (422)..(422): n is a, c, g, or t
  misc_feature (426)..(426): n is a, c, g, or t
  misc_feature (428)..(428): n is a, c, g, or t
  misc_feature (430)..(430): n is a, c, g, or t
  misc_feature (450)..(450): n is a, c, g, or t
  misc_feature (454)..(454): n is a, c, g, or t
  misc_feature (456)..(457): n is a, c, g, or t
  misc_feature (462)..(462): n is a, c, g, or t
  misc_feature (467)..(467): n is a, c, g, or t
  misc_feature (475)..(475): n is a, c, g, or t
  misc_feature (483)..(484): n is a, c, g, or t
  misc_feature (486)..(488): n is a, c, g, or t
  misc_feature (490)..(490): n is a, c, g, or t
  misc_feature (492)..(492): n is a, c, g, or t
  misc_feature (495)..(496): n is a, c, g, or t
  misc_feature (500)..(501): n is a, c, g, or t
  misc_feature (584)..(584): n is a, c, g, or t
  misc_feature (623)..(623): n is a, c, g, or t
  misc_feature (773)..(773): n is a, c, g, or t
gctctgctctnagccgctcactgcatggtagagtctggtgcccccgccgccgcctgcatcgccgccaccgccgctccgccacgaccaccgccgcctcctgccctgcagccaccgccaccgcctgtgtcgccgncgcctcgggaccggctgtatgattaggccacaatcttcaatgagtaaacatattcctcaattctgtggngttcttggtcacacatttatggagtttctgaagggcagtggagattactgccaggcacagcacgacctctatgcagacaagtgaactgtagaaantnattactnntncaccaagaancccccataagagtggntannctngacacagnngtgttgaattgaatcnncanagcatttnanaagagntcngacctggatggggtaaacctcagtgcacttcntttntntngcctcagattactgggatgnagantnnctgcntctgntaggaggntcatttanngnnncntnctnncaanntcatactcaagcactgagaatttcaagtggagtatattggagtagacttcaagttcttttgcatcattctcgattcaatattntaattaattcataacctattgaagggttttaactaaatnacattggttgaatgacccggcaagctctgtggaagcacataccagacatgaagattctattcccacatccatccatgcaacttaaccaattattgcgaacttagaagtttggatccccaattgtagaagttgtgaacactttgtccttcn

SEQ ID NO: 511994 - DNA, 747 bp, Homo sapiens
  misc_feature (11)..(11): n is a, c, g, or t
  misc_feature (133)..(133): n is a, c, g, or t
  misc_feature (202)..(202): n is a, c, g, or t
  misc_feature (297)..(297): n is a, c, g, or t
  misc_feature (299)..(299): n is a, c, g, or t
  misc_feature (306)..(307): n is a, c, g, or t
  misc_feature (309)..(309): n is a, c, g, or t
  misc_feature (319)..(319): n is a, c, g, or t
  misc_feature (335)..(335): n is a, c, g, or t
  misc_feature (338)..(339): n is a, c, g, or t
  misc_feature (342)..(342): n is a, c, g, or t
  misc_feature (350)..(351): n is a, c, g, or t
  misc_feature (367)..(368): n is a, c, g, or t
  misc_feature (371)..(371): n is a, c, g, or t
  misc_feature (379)..(379): n is a, c, g, or t
  misc_feature (381)..(381): n is a, c, g, or t
  misc_feature (387)..(387): n is a, c, g, or t
  misc_feature (390)..(390): n is a, c, g, or t
  misc_feature (422)..(422): n is a, c, g, or t
  misc_feature (426)..(426): n is a, c, g, or t
  misc_feature (428)..(428): n is a, c, g, or t
  misc_feature (430)..(430): n is a, c, g, or t
  misc_feature (450)..(450): n is a, c, g, or t
  misc_feature (454)..(454): n is a, c, g, or t
  misc_feature (456)..(457): n is a, c, g, or t
  misc_feature (462)..(462): n is a, c, g, or t
  misc_feature (467)..(467): n is a, c, g, or t
  misc_feature (475)..(475): n is a, c, g, or t
  misc_feature (483)..(484): n is a, c, g, or t
  misc_feature (486)..(488): n is a, c, g, or t
  misc_feature (490)..(490): n is a, c, g, or t
  misc_feature (492)..(492): n is a, c, g, or t
  misc_feature (495)..(496): n is a, c, g, or t
  misc_feature (500)..(501): n is a, c, g, or t
gctctgctctnagccgctcactgcatggtagagtctggtgcccccgccgccgcctgcatcgccgccaccgccgctccgccacgaccaccgccgcctcctgccctgcagccaccgccaccgcctgtgtcgccgncgcctcgggaccggctgtatgattaggccacaatcttcaatgagtaaacatattcctcaattctgtggngttcttggtcacacatttatggagtttctgaagggcagtggagattactgccaggcacagcacgacctctatgcagacaagtgaactgtagaaantnattactnntncaccaagaancccccataagagtggntannctngacacagnngtgttgaattgaatcnncanagcatttnanaagagntcngacctggatggggtaaacctcagtgcacttcntttntntngcctcagattactgggatgnagantnnctgcntctgntaggaggntcatttanngnnncntnctnncaanntcatactcaagcactgagaatttcaagtggagtatatcgaatatcgaagtagacttcaggttgttttttggttttgttttgttttttttttgttttggttttttttttttttttctgttttggtttaaatcatttctgtattcaattttttaattctttcataaccctattgggtgtttttttaaactaaattaacatggctcgaatgaaccgccctgctcctgtggaagtcacatacaagaacat

SEQ ID NO: 511995 - DNA, 725 bp, Homo sapiens
gattacatgaatctggtgaggtggcggtcgcagtgagctgataccacttgtatatgaactgtagcctaggagatactagtgagagtcaatttcttggatactacaacaagtaatctgatcctcgtggtttaacaagtctctgtttcaggagagagtactcctaaaagtacgtaagtcttgtgaatgatcctcttattcgtggtccttactttattcatgtcattgcatctgtgcacgatcaggtactcaattaaaaagcacgcctgtttcttaggcccgggcaccggttggcttcacgccttgtctaatcccagcactttggggaggctgagggcagtgcggaatcacgaaggtgaggaagttccaagaaccagccttggccaacatgtgtagaacccttgtctctactaaaaatacaaaaattacgctgggcgtggtagcaggcacctgtaatcccagctacttgggaggctgaggcaggagaatcatttgggcccaggaggcggaggttgcagtgaggcgagattaagccactgcactccagcctgggcgacagggcgagactccgtctcaaaaaagaacaacaacagaaagcaaagaccttttgttgccacaggcatcaaggatagtgtcgtgtaacaaggtgtctcatgacactcactgacccggtaatctgtgacaccgggcaagcactactgggattggactttcctagcattgtccaa

SEQ ID NO: 511996 - DNA, 274 bp, Homo sapiens
tttttttggggggggggttaattaaaggatattttcttccccccccccctttttttttggggccccccccccccccttttttgccagggaaatgggggatgggctatgagtttgcaaacagctgggcgggcagggggcttttttccaaagggtcccccttggcctccccttccccccctttcccctccttttccttccttccttcctttccttggggccctgggccccctttggaaggttgagagaaacccaaattaaagagggaaagggggga

SEQ ID NO: 511997 - DNA, 973 bp, Homo sapiens
gagatggatgacccctctctgttctcatctccaggtggcggtgggggaccacgaggccggggtaacagggacgcatggatgacccctctgtgggccccaagatcccccaggctttggacgaagatcctgcacgctgtaacggagagccgccacgggaaggagatgaacttctcagcaggaggaagaggagaatggtaacatagcagatggctcgctcgtccctgggccagtcagcgtcagagactgaggaggacacatgtgtccgtatctgatcaacggagaaagatacccggcaatgcgtaggaaccgaagagaagaagagaaacagccccagcggtgtgcgtaggtggttggtcctctgtagagtctctgggtgaccgggtagaatatgacttcaatgctcggtcccgtggctctgattccccagcagctgatgttgagattgagtatgtgactgaagaacctgaaatttacgagcccaactttatcttctttaagaggatctttgaggcttttaagctcactgatgatgtgaagaaggagacagagaaagagccagagaaacttgacaaactggagaactctgcagaccccaagaagaagggatctgaagaggagcacaaggacacgtgatgatgacagcagtgatgacgagcaggaaaagaagccagagagccccaagctgtccaagaagaagttgcgccgaatgaaccgttcactgtggctgcaactcaagcagctggtggctcggccgatgtcgtggagatgcacgatgtgacagcgcaggaccctaagctcttggttcaactcaagggcactcggaactcctgtgccctgtgcacgccactggtgtttaagcgcaatacctgcaggcaacggggcattgagaagccccccttcgagcctggcagacttcatcaaagcacaggatccaagagaatcacaaggcctgcgagcaacgagaacagagacg

SEQ ID NO: 511998 - DNA, 659 bp, Homo sapiens
cattgttgaagacgcccctgttgttaaaagaaagttttagtcgcgccagatggggcgcctttggaagagcccccctttggtgagtctccccttcttcggattgtggagagagtccccccccatggtttccccacattattttagagggtctgtatatgccgcctcgctaatacacacccttgtacatgagaggctttaaattagtggccacccccccctttttggggcgcccgcgcgcgattgtgtggcgctcaccccgcgcgcccatgcgccgggcccccctggggggcggccaatagtgccggctgcagatctcccccccgtgggggcccctgggcggttttcacaacaccccactcttctgctccgcacatacctggcgcctcaactctgacactcttctttgttgtgtttacaaatacagccggccgcaatccttatcccaccgcgcgcgtggggtggagtggcgcatatccgccgtaaatgccaccagaccccgggagcggcgccgcgcgcgcagagagcatcccctgtgtctcccactcgcggcgcccgcgtggtgcactccgcgcccgcgggcagccactccccctacgctcgcctcgccgcctctcggaggaccgacgcaaccaacttctacagctaaacaaagcaagaca

SEQ ID NO: 511999 - DNA, 843 bp, Homo sapiens
  misc_feature (72)..(72): n is a, c, g, or t
  misc_feature (144)..(144): n is a, c, g, or t
  misc_feature (203)..(203): n is a, c, g, or t
  misc_feature (216)..(216): n is a, c, g, or t
  misc_feature (232)..(232): n is a, c, g, or t
  misc_feature (234)..(234): n is a, c, g, or t
  misc_feature (259)..(259): n is a, c, g, or t
  misc_feature (280)..(280): n is a, c, g, or t
  misc_feature (282)..(282): n is a, c, g, or t
  misc_feature (284)..(284): n is a, c, g, or t
  misc_feature (335)..(335): n is a, c, g, or t
  misc_feature (348)..(348): n is a, c, g, or t
  misc_feature (397)..(397): n is a, c, g, or t
  misc_feature (412)..(412): n is a, c, g, or t
  misc_feature (448)..(448): n is a, c, g, or t
  misc_feature (471)..(471): n is a, c, g, or t
  misc_feature (481)..(481): n is a, c, g, or t
  misc_feature (485)..(485): n is a, c, g, or t
  misc_feature (500)..(500): n is a, c, g, or t
  misc_feature (502)..(502): n is a, c, g, or t
  misc_feature (525)..(525): n is a, c, g, or t
  misc_feature (528)..(528): n is a, c, g, or t
  misc_feature (536)..(536): n is a, c, g, or t
  misc_feature (545)..(545): n is a, c, g, or t
  misc_feature (547)..(547): n is a, c, g, or t
  misc_feature (555)..(555): n is a, c, g, or t
  misc_feature (558)..(558): n is a, c, g, or t
  misc_feature (561)..(561): n is a, c, g, or t
  misc_feature (568)..(568): n is a, c, g, or t
  misc_feature (570)..(570): n is a, c, g, or t
  misc_feature (578)..(578): n is a, c, g, or t
  misc_feature (637)..(637): n is a, c, g, or t
  misc_feature (720)..(720): n is a, c, g, or t
  misc_feature (759)..(759): n is a, c, g, or t
ggcggcggcggcggcgacacgtgcgagccatggtcgcgctggagaaccccgagtgcggcccggagcggcggngggcaccccgggcgggcggcggctgctgccccttcccagctgcctgcctgccctagccagctcccaggtgangagactctcggcttccaggcggaaacagcacttcatcaaccaggcagtgcggaactcanacctcgtgcccanggccaaggggcggaanancctccagcgccttgagaatacccantacctcctgaccctgctgganananacgggggcctgcctggcctggaggatggggacttggcaccccctgcatcancaggcatctttgncgaggcctgcaacaacgccacctatgtggaggtctggaacgatttcatnaaccgctccggggangagcaggagcgggttcttcgctacctggaggatganggcaggagcaaggagcggaggangggccctggncgtngggaggaccggagananaggaccccgcctatacaccccgngantgcttccngcgcatcancnggcgtctncangcngtcctcnancgcaccgnatccccatggaaacgctggagacctgggaggagcggctgcttcggttcttctccgtgtncccccaggccgtgtacacagcaatgctagacaacagcttcgagaggcttctgctgcacgctgtctgccagtacatggacctcntctcggcagtgctgacctggaggggaagcggcagatganggtcagtaatcggcacctggatttcctgtccgcggggctgctcctgtccgcctactggagcaagcacagctgattgcggccccg

SEQ ID NO: 512000 - DNA, 416 bp, Homo sapiens
  misc_feature (412)..(412): n is a, c, g, or t
agttggtcgcttccctgcgccgtgagcagtaaccaacatgtcagggtgggagtcatattacataaccgagggcgatgaagaagcagacgaagaacacgaagagaaccttgaagcaagtggagactatgaatattcatgaagagatagattgattttttaggttgatgccttcaatgctatactggaatctcatagtgaacatgagttgacaccttttgacatgagcatccagtgtatacagagtgtgtacatcagtgagatcatacgcagtgatcgagatctcttggctgctgtgatatatggtaccgagatagacatatagtctgtgagtcgtaataatatttacgtcttacatgagctggataatccaggtgcacacgaattctatagctcgaccagattcgtgccacanggct

SEQ ID NO: 512001 - DNA, 344 bp, Homo sapiens
aactctagagtttacggctatacattatcacgctggcataacctgtagtcccagctatttggaaggctgaggcaggagaatcgcttgaacctaggaggcagaggttacagtgagctgagatcgcgcactgcactgcagcctgggcaacagtgaggccctgtcttaaaaaaaaaaaaaagagttaaggaatgagctataaacattgacacagagccctgagaagattcttccaacactgatttaaagaactgggttacagttgtttatcagtgaccaaacgagactttaagggtcttgggaaaggtatcccggctggtggggggggtgacgataatgtgatagcg

SEQ ID NO: 512002 - DNA, 312 bp, Homo sapiens
  misc_feature (208)..(208): n is a, c, g, or t
  misc_feature (256)..(256): n is a, c, g, or t
  misc_feature (273)..(273): n is a, c, g, or t
tttttagagatgatagggtctcactctgttccctagcctggagtgcagtggcaccatcatagctcactgcagccttgaacttctgagcagtcaatcctcttgcttcagcctcctgagtagctgggactacaggcacgtgccaacatgcccagctgatttttttaaaaatttgtagagatgggttcttgctatgttgttcaggcttgtntcaaactcctggcctaaagcgaatttcccacctgggtctaccaaagtnttaggattacaggagtnagcatgcacccagccaatactgactaattttaaaacctg

SEQ ID NO: 512003 - DNA, 173 bp, Homo sapiens
aatcccccctttctttagtaactccacagtttaacaagtctgagccttgactaattgggtaaataatacaaaacaaaaaaggaggttaccctcaataaaattggcccattaaatggtaaaataattgcctaagtcctgccattctggaccaaccattaaaaatccctttacga

SEQ ID NO: 512004 - DNA, 874 bp, Homo sapiens
gaggcggaggtgcagtgagccgagatcgcaccatggcactccagtctggcaacagagtgagattccgtctcaaaaaaaaaaagaaagggaaaaaaaatagctttatacctcttcctggtctcaaccgccatgaaatttctgaacactccaaattcagtggaataatccaagaacaagaatttatacgtctacagaatacattgtccttcttatagtaatagtatactttaaaaagcctcagggtatattatcttctaaacagctacaattcagggcagctacattaaccaactatgttctctagctggagaacaactaggcctatttcacggctgtgtagcctcagggcctaacatgggtgccaaagtaaattattcgtagaattacactgaatgtgtaaaaaaccattcgtttttgtttacaatttgccaaaaattctcaaagggctctgtattgatgtaatccttgaaataataatttaatttgattctcagttatggactgctgggtgtgacttagtacatatgtactcaattattataaaaaactcaaatatttggtttggattttacacaaattcctttccctcttctacaagttacattttttacaaatcatggggttatctcctacataggttatatttaatggttctagaaacatgttcagatatttgtgctaataggatattggcttaatttccccacatttcttatttaagatattctggagagattggagggaggacttaacttggattaaatggtggggggcaagttttatggggccaagggaggagatttgacaggggaagggtccacaagaagagggttaaaaaaagggggcgaaaaaaatgcaagacggcgagattata

SEQ ID NO: 512005 - DNA, 154 bp, Homo sapiens
acaggccagcccagctccacgatgacggaacaaggttctgtcacacagccaccaggccggaagttgagagaaaacccaagatcactgcctcccgcaaactcaagctgaagagcctgatgctggccaaggcaaggaatgcagggagcaggagcac

SEQ ID NO: 512006 - DNA, 860 bp, Homo sapiens
ttctagatgctgtgagagacagtaaggaacatatatcgctcagttgcagtaccatttgagaagagctccaccagcagaccgtgatgcctatggaacacacacagcatgaaactttttaggtctcgaaagaaatctttgacattcttcttggagttttccctagtttacttggggtagatgttgagtacgtctggttacgcttattactcaactggcaaaagaactgtcgaaacaaaggtgtacttaaaactcaagcagaaagatactaactgaggctgtcaaacaaagtttctggaagaaaacgaaaaactagaaaggattttagaaagagccatggtgaacagatgaagaagtgtgttttggaagcagaaaataaagaagtagtagaagattccaggagaaagtgaaaactgaattaaggaagacttcagatgccctttctattggcacagaaatgatgtgatggaaatgaaagatgcggcagagagacttgcgaaagagtatgatcaatcgtgaaagaacattctgaacgtcaggatcgtgtagaaatgaggcagcacgaagagactgtgaatttattatagaaacttgcagtatactgctgtccaaaatgatcagtgtgtcatgttaggctctagaaatttacgttcagaaaaaatggcgctatgaccggtcgtacttattgtgaatgcgcgcctaggtggtattggatgggttatcaacatattcgctggtggtgccggtattttgaaggctggatcaagtggtaaaaaaatagggtgttagccaattgccttggagggagggcaacggggggcaccacacgggtttaaacaaacaaaaaaggttggggtccaaaa

SEQ ID NO: 512007 - DNA, 195 bp, Homo sapiens
ctgatggtttcagcctaaacagaagtctctgtcagatgtttctttcatagggccattgtgggcaggaatttaccacccactgacaacagtaactggtttggttgattgtacaaagggaggtcctgtgatacttttgcaacatctttatatgttgtgaccactccctcacccagccatggctgctactgctgatgg

SEQ ID NO: 512008 - DNA, 395 bp, Homo sapiens
ctccgctgctcgggccctcctggggagcccccgctccagggctcgctccaggaccttcttcacaagatgacttgctcgctgttacctgcttccccagtcttttctgaaaaactacaaattagggtgggaaaagctctgtatccccccccctcctaccagctctcaggaggtttgttgttttgcctgttagttctgaggcccaggaagctcttgggggcttgggccccccctctcaaatgtagtctttattctgagattttgaagctggaacctctttaaattttcagaattcttttttttaataggtcctcccgccccaaatgtcagctgttcttagcaaatatgatgatttgggtttgctgttggatttaattctgcaggtgttcaagtcttaa

SEQ ID NO: 512009 - DNA, 140 bp, Homo sapiens
ctctgacggccccccacagaggaggcagtgggaggcagaggaggaggaagaggaggatgaagaggcctgaggaggagcgcctggctctggaatgggccctgtggcgcggacgaggacttcctgctggagcacatccgcat

SEQ ID NO: 512010 - DNA, 125 bp, Homo sapiens
cggacccgacttgcttccatcaggatttctatacattgacctcttgttgggtataagacagcagttcaatgagtgtacacaaatgacgctggtttgatgtgagagctgatgggagcacagactgg

SEQ ID NO: 512011 - DNA, 147 bp, Homo sapiens
  misc_feature (54)..(54): n is a, c, g, or t
  misc_feature (70)..(70): n is a, c, g, or t
gcacgattcacccagacagctctgtggaggcagggtctgagcctcgccatgggncccgcactgcctaggntgtttgtgatgtgatctcggctcaccgcaacccccgtcatcctgggttcgagcgattctcctgcctcagccttcccc

SEQ ID NO: 512012 - DNA, 144 bp, Homo sapiens
tgacaggtagatagagtgatgcagcttctccttggtggaaggtgtgaagtgaccttccctggattaccagcactgttaaaacccacacattctgcttctgcttacctggccactcctcttttcctcttctctcagcttctccac

SEQ ID NO: 512013 - DNA, 545 bp, Homo sapiens
cactgtaatggaaagaacatggaattttggaaccaagtagacctggatttgaattctagctccttgcctgtagtgtatggccctgaacaagtcacttagtatttctgagtgttgatatctttattttttttggtatcttttttataaagtggagataacactttataccttgagaatattgagtaagatgatctcaataaactgtaaaaaaattcaaagtcatagggatggacccaggttgaggggaaagatgagagtttacaagtctaattttttatttcaaaaatatgttcccccactggtactcagaggcctcagatctaggcacccttcccatccgacactccacaccccagaatgcttctgaatgagcagccaccctggaacacctaggactttaacttttggatcagacacagctaggttggaattctaccattgcctctcttgtattgacttgggaaagttattagatttatctgagctttggtttcttcaactggaaaataccctaacaaagagttgtgttaggattcaacaataag

SEQ ID NO: 512014 - DNA, 117 bp, Homo sapiens
  misc_feature (7)..(8): n is a, c, g, or t
ctctgannttgagttgcagcaagattaggatttgagtaaatgtataatacacgcatatgacatgaaatgcacaatagcatgagcttttatcttataatataaattattaatatacta

SEQ ID NO: 512015 - DNA, 134 bp, Homo sapiens
ttcaagcggagatgctggggaggatgaagatgaggctggtggctgagtgtggacccgatcactctaaagatatcccggaatggttggcacacagattacaaggacattgaccaaaacaagcaggatcagagcta

SEQ ID NO: 512016 - DNA, 217 bp, Homo sapiens
actagtgctggcctccagccttagtttttgaaaaaataggaaatgcattggtgccaaatttagattttgatcactctctccatgcaatagcccttttatgggccctgggcgacagctttattgagtgtctctctgttaatctgcaatatcccatctggtacggtttctacaagacttacccaactccttcccactcagagaaccaaatagcctgagc

SEQ ID NO: 512017 - DNA, 173 bp, Homo sapiens
ctcactgtgtccctgtcgccccgcacccccaacccctacacatcattctcgcagtatgattttctaaagtaagtaagtaccatcatgacaggcaggcctgccgggttatgttttttccgcatcttaaggccatcgtatctccttgctcgaccagaaccatggttgcgttgtgc

SEQ ID NO: 512018 - DNA, 466 bp, Homo sapiens
atcgccgcccagcttatagcgcacgcgtctatttacatagggataatgtctgtgtgtaactgacgcgatcctcagttgagtaggctgtttcagcgctacgagggtgttcatttttaactcggcgcatatcacgtatgctcactctgtgtgcaatgagctgttgctctttgcagctaacagtcaactttacgacgggattaacacggttcggtgggcgaatttaaagttgaactaccattctatcttggacaaccagctatacatccaggactcgcgtacgtttcgtcgcctctacctattaatcttcccactattttgctacatagacgggtgtgctctttaagctgttctaacgtagctcgtctggtttcgcgggtcttagctctgtctcgcattgcaacgtaatttctagttcattcattatgcagaaggtatagggggtagtccttgctatatcatgcttggt

SEQ ID NO: 512019 - DNA, 426 bp, Homo sapiens
acatcctgaaatagtgtattctctcaagggcagatctgagctacactgatctcctgaaacatttttaaaatgcagagatgtgggccgggcgcggtggctcacgcctgtaatcccagcactttggatcaaaaactagaaatgattaggcttagtgaggaaggcatgtcaaaagctgagataggctgaaagctgagacagtcctctagcaccagtttagccaagctgtgaatacaaagaaaaagctcttgaaagacattacaagtgttactgcagtgaacacacaactgataagaaactggaacaaccatatcactgatatggagacagttctacctggttcggatagaaaatcaacttgtacacaacatacccttaagccaaagcctaatctagagcaaggccctaactctctgcaatactatgaag

SEQ ID NO: 512020 - DNA, 127 bp, Homo sapiens
gttgtaggacatcttctggtgggcctgtgcggaaactcgaggataaatcagtgagctgcatcactttaaaggcatggcctgtctcctcacttgagtgctatgtccactcgaccaaagccctgttctg

SEQ ID NO: 512021 - DNA, 175 bp, Homo sapiens
acaggtatcatgacaaagtaaacggtgaatggttgtatttagaagatatctatttgctattttctcaaatgatcgtcattttatgatgggcaagttcatgctaatcaaagagttaagtgggaatgcaagtcgatgcatcagccatccaagaatacacgccagacaagaaccacag

SEQ ID NO: 512022 - DNA, 739 bp, Homo sapiens
  misc_feature (637)..(637): n is a, c, g, or t
  misc_feature (640)..(640): n is a, c, g, or t
  misc_feature (715)..(715): n is a, c, g, or t
cttcaagtgagacaccttccttgccaagggaaccagcaagcagactgagtatctcagccacacaggtagttcagtgcttcagggatgaatccagaggttaactactgaatcagtatagaaagtggacgtggcttggcttgttagatcgtttctgtatccgggaaaggcgatgtgggcagagctggagctgcccccccagaggggccagttgttggagacagcagtgatgtggtatgatgacaggtatgctggcgagtcctccttggagccccgttctgcccttatttccaaagcacttggcttggagcgaggggcctggagtctacactgcaggcctctctagcccttgcccaagctaaggtcccattgaaaccgggagcatctgggcgaacggggactccaagggacgggtgatagggttctttgttgagaagcagccgagcctgatgtttaagagtgaatcagcctctgtctctggtgagctgtgtgactcacggcagtgccctcgcctctctgctgagtgtctttacctcgctcgcgggttgtgggagggcttggaccagcacctggtgtgctcttacgctgtttgctgcttccctggggaggatggcacttccctgcccatcaacacgctcangangattctgtcatgctttttcatttggtccaaatgtctaaaggggaaggagagaagtcccccccagctgcttgcaanctggggtgctgcaccgggcgtcca

SEQ ID NO: 512023 - DNA, 133 bp, Homo sapiens
gactctagagcgatccctccttctggccacgctccttctggccacgctccttctggccacgttccttctggccacgctccttctggccacgcggatgatggagggaatagaagagtgtaagaggagtgtaaca

SEQ ID NO: 512024 - DNA, 82 bp, Homo sapiens
tgggctgtacgctccggattacgggatcagccgcgcccaggcagcgtgagccggcgaggccctgtgccaacagcgcgtcatg

SEQ ID NO: 512025 - DNA, 1339 bp, Homo sapiens
ccttcctgggcgtcgcatggtgtcggggtgcgtcgctcttctgctttttgtggctcacgtgcttttttgctctcttctctgtgttgcttcatcatttcttgcctcctcatgggtggcgtgttgtggtgtcgcggtgtggcgggtatgttagatttcgtcctgtgctgctcgctcctttgttcgtggcttagtgttgtgatgtttttgtttctctctttcttcttcttttttgatctgtttttctcgcacgggggtccctcggctggtgttctctcattttctttgctttatatttgtgttctgtcctctcccgttagatgatgttcccctacgatgtcttggtggtgagttacctcctcattactcccctcgtgtgatggtgtgttggggtttgtttgatatacatcaacgttattgtttctctctccctccgatcgtggggagctagatagtgacttcatttttgtgtgggggacgaaatttgttcaccccgcttgtgtgtggtgggagacatttttttttgtctgggcccccgctctttttggggtggcccccccctgtgtttttttggggtattcacccccgctgtgttgtgcccttctacaggggatattctttgtgtttgccaactcctgttgcccatccccccacgggtttttgttgtcacacaactcgcgatcgcgggggtgtcatcttcttggtgccacactgtggtggtaccccacacatgggggtgtcgccctcgtgtgtagagtgttgccccccccgcgttgagattcttcttgtagcccccccctctcgctttctctgcgcgcgctttgggggcacacagggtcacacgcacatctctctcgtttctctgggcgctatctctgtggtgcgccggtcggtgtgtgtccccaaccttctcctcgcacactcaccgctggggttttgtggggggttcccacaacaagagggacacaatatttggccacaccgcgctctctccagaatatagtgataacttcccgggttctcgaagaaatgggcgccacacacacacggagaaaaaggttgggacacctcgggtgcctctttgtccacccctctggcttaccctgctgggccccttctgggagactcgtgcgcctcggaactctggagacccctctggaatattggctttttacaccacgcgggttttaaaccacctcttgaactcggaaaaaccaccctcccccctcgccctttttcacactcccaattaggggacccccaggtcccacaggagaaaaacccccttccaaagtccccaatttgggaggggactttagaccctttcatgcccaaaggggaa

SEQ ID NO: 512026 - DNA, 886 bp, Homo sapiens
caagtaccccacttcccagccatgccggaggtttcctggatgggaccactcctgtccagaggctgctcccagcccagcccagcattcctgggctctggccgggctatggcttcttgtttgcaacagggctgttcccagagctcccagttggtagccggaaggcccttgccccagcctgtgacaacatcctcccgggctgcctgagggtcgtcctcctccactgctttctggcctccatgtttctgattagaaatctggtgggaacgttatggaggatcctttgttcaggatatgttgctttatttttttttttctttagacagggtctcactctgttgcccaggccggagtgcagtggcaggatcatggctcactgcagtctcgacatcaagtggaccccctgcctcccaagtagctgggactacaggcaccagccaacgctaagttcttgtactatgtattatatattattatatggggagaaaagcggaaatttcccctcatgtgttggcccagggcgaggagggccaccaccactcaatggggcaaagagagtgcacaaccggggaatcacaaacaaccgttaacgatctagaggctataagaccacaaacacccccggagcgaccaaggcgccaaccagtgaaaaaaacggggagaaaaaacaaggggcaccccccgaacaaacaaaacccacagcacaaaaaatgaaggggcaaattgaaaaaagaaacaaaagagcggggatcaaccccaaatggtaggcccaagaacgagaatcaccaaaaaaagtggagaaccctcgaggggaaacccaccccacatggagagccccaaaagaggcgggagaacaaaagagagataagaccaaacacaggccaagcaa

SEQ ID NO: 512027 - DNA, 272 bp, Homo sapiens
ttctatctaactgtatgttagtacctattacctgacctctcttaatctaccctccctcaccacaatacaccctctccaggagggtacctatccttctcctctttacctctattaaataaactatttttggcttgacatatgatgtgagaacatgcaatatgtttctttctgtacttggcttgttacacttaacctaatgatctctagttccacccattttgctgctaaatgacataatttcattcttattttttaatgtctaaatgcaatca

SEQ ID NO: 512028 - DNA, 221 bp, Homo sapiens
cccgggaaccccctggggccagggcgggggggggaaatttttggggggggttcaatgcccccctgggggttgcccccccccccgggccaaaaaccccccctttgggggggggggggggggctgggggggttccccccccagggggtttttttgggcccccccccctggtttttttttaccccccctttgttttttaaatggaaaagtttttggggggggta

SEQ ID NO: 512029 - DNA, 165 bp, Homo sapiens
  misc_feature (57)..(57): n is a, c, g, or t
  misc_feature (106)..(106): n is a, c, g, or t
cagccttgacaattataaagcaccaggacctcagtaacatccagtttttaacaaacncggaatacatgcctaattcaatgctactccttcttcaggaccaggctgnaagtgatactattaataatattgctttgatgatatgatgatacatatggaagaagtctc

SEQ ID NO: 512030 - DNA, 739 bp, Homo sapiens
taggtgtctcaggcccctgggccccgcagatggccatttccggtgcctgcccagtggccactcttctggaaggggcttggaaaagaggaaggaggcccagctgtgggggttgagggtagagggtggaccagaggctgaggactgagccacccaaggaggtggggactgctcggctccaccgctgttccgcatgcagccccagccactgccccaaccacaccacagatagccgttggctagacagaccacattagcaaagtcgcagctatcatcgagagagtcactatcagatgtttccacatgctcgccttggttatgggagcagggagggggaagtcctagcccagatggaccaaggacgggcctgaaaggcacatgggggaaagggagcacacggggaggacgtaggggacccatgggtggggcctccaggtgcagcttgtggatggaagacagggatggcctgtgcttcagccgacacaggatggcacaggccagagctgcagcatggaggctcttttcctggtcattgggtggaggctgagtgccacatgtacccacattaaaaaggggggtccagggctgtgtgagtgtagtctatcatgagtctagggctcggggtagtagggtcaggactgtcccttcagcagtcgcttctcacacctgagccaacagtcattggccttcctgattcaactccatcctagattgagctaagaccacctaagacggacggggg

SEQ ID NO: 512031 - DNA, 180 bp, Homo sapiens
cctgcatcatcttccatgacatcatcttccccttctgtgttactgtatcattctcatctctgagattagacatccttcagacccagagaattcggtcaggcataccttgtgttatttgttgccggttgataaacaatacctctcctctctccgtggacatgaatgtagaaagtcccagga

SEQ ID NO: 512032 - DNA, 307 bp, Homo sapiens
ctgagatcgcccaacacattttctggtgatacccaagaaacatatatcttttatttctgcggcagaagatgatggggaaagttttcttggacacttaatgattctcgccaagaaatgtgctgctgaactgggcctgaatatggggtatcgaatggtggttaatgaaggttcagatagtgagcagtctatctatcacgatcatctccatgcccttggaggccggcaaatgcagtggcctcctggctaagcacgtgttgtatacaacatcatgagttatccacaacaccacattgacagaaatgacaac

SEQ ID NO: 512033 - DNA, 348 bp, Homo sapiens
tcgctgccttaataagtgaaaaattggcaactctccgaaatcaaggcaagaggaataaggtatggactaagcctagagttgactttggcaaaagttggcaaaagttagcaaaatctatttttcctatacattacatgcatccagagacaacaaaatgaggcatcaaaaaatagtaagatagctgaaaattctactttgggaaataggacaaatcaaaatgtagaatagacactgaaatgattttaaaaatatggacaagtaaacccaaataaaaaaacatagtaactgtaaaacataaaaaaaccagtataaaataaaaatagctgatatcaaaaataaaacaaaaaa

SEQ ID NO: 512034 - DNA, 402 bp, Homo sapiens
caatgtatttgtatgcttgcactgctggttgtgtatcatcaatatgtactttttatccaatgtctcaactctaatttcatcttagttagacttgctcacgttcagtttgttcagttgtgtgttgacttactatgttttgaaagtggtgacttctaccgaatgagtggaagttcccattgtcaaaaaaaatgggggcctgcttgcagtattcatgttgaccacagagtaaaagtgtattctgtaaagactccccgcccatatttcctgtttatgttaaaagacgttgtttgtagtttttatttagggttaattgtatatttatatcatgtgctttatcgttttcccctcatgtatccaagtaatttttatttacatccccctaaataaatgttgtcctctttg

SEQ ID NO: 512035 - DNA, 893 bp, Homo sapiens
  misc_feature (251)..(251): n is a, c, g, or t
  misc_feature (265)..(265): n is a, c, g, or t
  misc_feature (296)..(296): n is a, c, g, or t
  misc_feature (318)..(318): n is a, c, g, or t
  misc_feature (335)..(335): n is a, c, g, or t
  misc_feature (430)..(430): n is a, c, g, or t
  misc_feature (497)..(497): n is a, c, g, or t
  misc_feature (500)..(500): n is a, c, g, or t
  misc_feature (646)..(646): n is a, c, g, or t
  misc_feature (770)..(770): n is a, c, g, or t
  misc_feature (782)..(782): n is a, c, g, or t
  misc_feature (785)..(787): n is a, c, g, or t
  misc_feature (791)..(791): n is a, c, g, or t
  misc_feature (799)..(799): n is a, c, g, or t
  misc_feature (805)..(805): n is a, c, g, or t
  misc_feature (810)..(810): n is a, c, g, or t
  misc_feature (818)..(819): n is a, c, g, or t
  misc_feature (822)..(823): n is a, c, g, or t
  misc_feature (829)..(829): n is a, c, g, or t
  misc_feature (831)..(832): n is a, c, g, or t
  misc_feature (837)..(837): n is a, c, g, or t
  misc_feature (839)..(839): n is a, c, g, or t
cagctgactgctccaaatggagacctgggcatggccaacgaacaccatttcgaatggaatcaaagaatcacttggcctttcctcatgacaagagatggagacaaacggtctttcattagtttattgtgtgggttctttttttttttaaatgaaaagtatagtatgtggcactttttaaagaacaaaggaaatagtttggtatgagtactttaatggtgactcttaggatctttcaggtaaatgatgctctngcactagtgaaatngtctaaagaaactaaagggcagtcatgcccngttggcagtaatttttcttttnatcatttggttggtccnggctaaactgggagttggagtatagtaaattatgatccttaaatattggagagtcaggatgaagcagatctgctgtagacttttcagatgaaatngttcattctcgtaacctccatatttcaggattttggaagctgtggaccttttcatgtggattatttnaantggtgtgaacatagtataacaaatcatgggtgtccattattggcttggctgagctcagatcaaaatgtttgaagaagggaactttattttgcaagttacgtacagttttatgcttgagatatttcaccatgttctgtttttgggancttctacaggttgatgcctcctggttttatagcaggttagtgggggagcacttgaaagagcgtgtgtacatgtatttttctcctagggcaacatttggatgcaacggtgttttttaaatataantatttactggcnttnnnccangtggcggnaggaantcaantggggggnnccnnaaaagngnncggangntttccctctgagtataaaaaattggggggggaagaggcaggtaactctaaagag

SEQ ID NO: 512036 - DNA, 124 bp, Homo sapiens
  misc_feature (21)..(21): n is a, c, g, or t
  misc_feature (86)..(86): n is a, c, g, or t
  misc_feature (107)..(107): n is a, c, g, or t
  misc_feature (117)..(117): n is a, c, g, or t
tgacaggatgcccagggattnaaggatgtcctcctgacagcatttgcctaccgccaaggtctccaggagctgatcacagggaaccnagacaaggcactaagcagccntcatgaagcnggctcag

SEQ ID NO: 512037 - DNA, 187 bp, Homo sapiens
tagcgctagcccaagacaatgtcactagacctgctaggttcctatcagagaggttattctcatatatattcaagttccttactagccactacacttttaggtaacagatagattacagtttaatgaagggatgctgaagacaacaggtttttgtttattgaagctcctctgaagatctcacggagag

SEQ ID NO: 512038 - DNA, 173 bp, Homo sapiens
tctcaaaagttacaaggaagttcagttaaagattaacagttaaagatcaaggctgaataacactggggacaggggccaaacagaatatctgtggtcagtcaaacacctgggccccggctccagggccaagaacagatggttctcagataaagccggacccaggcacagacaca

SEQ ID NO: 512039 - DNA, 566 bp, Homo sapiens
cgacctccgagggtaaaccgacgcccaggataataagcccggcggagataaccctaagcttgagcatgctccacacagcagctatactaagtaccctagtgtgagccctggcagggttgctacacagcccatctactggatttagtaccatagtcccagcacttggcccagggtcctagactgctgggtaggtcctcagaggtatctgaagtcatgtctacattgatacaaagaaacgtatggctcatctgtaacaatacgtagagaaacacaattaagaacaataaggatcacagaactcgaatggatcattataacttcaagactcagtttaagttaccaagaaatgcactgtagcccttttctcacttttatattcagatcagggctaaccctaacatgttcttaaatgaccacttatggtcatttaagtggtcaatggaaatattgcagcagagaactgctgttttgtttaaacgtactagccattagcattaaaagagtctaatgaactcatctaacacctggacacatttttaaaggtcattatttaccatatgtaaatt

SEQ ID NO: 512040 - DNA, 283 bp, Homo sapiens
atgacctgtcagtcaggtctgagattctttcttcggcttgatctactctaataggtagcagctattcaaatgtattttgtatttcattcaataaatctttcagctccagaatctctgttcagttcctttttttttaaagagagagagtctcactctgttacccaggcgggagtggtaggtggcatgatcatagcgtcacggcagcctcaaaggtccgtgggcgtcaggcagtcttccggtttcagccttccaagtagctgggataacaggaactgaaagtgag

SEQ ID NO: 512041 - DNA, 204 bp, Homo sapiens
ctgtcttagaggatccgaggagatagcaggagacaactcggggctgctgcagactgcaggcatgggaggaggagcctcctagaggatttgcaaagcaaacccatccctgccagaccaggaaacagccctcctaccgtctcagagaaacagacctcagccctaatgatcactcaaatccgagtcaatccctctatttaaaaaaag

SEQ ID NO: 512042 - DNA, 331 bp, Homo sapiens
  misc_feature (100)..(100): n is a, c, g, or t
  misc_feature (153)..(153): n is a, c, g, or t
  misc_feature (184)..(184): n is a, c, g, or t
  misc_feature (229)..(229): n is a, c, g, or t
  misc_feature (237)..(237): n is a, c, g, or t
  misc_feature (239)..(239): n is a, c, g, or t
aaggaaggttttcttctggcggtgacccagggcagagagatccaggctcagaattttttttccggcttcaccctgatgaagttgaggcactcctccgctntgggtggggccagcctaggggccaggcacatcgggcacctcctccccatggantaaagggccaatgccattgccttctattccnacaccttttcctagggggctggtcccggctccacccccaaaaagntcagtggncnctgggtttgaaaggaaggagtcttttgcttcctttctcctttttacaaaaacaaacagagaagaaaataaaggccctttatccaaaaaaaaa

SEQ ID NO: 512043 - DNA, 816 bp, Homo sapiens
cctcggggggtctatcttccggcatacttgcgcacccttgggggttcttcgttgggccattccccccgcctgtgtttattccgggggcgcgtccccctccaagaacatccggcccgaacgttgatgtcgcgttgtccatgtcgcagttctctccccgccgctcccatgacacgtccttgtttgtagtaccaaaccagttgctttgcgcggtcttttaccccagtgtgaccaaataggactcgggtgatgttccccttaatgttctttaaaagtccccccccgtataattctttacatcccccacggaagaatagatttttgtcctttttgaatacaaactcctacctatcctaagtctactaattgtgtaataaatattacccccctcttcactttgctgtgtcaatacacctacaaaagaactcccgcacccgtcgttttttgtaacctcttctcacccccctgccaaggtaacccccctctgttaattccatttctttgggtctttcgccaagaagggcgaacccaccaggtcgtcctgaaaccaggtgggaggcctaatcttttagaataatataaatagtgggaaacaatacaagatcttgcgtgtgcctttcttaacattctggtggcataaatggtctctcgcccctctcctcgctgtcggtggctgtaataagagggatcaccacgagcaccctattgacccagcgcccccccttctgggtcaaaataccttgggtttacccacaaccccccacacagcgtgcccctcggtttgccccaataaaccccacaaacccccccaacataacg

SEQ ID NO: 512044 - DNA, 686 bp, Homo sapiens
tcggcgcggccgctgcatccgtggaggaacgcgccgacgagaccaacatcatgcctgggcacttacagagaaggcttcgagctgcgtggtcaccaaccgattcgaccagttatttgacgacgaatcggaccccattcagaggtgcatgaaggcagacagagaacaagaaaaaagaagccggctggtgaggcggcgttgggggccctgagggccaaagagcgcagactcatggccgcggaccagaccaacatccaacagcggacaggcaaacagcatgcgcaaggagtcccagaaagaccgcaagaacccgcatgccccccagcgttggctgtggttgacaagaaagaggagacagcagccgcccgtggacgcttaagaaagaaggaatcagacgagttggaagaagacctgatcaaacaaactatcagggatgaagggaaaatacattgatagaagaccagaaaggcgacacctcgatgaacgaagattcgaaaaagccacttgaagaacagggtgaaggaggcgaataaaacagttagataagacgattattgaccgacctattcaaggtcgatggtgggtcttggaagaggtacgagggggccgtggacgtggaatgagacagaggagatggataagatcaacgaggcaaaagtgatatgataggcatagatgaagtgatagac

SEQ ID NO: 512045 - DNA, 162 bp, Homo sapiens
tctagcacacagctgcgctcacaaaaactgcgcgacttgttagaactaattgagtggagcctgcaggtgaggggagggaggggctgcaggtcaggtaagatctggaagacaacgcacacttgaagggcaggggactctaagcagggatttacattgaaagga

SEQ ID NO: 512046 - DNA, 1009 bp, Homo sapiens
  misc_feature (11)..(11): n is a, c, g, or t
  misc_feature (13)..(13): n is a, c, g, or t
  misc_feature (168)..(168): n is a, c, g, or t
  misc_feature (183)..(183): n is a, c, g, or t
  misc_feature (214)..(214): n is a, c, g, or t
  misc_feature (219)..(219): n is a, c, g, or t
  misc_feature (230)..(230): n is a, c, g, or t
  misc_feature (233)..(233): n is a, c, g, or t
  misc_feature (235)..(235): n is a, c, g, or t
  misc_feature (237)..(237): n is a, c, g, or t
  misc_feature (239)..(239): n is a, c, g, or t
  misc_feature (250)..(250): n is a, c, g, or t
  misc_feature (252)..(252): n is a, c, g, or t
  misc_feature (262)..(262): n is a, c, g, or t
  misc_feature (280)..(280): n is a, c, g, or t
  misc_feature (314)..(314): n is a, c, g, or t
  misc_feature (351)..(351): n is a, c, g, or t
  misc_feature (380)..(380): n is a, c, g, or t
  misc_feature (402)..(402): n is a, c, g, or t
  misc_feature (455)..(455): n is a, c, g, or t
  misc_feature (465)..(465): n is a, c, g, or t
  misc_feature (504)..(504): n is a, c, g, or t
  misc_feature (513)..(513): n is a, c, g, or t
  misc_feature (525)..(525): n is a, c, g, or t
  misc_feature (546)..(546): n is a, c, g, or t
  misc_feature (572)..(572): n is a, c, g, or t
  misc_feature (577)..(577): n is a, c, g, or t
  misc_feature (588)..(588): n is a, c, g, or t
  misc_feature (676)..(676): n is a, c, g, or t
  misc_feature (767)..(767): n is a, c, g, or t
  misc_feature (808)..(808): n is a, c, g, or t
  misc_feature (817)..(817): n is a, c, g, or t
  misc_feature (821)..(821): n is a, c, g, or t
  misc_feature (832)..(832): n is a, c, g, or t
  misc_feature (856)..(856): n is a, c, g, or t
  misc_feature (906)..(906): n is a, c, g, or t
  misc_feature (941)..(941): n is a, c, g, or t
  misc_feature (946)..(946): n is a, c, g, or t
  misc_feature (949)..(949): n is a, c, g, or t
  misc_feature (1008)..(1008): n is a, c, g, or t
ctgcattgttntnagttcggaagctggtgagagctcggcatggcggtccccgctgcagccatcgcgggccctcggcgttggagccacgaccggccaccgcgctcagatggccccgtcggtgctcaatcaacagcggcctcgtcagcgctactgtagcttgggatgcangaactggttccgggngccacagcaagacgcgctgagttcctgcgcncacancgcaagagatncantngntngcctggatttncnaagggcgttnctagcacatacgagggtncttcgacaagacggccaatcgtcttcttactagnagataggcactctgcattaatctaaagtaaaacaatntatctgggggacatgggggaatatatgtnggaccagctgttgtttgcatcncaagataatccctagacctatattagttacgggcgtctgggagataaaaccantccgcatctngggattgtgagggactacaaaaatagcattgccactgtngaacactanaagggggagaanatttaatatctgcatggagtnctgatggggcagaccatttgctgtangcaanaaggatgatgnggtgacctttattgatgccaagacacaccgttccaaagcagaagagcagttcaagttcgaggtcaacgaaatctcctggaacaatganaataatatgttcttcctgacaaatggcaatggttgtatcaacatcctcagctacccagaactgaagcctgtgcagtccatcaacgcccatncttccaactgcatctgtatcaagtttgaccccatggggaantactttgcnacangaagtgcagangctttggtcaacctctgggatgtngatgagtcagtgtgtgttcggtgcttttccaggctggattggcctgtaanaacctcagtttcagccatgatggggaaatgctggngtcanatncggaagatcattttattgacattgctgaagtggagacaggggacaactatggggagtana

SEQ ID NO: 512047 - DNA, 981 bp, Homo sapiens
  misc_feature (165)..(165): n is a, c, g, or t
cccacgcgtccggtttcaataccaaagtgtgtcttcttctttttttttttcttaaaaaggccggtttcataggaccttctgaaaggatttccagaatattttatcgggctccaaaattaaagcacattagcaacttcacgcttcaaccccgtcatcatctccagngaaagtttcgtgccaaagcgggtggcattagccaacgtttggacttggggttctgcgccaattgggttttagtgtcccttaaaccttcattgggactccttgggggtatacgtttaattctttcgtggcttcaggtgcatttacgtggtaactttttcaacatatggggtctctttcgtggtaccaattagagtattagtgtgatatagtggtggagggcaaaaaagagggtttcacgcagtgggtgggtgacgggaaaagaggaggcttagaaaatcccagttgtggcacagcccgtgggcaaggcgccagcttccccctcgagggctaagcggccacgggttcacacgaagggatccctcagaaatcaggcggccaccgtgccttccacctttcgtgcccgtggagggcaatgggcgctgtgtggtagaaacctatgggtacgcaaagtgttttagtgtttgacgttggaatacgtgtaggtgttgggtttagcaccagaagaagagaccgtggtgtcctagagagtaggccaagggtgatctgcctcttctatggggagaaattctaatgtctttcccactttctacaacaagcccaatattccctccaagttctactgggggctgagggctgtaggaattattgaaagcttctggctcacttagtaatcgtcgggggcccaggacccaggcaataactctaaatacacgggcctaaaggtaatagcctccgaacatctcagtgtgacaatccacaattggaaacctggacgggagcctcaaagttggatggctagttgggcatggagaagcg

SEQ ID NO: 512048 - DNA, 150 bp, Homo sapiens
ctagtctgagaagtttcaatagcaggtggagctcattgctttctccaagctgggaactgtttcgcaagataacacagagggaaagggagagccaccgggtacttgtccacccgtgcctcgctcgtgttcgtgaaattccatcccgcctcg

SEQ ID NO: 512049 - DNA, 1011 bp, Homo sapiens
gatgatatgccgagaaagtcgtacgctctttgcttcaagcatacagggcacctgtcccaaagaaagataggcgtctgttgtcgagccgggatattctcccctctctaccctgttactatgttgttctgattttcatgagactactggctgggcatgtgctggtggtctgtctctcctgggattgagccactggatttgcacgtaggatcgtatggagatagaaagcgagcaggttcttggtcgagaagcctccctctgcttttcattgtcgtttagataactggttactggcgtccttctctcaagggtatcaaggtcaaggtgatggttgctctgttctcaggagagccatcagattcccttcctgttggagaagggtctgacatggaagtcagtgttaaacgggctgatcggtggcgcatcgtggtgggcgtctgggttcagcttaatggttggaattcggttactctgcatgggtgcgacgcatacgcctggctgtggtgggtagaagcagggatagacagctggaagctcagaaacaagcgaacttgaaaaacagactctaagtaagttagaagcatattttgcgtaagataggtattttactctggaagaccaacaacttttggagatttcccttgcccctgtgggacgggccaggtccttgtattaccttccttaggtcctgcaaggtactatgtcctgtcccctgaattgcaagcggggactcagggtgacttgcacccccgcgtcagcaagggacacaagtgctccacggttgactgaggttgctggtcttgagtcccgcgctctttggcctcccttatttcaccgggccgtggagccatgactggggggcgattcttcggtccaggtttacagtggtagccaccgttcggaagacggctttgttttggaacgcccttttgtgaggggtccaggcacccggagttgggccgtttgttccgtgggggggcccggttgggccggcccgtgggcagtgattttcca

SEQ ID NO: 512050 - DNA, 105 bp, Homo sapiens
gcgggcccatttgaggcctctcggcctatggcagcagcgttggcccggacccggagcgaagagcaaaggtagccggacacgtaggaaggatctaagagcgcacct

SEQ ID NO: 512051 - DNA, 170 bp, Homo sapiens
ctgcggtcctcgacggtacctctgctctctccagccccagctgctaccggtccgtcttctccgcggatctccgcggtggtagtcgccccgttcctttttccctcacctagtgttggaaacccagttgtttctcggcctccggttacttgtggtgtgagccattacatagg

SEQ ID NO: 512052 - DNA, 429 bp, Homo sapiens
tacaatttctacacttaggaaggcctgcattacaaggcttacatctgggatccatgactagctaaacagttccctacagtgatataaactatccctaaataactagagtggctcactgtgcctaaactgtttatacaaacaatgtggtttatgctgaacacctgtgttttgtccttgcatataaagtctgtgtgtggcaaagggttaacacagcaggccgtgagactgactggtatgtgagccagcaagcagcgagaatttagggaagcaaatgaatgaaagaagaaagattcataggcctagagaggaatagaagaggtaggagaaagcagtggtcatttggacacgttcaggtgatattattaacaaagtatatgccaggaataagcaaagaaaacaatagttcttctcaaatgtgtagaaattgaa

SEQ ID NO: 512053 - DNA, 254 bp, Homo sapiens
taggcagccatggccccaattaaggcagctgctctgctcctctgaaaaaaaaaaaagagaaaaaaaaaaaaaaaaaaaaaaaaaaagaaaaaaaaaaaaaaagaaaaaaaaaaaaaaaaaagaagggggggggtaaataataaatgagggggggataatttgtaattctgatgtttttgagataaaaaataaaggtgggggggatatttattgaggaggaggggtgtgggagtaatacagaggagggggtgggg

SEQ ID NO: 512054 - DNA, 687 bp, Homo sapiens
  misc_feature (241)..(241): n is a, c, g, or t
  misc_feature (282)..(282): n is a, c, g, or t
ttcaccaaaagtaatcacccagttccttaccaaccctaagctggggccaaaaaggttacctggaaccctaccattggaatttaccagtccagtttccacagcatgcctcaaatttcgctttgagggtgtcagagttatcttgtcatgccctgactcctcaaaagtctctccgtgctcttctatgactcctggcttcagatagcttcgtgtgcaaacactggcgcatggcaatctgtggctntctctttatagaactggagtttctcgaacgagttcatgtgngtgtctgccagaggacacttcagtggggctactgctcgagactgcttaccataggagcgttgagctgctgctctaggctgcgaggtctcccgtggcttcgcagcttcagcagtcacacgctctcactgcagaacgatctggtcagcccagccctctgtcttgcagttactatgatcaaattccttcaaagggatgtccttgagccctgtcccagagatatctaagcagtttagtttcctaaaagaaaacaggtatgcaatgcctgcatctgtgatctcagggttacatgataagtctaataatgttagattctcaaggcctcttttcatcactcgaactggtgctgtcatcttccgcacttcagcatcagataaccaattatccgtcaggtgtagctgagttaca

SEQ ID NO: 512055 - DNA, 83 bp, Homo sapiens
  misc_feature (79)..(79): n is a, c, g, or t
gatttgctggagcagtacaactaggcttaatagggacatgtccctattaagctctaacgttagaagcttgaattcgagnctgg

SEQ ID NO: 512056 - DNA, 223 bp, Homo sapiens
agtgtacttcaagaggggtaatagtataaaatagctattgcagtctttatattcaatatgatgtgcctgtaaaccacggagttttccctgcttagtacaaagacattgtagataattgaatgtttgattagagaaaggtcattagtattcttgtgacacaatatggttagtctggattttagtagccttagtcgggattaactatgtgttcttgaaagaacac

SEQ ID NO: 512057 - DNA, 830 bp, Homo sapiens
  misc_feature (18)..(18): n is a, c, g, or t
  misc_feature (161)..(161): n is a, c, g, or t
  misc_feature (332)..(332): n is a, c, g, or t
tataagagactaagtccngattatagtctagtatagtaatataatagatgatgaggctccgccgttactgtgtgacagtccgagtggaactataacatgatggagtatctctgcaaggcagtgtactggacaatctctggagagtctcttgcatcgcatcnagggcctgtgtgataacatgaagcctgagagctgtgctgatcacgagttgcgtgtatctcctgaaaggtcagcagggcaaccagttcatcctgcgtgctcgccgctcgctcctcgacacgtccgtcccctggcacctgcgctatctgggtcagcccgaggtgggcgacaanagccgtcatgccctggtgcggaactgagtgtacgtggcagcctcgcacagcttgcccgacttcctcaatgagatgggcttccgcatggaccatgagttcgtggccaagggtcaggtgttccggaagggtgtgatgaaggtggtgagtgagcaaactgtcgcgtgtgctggttcctgcaaacacggataacacggagccgctctatctgtcgtatcttgttgagctgagcgttctggctcttgcgggacaggacactgtgtctgagtacatgaggagcttcgcagaacagctcaaacctctcgttcacctggagaagattgatcccaaaagactcatgtagagaacatgacctacagactgagatttttgcttcggtgaataggtgttaagactgcatttatttggaatatttttgatgattgttttctttttttgtaattgatgaaatggtaattaaaatctttaaataaaaatattcattcattcattcaaaaaaaa

SEQ ID NO: 512058 - DNA, 852 bp, Homo sapiens
cgctcggtggcggatgagcagcagagggagagccgcggcaaccccggcaagccaggtctcggcgtcgctgccacctatgacgggaagcaatatgtcggatcgccttggcaagcgccgtgtgccagcgctgccaggtccgcgttcttccccgtcgagcgcattgtcaacagcaatggggagctgtaccatgagcacgtgcttcgtgtgtgcccagtgcttccgtggccttccccgaggggcgtcttctatgagtttgaaggccggaagtactgcgtaacacgacttcctaagatgctgtttgctccgtgctgtggatcctgcggtgagtccatcattggcctgtggtcatcaaggccagtgaacgaacaagtggcacccgggctgcttcctgctgcgagcgtgtgtgatgtggagcttggctgacctgggcttcgtgaacgaatgccgtgcaggtaatctctgaccggaccttgccacaaccgtgacgaatgtgccagaggcctgcgccaaagtacatcatgccatgctggtcgccaccgtggtcatcggacgagtcagcccctcagtgtcagggagccaacgcttaccgaccttgacccagttcaactggcacccacctgtcggaaggaagcttgacacgcggatgcccggtagagcttgaacgggtgcagctctactgcctgcccgtggccaattgaccaagaactggggcagtcccccattcgtgcggggccattgccgggcgggccaattcgacgggcccgactctggtcaaatgcggctggagctaagcacactggcacagttggacgccttttggtctgtgcaaagttgtgacaacgccatacttgg

SEQ ID NO: 512059 - DNA, 243 bp, Homo sapiens
gatagaatcgagctcggtaccgcgtagatattagaagttcaagtagcagtgctgcggtgagatctcggctcactactagctccagctcccgggtgcacaccattttcctgcctcagcctcccaggtagctgggactgcaggcgcctgccatcacgcctggctaattttcgtatttttagtagagacagggcttcaccatgttggccaggatggtctcgatctcctgacctcatgatccacccg

SEQ ID NO: 512060 - DNA, 813 bp, Homo sapiens
cctgcagaataccattggagactcttgagagctcgccaagtgtgcctaacatctcgcttagaaagagtccatgttagccatcttaatgattgctctccaatagattatacacacagattctgtttgtgactcatatgttcgatgcctgtcaagttcatgtctagctgtcaatttgtgaatacggcatcgaggataaaacatctatcacctcttcaaggacccattgcctactgcggccgcttctgagtgaagtgcattcttgtgacaaacaactgagaactgtggatggactaagacttccggtgcgtggcccccttcgtgttccaaatatgcccgttcttaaccaccgtatgctcataaaacgagatgatgctatacatggactgactggtcctacaccccatcccactcctttgacataatagaggtggaggatatcgcaaactttccaatgcctctaaacaacttgctagccgccactctactgcaagaaagaccttccattaaccaagtgggaactgtacgaccaacacacccaacatttaaccacctagatgctccacatgttcttctaagccacggccctttttcggtctgtccacacatgttccaagaacgtcccgccgaggctgcaaatatgctaaactaaggccccgcgaccgacgaggccaaggcaatctgcatgaacacattgtataaatccagacctttcttcttcatcggccattttaactttgatacaggcttaaaattgttgggggcaacaacttggtagtctccaggatttccaattatgctgggggcggcccctcc

SEQ ID NO: 512061 - DNA, 301 bp, Homo sapiens
tgagaaaacagattcaggaaaccaaagttttcgcttgaaggttcccctcagggggtgggtttgcccgtccccaaaagttttcacaggggggagggtttaagggggaagggcccccccctgtttctcagtttcagcctgcccccccccatcctttgggctttgacccttttttcccagggggcccccccctattgggggcccccaggttattttttccccccccccccccccccccccttgggttttattttggtaatgttgggggggaaagaaaaaaaaaaggggatttttggccccggta

SEQ ID NO: 512062 - DNA, 119 bp, Homo sapiens
aggcacaggaccaggttgtcgtggacggtttcttcctcacgcctgcgctgcttaaaaccgagctcgacactgacgaaaactcgatggttacagccgagatcccaggtggccgactcgca

SEQ ID NO: 512063 - DNA, 152 bp, Homo sapiens
ataccactgcaacagcactctatatacaagcacattgacgctcctgactatcctcaactaggggaccctttactatacccccttgcctatgcggacctctatctatcaaatactttacagagtactaggatctccttggccaggaaatccgc

SEQ ID NO: 512064 - DNA, 126 bp, Homo sapiens
tgcattcacctacattcccttactctgaactagtctgggacggatatcaaatggtcccacttcttggagttatgttataaccacagtggcgcgagcgctctccagatccacggtttcggcctccgt

SEQ ID NO: 512065 - DNA, 166 bp, Homo sapiens
  misc_feature (6)..(6): n is a, c, g, or t
  misc_feature (66)..(66): n is a, c, g, or t
  misc_feature (87)..(87): n is a, c, g, or t
  misc_feature (90)..(90): n is a, c, g, or t
  misc_feature (101)..(102): n is a, c, g, or t
  misc_feature (106)..(106): n is a, c, g, or t
  misc_feature (111)..(111): n is a, c, g, or t
  misc_feature (113)..(113): n is a, c, g, or t
  misc_feature (118)..(118): n is a, c, g, or t
  misc_feature (137)..(137): n is a, c, g, or t
  misc_feature (143)..(143): n is a, c, g, or t
gatganaaggctccctaggatccctacagaaaaatccagtgttggggcctctccagctggaaaggnagctggtacctctaccagatnttnatatattttgnnactnagttntncggtnacctttgacagtgtgcctntttatncacggggggatcatcaatcattg

SEQ ID NO: 512066 - DNA, 250 bp, Homo sapiens
gaattctggatcctcgtcacccagtttgaaagctgttgtattggaaaatggttaaggcccttctagtcttaaatgccttgacgtccccatgacctatgtcccccccccaccaccatgtcaacccttcaaaagggtgccgatggtaaaaaaccaaccttgctatttctggtgattgaggtttacaataaacaaaaccagctgtttctcattacctatactttttctcaggcaatgggtccattccctgaac

SEQ ID NO: 512067 - DNA, 514 bp, Homo sapiens
tccattgggacggccagtccaattgcaggttttctgcagaaaaccaaggctggaggaatgcttcccatttgcctcgaggtggataatattaacgccgctgtgatgggtttgaaaaaaaaaaagatcccccgtttaagtgaaggggtcaaaataggggcccatggaaacccagtgttttttctccctcctaaagactgggggggggcccttgtggaactggagcaagcttgatttatttttgcaagcaactaaattaattgccctgaaaaagcctttcaaatcctatcaaaagggactatgccattgagtccttcccggcttccatcatgtaaaagttcccagttaaaggctgaattccagaaagattaaaatatatccatatataaaaccataaataggtatattttttagattacccaacatatttgttaatttgaatttgaaaaaaattttgattcctaattccttagggaccctttttaaaatcaaatagaaataaatttttccttttcca

SEQ ID NO: 512068 - DNA, 473 bp, Homo sapiens
gcgacggggggggggggggcgaaacagaggcgctcgcggggacccaggagggagggcaggggggcaaggggagcgcaaagagcgcggcaaccgggaaggccggggcgccagggaggcgaagggggcagccgcccaaggaaacgggggcgacagacaaacaccaccaggcccaacgaagggggaaaagggggggggagacaggggcgggcgagggggcccaggcgaggggggaacgccgggccgcaagggagccgggagccgcaagccccacagcgcgcaccgcccgggggcacggggagcacaggcagaagcgaccgcacccagcggacaagacgcaaagggggggaggcagagggggcgaagcgaaaagaagggcaggaaaggcagaaaggggaagggaaagcgaagccgccgacggggagggggaagaaaaaaaaggggggaagcgaagacgccgacgagagaagggcgac

SEQ ID NO: 512069 - DNA, 935 bp, Homo sapiens
tggcaccctcgggctcgagacagcggcgaccgttgtaaagctgagcgatccagtgtcactggagacggtcagcttctccactcaggctcctccagcccgagccagaagaccccctcccccagaattctgggggccgatggaagggagccgagtcagatcgcgaggtacccagagccgacagaccggagcgacagggagttgccagaagccccgctccctaggagtgatcggaaagcctcacccatccgggtgaggaacccggagggaccgcctccgggcggagcccgccgaccatggctacgcccctgtgtggcagggtcccgcagctctacgcattcgcacgacgcaggcatagctgcgcaggatagtgcgcggacagctgcgtggaacagttttccgcgagtacatggagattaactgcagatctctgacgacgctggtagccccgtggctaggatacgcctaccggacaaacacgaacgcctataggtatggggcctaaaggccaacaggtatcggcagcaaagataggacctggaacaggggaaccagacaacgacacggggcagggcatgccggagccaccctgcacccaaggggggcccccaccacgcatatgggcgacgcatcgcacgcaccttacgtagcggcgaaacagtggttcaaggccttctgcccccagaacaagcataggcaggaacttacatgcaacattacgaagactagcccggcacacaagagacgggcaatgagactggggacagacctaggacagccaccgtggccaagcgcggacaccgagacaccatgtgggacggacaccacaaacgaactaccaagaaaaaacggcgccggtggaaaactcaaccgcacaattagaccaccaagcaaacacactgcggaaaccgaagtaacgacgaccgaggagcaatcac

SEQ ID NO: 512070 - DNA, 426 bp, Homo sapiens
  misc_feature (350)..(350): n is a, c, g, or t
  misc_feature (359)..(360): n is a, c, g, or t
tatcacaccacacgtatcactccagacagcccaagcgaggcacgggcttggggaaaaggggagaagctgagcccagagatgcccaggacaggctcatggtcaccagctagtcagggctggcgccgggacaagtgtgcgaggcaggcacgccgcacgcctgctgcttactgacagcacaaaatgcggggaacgctcatggacggctctgtgaggcaggtggtcctggtcaaggactgcgtggtccccaggtgcactgttctatttcaggtgtcagctccaaaaccaagtggctcccagagactgcccggcacagcctcgcctggcatccatcaatgcccacgcagtgctgnggaaggctnngctaaatatttacaaattgcgaaaggacttttaaaaggcctggaaaatcgagaaggtccaggtatg

SEQ ID NO: 512071 - DNA, 604 bp, Homo sapiens
  misc_feature (213)..(213): n is a, c, g, or t
aaaactttttgattacatttttgaacatttaaaccttccataaatttaaacaaggtttaaataaaaaatcattttttacagggatccaaaaagctttgtaaaccgtcaaaataagccagcccgtaatcactttaaaaaactttgtcctggttttgatttggggaaaaaaacttctggaatgtttccatttgaatttacaaaaatctctggggnttttcctcttttaattccctttttccaccccctaggggaaacccattttttttaaggggggggattaaaagtttttgcctaaagagttgcccaaattagctgttagtggtttatgactggaaccaaaagagcaaaacatgtttttttttttttattgttcaaaacacagtttgtttgtttaaaaaacgccagtcacagtggggggtttttgttatttgggcctaacccgtatcactgggtttttttgttggaaggaaagaaaaattttttggttaaaatgctaacaaaagggttttgttatcattcccccacatccggggttttgagtcctttttttcccctaaactcaacccaatagggggccttaaaccccgaatgaattggcttttct

SEQ ID NO: 512072 - DNA, 398 bp, Homo sapiens
gggcgctcctacctttccttctgacccatacctcctgggtcctgaccatgactttcttgaaagtgtagtcccaaaattctccttacctctgaatctacttcctctgatccctgcctcctaggtactaatggttcagactttcctttcctctagcaagttgtaactccaaagggatctaaggaagctctacactgtgtccttaggcatctaggctataaacccagggagtcttatccctggtgtccctcccaatttaggtatacagctctcaacatgggctgtatacctgccccaagtttgtaatggctaagagagagagacagagaggagagagagagacagagaagagagacagagagaaaaagagggagtcaaagagagagaaatatagaaatagt

SEQ ID NO: 512073 - DNA, 740 bp, Homo sapiens
cgcggtgggcgctggcgtgcggtacgctgcagggtgatgcggcggctggcggtggggactgacgtagcccggggctcggatggatctcctggtgctcgggtctggtgcagctgtaccttctttctggccagttgagtggtctgtattgccctctagtgatgagtgtgatcgaattaactccatcgaatttcgaaccagagaagttattcagagtgatagtttgtggcttgtagaattctatgcgtccatggtgtggtcagtgtcaaagattagacaccagaatggagagaaagcagcaacgtgcgattaaaagatgttgtcaaagttggtgcagtagatgcagataatgcatcattccctaggaggtcagtatggtgttcaggggatttcctaccattaagatttgggatccgaacaaaaagacagaccagaagattaccaaggtggcagaactggttgaagccattgtaggatgctgcgctgagtgctctggccagtcgttgaaggatcgcctcgggggacggagcggaggatacagttctggacacaacagggcacgaagtgactggttcaagtacagaaggctgtgattgagctgcacagacgacagcgtttgactaagaactgttctggaccgttgacagcactgcttggactgggtgagtactatgcctcctttgtgtggaccactgccaaaaacctaaatgcagattgggctgcccgcagttcagaagtcacag

SEQ ID NO: 512074 - DNA, 170 bp, Homo sapiens
caacaggcatgggtcccgtatattatatggcgatgatttagtgcgctaaagagaacttgagtgtaacgcagcggaaatcccattgatacgccaagaatactgcggggctgggttagaggccgagtggcaggataggttgcggttcgctcccgacaggtacgacgcgcaca

SEQ ID NO: 512075 - DNA, 159 bp, Homo sapiens
ttgtggacacaaggcgttgatggcctggtgcgtgggtaatcagttactcgtggaggctgagctgcgagagtcgcttgaacctgggagacggtggttgcggtgagccgagatcgtgcctctgcactccagcctgagcggctgagcaagactccatctcac

SEQ ID NO: 512076 - DNA, 629 bp, Homo sapiens
catcaatcctgaaatgcagatgccacaacacgctacccctgtccagcagccacctgaatgtgtacagcagcgacccccaggtcacagcctccctggatgggcgtcaccagcagctcctgccctgcggacctgacccagaagcgagagctcacagatgctgagagcagggccctggcacaatcgagcggcagaagaaagacaatcacaacttaattgactttgagacgaaggttcaacatcaatgaccgcatcaaggagatgggaatgcatgatccccaaggaccaatgacctggacgtgcgctggaacaagggcaccatcctcaaggcctctgtggattacatccggaggatgcagaaggaccatgcaaaagtccagggagactggagaaccactctcgccgcctggagatgaccaaacaagacagactctggactccgatatccaggagctggagatgcaggctcgagtgcacggactccctaccaacatccccgatacggcatgaacaatggctgagcatggaccagcaaggtggtgaagcaggagcatgctagacgaagagggccagaggaggccatgatgcaggcggctgaggtccaagaccatgagcactgcaaacagccagac

SEQ ID NO: 512077 - DNA, 1043 bp, Homo sapiens
  misc_feature (1)..(1): n is a, c, g, or t
ncgcagcgacgcagaagcacgagagagacagagaaataagaaaagagaggggggatgtgagtgaacgaggccggattaaggcggcgatacaaagtgggagcacgcgtcaggaggtccgaaaagcggctctttcgcgagataacgatcctggccggagaccagtggaaggacgcggcacggtgagtggggcgcccgcgtaaacgcgaaaggtcgccgccacactgaagagggtggaggcggacagcagatagctgcggggcaggccaccgcagtgttcccagaccgcaacgccgcgcaaaagcaggtgtggccaggccggcccatgataacgcgagttcatggtgagtgccgttatagccaacccctcagttggggggtggatagctggacaaaaagaccaccgtctggtgcgaggcggctggtgccgaagcgcccacgggagggcaccaccacaaatttggggccagggacaaaaacccgggtgccaacacaatattcgagccccacgcggaagggtgtggcccgccccgccctcctggggaccatagcgcaagagcgcgccctgtgttcgtcccgcgaacaacacacgcaccaaataggctgggcggagcctgggcgagacaaccaccgtgagatgcccacaacactcttggagggcgagcaatgggtcgacggagcgccaccataggccaaggggcggcgtaagcgacgccccccaattgggccaaagaaggcggccttgccccttccaatgggggaataaaacgccgcggcttatgtcccccacgcgtcggcgaaatgcgtgcagttatgtttggagagtacacctgagaacggcgcactctttttctttacaacatgcgacacgcggcccactacagtgagcactcgcagacctcatatgtggtgcaccacgagatgtgtgcatggagaaacaccgggtatgacacttggcggaagcatacatggggattctcagatggacagtgaaaaaagcaaaaaccacagggggcaaacaggggcgagaaacggcccacaaaaca

SEQ ID NO: 512078 - DNA, 293 bp, Homo sapiens
taaaaaccctcatcaatagagggagacttacagaaatagtcaaaccacattctacaaaagtgccagtttatcagggcgggggcttcgaaagcccaagaggtgagtgtttgggtgtgttaagaggtgaaatattaggtggggcggatgaagcagacataggtggaggaaagtggagccaataagtgcacgtgtgaaagctccggtggaaacccgtggtggctcacaaacaaagtgtttgacccgctagaatcccgatgggaaaaagtggggaagggaagaactcgaaagtccct

SEQ ID NO: 512079 - DNA, 287 bp, Homo sapiens
gctcacataaatttcttcaccgacccttttccttccagcttccttactataaaaaaccccacaattaatatgttcatcatcatccatactaaccaaccccgtcaccatctcaatcagcagcaagtcctactctctgtgggtgaaaccttgttaccacctctaggggcagaccccttttcagatatattcaagagtttaatatcctcccactatagcgcttcgactttgtatcttcctctatggctaccaaattctgtccgttgataagtactggctctaaaccatgc

SEQ ID NO: 512080 - DNA, 203 bp, Homo sapiens
cggcagctattattattaaccccattttacagatgagggaacggaggcagagagaggttaagtatgttgcccaaggtcacacagtggaggagccaagcctgtactcaatccaggtcatctgaaaccagagcttatgaaggtgaccacaccatacagtgtctcaggacagggaggaagtttcaataaagcagcaacaagcttca

SEQ ID NO: 512081 - DNA, 230 bp, Homo sapiens
tgaatccgacagtgaggattcgcgattgtctctacaggagtggtgccatctcttaataagggtggtcgttctaagtaagatttttttcgaagtttcatctctgtacataagtacattaatatggctgcgtatctttgacatagatgtaactcatctggtgtagcttctttcaaagtaaccgcagtgttacggatgatatcgaatgtttcgtccaaccaatgggtaccgag

SEQ ID NO: 512082 - DNA, 171 bp, Homo sapiens
tcgcccacagaactgatttctcacggcgtgtcacccaccaggcgcatgcctcactattacttgaactttccaaaacctaaagaggaaaagtgcaatgcgtgttgtacctacagaggtcactatcaatataaccgtttgttgctgtcaagattttttggtaacttcaaatat

SEQ ID NO: 512083 - DNA, 144 bp, Homo sapiens
gaaacccccttcttaatttgtttcccccattttttttttggggggggttttttttggcccccattttttgcggtttaaatcccaaaatctgagggaccagtcaggccctgtaaaaaaccaaataaattttgttttgggggccca

SEQ ID NO: 512084 - DNA, 314 bp, Homo sapiens
ctcaggttaattcgcagacactaacctcctgcagaagccacaaaaggttattacacataacccatggtttccacaggcaggcactcttgatgtggaaaattgggatacagcaggagaaggattaaaacaggctcatcaaaaaggtcttaaagtcgattcttctgttttctccacttggagtttagttcgtactgtacttctgccattatctcattattattctgcaggacagcaagctgaatctaaaaatctgaaagaatttgttgacccacgcacagctccagttaaaaataaaaaacaggagagggaggtta

SEQ ID NO: 512085 - DNA, 920 bp, Homo sapiens
  misc_feature (6)..(6): n is a, c, g, or t
  misc_feature (77)..(78): n is a, c, g, or t
  misc_feature (81)..(81): n is a, c, g, or t
  misc_feature (97)..(98): n is a, c, g, or t
  misc_feature (174)..(174): n is a, c, g, or t
  misc_feature (176)..(176): n is a, c, g, or t
  misc_feature (211)..(211): n is a, c, g, or t
  misc_feature (342)..(342): n is a, c, g, or t
  misc_feature (377)..(377): n is a, c, g, or t
  misc_feature (386)..(386): n is a, c, g, or t
  misc_feature (516)..(516): n is a, c, g, or t
  misc_feature (566)..(566): n is a, c, g, or t
  misc_feature (629)..(629): n is a, c, g, or t
  misc_feature (649)..(649): n is a, c, g, or t
  misc_feature (657)..(657): n is a, c, g, or t
  misc_feature (668)..(668): n is a, c, g, or t
  misc_feature (682)..(682): n is a, c, g, or t
  misc_feature (695)..(695): n is a, c, g, or t
  misc_feature (697)..(697): n is a, c, g, or t
  misc_feature (720)..(720): n is a, c, g, or t
  misc_feature (731)..(731): n is a, c, g, or t
  misc_feature (738)..(738): n is a, c, g, or t
  misc_feature (742)..(742): n is a, c, g, or t
  misc_feature (761)..(761): n is a, c, g, or t
  misc_feature (790)..(790): n is a, c, g, or t
  misc_feature (801)..(801): n is a, c, g, or t
  misc_feature (827)..(827): n is a, c, g, or t
  misc_feature (830)..(830): n is a, c, g, or t
  misc_feature (842)..(842): n is a, c, g, or t
  misc_feature (848)..(848): n is a, c, g, or t
  misc_feature (855)..(855): n is a, c, g, or t
  misc_feature (858)..(858): n is a, c, g, or t
  misc_feature (901)..(901): n is a, c, g, or t
ctacangcctggcctcacatgacccctgctccagcaacttgaacaggacaagcagcagctacatccttaaggtcggnnaantaagatgaggatttgnntcctgcattgccctgcctcccaccctatctctccccaaattataaacagccatccttgggaagcagcagagttaanangtctccccactgccctagtgacatacacaccaacnggagagcatgttcagatggcacagaatccagggactgcatttcatgaggagaaactggtaccaaaatatggggggggagggggggggtgtgagaaggcaagcgcaaagagaaccttcctccgtttctactnatcggatcctgacgctgagtcctctgagcgggggngtgtttttnctagttcttcttcttcagagtcctcgctcctcttcctcttctttttgctcttgttctctcccgaagtgctcttctacacaatacactaactttttgctctttaagctctctctttgctgctttgaggacnacttggatgatgatcccttagagtgcttggatttcttttccatctttacntttactttcttcttcttctttgacttgtccctcttataagactcgcttcggtccccttcatantctttcatggctttttcatnttcccttnttgcatccttngccttgcttttccnctcctctttcttntntttggtcatacccttccagtacncgcttgccttnttggaantatncgtgattctgatgccattntgttttttcttgttcttctctcggttggntttgagccacngcatgtatgcagatattggtttcttntgnggcatatgggtntttgcncttcttnatntccacaggtttcttgcggctcttgcgggtcctttgtttttttntcctttttgagcggtgtcc

SEQ ID NO: 512086 - DNA, 433 bp, Homo sapiens
aatgaatctctggcttgtctcacttggaactcctaacacattcaggtgcatctgccatacagggtcattctcagagtatgcttaagttattgctgtcaggtgcagctaccatacacaggtgtgtctgccatatagccacagaaagcaggagtcctacagctgctcctcatgggtctccatagactagtcttagagcaaggatgggcagccagcctccaggtttaacctggcactctcccccagcacttggtccccagagcaggggtgcatctctcccacttctggtcaacccttcagtaacaagtagagcccccagggtcttcatgaatatctagttgaactggctaaagaagagggccctgtaacaggacagaacaccaggagcctgaaccccgcatcttctacccttatcctgcatttatcctgcctgcat

SEQ ID NO: 512087 - DNA, 482 bp, Homo sapiens
  misc_feature (302)..(302): n is a, c, g, or t
  misc_feature (309)..(309): n is a, c, g, or t
  misc_feature (399)..(399): n is a, c, g, or t
  misc_feature (480)..(480): n is a, c, g, or t
ctacaaaacaccagtcggaggttctctggggacccttcccttacagtctccctaaagctggctaactcctttcactatgtcccagtatccctggttcctcggactggcactttctgagtcatagcaccgctcattcgtccgagcagaattgatctcggtggcagcacctctggtgggtcaagcctgcagcttctcctgagcagtttcgttatttttgggtcctagaaccgctatggtaccatagcggctcttcagggttgcaggacgtttgccaactccaacccacgctgcctgcctagttnggctaangggcagaacagatcctgcaaagaagaacccgaggttggatattaaggacgtcctttgcagtgccagtcgcggagctgcaattggctttcnctccctctggggaagaatgatgttactctcccaatctcgggccgcatatccaggattcgggatagatctgagatttaggtnct

SEQ ID NO: 512088 - DNA, 221 bp, Homo sapiens
gttctctgcacgatcccgggttcgagtgaaggcgtgtgggatctcccttatcgagaaaaacaccttaacctagtgcatcatcttcctctcgtccacaattatgtatgtcacgagcacttctgtgagctagttatcgtgcttcaaatcgagaatatttccttatttgttcctttaatccttgataccatcatatttatggttttctcctcttcttcctcttg

SEQ ID NO: 512089 - DNA, 815 bp, Homo sapiens
gcgtctcgtggaatgtgacatcgtctttaagccctgcgtgggaatccctgacgcagcgtcgtgatgcccagagaagacaggggcgatctggaagtccaactatttccttaagatcatccaactatgggatgattatccgaaagtgtgccattgtgggaaggcgagacaaatgtgggactctaagcagatgcaagacaggatccaggcaatgtcccattcggcgaggaatggcgtgatggtgctgaatgtggcaatgagacacacatggatgcgcgaaggccggatccggagggcagcctggaaaacagaccagctctggagaaattgactgcctcatatccgggggaatgtgggctgggtgttcagcaaggaggacctcaactgacgatcaagggaccatgttagttagggcaactaacggtcgttcagactgctgcccgatgctggtgtccatatgcccacaatgtgaagtcagttgtgccagtctcacgagacactcggtcgtcgggagccacgatgaacgatcctcgcttttttatccatggcttgagagtatcagcacgtaagaaactcgtcccatggcgtggcgaccctagctgacacactccgtgacgctcgaatgttgcaagcgtcggagtcaaagaacgtggtagcacgaaaaggtggggagccccaggcggaacgccccaccgctgggtgactcagtgctccaaattatcgtcccggttctccttaggggcgggtccatcccagccggtgttcgaccgatgggagtatctaaagacctgaaggtgttgatatcacggagaactctg

SEQ ID NO: 512090 - DNA, 353 bp, Homo sapiens
  misc_feature (14)..(14): n is a, c, g, or t
  misc_feature (113)..(113): n is a, c, g, or t
  misc_feature (153)..(153): n is a, c, g, or t
  misc_feature (158)..(158): n is a, c, g, or t
  misc_feature (167)..(167): n is a, c, g, or t
  misc_feature (295)..(295): n is a, c, g, or t
  misc_feature (325)..(325): n is a, c, g, or t
aaggcctatgtggnccctatgtaagtttatgtccaaaaccgactgtaagtggtcctctgtcagcactttaaaagaatgatggaggccctggcatggcggctcacacctgtaanaccagcactttgggagcccaagcgggcagatcccttgagnccagnagtttgagnccagcctcgccaacatgatgaagccctgtctctctgaaaatacaaaagattggctggatgtggtggtgtgtgcctgtatcccagttgttcggtaggctgaggcatgagaattgcttggacccagggangcggagattgcggtgagtggagatggtgcnattccactcccagcttgggcaacagagc

SEQ ID NO: 512091 - DNA, 1274 bp, Homo sapiens
atagccatgaacgagagtatgtgcagggcgaactccttactttacctctaatcactcacggatttcgttgagactccattgctacatgctcattgaagaacacaagaaacatggaataagcacctagttcactgctatgaattccagttgtaccgtcactcaaccagtgttcatcttctacagctaatctcgcctgggacaattcaaatgaattggagtgatgcggtgatgaggcgaacacagtacataatccattgatcaaatgcacagctagatgcatataatcctgatcccatagccaaggcttcttcgccatgaaaggtcctttcctgaagctgaaacgcttaaaatgtgctcgaaatcagtccatatactatggcacgggatgaagcagttggcttacagtttaatctaattgagctacgcgaattcgaatcatgtatggtttactcccatcatttgctgcattgactccttgaatacattctaacacacactccaagtcactttaagattacttaggtttcccatctccaaaaaaatcaattctcaaattcattgctatcgagtaaagttttagcacaataatttcgagtctgcgttgtcttcttatggcagctaaacaagttgtcgtacatctctctggaattggatagcagtacaagcgaaatggtagcggtccgtgcaagttaggggaaaaatctcagtatactttatcatagggcatttttactacatgctataggaggtgcattggctgccaaaggtggaagcaaagccattagaagcaaacagaagggggcaaggcactacttccaattggctgacaatgttcttgattaagaaggaatctgatattccaggttgcagggatttgatgttttggcggtacactttctgacaccatttggtagagtttcgatcaactttttaagagtatacgatcatatcggacacttataataggattaaggccaccattttaggagattcccactagggactcctatacttagtggacgtccataattttctctaaagttacatctatgccctgaacattacagtagtagcacaatcccactctctgtgaagtgggtgccctgccattggtcgacagatccatagcaacaaacaaacaacgagtgtgtttcccaaaaaccaaactagtaagctatagttgcgtcatgacgatcaataggaaagcggaagcgtgtggacccgccacgggcatataagggcattagctttcaggtaaacatcacagtgaaacg

SEQ ID NO: 512092 - DNA, 1350 bp, Homo sapiens
ccccccctcaccatcgcggtctgggacgcaagagagacaggggagaggggcggacgcgggcagctgagtgtagctaccagcgtagtccagagtgagtgacgtcatgttggttgattggctagccgaccacagtttttgcgtccgtcgatagacagcgttgtttccgatgtgttgttatgtccaccgcccatgtgtcttgtgtatctacttttaggtggggccgccatgctaagttggtttgtacttgcaccccctgtgagcggtgatttgttcatgtgtgttggaacacctgtgggaggctcgacaattgttgtttgctgggaaagaagggggatttttggccacctccaaagtgtgtggtgccccccggggctaccccccggggtgttgaaaagctcatgtaaaaccctgggttctcccgttaagcccacccgggtcacaaattgtctgcgaaatgtttttataaccccccccgctatctgtgacaccccccgctattcgtgaaatataaatctctggttcctccctagatattgtgtttcttgtgaaaaatatttataccggtctcccccaatttattttgcccagcaattgcacggttaagaggtggaatggtacctgtattaagggaccccacaagggacaccggttgtgaaattggaacaacagccgcgtcgatgagacttatgtgtccccccgccccccctcgtcttttgtgatccacgaaatggcacagcccctctgtggaaggccttggagtttaaaaattggggagccccaaatttggccgcgccatgcccttgcctcaccgtgatatttccgtatagaatagggtttgtgaaagtatagtgtaaaagtgctcttctctttccccgcaatattgctcttggtcggggtccctaaaacactttccccaccttaagaaatatgaattgttaaaagggaaaagtggtgaactcgttgcccaccccggaaatgtctcgttattaaattatggtgtaattaagtgtttcccacgaggcctcggtggtttctcctggtcgctgaggccacatcgtggtttgctaaactggaatggggttttcttaattaaataagagtggctcgcttcacgcttcttcttttaaaaggaaatgtggagtacactaagtgaatttttccctttaaatttattgctcacgaaatgaggcactattccttaaaatcctcggagaagctgtatttaaagcactttttgcacctaaattggtccctagtttaatttctattcgtatctgtttaatttaaccccaacaaattcactcataccccaaagtgtaagtggaaaccccccttttaaaccccaaccca

SEQ ID NO: 512093 - DNA, 1000 bp, Homo sapiens
tactcgtggtgccgctgcaagccggaagagatggttgagctcatgtgcccgctgtgctcctccttctgcccttccttctgtatatggtgcgccccaaaatcaggaaaatgctgtccagtgtggtgtgtccatcaaatgtcagcttccttgagaaaagtacgttgtggtcacaggagctaaatacaggtatcgggacacggagacagccaaagagctggctcagcagaggagctcgagatatattatagctgcgcggggatgttggacacacaggggggacattggtggccaaacgagattccagaccactgacagggaaaccaagcagggtgtaggggcgggaaactgacctgtctgatactaagtctattcgagctgggctaaagggctcctacaagcatggagggaaaaagacaccttcacacgtttggctccaacaaatgcaggcgtgatgatgttgtccggtaatcagaaggacatggcagaggggtttggagatggcacaataagggagtcacacccccatttaggtcacattccttcattaaaccattgcttgtgtcagaggaaatctacagtattcaggccatccaggatacgtacaatgtggtctacccctcggcaaattcaccgtggaggatccacttcctttaacttgcaggcggaagaaattctacacaatgcaggcctggcctaatgcgacaggacaaggtatgcaaagatcccttctacccaaggtattggcccggagaataaaaaggctggggttcggaccgattctggagcaccttggcgagagccaatctgcacttggtcggacacaatacatgcatggtaggggggtcacctataacacgacctacaaaggccaaacaacgagggctaaagaagagagccacggacgacagatcaggcagcatccaagagacaagggggacaagtcactgccacacaacagcggcacacacacactcaggcctcacacagccgtgacatctcg

SEQ ID NO: 512094 - DNA, 120 bp, Homo sapiens
  misc_feature (107)..(107): n is a, c, g, or t
cggttttcattaaggaggtgcgtttatcctgtttacttaggaggtggagagcctgccttgctcagccctgttactacattgaagtcactgtagtgccacacaattgnttgcaacttacaa

SEQ ID NO: 512095 - DNA, 178 bp, Homo sapiens
gtacatccttgctcaatcagctcatctgtaaagcgtgtgtcatggcacaccagctctggcactgagttctcagggtccaatgtctttccccgtctcagactgtatcaaggcttccaaggaattcgcaatgcctcgctttccatccccagtccagaagacacagggtcacgagatcgaa

SEQ ID NO: 512096 - DNA, 469 bp, Homo sapiens
tctagaggatcctgtagaggtgtggcaggctgtaaagctgggggacatggaatatccagaagctcgtggagtggtgtgctgcgaagaacctaccccagcctgaggtctagggttctgggggttctaggggcctgctgggtgataaccggatctgagcaggagtcagaaaggcaggcaggccatgaaagtcactcttcaattgtcgcaagggaaggaaatccaagcctgctatggattagtcctgccaccttccaaggaaggcctcactacatcataagactgaacactgctggtagaagcgctggtagtagtaggaagttgtgatctcatgcaaaggggaacaatgaccactattctccctctgacccctccttggctccattgcactgccagaggggccttcttgatggcagttgatccaagtaacctgaagctgagactcccagaagccccacctcactcctgtggt

SEQ ID NO: 512097 - DNA, 118 bp, Homo sapiens
tgatctcaggcaggaacacctaacagcacacttgtaacaatagcacaatagctgccgtttatggtttctgttgtgatctactgttcttagattctctttgacctcaatggtatacatt

SEQ ID NO: 512098 - DNA, 202 bp, Homo sapiens
ttgcgtggacacttacgcacggaaccaactttaaatgatctgctgcagcagacaagcaacctaaactgatcccctctaggggccgtaagaggccacgcaggctcccatgttcgcggggtcacttacgttgacttagcaggcatatatcacacttagcctgtagctttgaccaatcgtatgtgaccacacatacgcggctatg

SEQ ID NO: 512099 - DNA, 218 bp, Homo sapiens
  misc_feature (17)..(17): n is a, c, g, or t
  misc_feature (29)..(29): n is a, c, g, or t
  misc_feature (37)..(37): n is a, c, g, or t
  misc_feature (180)..(180): n is a, c, g, or t
gctggcaggcgcccgcnaccatgcccggntgattttngtacttttggtagagacgaggtttcgccatgttggccaggctggtctcgaactcctgacctctggtgatccgcccacctgttgagtgctgggatacaggcatgagccaccacggccggcccaccttgctcatttctaattttnttttatcttctgattatattttttaagaaatttgtctg

SEQ ID NO: 512100 - DNA, 120 bp, Homo sapiens
  misc_feature (77)..(77): n is a, c, g, or t
taatctttaaacagaacacaggggctggggagaagagaagcaacaataagcttgaaagcatccagtgaactaagcanctgcctttttcaactttgagttagtccttttttttcttgcgtg

SEQ ID NO: 512101 - DNA, 247 bp, Homo sapiens
  misc_feature (10)..(10): n is a, c, g, or t
  misc_feature (95)..(95): n is a, c, g, or t
gatggatgtngaacaaacacacatttattatttaaaaaaatcactttccaccctttattagtgaaaactcttttaaaaaacacgaataaagtgtncccattgtggctcagcagttagtgaacctgactagcatccatgaggacgagggcttgatccctggccttgctcagtgggtcaaggatccggcattgccatgagctctggtataggttgcagacgcggctcggatcccacactgctgtggttg

SEQ ID NO: 512102 - DNA, 353 bp, Homo sapiens
aaagggtttttttggggttcccggaaaaattttggtaaccccccccacacccccccccggggaaattttttgggttaaaaaacccccatcccccaaaaagggggttttttacttcctttaaaaaacctctcctttcccaaaaaaaaatttttggggttttgggggccctttggttggggccttttttcccccccccccccccccactttgggttgggcccaaatgggtttttttgttttccgggccccccccgggggggcccccattgttttaaaaatgttttttttttcccccaccccggggcccctttttccaaagggggggggggcccaaatttttccccgtttttttta

SEQ ID NO: 512103 - DNA, 210 bp, Homo sapiens
tccttttttttaaacccccccaggttttttttttaagccccccccccggggaaaaccggtttttttccccggtcccccggggtggggccccgttccccccggaaatagggttcccccccccccccgggggggtggttttttgttgggcttttgggggggggtgggcccgggcccgggctttcccaaaaaaaaccccttttttggttttta

SEQ ID NO: 512104 - DNA, 262 bp, Homo sapiens
agaggatcccgcagcaggtgctcctgatgtctcgccacggctaggtcttgtcacactcactcaccttctccagcagcttagggtcgggcgtgatatccttctccatggggctgctgaaggccagtgtgcttggacagcatgctggccctcttggcctcggcccggctgcccgtgcgccggtgggacttggtgctctgggttctgtgcaccacccggacactctggtggctaccgatgctgccgcgctgggacacccctgtgc

SEQ ID NO: 512105 - DNA, 381 bp, Homo sapiens
gcacgtctccactgaagaaggtagttgagagaagtagacaaaagtttggcgggaatcatggccatttcccacaattccatgcctctcagaaatctttactagcaatgtgaaaattgtatagaaatatgaatggaaaaacacagtcatatgtttctgttcacattttggggtgggaatagggttctgtggcaaacatataccttttgttgcctcaaagcatacctttaaaaacggtgagtccaaacggatgtgtcatctggtcaacatggcccagtcttttcctgtctaaaccatcaaggttgctgtgctcaatcttatcaaaaaaggcatccacccagtacaaccgggaagtactaagaaaaggaagaagacatgttatca

SEQ ID NO: 512106 - DNA, 1044 bp, Homo sapiens
  misc_feature (275)..(275): n is a, c, g, or t
tgtggatccgccgctgccggagcagcccgaagggagctgcggatctgcgaggccagtaccgaccgcggcctagtcagcgttaggcttgtcattcgagcgctgccattgtcacccggtgactatttagtcagcatcttacaaggcgtgtgtcatcactcgcgggacaagtggcgtgtggtcatagaatgcaggattacttgatagcggtacagctatgagctaaccacgtatacgtctagggctagcacgtactatccaccagcggactcggtagntggagtataccaacgtatcacgcggagccgtgcgcatgtattcaaactgggagagaacggtgcaagctgcatagatctggtgaccacaagcgggaggcaaggagcagcattcctggaccagtcacacatcacagcggataattcaatcggggggaggaacaccaaacagtgaggggtttcaaatatgggatagagattaataaacgcaaccgggatacaccagatgcgtgaccccaggacatggttcacctaaatatggagtcacaaaacgagtcaaacaactggagtggggacttatacagcaggacaaagatcgaacgagccgaagaagagcgttggttgcagtgaagattggtaggtgaccctagaaagtaagtttaaagaatcgaggagagtaaacatcaagggtaaaagttggaccacggaaacactccagttagcaagacatgggtgaaaacaagagatgggcatctgaggaacggaacacaggggcaacaacacgtttggccgcgataacagcgagaacaggtaatccgggccacaggacgcaggcaacgcaaactagcgagagccacacttcaccgaagagtacaggaatcacccgaaacggaagcaccaggggtagcggacccatccagggtagagacaacaattgggatccgcaaacagggttaggggagaaaacaggaaaaggaagtaggaatataccacacacaagaggcatataccaaacagagggagccaacatagagcgtaccgctatcaagcg

SEQ ID NO: 512107 - DNA, 971 bp, Homo sapiens
gtgctgtcagctctcgcactcggtgcttccgccgctctgacgtcgcttttctctgccggtcgcgagggaacgagagagatcgtcgtgctggtcatggaccatggctccggcatgtgccaagctggtatagctgtggacgacgctccccgagccgcgtttccctatcgcctcgatcgtgcgaccccagtacacctagtgcacggtcgactggctggtgcaatggtgccgaaaaggagctccatacgtgtggtggcgaagaggccccagtagcagggcgtggagatcctgacccgtgagagtaccccaatttgagcaatgtgtattcgttacttaattgggggactagcattggtaccaagaatctggtccaggcacactcgttctacatataagctgctccgtggtcgccttggagtaaacaccacgaatgctcgtttgactctgacggcctcccccttgaacgcgccgatagggccaaatcgatggaggcgaatgatgtagtctaggattattggttttgacgaccatcttgatgccctcggtccactgctactgctgagtcaatccacggcgcgacgcatgtccctcctaggcctcttggtggcaccgactggtattgtcttggactcttggagacggggtcacccacttggttggccagtcttacctactggctattcgtcgcgtccgcctggcgccctgttctgtgttgtgcgaccctgggcttggctcggtgaccgtgtagctggactacctcatgaagagttctcactgaggcgagatacgggctgcgtcagcacaggcgatcgggaaaaatcgtgcgccgaccatcaatggagaaagctgtgctaacgtttgcccctggacttcggagcaggagatgggcaccgcggatctccctcttctctggagaaaagtaacactggcgatggcaggtatccccattggcatgacggtccgggtccgaggct

SEQ ID NO: 512108 - DNA, 697 bp, Homo sapiens
  misc_feature (697)..(697): n is a, c, g, or t
gccgggcgcgtgctcacgcctgtaatcccagctctcagggaggccgaggcaggagcattgcttgtacccaggaggcagagattgcagtgagctgagatcacgcattgcactccagtctgagcaaaagagcaaaattcgtctcaaaaaaataacactttaaacaaataccaaaaaatgagaccagaaaaccaaaatatatggttctcattatggctgttgtagtggcttaaagtaattcctgctcccactttattttcaaagacaactatttgctacaactgaataaaaccttaatggagtttcattataccaaacaaaacaaacaccacaacaacccaacacaacacaaacaacacacaaaaaaacaacacgaacaaaacaaaaaaaaaaaaaccacaaacaaagaatgttggcgcgggccccgcgcaccagaagagaagatttaccaacaacaccgggttggggagccggccgacctccaaattctggataataaagaaaggccaggtgacatagtgtgcacaaagaaaaatccggctgcacgaagacagatggggctcggtcattccacaaacaaaaaaaaaaaaggcggggggaacacagacgcgtttcgaaaccacacaaagtggctcgcgggccaacgggcttcccaacaagaggacggcggagcataaaatacccggcgcgggcggagaan

SEQ ID NO: 512109 - DNA, 149 bp, Homo sapiens
tggaagtttgaggtttagatgactatggtggctataataattactggttatgggaatgatggttttgatgacagaatgagagatggaataggtatgggaggacatggctatggtggagctggtgatgcatgttcaggttttcatggttg

SEQ ID NO: 512110 - DNA, 205 bp, Homo sapiens
tacagagagaaagtcatgaactgtagggagcagtaccatattcatcaactagtattatataacccagcccgtcacagatagatcaattcctcagcaggaatgcagtgcccccatgcccccattgccaacaagtgtcataacttgcccctagcctctcactctccatgctacaccatagcacacccccgcatgcctagtgggtcct

SEQ ID NO: 512111 - DNA, 773 bp, Homo sapiens
gacataggccggcgcgactgattgacgccggacccatgatcattctgtgactttcagagtgctgtggtctgatgccgtgactccactagaactctgtccgattggtgggcgtactgcgtatggttgcgcgagaccagtgaggagttaatgtgtacagagggtactgctaaggctagttctatatcgtgcatactgaggttgaaagcactgaatgcaggtgatacagccgaagtatattatacaggtgctgatatttgactagagtttgtagtgtcgttggtctgtagatcttggatgttcagaaggcgaggatgcggtggagagagagtaccaagaagtgatatacatagcaagatccatcatatgcggtggctttgcaatggtagtccacatgtctttgctccgctgagtctggtggaacaagagctatggtaccacatgctgggccgattcgagtactcgagcctgtacatactcgcaggggcacattggtggcccagtacgtcacgattacaccacaaggaaaagtatgtccctatgttcttattgtggagattgtcgttggaattcaatagttgcgcaataggttgtgggaaagtatgtctggtggaggttatccagagtgccagtttactctgtgggatcacgttgtggtatgctgtggatgtgatggttggtaagaccttgtacatttcagttggaagggagaatattcctatgaggcctcgggaagcctcggagaagagggagatggcttggtgtgtggggaagaa

SEQ ID NO: 512112 - DNA, 193 bp, Homo sapiens
atcatggccgttctggaagatgttttctaccaccctgatcgttaagggagattccatgggcttaacgaacagaaatctgcttcatgttctgcctgtacagtagttcattctttctctagacgtagagctctagttgtctgagaacaaccttcttcaatcctcctctctctatcctctatgtgatcgacgtcag

SEQ ID NO: 512113 - DNA, 618 bp, Homo sapiens
  misc_feature (3)..(3): n is a, c, g, or t
  misc_feature (72)..(72): n is a, c, g, or t
  misc_feature (75)..(75): n is a, c, g, or t
  misc_feature (118)..(119): n is a, c, g, or t
  misc_feature (123)..(125): n is a, c, g, or t
  misc_feature (141)..(141): n is a, c, g, or t
  misc_feature (143)..(144): n is a, c, g, or t
  misc_feature (148)..(148): n is a, c, g, or t
  misc_feature (190)..(190): n is a, c, g, or t
  misc_feature (194)..(194): n is a, c, g, or t
  misc_feature (205)..(205): n is a, c, g, or t
  misc_feature (210)..(210): n is a, c, g, or t
  misc_feature (217)..(217): n is a, c, g, or t
  misc_feature (225)..(225): n is a, c, g, or t
  misc_feature (231)..(231): n is a, c, g, or t
  misc_feature (269)..(269): n is a, c, g, or t
  misc_feature (294)..(294): n is a, c, g, or t
  misc_feature (337)..(337): n is a, c, g, or t
  misc_feature (493)..(493): n is a, c, g, or t
  misc_feature (530)..(530): n is a, c, g, or t
  misc_feature (554)..(554): n is a, c, g, or t
  misc_feature (593)..(593): n is a, c, g, or t
ggnaaaagcatttgagaatgctcccatggatcctggaactaggtctactgtggcagcaaggcacaggctggnggnctcaggggtcctggaggtcaggcaggtcagccagcagcattgnngggnnnatctgggtctcacgcngnngggnctcaatatcggcagggttcatgccatggccttcgagccagtnagcnagtttgggggntgggngagaggntgaatctncctggncatcctgtggcccatcagccacgcccatgtcgaaagtntggtttaagaattcctccaggtcanagccaacaccgtagccagccccactgccctttggtgtgcctgngaacacagggggcagggggtcctccccctgtgacttagatagctgctgggtcacaaggttgacatcaggtgactctgacatggaagattgaggggctcccccggcgtctgggggcggcaggccaggtgggaagtaaggcaaaactcctggggtgcnggggccaggcgagcccagggggtggcacaagtgactnggcagccaggaggctggtggaggnggcaatctggggtggcgcggggacagggatgggcccaanagggcagtggggtggggtgcagggc

SEQ ID NO: 512114 - DNA, 162 bp, Homo sapiens
  misc_feature (37)..(37): n is a, c, g, or t
  misc_feature (138)..(138): n is a, c, g, or t
ggatttgctggtgcagtacaactaggcgttaataggngacatggtagctcaagcgctgtaatcctaagtgtctttgggaggccaaaggtgggagagatcacctgaacccaggaagtttgagaccaagcctaggcaaantatgggaagatcgtatgtctatga

SEQ ID NO: 512115 - DNA, 185 bp, Homo sapiens
ggatcttggctcatttcagtttcaggtcaaaaaaagtgaaaaagccaacagtaaactccaacaaaaccaaaaacctaaaattagacttaaggaagtaacttagaggtctgtattcaatgtggagttgtaagggtaagcaattaaagccagtgttggaagcatgcatacatatatatatatataaa

SEQ ID NO: 512116 - DNA, 126 bp, Homo sapiens
tgggaagggcatgaagcaggtggctgaggctggagaggccggagagtgtgtgggcagatgggtgcggctgcctccctgcctcctgggtggcctggcctggggtagcgtgagtcctcagctgggtgg

SEQ ID NO: 512117 - DNA, 136 bp, Homo sapiens
attgttgatatggtcctggcaagcccagtgtattgagaacttctcagactatccacctttaaacgctttgccatcggaagagacagacggccaggtcatcagcgaagagcgcggcgcagacagtcggtaggctaaa

SEQ ID NO: 512118 - DNA, 610 bp, Homo sapiens
  misc_feature (391)..(391): n is a, c, g, or t
  misc_feature (475)..(475): n is a, c, g, or t
  misc_feature (527)..(527): n is a, c, g, or t
  misc_feature (601)..(601): n is a, c, g, or t
  misc_feature (605)..(605): n is a, c, g, or t
gcaaaactctgtctttccctgtctgttttttcagatttattaccctaggctcctggttccattcttgctatactatttacagaggactcaacacctcactctgtttcatgcctccatatatagggacgagttatttcatctgcagcatattctgatattcaccattaagcctctcctgacctactccagctgaattaatggaatcttcttctaccagcaaacctgatagctacttttaggtactaagtaataacaactcagtccattgtattttaataatttatttacatgtaattttcccttaccagaatgtaagattttaaggcagagacagtcattcatttctgtatctcctggagccaagaagaatggattgcaaatgctctcaacntaatacctgttgctgggcatggtggcttacacctgtaatcacagcagtttgggaggtcaaggtgggaggatcacttgacctcangaggtggagaccagactgggcaacatggtgggactctgtctctacaagtttntcagctagacgggctggcacacatctgtagtcccatctatggcggagggtgaggcagaaggatagcttgagccngggnttggt

SEQ ID NO: 512119 - DNA, 287 bp, Homo sapiens
aagggagggctcgaagcttctcccggggtcgtcgcaagaaaaaatgcaagatttgcaagcttcgatcctttttccgtaaactcaacaccaggctaatgtcccaacggatctgatggtggggagggagacaactgttcttaaaggatcatccccactgctgtttgtccctagcttttcttaaggagagctctgagacatctacttctacatggcgttgttgggagtagaatctctttttagagcacatagtgctgacatgaagacctttttctgcactatatgcaaac

SEQ ID NO: 512120 - DNA, 165 bp, Homo sapiens
aggaatcgagacgctatgtgatcgtatatagtgagacttatacacgcaagacactaggagaatgtctgtagaactatccgttgcataggagagagaatggcaagtacaggtatactctgccaaacacttcacttctgaagtagattcactggtgtcctttctgtc

SEQ ID NO: 512121 - DNA, 321 bp, Homo sapiens
  misc_feature (44)..(44): n is a, c, g, or t
gttaactgactgtttatcatgtatgtttataactaaactgtggntaacacatacataagttaacacatatgtatgtattaaccaactgtttatgttatacacacacgtatgtgttagccaactgtttatcatatgtacatgttatacatatgtgttaacaaatgtgtgtgatttatgcattcgtgacatgaatatattttgtgaattaatgacatgcctttttcctatttttttcaatatttctaggccatgcagtttatctgtgagtttttaaaaattgtcacaatctcaataaaaaaaaattccaacatatttattaaa

SEQ ID NO: 512122 - DNA, 148 bp, Homo sapiens
cacatgtcagtgtctttaggacaactgagctgggacagaaagggactggagggctgccccccaacctgatcccttctgaacaaagacgtccacagatgtacctggacactctaggctcagagaaaagagggagactcctgctggattc

SEQ ID NO: 512123 - DNA, 396 bp, Homo sapiens
  misc_feature (199)..(199): n is a, c, g, or t
ccaacccaacaaggggttcaggccttgggtgggcccccattgcctttttctcccccacccccccgtgcccttgtgtccgaggaaagaggagccccccgggccctgggtggcctttggggccttttttctgtttccccccctccctctgggggggctggccgtgggtttgtcttttttaggtgggttggggggcctttgnccgccccctccccccccaaccagggtggtttcctttaacctgttttttgtgggggggggggatattttgtaacccctggggcccccgcccctttttttgggccccctgtccttacctgttttcggcccccttaattttttaaccccggggcaggcagggggtccgggccccccaaggccataaaacaggagccgtga

SEQ ID NO: 512124 - DNA, 1242 bp, Homo sapiens
ccaaacttttccctatggcttcggtgaccaggccgtgtttggagagctagccctcgggaggagggacagtggagaagttccagctgcagtcagacctcttgagagtggacatcatctcctggggctgcacgatacacagccctagaggtcaaagacaggcaggggcagagcctcgagacgtggtgctatggctatcgccgagattgcgaagcgatacctccaaaagccagccatactatatggagcagttattagggagggtggccaaccgaatcgccaaaggaaccttcaaggtggatgggaaggagtatcacctggaccattaacaaggaacccaaacagtactgaatggaggcagtcaagagggttatgatacagtgctctggaccccatcggagtgctgtcaaatggcagtccagttctcagcggcatcagtccagatggtgaagaaggctaccccggcagagttcaaagtctgggtgacatacaacctggatggcggagagctcaatagtcaactacaagagcacaaagccagtcagggcaaaccagatcaacctgaccacgccattctatacttcaaaacatggcaggccagcttccccagatatcacatgaccatgcaggtcaccatagacgcggaatactacattcagccctgtggaatgacgacctcttgatacctaccaggaacaaagcttgccacccagtattcaaaggcctctagaccataccgcaccatgagaaaggcccactggcatcttgggaacaccacctgagcaggacatcccagccgaccagagcgcgaggcacaccagatatactgcaccgcaagggcgcttaacgtctaggcccactacttaagcgccaagggagaagacaagctgctgacaagccatctcggtaccatcacagtgatcacaccaccaggtaccgggagtccaagtcatcacaccaggaacaactacaccaagattacacaaataaccagactcacagtcgacactggcataacaacaaaacacaaataagaggaaagtctaaacacaacatagaactatacaccctagtccaacacatcagctactacgtaatacattacacaaccactgcttatatcatcaattaacaagataaacaaacaaaacgaaccattcacgatacacataacgatatagcaaaaccatacactaacacacctctcataaccaacatctcactatacgcgacctacccacgaac

SEQ ID NO: 512125 - DNA, 259 bp, Homo sapiens
attgactgtgccaattcattttacccaggcacgattctgttccattaagaaagaaggaaaaagcctcaccgaagttccacgaaggcagccaagaacctgcaaaaggcaaatttaccttcttcgggcaattagcaaagtctgcaaagattgtacaatatatttggggttatggtatagttttagcaacccaattgttccagaagaccctcaaaaggctgtgctagttactgtttatgtgaccctgtttaagatgcttccc

SEQ ID NO: 512126 - DNA, 179 bp, Homo sapiens
ccccaccactgcggacgataatcgcgcacgtagtcgccgtggtacgggttgtactgtcggatgtaagtgcggttctggttgatgatgtatgtctggttgttcaccaccacggtttgattgatcaccgtggtgttgttgatcgtgacgctgttctggtgccagccgcgaaacgacgtctg

SEQ ID NO: 512127 - DNA, 174 bp, Homo sapiens
ccgagtccgaaagatgactgaaaaagcaaaagcttatttaaatcgttggtaacttgtaccaaaatattttacctcaaaatctataaagcaggtacagttaaggactaagtagaactaaggcttctgcttccttgatgctgtggtggagtagggaatgttatgatttgctttgca

SEQ ID NO: 512128 - DNA, 439 bp, Homo sapiens
ggccggggactattatttatgcatcatttgaggtcagccgtttgagaccaggctggccaacatggtgccttgcctctactatgcagaacattagccagtcatggtagcacacgcctagaatcctagctactcgtgaggctgaggcagtagaattgcttgaacccagtaggcagaggttgcagtgagccgagaccgtgccactgcactgcagcctggtagacggactgagactatgcctctctctcactcgtctagtgcactgattccatctcctgtatctgtcattcattactatctactctctcatatctgatccctacgtccgtcctgtacccttacacgccttgctccgcagtatcctccctctcacctatcatctcctcttcttcttcctatctctctgcactctcatattccctcgtccctacttctctcccct

SEQ ID NO: 512129 - DNA, 107 bp, Homo sapiens
ccctcgggattgggcagctgggggaagttaatatgagccattgggtgtaccagtgcattcatttgggcaaggaaagtgtcataatttgatactgtatcttgttttcc

SEQ ID NO: 512130 - DNA, 274 bp, Homo sapiens
acaagcccggatatctcggatcaagcatactgaccctggaatatcgcagcgttttgctcctcaaatgaaatacgcttccgtcatttcttcaaggggcgcgccctatgctgcttagcgtcgcttgtcaaactatgagctcatctattctctaatgaggtactctggcagctccgttcatgtcactgttgataatacccgtatcacactgctgtttcctcgtaccgtccactccatcttaccgggtcatagctgttttcctgaatatagatagagg

SEQ ID NO: 512131 - DNA, 446 bp, Homo sapiens
tcctaaatattatgtcatcatttcagtcatttcatcgcatcatttcatctcatctcgtatcttatctcatttcaatttcatttcattatttcatgtcatctcatctcatcatttcatctcatcatttcatctcatcacatctcatcatttcatcattttatttcatcatctcatcatttcatctctcatttcgattttagtttgaatttcatttcactatttcagtttcatctcatcatttcatcgtcaccatttcatttcatcatctcatctcatcatttcatcattcatctcatcatctcatcattcatctcatcatttcatatcattttatctcatctatcatttcatctcatttcatctcatctcattccatcattacatctcatttcatctcattttatgtcatcatttcatgtcatcatttcatcacatctcatctcatc

SEQ ID NO: 512132 - DNA, 815 bp, Homo sapiens
gcctggcgcccgtgacagaaccagctgtctgagctgcccgggcagcgggggagcagcgagcgggcttccgcgagccggagaaggcacaggcctgtcccgggtcccggcaggtctgcgcgtctgttcccagtcgctctgcgagggcctaacaatggaggagcaacctgtccatgaatccctgcaggacagtgagcaggagtgggaaatctcgacatggaaaagccctacaagtcagaaatgaaggaaacctggtaaaacgaccggaaagccagaagatgaactagagcctgatgctgaccggaaacgtcagacgaggccagaaaagccagacgtggaggggacgacagactgcgcagggacaagagcagaggatcgagcggcagaagccaaggtgatgcagcggacaagtgcgcaagatgacggcaagccatcgacaggcgggtggcccggtccggaactgtgaggggcaagttgccgcgcgcaagcgggccggaggagcataggtcgccaggaccgatccacaggagtcgaagacaggccgtgattgacgcccacgtgctgaccacggccctgccgcccaaagatgcgaccctgggggcttgagagaattgactcgttgccgcccgtgcacatagagcgagtctatgaggcataccccacgggagaaccacatgtggcgcgaacccgagtaccgcatttgcctctcgccaatggggaccctccttccgaaggcatcggaactttaatggcgtgaaccagggggcgattcttcgcatgctcaaggtgaagccgaagagtcgccttgtaggaaggaa

SEQ ID NO: 512133 - DNA, 260 bp, Homo sapiens
  misc_feature (37)..(37): n is a, c, g, or t
  misc_feature (149)..(149): n is a, c, g, or t
ggggccccaggtaggacagcttggatgttgggccccnagccaggggcctcggggttgggggcagcttgggtgctagcaaaaggaagtttctgggggggggcatgcggggagacccagcccccctgtggggggggcttttttttccaggntgggccttggcctccagaggcctttttgcccaccaacccctttgtattgagaggggcctggacccctcctcttcccctcagtgaaaacaataaagacaaatttttgttgca

SEQ ID NO: 512134 - DNA, 653 bp, Homo sapiens
  misc_feature (628)..(628): n is a, c, g, or t
aattcgggagtttcgccgccgcagtcttcgccaccatgccgccctacaccgtggtctatttcccagttcgaggccgctgcgcggccctgcgcatgctgctggcagatcagggccagagctggaaggaggaggtggtgaccgtggagacgtggcaggagggctcactcaaagcctcctgcctatacgggcagctccccaagttccaggacggagacctcaccctgtaccagtccaataccattccaccttattaccagaaaacttagccaaaaccatttacccaaataaagtttaggcgatagaacttaaacaacaaaacaaccaaaacaaaaaaatctttgttgggcggcgtcggagcgctgagaaaaaaagttttaaacacccttgcgtgttggggcgccgcccgggccgccagttgtggttaggttggaaccgtgggccactaggcgtgtgctcccaacgaggcaaactccggcgccttgacatctgggtgtttgggtttcttccaccaatttaaaaaagcgcgcgggggcgacaccacgacgctgttgtggaccacaatctcaggagggagttcggcagggcacattgcagggcactctacaccaacgagacgtccagagggagncaggatattaatagccgggccggaa

SEQ ID NO: 512135 - DNA, 1027 bp, Homo sapiens
  misc_feature (206)..(206): n is a, c, g, or t
  misc_feature (270)..(270): n is a, c, g, or t
  misc_feature (305)..(305): n is a, c, g, or t
  misc_feature (319)..(319): n is a, c, g, or t
ggtacagaagttagccgggtgtgctggtgcacacctgtggtcccagctgctcgggaggctgaggtgggaggattgcttgggcccgggaggtggaggttgcagtgggccgtggtcatgccactgcatctccagcctgggtgacaaggcacaaccctcaaataaataaataaatacatgttaaacatatacctttattacttcatttntgtaagagcttcagggaataggcttttttaaagggaatagacttatagatcaattttaatattngacttatagaattttatgacactaaatggataatngtaaagtttgagtngggacccattttgtaagacattcaggctataaacaaggtaataaatcacactcttccagttctacgtcccaatttaatcggtttacagttcggtggctgtcttttttttgtgtttatttttctgtggacacggggggttccccattgggaccaccgggcgtcgggcggcgcctggtggtagaagtactgggcgcacacagcgggcgctccccaccatcgagggacctcgaggataattgtactcagaggcatccggtgcgtcggcagaacaagggcgtagggaaacgagcactgtccacgaccgcccataacaccccccccgggaagagaaaaatgcggcgaaccacacgggggggacaaacacgacgacatctgccccaatagttaaacccggggaaagtggccacaacacaccctatcggtgcgcaccaaagtgatcacccacactagagtgagggacccccacgcagtaaggggctcaccgacagaataccgtggcaaaatcgcggggccacacataggccccccgggggtccccgggtggagcaggcccccctctgcaaagagaaccccggggggcaactacagccccgtgtgcacacgacgatggggcacaaacaacaacagcaacatcgtggcctaccaacgccgagtggcgacacaaaaggcggcgcgtagagcgcgacaactaacgctcgaccgataata

SEQ ID NO: 512136 - DNA, 256 bp, Homo sapiens
cacccccttcctatatacggaggtaacccctatcctgaatctatttctattattccaattagaaatttcaactttattgcatgtgcctaatccacatcaatcctacattagtttaaaaactccattcaaatagtattactctgacattatcattctggaagtatttctaaaactgcatgtgtctatgtcatgtgtagtctcactgagctaattttaactgctgcatgcggtttcactgttttaaaaaaggaaggat

SEQ ID NO: 512137 - DNA, 432 bp, Homo sapiens
gtttttttttttaaatttttggtaattcctaagcaaccccctttggacttttcctaactccaataccccacccctggcctttttttatcccaaatgttggtgatgcggagagggaaggtcattttaaggggacctcccggcgccgaatccacctttgggagaaaaataaagttttttaaccccccttttaattggaccataaattacgcctttaacccctaaataccaaggcgcctcccaccgggacatgggggcagccgggaccccattttacagaatttctgggatttctccgttgtaaaacctgatttcctcctgcatgcctccttgaattccccaaatgggtcgccaaacaaccaaatggagaaaaaaagttttacttccttgcattcttctacctttaaatagcaccccctctaccccctctagagc

SEQ ID NO: 512138 - DNA, 966 bp, Homo sapiens
  misc_feature (660)..(660): n is a, c, g, or t
aattcgggagtttcgccgccgcagtcttcgccaccatgccgccctacaccgtggtctatttcccagttcgaggccgctgcgcggccctgcgcatgctgctggcagatcagggccagagctggaaggaggaggtggtgaccgtggagacgtggcaggagggctcactcaaagcctcctgcctatacgggcagctccccaagttccaggacggagacctcaccctgtaccagtccaataccatcctgcgtcacctgggccgcacccttgggctctatgggaaggaccagcaggaggcagccctggtggacatggtgaatgacggcgtggaggacctccgctgcaaatacgtctccctcatctacaccaactatgaggcgggcaaggatgactatgtgaaggcactgcccgggcaactgaagccttttgagaccctgctgtcccagaaccagggaggcaagaccttcattgtgggagaccagatctccttcgctgactacaacctgctggacttgctgctgatccatgaggtcctagcccctggctgcctggatgcgttccccctgctctcagcatatgtggggcgcctcagtgcccggcccaagctcaaggccttcctggcctcccctgagtacgtgaacctccccatcaatggcaacgggnaaacagtgagggttggggggactctgagcgggaggcagagtttgccttcctttctcccagggagcaataaaggtttctaaggagaatgaaagtagagcgtacaagaaacacaatacagcacgcacgaagggacaacaaattgagaggaggggcggacaaacagcaagggcatgcaacaaggggcccagcgtgaccacagagccggttactgtgaccacgcatatggtgtgacacaggtgggcaaaacacgcgcgttccccctaaagtgagagccaatcaacgcgaagagccagtaacccgacatag

SEQ ID NO: 512139 - DNA, 1074 bp, Homo sapiens
  misc_feature (768)..(768): n is a, c, g, or t
cgtttcataatatgtttcttcacatgtttcaatcatcataaataaaaatagccaccatgccgccctacaccgtggtctatttcccagttcgaggccgctgcgcggcctttaataaggagcaaaagtactgcgcatgctgctggcagatcagggccagagctggaaggaggaggtggtgaccgtggacagtaaagggtggaataggtaggagacgtggcaggagggctcactcaaagcctcctgcctatacgggcagctccccaagttccaggacggagacctcaccctgtaccagtccaataccatcctgcgtcacctgggccgcacccttgggctctatgggaaggaccagcaggaggcagccctggtggacatggtgaatgacggcgtggtgagggaaaaaataaagagtagaggacctccgctgcaaatacatctccctcatctacaccaactatgaggcgggcaaggatgactatgtgaaggcactgcccgggcaactgaagccttttgagaccctgctgtcccagaaccagggaggcaagaccttcattgtgggagaccagatctccttcgctgactacaacctgctggacttgctgctgatccatgaggtcctagcccctggctgcctggatgcgttccccctgctctcagcatatgtggggcgcctcagtgcccggcccaagctcaaggccttcctggcctcccctaatagagaaagaaaaagtccagagtacgtgaacctccccatcaatggcaacgggnaaacagtgagggttggggggactctgagcgggaggcagagtttgccttcctttctcccagggagcaataaaggtttctaaggagaatgaaagtagagcgtacaagaaacacaatacagcacgcacgaagggacaacaaattgagaggaggggcggacaaacagcaagggcatgcaacaaggggcccagcgtgaccacagagccggttactgtgaccacgcatatggtgtgacacaggtgggcaaaacacgcgcgttccccctaaagtgagagccaatcaacgcgaagagccagtaacccgacatag

SEQ ID NO: 512140 - DNA, 874 bp, Homo sapiens
tttagtctggcctctgttttaattggccgattggccttcctcgcgctccctgttactgtgcgttctgtccccgtggccttgctgccctgcgtctgtgccctggctcctgctgtgctgtgcctatgtcctgatgtgctccttcagcgtgagtgtgcctgcacaccaatggctgccctgatgtgttgcaactgtgagctgtgcctgatgctgcctgtgtaacctggatgcatgcacctaagaatgtgacctgatagcccctgctgtgtgatggtgttgcatgatgtgcttgtggcatgagtgcctgtgtgctaatgtgacctgctgtgtgccttcgtgtgtgtgcttgtgctttttgtgctcacctgcactcctgctcttgtgatgcagcttttgtggtgcctgactgactgggtggtcgcaggatgtgtccttgggccctgccgtggctgatggtctgttggcagggagattcatctgatgtgtgccctgctcttgagtgactactgacagtcacctgcaggttcgaatggctgcactccccgaaatgttgcggcatgattgtgtcaccgagtgtcgtcatcaccagtggatggaagcggagcggattcgcagcgtagctgaaaatggtgctctccctgggaggatctgacttgaggggcatccattctggacttgcactcagtgtgccctgtcttgtcgggaagcactttgttaaccttgtacagattacttcgggggataaaaataccagaacatcttctcagaggaggacttccggttataccgggagttgctggcagaaggtcagctcaccattgctgaagctttggcatcagcgcatctcgctgatttgacaaggcccacttcttctccg

SEQ ID NO: 512141 - DNA, 107 bp, Homo sapiens
gatcacggtctcatctgtactgtgttaagcacctatagtgtctgatctcagcttgaaataagtttacatttatcttccaattacagtaatgctgacgaaacagcaag

SEQ ID NO: 512142 - DNA, 745 bp, Homo sapiens
  misc_feature (439)..(439): n is a, c, g, or t
taattatactttaagttttagggtacatgtgcacattgtgcaggttagttacatatgtatacacgtgccatgctagtgcgctgcacccaccaactcatcatctagtattaggtatatctcccaatgctatccctcatctacaccaactatgaggcgggcaaggatgactatgtgaaggcactgcccgggcaactgaagccttttgagaccctgctgtcccagaaccagggaggcaagaccttcattgtgggagaccagatctccttcgctgactacaacctgctggacttgctgctgatccatgaggtcctagcccctggctgcctggatgcgttccccctgctctcagcatatgtggggcgcctcagtgcccggcccaagctcaaggccttcctggcctcccctgagtacgtgaacctccccatcaatggcaacgggnaaacagtgagggttggggggactctgagcgggaggcagagtttgccttcctttctcccagggagcaataaaggtttctaaggagaatgaaagtagagcgtacaagaaacacaatacagcacgcacgaagggacaacaaattgagaggaggggcggacaaacagcaagggcatgcaacaaggggcccagcgtgaccacagagccggttactgtgaccacgcatatggtgtgacacaggtgggcaaaacacgcgcgttccccctaaagtgagagccaatcaacgcgaagagccagtaacccgacatag

SEQ ID NO: 512143 - DNA, 308 bp, Homo sapiens
  misc_feature (7)..(7): n is a, c, g, or t
  misc_feature (111)..(111): n is a, c, g, or t
  misc_feature (113)..(113): n is a, c, g, or t
  misc_feature (256)..(256): n is a, c, g, or t
gtgccgntcccccagcactgccagctcacctgggctgtgcttgaattcttcgctgggcctcagctgcctccccgtggagcagggcgtgggacttgcaacccgccatgcctnantcccccccttcccctgccctgctccctcatggccagagcctcccggacgggcgccgcccctgctctgcaaccagtcccattgaccgcccaagggctgaggagtgcgggggcatggtgtgggactagcaggcagctccacccanggccccagcatgggatccagtaggcaaagccagctgggacttcctgagtcgg

SEQ ID NO: 512144 - DNA, 555 bp, Homo sapiens
atcctcgtctcatagaagtcgatcgcccagctacacataagccgtatctccaggcagccatatctcacaggcctcggagaactcaccctcctccatgccctcacccacataccaatacacaaacgccctcttggaatacatcaggtcgaacttgtaggtaccaggcgggcccaggcctacggcgatagcagacgtgtagctacagcatgcacacatgcacgctgaaccttggccaggtcacccccaggcaccacaagaggaaaagctagtaatagataccaaccttgaagcctagtgagaaccagttccacaaactgaatgcttgcgcttggtctatgacatggcggcaataggcagcagtatgacatccttagacaccatatcttccacaggtacagccaggcagcaagccatgtacctatccgttgccgaggatccacactttaaacatctaggtaggcaggctccaaagcaggcattggtgcactctgccaccgacagctgctccgtggtatgcctttactggcagagattactggtgcataggtagcccag

SEQ ID NO: 512145 - DNA, 157 bp, Homo sapiens
gatcaaaaagcgagagctgatgggtacgctaaaaaggcggctctctgcaaaacagaagtactcaaggcaagtcgggcacaccctctggaagctctgccgacgaggacccttctcctcctcctcagcacccatagtcttaaagacgtgagaactcaga

SEQ ID NO: 512146 - DNA, 172 bp, Homo sapiens
atattacgtggcaagagtaaaataaatagttcagatgactactaaagtcaaagtcattaaatctggaagtaaacacgagaattcattctggggaaatcagtgctgtcgtgtgtaagaggttactgcgtgtgctcagtgagttgaacacgtgtggtgcatgtatccaggatac

SEQ ID NO: 512147 - DNA, 149 bp, Homo sapiens
ggcagttctgagtcccgcccggcgtgcgcggagcggggcacccagcagcggaggcgcggcgcgcagcacacccggggacctattgttccatgttgcggagcgaggaggtggccctggtccagctttttctttccacagggggtgcctac

SEQ ID NO: 512148 - DNA, 323 bp, Homo sapiens
  misc_feature (37)..(38): n is a, c, g, or t
  misc_feature (46)..(46): n is a, c, g, or t
aggcagggatgtgtggtttcactgtcattttcaatgnngcactggnagtcctagcacctgcacgtggcaagaataagcaattattaggcaagtagattggcaagagtaaaataagtgtcctgatttacagataagctgattgtctacatgaaagtcacaaggatctaccagataattcctaggacttgtgagttcagcaaggtctctggataaaagattatcacccaaattcagttacatttgtatataatacaaaaatcatggtgaaacccaaattaaaacataatagtttttacagttgcttcaaaaagtgaatactaggg

SEQ ID NO: 512149 - DNA, 213 bp, Homo sapiens
tgacgtgccgttgcacatggaagtctgtcagaggattacgtgcggtctaggtgaggaatccgcggggggacatcacgaatcgcgtggaccacatcggatctgggtacacaacgcgtctcctcgatcctaggcaatgatggtgaattctatgcccaagatacacgtagatagtgattggcagcggtaggatcctcggtggagcacgcctacgcg

SEQ ID NO: 512150 - DNA, 298 bp, Homo sapiens
ctaccctgcccacattacacccactgacccaacgcctgagatcagccacacccccagacagtgggggccacataccagacatcagagcagggcacctagagacacacgaatcactccccacaaaccgataatcacagagccagaatgcactgctctgggactaaagaataggtaagatcaggccaccactgaggcccaaatactggcccaggtggccgcctagtccccagcaaccacagcctccactaataaccacaccctaagccacccaagaaatcatacagagcctacagtacaa

SEQ ID NO: 512151 - DNA, 885 bp, Homo sapiens
gcatccgcttgtggaagtacgccctggacatgcaatcagagcaacctggagcctctgagccccatgaccgccagacagtttcctctccttcgcggaactcttctcctacgtgcttcaggaccgggccgccaaaggcagcctgggcgacccagatcggctttgcgtgacctcatgggggttctctagccaaaggggtccgggaagtggaacgggccctgcagctgcccagagagccccggagactcagcccagttcaccaaggcgctggtcatcatcctccaactgctctacctgctgtagaaagtggagtgcacccccagccaggatctcctgaagcaccagactcgtctaccgcctgcttcaagtgcgcgcccgaggggtccagaacggcttcatccccgtctgcacatggctgtgagactaatggacaccacaaactgtgggccgctatcccgtggtgctagattccccttccctgcacgtggtcaaagtgctgctcgactgtggggccgacccggacagcaggtattttgacaacaacaccccgatacacatagcatcccagaacaagtgcccggccatcatgaattgccgctgatcgaagcaggggcccatcatgtggacgccaccaatgccttcaacgaatgacggcctatcgagctgcttggactgaagaatgcttgctgacgcatggggtaccattgcaggccttcaactacgtgaccctgcagtgccttgccggtccgggccctggataagaacaagatcccttacaagggcttcagtcccggaagatctggaggcgttcattcgaaactgtactgaccttgccagaaacgcgtgtacctctacctctcccctctctggctgaaatggggggaaatc

SEQ ID NO: 512152 - DNA, 326 bp, Homo sapiens
catgtgatctcacgactgatctaaggccagatatgagcccatgaatcacatgtcagtcacttggccacagctacagcatgaggcctgagatgcccacatcacatcacatgctgagcacaggtggcccagttcccggtgcagctgcccagcctccggtgcgaagagccggacctgcagagcctggaggcccatgatagaggtggtgtggtgcagcagttcacatgcaagatgtgccagtaccggagcagcaccaaggccacactgctgcgcaaaatgcggggaacgcaacttccgtccagtagcagcagccgcaagcagcagctggt

SEQ ID NO: 512153 - DNA, 108 bp, Homo sapiens
tcagcggtaccaactgatgcgaggaagaactatagacagtaaagagtaaaggatgaggaaaggaggggaaaaaaaaagagaacattttgagggtttcttagcgatagt

SEQ ID NO: 512154 - DNA, 1030 bp, Homo sapiens
  misc_feature (136)..(136): n is a, c, g, or t
  misc_feature (224)..(224): n is a, c, g, or t
  misc_feature (499)..(499): n is a, c, g, or t
  misc_feature (518)..(518): n is a, c, g, or t
gcgaagagattcttagtgaacgccgtaccagccgcgtctctcaggacagcaggcctcctgtcgcttctgtacgtggcgccgcatcatgccgtgcacctaccgtccccgtcgaggttcttgttttgctgaaattccnacaagtaaacgtatgccagagacggacctagtgcaagagcattagtcgatgcaactctcctccacaatatgtatgcacattcacatgnacacactacttgggacggtgtggcctttgctaacaggctcacactctgccttgcctatatcctctactggaagaagatggatagcttatagagagaactcactggaactataagaatcatcagctatgcgtgagctgattcttggtcgcgccgggaattctaacataacggaggagttcgatgggcctctgaaatgaaaccttgacgaacactcacctaatactaatggtcagaactcttaccaatgtatgcgtagtacgaacagcacgaagcanaacaatatatcgacttggntttcctatgcacgtaccatggtccacctgggatcggaagatgccttgttatgacatatataaattttccccaaaggagttcagctcgtgatccaccaaaacgaagggagaacccctagagaggttaggtacttcccagttcaagaattgagtactcgtgcatggtatggcaatgttattggtgcgagcagtccagggggcctgatgcgtgcaacaagggggaaccttccaagacgcaggagagaattttgcctgctctgtgactcgaaatgagtcagttaagactttaacaaggcctgattggaccttgtgggtctcctgtggccaagagaccccaaaggggtaaaacaaagggaatttcaccaatcttagcaagaaccattgctggttggggagatactgggctttattggcaggcaaccttgaagtttaaattacaaagggcgacaattcaataactcgttggaattccacgaaggcacgattgggttgtgggagcaatggggccatact

SEQ ID NO: 512155 - DNA, 97 bp, Homo sapiens
acggccgtgtattactgtgcgagacgactcggtagtggtggttattaccttaaacctacctggggccagggaaccctggtcaccgtctcctcaggga

SEQ ID NO: 512156 - DNA, 185 bp, Homo sapiens
ggcattcccgcgtcaaccagaatgatttcccccggagctgagggattttcgataaagtaaacattcgcaatctggacggtcagcccgtaaacaccgtccgccgctttaaaaccgacaccgcttttcaatgaaaagagcggcataaacggatcactcatcatggcacctcctctgatgccgtcgac

SEQ ID NO: 512157 - DNA, 416 bp, Homo sapiens
tgggtttaaaaaatggtggtacctttaaaaatgaaaaatttcctctcttggttggcaattatctggggtgttttctttgtaattgtggctcaattgggtcatcatgaagggtaaaaaaagcgaggtgccctttttatgctgttgtttagggtcaggccctctccacccatggtgccactgatttgctgtgtgaccctgggcaattcatcttacttataaggtgcctcagtttcctttctgtcaaattggggtataatattattgccctacctcaaagggcagtttggaggcttgactattgtttttaagaaggcttttggggatccttcagcccaggatttctcaagacctgagttttttttatattaggattgtccaccatgaatttgatacgtccgtgtgtcccagatgctgtc

SEQ ID NO: 512158 - DNA, 177 bp, Homo sapiens
attcggcacacgggagggctgtcaacggtgatggtggagtattccacgtcccgcggctccgagcgaggtggacatgttcgtggctcaggccgtgctacagtttctctgtttaaaaaacaaaagtagcgcatcggtggtcttcacgacgtacacccagaagcacccgtccatcgagga

SEQ ID NO: 512159 - DNA, 101 bp, Homo sapiens
  misc_feature (38)..(39): n is a, c, g, or t
acataaaatacactattaataatgataactgatgagcnnatgtaaaaatcacacaaaaaaatttcataatgttttaagaaagtttgcgaatttgtgttggg

SEQ ID NO: 512160 - DNA, 241 bp, Homo sapiens
  misc_feature (39)..(39): n is a, c, g, or t
  misc_feature (104)..(106): n is a, c, g, or t
  misc_feature (111)..(111): n is a, c, g, or t
  misc_feature (120)..(120): n is a, c, g, or t
  misc_feature (149)..(149): n is a, c, g, or t
  misc_feature (172)..(172): n is a, c, g, or t
  misc_feature (179)..(179): n is a, c, g, or t
  misc_feature (187)..(187): n is a, c, g, or t
  misc_feature (193)..(193): n is a, c, g, or t
  misc_feature (198)..(199): n is a, c, g, or t
  misc_feature (207)..(207): n is a, c, g, or t
  misc_feature (229)..(229): n is a, c, g, or t
  misc_feature (231)..(231): n is a, c, g, or t
acagcattataaggaggggaaggccaagcccccgggggnccggccatttgccctggacaaatttgtgcgctgagccaaactccagggttgcctgggaacagtcnnnccccnagatccccngtagggaaatgagtgttccctggaacaangaggtgggggcagtgtggccccntcccccnctgggggnggacanctgtnncctggggngggttggtattaaaaaggaaancnattttttgga

SEQ ID NO: 512161 - DNA, 760 bp, Homo sapiens
cccgggtggctgggctgcatgcccctgcggctggcggctgggatgttcgtgcaggaggagaacgatcttcgctgggcaatgtgctgcgtgctgcacatctgcgcgtcctgactggcgccgagtggctggtggaggccatccgagagacacctcggtggagaagctcaaggaggcgctgcctcaagctactgtgctcatgggagcttagcaagtatcccacagaagtataacccatcatagattaatccatcgctgcctcagagagtggtgctgactgatgccaggaccatcctggaagagaacatccaggaccacggatgtcctattattgataaaaaagcgtgctccatcacgcacttcccaagatggctgagtgtctcagcagacagaaaatgacacgaacaagaccagaactgctccagataacgaggccatactgcggtgccaccgtcgagcctgccctcctacaagcatggaccgtggccgcggtccagaccaacatgacagacttccaggacagaactccggaaggatactggtgtctctcatcgaggtggcgcagacctgtagccgctgaacccggcatgcgggtggacttgcttatgcaaggggaatgccttgctggcgacgacgaggatagcgtgtgcgcgagctgcctggggggtcacggagatggcttccgggaccatgcacgaggcctttgtgacccgttttggcctcggcctggtggcctgacgccaacccgcattagccctttggc

SEQ ID NO: 512162 - DNA, 290 bp, Homo sapiens
aggtggcaacgtaatggcgtcccaggtgctcaggaggctgaggctggtagactgacatgaatctgggaggcggcgtttgcagctgatgagccacgtgctttccagtccagcctggtgtggcagagcaagactctgtctcaaaaaaaaaaacaccaaaacaaaacaaaaaaaacactcaaatctcaacagtaagaaaaacaccagataatccatttagaaattgtgcaaaaaaaacattaaagatatttcccccaaagagattatacaggaaggccattcattatggcccc

SEQ ID NO: 512163 - DNA, 392 bp, Homo sapiens
  misc_feature (2)..(2): n is a, c, g, or t
  misc_feature (17)..(17): n is a, c, g, or t
  misc_feature (42)..(42): n is a, c, g, or t
  misc_feature (85)..(85): n is a, c, g, or t
  misc_feature (194)..(194): n is a, c, g, or t
  misc_feature (240)..(240): n is a, c, g, or t
  misc_feature (306)..(306): n is a, c, g, or t
  misc_feature (384)..(384): n is a, c, g, or t
tnaattccataagtggnaaagtcaaactgagaatatttgtcnaaatattttctccttattaatatgggtgtttagaatgtgagcnacatctttaatataggaattatgggcccaggtgcagtggcttatgcctataatcccagcacttctggaggcagagacaggtggaatcgcttgagctcaggaattcaagnccagcttggtcaacatggcgagaccctgtctctacaaaaaaatacnaaaattagctgggcatgatggtatgtgcttgtagtcccagctacttgggaggctgaggtgggaggntcacttgagcccgagaggtcaaggctacagtgagctgtgattgcacagctatactccagcctggccaacagagcaagnccctctca

SEQ ID NO: 512164 - DNA, 155 bp, Homo sapiens
gttccagggccaggctggatgccacatgcaccccattatgccgcaggcgccctacccatcttcaggcagcctatgggacgcaggccccattctgtccctcggtcgccgtgttgccggaggtgggtccgtcgtccccaatagtcgtgctcgctcag

SEQ ID NO: 512165 - DNA, 240 bp, Homo sapiens
aggatcatcagaatatacaatatgccggaataggggtcgtgtctcctagcctaagaaacttaaaagaaatatcttttgacacaaaacacaaagatgttttccaaaacaattgacatactgatacattacgcctttagcagtagagctcaatacataagctaacctattgtgcacaaactaacattaatataatattatatatactattactgcatagagtattatatagactttagtagc

SEQ ID NO: 512166 - DNA, 448 bp, Homo sapiens
  misc_feature (345)..(345): n is a, c, g, or t
  misc_feature (362)..(362): n is a, c, g, or t
tgagtcgaaagaggcgacgaaatgcaggcaaggacaggagacatctccctttgagcaaagagtaataaggaactatcctctgctctgccactgccccagggagacatggatctgtgaggacagatttggccacggctggtttccgttcaagggcaaggatcacagctgcccttgaatctcattgcctcagagaagactagagggctcttggactatcccgaggccaaccaaaaaaaaattcccacctccccccaacccaaaaaaaccgaattgtaaaagtgtaatatttttttttttttttccccccccaacccccccgaaataagaggggagcaaaggagaaanaaacccccaaaaaaacncccagagggattctgttcgtgactcccagggctgggacattatgtaggagccacttcataaacattctctttactcataaaaaaaa

SEQ ID NO: 512167 - DNA, 2726 bp, Homo sapiens
ggaccccgcaggtgattgggggcgtagcctggagtgagggtttggctggtgtagcttggagtgaggccccctggcgtggagtcttgaggcctgctgagggcgtgagatggcatgaggcgaagagagggccatggcaccgactccgagatgggtcaaggacccgtacgggagtcgcaatcctcagaccctcccgcgctccagttccggataagcgagtataagccgctgaacatggcgggagtggagcagcccccgagccccgagctgcggcaggaaggcgtgaccgaatacgaagatggcggggccccggcgggagatggcgaggcgggcccccaacaggcggaggaccacccccagaatcctccagaagatcccaatcaggaccccccagaggatgatagcacctgtcagtgccaggcgtgcgggcctcaccaagccgcgggtccagatcttggttcctctaatgatggctgccctcagctgttccaggagcggtcagtcatagtggagaactcctcaggctctaccagcgcttctgagctcctcaaacccatgaagaagaggaagcgcagggaataccagagcccatcagaggaggagtcggagccagaggccatggagaagcaagaagaaggaaaggacccagagggacaacccactgctagcaccccagagagtgaggagtggagcagcagccagcctgcaacaggtgagaagaaggaatgctggtcgtgggagtcctacctagaggagcagaaggccattactgctccagtcagcctcttccaggactcccaggcagtcactcacaacaagaatggcttcaaactgggcatgaagttggaaggcattgaccctcaacacccgtccatgtacttcatcctcaccgtggctgaggtatgtggctatcgcctacgcctgcactttgatgggtattctgagtgccatgacttctgggtcaatgccaactcccctgacattcaccctgctggctggttcgagaagacgggccacaagctgcagcttcccaaaggttacaaggaggaggagttcagctggagccagtacatgtgcagcacaagagctcaggctgcccccaagcacatgtttgtgagccagagccacagtcccccacccttgggcttccaggtgggcatgaagctggaggctgttgaccgcatgaacccgtcccttgtctgcgtggccagtgtgaccgatgtggtggacagccgcttcctggtgcactttgacaactgggatgatacttatgactactggtgtgatcccagcagcccctacatccacccagtgggctggtgccagaagcaaggaaagcccctcacccctccacaagactacccagaccctgataacttctgttgggagaaatatctggaagaaactggggcctctgctgtccccacctgggccttcaaggtgcgaccccctcacagcttcctggtcaatatgaagctggaggctgtggaccgcaggaacccagccctgattcgcgtggccagcgtggaggatgtggaggaccatcggataaagatccactttgatggctggagtcatggctatgatttctggatcgacgctgatcacccagacatccaccctgccggctggtgctccaagacaggacatcccctgcagcctcctctcggacccagagagcccagctctgcctcccctgggggctgtccccctctcagctataggagcctgccccacactaggacctccaaatacagctttcaccaccggaagtgccccactcctggttgcgacggctctggccatgtcacaggcaagttcacagctcaccattgcctctcaggctgcccactggctgagaggaaccagagccggctgaaagcggagctgtctgacccggaggcctcagcccgcaagaagaacctctcaggcttctccccaaggaagaagcctcgccatcacggccgaattggacgccctccgaagtatcgaaagattccgcaggaagatttccagaccctcacgcccgatgtcgtgcaccagtccctcttcatgtcagccctgtcggcccaccctgaccgctcactctcagtgtgctgggagcagcactgcaagctcctgccaggagtagcgggcatctcagcctcgacagtcgccaagtggaccatcgatgaggtcttcggctttgttcagaccctgacaggttgtgaggaccaagcacgcctcttcaaagacgaggtaaggtgcaagtgcagagtgggagacagagccggggtcactgtccttaagacggcaggaagcaggtgccctccccagcgtcacttctgctaaggagggacccgtgttgccccaccaggtaaggtgcaagtgcagagtgggagacagagccggggtcactgtccttaagacggcaggaagcaggtgccctccccagcgtcacttctgctaaggagggacccgtgttgccccaccaggcaagaatagtcagagtgacccatgtatctgggaagactctagtctggactgtggcccagcttggggaccttgtgtgctcagatcatcttcaggaaggaaaaggcatcctggagacaggagtccattcactcctctgctctctacccactcatttgcttgccaaacttagctttgccagtgatagtcaatattaaagtgtacttttttcccctttaatccaatatagttgataattaaagtgtattttgaatgac

SEQ ID NO: 512168 - DNA, 143 bp, Homo sapiens
ttagaggatcctgttgttttcttctccactgcagcggtgcttgtggggctgggatgagccctctctgtccccaccggccctccttgccaagccattcctgtgtggctcccgcaggcctgaactcacccaggaatggcttggca

SEQ ID NO: 512169 - DNA, 946 bp, Homo sapiens
  misc_feature (63)..(63): n is a, c, g, or t
  misc_feature (65)..(65): n is a, c, g, or t
  misc_feature (72)..(72): n is a, c, g, or t
  misc_feature (77)..(77): n is a, c, g, or t
  misc_feature (85)..(86): n is a, c, g, or t
  misc_feature (88)..(88): n is a, c, g, or t
  misc_feature (96)..(96): n is a, c, g, or t
  misc_feature (99)..(99): n is a, c, g, or t
  misc_feature (102)..(103): n is a, c, g, or t
  misc_feature (106)..(107): n is a, c, g, or t
  misc_feature (109)..(110): n is a, c, g, or t
  misc_feature (112)..(112): n is a, c, g, or t
  misc_feature (125)..(127): n is a, c, g, or t
  misc_feature (129)..(130): n is a, c, g, or t
  misc_feature (132)..(132): n is a, c, g, or t
  misc_feature (135)..(135): n is a, c, g, or t
  misc_feature (139)..(139): n is a, c, g, or t
  misc_feature (142)..(142): n is a, c, g, or t
  misc_feature (146)..(147): n is a, c, g, or t
  misc_feature (153)..(153): n is a, c, g, or t
  misc_feature (171)..(171): n is a, c, g, or t
  misc_feature (192)..(192): n is a, c, g, or t
  misc_feature (196)..(196): n is a, c, g, or t
  misc_feature (200)..(200): n is a, c, g, or t
  misc_feature (202)..(202): n is a, c, g, or t
  misc_feature (205)..(205): n is a, c, g, or t
  misc_feature (209)..(209): n is a, c, g, or t
  misc_feature (211)..(212): n is a, c, g, or t
  misc_feature (223)..(223): n is a, c, g, or t
  misc_feature (228)..(228): n is a, c, g, or t
  misc_feature (230)..(230): n is a, c, g, or t
  misc_feature (233)..(233): n is a, c, g, or t
  misc_feature (235)..(235): n is a, c, g, or t
  misc_feature (239)..(241): n is a, c, g, or t
  misc_feature (250)..(250): n is a, c, g, or t
  misc_feature (259)..(259): n is a, c, g, or t
  misc_feature (262)..(262): n is a, c, g, or t
  misc_feature (268)..(268): n is a, c, g, or t
  misc_feature (270)..(270): n is a, c, g, or t
  misc_feature (274)..(275): n is a, c, g, or t
  misc_feature (277)..(277): n is a, c, g, or t
  misc_feature (279)..(280): n is a, c, g, or t
  misc_feature (283)..(283): n is a, c, g, or t
  misc_feature (286)..(287): n is a, c, g, or t
  misc_feature (302)..(302): n is a, c, g, or t
  misc_feature (305)..(305): n is a, c, g, or t
  misc_feature (314)..(314): n is a, c, g, or t
  misc_feature (319)..(319): n is a, c, g, or t
  misc_feature (386)..(386): n is a, c, g, or t
  misc_feature (389)..(389): n is a, c, g, or t
  misc_feature (392)..(392): n is a, c, g, or t
  misc_feature (395)..(395): n is a, c, g, or t
  misc_feature (399)..(399): n is a, c, g, or t
  misc_feature (407)..(407): n is a, c, g, or t
  misc_feature (422)..(422): n is a, c, g, or t
  misc_feature (425)..(425): n is a, c, g, or t
  misc_feature (427)..(427): n is a, c, g, or t
  misc_feature (430)..(430): n is a, c, g, or t
  misc_feature (435)..(435): n is a, c, g, or t
  misc_feature (466)..(466): n is a, c, g, or t
  misc_feature (494)..(494): n is a, c, g, or t
  misc_feature (499)..(499): n is a, c, g, or t
  misc_feature (501)..(501): n is a, c, g, or t
  misc_feature (542)..(542): n is a, c, g, or t
  misc_feature (880)..(880): n is a, c, g, or t
  misc_feature (938)..(938): n is a, c, g, or t
gcctgcgagcgctgctcatggcgctctatgagctcttctctcacccggtcgagcgcagttacngngcggggntctgntccaaagnngngctgttcntgntgnnggnngnngngctcacgtacatnnngnngntgntggnggncttnnggagcnacgggttttggctgaagnggagagctaggaggaggaggngacngtgngnttncaanannaggtggtggtngtggncntgntnggannngaaagggangggttcctnggntggagnangttnncngnnttnaanngggtgcaaggggatngcntgcgcgtgncgctngtttcgactagagaagaagacaggaaccaggatgggaagacggacatgttaaattttaaggtggagnttnccntgnagtncacggagnacgttctcggtgtgnagntnatnctgantttgtcctatggattacacaggatggggacnctggtgatggagaggatggggtttgtgnagtgntngtttggtgtcccgggatcacagttataggtgaacggagacntgaggctgcagcagaagcagccgctgagctgtggtggcctagatgcccgatacaacatatccgtgatcaacgggaccagcccctttgcctatgactacgacctcacccatattgttgctgcctaccaggagaggaacgttaccaccgtcctgaatgatcccaaccccatctggctggtgggcagggccgcagatgctccatttgtgattaatgctatcatccgataccctgtggaagtcatttcttatcagccaggattctgggagatggtaaagttcgcctgggtgcagtatgtcagcatcctgcttatcttcctctgggtgtttgaaagaatcaanatcttcgtgtttcagaatcaggtggtgaccacattcctgtgacagtgacgcccggggngattgtgt

SEQ ID NO: 512170 - DNA, 279 bp, Homo sapiens
gtacagcctcttccagatcattgtgtgaaccccagacatcagtttctgctaatttactcctaactgtctgtcttaatattatattatttttcattgttcttaggaagtttcctagtacacaagcacttttcattactccactaaatacccaagagggaatctctgcacatctccaggatttgtttcctgtactgcttttttctctccagttttctgtcctgtgatctctatctgctttggtttcacatggccactcaatactcacatggccactcaata

SEQ ID NO: 512171 - DNA, 616 bp, Homo sapiens
tctcttgggacagaagcagcaaaaccccatatcaaagcagacaaactctctataaatgtgcatcatcatctattttggcaaagattgatatctgaccccacagtgtactgagagaatgcactggttccagagatatggtaaactggttctcctggacaggtaaacgtgctggttgtgtcttccataagttgttgatcactagcagcacttttgagatcactgattttcccacacaaattgtgtaagtggactcagccaaaactggcattttacacataaaggtgcataaagtgaaattacttggtcacttggtttaacgttggtaattctgggcccaatcctttccccaatccttacaccttaatggccaccgttcattggaaaagttaggccttcaaattaagattcgataccatggcatcagtatggcacagggaggtagcaatgatctgaatgcgaacttcatgagccttggggggagctacttcaaccttttcaatgcaaaggggcttgcctgcttcccaggcgatggctgctttgcatttaataactttgcccttggtgcccatttttctttgggaaactgtgttggaagtttctttctgagttaagaaag

SEQ ID NO: 512172 - DNA, 108 bp, Homo sapiens
ccagacagagtgcaagctgacagtgaagcaggatgtatgtaggcctatgaggataacctgcactgtaatagcctaaacacaactctatatttacttacagccttatgt

SEQ ID NO: 512173 - DNA, 264 bp, Homo sapiens
ataaagtcagctttcaaaggctcagggtgggggggcctgcccgaggccataatgctcccccccccccctcctaacccctggtttgttggaataacccaaatgtttgcatccccccaagtcagtcaatttcctttttgtcccctggggggggaatggggtagggggggatactttaaagggctcctgcttaaataaattagacccgcccaggggttttttaaaaaaaatcctgccatgccccccccttaaaaataggccctttta

SEQ ID NO: 512174 - DNA, 286 bp, Homo sapiens
cgcgtcgacccctgccccctttgttttgtatccaataaatatcagcgcagcctggcattccgggctactactggtctccgtgacttggtggtagttgtccccagggcccagctcttttatctttttgtcttgtgtctttatttctatgatctctcgtctccacacacggggagaaaaacccactgaccctgtggggctggaccctacacagagcgacacttctaacggggccctgttccagaccccactgttgatccggccgcgaatttagtagtagtagtagacc

SEQ ID NO: 512175 - DNA, 846 bp, Homo sapiens
  misc_feature (254)..(254): n is a, c, g, or t
taggagtgctctaaaaaaaaccccttgtttggtaatttatggtggggggtgggaatagtaaaattattgtcctcgaaaatgacaagttaatgggcaaaaaatattaatctataaaggggtttggtgtctccagagcgggaggagccctcatttagcaacgtgaacagaaaccccctctcgagaaggacgcacttccacccccgacgtgtgcgcggtacacaccacacacacgcgcgcacgtggtcacgtgcaanataatttttacacacacacgtgaggagttgactctcctccctaagagctctccttggtgcctcaggagccaagatttccccgtgcgtggcgggcggtgccctccccaggtgccgggacataataagacagaaaggggggggacagtgctcccctgcaaaggtgggacgttcagagacacacgcctcctattcatgtagcaaaaaacagcccgtggaccactccgggcgccacaaagcccctcgtgcacacctttcgaaggggcgtggggtgccccttctctgagtggcagaaagacaacaccagcaaaaagacggggtgaacaactggcagaatccctccatacccccgaacagcctggtctgtcctccccacttccacgtctcaacagccttgtgtagcaccgggtgtcttgcaccattttgtgggctttggtgggccgaacacttggcgccgtagaccttggtgctcccgggggaggctcccctgtccaactctggcgttcccagctcctcccgggcccctcgtgttttgccaggtgtcccagggttctaaactcccgtgttcccaaagcgatcttccccccggtgaccc

SEQ ID NO: 512176 - DNA, 351 bp, Homo sapiens
ttttttttttagacagggtcttgctctgtcacccaggctggaatgcagtggtacaatcatggctccctgcagcctagacctcctgcgctcaggtggtcctcccacctcagcctcctgagtagcggggactgcagttgcatgccactatgccaggtcgatttttgaactttttacagagatgggggtcttactatgttgcccaggctggtattgaactcctgggctcaagcaatcctcctgccttggtctcccaaagtgctgggattacaggtgtgacccgctgtgcccagaagggcggacctgaaacaaagctattcatctacattagggatcccaacccttcttcttttt

SEQ ID NO: 512177 - DNA, 1589 bp, Homo sapiens
gtacggcagcatgtacaataatatattgtactaacatttgccatctgacagttcaggaatatgtaggtatatcgcttcgaaaccctctatgttctcgcgtatttgagtgaggcctaggaagaggaatagatgactatatcgactgtgttagcacttagtaggtataagtcatacagttacctgtcaaaggaggctgagatccaggtcgtgatacggacaagtcattggttggaccccttagttaggacgcaactcacacaataaatgtctttcagacaccgtcgcctggctgtgtacattagtcaatacagagaattgatagcgcctaaagagcgcagattagaggtgagtgacatacaagttcgaactgaaaattcaattagttggccctaaggagcgtacagtctatcagaagagggctaataggcccatttgacgtcccctactgctggcttgaagcacagcactagaggtgtcatgtgtgtgccaagggataaggtttagtaacttaaagcatttagagcgaaccattgggagccaatagaagctggattaggcgagcactaacacgaaacaatgggaattcagagtcggagtaaaggtcccaaaaacagcataaagcccattgccaagaaagtcccattaaagtataattcaaggcacagtcagagattaacatcattcgagaccgtaagggttggagcacgaaaggggcctcaacgaatgtcaatatacaaggaaaacccaaaagtgtagaagcagtagggcgcaaaccgagtggacagatgagcagcacacaaccagggtcaacatacgataaaaggatgaagacctgactcagatacacacaatgcacaagaaaagcaaccaccggcagtgagatatgccattataggaaggacccaacaaagagagcaagatagaaccggagagaaacaccagagatccacaaacaatataacccaacgaggaggaagcagccaacacgtagatcaaaatacacaggacgaaccaacagatattttaagcaagcggtgcaagaccacaagagaaaagaagacatactctgtacaaaaaacaggactagcactgcagaaaacagagcatacaatcattgaacgagaagcaagacgacaagagatagagccaggcgcatcaacaaggacacaatacagaacagcatgagacaaacttagatgacgcacaacagacacagaccacgctaggaggagaaaacgcacgaaacacgagagaacagagaaaaaaagtagcaaagtatgcatgagcgaactacagagaagaaataatgactgaagataaacgacaacgaacaaacagacaagtcaaaagaaacaggagaaccgcgagtcataaaaggagacaccagaagctagatcggagacgccagagaaaaagaaaagataagacaagcaaaacgcaatagatcgaaaaaaacgaaggagtagacgaagaagaaagacacagagaaacagagcatcagaaactgacagagacgagtaccacgagaaagaggaaacgagcatatacactgtctgaccgtaagaagacaagagatgggagaaggagga

SEQ ID NO: 512178 - DNA, 164 bp, Homo sapiens
cctaagtggaactgctccgtgggtgatggagctgctccgtgggtgatggagctgttctgtctaattatgatcgtgtctctgagatgatgaacaacatgggtggtgatagagtatgtagatttaccagtagagtagacggcatgctagttccactataggcgggc

SEQ ID NO: 512179 - DNA, 128 bp, Homo sapiens
taaaatagcaaaaaaaaattacgccgggggttggtggcgggtacctgtagtcctagctacttgaggaggctgaggcaggacgaatggcgtgacccctgggcggtggactcttggacggggactcctct

SEQ ID NO: 512180 - DNA, 552 bp, Homo sapiens
tccacactgggtcgagtcacggttgaggagcagtctggggacatcagctcttaatattttcacgtttggagcagtgggttctcaggttctgagtgaagtgaaccagaatcctcctagggggctgtggtaaagataatcccatactatgtactgcgtagagttcaagaagaagaggggagagcatgcagataaaccagtacaatcagtcgttcacattaccactaactacaatgatactcccatttgcttcctgtgaagtagttactaataatcactggttgtcgcttatttacaatttccataacatacctttaactgtcttcatataggtattgaaagagtccacataaaagccacatccattttctaattttgaacaatagttagagaaacctaatatacttctcatatataggtctagcttctgtctcatgagttccccaaaataggcatactatatatcttgagatgacagagttcactggggccaatgtcacacttttctcggggcagggtcataatatttctgcgatagggaagaataagattcac

SEQ ID NO: 512181 - DNA, 691 bp, Homo sapiens
gcgatgttcctgggactgtcctggttgacctgcgcgtctgctgcagagaccatgtctgccgacggggcagagtgctgatggcagcacccaggtgacagtggaagaacctgtgtacagcagcccagtgtggtgtgacctgtgtggccagcatgcctctgatcagctccacctgctgacatgtgtgtcctgcagcctatgcctccaccaatgtgatgagctaccctgcactgtcaagacttgtcttgcgactgcagcagagaagtggagtgaggaccctcactgtgctggctgctgtcatgctggtgtgctcatgcctgatcctctccaatgctggagcccacagattgcatcagtcctagctgaatactgcccacagggtggctggaccaacgttggaaggagaaccatccccatcctgcaagcagcaccacggagtaagtgtccatggctggacaccatggagcttgctgtcgtctaagtgtgtcggggtgcccaagagatggttgtctacgctgccaatgtgaccggtggccacccaaattgtcgcgagggctggtggacctgcgacccgcggtgctgtgcagagcggcgtggactagactaaagtccgtagttgtctggcggcgtccaatcagtcattgggctcccgcttgggccagatggtgctgagtggtgtcgacacggtgctggg

SEQ ID NO: 512182 - DNA, 433 bp, Homo sapiens
  misc_feature (65)..(65): n is a, c, g, or t
  misc_feature (292)..(292): n is a, c, g, or t
  misc_feature (322)..(322): n is a, c, g, or t
  misc_feature (349)..(349): n is a, c, g, or t
  misc_feature (352)..(352): n is a, c, g, or t
  misc_feature (370)..(370): n is a, c, g, or t
  misc_feature (382)..(382): n is a, c, g, or t
  misc_feature (385)..(385): n is a, c, g, or t
  misc_feature (405)..(405): n is a, c, g, or t
  misc_feature (409)..(409): n is a, c, g, or t
  misc_feature (422)..(422): n is a, c, g, or t
tgtgtccacaccgcagtgcttttgcccctggggggattggacacacatcctgccaaaggcgttangaagttttgcccaaatgaagccaggtgggctccgggttcactcccattttcccgaggggtgttggcctccccagggtttgcctttttagggatttaaacgaggttcgaggctcccctatcagggcagctttcaggattgtcattttcctttttgcctgggggtttaacttttgtatttttttaatcccaagtttgaaacaaaatgtttttttggactttttggaaangcccattttacttttgaatttagcttttantaattggcatttggaagctcagcaagngcncaacccttattttggttnccgtggaaaccnctnccccccctccccaatgtggngggntcaataaaaatgntggaattccca

SEQ ID NO: 512183 - DNA, 425 bp, Homo sapiens
  misc_feature (90)..(90): n is a, c, g, or t
  misc_feature (132)..(132): n is a, c, g, or t
ggggccaaaaatggcaaggtttttcccttggccaaggtctacagatggtttcccaaccataaatctacaccaacaatggtgccaactgcnttgcattccaaattggaaacaaaatggggctaggctagaccnactgtgctaaaacaatctctatcctagaacccattccagcacacacatgcaacagctgcaaagcaccatttgcccctaacttttcaacactctcatgttggggcaaacacagccagctttgtcagcagcatttgcagcaaaggggtataggataatccgtttaaacgcaaaagtgcccccgttttaaagaagccgtataaaacgggttttccccctgccaaaaggcgggggtttaacgcgacctttaacttttggggggggccttccaagttcgaaagatcttccgaagaacg

SEQ ID NO: 512184 - DNA, 1492 bp, Homo sapiens
ggttgtgcctgctgtgcgccgcgctggcctgcagtccctgggccctgctgcccctgctgcctgcctgcctgccgccatggagccctggccccgacgtgcccgccgccatcctggccccggccgaccagtccgcggagggctgtgttccagcgaagacctgcaggccgtgtggccctggacagggcccatgatcagcatagacgtgtggaagcatgcttgcatccgaccagccggcagcatcagcgcgtaccaggaccatccgtcgtcgttaccgccagtaaggaccatagtggcaagcgtgcatcggtagttaggacaggtcgtcaatccacggtgcaccggacgacgagacccagcgttctcctaccacggcaccatgatccgccaacgcttgccatctcttgccaggacaacccccaaacccagccgaagacggttgcctgagtcaatcaggcgggcccggacgactggagcagtgatcccatagccgcgcgacccgtaccctcagaagccaaaacacacgtacaagcagcgcagagacccggacgggatccaacacctgaccgacacgaactacgaaccagcaacggcaatcgagtcagcccccccagccacagccgcccacaaccacgagccttccccacaagccccaaggaccacagtgcccccgacacaagggcgacaaccagccgaaggccagtcccgccgagcccccaggcgaccccactcaccggcagcaccggccatgacgcgagcacagcaccggcaggcagccagcaccgacaaccaccgacaatcacgcagacgagcgccccaccgccaccaacagaccccaagcacgcggaccacgcccccccaacaacacacccagacaggcgcccaccaccgcagcgcacagaccaaactacacacgggagagccagcacacaaccaaacgcgccaccacgaagcagacccggccgcagcccgcacccacccgcgcccgcacaagcgtagcataaagagcaagatagcgacaagaaatagcgagacatggagacgcccatacggcaagaatacgggaagaagttacgacgagcaagataggatccacgactggcggaccaatggactaagggcaccaaagcccaaacacacacccacagcctgccaagatagacaaacaaataagagacacgaaccacgacaaaagatcagaaacagaggcgcgcccccccgacccggcaaccaggtcacagccgacacaagcacaacaagcagcgagcgcgcacaggcaagacagtcagcaaggactcaagcgaagacagcaacgaccgccagcgcccgaacgaccacagcaggaagcgcgagcacaccacgcgggcgcgcaaggcgcgaaggacagcgcgcgccagcacgaacacgccaccacagcgagggacgcgcacgtacacggttctcccaggggacgacgcgccagagcgcgcacagaagagagagggcaggagagcgg

SEQ ID NO: 512185 - DNA, 115 bp, Homo sapiens
gggctggacttcttacacatgttgattagttacacttgcacttaaaaagatggaggctgaaggggtaagcaaacaaacttgtgaagtagacgaagactcatctctgaagtacaac

SEQ ID NO: 512186 - DNA, 402 bp, Homo sapiens
ctattgctgggaatgaaacgagtaccagcaggcccttgctgtggaattttctgagcgaggtcagagagaagcacagtgtacttttagaacaagatctgtcctgcctttttttgtattctggagtacacttggggagaaatagagtaagctgctgtttggggaagaagtttgggcttttgatttattttgaaggagtttaagaaatgctaccaacatggtgaaaccccgtctctagtaaaaatacaaaaattagctgggcatggtggtggccgcctgtaatcccagctactctggaggctgaggcaggagaatcgcttgaacctgggaggtggaggttgtagtgagctgagatcgcgccactgcactccagcctgggcaacaagagcaagactccatttccaa

SEQ ID NO: 512187 - DNA, 1112 bp, Homo sapiens
  misc_feature (1112)..(1112): n is a, c, g, or t
gacctgtagtgtcgcggttatttggtcgaaagctgtaccaagaagacgtcggtgatcgctcggtgaagtacgtggagccgctattggggacctccgctccgagaaaatggtgaagaatattgaaagtcagaccaggcacgtctccatagctacacatttgacgttctcttctgtggcggaacaccatacgcatgacagagacgtagcctgtgcgggatctggcactgttggttcctgcatgaagacagatggctgagcggtgcctgtaacggtagcaataccacttaccggctgtcacggctaaagtccgcccagtgcagaagactgaacgaagttgaagacgacctagtagacgctccgtctagctctttgagacatcacgtggtcctatacactaaagtgggttaatttactgtagaacatacatacgagcacgaaaagatgctgtgggtgtgcacaagtggataaacgaccattgacaagatggagggtcgctaacacggcggcatgaaaagcatagtgtgggcatcgattggcatccccctattagacgcacagaggatcctccgttgttcttgaggggtccgcgtttggacaagttctgcttcgttagctcatggcgaaaacgcaagagggaggtcatgggcgaactaagcgtttgaaggtgtgggtaaagaagtctacgagatacggagcaaaagatatcggacagcggggcgaaaacccaaggacctgtagtgagagaggcacattcccgggtgacaggtggcgcatccagcgagggaacacacatggaaggggactagcgggggcaccgacgggcaatacgggccaatgggccagcgaagcgcaccaatctggtggaacgatccccaaagtgaacactagcagcccagggctaaaaggggaatggacccggggcccactccagggaaccgtagggacacccgagacaaagacagaagtgccccgaagacaagggaaacacacagtgtggcgcaaggacacacccacagacggagagccgacacgagcctttagacaagagcgaccgttttgtgacaaccagcgatcagggggtaggtagagacacacgcggaggagaatagcan

SEQ ID NO: 512188 - DNA, 175 bp, Homo sapiens
  misc_feature (51)..(51): n is a, c, g, or t
  misc_feature (61)..(61): n is a, c, g, or t
taagcaattgaactttttatttaaaagagatggggtctctctgttgcccanattggtctanaactcctgagctcaagtgattctcctgactccctaagtgttgggattacaagcatgagccaccacgcccagctgcaatttaattttaaatcagagttcaaaacaatagaattta

SEQ ID NO: 512189 - DNA, 140 bp, Homo sapiens
cggcggtcctcatatgttcgtttatccttccagaaagcatatcatattagaggtctaagaaatcagtgaatcaagtgactagattataaatattctctatgtgaatagttgaataaaacagctgtttttttctgcttcct

SEQ ID NO: 512190 - DNA, 111 bp, Homo sapiens
cgaattgaaactacagagggaattgtgggaactcaacttgaaggcagtcggtcagaagttccaaaggtcacccgggcgcggtggttcacgcctggtatcccacgcactttg

SEQ ID NO: 512191 - DNA, 329 bp, Homo sapiens
tgaaatggattttctctcttgtgtgtccaggctggagtgcaagggtgtgatctcggctcactgcaacctccgccttcggggttcaagtgattctcctgcctcagcctccccagtagctgggattacagatcgtggccaccatgcccagctaatttggtatttcaagtagagagggggttcctccatgtgggtcaggcgggtctcgaactcctgacctcaagtgatctgtccacctcggcctcccagagtgcggggataacaggcgtgagccatggttcccagcaggaattcctttttaatagtatgggataaagttgggggttttcacg

SEQ ID NO: 512192 - DNA, 875 bp, Homo sapiens
ggcagccgaggcccaggcacggtcaggctgtgtcctggaggggagggtgggcagggccgtctgagtgctgcacagctgcgtcccacatgtcagctcctcgcccagctggccctccctgtggctcagcacacgggctgccttgcggctggttcccggatggggagggtacactgcctggagctcaggggctggctggggtgagtccgaggccgggctccagcacagccttcaagtgaggcccacagtggggctgctggtactgaaatggcatcctggcttcccagtagcacattccttgagtgtgtcagtccctctggggaccatctggaggacgggggctagagagcagccctggtcattctccaccaagaccacacatgaggccccgatggcacagtgccgggatcctgtgtaattagggtctgggtgccctcgttgccctactcctctgaaagcgagccaggttcaccttgaaccctgcagaatgatgctctttctggcgtctttctctgtcttcctgggccttacaggttcttcggcagtaaatcaactaaacggtaacactcttccctccatcttccacattcaggcaaagctggccccggggagctcctgcgcagacgtccctcacggccagggaggccgcaatgaaggctgaacctggggaaggggcccaggtgcggtgtagacctcctctgtcatccagcccctcctgagggggcttgatgggcgtcacaagtgggcagcttttccgcgcttccccgtgtctgactgtgctgagggcctcctgaagtgcaattggttagtcacggtttagtgttctttactgcaatgctattttaagatgcaattaaaacgtctcatggcaaagaaag

SEQ ID NO: 512193 - DNA, 140 bp, Homo sapiens
tttaaaaaggacgtctcttctttgggggggaacaacagaaagtctggctgaggcggttgctgagtatgcgctaagtcacagctttatgcggttgtgtcgggagaaaaaaaaaacagacccgaacagaacaaacaaaaaca

SEQ ID NO: 512194 - DNA, 372 bp, Homo sapiens
tatatggcgaataggaggatcatgataggataggataagatgaggactgatcgggcatcttactgggagcaatttgagataggaactggaatgggatcctgctttccgtcagaccgagtaccggctccgtttcggaggtcatcgctgtcatggagcgggaactggaaaatatcatctcaggaaacatagaaagatctgtacccagcatggctgaataatgattctcagtcggtatcgtgtattgttggctctcacatccactctcaacaaactcttcataagactggaggaaaaacagagtccatagctggtgactaagctcaagaaaaagagggttgtccccaaaaagcctcccccatcaccccaacctac

SEQ ID NO: 512195 - DNA, 377 bp, Homo sapiens
  misc_feature (174)..(174): n is a, c, g, or t
  misc_feature (333)..(333): n is a, c, g, or t
catccggcggcgaaaaaagtctcccagcgggcgattacgctgctcaaccaggcgattgttgccgcagtgggccggaaaacttactggttactgtggcaaatccggatatcgaaaccgcgcaacgcttgttcaagtttccgggtatcggcctgctggtggtaaccggcggcgaangggtagtagaagcggcgcgtaaacacaccaataaacgtctgattgccgcaggcttggcaacccgccggtagtggtggatgaaaccgccgacctcgcccgtgccgctcagtccatcgtcaaaggcgcttctttcgataacaacatcatttgtgccgacgnaaaggtactgattgttgttgatagcgtagcgatgacttatgcgt

SEQ ID NO: 512196 - DNA, 511 bp, Homo sapiens
ctatccggccgtgcagggccggtgctggaatgcccccctcatccgcgcacgtggacttggcgtcagccgctagtgcacacatcccgtgttctctcctgccctgtggactccgtcacactgatctccacctgaggcgggaccatcaatcccccgagaacataaaaatcacaagcacagaagagcagattgcacgggaacctggaatcggctgggtcctgcagatcactcagcgtctgctggctaggagagacagaaggccccaaggatctcactggctcacctggagccccctcgtcttgtgtctaagtctctctttatgtgttctgtggtccacctttccgctcctaccttgtgcgtcctcattgactcgagattacagtgtgcgtgccatcagggcagggcctctgtgtcctctgcctcgtgtctccagccatagcacatgaaccagaacagctcagaacactctgtccagtgacagtcagtctacatccttacctagtgctctatagca

SEQ ID NO: 512197 - DNA, 170 bp, Homo sapiens
agccggcgcagctgcagggcaccatggaaatcctgagggatgtgaggtgatcaagagcggagacaaagtgtgagccagcgaagccacgctgcggaacatgcgcaacatctcccccttctccgttggggcgggtcatccagcaggtgttcgacaagtagcagcatctacaa

SEQ ID NO: 512198 - DNA, 484 bp, Homo sapiens
ctgcatactacactctgttactctctcaacagctctatctgctatttatatacttacctggcaggggagataccatgatcacgaaggtggttttcccagggcgaggcttatccattgcactccggatgtgctgacccctgcgatttccccaaatgtgggaaactcgactgcataatttgtggtagtagggggactgcgttcgcgctttcccctgccttactggaagtagaaaggtagttgatattatgatcggcgctgggtctggatgtgaggtgtttaaaacacgggctgttgggcagttcgcttacgctttcacgtttttgtggtggtagggcgaatactgctttttttcttaccccgcgggggatcctctagtaacgcgccaattatactgtgggtttatggtcttcagggtattgccgagacgtacgatctcatgctttctccaaggccgacccgtattttcttggtttggtgtgtgtag

SEQ ID NO: 512199 - DNA, 188 bp, Homo sapiens
ggtagcagccaggcactgtcaggccttattcttctccactttgacagcccgaggcttaatcgctccggttcgcttcatctagggacgcagcctgaagcgacctcctgcagcttcacggctcccaggctgagtttctcatccactcgttgttttccctgttgccgggataccgagctcgatacttcgta

SEQ ID NO: 512200 - DNA, 144 bp, Homo sapiens
cgtgatccagctccatcacgatacacaagatcgatggggcgaccgcagttcaagtcaatgacacgaaggtaggaacagagcgccgacaacacctctgttgcttttaatgcctgccaagagttaataagcaacaatctgagcacc

SEQ ID NO: 512201 - DNA, 207 bp, Homo sapiens
gcggccgcctactactactaaattcgcggccgcgtcgacgggagataccatgatcacgaaggtggttttcccagggcgaggcttatccattgcactccggatgtgctgacccctgcgatttccccaaatgtgggaaactcgactgcataatttgtggtagtaggggaaagcgcgaacgcgtcgacgcggccgcgaatttagtagtag

SEQ ID NO: 512202 - DNA, 449 bp, Homo sapiens
  misc_feature (320)..(320): n is a, c, g, or t
  misc_feature (347)..(347): n is a, c, g, or t
gttcactctagagtatccccatctatactgacgcggaggtaggattggtgctgtgggtgaaagagtatgatggggaagggacagacgaggtcagtaggtcagtatagataggtcagtatagataggtcagtatagataggtcagtatagataagtcagtatagataggtcagtatagataggtcagtatagataggtcagtatagataggtcagtatagataggtcagtatagataggtcagtatagataggtagtatagataggtcagtatagataggtcagtatagatgcggaggtatagataggtcagtatagatangtcagtatagataggtagtatagatangtcagtaatagtagttaatagtcagatagatagtcagatagatacgtagtatagataggtagtatagataggtcagtgtgtatcctctagagtcagctatga

SEQ ID NO: 512203 - DNA, 641 bp, Homo sapiens
  misc_feature (13)..(13): n is a, c, g, or t
  misc_feature (356)..(356): n is a, c, g, or t
  misc_feature (401)..(402): n is a, c, g, or t
  misc_feature (428)..(428): n is a, c, g, or t
  misc_feature (468)..(469): n is a, c, g, or t
  misc_feature (484)..(484): n is a, c, g, or t
  misc_feature (521)..(521): n is a, c, g, or t
  misc_feature (526)..(526): n is a, c, g, or t
  misc_feature (567)..(567): n is a, c, g, or t
  misc_feature (584)..(584): n is a, c, g, or t
gcacgaggtgctntgcagtatgaagatgtaagcactgctgtccagaatctacaaaaggctctcaagttactgacgacaggcagagaatgaagcctttgtatgacagacccatgtatttttggcatgaggaactaacagtccattactctatcttcagcctatcaggatcacagttttaaggaagacttggttttgttgaatatgacaatgaaatctgtgtgtatcagatttttattgaagcattcatcagcagcctcaaccagttttcattgaccatttactagattcaatcgtctctgagtatatagggctgatgggagcaagaccctaaaaatgtccattgaaccctgcttcanaaaatgaaaacacacctctataaaatgtgtactgggaataagctnntgatttacatacattaggggaatttnttctgaatggttgacaaacagatgatattacttgctatannaatataatgtaactntaataagatagccagatatctaaatagaaatacgttntgttncctcagacatcaattaacatctaactgctgatgatctgaangacattagtcaattaantatctatattatactcattccagtctactattgtagcgagagatgattgtatgcgtg

SEQ ID NO: 512204 - DNA, 407 bp, Homo sapiens
  misc_feature (278)..(278): n is a, c, g, or t
  misc_feature (305)..(305): n is a, c, g, or t
cctatctatactgacctatctatactgacccccctcgcgccgacaattatggggcgtcagtatagataggtcagtatagataggtcagtatagataggtcagtatagataagtcagtatagataggtcagtatagataggtcagtatagataggtcagtatagataggtcagtatagataggtcagtatagataggtcagtatagataggtagtatagataggtcagtatagataggtcagtatagatgcggaggtatagataggtcagtatagatangtcagtatagataggtagtatagatangtcagtaatagtagttaatagtcagatagatagtcagatagatacgtagtatagataggtagtatagataggtcagtgtgtatcctctagagtcagctatga

SEQ ID NO: 512205 - DNA, 405 bp, Homo sapiens
  misc_feature (13)..(13): n is a, c, g, or t
gcacgaggtgctntgcagtatgaagatgtaagcactgctgtccagaatctacaaaaggctctcaagttactgacgacaggcagagaatgaagcctttgtatgacagacccatgtatttttggcatgaggaactaacagtccattactctatcttcagcctatcaggatcacagttttaaggaagacttggttttgttgaatatgacaatgaaatctgtgtgtatcagatttttattgaagcattcatcagcagcctcaaccagttttcattgaccatttactagattcaatcgtctctgagtatatagggctgatgggagcaagatgtcttgctcccatcaggatattggtactcttcattttacagatggggaaactgagtctctgatgggagaagctacggtc

SEQ ID NO: 512206 - DNA, 438 bp, Homo sapiens
  misc_feature (98)..(98): n is a, c, g, or t
  misc_feature (106)..(106): n is a, c, g, or t
  misc_feature (112)..(113): n is a, c, g, or t
  misc_feature (178)..(178): n is a, c, g, or t
  misc_feature (309)..(309): n is a, c, g, or t
  misc_feature (336)..(336): n is a, c, g, or t
ctgcgcagatatttccgtgggttattcttcttgatggcagtctgatgtacaaatacatcttctttggtgtcatttcgatttataaatccatatccatntctgacgntgaacnntttgacagtgccaaggactttggtggcgagaacttttttctccgcgtcttcgctccggcggcggnggctaggtcagtatagataggtcagtatagataggtcagtatagataggtcagtatagataggtagtatagataggtcagtatagataggtcagtatagatgcggaggtatagataggtcagtatagatangtcagtatagataggtagtatagatangtcagtaatagtagttaatagtcagatagatagtcagatagatacgtagtatagataggtagtatagataggtcagtgtgtatcctctagagtcagctatga

SEQ ID NO: 512207 - DNA, 115 bp, Homo sapiens
gatcccagcggcgtcctttttttcagcaacttcagttaatacattatgtgtgttaagactgcttgattttgtccagaaagtaactaaggctctgttcacttctttttcagttttt

SEQ ID NO: 512208 - DNA, 250 bp, Homo sapiens
gcggccgcctactactactaaattcgcggccgcgtcgacgcgaggcttatccattgcactccggatgtgctgacccctgcgatttccccaaatgtgggaaactcgactgcataatttgtggtagtaggtttttttttttttttgagatagagtctcactctgtctcccaggctggagtgcagtggcacaatctcagctgactgcaacctccgcctcctgggctcaagtgtcgacgaaagccgccaattta

SEQ ID NO: 512209 - DNA, 270 bp, Homo sapiens
gtatatgcacaatgtatattgacacccatatatttaaaacagcaacatataccctgatgaattatactttacagtactcatagacctacattgatcatatatttattttttcatgtatctacttccaatatgatcaactaggaacttaagccccataagaacaaagacattcttcagttcactgctatttccccaacaactacagaatgctcaaataattgaataaatgaatgaaaattaagtaagtctttcacaaatatacaacacact

SEQ ID NO: 512210 - DNA, 206 bp, Homo sapiens
tgtgcgacctagaggttcctcctttatccaagcagtcggggagataccatgatcacgaaggtggttttcccagggcgaggcttatccattgcactccggatgtgctgacccctgcgatttccccaaatgtgggaaactcgactgcataatttgtggtagtaggggaaagcgcgaacgcgtcgacgcggccgcgaatttagtagtag

SEQ ID NO: 512211 - DNA, 507 bp, Homo sapiens
  misc_feature (378)..(378): n is a, c, g, or t
  misc_feature (405)..(405): n is a, c, g, or t
gcggccgcctactactactaaattcgcggccgcgtcgacgggagataccatgatcacgaaggtggttttcccagggcgaggcttatccattgcactccggatgtgctgacccctgcgatttccccaaatgtgggaaactcgactgcataatttgtggtagtatagataggtcagtatagataggtcagtatagataggtcagtatagataagtcagtatagataggtcagtatagataggtcagtatagataggtcagtatagataggtcagtatagataggtcagtatagataggtcagtatagataggtagtatagataggtcagtatagataggtcagtatagatgcggaggtatagataggtcagtatagatangtcagtatagataggtagtatagatangtcagtaatagtagttaatagtcagatagatagtcagatagatacgtagtatagataggtagtatagataggtcagtgtgtatcctctagagtcagctatga

SEQ ID NO: 512212 - DNA, 362 bp, Homo sapiens
gcggccgcctactactactaaattcgcggccgcgtcgacgggagataccatgatcacgaaggtggttttcccagggcgaggcttatccattgcactccggatgtgctgacccctgcgatttccccaaatgtgggaaactcgactgcataatttgtggtagtattttttttttttaaaataggttcctctggtcattgtgttgacaagctcggtttggaaagcattgatttacttatttcaccccaaattatatctctgactcagttagctggtagaatgtttgtgtgggctattagatcaccatccctaaatcctgctcttgccactaaggaccatctgtcataaatcactgatgctgggag

SEQ ID NO: 512213 - DNA, 105 bp, Homo sapiens
tggaaacaagcggcagtgggctaaagctgatgtatacggaattaacggacgtgcagatcaaagggcaaatgtagaagtgcctgtatccctgaaaatacacatgta

SEQ ID NO: 512214 - DNA, 692 bp, Homo sapiens
  misc_feature (316)..(316): n is a, c, g, or t
acacgtatgtttattgcggcactattcacaatagcaaagacttggaaccaacccaaatgtccaacaatgatagactggattaagaaaatgtggcacatatacaccatggaatactatgcagccataaaaaaggatgagttcatgtcctttgtatggacatggatgaaattggaaatcatcattctcagtaaactaccacaagaacaaaaaaccaaacaccgcatattctcactcataggtgggaattgaacaatgagaacacatggacacaggaaggggaacatcacactctggggcctgttatggggtgagcatntctatctccatctatataatattatcttctacttttgtcctgaaatccttttaatccatccatatactctcatcattatcctctatacatcttttcctattcctcactcattattagtttccctttactaatttttacgtgatgcacatcatccactgaactttgtatattttttgggatctaatctttttgtctctatttaataatcatataactactcactcttaattactaacatataccttccttactatcctatattcttaaccttagtacctttttttacctcactttcctgatcctaatcatttctttaacataatatatattgtcaaatagttttctcttctcttgctacgtctcttcctaatgccct

SEQ ID NO: 512215 - DNA, 182 bp, Homo sapiens
gcggccgcctactactactaaattcgcggccgcgtcgacgggagataccatgatcacgaaggtggttttcccagggcgaggcttatccattgcactccggatgtgctgacccctgcgatttccccaaatgtgggaaactcgactgcataatttgtggtagtagttgaatcaatacgtgacca

SEQ ID NO: 512216 - DNA, 403 bp, Homo sapiens
agccccctgaagggtgccctccttacagagctaagtggagacgtttccagatcagccccagttttctataaaggctggcccaggccctgaatgtttaggacattctgtggatgaaaataaaaatggtggaataggttttatcacatcttttatttttcttttccccctactctctaccctttcccttatgtgggggaacctttttaggtaattaatagggttccttcccctcatatgttcatatagatgaaactaatttttggcttaagtcagaaccactggcccaaatttaagtcatattttaggggggaaatggcctaccccatattatattatattggatatttatgttccccccggaatttggttttctgctttgttaataaaaggaaaaactcccgga

SEQ ID NO: 512217 - DNA, 105 bp, Homo sapiens
acggcgaagcgcagcggcggcgacagtctggggtttgcgtctcggggtgtgtcggccgccgctgctgcttgggcctggtatgtacaagtggctgtaggattctcg

SEQ ID NO: 512218 - DNA, 141 bp, Homo sapiens
tctgacctgtacggtgatccagatggttttgcttttaattatgcataaaaaaaataggaaccatgcagcagcatcagcttaggcaaacaggttagtcaaatatacagctaggaactgttcactcagtcattaaggagagcc

SEQ ID NO: 512219 - DNA, 1158 bp, Homo sapiens
gtttgtcatgttccaaactgtcatttcattttacgttgttcagcatatggggcagtagtgtgcattgcaggtggcagtcagcattcaggcgtcagtcagcacagtagcaggttaaggcagggtgcatggtggctcatgcatggtggggcatgcatgcagggctcatgttttgtgcaatacttcgataatggccccatttgggccaaaaagccggttagcgggggcaggcctcctagggagaggagggtggatggaacttacagggtgttagctcctgtacagcattgatcacaggctgcgagatagataactagggatcggtggtgcctggcagcatacatgtctgcagcacactcatgcactgcaggacagagaagctatcggaaatacaagagtaaagatacgcacacaaattagacgaaatagcacagcaaccctaaccccgtgcgccaccacgcaccacacactgcaaccatcatcacacttccccaactaacacaatcacccccacgagaacatcgggaaaccacaatctcctcgacgctcagcgtgagacacaacggcaatcaacgatgacaacaccgacgcagagcagcagcatacgtgaaaggcagtcacaactacgacaacgcagctgagtccggtcatgtatacagataaaactgagacgcgcaggcacacaccggccacagcagagaacgacatccggcatgagaacgaagaccccgtgacgagacagacaagaccacccaagaagtgaccaaaccgaccagcacaagccactagaccaagaagcacataccaacagcaaccagaacacagacacagagtggacggcgggcgaagcacagagacgcgcgaggacgcgagacggcacgcagccgcggaaaggaaagacgcgggaggcgcgacggagaagcgcagacgaacgaggaagagacggcggaagaagaagaagcggaagacgagacggagccggacacgacgtgaaggggagagggacgacggagcggagcggacggacggaaaagagatgtgagcgcgactgcggacgcggaggagacagggcgcgagaagacgaatccggggcgggacggctacgactggggagccgaacaggggaaaagaacgaaggagagaggaggacaggaaggacgc

SEQ ID NO: 512220 - DNA, 1293 bp, Homo sapiens
aattcgccaagaatgacgaacataaagggaaagaggagaggcacccgatagtagtgttctctaggcctttttgagaaaagcagtggaggtcgtctcctattgggactcacactatactgacgaactctactaagcaaacaggtgatattcgttagacatcaagggaatgggtactcgttcacagaaacggaatgctcccaacagaggtgttgacccactaggggatagaactagggaacgaagtcgtagcgatagtggtgtactcgcaggacatggctggttgggcaacttgtatgtaatagcgaagagcaaggttgagacggggcgaaggagtctcatctgtcgcgaaagagcacatttcaaatggtgctgctagttagacgcaccaattaaatggcacttcttgaatggaggcccgagtactaagcgtttccctagagaaacagtagtggagatggaatcacatggatccatgagacacaatgaaacatgcatagcgcaaaggaagggacaagggttaccctgggggttcagacttagaaacgcgcagcgcatgctcgcaccgcagaagaaacgcacactttatggtgcagaatccaatcgggcaaggcagccttgagctggctgggaacctcattcgccctatgaattacatgggcataaatcagcggtggtttaaacaacatggaagacactaaaaggggaacccgtcgtgagggcctgtacatagaagaaacccaccacacagcaaaccgagaacgcaacatgaggagaccgacaccagcacaggacaagccaacccagggcaagaatataactcgcagcgagcctagaacacccagaggtgaaaaacaaacggaaggcacggaaggacaacaacggaagaaacgaaatcgacaaggaacaaacagatcttggacccacacaggggcgacaaaggcaataacgcaggcgcgacccaacaatgagggcagggcgaccaaccacaacacagaaagaccggagaaggaacacaccgacaatacgaccccagacacgaacagccggaacagcggaccaggaacaacgggcgacgaagcagcgaacagagaaacaggcgcgacaccacacacagtggaagaaacagaggcaggagaaaccaggcgccgcaaacaacgagagaaaaagaaaaacgcacaacgaacgacaaccaccaagacagcccaccaactaagcaaagaagcaaaaagaacaccacgcatacaccacacaacaacaaaaaacaacatcaaacaaccaagcaacgaaaggaat

SEQ ID NO: 512221 - DNA, 83 bp, Homo sapiens
gccgccgcctactactactactactgctcgaattcaagcttctaacatgtacggggacatggcgaaaccccatctctactacc

SEQ ID NO: 512222 - DNA, 562 bp, Homo sapiens
  misc_feature (134)..(134): n is a, c, g, or t
  misc_feature (378)..(378): n is a, c, g, or t
tctatttggcctgaagggagtgccgttcctgggctaaaaacaagcaccagcctgcattggaaaacgcaggaccccgttgcccaaaaggagcagccacggcctgcggaaggacttggcccagcaaggtctcccanggttttcccttctcctcagcgccctaaggagagaggcccagtgtgcgggttgaggaagtcgcgaaggaagaagcgccggaagtgcgccgagaaggcaaccagtgttccgccaagaaaaatagagagaaagcgcccgtaagaactcctcgaggtgcccacagaaattatccagccacgcgctggttccacacctgtcctgttgcgaccccataagaagggcaacgttgggtgggccttccccccnacaatggggcaggaacatctcctgtggacacactgtgcggcgcccacaatgccccgtggttttggacccctttcgggagattcaccacgggttgccaggcttcccgggccgcatgtgaactgaccagctgcgtgcgcggggctatccggcagattgcccttggtggagtgggctaccaatcttg

SEQ ID NO: 512223 - DNA, 297 bp, Homo sapiens
aaggaactggaggcaagttttttccttgggaaaaaaaatgcccttaaaaatttgcatgagccataaagtcctggtttgagccctaaaggaaacagggggctttttttttgctggagtggcaaaagggggccgtttgggttttaagtgcccaggggaggctgcaaagtttaatttcccagaccagtttggatagaccagctcgctttgctccagtccttacaaacaggtttatccatggccttagctgctgttttataaaacccttttagggtggaggaaaattttaataacccccca

SEQ ID NO: 512224 - DNA, 290 bp, Homo sapiens
  misc_feature (236)..(236): n is a, c, g, or t
  misc_feature (249)..(249): n is a, c, g, or t
acagactacgatagtacacactaacagactttcagatatgacgactctctcaggatcattaattcaagagactactacagttattttggtcccggtccagtcattctcctagcatcattattacccctcatctaatctaatccaaaacctaaatctaataaaatacttctaaaatctggcaccctaatggcctcccacactcaaacatttcacttactttgtaatttagagaggcnctacatttggtcnaaatagaggcacagctaatagatgtatgtcacatattacgg

SEQ ID NO: 512225 - DNA, 251 bp, Homo sapiens
  misc_feature (117)..(117): n is a, c, g, or t
  misc_feature (186)..(186): n is a, c, g, or t
catagatgaatcttgaaaacaggttaaatgaacagatccagtaacaaaaagaccattgattttttgattccatttcatatgaaaaattcatgggagactgagaggcgggcggatctnttgaggtcaggagtttgagaccagcttggtcaacatggtgaaccctgtctctacaaaaagatataaaanttaaccaggcatggtggcacatgcctgtaatcccagctacttgggtggctgaggcactaattgct

SEQ ID NO: 512226 - DNA, 327 bp, Homo sapiens
acacgtactacactgcatccctaagcacaacatattcaataaaactaaaacaatacagacagaaaagactggaatacattactaataatacaatgcacagatacctgcattcaatacatccacacaacacaatagcaaacatggaaccatgatctccccaaacacacaaagcaaggaaccggtgactgaccctaaaaagaccaatgatagactttgctgaactgacaaacttcatgacggcttccacagagccgaatactccacaagagactcagttagctcgacagaccaccgcctattcgaaactacacgtcagaaaagaaaaaa

SEQ ID NO: 512227 - DNA, 552 bp, Homo sapiens
  misc_feature (100)..(100): n is a, c, g, or t
  misc_feature (106)..(107): n is a, c, g, or t
  misc_feature (111)..(111): n is a, c, g, or t
  misc_feature (121)..(122): n is a, c, g, or t
  misc_feature (133)..(133): n is a, c, g, or t
  misc_feature (144)..(144): n is a, c, g, or t
  misc_feature (149)..(149): n is a, c, g, or t
  misc_feature (155)..(155): n is a, c, g, or t
  misc_feature (164)..(164): n is a, c, g, or t
  misc_feature (168)..(168): n is a, c, g, or t
  misc_feature (171)..(171): n is a, c, g, or t
  misc_feature (188)..(188): n is a, c, g, or t
  misc_feature (464)..(464): n is a, c, g, or t
  misc_feature (471)..(471): n is a, c, g, or t
  misc_feature (499)..(499): n is a, c, g, or t
gatgtgcatatcaacatttatacatggaactggagaacattgtgccaataataattaaaaaatgccaatttttaaggttatattttaaattgttctaatnaagttnnagtnccttgagggnnaaagattgttnttctgggtaanagctnttgggntggtttttnagancanagtcttgttgtgggtanactgtgactaggttcacagcctttgtggaacattccgtataacggcattgtggaagcaataactagttcctatgaaagaaccagagctgggaagatggctgggaagccaggccaaagtgggggcaacagcttgcttctctttctcttctcaccctcagtttgtatgggaagatggctgggaagccaggccaaagtgggggcaacagcttgcttctctttctcttctcaccctcagtttgtatgggaaaatggagatgtcctctccactttatcccncgatatntaaatgaaaaagaaagaaaacccacacncaaagcaaaaactcaagtattaagagcacatatttttgacccagtggaggctt

SEQ ID NO: 512228 - DNA, 330 bp, Homo sapiens
gaccggtctttaaaaaatacttatttcactaataagaaaactaggccaggcacagtggcttacacctgtaatcccagcattttgggaggctgaggtgggtggatcacttgaggtcaggaattcaagaccagcctgggtaacatggtgaaaccccatacccactaaaaatacaaaaattagccgaggcatggtggtgcacacctgtagtcccagctgcctgagaggctgaggcatgggaatcacttgaacccgggaggcagaggttacagtgagccgagatcacgccactgcactccatccagcctaggcaacagagcaagactccgtctc

SEQ ID NO: 512229 - DNA, 474 bp, Homo sapiens
  misc_feature (100)..(100): n is a, c, g, or t
  misc_feature (106)..(107): n is a, c, g, or t
  misc_feature (111)..(111): n is a, c, g, or t
  misc_feature (121)..(122): n is a, c, g, or t
  misc_feature (133)..(133): n is a, c, g, or t
  misc_feature (144)..(144): n is a, c, g, or t
  misc_feature (149)..(149): n is a, c, g, or t
  misc_feature (155)..(155): n is a, c, g, or t
  misc_feature (164)..(164): n is a, c, g, or t
  misc_feature (168)..(168): n is a, c, g, or t
  misc_feature (171)..(171): n is a, c, g, or t
  misc_feature (188)..(188): n is a, c, g, or t
  misc_feature (386)..(386): n is a, c, g, or t
  misc_feature (393)..(393): n is a, c, g, or t
  misc_feature (421)..(421): n is a, c, g, or t
gatgtgcatatcaacatttatacatggaactggagaacattgtgccaataataattaaaaaatgccaatttttaaggttatattttaaattgttctaatnaagttnnagtnccttgagggnnaaagattgttnttctgggtaanagctnttgggntggtttttnagancanagtcttgttgtgggtanactgtgactaggttcacagcctttgtggaacattccgtataacggcattgtggaagcaataactagttcctatgaaagaaccagagctgggaagatggctgggaagccaggccaaagtgggggcaacagcttgctttctttctcttctcaccctcagtttgtatgggaaaatggagatgtcctctccactttatcccncgatatntaaatgaaaaagaaagaaaacccacacncaaagcaaaaactcaagtattaagagcacatatttttgacccagtggaggctt

SEQ ID NO: 512230 - DNA, 377 bp, Homo sapiens
aagcaatttttcatgttttactcctatgagacagatatgaaagaacaatttaaactttgaacgtctacaaaagattggtccttggatgaaataaacttttcaaaagatgaatgttcttttcacaaaaataacgtagaaaaatgcactctactaagaaaccatgattagatagaccattgaaggtaggacaataagatgaagactttgtattttggctgtaacagtttcacttgtgtgactcatcttacacattatctcacttcattaaatctcataattatactatagaatgtatactgtcacaatttacacatagcatacatgacacatgttcaaatttattctatacaacatgaacaatagaacatataaacaag

SEQ ID NO: 512231 - DNA, 214 bp, Homo sapiens
tagaggatcccgactacatagaatgtggggattcctggtggtggagctactccctctgtggtgcttctcagtgccaccattgaagaggttgattaagccaaccaagtgtagatgtagcattgttccacacatctaaaacatttgaaggacctaaattcgtagcaaattctgtggcagttttaacaaagttaagctgctatagtaagttactggg

SEQ ID NO: 512232 - DNA, 914 bp, Homo sapiens
  misc_feature (78)..(79): n is a, c, g, or t
  misc_feature (133)..(135): n is a, c, g, or t
  misc_feature (170)..(170): n is a, c, g, or t
  misc_feature (173)..(173): n is a, c, g, or t
ggcagagctgcgcgcgcactcgggaaaggggggaagggagcagggtccaggcagggtggggttaggccccctgatccnnctcgttaccccgactggcacggaataaggggacggaaatgatcgagatggcggnnngagaaggagccgtttctggtgccggccccgccgcngcngctcaaagatgagtcgggcgtgagtggtggctggcccactggtgccacctgcaccaatgaggcctgcctctgtgtggagctcctgctggctgggacggagctgttggtcctgggtcgttgctgcgccatctgcggggtccccagccgctgcggtcggtcgggaaagcccctggggccgcgtgcacctcctccagtggtccccaggctgcagcagcaccgagggggctggccccaggcgcagtctgcatggggatggccctgcctgtcggatccccctgtgggctgatgcctgctcccccggacgtgggggaggagctgccggggagggtgggctgggacccgagcttgggtccccctgctcctcctcgacccctgcaatggctatcagcccaccggacacctggggcgcgggcggggggcaagaggagaaatagctgttaatgtacgggggaggcgacacgaggcttccacacatcagggacatcaacgcggcgccagccgcgctgaaatccggcacatgtgatcctgcgattcaccctccaaatatcattgctggagcgcgaaaaatactaagactcaccattacagctgacgttcggcaacactggcagttatgcgatctacaccgagacatatctaaaggaggacagacctctaagactcaacccccacgactcgcgacacaggcggcacaatccgtgtgtcagatctcaataccagaaaatattactcgaccaccat

SEQ ID NO: 512233 - DNA, 1116 bp, Homo sapiens
agtgccggctggtggaggccgtggacggcaaagccatgaacaccagccaggtggaggcgctggggatccagatgctgcctggctaccgggacccctaccacggccggcccctcaccaagggtgagctgggctgcttcctgagccactacaacatctggaaggaggtggtggaccgggggctgcagaaatcgcttgtgtttgaggatgacctgcgttttgagatcttcttcaagagacgtctgatgaacctcatgcgggatgtggagcgggagggcctggactgggacctcatctatgtgggccggaagcggatgcaggtggagcaccccgagaaggctgtgcctcgcgtgaggaacctggtggaggccgactattcctacccggacgaggaaggcccgaaacactggtctgactcacgctacgagcatgtcatgaagttgcgccaggcagccctgaaatcagctcgagacatgtgggctgattacatcctgttgtagatgcggacaacctgatcctcaaccctgacacactgagccgctctccaagatgctgcctgtggacgagttcctgcccgtcatgttcgacgaaaaccagtgtccgagtacaaggccacttctccctccggaactggatgccttctctgtggagccggtgctcatctacccaaaaatacacaggagacgatggtatgttgagtgacaccgagaactcaagtcgtatgggaccactgagcacgtccagaacgactgtgacgcggcaagtccagaagatgcgcgagcagcatggtcccagtggtaactgagggcttcggggcactttgtgaccttggggtggccccagagaggcctcgggtggggggggggtggctcaccaagcctctggtgttgcaacacctggtggtccaaggaacgaaatatggaggggggcacatgctgctccaccacaggggtgtccgtggtcaaagtgtgaagacacccagcctcttgtatgtgagacgacaaaattagacgagcaggagcaggggcacttaaacaacaggggggacgaacacaagaccagtagacgcaacagacgtgaagctagacagtagagtgcagcaagagaagaagtcgacag

SEQ ID NO: 512234 - DNA, 879 bp, Homo sapiens
ggtccaaggtgggcttcagcttggccccaagctgctgggatgggccctggccacctgcagttctgaactggaattagtgggtaaatgtttttattcatctttcttaaatgtatgtatagcttacatttatttcaatgtctttttttttttcaaaaaactggttggtatatggcatatataactaaaatataaaagcaacattttataaaactttctagagagacaaattccacacaagtggtaagggcaacctagtgtctctagattggtccgtgttccataaatgggattttaccaaatcctatgtaaatcaattttggtaacataacactgtaactcgtgggatttttcacatgtagattttggcagtaatcttgagatttaccaacacttttcggatgtatgtcacctctgattctgaaactaacattactattctgggatttcatatacagtattacaatcagggggggtttaccaagattagccttttaacagcatatctgaaaagttatctatctgttgacataaagaccaaactggtcttaccagaattagttcatattagtccgggatgtgtaaaccccttggtttaagaaccacaacaatctatgaatgcattaggaaaactgccacaagtgaccgactgcatcagaagagatcctactttttattcagccctcacgggatcggtccccggacgcggccggaacaagaccggagggaacagaaatacaacacaacttggtggccgcgccagaaacaaaaacatgtggcggcgcgcgagtgcaggatagcgccacaacgcgcgcggggcccacacacggcagcgcacagggagtatggcacgactacaccgggacagcacatcaacgaggc

SEQ ID NO: 512235 - DNA, 328 bp, Homo sapiens
ggactagggcacgagaccaagaaatcagccaggatgccattgcaatattccaggaatgagatgttggcagcctaggttggataaatggtctgtgtgggctgaaaagcctggtaagacagaagttagaagcattttcgagggagagttgtcagagcacagtggcctatgaatactagggtcatgactattggtgatcttttgagcaggctcattaaggggaagtctacagataccttctccatgtcatcccagttggtgatgatgccgtgttcaatggggtatttgagagttaggatccctcgcttgctctgagcctcatcctaccaaa

SEQ ID NO: 512236 - DNA, 878 bp, Homo sapiens
  misc_feature (78)..(79): n is a, c, g, or t
  misc_feature (133)..(135): n is a, c, g, or t
  misc_feature (170)..(170): n is a, c, g, or t
  misc_feature (173)..(173): n is a, c, g, or t
ggcagagctgcgcgcgcactcgggaaaggggggaagggagcagggtccaggcagggtggggttaggccccctgatccnnctcgttaccccgactggcacggaataaggggacggaaatgatcgagatggcggnnngagaaggagccgtttctggtgccggccccgccgcngcngctcaaagatgagtcgggcggagggggcaggaacccacggaagccagactgaacacaaagaggccagacatctgggagagctccgcggcaggaggacggagcgtgtgtccaggagatcggtatgcgcagccatacatgcaggggatccccaagacagacatagcgagacggacagggacaagcccacgggggaacagcgagaacaaaggcatcactaccatgatgaggtcacacacaagagcagacaagaaaagcaaacacagaaggaggggacggggaaccaccaaaggagacaggtcagcaaatgagaggagagacccagaccaatgaaaggggataaccacacacggggggaaggaaagcacgaaatcaaccacacggagaaacacgaagaagagagcgaaaagagacaggacaggacaccagagagagacaagcgagaaaggacaggagaacaaaacaaagaaagacaataggagggatacgaccgagacaaaatgggaaaatacaaagatacacaatatacaagaacacacagacacagacaaaaagatggagaaattacatacaaaagacacacaccagaacaccaggagagaagacaacaacaaaaggagaaagaaaaagcgacaaaggagagagaggcaaaaacagaaaacgacgtcgagaaacacaacacagagaacaataggataaacacaggaa

SEQ ID NO: 512237 - DNA, 430 bp, Homo sapiens
  misc_feature (226)..(226): n is a, c, g, or t
  misc_feature (248)..(248): n is a, c, g, or t
  misc_feature (274)..(274): n is a, c, g, or t
  misc_feature (300)..(301): n is a, c, g, or t
  misc_feature (339)..(340): n is a, c, g, or t
  misc_feature (358)..(358): n is a, c, g, or t
gctctgcagagccagccttggagcctgctcattttgggcccttgctgccaaggagcccagcctcacctagcaggaaaggagatgaaggccctcctcccaggaggtagggttttggctgccccgaacttaaatgcttttgaaatctcttagatgtggaaatattttttcgaacctgaaaatgcagctgggtagaatttcaaatggaagcataatccactgtgaaaantatattttagtgtgatattttngtaaaatagcactttttggtgtgtgnttgatacctggtttcccaagatctgnntatttcagatggtttacaaaagggagagaaggaccttnntcctcaccctcccctttntgacagaagattagaaggtacttcttttaagaaaaaaaaataaaatttgagaaatgtgtgattgattttaga

SEQ ID NO: 512238 - DNA, 1092 bp, Homo sapiens
  misc_feature (27)..(27): n is a, c, g, or t
  misc_feature (92)..(92): n is a, c, g, or t
  misc_feature (204)..(204): n is a, c, g, or t
  misc_feature (219)..(219): n is a, c, g, or t
  misc_feature (344)..(344): n is a, c, g, or t
  misc_feature (364)..(364): n is a, c, g, or t
  misc_feature (450)..(450): n is a, c, g, or t
  misc_feature (510)..(510): n is a, c, g, or t
  misc_feature (576)..(576): n is a, c, g, or t
  misc_feature (602)..(602): n is a, c, g, or t
  misc_feature (627)..(627): n is a, c, g, or t
  misc_feature (643)..(643): n is a, c, g, or t
  misc_feature (668)..(668): n is a, c, g, or t
  misc_feature (680)..(680): n is a, c, g, or t
  misc_feature (714)..(714): n is a, c, g, or t
  misc_feature (728)..(728): n is a, c, g, or t
  misc_feature (734)..(734): n is a, c, g, or t
  misc_feature (743)..(743): n is a, c, g, or t
  misc_feature (767)..(767): n is a, c, g, or t
  misc_feature (788)..(788): n is a, c, g, or t
  misc_feature (828)..(828): n is a, c, g, or t
  misc_feature (849)..(849): n is a, c, g, or t
  misc_feature (875)..(875): n is a, c, g, or t
  misc_feature (882)..(882): n is a, c, g, or t
  misc_feature (884)..(884): n is a, c, g, or t
  misc_feature (903)..(903): n is a, c, g, or t
  misc_feature (916)..(916): n is a, c, g, or t
  misc_feature (935)..(935): n is a, c, g, or t
  misc_feature (939)..(939): n is a, c, g, or t
  misc_feature (973)..(973): n is a, c, g, or t
  misc_feature (976)..(976): n is a, c, g, or t
  misc_feature (978)..(978): n is a, c, g, or t
  misc_feature (991)..(991): n is a, c, g, or t
  misc_feature (1009)..(1009): n is a, c, g, or t
  misc_feature (1016)..(1016): n is a, c, g, or t
  misc_feature (1020)..(1020): n is a, c, g, or t
  misc_feature (1024)..(1024): n is a, c, g, or t
  misc_feature (1030)..(1030): n is a, c, g, or t
  misc_feature (1056)..(1056): n is a, c, g, or t
gaccagtaaggggtgagggcacgtccnccgaagacgaggggtggcatccctgcccaggggcctgagcctgaatgcactaagggctggccccncagacaggctcaggggagggccgcccacaagggcttggggcccctccctcaggaagacgccacccctgccagggggtccgtggccctggcggtcacaactgcctgggttganctcagggaggttganctctctcagggagaactgtggggtggggatgtagccttgggagggcccttcaggaagtaggagtggggggttggggagtgtggtagagccagacacttctggggacgtcagtaatagttactaanatttggaggcagttggagangctggccccaaggttgaggtatcagttagagcagaacaattggacctagagctggtttttcctttgggtttaggtgttagttaacnattatcattggagttgagaactggagaaaaagggttgttacttttcagcactacacagcngcagggacacagatgggacacattcccagaaagacacaaaggtagacacgtggcttttcacccatncacacacacacaatcacgcatacctnttggcatgttttttaacacccacangcacccacacccacangccttggagttcacagaactgtttncattcatttgtnccagggtggggccttgagttaaaggaaaggggtntgttaagggtaganagtttngttggaganacggatttcttcctgaacaaagtncctcccctacatggtggacangggaagagacggcctttagttacttcctcttgacccccanggctgcctgccgcctcatgtnggacaggatgtcatcttgacgttgcngaacgtngncggtggtgcaacacattangggtatacaactngccccacaaggactctcanagtncagccgatgttgtaaccttcaagggtgccagagnagngngagatgtcccagngcccgagggggaggcagngtcttangaantttnattctncctctctcattaaaccctctaaaacnggaataggaaagctcacctgcgaaacttaggttgag

SEQ ID NO: 512239 - DNA, 661 bp, Homo sapiens
  misc_feature (544)..(544): n is a, c, g, or t
  misc_feature (566)..(566): n is a, c, g, or t
  misc_feature (661)..(661): n is a, c, g, or t
gggagaagagtctcgctctgtcaccaggatggagtgcaatggcacaatctcggttcagtgcaacctccacctcctgggttcaagcaattttcccacctcagcctttggagtagctgggattacaggcacacaccaccatgcctggctaatttttggatttttttttcagtagagacagggtttcaccatgtcggccaggctggtcttgagctcctgacaatcaggggatctgcctgcatcggcctcccaaagtgctaggattacagctcgtgagccactggttttataagggggagtttccctgcacaagctctcgctttgcttgctgccatccatgtaagacatgacttgctcctttttgccttccaccatgattgaggtctccccagccatgtggaactgggagtccattaaaactctttcctcttaaattacccagtctcaggtatgtctttattagcaggtgaaaatggactaattaattggcaacaaatgaacccagaagcctaggcccactcctgccctttcaatactttttccaacntgctaaaactaggagattctgngttacctgattaagggcctgctagactctagggcaccccaaccagcatgacctcttttaggtatgggcaatgtgtcgcagtattacatagctttn

SEQ ID NO: 512240 - DNA, 655 bp, Homo sapiens
  misc_feature (211)..(211): n is a, c, g, or t
  misc_feature (222)..(222): n is a, c, g, or t
  misc_feature (226)..(226): n is a, c, g, or t
  misc_feature (236)..(236): n is a, c, g, or t
  misc_feature (239)..(239): n is a, c, g, or t
  misc_feature (244)..(244): n is a, c, g, or t
  misc_feature (248)..(248): n is a, c, g, or t
  misc_feature (251)..(251): n is a, c, g, or t
  misc_feature (262)..(262): n is a, c, g, or t
  misc_feature (503)..(503): n is a, c, g, or t
  misc_feature (578)..(578): n is a, c, g, or t
ggcctgggtgagcccccttcaggcttaccccgaacaatttggttgcaaaccctgggtggcagtttttaaaatggctccccaataaaacccagttaatcacttggcaaaagtcacgtcggggtttcctgttagtccctaaaggtctgtgaataagtgcacttatgtatgtccaataattaatattctacccagactagtgaaggatttttgnaaaattgattnccanaaactgtcanccncaaanaaantgnattggtttttnaaaaaagaaagtgtatttggaaataaagtcagatggaaaattcattttttaaattcccgttttgtcactttttctgataaaagatggccatattaccccttttcggccccatgtatctcagtaccccatggagctgggctaagtaaataggaattggtttcacgcctgaggcaattagacactttggaagatggcataacctgtctcacctggacttaagcgtctggctctaattcacagngctcttttctcctcactgtatccaggttccctcccagaggagccaccagttctcatgggtggcactcagtctctnttctctccagctgactaaactttttttctgtaccagttaatttttccaactactaatagaataaaggcagttttcta

SEQ ID NO: 512241 - DNA, 468 bp, Homo sapiens
  misc_feature (316)..(316): n is a, c, g, or t
  misc_feature (391)..(391): n is a, c, g, or t
ggctggtcggagggtcaccgggatgtgggggcgcctcgtactgttgagctgtaaagagagggtgtaggtgttactgaagaggatcgtgtattgggcagtgaggtcagatggaaaattcattttttaaattcccgttttgtcactttttctgataaaagatggccatattaccccttttcggccccatgtatctcagtaccccatggagctgggctaagtaaataggaattggtttcacgcctgaggcaattagacactttggaagatggcataacctgtctcacctggacttaagcgtctggctctaattcacagngctcttttctcctcactgtatccaggttccctcccagaggagccaccagttctcatgggtggcactcagtctctnttctctccagctgactaaactttttttctgtaccagttaatttttccaactactaatagaataaaggcagttttcta

SEQ ID NO: 512242 - DNA, 613 bp, Homo sapiens
ggacgcgtggtgatcgacccacgcgtgcgctcttcgtccgtggggttgctcatgtgtgatgtcgcctcgtgctgtcccatacagtccctaccatgttaggagggtgagaacaatcccgaagctaaagggttgggtgttaaggagattgaatttggaagaaggctacgattctggtagtgcgaaggtgatgatactagcagtggttcgcagtgtaactcgagggttgtcattcgattgcgcatacgtgctatacccaagtgaggtatgacgagcatataattaacacggttatattaatgatagataacagcagcagtatacttagcagtttactagtgatgctatacgctaagagtactctattgtatggagccaagctccttaagcggataggtgtgcaaatggagcaggtctcagactaaggagccggggcatatgtggtggggaaatcactttttgactgggggatatggttgcagatttaggaaagggttttcctaagaatttgaaaggccttaaatttcatttattgaatttaagggcgtttttcggatttcaagaactcccaattggggccagcgttggtgcatgtcgtacatttaaaatttgatgg

SEQ ID NO: 512243 - DNA, 875 bp, Homo sapiens
gagaattatccttgaggacaatgactctgtgtgtgtgtgtgtgtgtgtcgttgtgtgtgtgtgtgtgtgtgtgtgtgtggttgagagcaggtgcttcactgtatagacagatcacagccagcggccgtagaagacacacacagagagagatgatggagggccggctaccgtcatggatgtggtgtggagaggagcgtggaggagttagtggtggtaacacaccacgagggagtgggtgacggcgggaagaacaacaaccggcgagagcgtcgctcgtgcatggtatgatgctggtgttagcaccaagaagccgtagtgtggatgctgcccatcatcaggacgatctacagtctcttcctcatcatcacacaaggtgtgtgagggcgccgcgtggggctttagacaccaacgcagcacacagagaaagaagagaagtagtacagcaggaacatcatcagcgcaccaagcatcctccccagcaggagcatggtgatggtcgatgtgctgcatcgtgtggtggggtgatgaagatgaaggaaaccacgcaggacgatcatcttgttaggtgggaatagatgtggtggtacgtaagtcggtctcttcgtctcccgctgcgagcatgtttcactcccaggcatgatcgtccgcaaccagggggggaggagacagccccccacggagaggggagcaggagggagaaacagtcaaagagcaggagggtagcagagtcggcggcagaaagcgagcagggcagtgacagaacgcagtcagcagggggttaatcgtgtgaagaaaaccacagaaagacaaaagaagcgtgtgggggtggagaatccttctcggtcgcgaaaacccgttgggaggggagaaaagaa

SEQ ID NO: 512244 - DNA, 277 bp, Homo sapiens
cgagctcggtaccccttttggggtctgtgctcttttgggtttcgctcaaattcgtgtaaaaaaaatttaacccaggaacttgccatctattatttcggggggacttggcagtctgccctaaaaagcttcagacaagattcatgagtataagcctgaaaaagagaaacctacaacacccggaattgggcctacgtccccatataattccttttacacctaagtgcgaaactccccctttgtttttggaaaataaataaagggtttcccataagtaagt

SEQ ID NO: 512245 - DNA, 1304 bp, Homo sapiens
  misc_feature (321)..(321): n is a, c, g, or t
  misc_feature (342)..(342): n is a, c, g, or t
  misc_feature (648)..(648): n is a, c, g, or t
  misc_feature (680)..(680): n is a, c, g, or t
gatgccgtggaggcgagaaggccacgggaccgaaggtgagctgccggcccgcagtctgttcgtagaagaaggtcctgaggctcgacgcatgagtggtgaatctcccatgatgtagacgaaagacatggcgctgttagacggaagtgtatggtgcgacttagtgtactacgcgcacaagtccaaagacacgccataccaggcagacacatcaatacgcgacggttgtgatcatggactcctgcatatatcaggagttgcgaacgaggcgcgagccaaccgtctataccagccggactgagacagttgcacgtacctggcagnaattgaaaaccagagtatcancacacctatgagtcgctcttgcgtagcacgggtccatacaacgacgcctttagcgtacaacgactggacgtatatataagtctggagacgctcaagcaatacgcttagcaacgacctcaaggaggaaccataagacgccaacaaaggacgtatatgcaagaggccatgtacggacgtagtgtccgtgcgccccgagagccctgtaccgaaggtacaaggtctgcgtcgtcacaacatggggggaccagtgcacctatacgaaagcagacctacgcgtggtacccttgctgaggcaagtgatgtttnaatcgatccagtgcatccctacactttagggntggggaagtaaacatagtagagagcatcaagccatagagatagagatagaatttgcaacacgaaccgtggaatcccatcgagcctggttgtcttcttgccctgccctgatgtccgtcaacaatggggggtcccttacttgcattatcaagggaaaggcaagacttgggacgtctagtccacaggaagacctgcaccactgtcgccttcacacaggtgaactcggaagacaaaggcgcttttggctaagctggtggaagctatcaggacccccattttccccctgaccagatacgatgagaatcggcgtcactggggtggccattgtcctgggtcctaagtctgtggtcgtatcgccaagttcgaaaaggcaaggtaaagacttggccacttaaaactgggtttaactggttacccctgttgcagttttccgggtcctttaaacatatcttggacttccttatcacacatcatatcatcacacacctacaaaacaacccgcgcgcctatttgggggggggaacacagctcactacagggcacctgataatctgctctctcacaccccttttgcacgggggacaggcggccccacggggcgcaatcgcacaccgccgcgacacatc

SEQ ID NO: 512246 - DNA, 253 bp, Homo sapiens
cctctagcaggctccccagttactctccagaagaagcacaagctgtttcttcacaaattattgggacaaaattgtttaccaagcaatacgggagacaagggcagtaagtatgcgatctagtattggtctgtgagcgaaaatatcccaggagagaatactactttgctataaccatggaaaggtcatttcatattatgaatattgctgatttatttcaaagtggttctactgtaatgatcagcatgaaccaata

SEQ ID NO: 512247 - DNA, 1019 bp, Homo sapiens
  misc_feature (822)..(822): n is a, c, g, or t
gggcaaatcagttcgcagcctgccagcgcgccctgtcaccatctccacaggagagtgcaggctcctcgctccctacgattctagagtacgatctcatgacttccataccccgtattctaagagagtgcacaacgtcttctctctctaagcccgcttgcgctcagcttatcctacgcctggggatccttggaccgtcgactcttctggccaataagtgaaagagtatcagagcattatcaatcatgcgacatgagccatcactatgcttgcttctgtggaatgctataaatctaccgtagatgacctggtggatctcaatgagctcattgaaggcactagatgatggtcccttacttagtagtgctcaccccttggagagatgaatgttatggatttatatagcatgtacatagcgttgacatatctgctctagaggggaacataacgacaggaggacgatgtttggcaagacttgcccatgagcaatcatgaccacgtaattgctgcatgcacacctcgcctcctttgtcagcaatcatagtgcctaggtatatgatctaatacattgcataccctgtaagggttaaccctctgtctgcaaggagtagtacaccagggaagatcatttgttctggtcattatgagaaacatggcttaaaacctgatgcgagagattggtcgtcttttctgaaaaacaaatgtggcacgacatttttgtattaaactgacagaactggggcgggaactccttttataattatacctcttcccgcaaggttagtcctcactgtctaccaactgtctgcacagaatcatttctantacgactagtgcctacctttcttgcgaagtacgagaaaaagaagggaccttggctacttgacccgggccagttggatcaccctatgcttgtacttcgtggaaaatgcggtccacctacttgcgggaaacctatctgggagacaccgaccacttacctccttgttggcaggttgcaccaaactggtggacaattctcc

SEQ ID NO: 512248 - DNA, 642 bp, Homo sapiens
taggtcttgctctgggtccagatgatcagcactgtaaagatagtggtaacgcctggcactgcattactgagcattaactctggacaggccagttcctttcaggaggacttccccaacccctcggccctttctgctttgcccctctcctgaaacgctatcacctgtgactggccaacccacattttaaagaatagttacattagtgattcctaaagatccttagtccttctgttcatccatccatggatacttaatgagcattcttgaggggctataatgaacaaggcagaggtgtcccttaccccagaagagctctaatgggaaagaagatgataaagacaattagcatacaaagtgatcagtgctgtgagaaggaagtgggaggaacataggactctcgggtgggcgcctcaactggactagatggtgcagggaaggcttccggaagcagctaccaagtaaagtaggacctgaagactgagtaggtgtcagtcagatgaggggaaggtgtgtggaattgaaagcatctccatggcagtggtaggagcacttgtgtgagagtatgctgtgtgtttgtgtgtgtgtctgtgcacatgtgtgtgtgtgctgcttagagtttttgagcaaagtatggaatgatca

SEQ ID NO: 512249 - DNA, 336 bp, Homo sapiens
gagacggagtttcactcttgttgcccaggctggagtgcaatggcgcgatctcggctcaccgcaacctccgccccccaggttcaagcgactctcgggtgggcgcctcaactggactagatggtgcagggaaggcttccggaagcagctaccaagtaaagtaggacctgaagactgagtaggtgtcagtcagatgaggggaaggtgtgtggaattgaaagcatctccatggcagtggtaggagcacttgtgtgagagtatgctgtgtgtttgtgtgtgtgtctgtgcacatgtgtgtgtgtgctgcttagagtttttgagcaaagtatggaatgatca

SEQ ID NO: 512250 - DNA, 912 bp, Homo sapiens
gctttgccctttcgccttgtttcgcgccaatccgttcccttccggcttcccaagccatgtccctcctggcacgtgtcccccgttgtatgagccaaatgttgggcccacctgtgagaattttcccccccgggcccgaatttgccacacaaactggggggccccccccaccgaccaacgggggttctaaccgacccgccgtccaggctttccctcccctgggttgtggggcaggcccgactattctaatgctcctgtgggcgagtctgccctttcttcacattcccgcccgggttttgtcccgccccccccctttgttccgctcggagtatctgctggcccaatgaggccaccgggtgttccgcggtttttccccctgcccgttttttacgccgccgcggggtcacacaactgtggggcaccccgcccccttcccatcccctgggcacccacgtccctcattttttgcacgggggcaccaccttcgagtttcggggcccgcatttctcccacgagtgcggtcccgtcggtcttgagcggcttcctctggtttgtgccccgcgccttcattgtgtgaacctcctctccccccggacagtttccccgccgcacagtgtgctctgctcgggtcctccccttgagggcgggcaacggtttcttccgccgggattattgtgctgcggccccttgtggttgcacagaggggcacgcccttcccacgagatgttgctacccaggggtgtagtcctgcgcccccgcagggcacagccccgtgcggctggttcaccacccacgggtctccccaacgatctgaatcagggatcatgccacccccttcgtccgacccagctgagcccccccgctgtttttcccgtttttaaacccaaaaaaggacccccttttccaaaaaaaaac

SEQ ID NO: 512251 - DNA, 152 bp, Homo sapiens
gttttaattggttttctctttcccgattttttttttattaaaacaaagggccttttttccaaagtaaaaaatcacaaacgcttaggttttactattcaattcaatcccccctcccattgcacttatctcccttccccaagttgtttgtttta

SEQ ID NO: 512252 - DNA, 519 bp, Homo sapiens
  misc_feature (481)..(481): n is a, c, g, or t
catatctctctttgtcacagttccagaagaattcccaggaatttagctttccctttactctaatctcagaaggagctataccctctttgaagctccatagagagaaataggaacaaacttacccaaaacacacggtgggtatgagtgctgatttttatccccatggagaaagggaattttacagcaatgagcatagggtctctggtgaaaggtcatatccatacatatctttatagaaaaaaaaaaagaaggcttggaaatagtgagaacaaagcccagagcccagggcttggtgggaaagcaggccctggctccccttcctgcatgtgagttttgacttcttcctgtgctggtcagggctgcaaatggctgataatatcactgaagcctggactatcttcaaagcccgactggcacaaaatgacatattaatgtagtatctcatttcctttgcattctggggacaagtgggattggctcnatgcccagggatatcctgtgaactcatggaataggact

SEQ ID NO: 512253 - DNA, 363 bp, Homo sapiens
gacacaggcaggcttgtggtggggcttctggatccctcagtgtatgggtcagtgtagcatctcacagggagggtggctttgaggcacgtaccccataggaaggcggtgaggaaagcaggactgtgccgtggtctgggaggtgtacagagaataggtgtgccgaagagtgggcctggaagttgaggggtgcctgctgcctgtggttgattgggcacctgtgcctctgtcctacaatcggacatgggtttcttgctcctagaattgtctgggtccctggtctgtcctactctgatctcagtgtgtttgaacttggatgtggagattcggatgtgttcccgcggattgctgtggctttgcgccttt

SEQ ID NO: 512254 - DNA, 150 bp, Homo sapiens
  misc_feature (7)..(7): n is a, c, g, or t
ggtcttntgcttcttggtatcgacatcgtcatcctcatcatctccagaagaccgcttgcccgtagctgaatcagattcttcatcttcatctccatcctcttcctcaccatcaccttcttcttcctcctcctcttcctccccaccttcttc

SEQ ID NO: 512255 - DNA, 314 bp, Homo sapiens
tttccagtgctacaggatctctgatctggggcacaacaccctggacttggctcctgagatcaactggccggccctcgtgagccatcattgataacactaaagggcagctggtggtgcatccagaagccctgaagatcctatctgcaattacgcagcctgtggtggtggtggcgattgtgggcctctatcgcacaggcaaatcctacctgatgaacaagctggctgggaagaaaaacggcttctctctaggctccacagtgaagtctcacaccaagggaatctggatgtggtgtgtgcctcatcccaagaagcca

SEQ ID NO: 512256 - DNA, 1808 bp, Homo sapiens
gggcagggacaaggattggaaggtaaagtccttattcagaccaatcttcctgcagggactatacgtagctttgggaaagggactttgaaacactttgattttcttttcagtaatataattatggtacttattcttttatgttattaaatattcttttggataacactgaggaaggggtgtttgtgagaaacagcactggtatttagagttcccagctatgaaggaaatgctcttcacaggtattagagtacaactgacttgaaaaaaaattcatctctccgtggttatatttctacaagaagttgtttaaatttaagtaaaatattaatatatgttatttgtctaacagtgaaagagaaaaaatcaagaacaataaaacattagagaagaaaatagaaaaatcctgtgaaaaaggtccaaatgcaggctgcaaagaggggaagccagtcctagcaagcacctaaccaactaaatgacctgaaaaaaaagtctgtcagcctctatctacctggatctcattagtaaaattaggaggcaggatgaaataatttataaggttgctattagctttaaaatttttatgagttcagagcctttaaaaacatgatgtcttcagcagaaaacaccactgtgaattttttttcaatattccttttaactataatggaaacaagttaaaaataataggtctaatgttcataaatccattaaatatttactggtcaccctcttgatgactattttgatttaatacatggtatatataaatcatcaatattttcaagttcaaaaatgcacagggaggaattttatggcttctgtgatggctttgaacaaaagtgtaatttacttccttgtttgtgtaagtgtttatatactgatcatttgtcagtaagcctgagaatctaagcacaatattatatatgcatgctaagtgcttagtttatcattatgattttcctcttgaatttaaattgtgtaatgcagataatttaacttttctagggttctcgtttatttttaaaatgttagtgtccaggtaacaaccagaaaaaaaaaaattctaagccatgtggtatgctaatactgaaaataaaatgagtgttatttcccttgagggaaatgtaattaaagataaaggggagatatgcctagaataatgacattcactatacataactaataagataatattgttttaaaattctgtaaatttttcttattttacttaattttatgtccctgctggtatttttgctttttcataaaaattatcatttatttttctcaactgcatattgccatcttcattttttaattttctcacatattcatagaattgttctctgtaatagatactgtacagtaattatttgttgatcgattaaccttttcaatgctacttccgacacctacttcccatcctccgtgtaacagatactgtcagttacctatccttaacagcctttccactcccaacttctgtgaatggacaagagatgcaattgtgatcactgaacatgaggcaacatcttctaggaagacatttccatagtcttcagacaaaagggagagatatcttttcagacaatctttgaacaatcctatatgaagcttacctgaagttgctgtagccgtttggcaagtctggggagactaacagacacactgaggatagcagaaaataaagatagaaacagcccaggtttttggtgaaattcatgagcttctgaataacgaaccccataccaccctacctctataaaagaattcttaatatgtgacataataaaatttctttattattt

SEQ ID NO: 512257 - DNA, 253 bp, Homo sapiens
aacgcgcaagtagatatatgctatataacactgatctttaagaatcatttagctctcaaactaattaggtaatcactggtaatccaccttggtcggaagaggcctgcttgtggtcagttgcacttgcttgctaggcagagggacaatcgggaggggctcaagagcgcctcccccgccagcgccgtcactgcagtggaaggcggtccttgggcaccagcaaaggcaaggcccattttcacatttccgcttgggg

SEQ ID NO: 512258 - DNA, 136 bp, Homo sapiens
cccccccccccaaatttataattttttatacaaatatttcctctggcttggaacttttggccaggtttttttttggcccggggggggggggtccaaagtctgggggccccccctttttaaataaaaattttcccta

SEQ ID NO: 512259 - DNA, 339 bp, Homo sapiens
ccaccatttaataagagcttcagttctgccaagggcattcctacactgtaaagaatttccaggctgggcgcggtggctcatgcctgtaatcccagcacttgggaggccgaggagggcggatcacaaggtcaagagattgagatcatcctggccaacatggtgaaactccgtctctactaaaaatacaaaaattagctgggcatggtggcacgtgcctgtagtcccagctacttgggaggctgaggcaggagaatcgctggaacccaggaggcagaaggggcagtgagccgagatcgtgccactgcactccagcctggcgacagagcgagactctgtctt

SEQ ID NO: 512260 - DNA, 124 bp, Homo sapiens
  misc_feature (2)..(2): n is a, c, g, or t
tnaccagctatacatgcactggcgtcgtttaacactaacagctataccatgcatggccgtcgtttaacactaacagcgtataaccatgcattggccgtcgttgaacataaacagctatacccat

SEQ ID NO: 512261 - DNA, 494 bp, Homo sapiens
  misc_feature (33)..(33): n is a, c, g, or t
  misc_feature (41)..(41): n is a, c, g, or t
  misc_feature (91)..(91): n is a, c, g, or t
  misc_feature (475)..(475): n is a, c, g, or t
  misc_feature (477)..(477): n is a, c, g, or t
  misc_feature (482)..(482): n is a, c, g, or t
aaaaaaaaaaaaaggcttggggtcccctgtttnccctcctngcggccttcaaactctgacttcactctgtaactgtacccctaaattcccnaatacaaaaatccttttttttttctgagatggagcttcactcttgttgtcccaggctggagtgagactcccatctcaaaaaaaaaaagtagaatatttacaatctaaaatgtcctctctggcccagatacggtcactcacacctgtaatctcagcactttgggaggccaaggcaggagggactactagagccccaggagttcaagaccagcctgagcaacactgtgaaacccagtttctactaaaaatacaaaaactagccaagcatcgtggcacatgcctgcaatcccagctattcaggaggctgaaacacaagaatcactggaacccaggaggcagaggttgcagtgagccgagatcacaccactgcactccagcctgggananataanaaagtactgtct

SEQ ID NO: 512262 - DNA, 610 bp, Homo sapiens
agccggacggggatctgagctggcaggatgaatgtgggggtggcacacagcgaagtaaaccccaacacccgagtgatgaatagccgaggcatctggctggcctacatcatcttggtaggattgctgcatatggttctactcagcatccccttcttcagcattcctgttgtctggaccctgaccaacgtcatccataacctggctacgtatgtcttccttcatacggtgaaagggacaccctttgagactcctgaccaaggaaaggctcggctactgacacactgggagcaaaatggactatgggctccaggtttacctcttccccggaaggttccctcaagaattttttcccatattggggcatcatattctccgtggccgagcttctataccagagtagtgagtgcgtgcgcatctttccctcactcacacacaggcctcattgctaaagtgtactgctggccgaagttggccccagttccatggggttcgtgtctttggcatcaacaaatactgagggatgggtttggggacagctccatgggcatggggaaggcactgaaacagaggactataaaacatcaaaaacaacacaaaccacacacaacac

SEQ ID NO: 512263 - DNA, 593 bp, Homo sapiens
  misc_feature (40)..(40): n is a, c, g, or t
  misc_feature (121)..(121): n is a, c, g, or t
  misc_feature (124)..(124): n is a, c, g, or t
  misc_feature (155)..(155): n is a, c, g, or t
  misc_feature (163)..(163): n is a, c, g, or t
  misc_feature (199)..(199): n is a, c, g, or t
  misc_feature (247)..(247): n is a, c, g, or t
  misc_feature (250)..(250): n is a, c, g, or t
  misc_feature (376)..(376): n is a, c, g, or t
  misc_feature (378)..(378): n is a, c, g, or t
  misc_feature (588)..(588): n is a, c, g, or t
gtggaacatttcaccaaatctccctccattcatctttttntcccccctctcaacccctagctctcacttctctcttctttctcacttcccccttaacactctattctaacccctctaaaanacncactaaaactactaacctcataataatcacntttaacanaacccccaccactaacccaccctctcaccaaaattnaaacaacacttcctctttccccttcaatataaccccttctcatctctnatnccctcaacaaccactccacctccctctcactacccctactcatcccccttcaaccccccatcacaccacatccccacctactccccttccttctcacttaccttcctcaacttcacattcaccttncncacctccccttcacccactccctcatccaccttcttccccaccaaatcaaccccaaccccctacttctctccatccctccacacctccatctcccccatcacctccttcctcaaccacttactcatcaccaacctcgccctcccccatcccacaacccaccttcaccaccccaccctcccgccaccaccgatcatccccgccccattctncaacc

SEQ ID NO: 512264 - DNA, 98 bp, Homo sapiens
acggccgtgtattactgtgcgggttcgtatagcagtggctggggccatcatgatgcttttgtcatctggggccaagggacaatggtcaccgtctcttc

SEQ ID NO: 512265 - DNA, 183 bp, Homo sapiens
ctcactatccagaaagaatgaacaagaacaggctgtatgcaacaaatatttagtccctttacacatattgtcaatcttcattaatgctaaaaaatgtagtgattattaaatgtctgaaagaatcagtatgtataattaagatggttaatctcttagtataacacattttgttcagtctcagcg

SEQ ID NO: 512266 - DNA, 145 bp, Homo sapiens
gagagagagagaggatcacttgagctcaggagtttgaaaccagcctgggctacacagtgagaccctatctctttaaaaaagtatatacactcaaaaaagaggaagtcaaattatacctatatgcagatgacatgatcttatatat

SEQ ID NO: 512267 - DNA, 411 bp, Homo sapiens
  misc_feature (78)..(78): n is a, c, g, or t
  misc_feature (404)..(407): n is a, c, g, or t
ccgtgggtgggggttaggggaacactctgttaaaaaatatggttgatgtattatcctagtaaaaggtgaggaaaaaancttcattttaaagagtaaaaatatgtcatccccctggcatggtggctcacacctgtaatccccaacactttgggaggccccaggtgggaggatcactcaaggctagaagttcgagaccagcctaagcaacaaagcaagatccctctctctaccaaaaaaaaattaaaaattagctgagtgtggtggcatgcacctgtagtctgtagtcctagctactcatgaggttgagacaggaggattgcttgagcccaggagtttaagactgcagtgagttatcactgtaccactgcactccagcgtggttggcagagtaagaccctgtctcnnnnaaaa

SEQ ID NO: 512268 - DNA, 166 bp, Homo sapiens
  misc_feature (22)..(22): n is a, c, g, or t
tggttctgggtagctgaggcangttaattgctggaacctgaaaggcggaggtagcagtgggcagagatcgtgctgtcgcactccagccagctgggcaacaggagtgaagctccatctcaaaaaaaaaacaacaaacaggctaaacctggccttttctgtttacccg

SEQ ID NO: 512269 - DNA, 777 bp, Homo sapiens
  misc_feature (679)..(679): n is a, c, g, or t
  misc_feature (705)..(705): n is a, c, g, or t
  misc_feature (739)..(739): n is a, c, g, or t
aaggagactagagccttgaagatgaggagtgcagtggccagtcatcggaaattgataatgaccaattgagaacatcatcgaagctgatcctcttacaactataagagagctgcccaagaactcaatgttgaccattttatggtcgttcggcatttgaagcaaattgaaaaggtgaaaaagctcaataaatgggtgcctcatgagctgagtgaaaaataaaaaaattcgttgttttgaagtgtcattttctctattctatgcaacaataatgaatcatctctctatcggattgtgatgtgtgccaaaaggtggattttatacgacaactggcgatgaccagctcagtggctggactgaaagaagctccaaagcacttcccaaagccaaacttgctccaaaaaatggtcatggtcattgtttggtggtttgctgccagtctgatccactacagctttctgaatccaggtgaaaccattacatctgataagtatgctcagcaaatcaatgagatgcaccaaaaactgcaatgcctgcagccggcattggccaccagaaagggcccaattcttttcacgacaacactgggccgcacgttgcacaaccaacgcttcgaaaattgaactaattgggctatgaagttttgcctcatctgccatatcacctgacctcctgccaacanactaccacttctttaggcaatctcancaacgttttgcagggaaattgcttccacaactancaaggcacagaaaaatgctttcccaagaagttcgtcaa

SEQ ID NO: 512270 - DNA, 984 bp, Homo sapiens
  misc_feature (22)..(22): n is a, c, g, or t
  misc_feature (80)..(80): n is a, c, g, or t
  misc_feature (89)..(89): n is a, c, g, or t
  misc_feature (140)..(140): n is a, c, g, or t
  misc_feature (147)..(147): n is a, c, g, or t
  misc_feature (149)..(149): n is a, c, g, or t
  misc_feature (167)..(167): n is a, c, g, or t
  misc_feature (178)..(178): n is a, c, g, or t
  misc_feature (191)..(191): n is a, c, g, or t
  misc_feature (208)..(208): n is a, c, g, or t
  misc_feature (230)..(230): n is a, c, g, or t
  misc_feature (247)..(247): n is a, c, g, or t
  misc_feature (256)..(256): n is a, c, g, or t
  misc_feature (270)..(270): n is a, c, g, or t
  misc_feature (283)..(284): n is a, c, g, or t
  misc_feature (286)..(286): n is a, c, g, or t
  misc_feature (296)..(296): n is a, c, g, or t
  misc_feature (307)..(307): n is a, c, g, or t
  misc_feature (326)..(326): n is a, c, g, or t
  misc_feature (330)..(330): n is a, c, g, or t
  misc_feature (337)..(337): n is a, c, g, or t
  misc_feature (344)..(344): n is a, c, g, or t
  misc_feature (348)..(349): n is a, c, g, or t
  misc_feature (368)..(368): n is a, c, g, or t
  misc_feature (381)..(381): n is a, c, g, or t
  misc_feature (400)..(400): n is a, c, g, or t
  misc_feature (406)..(406): n is a, c, g, or t
  misc_feature (416)..(416): n is a, c, g, or t
  misc_feature (427)..(427): n is a, c, g, or t
  misc_feature (429)..(429): n is a, c, g, or t
  misc_feature (454)..(454): n is a, c, g, or t
  misc_feature (458)..(458): n is a, c, g, or t
  misc_feature (480)..(480): n is a, c, g, or t
  misc_feature (484)..(484): n is a, c, g, or t
  misc_feature (491)..(491): n is a, c, g, or t
  misc_feature (497)..(497): n is a, c, g, or t
  misc_feature (734)..(734): n is a, c, g, or t
  misc_feature (739)..(739): n is a, c, g, or t
  misc_feature (744)..(744): n is a, c, g, or t
  misc_feature (750)..(750): n is a, c, g, or t
  misc_feature (809)..(809): n is a, c, g, or t
  misc_feature (818)..(818): n is a, c, g, or t
  misc_feature (821)..(821): n is a, c, g, or t
  misc_feature (827)..(827): n is a, c, g, or t
  misc_feature (831)..(832): n is a, c, g, or t
  misc_feature (837)..(838): n is a, c, g, or t
  misc_feature (841)..(841): n is a, c, g, or t
  misc_feature (866)..(866): n is a, c, g, or t
  misc_feature (888)..(888): n is a, c, g, or t
  misc_feature (891)..(891): n is a, c, g, or t
  misc_feature (893)..(893): n is a, c, g, or t
  misc_feature (905)..(905): n is a, c, g, or t
  misc_feature (910)..(910): n is a, c, g, or t
  misc_feature (920)..(921): n is a, c, g, or t
  misc_feature (975)..(975): n is a, c, g, or t
cccctccgcaccaggctgcctnctgtttcccggggagatcatgaaacgaggtcgccttcccagcagcagtcaggattctnacgacaatngcagcctgtcaactacttggtcccagaattcccgatcccagcataggagangctcctncnccagacatgaagatcganagccttcagangtgtttaggacanacctgatcactgccatnaagcttgcatgactcctaccanctgaatccggatgagtnctatgtgtnggcagatccctggngacaggaatgggnnanaggggtccangtgcctgtcancccggggaccatccctcancctntcgccanggttgtntctnnagacaaatccctcatgctncatcaggcccaanaagtacatcgtgtcatcangctctnagcctcccgnctcgggctatntngacatccggaccctggctgacagcntgtntcgctatgacctcaatcacatngatnccgcctngctggnactcaccaatgaagaatttaaggagatgggaatgcctgaactagatgaatacaccatggagagggtcctagaggaatttgagcagcgatgctacgacaatatgaatcatgccatagagactgaggaaggcctggggatcgaatatgatgaagatgttgtctgttatgtctgccagtctcctgatggtgaggacggcaatgagatgggtgttctgtgacaaatgcacatctgtgtgcncaagnctgtnatggantctcaaggtacagagggcagcgggtgtgccgacatgtgcctgggggtcagcaaaatgtntccgtgtcngangagggnggannatgannccnccgtagcgaaccagtgggtcacgtnactgtctctttgatcctgagtnacntngcacccaaaganatganccatacaagnntaaaatccacagcggtgggcaatttcacctttcataaagtttgggcttttaatnttgttaaat

SEQ ID NO: 512271 - DNA, 2126 bp, Homo sapiens
atctcagataaggcatcataccacttgagaacaacctatggacctgcagtggataggcctatgtgacaattcatttcgctgagtggagagtgagcacgacgcaaggcggattgggcctgccttaccttcacatgcaggcatcatgcttggactgagagaggggtggtcaattgggccatatgcgtgtagtagttgcgattatgaagtagtgcgtctatgaggctagattaaactcaaatacttagctgaatagggttcttcaggccaatgctctgatgcattgcatccggagacgacccttttgttagtgcatgagggtcggcgtggtagcactttccagtaatcgcgaggaagtgggaatacacaagcccgtatacacaatggtgctttccttgatcgctcttgagaatagataagattcaaagaggccatagtgtggcggagaccgaggttacaccagtctggaccaatagtcggagagaccctctttgtgtggaaacaacctctgggggccacttgttcgtgccaaggagaaatatcttcaatatagagttatagcttgatgcgctcgttgcgattcacccaaccagtccatggcacatcggatgttagacttcgctcagagacgccatccgacctacgtctcgctattcggatatatccagcacgtctgatgggccactttgaaaatgctggggactacttcccacaaaagacctttggttcctaaggcgagactgtagtgccggtttgcctggtcacgactggctctgggcaattggcatccgcacatgtacaatgggggaatacctgaaggccttactatttgggaggcggaccttctacggccctctttgaaggcgtttccaacattttggtgtgccccccatgtgaaaaacccccaagcaaatatatttccccgccccggggaatcaagcgacaaagacggctccaccaacaaccccaccaaaacacaggggggaccccaacctcccggcaaaacaccaccctctcgcccacccacacacgaccaacacccgacccccaccaccaccagacagtactccgtcccaacctcgcgccacaacctcaattgtttaataggataagataattatataatactcactccaaccaccaccaaccacacaacccacccccccacgccactccatcccacgcaaaatcacgcaccactacatcacaccacccccccagccacaactatcctcctaccccacaacaacacacatcagacccccctaagagggcgcagccccgacagcgacgacaggagacaccacacggagaaagaacgaagaggcggcacaggcgacacacaccaacgaccacaccggaggacgacggacgcgcgaagagaggagaggggtaagggcacagcagaagcagagaacagccgcgcagcgagctagaaggaagggaacacgacgaggagagacgggaggtagaggagggagaggaagaacgaccgggaggaggtggagggacggacagcaggcagagaccggagagaggcggaagcagcggaggagcagagcaacaacaaagaaagcacagaagacagcacgaagaagcgggcgcaaacagaggaaagaaacgacagccaggcagcggaagtgagagagaagcgacagcaagaggggagaacagagaagcacgaacagagaagcggcgaaccgagcagaccgacggatgcagcggacgcaagcaagagaaccacaggcgccgacggcagcaaagcgacaggaggcacagcgacggcaagctaccacgagacacgcacgccgcacacacacactcaggacaagagaacatgacacacaacgaaacacaacaaacacacgcaccccacacacagcacgcgagaccagcgaagagagacggagcaactgagacccacacgcagacagcaaacacaacatcacacccacgcacacacaccaacgcatgccagcagcacagtgaaacggtcggcttacagcaaccacgcagcgtctagacaggaagaagcaactaagactggcgaccgattacagcacacacgatggcgtgaggtcgagcgcgtgcgacgcggcaatccgccccaccccccacgcccacaccaa

SEQ ID NO: 512272 - DNA, 304 bp, Homo sapiens
atcggcggggcacccggcgggctgctgtggtcatcaatgttttttatgctggtggtacttatattgtccacttcgccatgggagaactctgtgcttccaccctccacttcaatctcctctcgctctgaatcagaacgatctgaagaaatagttgatccaatgctgtccattcgtattcgttccatctcctgaggaccctgcagctgttccagtcgccactttaaaaatctctgttctcgttccaaattctcgagctggtgctggctttttctttcagcttcttcaagtttcttgatgtgtgctt

SEQ ID NO: 512273 - DNA, 456 bp, Homo sapiens
acaaaagagacatatacaatcgagctcgtaccccttctagggtattgggacaagtttgggtaatgtttacgaatcacaggacttgctgactggagaagagggcagaaagcagagttatcacaacacatgatttatgaccatcttgagtcagctcagcagggggtggtgccatttacagaacaaagatggcatggacagagccctatggagaacgaggaggaagaaagagagttgggtatagggttcagatctcaagaccagggtctctggctctgtcacccaggctggagtgctttggtgccgatcatagctctttacagcctcaaactcctgggctcaagtgatcctcctgcctcagcctcccaagtagcaggattacagatcctacagatgcacttcaccatgcctagctaatttttttttttttttttttttttgggcccaccccggtcccgg

SEQ ID NO: 512274 - DNA, 312 bp, Homo sapiens
acgtgctgggaaaagggagctctgctgggagagcatagtaaattcagagaactgaagcgaaaaggattaaaaacgctgctctaaagaaaagaaaactggaggctgggcgcagtggcttacgcctataatcccagaggctgaggcaggcggatcacctgaggtcgggggttcgggatcagcctgaccaacatggagaggccctgctgggaatacaaagttagccaggcatggtggtgcatgcctgtaatcccagctgctcaggagcctggcaacaagagcaaaactccagctcaaaaaaaaaaagaaggaacg

SEQ ID NO: 512275 - DNA, 1784 bp, Homo sapiens
  misc_feature (433)..(433): n is a, c, g, or t
  misc_feature (1379)..(1379): n is a, c, g, or t
acgtgtatctctggtgtatcactaattgtttttgtgttacaaccaaccgtggggggaaagtatgattgtattaagttgtgtgcttacgtaataagattttttttttgtgggggagagggtcgtcggtgttgttatatgtcggtacatctttataatcagataagcgttgttttttaataaaagggggggctcttcttgttattaagcgctacgctgtcgccgacaaaaaggcttttgttttgtgggggcagcatcatcgtttagttgttttgggtgcaataacaactccctggggggcctcgctaatattgtgtggcaaaaggcgttggtagtaatgatacatactttttgtgtggagacaccctccccctaaaaatatttttgtggggggccatccaagatcctatatggagaatatatatttgttggggtntaactccaccggggagggaaggagatatatgttttgtggtgtgatgtgtgtattgtgtaacccctgcggtaagttgcttctgttattagtcttccctcaatatatattatgtcttaataaagcggggtcttctctgtataactaccgcgttgctctgcgccatcttctccaggagatgtgttagttttctcttcttaacaacagccttgggggggcggaccaccaacatcatgggatgttttgttaccaacatggtctggtttgaagattagaacgaatttttggggaggagcccctctttcttctgttaacacaatcggagagagcgcacacccactctgttgggtggtttatataggtggtataaaaggagagtaggagttttttttctggggagagttctcacacaaaatagtcttccgtgtggggttttttctcaaccgcggtggggggggggcgtggctcctctgtgtaatgagaatcgaccacgccccccctctgttgtcccacatgagtatgagcccgcctccttggatgatataacactttatgttgtggcgacacaccacaccaccgacaacatctggggagggttgttcttctcggggagtgactacacacgacttgtttcgtcgagacgttgtttgcacacaagagaagttgtttttgccacaacagaggtgccactactcttgtcgtcgtgggtgtaagatgtgtcccccacaacatatgacatcatcttagcgccacagtgttaaaagatgggctcgcgcctcacggggagatctctctcacacacagagatgtctcgcgtgtggctgcacacaaatttatatagagagtctctgtctatcacatataatgagagggggtcccaccagggtgtatacacccccaccgagatactgttatataaagatttctattaaaagatcgggagtttggngtgtctctggagagttggagagcacactggggtagatacacctctcgagagacgcacacccaaacacaaagccacaggggtgtgtgttgagaaccacacaccactaagtgtaagaagttataagagagtgttgagatatttcgcacaccacaagaagctgccatgcacccacttgttctgagatgtgagtgagtgcttattgaaatgtacactccacggaagtgaaaagaggtgagtataacacactggataggttattgaaagaatgctgggtcaccttctggaggcccctaaatgagttgagtctgatgttccttttatttatacaccagagttaaaacgccattgtcttgtaccctggagttggagtattaccaccactttaaggttaagttcccagctgtt

SEQ ID NO: 512276 - DNA, 403 bp, Homo sapiens
cttctccgatgccagtaattcttgccccaaccattgtacatacatgaggaaacccctatggataacatttgattcatctgtaacgttgggatattttgtcctcataaaaccacacttgaggtggatggtgaaaacaacctttgaattttatattttgtttctcttgattcctcttgaagaagggggtgatgggaaagttttcccccttgggtaatgaaaaggttgtgtaaagtgtgtggaggtcgtaggacggaaaatccagtgctgggttacttgtgtagcactgtggtcttgtgtatgcggttggcttgtctactgtgtggttcctcagcgatgtaatcttgtttaaatgtaaagttcccttgattttgtcatacatataaatgagtattttcagagatca

SEQ ID NO: 512277 - DNA, 410 bp, Homo sapiens
taatggatgcctgttgttataacaccactgaaactattgagagtggtgggggagttagtaggtcccaaagtgaaagaaaaagaggtaggtccggcttgagagcttttgctggttgattcactggcatcatgaacatccagcagccagggcaaggcaggttgagtctggcgcatcacacacggcagcaacacactttgtagcacacagtagtcagaggcagagcccaacactcaggtagcatggtggccttgagcagcggacagtggaaggtgctctgagcagggcagcatgcttgaggaccaaggtggccctaagtagtgtctacctctgtggcagtaggtgtagtgttgggtgaagtcaagcctgtccccaaggttctgccgggtctagttggctgttggaagtgctag

SEQ ID NO: 512278 - DNA, 99 bp, Homo sapiens
gcggccgactactactactactactgctcgaattcaagcttctaacgatgtacggggacatgctcccccaatcatgcaaaaaaaaaaaagttgtactgc

SEQ ID NO: 512279 - DNA, 367 bp, Homo sapiens
tgcaggtgactctatattatccccacggacatgagtctatggatatataaaagggtcttggttcttaatgaacctgtcatgcacaagcagcgtttcatgtgtcgtgaattagatacaaccatcgattaatttaagtcttggtctccctcaagtgaggaaattttagttgttcacaaataatacctgttaaatatatttgagtaaataatttcttatgtttatttcaaacaattctttttctccaaaagagcataaatggtattttgtgtaatgagagcttatagctatttctgaattatgaggagaacataacctatttttaagcagtgtttttcatttttttttgcattattgttgcagctatatc

SEQ ID NO: 512280 - DNA, 304 bp, Homo sapiens
tgcggcatcactgcacgctgctctcggggtgggcctggcccccgtgccccttcaacctcttgggcacggcatgtgggggtgctggcagctggcagtggcatggtcccccgtggcatggggctcgaccctctttcttcagcactgcggtctttaacttgcatccctctcttgggccaagccgagggttggacgtgcctgtcggaatcgggcatggccatcagggttggcaagtgcaatgtcggcacatcgggcatggcaatcagggttggacagcgcaaagtcaacgcatgtgtcgggtcaccgc

SEQ ID NO: 512281 - DNA, 385 bp, Homo sapiens
  misc_feature (341)..(341): n is a, c, g, or t
cgacatggctgtagctaccatctggtatctcaggctgacggagttgagttctccctgggatggagtgcccgagggaggggtgggctgcatatgtgatgtcttggcgacttggccattccaaagtttgggctttggggagtcccagctgacttagggtggatatagcccaccagcacagcacggctgctgtacaaaagcatggccagactgcttctttgggcgggtcccggattcattcctccgcgctgtttgggacttcccaactggggcctccagccgcccccactggtgttctcctgctgacggtgatttcagtttttttcttgggctggagctccctngatggaggggcaggccatcatgtttgctggttttgcaacttaac

SEQ ID NO: 512282 - DNA, 348 bp, Homo sapiens
  misc_feature (80)..(80): n is a, c, g, or t
acattttgaaattaaaatactccactagatattgtctccaacattgaaagataaagtaaagaaatatagccagggagggngatgggaaagtcggtcaacaggtacaaagtgcacttagatagaggaataagtcctgggttctattgcacagtagggtgattgtgtttaacaataattcattgtatatttcaaatagctacacaagaggatgctgaatgttctaaccacaatgaaaggatcaatgtttgaggtgaaagatttgctaattaccctgatttgatcattatacaatatatacatgcattgaaatatgacattataccccataaatatgtactattatttgtc

SEQ ID NO: 512283 - DNA, 174 bp, Homo sapiens
cccggtctcatgtcttacgcacagcgcttagctcgcacttgattttttacctttagtaggcctagaaagtataacattgctaggctttataccagtactaaccaaaaaaataaaccctcgttccacagaacctgccaccaagtatttcctcacgtcagacatcatctgcagggt

SEQ ID NO: 512284 - DNA, 712 bp, Homo sapiens
  misc_feature (668)..(668): n is a, c, g, or t
cagagaaaaacgtaaagctgagaaccaacgtaagtttgagttaggcggtgctgtgttggcggcttttaaagacttggggatggatattagtgaatcgactcctgaacagattaggaatcgtattaagaatgtgacaaaattccataatgatgtattaaaatctaaggtatatcaggaggttaaaaattataaaaatgaatattttgagcggaataagctttttcatcaggttctgcatggactaagtacttggtccaataaaggggaacacttgtatctcatcgaaatcaagaaagctttagcgaaaaatcaggaatagcctttttcagaaaggctgtacaggcgagtttcgcataaaagcttttatgtaatgtaaacctggagtacaccccaaagtaacgtaatggcagccaaaatcctgaacctaaaatcaatatcttagaagctgtggaacattgccttagcaacgattgaaacaagtcttagatttatacgtgacactaaaaagccaattagagaaaccggacatttttattggtgagaatatagacactttgattgggttctaacacctgaatttcgtataagagattttatgttaaataataaaaggctctaactgagagtgagagcctttattcttaaatttttttatctattgtgataanccatgtgccgttattacgctcataaagtggtaaattgctgacac

SEQ ID NO: 512285 - DNA, 438 bp, Homo sapiens
gagatcacgccactgcactccagactccgtctcaaaaaaaaaaaaaaaaagtttttgaaacctgattttcaaacctaccaccttccagctccgagtccacagggtaaactgtggtattgggtggtacccggggggatcagtgactaaggcatcccagtaactgatgatttctgggcccttgttgggtgtcaccccagagtttaggccacatctcttaccacaacctaggaagaggcctccccttcttggacagagtgtcagaggtcaggtccagggctaaaagcacccagacagctatgaggtggtaggatgtgtagaacctatagccagagtccttctctcagctccatttatttcagaggggacactctaaccacagggagtgggtcggtgagggcagcctttgcgggtaggacaggggctctcccaggttctaca

SEQ ID NO: 512286 - DNA, 202 bp, Homo sapiens
cagaggactcccgatgttgcgcgtccctctacagacaacttagcaaacatttacccagataaagtataggcgatagaaattgaaaccgggcgcaatagatatagtaccgaagggaaagatgaaaaattataaccaagcataatatagcaaggactaacccctataccttctgcataatgaattaactagaaataacttggca

SEQ ID NO: 512287 - DNA, 328 bp, Homo sapiens
gcacaagagatgatgtgctacgtctgagaatgtatgcgagtggcaacgaccttagagctcaaggctcactccactgctagatgatgtatctctctacggtcaggatcaaccgtagaacttacggcgtgactctgcagggtcaaactctccttgcttgtctcacactggaggctgcaatcgccacagggaattgcgtatccggttccacgacgcaacacaccacatgcggatcccacgttcattgcacactgttggcagattctcaaatccgaagtcctcctttgccatatggtacatgtgagttatacggcttgtctgacacatatcc

SEQ ID NO: 512288 - DNA, 404 bp, Homo sapiens
  misc_feature (5)..(5): n is a, c, g, or t
cacgngccattggcctggcttggaaatcttttgaactttagtttagccaatcctgaactgttaatgtaagagacaacatatgtggtttattactgtgcatacccgcccttgttcagccagaagatattccagggcaaatctgttatccaagacagcattggctagggagtgcagggaggcttgacgtccttttatggctctgcctgtactagttgccagtgtttcaagggtttgaaagtttctcaaagctgtctgacagtatgcaaagccatcccaaggggctattccaactcctgccaaaattagccctattgcctttttagatttcaccacatgtgtgatattatgaactgttattctattgggacttaaaagacctaacatgcattccttattgcgttgac

SEQ ID NO: 512289 - DNA, 1374 bp, Homo sapiens
  misc_feature (8)..(8): n is a, c, g, or t
  misc_feature (10)..(10): n is a, c, g, or t
  misc_feature (12)..(12): n is a, c, g, or t
cccaattngncnttggccgggtctaatagaattcttattttacataattgtgcattttaattgatagtcatatggtatttttgttaataacagcaaaggcattaaatcagtaccattgttccttctgcctgatgacttcttgtttgtaacacaatctgtattatcagaatcactttaaaccaaagcttttatattccctgtacacatagccaaaataattagcactgttacttctgtccacttgtaagctaatagtataaaaattataaagcagatactagtagaatttgtattctggtatatccttcaaggaaaaggacaggtgatcagtgcatttagacatccagaagttacttccactattgaggaactatgtagacatgaatttaagcttgtacatgtgccaatcttgttaatgtcacttgaccactgattcacatagacagacattaacgtctgatgcctcaggttgatggcgaactttcttcctagtgtcttaacatttatgaacttatgtttgacttgaggggcatttcagcaaagctgtgaggaaaagtaggttctggactgatgtctgctttgtgccatagacattttggaacataaggaagtatctgcttctactatatgtacaggacttgtccccaaataatttctgaatcccttaatgcagttgagaatcccttaatgcagttgagaacagtaaagttcatgaccataccgaaaagcacttttaagttcacttctttttaaatatttttttagaatttattttttaaaagcatatgtaactagtgatgattttagcattagctttacttggaggggagaagaaacaaaattacaccttaaactctattagatagactacaaaatggatttgatgtattcttacttttccaaagaattttttccacctggaataagaagagaggactagttgaaacatttgagctggagaggcttatgggcaatatgaagtgggccaaattcttgcaatacaccctattcaattgaaagtacagtgtctaaggataagaatacttctttaaagaccaacaattgttttaatgcaatcttaattagtaaatggtttacattttttctattgttattggttttaaaatttgctaccctgaattctgaaatattataagagttaataccaaaaatacttttaatgtctgacatctcttacatttcacatggttctttttattcattgtaaataaaagtaaacttggataaatttgagaataaactttgaattgttgcaaactatgattatcaatttgtaaatttaccctttgacataataatgtacatttttaaatgtagccattaaattctctatatttaacctaaaaaaaaaaa

SEQ ID NO: 512290 - DNA, 804 bp, Homo sapiens
ttccgcttttttttgttccggcgctcttttggattgttgaattttcttttacacttctaagtgctatacagccttttatggtggctgcttctgttacaatctctgatgaacctagacatattatataagcgcctctcgtttttggtgataggtctacgataaggctgtattggacagttatgaatattttgctgtgctttcttgtctatatagaacttggtatctctagtataagtactatgaacctccaaggttaatatagtagcgatttactcttctccaatcagtgcatatgtacaagaagcacttagtagttcagtatgtaatatgatgaacactttacagatgtttagagttagtacatctatactggaagcacagcagatgtctacttggaatatattcagcgataacttacctgaaggggttgccatggaagtaatacaatagactacttattagaacagttaccagtaacacatcataggagccaatctgggaaacactatcagaagtaaaaagaagaaagcatagtctataatagcctcagggaggccatttttgcctaatatttgaaatgagggtgggcctagatgagtatgtttatagtggagagtgcttccagctgagatgatttgagtctgtcctaactgctccattgagttctcgtgccctcatcagctgagggcagggaatgaactttaatgtgaagtaatccatctctgttactcttattgcggtttgttatttcattgtgttgaatataaacccccctcttctagcatatcatgagctaccacttcc

SEQ ID NO: 512291 - DNA, 934 bp, Homo sapiens
  misc_feature (16)..(16): n is a, c, g, or t
  misc_feature (78)..(79): n is a, c, g, or t
  misc_feature (94)..(94): n is a, c, g, or t
  misc_feature (107)..(107): n is a, c, g, or t
  misc_feature (114)..(114): n is a, c, g, or t
  misc_feature (131)..(131): n is a, c, g, or t
  misc_feature (133)..(133): n is a, c, g, or t
  misc_feature (138)..(138): n is a, c, g, or t
  misc_feature (147)..(147): n is a, c, g, or t
  misc_feature (151)..(151): n is a, c, g, or t
  misc_feature (153)..(153): n is a, c, g, or t
  misc_feature (161)..(161): n is a, c, g, or t
  misc_feature (184)..(184): n is a, c, g, or t
  misc_feature (205)..(205): n is a, c, g, or t
  misc_feature (251)..(251): n is a, c, g, or t
  misc_feature (266)..(266): n is a, c, g, or t
  misc_feature (277)..(277): n is a, c, g, or t
  misc_feature (736)..(736): n is a, c, g, or t
  misc_feature (841)..(841): n is a, c, g, or t
  misc_feature (866)..(866): n is a, c, g, or t
  misc_feature (899)..(899): n is a, c, g, or t
cacaacggggaaaaanggcagtagacaaggaacagcaaataaatttatcttgcatgccactttcagtcaacaggatgnngctctctagatagcngtgtttagaaggnatctgangcttcaacctcacacangngaaanactactgcnattnanagcaatanccaacatctcactcaacccagangaaaccaatggcaccaaagtnggcagcggagttggcactggctgttccaccagggccaataatgggnccgggaaaggtctgngggaatctggngcgggcattctggtggtatctggcccagaaggtaaatggaattctggaccagggatctccaaaatctccttcctcatcccaggtcagcagctcaaactcaatgtcatcccagctccagggcccagacacagcctcatctccaattcccatgcgggttcttgcttcagcccgggcttcggcctcagctgcagcagcatccagagcatccaaggcctcatctgcagcctccatgaactgtgcagtccagtcacgagggtctcttttctgaacctctgcaatgaatctcagcactttcatcttgctagtctcatggtaggaacggaggccccagaggaactcatactccggggggttgctgttgggcactcgtctgtagtccaggtatttctgctttacaaactcataggtgagaagtttccttagatctccaaggaggggatgtctcaccccaggacgcanccaatcttgcgtagtgcctcccagaggacagcctcactggcacggttgccattcatgaagatgacacccagaatcaccaagaggagaccgagcttggggtgtgtntttggtcgttcccagtatgccagcnagggactcggggggtactgatgagaatatacangtgttcttctttgtcaatttctttcagttgaatcc

SEQ ID NO: 512292 - DNA, 311 bp, Homo sapiens
ggtcggcgcgcggtgggtgcatggctgggttcgcggggtgcggtggcgcacggcggcgctcaggagcgtgcggctcggagtaagcggcggtcatgtagaccctgaattgtgatgccgtgatggcctctgagcctggaggcaccccctcgtctctctggcaccttctactctctcagtccacagcaccggtagtggatatactggcgtctccgacaggcgaggagagtagtgttctcagtgcctggcaagattcgcggcagtgacaagcagtgaggcatgatgacgaaggcgacggaggaggggagaggact

SEQ ID NO: 512293 - DNA, 228 bp, Homo sapiens
tgagttattagaagagaaatccaaaaagaggcctcatacatgccttcattccagtgtcagagactttcaacatggaaataaatattaaaagagcaatcgatatatatccatcacacactagtaggctagaaggaggcaaattaggaaccaaaaatctagacatagctccttgcatagggtaagatattaagcacacacttgcacagaataactccatatccaccctat

SEQ ID NO: 512294 - DNA, 139 bp, Homo sapiens
  misc_feature (108)..(108): n is a, c, g, or t
gcggccgcctactactactactactactgctcgaattcaagcttctaacgatgtacggggacatggaagcaggaccagtaagggaccttcgattaaaaaaaaaaaagncaataaaaaaaggctcattaatgggaaaaaa

SEQ ID NO: 512295 - DNA, 567 bp, Homo sapiens
gagttccgcgcggggctgtcggggaaccatggctgtgcccgagagacagtgtcactttattattcaagttatactgcttggtagatgatgaccctgatggctgcggtctataccatagctttagagatacgacagaggacatcagacaagagaattctacttttcgaaccacaggcctgtgtgtatcacatgaagggttataaaggttattgctaatgtgtgggaatgatgtagcgtagaagaaactggtagtctgggtagattcaaagcatcgtttaagagaaaaggtcttggggagccccaaggaacgtgtgaagttaagtgtgcgcatcgttgagtgtatgcctgttcgaggaacaagcagtggctttcgctagtccgtcttagcaatctggatgcagtagtgtaccaggtgaccgtacgcagtttgaagattccgtgtactgttttatgcactgtataaatgttgaagcggaattcagaaattacagtgggttgcagtttttatgctgtgtgctggagttacgcttgtacagtggaaagcagggccaagtacagaaagtggtc

SEQ ID NO: 512296 - DNA, 169 bp, Homo sapiens
cccgttgggcaacgcaccgtcctggagtgctgaaatacggcatgttcttgtctcactgggtgagaagatacagaggaagaagtagagattctggtttgctagggcctatgaggacagcaatgagttgtatcatctatgaagagctcgtccgtacggtgcgttgggccaa

SEQ ID NO: 512297 - DNA, 519 bp, Homo sapiens
  misc_feature (492)..(492): n is a, c, g, or t
gccactcttaaaggatcccccaaccatgtcggggttacatacggcgtatctcactggacaccacagaccacactgatgtgcttgtgagtgcccctgagctcaacaatgtcatctccctggactatgacagccctgtagtaaaggtttattacacatatgtgtttctggatgttatcaggcgagcagacctgaacggcagcaacatggagacagtgatcgggcgagggctgaagaccactgacgggctggcagtggactgggtggccaggaacctgtactggacagacacaggtcgaaataccattgaggcgtccaggctggatggttcctgccgcaaagtactgatcaacaatagcctggatgagccccgggccattgctgttttccccaggaaggggtacctcttctggacagactggggccacattgccaagatcgaacgggcaaactcggatggttctgagcggaaggtcctcatcaacacagacctgngttggcccaatggccttaccctggact

SEQ ID NO: 512298 - DNA, 704 bp, Homo sapiens
aaaattgtggagtcacgtttttttcaagcgtcttttctggggcggaaaatgttgggaacccccttggtgatatagccgtcaaagcacttgcctgatagggttttacaccttgggggacccacacacagcatccgcggagttcacgcactgtcacacgcactcgggccaccacgagcgaaaggggactatcctaggtggagaagcgtatctgggcccggcggcctgcacctgtacaccccacttaccttttccggaccacggaccacgggtggctttggagaaacttttccgaacagcaccttcttttcttcaaacgcacgggaaacctcgtgcaacctcaaactatggggaggggcccccaagctcataattcgtaaagctggctgagtgcaatccgctggtcgtatcggggccgggagttgtcctcacggcttggcaacactcgctcggttggaaacttaaattatctgcgtccccactgggagtacacgacacggcgacaacggaataatgtgatggcgtccacgtttggaggctgggagtaaaggttcctgtagccgacacccctacaggagaagctttgggactggggcaacaacaaggcgcccatgccacacaccgtcttttgaggaacccggttcagacgattttttgactgcggaccctgtgggaaccccgtcaataaatgtttaagacacactcca

SEQ ID NO: 512299 - DNA, 101 bp, Homo sapiens
ctgaaactccagtttttatatgtgctacggcgggagtgtctccaggaaccaagaagccctcagcctggtgtagtctccctgatcccccgtccatcacaata

SEQ ID NO: 512300 - DNA, 295 bp, Homo sapiens
ctagcgacggtgtaaaaaccagggaccacagactgagaaacacatgttgaaaaagcacgctgtcacgacgcggaacaaaacgtcgaagagcagcctggtcgcattcgcagaggcctgcgagcccagcgtggcccggcccgaaaggaccgccacaggacacgcgcccacccgggagctcgggccctgggcctgggttcgggagaccccccggcaaccaagaggacggaagaggagccgggaactcgttcgacgcggagaacccccggggacggcgtccatttgaggacccggtagc

SEQ ID NO: 512301 - DNA, 125 bp, Homo sapiens
  misc_feature (106)..(106): n is a, c, g, or t
tgagacgagtatggttgtttgaattcacttattgaactggagttcggtctgtagttatggtttctgtttatagagatggagtttcgctttcgtggcccgaggctgnagagcaatggcacgatctc

SEQ ID NO: 512302 - DNA, 425 bp, Homo sapiens
  misc_feature (358)..(358): n is a, c, g, or t
  misc_feature (368)..(368): n is a, c, g, or t
  misc_feature (402)..(402): n is a, c, g, or t
  misc_feature (404)..(404): n is a, c, g, or t
atcttacagaaatttctattcagtcctacttagtaacaaagagcatttgattgtgggtaacgttgacatactcaactattctaatgcacttaatcttcaaaatattttcttcagtaacatctttactgagggaggaaaaagttaacggttcttcatacacacacacacacacacacacacacacacacacacacacactagtgcccacttatccacaggggatacattaccagaccccttccctcccactggatgcttgaaaccacggatagcacctaacccaattttcatcaatttgaacatgtttctgttcatgtctcccacttcacaaatgttaacgccttttccctcttaactnaggcaccttnaacatggcacctgtgggctttaattttgcggttngnggtgtggacagttaaaattgg

SEQ ID NO: 512303 - DNA, 102 bp, Homo sapiens
taataaacagggccctgaaagaacatggatattttggacgttagttaagcacttatccctgctaaggcgcttttcatcattgtctaatttgttttttgtggg

SEQ ID NO: 512304 - DNA, 336 bp, Homo sapiens
tctagagcatcccctgtactcgtaattctcactatccatggccttgttgataactgaggatctgatactggcttcctgatgtgtctttttttttttggaaaacagagctctcgaatctgtggcccaggctggagtgcaagggcaaaatcaatctcagttcagtgcaaccttcacctcccggtttcaagcaatcttcctgcctcaaatccccaagttgctgggtattccagaaaacacctcacttcacaaaggagagtgtaacacgaccaatccattaccagggaagcgaaagcaactgcaccaggacaccgggagtctttatccaggagaataatt

SEQ ID NO: 512305 - DNA, 631 bp, Homo sapiens
gccatgacataggtgcttggcattctcacctaataataacatactgctctctggccggtaaccgagcgattctgcaacacaatccagattgcgcagttctcgatggtccattacgtggcatctatcgaacgaggcagttccaagctgatgctcgatgactcataagtgacggctgccgtgcctgtggaagcaggtagaagccggctgatgcaagtcgccccttttgcttagggtgtgagttctcaggcaattaacaggcaatttgttgcctgccttgaggggtataatgcacgcaaaaagcaaatggcacagactgtgtacctttggaagggcttactggaggtcaaacgctcacccgtgaaaacctttggcgctttacgaggctaagacctgcagcttaggtcgtgtgcaaaggttccaacgaatcagtaaatcaagggcgtttcacagtttgtcacttgtttccatgcaaatggccaacaagacatacatttataaccttgacaaaagaaaatgtatactttacgaacaaataatgcacagaaaaatgcagcctataattggctagttaggtagtcaaagaagtaagatggctgaaatttaccataagtaatattgcataatcttagat

SEQ ID NO: 512306 - DNA, 1308 bp, Homo sapiens
gggaattcaggacactgctatttattcctcgctcgggctccctttgcaccttctcgagaacaagcaagaacaaagaacaacatcaaactctactgctccgccgccgctgcttcactcatggacagctgtgatgagcttgactaccagcagctatctcacactcttctatccgtgcgtgtggtctgactcatgcacggatcctgcccctgcaacatctcccgagcaaatgctccagccagcacgcaaaatccttgaaacgtcatctcgcaaaacacattgctctaacgaagtgcccttgagcctcttcctctgcagcctggccagaacgacaaggcagcaatccacaaccgacaattcctaatgcagggccatctctcctaaacaaaactcctcacacgcctctgcgcaatctcccccgcaaacgaacttccccacctaacacccgacacgccgaccctgctcctagcagccctcgcttgccgcctaactcataaccctaccccagctcctggaacgactgccgcactcgaacactccctcgtgctccagcaccccacctgctcacctccgcccccgcacagggcagaacaccagaacacgccccacccctaccccaccacctcacctcggcgaagaagccaccaaggaagccagagcggcaccaacacccagccctccccgaatgccaccgcaccctgcccccaccacgcgcgcactccgaacgccgccccatctcatgacacgacaccccacttgaccacacgctacctgccgctacacccaacccccacccccactccgcctcgcgcaaacaaacccgccccccaacaccacccacccgcagcgcacccggacagcccgctgcacgcatgcacccacgaccacaccaccccgccaggccaccaaccccccacgacaccacacagcaccaacaccccgacccccccccccaaccacactctccccacaacaacgcccacacaaacccaaaccacacacccaccccccacccacccgccacccggcgcacagcccccaccaccgcaccgccaaaagggccgagcataccacacccagcgaccacacgaccacccacacgccaaaaagacccacaccagaccacccgcccccaccgaaccccaacacccgcccgcacagccgacaccgacaaaccaccacaccgcacaaacgcgccacaccccaccgccacgcacaccggacgacggccagcgccccacgcacccccgacacagccgtgccgcacccacgctagactcggctccacccgaccacccgcacccacgcccc

SEQ ID NO: 512307 - DNA, 913 bp, Homo sapiens
gacgccatggtccgactggcctacggcgctgggcaaggacttcgtgactctgctaggagcaggctggaggagaggccgagctccggaggtgcccacgccccgaggcatcaccctgaaggagctcactgtgcgagaatacctgcactgagccggactgggaccccggcagggacgctggagatttggggtcaccatggctcatcgagtgggctgtctggggttcttttttttatatttattccttatactattattcagttattctggaggacagtcttgcatctgtcacaccatgactgaagtgcaggtggcgtcacattatgtctcacttgcagcctcaaactcctgggcacaagcaatcctcccaccttcagcctcccaagtagctgggattacaggtgcacaccaagcacaccaggctaattttgtaagttttccagtagagacagggtctctctgttgcccaggctggtctctaacttctgatccttaaatgatcttcctgcctcagcttcccaaatacagctggggttcacacagtgtgagccaccaaccctggctgggtcatttgtagtgggaaaagcctctgggggctctaatatcgctgggtgactttggactatgcccccttccatcttgtgtccctcacattactcgcattctcgtgttggacagaggtgctcctggggagccccttggaagcatcttgcttgtgttccatcggtgctctttgactgccagggccactttcattctcgaaaatttgaacctgattggctaaccgtgcagaaggcagtgttcacccccaccaggtgttttgtggcaaccgggcgagaatgttctcccatttttaggaattgtgccttcttggaaaaggttctctcgggggcaagcctgtcctggtcctcccctg

SEQ ID NO: 512308 - DNA, 360 bp, Homo sapiens
ccaagggcagcagtctgtaaggaaaggctggccttcgtgcggcaccagccggcacacaggcgacccaggtgagaggccccaacagagggtctgtcaccatcataaaagaaacaccccagtgactcatcaaatgcaaaggggcacagagaagtcacaggaaagacaaaccaataagcatgcgttttgtttcttgtttttaaatgagactgctccctccaggcagaagcataacctggctgcctggtgctccaggcaatcagaggcagaaaggtggcaggcaggcatctcaggggcaaaccgacacagttcaagctccagctccacctctcgggagctccgggacttaggctaactgacaac

SEQ ID NO: 512309 - DNA, 957 bp, Homo sapiens
  misc_feature (489)..(489): n is a, c, g, or t
tataaaaggaaaacccggtaatgatgtccggggtttgagggataggaggaaaatggggaatagggtttataaaaatgagggtgtttgtctcgtgtagaatgaggtgttattatggtatgttaaatgtgcggggtggtgtgatgtagagccccgattgtgttgttgtggtggtaaatgtattgatagcaggggaagatattaagggtggtgtggactgataggtagtgtcgtagttccgtgtgtaagctacagagtagctagatctattgtgctatcagagagacagttcggtggatttgtataagctgcaagagagttctgtccacagattagcgtattaatacggtgggggagggattaatgggcgcgagggtcttacgtagaaggacttgtgccctatacataggctcctctcaagaacaaatgcgtatgtgacgtggagcgacaataaggaaaggtctttggaactctcctgttgaaaacataggntgtattcattaacgcgacgggattcgtgcgtaaatggtgcggttggcgaataggtatggtgacgcattggcgattagcgggaacatatagacttagagttgagagggtatggatgataagtcacacagggaggggacgaatatatatggctaaaaataactttgagcggctcgggcatagtaattgtccgagggggggtatttcgcgtatcggaaaaatatgggggagtggacacaaagcggaggggcgataaagggtagttgagattgtcaagaagaggttttcgatcgtaagccatatgtacaggggaattgcacgggtgaaaagtggaaatttgatgccttcgtgaaacaattttagcacttgtaagggcataataccaaggaaggggccaaggatataaggtaactgaacggggattaagacatggtgtataggccatataaaaccaaggggaatatgtaagac

SEQ ID NO: 512310 - DNA, 269 bp, Homo sapiens
  misc_feature (212)..(212): n is a, c, g, or t
  misc_feature (249)..(249): n is a, c, g, or t
gacaatgtaggagacagaatgtcgtgctagtcgacttgtatttgagtgtgaaattgagcagatggagaacaagaaatatggccaatccgtcacacaattgccatcagtgtttctaatgggtttagcagctattgatgattatagcgtaaatccatttcactaagtgttgggggaaaggtgttttcagatgcttttatgccttctgcatttantgttattttgagacagggtccctctctgtcacccagngtggactggagtgggcctat

SEQ ID NO: 512311 - DNA, 149 bp, Homo sapiens
gtgcccgactcgtagaggatcccccagttcctgcttcttgaaaggctgaggcaggagaattgcttgaaccctaggaggtggaggttgcagattagctgagatcacgccattgcactccaggctgggctagcagagtgagattctgtctc

SEQ ID NO: 512312 - DNA, 732 bp, Homo sapiens
ctcgtgccattccctttcccagtcttggagcacatgtggtccctctgctcagccaagacctccttgatcaggtgtggatcccctcgggtggcctttgggaaatggctccatctgcattaccgccggaatgttctggcctttggcggcccccagccaccgccagtgtaccaggtctccgagtatgccccggccctttggtgttcccggtcattctgatggaggaatcccaaatgtgggtcatattgcgaagccttggccccttggggcctccaccagtcatgatgggctctctccatggctgcccccccactgaggcccctggtgaatacttcttttcccgatgggatcccggctaaagaaatatcccggtatgggttctctcgatgccctggaccagcacctcagcagcccgaccagatatttcagtgaagctgaccaaaatccaagtggccccgggagtgtctggtgctgtgcaggaccaagggtccatcccaccaatttgtcccctacctgattgctggcatcccacactcatgcccggaccttggtgcccagagcttgaccccagtccgagccctgatgtactctggggagcttaagtttgagaagagacgtcctccgccccggtggaaggtggcgtccctagcctcccttcgtatgagaaacgggcttttttgagaaagggagtcccgcaccccctcctcggtttttttttccataaagtttagaaga

SEQ ID NO: 512313 - DNA, 166 bp, Homo sapiens
cctatccatgggtttataccctcaaatacctatgagtggccgggcgcggcggatcacaaggtcaagagaacaagaccattctggccaacatggtgaaaccctatctctactaaaaatacaaaaaaaattagctgggcgtggtgccggccgcctgtagtcccagcta

SEQ ID NO: 512314 - DNA, 1141 bp, Homo sapiens
ggtagacttagccagccatagagaagttgccttatatgttgaaggaggtgtatacaaagggaaatagggtgtctcctcgggactcgcaacttaagcacctcaaaatcacactcgtatacctcgaacatcgaacaagcaaatcgatcgaacatcgatcgaaacaatcgaaacattagatcgaacacttcgaaacaccgcaaaatgatcgaacactcgaacgcaacactcgaaccatcaactcgagcatcgaaactgatcgatcgaacactcgaacctcgcaacatgcatgcaactggcagctgcattgcacacatgcaacatgcatgacagtgcatgacaatgcaaatgggtgcaaatgcaaaagtgaaattgcaccataatgcaagtgacacatgcaacataatgcacgtggcacatgcaaattgcatgccaaatgcattgcaacttgaacacagcatgcacacatggcatggcaaagtcaaatattgcatcattgcaaaatagcaatgccacacatgccatgcaacatggcacagactggcaaatgcatgccacaatgcattgccaccaagcattgccaagatatcaagattggcatagcacattagacattggaacattgcaaacacctccatgcaggcattgcaacaacaagagttgcaaaccatggcaagcacggcaaacattccaagtagagaagatgcgcaacatagccagcactggccaacaagtcaatgccaacgtggcacaatcactagccacaatgcacacaaggcacacgatagcctgcccacccatgcgacaggcgccaccacgcaacagcgaccaggcacaatgacatgaagcatcgcagacgccagccacaaggcccaccgaacataacgacgcgaactacatgactggacgcctgccacggtgcacactggcagcaacagagggacacagaacggcacagctgcaaacagggagacaacaaggggagacacagagaaaacgaaggaaaccaagcaaagcagggaccaagacagcacaaggacagcaaaaagccagacgagaaaaaaggacaggaacggaaagaagacaaacacagaccagaaagaagcatgaaagaccgggcgcagtgaacatgggccccacagcg

SEQ ID NO: 512315 - DNA, 109 bp, Homo sapiens
gtcccactgcatgcctagctacatgtgtaattttacaagtaaaatgaaatataatttcatttcattatggggcctcagactcccaaagtccactgcacgcccagcctgg

SEQ ID NO: 512316 - DNA, 374 bp, Homo sapiens
agtttctcccttttggaacgggagtatttacccaatgcctgtacccccatggccacttccagcatcgatggtgtcaggtcaggtcctctgggtagaagaaatggagtcagttaggagtgctggagactgagtaagaggtggcagctgaggcttactaccccaggaaagggatgccaccagagaaggcagacaaccaagatggcgactctcaatttttgagctcctaattttctcatgtcagacataagaaaaaaaaatattttttaaagaaaaagctttaggttgcaaaaatctaggcctttcaactttaaaatcctattcttgcaagccttggagaataaagcttatgcataaacagtagatttggaaacaga

SEQ ID NO: 512317 - DNA, 926 bp, Homo sapiens
cagctttccagcttctcttgaaaaattaggaaacgtggccacacccaggcagcctctgtgcatgtggacattcgagcaggggttgggagcgtggaccctctggaaaggctgtgctcttcagcctgccacactccccaccgttccctgcagcccgtccctggtccaccatcatcccccccgccccgctcgcggcccccgccgcagggcaccgcacccggccccacccacgcccactcccgacacgtccccccctccccccacagctccctccgcactccccactagccgactcccacaaccctgccgcccccaccccaccacacgcgcccccgcccccccccgccctcccaccactcacccccccgcaccaccccccccggcccccccccccagccccgccgccccgcccgcccaccccgccccccccctcctgcaccgcccccccgctcacctcccccgcgcactccccacccctcccactcacctcccccccccacccacctacccccccactgccccccctcccccctccgccccccccgccacccccacccgccccggccccccccctcccaacggcgcccccccccgcccccgcaccaccccccgccccacgccccgccagcccccactaccccccccgctatcaacaccgctccctcgccccctcccccacctcgcgccgcaccaccccccgccccccccaccccccaccccaccccacccccgccacaccccacgcccacacaccgcacacgccccccaccacgacccgcctcagcccccccgcaccccgcccctccccaccgcgcccccccgccccacaccacacccctcgccaccccacgcccacccgccacacctccacccctccccaccgcaccacccgcgcccaccccaccgcgcccccccgccgccaccacgcg

SEQ ID NO: 512318 - DNA, 287 bp, Homo sapiens
tgacgctgatccgcctgttcgagacgctgcgggcgcaaggatacgagggcggctatgataccgttcgccgccatgcccgccgctggcagcgcgaggaagtgggccgcacggcgaccgcgttcgtgccgctgagctttgagccgggcgaggcttaccagttcgactggagccatgaggtcgtggtgctggccggcgtgacgacgacggtgaaggtcgcgcatatgcggctgtgccatagccggatgttcttcgtgcgtgcctacccccgcgagacgcaggagatggtg

SEQ ID NO: 512319 - DNA, 428 bp, Homo sapiens
ggggaggacttgcggcgggacaagggtgcgacgtgattccggctgggtctggcctctcaagttaacattgtggctttcgagcagcggggatccgtttctggggatgccgcacccgttggtattatggcgggaatattccgtccggcgatctacagattatgctgtatgaagaccagcaggcgaatgagctggacgtcactttttctgacgccgattatgcaaattcattaggcgatctggatgttttgcagcgccgtttccagtttattttacgggcgctgaacgcatcaacggcggggacgatcgaggcgttggatcggcaagtggcggcgctggcggataccgaggccggcggcagcttttacaccaaccgtcggcaaccgcctgccggcggtatcattcgttgggatcgcccggctgaggcgctg

SEQ ID NO: 512320 - DNA, 404 bp, Homo sapiens
ctgcttgggaggctggggcgggagaattgcttgggcccgggaggcggaggtttcagttaaccgagattgcgcccctgcactcaggcctgtgcggcggagtgagactttgtttcaaaaccaaccaaccaaccaaactatttggccctgtattggtggatatattatatgcctttggccaaaatattcagttaccccaagcctggaactattaaaccctgggccttagtttattataggtccgtaaaagaaagccggtcctgtttatacctagattttagccccgtgagagcttttccgacttttttttttcagttctgttagatatttaatttttgttgtttaatgttttaacaggtccgtttggttactttttttagcagccattaaaaaatggattcctttta

SEQ ID NO: 512321 - DNA, 183 bp, Homo sapiens
aaaatttgcccccccccaaatcccccccctttttggaaaaacaaaagtttaaaccggggagccccccgttcctttttatgggttaaacagtttccccccctttgagcggggggggagggaagggcctttaaattgtgggtgggatttttgggccccccaaaaaaaaccggtttttccccccca

SEQ ID NO: 512322 - DNA, 143 bp, Homo sapiens
ctggccgatgcgcgtccagtcctgtttcagcgacaccagaagctggccctgaaccaggccggtgatgtccgagttggccggcagttgaagctgggtcagggcgccgtcgtcgcccaggcgccaggtctcggacgaatagaagt

SEQ ID NO: 512323 - DNA, 284 bp, Homo sapiens
ccaagggggagagatttatggattttatttcccagattctctggtcacaggtttttgcccagggaaattttgagaaattcccaattttttaccagataaaacatgaaaagtttgccgttagttccccccccctcccctccctctttttagttttaatttattggttaaactgatggcagcaatccatgaggggggtcaaagaggggacaaatgtatggggggatattgaatggtaaacatattactgaaagacccattttaataaagatttttgtcataattca

SEQ ID NO: 512324 - DNA, 360 bp, Homo sapiens
ggtcgacatggggctgagctgggtgtggagtggtcgttgtgggtcttggtgagtgggagggggagtagcatgagccgggcctcgaggcagaaggacaaccaggagacagcctggaaaaagtgccagacccacaagggctcaaggctggccaaaggggaggtgggataggctgcaaagtcctgaggtctgaagattggccctggcaggaagaaaccaggtaaggtggggtgttacctacaccctcggggccaaatgcaggtcagagccagccaattaccaggcccttagggaggtgtgagccccttgaaatgatgcaaggttttttgttttgttttggagacggattacgctcttgtcgtc

SEQ ID NO: 512325 - DNA, 456 bp, Homo sapiens
tatacatgtctgggcttgatctggttagacttctgacacaggaaagaaacccatattagttttttcctctgctcttgaaaaatatcttaagattctcaggagttactatgtagctctaaaatgtacattatcagtattttcttgtcatggtgtatagtaaaaggaactgtggatgggtgctttgcagatttgtgtttcatgccactaacttgctctgtgactctgatgaggtccattaatttctttttttaaattttttaaattttttgagacggaatctctctctgtcacccaggctggagtgcagtggtgcaatcttggctctctgcaacctccgcctccgttcaagcgattctcctgcgtcagcctcctgagtagctgggactacaggcacgtgccaccatgcccggctaattttttgtatttttagtagagatggggtttcaccgtgttagc

SEQ ID NO: 512326 - DNA, 872 bp, Homo sapiens
  misc_feature (33)..(34): n is a, c, g, or t
  misc_feature (850)..(850): n is a, c, g, or t
  misc_feature (853)..(853): n is a, c, g, or t
  misc_feature (855)..(856): n is a, c, g, or t
acaacttacaggctaagtagcgaggccaggtgnntaatggagcagttcggcggtcccgcgggtctgtctcttgcttcaacagtgttgggacggaacagatccggggactctcttccagcctccgaccgccctccgatttcctctccgcttgcaacctccgggaccatcttctcggccatctcctgcttctgggacctgccagcaccgttttgtggttagctccttcttgccaaccaaccatgagctcccagattcgtcagaattattccaccgacgtggaggcagccgtcaacagcctggtcaatttgtacctgcaggcctcctacacctacctctctctgggcttctatttcgaccgcgatgatgtggctctggaaggcgtgagccacttcttccgcgaatgtggccgaggagaagcgcgagggctacgagcgtctcctgaagatgcaaaaccagcgtggcggccgcgctctcttccaggacatcaagaagccagctgaaagatgagtggggtaaaacccccagacgccatgaaaagcttgccattggccctggagaaaaaagctgaaccaggcccttgtggatcttcatgccctgggttctgcccgcacggacccccatctctgtgacttcctggagactcacttcctagatgaggaagtgaagcttatcaagaagatgggtgaccacctgacaaactccaaaggctgggtggccggaggctgggtggggagtatctcttcgaagggtcatctcaagacgataaagctttgagccaggattttgagggccttgaagaaaaggtttgcaaggctcctcagcaaaggggtttaattctaagtctgcccanganannttggccaaaacacaat

SEQ ID NO: 512327 - DNA, 885 bp, Homo sapiens
ccggcagtcgctgggaaataggcccccggggtgcggtggtggcggtgtgggccatggcgcggagaccccgggcgccggccagctccggggaggagttctccttcgtcagcccgatggtgaaatacctgctcttcttcttcaacatgctcttctgggtgatttccatggtgatggtggctgtgggtgtctacgctcggctaatgaagcatgcagaagcagccctagcctgcctggcagtggaccctgccatcctgctgatcgtggtgggtgtcctcatgttcctgctcaccttctgtggctgcattgggtccctccgcgagaacatctgcctcctgcacgacgttctccctctgcctcaccgctgtgttcctgctgcagctggccgctgggatcctgggcttcgtcttctcagacaaggctcgcagggaaagtgagtgagatcatcaacaatgccattgtgcactaccgagatgacttggatctgcagaacctcatcgatcccggccagaaaaacgtcagctgctgtgcacgcgcattcctacacaggacctggtctcagaacatgtattccaactgctcagacagaccaccccagtcgagagcgctgctctgtgccttactcctgttgcttgcctaactcctgaccaggcaggtgactcaacactaatgtgctggccaaggtatgcaggccttctgccaacttgcgacgttagcacagtcatctaccacccactggcccgcacttggaccaggtggagccacctggcatacacaacagcaccctcaatcctaacttgggagccgataggcacctaggccctggccatccccccaatgtaacttatccctggcgacacccttgttagttccacccacacctcgtga

SEQ ID NO: 512328 - DNA, 899 bp, Homo sapiens
  misc_feature (33)..(34): n is a, c, g, or t
  misc_feature (847)..(847): n is a, c, g, or t
  misc_feature (849)..(850): n is a, c, g, or t
  misc_feature (859)..(860): n is a, c, g, or t
  misc_feature (864)..(864): n is a, c, g, or t
acaacttacaggctaagtagcgaggccaggtgnntaatggagcagttcggcggtcccgcgggtctgtctcttgcttcaacagtgttgggacggaacagatccggggactctcttccagcctccgaccgccctccgatttcctctccgcttgcaacctccgggaccatcttctcggccatctcctgcttctgggacctgccagcaccgttttgtggttagctccttcttgccaaccaaccatgagctcccagattcgtcagaattattccaccgacgtggaggcagccgtcaacagcctggtcaatttgtacctgcaggcctcctacacctacctctctctgggcttctatttcgaccgcgatgatgtggctctggaaggcgtgagccacttcttccgcgaatgtggccgaggagaagcgcgagggctacgagcgtctcctgaagatgcaaaaccagcgtggcggccgcgctctcttccaggacatcaagaagccagctgaagatgagtggggtaaaaccccagacgccatgaaagctgccatggccctggagaaaaagctgaaccaggccctttggatcttcatgccctgggttctgcccgcacggacccccatctctgtgacttcctggagactcacttcctagatgaggaagtgaagcttatcaagaagatgggtgaccacctgaccaacctccacaggctgggtggcccggaggctgggctgggcgagtatctcttcgaaaggctcactctcaagcacgactaagagccttctgagcccagcgactttctgaagggccccttgcaaagtaatagggcttctgcctaagctttcttccaggcaangnngttttaatnntaanaggtggccatggggtaaagtttggggcaagaaaca

SEQ ID NO: 512329 - DNA, 925 bp, Homo sapiens
  misc_feature (33)..(34): n is a, c, g, or t
acaacttacaggctaagtagcgaggccaggtgnntaatggagcagttcggcggtcccgcgggtctgtctcttgcttcaacagtgttgggacggaacagatccggggactctcttccagcctccgaccgccctccgatttcctctccgcttgcaacctccgggaccatcttctcggccatctcctgcttctgggacctgccagcaccgttttgtggttagctccttcttgccaaccaaccatgagctcccagattcgtcagaattattccaccgacgtggaggcagccgtcaacagcctggtcaatttgtacctgcaggcctcctacacctacctctctctgggcttctatttcgaccgcgatgatgtggctctggaaggcgtgagccacttcttccgcgaatgtggccgaggagaagcgcgagggctacgagcgtctcctgaagatgcaaaaccagcgtggcggccgcgctctcttccaggacatcaagaagccagctgaaagatgagtggggtaaaacccccagacgccatgaaaagcttgccattggccctggagaaaaaagctgaaccaggcccttgtggatcttcatgccctgggttctgcccgcacggacccccatctctgtgacttcctggagactcacttcctagatgaggaagtgaagcttatcaagaagatgggtgaccacctgaccaacctccacaggctgggtggcccggaggctgggctgggcgagtatctcttcgaaaggctcactctcaagcacgactaagagccttctgagcccagcgactttctgaagggccccttgcaaagtaatagggcttctgcctaagcctctccctccagcccataggcagcttttttaactatcctaacaagccttgggcccaatggaaataaagctttttgatgcaaaaaaa

SEQ ID NO: 512330 - DNA, 189 bp, Homo sapiens
atccctgagttatggtgctataggagtaattgtcggacacgaatttacacatggatttgataataatgaaaatatgataaaaatggaaatcttgatccttggtggtctgtggactcagaagaaagttaaggaaaaacaagtgcatgattaaccagtatagcaacttatattggaggaagctggcttaac

SEQ ID NO: 512331 - DNA, 956 bp, Homo sapiens
  misc_feature (33)..(34): n is a, c, g, or t
acaacttacaggctaagtagcgaggccaggtgnntaatggagcagttcggcggtcccgcgggtctgtctcttgcttcaacagtgttgggacggaacagatccggggactctcttccagcctccgaccgccctccgatttcctctccgcttgcaacctccgggaccatcttctcggccatctcctgcttctgggacctgccagcaccgttttgtggttagctccttcttgccaaccaaccatgagctcccagattcgtcagaattattccaccgacgtggaggcagccgtcaacagcctggtcaatttgtacctgcaggcctcctacacctacctctctctgggcttctatttcgaccgcgatgatgtggctctggaaggcgtgagccacttcttccgcgaatgtggccgaggagaagcgcgagggctacgagcgtctcctgaagatgcaaaaccagcgtggcggccgcgctctcttccaggacatcaagaagccagctgaaagatgagtggggtaaaacccccagacgccatgaaaagcttgccattggccctggagaaaaaagctgaaccaggcccttgtggatcttcatgccctgggttctgcccgcacggacccccatctctgtgacttcctggagactcacttcctagatgaggaagtgaagcttatcaagaagatgggtgaccacctgaccaacctccacaggctgggtggcccggaggctgggctgggcgagtatctcttcgaaaggctcactctcaagcacgactaagagccttctgagcccagcgactttctgaagggccccttgcaaagtaatagggcttctgcctaagcctctccctccagcccataggcagcttttttaactatcctaacaagccttgggcccaatggaaataaagctttttgatgcaaaaaaaccaaaaagaaactccgagactagttctctcc

SEQ ID NO: 512332 - DNA, 273 bp, Homo sapiens
gccgggggggcccccccccccttttttttcccccttttaagaccccgggggcggttccccccccgggtttttgctttgggcccggggggggttacctttttcccccgggggcccctttttccctttggccctttttgggggcccttttgacccagttttttccaaaaacccggggggggccgggtcgggttttccggggtttttttgccccccggggccccccccggggccggggttgtttccaatttaaggggggttcccttttttttccca

SEQ ID NO: 512333 - DNA, 951 bp, Homo sapiens
  misc_feature (33)..(34): n is a, c, g, or t
  misc_feature (763)..(763): n is a, c, g, or t
  misc_feature (821)..(821): n is a, c, g, or t
  misc_feature (915)..(915): n is a, c, g, or t
acaacttacaggctaagtagcgaggccaggtgnntaatggagcagttcggcggtcccgcgggtctgtctcttgcttcaacagtgttgggacggaacagatccggggactctcttccagcctccgaccgccctccgatttcctctccgcttgcaacctccgggaccatcttctcggccatctcctgcttctgggacctgccagcaccgttttgtggttagctccttcttgccaaccaaccatgagctcccagattcgtcagaattattccaccgacgtggaggcagccgtcaacagcctggtcaatttgtacctgcaggcctcctacacctacctctctctgggcttctatttcgaccgcgatgatgtggctctggaaggcgtgagccacttcttccgcgaatgtggccgaggagaagcgcgagggctacgagcgtctcctgaagatgcaaaaccagcgtggcggccgcgctctcttccaggacatcaagaagccagctgaaagatgagtggggtaaaacccccagacgccatgaaaagcttgccattggccctggagaaaaaagctgaaccaggcccttgtggatcttcatgccctgggttctgcccgcacggacccccatctctgtgacttcctggagactcacttcctagatgaggaagtgaagcttatcaagaagatgggtgaccacctgaccaacctccacaggctgggtggcccggaggctgggctgggcgagtatctcttccgccagggtttttccnattccagaacctatgagcatctacgagccacagcgacgtctgaagggcctccttgctnaagctaatagagggatcctgccataagcttctccctccagccaaaaggcagctttcgttaactatcctaatttctctcggagccaatggcgatncttagatcacctgcaggatgcagctgcatgccctcg

SEQ ID NO: 512334 - DNA, 155 bp, Homo sapiens
tcatatacaatcagcctgtaccgtgctagctacaatagaattaaggtgacaaaaatcaaatcaataataaaagtttagtgctaccaataacattaccgaagagggtaaacagactttggggcgtaccatctttagaaggagagaagagcaagcag

SEQ ID NO: 512335 - DNA, 757 bp, Homo sapiens
  misc_feature (33)..(34): n is a, c, g, or t
acaacttacaggctaagtagcgaggccaggtgnntaatggagcagttcggcggtcccgcgggtctgtctcttgcttcaacagtgttgggacggaacagatccggggactctcttccagcctccgaccgccctccgatttcctctccgcttgcaacctccgggaccatcttctcggccatctcctgcttctgggacctgccagcaccgttttgtggttagctccttcttgccaaccaaccatgagctcccagattcgtcagaattattccaccgacgtggaggcagccgtcaacagcctggtcaatttgtacctgcaggcctcctacacctacctctctctgggcttctatttcgaccgcgatgatgtggctctggaaggcgtgagccacttcttccgcgaatgtggccgaggagaagcgcgagggctacgagcgtctcctgaagatgcaaaaccagcgtggcggccgcgctctcttccaggacatcaagaagccagctgaaagatgagtggggtaaaacccccagacgccatgaaaagcttgccattggccctggagaaaaaagctgaaccaggcccttgtggatcttcatgccctgggttctgcccgcacggacccccatctctgtgacttcctggagactcacttcctagatgaggaagtgaagcttatcaagaagatgggtgaccacctgacaaactctcaacaatgcgcctggtgggtacccgaagctctgaatatcgtaaatacataggtca

SEQ ID NO: 512336 - DNA, 966 bp, Homo sapiens
agagtgccccccaagaaggggtgccccatgctccgcgctctcacgatgttgtcccccctttcgcgggtttttccccccttgggagagagtttcgaagcgcttgaaaatccaaggtaagggcgttgcttcacattcccgggtcgccccagccatgtcgtggatgtccacgcacggagccggtcctgggcacgcgcctgttttttcagcggttctattcgtactcctctcctcggaaagtctcttgtgccgggagtcttagccatgtatctagccccgcctccccttttcgtgggacgtccaggttcaccggggggacatattgtacacaatagtatggacaaaacagcgcatttaaaaaccgaggtcttgtagaaaccagagagtgggcagacaaaatgcccgcggggtggtcattgcagataaaaaccagggagggcttataaaacagcggtagttctccccagcgggattcccccgacaggagtcccctcactgcgctcgggggtcttccgacagcagcccagggactagaccccgtgcgggtgaaacaccgcgcgagcaggttgtgaacgagcacccgccgaatgtggggcacacaccccgccagctccactcgagcaagccacacacccggccggggtggccaaaaaatacgttgctaccatcctagtgcgccccaggtaataaggaaacgctgcacacacccgggggagcaacgccccgccgagttcggcaagaaatgcgagacaccacacaagaggggggacatactgcggagaggaaacccatgctgccccacatatacaggagagagcaggatgacccgaagtaggcgtggttctggtaagacagacccccaggcatcagacaccgcgcggtggaggctgtgcgggactccggagtcaactgggactcctcctgggggcttttttttttcaaaaaaagaacccgcagcaaacaaaaaca

SEQ ID NO: 512337 - DNA, 918 bp, Homo sapiens
  misc_feature (33)..(34): n is a, c, g, or t
acaacttacaggctaagtagcgaggccaggtgnntaatggagcagttcggcggtcccgcgggtctgtctcttgcttcaacagtgttgggacggaacagatccggggactctcttccagcctccgaccgccctccgatttcctctccgcttgcaacctccgggaccatcttctcggccatctcctgcttctgggacctgccagcaccgttttgtggttagctccttcttgccaaccaaccatgagctcccagattcgtcagaattattccaccgacgtggaggcagccgtcaacagcctggtcaatttgtacctgcaggcctcctacacctacctctctctgggcttctatttcgaccgcgatgatgtggctctggaaggcgtgagccacttcttccgcgaatgtggccgaggagaagcgcgagggctacgagcgtctcctgaagatgcaaaaccagcgtggcggccgcgctctcttccaggacatcaagaagccagctgaagatgagtggggtaaaaccccagacgccatgaaagctgccatggccctggagaaaaagctgaaccaggccctttggatcttcatgccctgggttctgcccgcacggacccccatctctgtgacttcctggagactcacttcctagatgaggaagtgaagcttatcaagaagatgggtgaccacctgaccaacctccacaggctgggtggcccggaggctgggctgggcgagtatctcttcgaaaggctcactctcaagcacgactaagagccttctgagcccagcgactttctgaagggccccttgcaaagtaatagggcttctgcctaagcctctccctccagcccataggcagcttttttaactatcctaacaagccttgggcccaatggaaataaagctttttgatgcaaaaaaa

SEQ ID NO: 512338 - DNA, 983 bp, Homo sapiens
  misc_feature (983)..(983): n is a, c, g, or t
atgacccacacaatcacatgcctatcatatagtaaaacccagcccatgaaccctaacagtgtgccctctcagccctcctaatgacctctcgtgctatccatgtgattccacttgcattccattacgctcctcatatcgaggcctactaaccaatcacatgtaatccaatctcccaagtgattggcgcggatgtatcatcgagaaagcacaataccaaggccatcacacaccacctgtccaatagaaggcgcttcagactagccggggatgaaaccctagtttattacctcagaaggttttttcccttcgcagggattctgctgatgcggttgtacgccatcttccagacgtaggcccttaccaccccaatataaggtgagggtatttggatcttaactggttggtattaccaggtaaaaatgcccttagaaagtcccatgccttaaatcgacatccgcatttaatcgcatagggaggtatcgaatgcgcctgaggctcaccataagtctaatacgagtgacatactcggagtatcgccatgatgcatgcgatgtttactactcattttactgtgtctctactttttacctctctctgacttgcctccgaggtagttcgctggtctccctttctgcatttgccggtcggcgtctcacgggtcagcatttcttgtcagcctagggtttccgcgtgcttcacgttctttttgggttcaaattgcctcatatttggttgatccggcattagtattacattacgtccatcacatttgtttcgaaccggcgctgaactggctttggcacatgtgtgaccattttgggttctcccccttttgaggaggctcacaacaccaagagagcgcacaaaaattttttgcgccgcgcccaagattaacacatgtgggcggggcagaaaaaaaaaggggcagagaccaccaggggttcacaaaaccggcgccgtcgactgtggtatagcgcacacgn

SEQ ID NO: 512339 - DNA, 949 bp, Homo sapiens
  misc_feature (33)..(34): n is a, c, g, or t
acaacttacaggctaagtagcgaggccaggtgnntaatggagcagttcggcggtcccgcgggtctgtctcttgcttcaacagtgttgggacggaacagatccggggactctcttccagcctccgaccgccctccgatttcctctccgcttgcaacctccgggaccatcttctcggccatctcctgcttctgggacctgccagcaccgttttgtggttagctccttcttgccaaccaaccatgagctcccagattcgtcagaattattccaccgacgtggaggcagccgtcaacagcctggtcaatttgtacctgcaggcctcctacacctacctctctctgggcttctatttcgaccgcgatgatgtggctctggaaggcgtgagccacttcttccgcgaatgtggccgaggagaagcgcgagggctacgagcgtctcctgaagatgcaaaaccagcgtggcggccgcgctctcttccaggacatcaagaagccagctgaagatgagtggggtaaaaccccagacgccatgaaagctgccatggccctggagaaaaagctgaaccaggccctttggatcttcatgccctgggttctgcccgcacggacccccatctctgtgacttcctggagactcacttcctagatgaggaagtgaagcttatcaagaagatgggtgaccacctgaccaacctccacaggctgggtggcccggaggctgggctgggcgagtatctcttcgaaaggctcactctcaagcacgactaagagccttctgagcccagcgactttctgaagggccccttgcaaagtaatagggcttctgcctaagcctctccctccagcccataggcagcttttttaactatcctaacaagccttgggcccaatggaaataaagctttttgatgcaaaaaaaccaaaaagaaactccgagactagttctctcc

SEQ ID NO: 512340 - DNA, 944 bp, Homo sapiens
  misc_feature (33)..(34): n is a, c, g, or t
  misc_feature (756)..(756): n is a, c, g, or t
  misc_feature (814)..(814): n is a, c, g, or t
  misc_feature (908)..(908): n is a, c, g, or t
acaacttacaggctaagtagcgaggccaggtgnntaatggagcagttcggcggtcccgcgggtctgtctcttgcttcaacagtgttgggacggaacagatccggggactctcttccagcctccgaccgccctccgatttcctctccgcttgcaacctccgggaccatcttctcggccatctcctgcttctgggacctgccagcaccgttttgtggttagctccttcttgccaaccaaccatgagctcccagattcgtcagaattattccaccgacgtggaggcagccgtcaacagcctggtcaatttgtacctgcaggcctcctacacctacctctctctgggcttctatttcgaccgcgatgatgtggctctggaaggcgtgagccacttcttccgcgaatgtggccgaggagaagcgcgagggctacgagcgtctcctgaagatgcaaaaccagcgtggcggccgcgctctcttccaggacatcaagaagccagctgaagatgagtggggtaaaaccccagacgccatgaaagctgccatggccctggagaaaaagctgaaccaggccctttggatcttcatgccctgggttctgcccgcacggacccccatctctgtgacttcctggagactcacttcctagatgaggaagtgaagcttatcaagaagatgggtgaccacctgaccaacctccacaggctgggtggcccggaggctgggctgggcgagtatctcttccgccagggtttttccnattccagaacctatgagcatctacgagccacagcgacgtctgaagggcctccttgctnaagctaatagagggatcctgccataagcttctccctccagccaaaaggcagctttcgttaactatcctaatttctctcggagccaatggcgatncttagatcacctgcaggatgcagctgcatgccctcg

SEQ ID NO: 512341 - DNA, 866 bp, Homo sapiens
  misc_feature (33)..(34): n is a, c, g, or t
  misc_feature (548)..(548): n is a, c, g, or t
acaacttacaggctaagtagcgaggccaggtgnntaatggagcagttcggcggtcccgcgggtctgtctcttgcttcaacagtgttgggacggaacagatccggggactctcttccagcctccgaccgccctccgatttcctctccgcttgcaacctccgggaccatcttctcggccatctcctgcttctgggacctgccagcaccgttttgtggttagctccttcttgccaaccaaccatgagctcccagattcgtcagaattattccaccgacgtggaggcagccgtcaacagcctggtcaatttgtacctgcaggcctcctacacctacctctctctgggcttctatttcgaccgcgatgatgtggctctggaaggcgtgagccacttcttccgcgaatgtggccgaggagaagcgcgagggctacgagcgtctcctgaagatgcaaaaccagcgtggcggccgcgctctcttccaggacatcaagaagccagctgaaagatgagtggggtaaaacccccagacggccatggcgtggcatggccntggagaacccccatctctgtgacttcctggagactcacttcctagatgaggaagtgaagcttatcaagaagatgggtgaccacctgaccaacctccacaggctgggtggcccggaggctgggctgggcgagtatctcttcgaaaggctcactctcaagcacgactaagagccttctgagcccagcgactttctgaagggccccttgcaaagtaatagggcttctgcctaagcctctccctccagcccataggcagcttttttaactatcctaacaagccttgggcccaatggaaataaagctttttgatgcaaaaaaa

SEQ ID NO: 512342 - DNA, 753 bp, Homo sapiens
gagcgggctggggttcctccccgagccgccccagtgcccaagcttcctgcggctccgccgacaggtgccgcgccgactgggaactcgccaggtgcgtagtcccctgcaaggccatggtggtgcctggcgaggccgcagaaggcgggatgggcctgagacccgggcgccagagggggagtacagctgctcctgactccctaggattcccccaaacccatcacccagaacaccgactacgacgaacctgccggataaccagggagcccaaggagccgcaggacgcagcactgacgctcagcgaccgtatcaggagtagatagccacacagctacagaacggactccgctgggactactgcaggcgatggcgaccagacaacccccagcccccagccaacgacctccgaacagggggacacacattagcacaccagggcacgaacgccatccacgccaacggggacgcacgggcctgctagaccacgccctacgccagaaccaacaaccccaaggcccagacaagagccaggcacctgcgcagctacccacccacgaccacagcaagcgccccatcgaacgaaccgtcgacccgggcaccacgtcaaactacccacgacacaccgaccagcgtcgaacggcggacaacaccacagccgaccacccgcacgacccctagggaagaacgcccaagacgcaggcccaactagccgaaccgacacaatagcgcacccaaccatacaccaaccctggcaca

SEQ ID NO: 512343 - DNA, 307 bp, Homo sapiens
  misc_feature (16)..(16): n is a, c, g, or t
  misc_feature (46)..(46): n is a, c, g, or t
  misc_feature (123)..(123): n is a, c, g, or t
  misc_feature (265)..(265): n is a, c, g, or t
  misc_feature (287)..(287): n is a, c, g, or t
  misc_feature (303)..(303): n is a, c, g, or t
caccttcccgcatggnccccttccggccagaccgggccccttcagnatgaggaggctgcacccagggccaggcaccagttcgcttcaggccaccagcagcgggcacccccatctgcagttggnctcttctgctgctgcgccccggcagccagggtctgatgggcccagatgggcaaccactgcagctgggcgtggctgtgggctctgctgtggggcacacatttggtcacgccattacttggggcttcagtggaggaagtaattntaagcttcaaggcttaaaatantttccagggggcttanggga

SEQ ID NO: 512344 - DNA, 1234 bp, Homo sapiens
  misc_feature (221)..(221): n is a, c, g, or t
  misc_feature (639)..(639): n is a, c, g, or t
  misc_feature (1198)..(1198): n is a, c, g, or t
agcggaatcaacaacagtgtgcgaaaggcccaggcgcatcttatgcggattggaccaaagaggaaacacatagttgcacaatgatatcatactcttgcttggtaccaattgctcactacgtaagggaacctcccaccagcaaagtgccataacagagccagttccagggtcagtctggtgggcgggcgtcagttgctgtggtggccatgggtagttggagncaagatgtctcatgtgccccgtccctagaacttagcagatggagtaccattgcaacgtcccgcgatgaccagcgttccagcctgagacgcctcctcgggccttccgttaccagtgagctgcgcggagggtcggcgtggaggcacagacccagggatggcttccctctagtgggcgtcgccagccgtccaatgcgcaggatgcggcggggggatgcgcacgacattcattcgcaccgtggttctctttgccaccccaaccgtccggaacggcgttggcgccgacccccccgtggggacggcgatcctctgggagggtttcgtaggcacaggaacagcaggcgctcccccgttaactttaacgtggcctgtggaatagtggaggtaaaagtgcacaatcgcgatttgacatgaaattacnttcaaaagcagaaacctgacacttggtccctacactaagcactaggggatgtataagggttttctgcttgctcccctggagaagtggaggtgtccgaatcagttgaagaatgccttgggacacatggcacgacgaattctctcggataaatatgggcgacgcaagacaaggaaagcaagaatttcgcgttgggcacgtttagagcgaaaacgcacttttagttttcgcgccaagataatttgaacgggaaaaaaagaacaaattcaaaaaacaagcacgttgtgcaagggaaagataagaattggcgtcgtggacttggggctaaacggaattggaacgcaaaaatgtgggttacctagggcaattttgaatttacgtggtccttccaagttttgagagccaaacgtgggcccccaagggaaattgggcgccggttgggggaatttgaagctggttcccaaaacccccttcccacaagccttgcttggaaaacgattttgaaattcgagacttccttttgttaccacaggaaatcacgggaaccttcggggaggaccantctggaaaggtttgcggaagagcgagccccgtcccg

SEQ ID NO: 512345 - DNA, 189 bp, Homo sapiens
ccttcttttctctgcctaaacatcttcccacatcagatgaagtgattagatttaatgggtacagcacaccaacatggcacatgtatacatatgtaacaaacctgcacgtgtggcgcgtgtaccctagaacttaaagtatatattaagaaagaacttcaacaattataatatgtcaaaagttaatctagg

SEQ ID NO: 512346 - DNA, 660 bp, Homo sapiens
  misc_feature (14)..(14): n is a, c, g, or t
  misc_feature (75)..(75): n is a, c, g, or t
  misc_feature (349)..(349): n is a, c, g, or t
  misc_feature (456)..(456): n is a, c, g, or t
  misc_feature (530)..(530): n is a, c, g, or t
  misc_feature (555)..(555): n is a, c, g, or t
  misc_feature (596)..(596): n is a, c, g, or t
  misc_feature (608)..(608): n is a, c, g, or t
cagccctggccccncccctgccgccatgggtggcgcctccccctactgcctgcccagggccctgtccaggttgcncttgacggtgtcgaggaagtccgtggtgtccaggaagtgctcgtccagcttcacattgctgaggccgtgaatcccgcccgccaggcccttggtcatggctcccctctccaccgtctccccgcacacctcctccagcatctgggccaacctgatgaggtcttggttcccatccagcttcccccggtgctccaggccacgtgtcccggcaaagatgccggcgatggggttggtgctggtgggccggcccttctggtgctcccgacagttgcgggtnacggttccatgagcggcctcagcctcaatcgtcttcccatcagggcagaacaggacggacgttatcaggccaagggagccaaagccctgggccaggatgtttgattncacaactccgttatagttcttgcaggcccacacaaagccacccgaagacttgaggacctgagccaccatgttancaatgagccggtgctcaaaccagancttattcttgttgagttggtcttatagtgcttgttaaagancttctgggagangttcttgaaacgcccatcgtaggctttcagtttggtgttcttggtgctcatg

SEQ ID NO: 512347 - DNA, 445 bp, Homo sapiens
acccccactgggttcgagttcctgcttgtgtgagtgagagcggtctttttgtcacatggcagagacagcctgactgggcacattgaaatccgtatcgtttccccacctggcctgactggaaggaaaggcaataggggaacaatgtaacaaattgctgaggctcctactgactcaggtttacacatttagagagtccacaaggagaacagaaaagaatggtgggctataaggtactaggtacagggtgtgtttaccatgacatttcacttaaaagtaacacgaggacagctttttggtggaaaagaaggactgaactggtgaccttcatcgctgttcttttaagaagaaaagtgaagcatttcttgaggcctagagctgcagaaggacattccccatcgccaaggagaagaagaagcaatctgctagaacatttgcatgcagaaat

SEQ ID NO: 512348 - DNA, 360 bp, Homo sapiens
  misc_feature (22)..(22): n is a, c, g, or t
  misc_feature (329)..(329): n is a, c, g, or t
ccacgcgtcgcgacccacgcgntcgaaaaaaaaaaaaaaaaaaaaaaaaaaaaaaaaaaaaaggggggagacaaaaaaaaaatccaacaggggggacacacaattaagaggaccccagattttatgtgcaaaaaaggggtacccataatggcgagagcacgattattatgacgcatagaagacagggagctacgacgagtttatcaacacacgctgttcgaaggtggagaaacacgcgtggtagcggtagtgagacaactattggagtgatacagcagcccccttctaattctcgatggggtggtggccacaaatcatgcggggcacanacaacttactcatcatacagcagcgatttgt

SEQ ID NO: 512349 - DNA, 243 bp, Homo sapiens
gttcaccactgtctgcaccagtcttgtgcttttgcatatcagtctttgccgcctgcgcaacagggtgggcctagccctactagtctcaatctccaacaccatatggcctcagtactacgtacataacctaaccctcactccaatgctaacactaatcgtcccaacaattatattactaccactgacatgactttccagaaaacacataatttgaatccacacaacgggtcacgagctcgaatt

SEQ ID NO: 512350 - DNA, 165 bp, Homo sapiens
tgtgtcacttctataggatcccccgtaagtggaattcctccgcgcaaattcacgtccatgttgactttggattcggaaattgcggaactcttcggagcgggaactgctctggtgctgtctgccgcgaaagagcagatcccctccggaggcatcttccactatagg

SEQ ID NO: 512351 - DNA, 402 bp, Homo sapiens
  misc_feature (121)..(121): n is a, c, g, or t
  misc_feature (151)..(151): n is a, c, g, or t
  misc_feature (195)..(195): n is a, c, g, or t
  misc_feature (230)..(230): n is a, c, g, or t
  misc_feature (279)..(279): n is a, c, g, or t
  misc_feature (337)..(337): n is a, c, g, or t
  misc_feature (341)..(341): n is a, c, g, or t
aagagaacagtttggaagttcctgaaaaaactaaaaatagagctatcatatgatccagcaatcccactgctaggtatatgcccaaaagaaaagaaatcagtacatcaatgagatatctctnctcccatgtttactgcagcactgttcacangagctaagatttggaatcaacctaagtgtccattcacagataancagataaagaaaatgtggtacatatacacaatggngtaccattcagccataaaaacgaatgagagatcctgtcatatgcaacancctagacggaaatggaagcagaatgttaaattttgcatgtcctcacttatttgtgaangctnaaaaattaccataacttgaactcatgggaggtgaggtagaaagtaaaaagggacggttacc

SEQ ID NO: 512352 - DNA, 380 bp, Homo sapiens
tcagcacttggaggcaagacaggtgatcacctgaggtcaggagttgtagaccatgcctgaccaacatggtgaaaccgccgtctctactaaaaatagaaaattagctgggtgtggtggcacatgcctgtaatcccagctacttgggagactgaggcaggagaatcgtttgaacccaggatgcagaggttgcagtgagctgagatcgtgccactgcactccagcctgggtgacagagtgagatcccatctcaaaaaaaaaaagggaattgtaaataatactgctttgggcccctagtgtaaggtcagtgtctctaaaccttggggctattgacttcttggactagcattggtcgggggggtcaatccttctccccattatag

SEQ ID NO: 512353 - DNA, 496 bp, Homo sapiens
  misc_feature (117)..(117): n is a, c, g, or t
gctactttaagcctctcctcctgagcgggagaggctgtcaatgacccgcccattgcgttaagtgattggccttcttttctgcgcgcgcgtcggcaggctgcccagacagcctgcccncggcgcaggagagcgaacgcggaacagagacaaaaacggagatcgcagtcacggacaagacgaacgaccagcaagacagaaagaacgaaagacagacaacaggcagcaaaacagaacagccaaaaacagaagagacatgagcacaatatacgccacagaaaacgacacagaaccaaccacacagccccgctaacacaacggcatcccaagcgagcaacaaactgcgcgagccacccagcaaaaaacacacagttagacgagagggagacaagaacgcagcaacaccaaatggcggcgaccagccacgaccgaaacaacggcaaccgaagacaatcacacacagacaatgaggacaacacgactcgccacaacacaacac

SEQ ID NO: 512354 - DNA, 336 bp, Homo sapiens
ttgaccacgcgtcgccaggatggtctccttttggacctaactatgggacctgtacagacagtctacttggaaagaacagtaagcccagcctgcccggcagattttggtgctggacaatgctgccattgtctgcaactttggcagtgagctcagcctagtgtatgtgccctctgtgctggagaaactggactgaaggcaggtcaactgcactatgcctttcccccatcccaaggtggggcactggggattgcaactctttggacctagactggaggcaataggtaggcatctttgcagctgactcagaactgttgtctcctgactgtaataataaac

SEQ ID NO: 512355 - DNA, 887 bp, Homo sapiens
tccagaaagattcatcatctactaactggaatcaaggacactagttagatgttgtgcaccatggggaccattacatatgaccatacaagcactgaattgacaggttaatcataagacatggaaagagaagtgtctaaaagcttcaaaatgttccacttttttttccttcatggagacggttgttggctttcttccatgtgtgtttgtagcatttatttcagaaatgtgtatttccataatccagaggtgtaaaaccactagtgtatgagtggttacagcaacattgaaatggaaagctaaaagttaggattttatggagtatggagatagggtccagtatctatttacccgtgtaatgtttaggattaaacagtgttaagaagtttgtgaccatgaattagctttgcttttataaatttgctcatttagaaaatcaaaaatctggcaaaaagaaaaaccatgtttctttttgcttgtataactgtgttgtccttgcagcaacataaattgattcttggagctggcagacaagaatatccatataagattgttaccatttcagagagttgggaatttttaaacaggactactacggcaatccttttgccaacgtactggaaaaattaggaatattgcgctggtgggggcacaataaagtttggcatgaggtacggtttacgaatactgtatcggcggaaaggcggcggtgccgaatattccctaaccctatgacagctaaccataggatttcggggcccctcacgagaattactttgggccccaaacccttctctggggcgagcacaacggaacttgcgaccgggctcacagacacgcgcgttggcagtctccaaaacccgaaaggcgcccaaatatacctcaccggc

SEQ ID NO: 512356 - DNA, 346 bp, Homo sapiens
  misc_feature (341)..(341): n is a, c, g, or t
tagggcaaagctgccctcccattctattcaaagtcacccctgtgctcactgagatagatgcatatctgattgcctcctttggaaaggctaacagaatctcaaaagaatgtaaccatttgtgtatcacctatctgtgacctggaagcctcctccccacttcaagtcttcctgcctttccagactgaaccaatgtacttcttacatatattgattgatgtctcatgcctccctaaaatgtataaaactaagctgtaccccaaccaccttgggcacaggtcttcaggacttcctgaggctgtcacggacacatgtccccaacctaggcaaccataacccttttnctgag

SEQ ID NO: 512357 - DNA, 163 bp, Homo sapiens
  misc_feature (40)..(40): n is a, c, g, or t
  misc_feature (105)..(105): n is a, c, g, or t
  misc_feature (117)..(117): n is a, c, g, or t
gcacagagagcctggtgggttccttccacaccacactctntaccccaccacactggctgccacactaacagggatgctcagagagaccttccacaatggtctttnttccctgatttnaagccctctgaaacagtttttaaaatagtattttggctcggatatc

SEQ ID NO: 512358 - DNA, 107 bp, Homo sapiens
ggtcccacaggtgctgctacacaaccataacaatcttaaagagggaaaactgccagaccagatgttttagctacagccccgtgtcagggttgcacggggaatctcgc

SEQ ID NO: 512359 - DNA, 806 bp, Homo sapiens
ggacggacggagcgcccccgcccccgaccggccgcccgcccgccgccgccatgcccttctccaacagccacaacgcactgaagctgcgcttccctggccgaggacgagttccccgacctgagctgcccacaacaaccacatggccaaggtgctgacccccgagctgtactgcggatgctgcgctgccaatgagcactgcctgagctggcttcactgctggacagacagtcatccagaacagtgcgtgtgacaaccctggtgccaccctgtacatccatgacccgtgggctagcgtggccggtgctgactgaggcagtcctgacgcaagtgttcaatggatctcttcgaccccgatcatacgagggacctggcacaggctgtgctacaatgcccaagcgactgcagcacaatgacctgacctcaacccccggacaacctgcacgggcctggctgacagaccttggaacccacagactaccgtgcatgacgctacgcgagcgttgcagcgacaggagcctgccacgcataccagtaggctttcatgcactcccccacacggcgcacatcgcaacgcccgcgggtgagacagcagcccagaggcgcacaatcagacgaaagcctcaggcgggatgggacagccccttgatccaaggccttgcgacctggcgcgaacccttgcgcgagtgcccccggacgtacctaacgaccggcctcaaaggaagacaatggacccgggaagcgccgggagagccaaggcaggcacggctcaatccgacacgagcgcagctttccctaccttccgacca

SEQ ID NO: 512360 - DNA, 129 bp, Homo sapiens
  misc_feature (102)..(102): n is a, c, g, or t
tagagctctgttttgaagccatggatggatttccttgttaaaagctgttgccaagcttccctgatagaggaggagacagctgttgactacatgatttcttanctgtgttgccgtgggcacgcgatgacc

SEQ ID NO: 512361 - DNA, 987 bp, Homo sapiens
gtgcccctcatctgaaatacaatatggtagcgtagcagttccactgatactcagttatctcaggaatacattgaggatgaggatctgctcaaggactcctcatcatgccttgcctctaattaatagccgggaggcatcggaagtacatgacgttagtctcgtctggtcaattaatcacgattattccttattaggccatcaaacaaccgctccccttgtaatgtcccatatcagtgtagtctcattggccggacatgggttctttggcactggtcgtgcggattgactagatggggatgtggctcgtaggtcgctcttagcataaggtcatccagactcattctcgaacctacattattggtgaacgtcaaacgtagcggatacctagtagaggcgtaagataactactccaagagtgcgtaagaacctaggtcggtcgccagatcgagagttgactactttacgtatcgcatctcgagcattagtacggttgtccacacagaacacaagataaccatagagagatgttacacacacaaaacttatggtgcagtcgaagtggcgaccagagaaacacaaaagaagggccatcttgacgaaactgcaaaagggaggaggaggtgacaggcgaaaaatttacatggggggagcatgtactgggcaagtgggcgttaacatgtgggagatgaaccgcaaggggaacgatttatatcctggggtgggcggatggacaccaggagggtggacgagtatagtggcttgagccattccaacaaaggataggttcctagcgaggcgcatgtgaataagggcagggggttccttacttgagaggcccaaggggtttccctaaaggaagagcggcgtataccatttttgacgcgggcgccaaagggccctgtgggcgacccaaagttaacccaaaacgcgaaacgtggagattaccctgcaacacttggcaagtttaaaaccataggtaccccacgg

SEQ ID NO: 512362 - DNA, 122 bp, Homo sapiens
ggatggccaaaagcacctggagatcaaccctgaccaccccatttgttggagacgcttcgcagaggcttaagccacaaggattataggcaggtaggacctgtggcctctgtttaaacccccct

SEQ ID NO: 512363 - DNA, 120 bp, Homo sapiens
gcagatgggcacaggtaggagggggcaggtcatggaagggcacagttgtttacaaagccattaaaggagaatgaatagatctagtcctggttcccaaacaggcaaagaatatgtgtaatt

SEQ ID NO: 512364 - DNA, 598 bp, Homo sapiens
agaatccaggacatgaagccaggagctctccacagtcaacatgatggacgagttggccagatatgccaggctgggaaacgaaacgatcaacaagatgaccggataagctcaaaagccatgtgaaacgctcggacagctcaattagccaagatacaaatggggtgataagtgtcgctttctacgtattggcaggctgccctgatgatctcactcatttggaagtataattctgtccctgtggctgtcgtagcccgagtaaatggataacccctctagaccggcctggtaccctttcctactagagtagcaggtaggtagtggaattacctgtgggattacagtctggtaacaaaagtatgtcgccaattgtgctccatcccgttccaacctgaacaggaaggcatgcgcatatacaggcccgagtagggcttaaaaaaaggagaatttcccttttatacctaagctttaaaaaatctgcgatttaaccacggggtcgcgggacatctcgtaagagaacacaccacagggtgtgccatatcgcactagagcaacactcttccacagagtgcgcagaacaaaatactgaggccacttatga

SEQ ID NO: 512365 - DNA, 283 bp, Homo sapiens
gcctactactactaaattcgcggccgcgtcgacaagaatgtatcctatagattctccttcacaagtttataagggcttatggaaaaagggttcatcccaggattgtttataatcatgaaaaatgtggccaggtgcagtggctcactcttgtaatcccagcactatgggaggccaaggtgggtgacccacgaggtcaagagatggagaccatcctggccaacatggtgaaaccctgtctctactaaaaatacaaaaattaactgggcgtgatggtgcacgcctg

SEQ ID NO: 512366 - DNA, 460 bp, Homo sapiens
agaaatcagtgcgccattggatcgagtaaggatttaattacaagctcacaagtcaccattacaagcatagaggtgagtcaatagatgctaaagataaaaatgaatgaaaatatcgtggaaagtgggcaaaaaaagggaatttacgttcgggggtgtcaaaagtaaagtagaggctcctcttaaaaaactttttgccccatgtaatcaggaataaatagtaacttctctcagaagcgaaatttatgcagagacctgtgctaacatacttaaatatttgctagccatgattggtaaatcaatgtgcgcgatgtacttagctcccacaattaagcctaaatattcgccctggcatgcttattcggctccaagcaagcattaggtcatagctcgttccgtgtgccttatctacaggtgtaccataattaccttccccagcataccacaggttactttctccttc

SEQ ID NO: 512367 - DNA, 357 bp, Homo sapiens
caccgccctatcatacctaccttgagcccacaacaccgcccttggatttgtttacttgggggaagtgacgcccatcatccgcctgctggtatagggtctcatggaagaggatgacacccccaatgcaggagctcacgcggtcgtcagctgtcagcagcagctggcgacagaagcgcggattctcctcggtgttctcggctccaatggactgcagccgattggcaatgctcccagaggactcatctgcagccagtatgcccttgccaggagccacgatgcggtgagcgatgtcagacagctcatgtttctgctccggggtcagtgctggatattgagaggtatgatgaaggacggatg

SEQ ID NO: 512368 - DNA, 132 bp, Homo sapiens
tccctcaccagacagatgtggattagaagcatttgcggtggacgatggaggggcccgactcgtcgtactcctgcttgctaatccacatctgctggtggagggaggctgtggaaggaggctggtggaagggag

SEQ ID NO: 512369 - DNA, 127 bp, Homo sapiens
gattcctgttgcttgtctttagagtttcccggaacagcgcaacctgccgccaccgtggtgaccgtgattgccagtcctctgccggtgcgcccagagccgccagtgaggtgcccggccgggggccagg

SEQ ID NO: 512370 - DNA, 583 bp, Homo sapiens
  misc_feature (45)..(45): n is a, c, g, or t
  misc_feature (184)..(184): n is a, c, g, or t
  misc_feature (189)..(189): n is a, c, g, or t
  misc_feature (196)..(196): n is a, c, g, or t
cctttagctccatcttagttcgggggggtgaaacataatctcatntcctccacccgagaccccttaagcaccaaccctattcccccgcgcggccccttattcgctccgacaagatgaaagaaacaatcatgaaccaggaaaaactccccaaactgtaatcacattttctcagtgggggggaagnaactnctcgcanaacgaagaaagaggttcataaaacatccacagtatgtgacaaaaaacttcatttctccttaaagaagctaggggcaaacaatatctcttgtattgaagaggttaatatgttcacaaaccaaggaacagggatccactttaacaaccctaaaggtcaggcattctctgacaacgaacaccttcaccattacaggccatgcttatactaagcaccttttataaatgctaccaatcatcttaaaccaacttgctccaaaatagttttactagcttaagcaaaactgaccaaagacttcgccaaacaatcttgggtttgaaaatacactacttgcttctttaaagttttatttatcataaacttccagatctctcgaaactcttaacatct

SEQ ID NO: 512371 - DNA, 601 bp, Homo sapiens
  misc_feature (334)..(334): n is a, c, g, or t
aaacccaagcccatgacccctaacaggggccctctcagccctcctaatgacctccggcctagccatgtgatttcacttccactccataacgctcctcatactaggcctactaaccaacacactaaccatatacccaatgatggcgcgatgtaacacgagaaagcacataccaagggccaccatacaccaccttgttccaaaaaaggcctttcgactacgggactaatccttatttaattaccctcaagaagtttttttctatcgcagagatttttcatgagaccttttaccaactccaagcctagccccataacccccaaattaggagggcacntggaccccaaacaggcatcaccgccgctaaatcccgctagaagtcccactcctaacacaccaattccgtattactctgcatcaggagtatcaactcacctgcagctcaccactagtctacatagacaacacaaccggaaacccaacatacattcacagcactgcgttattaacaacttttacctgggcgtctcctacttttaccccatccttacaaagctctcaagagctaccttcgcagctcatcccattccaccaatcttcccga

SEQ ID NO: 512372 - DNA, 188 bp, Homo sapiens
  misc_feature (58)..(58): n is a, c, g, or t
catggctcaggcggctagtgcagagcccaggtgctggatgtagtccaaaatcgtccanggagggtgcccgccgttgatgtagaggacataggtgaagccatctttgaggacccctcgaatggagacctaattgggctgatttgcctgctgctgctaggaggaggcctaatagtggggtgaggcttgga

SEQ ID NO: 512373 - DNA, 1516 bp, Homo sapiens
  misc_feature (577)..(577): n is a, c, g, or t
  misc_feature (998)..(998): n is a, c, g, or t
tcctgtattgatagctgcgtctggtgtcggtccgttacgtgttgtgacactcctgcttttgttgtattatatctacttttgttatgttgttatcgttgttggcgtccgctcttctgtgtggttgtgctgatccacgctatcatgtgtcgtgcagtctccgcttgttcggcggtcgggtgcacaaatggttggtattgttctttctgtctggcttcagggtgtgctgttttttcaccccgcgtggttgtgttatccctttttagcaccgtctgctcgtatccccggggtgtaacttctttgcgtatggcgccccacgcatcgttctgtggtgaccttctttcctccgggggacacaatgtggggctgctactaatcttaacaaaagtggttggctctcctctaagggttgttcttcgctctagggcagaaccactgctcgtgggtggtccacccaccagattgtgctcctcccccccccttgtgagctaccacggctgggggtgttttaccttcgctaccaacggggtggtgttttctcccttggtgtcaccttctccgcggcgcctcatttttgcgntgcctcgctgctaatttgtcccccctccttaattgtttggggttttgccaccacccccggggtcttcaccacctgtgggcacagtgagccaggggttgtgcttcggaggcgctcgacagggggagaaggggtgtgtgtttccccccgcttttttggtttacaaacgcctgtgagagagtggcgccccctccgtaatgtttctcttgcgagtgttctcgtgtgggatccctcgcgccccccccttgttgggatatagggtgttccccctggcgcacaggcccccactcgtggtgtttttgagagagagcctttttttcaccagactcagtgtcccccctcttggggggttcactctctgttgggtcgtgtttccgtggtgagatagtggagggacgcacacacgcactctgtctctcgggtntgggttcacactctcaaacgccccgttggaccacacagagaggggcgctgctctgtagaggaccttcgcacacgggctctcccccaaagttctgttcccccccagaaaagcctccacagaagaggcgtataaaagtggagatatttatactcccttatatatcctcgtccaccccccacttttttaaatccactctgtggtggaagaaccgcgttttcacgaatcctctgtttgtgttctccaattgtgcccatcattaagagtttatggtaggtaaaaagaaactgtggttaaatggaataacccacagtgcactcttgttaacccttcacgaaggaaaaggaggagaatgttcttggtggagcccccttgtgtttttttttttggcgctgtggccacttttaagttatattatggtttttgtaaaaccacgcgatacttttttaatgggaacccaccttgaccccacaaatttgtccccgaaattttgggaccccctttaaaaaatttaaaggaga

SEQ ID NO: 512374 - DNA, 348 bp, Homo sapiens
acactacataattattcattctaaccttcgcagaggtacatgattctgtctaccagatattaattttacagtgaccactaaaggttatttggttgttacaacgactacaattctgaatatactacattgtgctaaattttgccattattaatatcaaccaatcacagaagatacaacagatgtgtttctaatgcacgatttactttctagattcccttgatattcaatgctatttcacttcgttcattattttcaatcatctagacacctgttacaaatgaggaacaaatccagaagagcctatctgatctcgtctgaagtggtcccttatatactattggagcctac

SEQ ID NO: 512375 - DNA, 952 bp, Homo sapiens
  misc_feature (59)..(59): n is a, c, g, or t
  misc_feature (95)..(95): n is a, c, g, or t
  misc_feature (108)..(108): n is a, c, g, or t
  misc_feature (127)..(127): n is a, c, g, or t
  misc_feature (129)..(130): n is a, c, g, or t
  misc_feature (132)..(132): n is a, c, g, or t
  misc_feature (136)..(137): n is a, c, g, or t
  misc_feature (139)..(139): n is a, c, g, or t
  misc_feature (141)..(141): n is a, c, g, or t
  misc_feature (146)..(146): n is a, c, g, or t
  misc_feature (153)..(154): n is a, c, g, or t
  misc_feature (166)..(166): n is a, c, g, or t
  misc_feature (173)..(173): n is a, c, g, or t
  misc_feature (188)..(188): n is a, c, g, or t
  misc_feature (211)..(212): n is a, c, g, or t
  misc_feature (234)..(235): n is a, c, g, or t
  misc_feature (286)..(286): n is a, c, g, or t
  misc_feature (292)..(292): n is a, c, g, or t
  misc_feature (296)..(297): n is a, c, g, or t
  misc_feature (313)..(313): n is a, c, g, or t
  misc_feature (316)..(316): n is a, c, g, or t
  misc_feature (325)..(325): n is a, c, g, or t
  misc_feature (336)..(336): n is a, c, g, or t
  misc_feature (340)..(340): n is a, c, g, or t
  misc_feature (342)..(344): n is a, c, g, or t
  misc_feature (346)..(346): n is a, c, g, or t
  misc_feature (351)..(351): n is a, c, g, or t
  misc_feature (360)..(360): n is a, c, g, or t
  misc_feature (364)..(364): n is a, c, g, or t
  misc_feature (373)..(373): n is a, c, g, or t
  misc_feature (383)..(383): n is a, c, g, or t
  misc_feature (385)..(385): n is a, c, g, or t
  misc_feature (409)..(409): n is a, c, g, or t
  misc_feature (415)..(415): n is a, c, g, or t
  misc_feature (417)..(417): n is a, c, g, or t
  misc_feature (421)..(421): n is a, c, g, or t
  misc_feature (423)..(424): n is a, c, g, or t
  misc_feature (446)..(449): n is a, c, g, or t
  misc_feature (459)..(459): n is a, c, g, or t
  misc_feature (506)..(506): n is a, c, g, or t
  misc_feature (528)..(528): n is a, c, g, or t
  misc_feature (866)..(866): n is a, c, g, or t
  misc_feature (883)..(883): n is a, c, g, or t
  misc_feature (887)..(887): n is a, c, g, or t
  misc_feature (930)..(930): n is a, c, g, or t
ttggcccatgagactgatctatagtaaaacactctaagaaatgcagtccaattaaaaanacttccaagaatccctagaaaagaaagtcacaatgnacaatgaggaaanaaaggaatcactactacantnnanatannangnaagtntcaatannctttagacagtngtaaatncacctgtcccttaanatttgggtttgcttttttttctnngccatggtaaatggttttttanntgttctttttttttttgttactctgctgttacatggggcatagctttttcncggggntttnngggggctgcggtcaanggntggcgacgnacaatgggggnccancnnncnaaatngcggtcacngggngggcggggngccctctcgngngggcgcaaatctgcatgggggggngctagngngttngnnttgggcttgtgtactttagttnnnntcccctttcnagtgtattaagagatggcatgcactttaatttgccaaaagcgatgcntgtgttctggcagcgacatgcnacttctatcacatagtaaagtgaataccagaactacaaaggcaggaggtgtaagtgaatttttattgggaggggaggttggcaacttaaacagcagcaaataaagagtgaataaggaaactccctgttgccacagatacacaagacctccgtatgtgatacaggagccatttcaatttgtgacccctagacagagatggcaagtgctttttccattcaatctaatacttccggattcctactaaaaaggaatacattaagagcatggaaaagttgcttactgaaaggaaacccccgaagagtaagggagggaatgtagaaattaagaagttatgtggnatactctttaaattgtnattnactacatttttcttattttcacagtaatactaaacacagtcanttgcagaacttggttcagatac

SEQ ID NO: 512376 - DNA, 153 bp, Homo sapiens
cgaggcccctacccgacaataaatagtcaaggtcggggaagataggtgaccccatagtacgcagccggtgagaaaccaggggagggaccggcacactaggggatgaatggctagtcagcctccctcttcccccgcaggaagaggtcagcgtag

SEQ ID NO: 512377 - DNA, 148 bp, Homo sapiens
gtggtgaaggtgaagcctaacgacaaggatgctaagatgaagtaccaagagtgtagcaagattgtgaaacagaaggcctttgagcgggccatcgcgggcgacgagcaccggcgttctgttgtggactctctggacatcgagagcatga

SEQ ID NO: 512378 - DNA, 171 bp, Homo sapiens
caatggcattcattcagttccatcaggtcatccacctttttttcaaccagcacatgtcttgttccctctgcacatccatcacttgtgcacagcgtcgtgccacattgtccatgcagcacagcatgcattcctgtgtcatgcttcttccatcccatgtggtttcattcacac

SEQ ID NO: 512379 - DNA, 137 bp, Homo sapiens
cccgagatccccatacagagtagataaagagttgttattctagaaaatagactactgaaggagaaaggctttaataatattaaaatagggcagtaatgcttttcatagtatagtaagatttggctaataccatctta

SEQ ID NO: 512380 - DNA, 441 bp, Homo sapiens
  misc_feature (256)..(256): n is a, c, g, or t
gtctcttactttcatgcagtgaaatgatctgaccgctgaagaggacgggcataacacagaaagacgagaagaccctatggagcttgaatgttacttgaatgcacagacaggtaccgtatacgaaaccgcgacagggtccgtaagacataccgaaaccgtgctaattgatgaagacttctccgggttgcgggcggacgctcggcagacgaaggaacccgaacgcttcgcgcaggcgagtaagcatgactagagcagntttcgactcagggtcagagagacagatacatacatgatgagctctacattctgaatcctaactgagacattgacgcaagcggcagactagagttagccgcctaggtgataagctagcgcaatcctgattctagagtaccatgatcgagacaataagggtttgactgaccttcgatgtagaataca

SEQ ID NO: 512381 - DNA, 273 bp, Homo sapiens
aatgtataacgtggaaatccccgggaccaaatttttgcaaaggccctgccggatggttccataactgtagagtctaattgctatcccttccagaaattaatcgttcagttgaaaaaaggactgatgccttttcaaaacaaatgaacccccgtagctgacaaaaaaccgtatcgtaaaggtttgtagttagggcttatttttgcatgttgatgttgcctagctaataaactgtaaatgtaaaccctgcgaataaaatggttttttttttcccca

SEQ ID NO: 512382 - DNA, 362 bp, Homo sapiens
gcccgagtagttgctatctgtggtaggttaagtgtttgaattaaaaaaaaaaaaacccgtaattccttgtgaaacttcccaaggccctgttccccttttaagttggagaccgattattcccagaaataggaaagataatcctaaatcttagtcaattttttttctccacacagattttaaaaagtgactagtaagggagaattttaaaaatttagaaaacctggagggaaagaaaaaagagggaaggaaggagagaaaaaaggaaggaaagaaggaagaaaggaaaaaaaagaggaagggagggaggagataaaggaaagaaaaggaaaagaaaaaaggccgaaagaaaagagaaagaaaga

SEQ ID NO: 512383 - DNA, 102 bp, Homo sapiens
  misc_feature (71)..(71): n is a, c, g, or t
ccactgcagttctgactcaggtggggaccccttcctcactctgctcttggttctaagttgtgttttctctnttccccaatctttgggagtcatattttcata

SEQ ID NO: 512384 - DNA, 379 bp, Homo sapiens
gccattctcatcccccttataatattctcagcacagccagcttacccttctttctcttgtgctatattcttcttggaagtggtgtaagacttcttctcccttttctaagcaccaccacgaagtctcaccacaagatgaagagtagcctccttttgaatatggtagtcagccaaagtacgtccttcttccaggtgcttgccaccaaagctcagtctctgctgatcagagaggaattcctcccatatcgtgtatcttggcctttacattctctatggtatcagagggttcaacctagagggtaatggtcttccctgtaagggttctcacgaatatgcgcattgtggtggcggctccagcacagctcgtgccgtattcgtac

SEQ ID NO: 512385 - DNA, 1000 bp, Homo sapiens
  misc_feature (1)..(1): n is a, c, g, or t
  misc_feature (86)..(86): n is a, c, g, or t
  misc_feature (90)..(91): n is a, c, g, or t
  misc_feature (133)..(134): n is a, c, g, or t
  misc_feature (137)..(137): n is a, c, g, or t
  misc_feature (141)..(141): n is a, c, g, or t
  misc_feature (145)..(145): n is a, c, g, or t
  misc_feature (154)..(154): n is a, c, g, or t
  misc_feature (156)..(157): n is a, c, g, or t
  misc_feature (159)..(159): n is a, c, g, or t
  misc_feature (162)..(162): n is a, c, g, or t
  misc_feature (170)..(172): n is a, c, g, or t
  misc_feature (177)..(177): n is a, c, g, or t
  misc_feature (188)..(188): n is a, c, g, or t
  misc_feature (202)..(202): n is a, c, g, or t
  misc_feature (207)..(207): n is a, c, g, or t
  misc_feature (209)..(209): n is a, c, g, or t
  misc_feature (212)..(212): n is a, c, g, or t
  misc_feature (214)..(214): n is a, c, g, or t
  misc_feature (222)..(222): n is a, c, g, or t
  misc_feature (225)..(225): n is a, c, g, or t
  misc_feature (237)..(239): n is a, c, g, or t
  misc_feature (243)..(246): n is a, c, g, or t
  misc_feature (425)..(425): n is a, c, g, or t
  misc_feature (485)..(485): n is a, c, g, or t
  misc_feature (529)..(529): n is a, c, g, or t
  misc_feature (717)..(717): n is a, c, g, or t
  misc_feature (750)..(750): n is a, c, g, or t
  misc_feature (843)..(843): n is a, c, g, or t
  misc_feature (899)..(899): n is a, c, g, or t
  misc_feature (918)..(918): n is a, c, g, or t
  misc_feature (971)..(971): n is a, c, g, or t
nttatggtcttaaaaaattctccactgtaacttgaattttcccaagaaactggcttgtgctttggcagcttcaccttcatacttgntctnntcactcacacaatcaatagagcaccaaacctacacagcaaanntanattntttntttatatanannantanaatttgtnnnatatnttttgttttgnttattttgtttttngttantntantnatgtatcnttnaatttaaaaaannncttnnnnttctcaatacttcaaaaaggcctggaaatttggcataaccttgtttgactgtgtgctttgaaagtaagtgatcaaaaaaagaaactctaaaaaaaaaatagaagtaggtggtcatggtcagtgccagtggggctgggaggcaggagcaagtggcggaactcaaaaagaagaagttagcntgaagtacatggcaggataggggtggggggcctcgctgcctggcaccccaaaggaaagcngtgagtgaaaataggaacctcggcttaaaaggctaaatggagtncagttcagctgtagcgggggaatactattcagtacacagccatggattatttttcttctctttgtctcttttcagagtttgttagcctccagcctgggagctctgggactggagcagctcagccgccgtctttctttgcttgaaagcattcacttcatcatccagggatttcttcttatcctccagtntcttcttctcgtcctggtgcagtttcttcaganggtcaaacttctcgtgcagctctttctctgcctctttgagctccgcttctttctctttgactcgctggacgaacatctgtttcatctcctctncttttttctggagtcccctaggaactcgttccttttggcctcatatgtttactgtnaactgaagggtttgctgtnagggtcggtgttcttgaagcccatttcctccagcttacagcggcgatacagcncatagtgccgggtgtgggtgttctcccgc

SEQ ID NO: 512386 - DNA, 126 bp, Homo sapiens
ttgtacggtgtacgcacttgtcacacgcggtacgacacttatatgttgttcatgttatgtaacacgtctaaatctgacccgccgtaggaacttggctgaagtaaattgtgatatgttcacaccagc

SEQ ID NO: 512387 - DNA, 406 bp, Homo sapiens
  misc_feature (400)..(400): n is a, c, g, or t
  misc_feature (406)..(406): n is a, c, g, or t
tttgctcagactatggaagtgaggttttttaaaggcaagtgtattaacgtggtggtattctgaaggcaatgattcagcacagagggaaagatgattatgaccatctaatgtccaaagattatgatcatctaatttcaaagatgaaatctttgccttgtgcttcattttattttttcttttaatttgttttgtgcttcattttagacgagcagctttatacttactacagactttatcctaccctaaatgtaataaatctaatacttttctggggatatcttacaactagtggaaataaggtcattcttcatatacatgatgcattgccttaaattcagatactgccctcctacttaaacataactattgtatgttgtgtatgtcacttatggtaattggnaatcan

SEQ ID NO: 512388 - DNA, 290 bp, Homo sapiens
aaagagtgttcactgaatgcatcatgtgtaaaaatgcaattatcatttcacaaccacattaaaagggaaaatacctaagaggtgaacttttaataaaattatttgaaacaatctcaccctgcacataaaaatacattacttgtatatacatgtagatctctacatgaaagaaaagattcagcttcaaatagaaaaaggctgacccttgataaagacatattagattgccaaactgatgtgattaccactgtaagaactaaaaacataaagataaaaagattaatttaaac

SEQ ID NO: 512389 - DNA, 217 bp, Homo sapiens
aggtcagaatgtaacttccttgtcctcacctcctcaccctaacatcagcaacaagagttccatcctactttgtattcacctttactataatcactcatcacactgtcccacaatcattgtggatcatttaactgcccctctatgacctgactactttgatggcagtgactatgtcttatgcatttccatatacctaatgcctcaataactgtaaagt

SEQ ID NO: 512390 - DNA, 865 bp, Homo sapiens
tgtccggataataaccgatgagtggggagtgaggagtcgatggacgtcgcgactgaccactttgtcagagtgtcacctcccatgtgcagtgaaaccaaccgtgttgggcacagcccctgttcgctgcgcgtttgtcacaccttccggggccccatgtctcggtgccccgtaccaaggttgagacgcaccgaccgtgccggggctttctccataagacggtgttcaccaaactcttgtttgcgccaaaccaccgcgcattttgtcaagttctaacgcggtcctattcttcccctcggggggtcgttcacgattttcccaacgccgcttagtgcatgctgttcgttgatgcaccccccccaggcgtgtgggcgtccaaaagtcgcccctgtgtgtcgcggccccgtatcaaaagtgctgcttgtttaatacgccgctggtaagtgagttctccctctctgcagacagttgtgtggatatggtctccccccaacggggcgcatgtctgcattccctcccggggcaccaccacgtttcatttcgagcaaactcaaaaaacacaccccactattgggtcggagaaccacaccctctttgtggcgaacccttgtgttgaatctgaccaagaaccaatcacaggttccgtgcgccagatcctcccccgcttcaaggggctccccaacgcctcatcactcatggtgagtggtctaaaagcaatacaagcctttctggggcacagcttctcccagaatattttctggagactcgttgtaagagggctcccagccttaagatctatgaacaggcgggggaagagggtgtacccattcttcctgggccccaaacggcaaatttcccccacaatgac

SEQ ID NO: 512391 - DNA, 892 bp, Homo sapiens
gaagatggtacatgcggtctgcggccgatccgtccaatgagtcttatagtaatggactggtaacagatctctgtgtcggagtgcattgttcggaccggcggtataagcatctctggcaagcagggccctcgagaggagcgaagatcgggacttggctgtgcataaaggacattctgcggccatgcatgggagacacaatgacgaactgagttgcagatacccttcagttgcacgcattgaacttacctgtggacaaaagaatgaaattaccaatcagagaggccatcagtaacgggagacagcaatgtgcctccattggatctatggaagactacctacgatggcacatggtcttacctagcaaattgacatgagcgtcggtgagctttagaaaccttttaccacgagacgtgcgatcgattaacaataactatggtcccaacgcgcatgacttacacgcgatcgcacattgtgaacgccgcgatgaggctaggctttgaacaagggctgcgaccttgtatgaacactgcaaaggagaacctgtcggaaccccttagtatttagggacaaatttggacacggcacgggcgagtctcacgcaccgatccactgcctaaagtgtagcatcgttcgagatcaagagagcatcccccaattgttggcacgttccatcgccgcatcactggccaatggtggtttgtcaacagttgcggaaacaggccacataattccaaacgtaagaccacatgttgtggttgtcgttcataaggacgtgtaccaatcctcaaaaaaatgggcgcgagctgtggcatgccaaggtccttggaaccgcatccgtcaacagagttccaacacattaaaaactcttgatgccaccctggcaacacaatac

SEQ ID NO: 512392 - DNA, 132 bp, Homo sapiens
taatcaaaaccacaaattatgtcagcaatatgcactaagaggctggagaaacctacgcgtccagaattgttggcctcagttctcttatatgtcagatttagtccttcacgggttttgcaggggtttattcta

SEQ ID NO: 512393 - DNA, 187 bp, Homo sapiens
cataccccagttatgggacacacacacagatgcacacacacaccatgctgcgtactgacaaacacagcctcacatcacaaacacctcacatcacacactaagcacaattacacaccacacactcacatccataaccacacacacaccatgcacgtagacacacacatcacacatatacacacacaca

SEQ ID NO: 512394 - DNA, 336 bp, Homo sapiens
  misc_feature (14)..(14): n is a, c, g, or t
  misc_feature (31)..(31): n is a, c, g, or t
  misc_feature (68)..(68): n is a, c, g, or t
ccattcgaatggcnatcgaaatggaatcatncgactggaaaaagaatggaatcatcatcgaatggaantgaatagaatcacagaatgaaatcgaatggaatcatcatcgaatggagtctaatggaataatcatcgaatggaatagaatggaatcatcgagtggacacgaatggaatcatcattgaatggaatcgaatagaatcattaaatggacttgaatggaaacaacatcgaatggaatcgaatttagtcattgattggcattgagtggaatcatcattgaatggaatctaaggaaatcatcgaatggactggagtggaatcatcgaatggact

SEQ ID NO: 512395 - DNA, 451 bp, Homo sapiens
gtcccagttatagagactttcaggcttctaactcctgttctaatacatgatctgaggattctgctggtaaaggagacagcaagatactgctcttattccacatagtccaaaatcttaacagaaagaatctttgattagattgagacattagacaagtagcaagcgacagatgttcatcatcttagagcaatttcaaagaaagaggtgaaaaacaagagcaccttaatgtcgaagactggtcctaatactgaaagcaaacatgtcacttatttatcagtaacttaatatgcaaaaatgtgagttgcatcaaacatgttattgtatcaagagaaagactttgcttacatacaaaacagaatcttggctggagatgaggcaatctgtgagtcagttattggcattttctgggagaacagggaacaacagttctctcctaccaaacaaactgatc

SEQ ID NO: 512396 - DNA, 163 bp, Homo sapiens
  misc_feature (8)..(8): n is a, c, g, or t
  misc_feature (68)..(68): n is a, c, g, or t
gctgtgtnttggacaggtggagcccagccacattgcggagataagaactcttactaagaccatcgcanggtacccgccgcagtcctccgctggacccaatggctaatccctgaaggatgaggatgttctgcagaagctgcccgtgtgcaccacgggcacactg

SEQ ID NO: 512397 - DNA, 523 bp, Homo sapiens
  misc_feature (6)..(6): n is a, c, g, or t
  misc_feature (52)..(52): n is a, c, g, or t
  misc_feature (54)..(54): n is a, c, g, or t
  misc_feature (65)..(65): n is a, c, g, or t
  misc_feature (74)..(74): n is a, c, g, or t
ggcaantaaggggcatctaagaagatggccgcatattgtgaagccagtcgcntngctggaaagcntgaacctgntcattgacggctttagtcatgtttgaaaccgtggctttggagtagtgagcaccgtacattttctcaatgagttcggcaatttcagcagtggtaattcccttggtatacaactgaatgaccgttgtttctaaattatcactgtgccgaccgtagctggcaaggatgattttcaaccagccattgcgatctcgaggaatggttaagttaagttggccgtatttcgtatcaaacgagcgctcataactgccgttgcggttataaccagtgttaatcccagcgtatgagtagcgttcgtaacccaaaactctgccacttcgatttgaagcagctggttaatcgcaatttcgaggtggtgacgaaaaacttcgtccacatcttgcttttgggctagtgcagcgataatttctgtggtagttcattcatggggatgcctcctgtgatgttttttg

SEQ ID NO: 512398 - DNA, 155 bp, Homo sapiens
  misc_feature (144)..(144): n is a, c, g, or t
  misc_feature (154)..(154): n is a, c, g, or t
ctacttctcacgcttatacttctcaacgcttatacttctcaacgcttatacttctcaacgctttatacttctcaacgctttatacttcctctacgctttatacttcctatacttcctcaaccgcttctcattttcactttcccnggtatgaagnt

SEQ ID NO: 512399 - DNA, 136 bp, Homo sapiens
ctcatatcctcagagagcggcccacatcccctcacaactaccaaagtcactgggggatgcagctcttccccagaacagtccatggaactgactccagctccagggatcccaccgagaagattacattcattctcca

SEQ ID NO: 512400 - DNA, 223 bp, Homo sapiens
ctgggaacgacagctttgaccatcatgagtttccttgtctgacatgggccgtcgctgccgggttcagtaggatctcctcattgtagtcatctcctttgaaggtgtcatagatagtaatctcggtcctccaccactatcctacccctatctatcctcatcctacatcatacctgcataccagcagctagcttctagtgaagatcttccatgatcttgcttcagt

SEQ ID NO: 512401 - DNA, 191 bp, Homo sapiens
  misc_feature (36)..(36): n is a, c, g, or t
tcggccctggttaagtcggctcatgtggactcacgntcggctcttatagtccacgtatgacagaggctgagacaaacaggtttttttgggggggttttttttgtttgtttgtttttgttctttttttagacagagtttcactcttgtcacccaggctggaatgcaatggtggaatcttggcccaccacaac

SEQ ID NO: 512402 - DNA, 247 bp, Homo sapiens
cgatcacagcgttgcgccctgtgacatggtgcatgacggctgtggacctcgctgcgaatacatctccctcatctacaccaagctattcaggcgggcatggatgactattgaaggcactccggctgccactgaagccttttgagaccctactgtccctcaaccagggaggtcagaccttcattgttggagaccaaatctccttcgctgactaccacctgctggactttctagctactcctgtaataga

SEQ ID NO: 512403 - DNA, 113 bp, Homo sapiens
tctagagtatcccctcgaatcgacggttctcattgacctcacaacgaatgaggcacggtggagacgctaacagagaccacgatcattgtgagactgatgagaaagactttcta

SEQ ID NO: 512404 - DNA, 1394 bp, Homo sapiens
ataggtatcgctcttcaacaatatagtctccggacaatgaaccataagcgaatcagtaccagatcaatactcgatcatctaagtaatcataatggctcatcgcaactgaaatacgaggcaatagccccctttcacttctgagtcccagaggtaacccaaggcagccccttctgacatcgcggcctgcttcttgtcaggatgagcaagagagactcagccccacatcttacgatattcataatatcctatacattctcatccacatgctactaagatacgaaaatgccgttgctacctgcaagcatctgcttcgaagtgcttttattcacaagtacgagtaagctaggcaatgttgaagggtcgcgtattaatataacccgaaagaggcccaaggcgttacggccatagaatcttgtcgagccatcacgtccatcccaatctcaccgctaacaagtgaggcatgcacactacatccagcaccagagtacgtaaccgggttagcagatctctctagacggagtgacaggcagatgtcttatacacatcatttgagaccctcatggtaaattaattgcaatcgcgctcatactgttacttcacccgtgaattctcgccttaacagtaatcagttcggaaagctttggtaacataggctatgctcggagggcaattcactaactggagccctccggtaagcgataaaccctaacttcttgcaggaccaatctcgttggacaatatcaataaggtcaataaggagcgacgttggcagtcctataccgataataacccagttttaggaagtatccgccaatgtcacaaacacctgggtcagttcataccctcatacggggaagtgggcctgttgccgtcacccggccaattaaacgccgagtgttccttaatgtgggcctccaacacattgggagctccactatatattcgggcacacgaaacacttttctaacagaaatacgacagatctcaagagtttaccggcaccgtccaatttaacattcctcggccaaattgcatatggcacttagggcccaaccgcaagtagacacgcgcggatccctatgtcaatacccatttcataagtttgtgtgtagccactcaacggccccttaaaattcctcaaggtccgcgagcccttccaaagtcaacgcgccagttaaggtacccccgtcaagtgagtgcgtaaaagcagactcggctagacaggaacacttatctccaatgggcaccacgcctgttggaagtcggattgacgccagagacaccgcccacagacccagcacagttacatggtcccaggcgaagcagccgtccaatgttggccgcccgattttagatgccgacaggtctgtgatctcacccgtaagccgcggaaa

SEQ ID NO: 512405 - DNA, 915 bp, Homo sapiens
tggtggctcatggctgtaatcccagcactttgggaggcgaggcgggtgaatcacctaaggtcataagttcgagatcagccccgacatggtgaaaccccgtctttactaaaaatacaaaaaattagctgggcgtggtggcgggctcctgtaatcccagctactctagatagagcccgaggcaggagaattgcttgaactcgggaagcagaggctgcagtgagccaagatcgcgccattgcactccagcctgggcaataagaacaaaactctgtctcaaaaaaaaaaagtgtgcgtgtgggtgtgtgggtgtgtgtgtgtgtgtgtgtgtaaacggggctgtgtcaaaattacacttgggtgctctcagaaagacatttctcaaaatcagtgaacaaagtagcccacaaaatagaacgatatcgcccatcatatctactacgggggtaatatccagaatatgtaacagacatccttagaactcaacaacaacacaacactctaactccaaccacgtgtacaactgacttggaatagaccagttctccacagaagatgtgcacgtggtcaacctcattactcatcagggcaccctggtccctcactctcgggtatcctccaccagcgaagattatcacttctcacccaataaggtggcttctaatcaaacaccaacaaaccgcaacccacgttggcgaggtgcgcccacaccggcaccctgtcgctgccgacggcagggcaacggggcccgctgggaaacagctcgcgctctccaccagcaccgagtccaggggccgcacctctggtttccaacatggacgcatcaacacaccggccgcgcacgcctcaaccacaggggacactgcgtcacaatcaaggtccgaccacagaaacagcgcgcgcccgcggacccgcaag

SEQ ID NO: 512406 - DNA, 276 bp, Homo sapiens
cttcccttcccagatggagtctcgctgtaacgcccaggctggagtgcaatggggccattttggttccctgcaacttctgcctccccgattccagcgattttcctgtttcagactcccgagtggctgggattacccggggtgggccctcatgcccggcccagtaaaatgttttttaaaatgggtatgggccttattcataaaaaataatggggtcccgtcttttttaacctgtaaagacccctcttattgaataaaaagatgagagcttaagtttga

SEQ ID NO: 512407 - DNA, 3515 bp, Homo sapiens
taaaccaggaagccaggtcttgcctgggtcagggcaggcactgggcccgaaggaggagggccacttcctgccagccctccaccgagcccacctatggcgcctccccaggaagtgctccggccagcccagggtaaacacgctagccctgcccctctgggaccatagcccggggacccagactcttggccacgctcattcccacccctacccaggaccggcagccggagccttgggtccctgcatgggcctggggcgccctgtgccccttcacctcgtcctcgtccagttgactgctgtggcagccggtgctacccgctgtgtccactgcaccctggccctgttctgagcggtcacagcagctggggagaagggccatcctggaagccgggcagatgaggacggaaccagacagtcccactgtggtgggcagaggttcctcctctcccggccccgccccggcccggccccgccgagcgtcccacccgcccgcgggagacctggcgccccggccgaggcgcgaacagacggacgcaccggcgagcgccgaggggacaggccgagcgcggggcgccggaggcagcaggaccctcccgagggcctgaccgtggaggtagcactgcacacccactccctgtgggccggagccaggaggcacttcctgggtgtcggagcccagaaggaaaccagtggccgggaagcaccagctgggtgtgggacaggcactggcctcagaccggggccacactgaggtctgcccttctcccgctggccgccacccaagacaccatgagccagtccggggccgtgagctgctgcccgggtgccaccaatggcagcctgggccggtccgacggtgtggccaagatgagccccaaggacctgtttgagcagaggaagaagtattccaactccaacgtcatcatgcacgagacctcgcagtaccacgtccagcacctggccacattcatcatggacaagagcgaagccatcacgtctgtggacgacgccatccggaagctggtgcagctgagctccaaggagaagatctggacccaggagatgctgctgcaggtgaacgaccagtcgttgcggctgctggacatcgagtcacaggaggagctggaagacttcccgctgcccacggtgcagcgcagccagacggtcctcaaccagctgcgctacccgtctgtgctgctgctcgtgtgccaggactcggagcagagcaagccggatgtccacttcttccactgcgatgaggtggaggcagagctggtgcacgaggacatcgagagcgcgttggccgactgccggctgggcaagaagatgcggccgcagaccctgaagggacaccaggagaagattcggcagcggcagtccatcctgcctcctccccagggcccggcgcccatccccttccagcaccgcggcggggattccccggaggccaagaatcgcgtgggcccgcaggtgccactcagcgagccaggtttccgccgtcgggagtcgcaggaggagccgcgggccgtgctggctcagaagatagagaaggagacgcaaatcctcaactgcgccctggacgacatcgagtggtttgtggcccggctgcagaaggcagccgaggctttcaagcagctgaaccagcggaaaaaggggaagaagaagggcaagaaggcgccagcgatcgtcaacacctgcagtggcccagacatcgcacgctccgtctcctgcccactgctctcccgagatgccgtggacttcctgcgcggccacctggtccctaaggagatgtcgctgtgggagtcactgggagagagctggatgcggccccgttccgagtggccgcgggagccacaggtgcccctctacgtgcccaagttccacagcggctgggagcctcctgtggatgtgctgcaggaggccccctgggaggtggaggggctggcgtctgcccccatcgaggaggtgagtccagtgagccgacagtccataagaaactcccagaagcacagccccacttcagagcccacccccccgggggatgccctaccaccagtcagctccccacatactcacaggggctaccagccaacaccagccatggccaagtacgtcaagatcctgtatgacttcacagcccgaaatgccaacgagctatcggtgctcaaggatgaggtcctagaggtgctggaggacggccggcagtggtggaagctgcgcagccgcagcggccaggcggggtacgtgccctgcaacatcctaggcgaggcgcgaccggaggacgccggcgccccgttcgagcaggccggtcagaagtactggggccccgccagcccgacccacaagctacccccaagcttcccggggaacaaagacgagctcatgcagcacatggacgaggtcaacgacgagctcatccggaaaatcagcaacatcagggcgcagccacagaggcacttccgcgtggagcgcagccagcccgtgagccagccgctcacctacgagtcgggtccggacgaggtccgcgcctggctggaagccaaggccttcagcccgcggatcgtggagaacctgggcatcctgaccgggccgcagctcttctccctcaacaaggaggagctgaagaaagtgtgcggcgaggagggcgtccgcgtgtacagccagctcaccatgcagaaggccttcctggagaagcagcaaagtgggtcggagctggaagaactcatgaacaagtttcattccatgaatcagaggaggggggaggacagctaggcccagctgccttgggctggggcctgcggaggggaagcccacccacaatgcatggagtattatttttatatgtgtatgtattttgtatcaaggacacggagggggtgtggtgctggctagaggtccctgcccctgtctggaggcacaacgcccatccttaggccaaacagtacccaaggcctcagcccacaccaagactaatctcagccaaacctgctgcttggtggtgccagccccttgtccaccttctcttgaggccacagaactccctggggctggggcctctttctctggcctcccctgtgcacctggggggtcctggcccctgtgatgctcccccatccccacccacttctacatccatccacaccccagggtgagctggagctccaggctggccaggctgaacctcgcacacacgcagagttctgctccctgaggggggcccgggaggggctccagcaggaggccgtgggtgccattcgggggaaagtgggggaacgacacacacttcacctgcaagggccgacaacgcaggggacaccgtgccggcttcagacactcccagcgcccactcttacaggcccaggactggagctttctctggccaagtttcaggccaatgatccccgcatggtgttgggggtgctggtgtgtcttggtgcctggacttgagtctcaccctacagatgagaggtggctgaggcaccagggctaagcaattaaaccagttaagtctcccagga

SEQ ID NO: 512408 - DNA, 363 bp, Homo sapiens
  misc_feature (349)..(349): n is a, c, g, or t
tggatctccactggtgcgggggcttgtctactatgggcgttgactacgtactacttactggttgcaacatgttgtggtgtcatcatcttgtaattcagcaggcggcgggggcaatcaggttcatgtgcatcaggcagtcagggttcaggcatgcagtgggcaagcaagcaaagcagcaggcaagtcacagtttcacattcatgccctcttttgggttgcaggtgcatgcatggcaggtaggcagcatttggtgctagtgcaacattgtttccagagtacatcagctgggggctcagtccagagttacaggtactcaggcatcaccagtcagggcagcaggcggcatccntcctcagcagtcgc

SEQ ID NO: 512409 - DNA, 3764 bp, Homo sapiens
taaaccaggaagccaggtcttgcctgggtcagggcaggcactgggcccgaaggaggagggccacttcctgccagccctccaccgagcccacctatggcgcctccccaggaagtgctccggccagcccagggtaaacacgctagccctgcccctctgggaccatagcccggggacccagactcttggccacgctcattcccacccctacccaggaccggcagccggagccttgggtccctgcatgggcctggggcgccctgtgccccttcacctcgtcctcgtccagttgactgctgtggcagccggtgctacccgctgtgtccactgcaccctggccctgttctgagcggtcacagcagctggggagaagggccatcctggaagccgggcagatgaggacggaaccagacagtcccactgtggtgggcagaggttcctcctctcccggccccgccccggcccggccccgccgagcgtcccacccgcccgcgggagacctggcgccccggccgaggcgcgaacagacggacgcaccggcgagcgccgaggggacaggccgagcgcggggcgccggaggcagcaggaccctcccgagggcctgaccgtggaggtagcactgcacacccactccctgtgggccggagccaggaggcacttcctgggtgtcggagcccagaaggaaaccagtggccgggaagcaccagctgggtgtgggacaggcactggcctcagaccggggccacactgaggtctgcccttctcccgctggccgccacccaagacaccatgagccagtccggggccgtgagctgctgcccgggtgccaccaatggcagcctgggccggtccgacggtgtggccaagatgagccccaaggacctgtttgagcagaggaagaagtattccaactccaacgtcatcatgcacgagacctcgcagtaccacgtccagcacctggccacattcatcatggacaagagcgaagccatcacgtctgtggacgacgccatccggaagctggtgcagctgagctccaaggagaagatctggacccaggagatgctgctgcaggtgaacgaccagtcgttgcggctgctggacatcgagtcacaggaggagctggaagacttcccgctgcccacggtgcagcgcagccagacggtcctcaaccagctgcgctacccgtctgtgctgctgctcgtgtgccaggactcggagcagagcaagccggatgtccacttcttccactgcgatgaggtggaggcagagctggtgcacgaggacatcgagagcgcgttggccgactgccggctgggcaagaagatgcggccgcagaccctgaagggacaccaggagaagattcggcagcggcagtccatcctgcctcctccccagggcccggcgcccatccccttccagcaccgcggcggggattccccggaggccaagaatcgcgtgggcccgcaggtgccactcagcgagccaggtttccgccgtcgggagtcgcaggaggagccgcgggccgtgctggctcagaagatagagaaggagacgcaaatcctcaactgcgccctggacgacatcgagtggtttgtggcccggctgcagaaggcagccgaggctttcaagcagctgaaccagcggaaaaaggggaagaagaagggcaagaaggcgccagcagagggcgtcctcacactgcgggcacggcccccctctgagggcgagttcatcgactgcttccagaaaatcaagctggcgattaacttgctggcaaagctgcagaagcacatccagaaccccagcgccgcggagctcgtgcacttcctcttcgggcctctggacctgatcgtcaacacctgcagtggcccagacatcgcacgctccgtctcctgcccactgctctcccgagatgccgtggacttcctgcgcggccacctggtccctaaggagatgtcgctgtgggagtcactgggagagagctggatgcggccccgttccgagtggccgcgggagccacaggtgcccctctacgtgcccaagttccacagcggctgggagcctcctgtggatgtgctgcaggaggccccctgggaggtggaggggctggcgtctgcccccatcgaggaggtgagtccagtgagccgacagtccataagaaactcccagaagcacagccccacttcagagcccacccccccgggggatgccctaccaccagtcagctccccacatactcacaggggctaccagccaacaccagccatggccaagtacgtcaagatcctgtatgacttcacagcccgaaatgccaacgagctatcggtgctcaaggatgaggtcctagaggtgctggaggacggccggcagtggtggaagctgcgcagccgcagcggccaggcggggtacgtgccctgcaacatcctaggcgaggcgcgaccggaggacgccggcgccccgttcgagcaggccggtcagaagtactggggccccgccagcccgacccacaagctacccccaagcttcccggggaacaaagacgagctcatgcagcacatggacgaggtcaacgacgagctcatccggaaaatcagcaacatcagggcgcagccacagaggcacttccgcgtggagcgcagccagcccgtgagccagccgctcacctacgagtcgggtccggacgaggtccgcgcctggctggaagccaaggccttcagcccgcggatcgtggagaacctgggcatcctgaccgggccgcagctcttctccctcaacaaggaggagctgaagaaagtgtgcggcgaggagggcgtccgcgtgtacagccagctcaccatgcagaaggccttcctggagaagcagcaaagtgggtcggagctggaagaactcatgaacaagtttcattccatgaatcagaggaggggggaggacagctaggcccagctgccttgggctggggcctgcggaggggaagcccacccacaatgcatggagtattatttttatatgtgtatgtattttgtatcaaggacacggagggggtgtggtgctggctagaggtccctgcccctgtctggaggcacaacgcccatccttaggccaaacagtacccaaggcctcagcccacaccaagactaatctcagccaaacctgctgcttggtggtgccagccccttgtccaccttctcttgaggccacagaactccctggggctggggcctctttctctggcctcccctgtgcacctggggggtcctggcccctgtgatgctcccccatccccacccacttctacatccatccacaccccagggtgagctggagctccaggctggccaggctgaacctcgcacacacgcagagttctgctccctgaggggggcccgggaggggctccagcaggaggccgtgggtgccattcgggggaaagtgggggaacgacacacacttcacctgcaagggccgacaacgcaggggacaccgtgccggcttcagacactcccagcgcccactcttacaggcccaggactggagctttctctggccaagtttcaggccaatgatccccgcatggtgttgggggtgctggtgtgtcttggtgcctggacttgagtctcaccctacagatgagaggtggctgaggcaccagggctaagcaattaaaccagttaagtctcccaggagccgtgtgtctcagttctctgggagtcggagtgggtcctggagcccccggaaactgcaccttttctaagcagtgccgggcagag

SEQ ID NO: 512410 - DNA, 645 bp, Homo sapiens
ggggtagaaaccgtagctaacagtgttagttatctaagcaatcagatgttacagggccagccctttagctgctgtggtgtattctgttggtagtgaggtagtaggaccttatagacttttaaattttggaaatggttacaatccttaagcatgtattcttgagaaaggaaatctgtgaaattctgtgtgtgcagtatgccctacaattagtaggcaacgtgtattaaaaacactagtgtggattataaagatatccattaaaagaggacccggaaaacttggtatttcagggcacaaaaagcatgtaaaacacacaaaagcacagtgttacttttgaaagttccaattggtaaaacaccccgatttttcaacattgggcgtgtcgccaacaagggttacctgattgctctgttgaatatgctttaacaaaaaaaagaattttgaccccccacaatattttaaaaaaacttttaattaaatcgggatttaaaaaattttggaaaattttttgagatttacccccaaaagatttccacttgtttaaaaaaatttttagcttttttaaagccccctttaaaaatgtaaaatttaataatggagaataaaaaacctttgtttgtataaaacattttccccatttttgtt

SEQ ID NO: 512411 - DNA, 4113 bp, Homo sapiens
taaaccaggaagccaggtcttgcctgggtcagggcaggcactgggcccgaaggaggagggccacttcctgccagccctccaccgagcccacctatggcgcctccccaggaagtgctccggccagcccagggtaaacacgctagccctgcccctctgggaccatagcccggggacccagactcttggccacgctcattcccacccctacccaggaccggcagccggagccttgggtccctgcatgggcctggggcgccctgtgccccttcacctcgtcctcgtccagttgactgctgtggcagccggtgctacccgctgtgtccactgcaccctggccctgttctgagcggtcacagcagctggggagaagggccatcctggaagccgggcagatgaggacggaaccagacagtcccactgtggtgggcagaggttcctcctctcccggccccgccccggcccggccccgccgagcgtcccacccgcccgcgggagacctggcgccccggccgaggcgcgaacagacggacgcaccggcgagcgccgaggggacaggccgagcgcggggcgccggaggcagcaggaccctcccgagggcctgaccgtggaggtagcactgcacacccactccctgtgggccggagccaggaggcacttcctgggtgtcggagcccagaaggaaaccagtggccgggaagcaccagctgggtgtgggacaggcactggcctcagaccggggccacactgaggtctgcccttctcccgctggccgccacccaagacaccatgagccagtccggggccgtgagctgctgcccgggtgccaccaatggcagcctgggccggtccgacggtgtggccaagatgagccccaaggacctgtttgagcagaggaagaagtattccaactccaacgtcatcatgcacgagacctcgcagtaccacgtccagcacctggccacattcatcatggacaagagcgaagccatcacgtctgtggacgacgccatccggaagctggtgcagctgagctccaaggagaagatctggacccaggagatgctgctgcaggtgaacgaccagtcgttgcggctgctggacatcgagtcacaggaggagctggaagacttcccgctgcccacggtgcagcgcagccagacggtcctcaaccagctgcgctacccgtctgtgctgctgctcgtgtgccaggactcggagcagagcaagccggatgtccacttcttccactgcgatgaggtggaggcagagctggtgcacgaggacatcgagagcgcgttggccgactgccggctgggcaagaagatgcggccgcagaccctgaagggacaccaggagaagattcggcagcggcagtccatcctgcctcctccccagggcccggcgcccatccccttccagcaccgcggcggggattccccggaggccaagaatcgcgtgggcccgcaggtgccactcagcgagccaggtttccgccgtcgggagtcgcaggaggagccgcgggccgtgctggctcagaagatagagaaggagacgcaaatcctcaactgcgccctggacgacatcgagtggtttgtggcccggctgcagaaggcagccgaggctttcaagcagctgaaccagcggaaaaaggggaagaagaagggcaagaaggcgccagcagagggcgtcctcacactgcgggcacggcccccctctgagggcgagttcatcgactgcttccagaaaatcaagctggcgattaacttgctggcaaagctgcagaagcacatccagaaccccagcgccgcggagctcgtgcacttcctcttcgggcctctggacctgatcgtcaacacctgcagtggcccagacatcgcacgctccgtctcctgcccactgctctcccgagatgccgtggacttcctgcgcggccacctggtccctaaggagatgtcgctgtgggagtcactgggagagagctggatgcggccccgttccgagtggccgcgggagccacaggtgcccctctacgtgcccaagttccacagcggctgggagcctcctgtggatgtgctgcaggaggccccctgggaggtggaggggctggcgtctgcccccatcgaggaggtgagtccagtgagccgacagtccataagaaactcccagaagcacagccccacttcagagcccacccccccgggggatgccctaccaccagtcagctccccacatactcacaggggctaccagccaacaccagccatggccaagtacgtcaagatcctgtatgacttcacagcccgaaatgccaacgagctatcggtgctcaaggatgaggtcctagaggtgctggaggacggccggcagtggtggaagctgcgcagccgcagcggccaggcggggtacgtgccctgcaacatcctaggcgaggcgcgaccggaggacgccggcgccccgttcgagcaggccggtcagaagtactggggccccgccagcccgacccacaagctacccccaagcttcccggggaacaaagacgagctcatgcagcacatggacgaggtcaacgacgagctcatccggaaaatcagcaacatcagggcgcagccacagaggcacttccgcgtggagcgcagccagcccgtgagccagccgctcacctacgagtcgggtccggacgaggtccgcgcctggctggaagccaaggccttcagcccgcggatcgtggagaacctgggcatcctgaccgggccgcagctcttctccctcaacaaggaggagctgaagaaagtgtgcggcgaggagggcgtccgcgtgtacagccagctcaccatgcagaaggccttcctggagaagcagcaaagtgggtcggagctggaagaactcatgaacaagtttcattccatgaatcagaggaggggggaggacagctaggcccagctgccttgggctggggcctgcggaggggaagcccacccacaatgcatggagtattatttttatatgtgtatgtattttgtatcaaggacacggagggggtgtggtgctggctagaggtccctgcccctgtctggaggcacaacgcccatccttaggccaaacagtacccaaggcctcagcccacaccaagactaatctcagccaaacctgctgcttggtggtgccagccccttgtccaccttctcttgaggccacagaactccctggggctggggcctctttctctggcctcccctgtgcacctggggggtcctggcccctgtgatgctcccccatccccacccacttctacatccatccacaccccagggtgagctggagctccaggctggccaggctgaacctcgcacacacgcagagttctgctccctgaggggggcccgggaggggctccagcaggaggccgtgggtgccattcgggggaaagtgggggaacgacacacacttcacctgcaagggccgacaacgcaggggacaccgtgccggcttcagacactcccagcgcccactcttacaggcccaggactggagctttctctggccaagtttcaggccaatgatccccgcatggtgttgggggtgctggtgtgtcttggtgcctggacttgagtctcaccctacagatgagaggtggctgaggcaccagggctaagcaattaaaccagttaagtctcccaggaaaaaaaaaaaaacaacaaaaacaaaaaaaaaaaaaaacaaaagaaaacatgtgtgtgcgcggcgcgcgcccgcgcggcccctggagagaaaggcttttaagaaaccacactgcgcggtggggcgcgcgcgggggcccacggggcggtaagggcaaacagtgggcgccagagagggggtgttccacatgagaggagaaaccggggcgccagagagaacaagagggcgcgggggattctctccaccaaactataaaaagagcccgcgggggcgaaaacgcgcgagaggcgtctggcggaacaaaatatccgcagaagaggcgaggactcgcgagagaggccctacagagagggggctctcttcataagagaggggggagtctccagaggaagagcggaaaaatactcaaactagcccccacgggcgggggcacgg

SEQ ID NO: 512412 - DNA, 124 bp, Homo sapiens
aaaaaattatatgcgctttcatttaaagccaaccactagtgcacaatacacaaaatagctacttggagttccattgtgctgaagcacaaatgaatctgactagtaaccacaggcgttgcaggtt

SEQ ID NO: 512413 - DNA, 142 bp, Homo sapiens
  misc_feature (41)..(41): n is a, c, g, or t
  misc_feature (113)..(113): n is a, c, g, or t
aaactaacacagtatgttctagtcagatgtcatacatgaanggatgtacatcagggagagaaataaacacgtctatcaccatccttttggtctgttttaaatccaacgtcttnaagaaacttctgctgcttaagcaagtctt

SEQ ID NO: 512414 - DNA, 2587 bp, Homo sapiens
gcggccgcagaccctgaagtagggcagcgggcggagcggggtcgcagggggcggggaggggaggagcccggcaggggaggggaggagccggcaggggaggggaggagcccggcagggagggagggtcaggtgcgttcccggcggggctgagcaggaccccctcgccctccaggggacaccaggagaagattcggcagcggcagtccatcctgcctcctccccagggcccggcgcccatccccttccagcaccgcggcggggattccccggaggccaagaatcgcgtgggcccgcaggtgccactcagcgagccaggtgggccgaggggctggagggggctccacagggctcgttgtggggggctcggtgagcagccgccgtgtcccccatcaggtttccgccgtcgggagtcgcaggaggagccgcgggccgtgctggctcagaagatagagaaggagacgcaaatcctcaactgcgccctggacgacatcgagtggtttgtggcccggctgcagaaggcagccgaggctttcaagcagctgaaccagcggaaaaaggggaagaagaagggcaagaaggcgccagcagagggcgtcctcacactgcgggcacggcccccctctgagggcgagttcatcgactgcttccagaaaatcaagctggcgattaacttgctggcaaagctgcagaagcacatccagaaccccagcgccgcggagctcgtgcacttcctcttcgggcctctggacctgatcgtcaacacctgcagtggcccagacatcgcacgctccgtctcctgcccactgctctcccgagatgccgtggacttcctgcgcggccacctggtccctaaggagatgtcgctgtgggagtcactgggagagagctggatgcggccccgttccgagtggccgcgggagccacaggtgcccctctacgtgcccaagttccacagcggctgggagcctcctgtggatgtgctgcaggaggccccctgggaggtggaggggctggcgtctgcccccatcgaggaggtgagtccagtgagccgacagtccataagaaactcccagaagcacagccccacttcagagcccacccccccgggggatgccctaccaccagtcagctccccacatactcacaggggctaccagccaacaccagccatggccaagtacgtcaagatcctgtatgacttcacagcccgaaatgccaacgagctatcggtgctcaaggatgaggtcctagaggtgctggaggacggccggcagtggtggaagctgcgcagccgcagcggccaggcggggtacgtgccctgcaacatcctaggcgaggcgcgaccggaggacgccggcgccccgttcgagcaggccggtcagaagtactggggccccgccagcccgacccacaagctacccccaagcttcccggggaacaaagacgagctcatgcagcacatggacgaggtcaacgacgagctcatccggaaaatcagcaacatcagggcgcagccacagaggcacttccgcgtggagcgcagccagcccgtgagccagccgctcacctacgagtcgggtccggacgaggtccgcgcctggctggaagccaaggccttcagcccgcggatcgtggagaacctgggcatcctgaccgggccgcagctcttctccctcaacaaggaggagctgaagaaagtgtgcggcgaggagggcgtccgcgtgtacagccagctcaccatgcagaaggccttcctggagaagcagcaaagtgggtcggagctggaagaactcatgaacaagtttcattccatgaatcagaggaggggggaggacagctaggcccagctgccttgggctggggcctgcggaggggaagcccacccacaatgcatggagtattatttttatatgtgtatgtattttgtatcaaggacacggagggggtgtggtgctggctagaggtccctgcccctgtctggaggcacaacgcccatccttaggccaaacagtacccaaggcctcagcccacaccaagactaatctcagccaaacctgctgcttggtggtgccagccccttgtccaccttctcttgaggccacagaactccctggggctggggcctctttctctggcctcccctgtgcacctggggggtcctggcccctgtgatgctcccccatccccacccacttctacatccatccacaccccagggtgagctggagctccaggctggccaggctgaacctcgcacacacgcagagttctgctccctgaggggggcccgggaggggctccagcaggaggccgtgggtgccattcgggggaaagtgggggaacgacacacacttcacctgcaagggccgacaacgcaggggacaccgtgccggcttcagacactcccagcgcccactcttacaggcccaggactggagctttctctggccaagtttcaggccaatgatccccgcatggtgttgggggtgctggtgtgtcttggtgcctggacttgagtctcaccctacagatgagaggtggctgaggcaccagggctaagcaattaaaccagttaagtctcccagga

SEQ ID NO: 512415 - DNA, 1078 bp, Homo sapiens
tacgccaaattctagtccacctcaatcacactactccccatatctaacaacgtaaaaataaaatgtacagagttgacagagtacaagaaccacacgcccagttcctccccacactcatcgacccttagcaggctactcctagcctatgctccccttccagtactgtaataatcgtatgacataaaaacaaggaaatcatatacaaacaggaagatccaaggtgcgggcgccgactagtgcgacattgagagaaccaccgtccctctagtaggacccaactgggcgtggaggacgccgcgcgggcacccacacactaggactacacgggaacacccgtgggcccacagaagcgtgtacccaaaagaaagaaaaaccgggggacccaggagcaacagaggcggggcgggtattccccccccacaataaaaaaagccgcccggggggggcaacccgaaggcgtcctggaaccacaacctcccaaggaggggctctcgcgggagggcacacaacggcgggctcctaccacaaccgggggcggcccacacgagaaggacaaaacatacaattaaacccccggccgccgggggacggctaccaacagtcacacgtacgacgacgcagcagacacaccacccacagacaaaccatgcgacaccaaccacagcagcaaccgcagccacgccagcacaagagacagcagcacagcgaacaccaagggacggagaagccgcagcaagcggcgcagccgagacagagacaacgcgagacaacggcccagcgaaaggcgccaggacacgccgccgcaccgacccgcggacgacgaccccagagccgcgacagcacgaaccacgaaaacagccaccgagcgagcgcggccgcgcagccgcgagcagcgcgcaccaccaccgacgcgcccggcgccacgaaccagtacacgccggcgcagggaacggaagagacggagagagacaccccgaacgcgacagacgagcgaaaacgataggccaacgacgccgaccgactaggcgcacctgacacgcgcggaggcagggacacgacaacagaggtgtatgaacaa

SEQ ID NO: 512416 - DNA, 1589 bp, Homo sapiens
gctgcctgcagcctctctccacggtgacctccagaacagaaaagaggcagccagtcgtgcacctgggaagctgctgccccccagccactgcccaggtctcagaggagacccccaccagactgggcctcagcccctcctgttcctcacaggggctaccagccaacaccagccatggccaagtacgtcaagatcctgtatgacttcacagcccgaaatgccaacgagctatcggtgctcaaggatgaggtcctagaggtgctggaggacggccggcagtggtggaagctgcgcagccgcagcggccaggcggggtacgtgccctgcaacatcctaggcgaggcgcgaccggaggacgccggcgccccgttcgagcaggccggtcagaagtactggggccccgccagcccgacccacaagctacccccaagcttcccggggaacaaagacgagctcatgcagcacatggacgaggtcaacgacgagctcatccggaaaatcagcaacatcagggcgcagccacagaggcacttccgcgtggagcgcagccagcccgtgagccagccgctcacctacgagtcgggtccggacgaggtccgcgcctggctggaagccaaggccttcagcccgcggatcgtggagaacctgggcatcctgaccgggccgcagctcttctccctcaacaaggaggagctgaagaaagtgtgcggcgaggagggcgtccgcgtgtacagccagctcaccatgcagaaggccttcctggagaagcagcaaagtgggtcggagctggaagaactcatgaacaagtttcattccatgaatcagaggaggggggaggacagctaggcccagctgccttgggctggggcctgcggaggggaagcccacccacaatgcatggagtattatttttatatgtgtatgtattttgtatcaaggacacggagggggtgtggtgctggctagaggtccctgcccctgtctggaggcacaacgcccatccttaggccaaacagtacccaaggcctcagcccacaccaagactaatctcagccaaacctgctgcttggtggtgccagccccttgtccaccttctcttgaggccacagaactccctggggctggggcctctttctctggcctcccctgtgcacctggggggtcctggcccctgtgatgctcccccatccccacccacttctacatccatccacaccccagggtgagctggagctccaggctggccaggctgaacctcgcacacacgcagagttctgctccctgaggggggcccgggaggggctccagcaggaggccgtgggtgccattcgggggaaagtgggggaacgacacacacttcacctgcaagggccgacaacgcaggggacaccgtgccggcttcagacactcccagcgcccactcttacaggcccaggactggagctttctctggccaagtttcaggccaatgatccccgcatggtgttgggggtgctggtgtgtcttggtgcctggacttgagtctcaccctacagatgagaggtggctgaggcaccagggctaagcaattaaaccagttaagtctcccagga

SEQ ID NO: 512417 - DNA, 1602 bp, Homo sapiens
ggcgtccggagagcgctggtggtagggaggcttctcccggttctgtgagcagcaggaccctcccgagggcctgaccgtggaggtagcactgcacagccccacttcagagcccacccccccgggggatgccctaccaccagtcagctccccacatactcacaggggctaccagccaacaccagccatggccaagtacgtcaagatcctgtatgacttcacagcccgaaatgccaacgagctatcggtgctcaaggatgaggtcctagaggtgctggaggacggccggcagtggtggaagctgcgcagccgcagcggccaggcggggtacgtgccctgcaacatcctaggcgaggcgcgaccggaggacgccggcgccccgttcgagcaggccggtcagaagtactggggccccgccagcccgacccacaagctacccccaagcttcccggggaacaaagacgagctcatgcagcacatggacgaggtcaacgacgagctcatccggaaaatcagcaacatcagggcgcagccacagaggcacttccgcgtggagcgcagccagcccgtgagccagccgctcacctacgagtcgggtccggacgaggtccgcgcctggctggaagccaaggccttcagcccgcggatcgtggagaacctgggcatcctgaccgggccgcagctcttctccctcaacaaggaggagctgaagaaagtgtgcggcgaggagggcgtccgcgtgtacagccagctcaccatgcagaaggccttcctggagaagcagcaaagtgggtcggagctggaagaactcatgaacaagtttcattccatgaatcagaggaggggggaggacagctaggcccagctgccttgggctggggcctgcggaggggaagcccacccacaatgcatggagtattatttttatatgtgtatgtattttgtatcaaggacacggagggggtgtggtgctggctagaggtccctgcccctgtctggaggcacaacgcccatccttaggccaaacagtacccaaggcctcagcccacaccaagactaatctcagccaaacctgctgcttggtggtgccagccccttgtccaccttctcttgaggccacagaactccctggggctggggcctctttctctggcctcccctgtgcacctggggggtcctggcccctgtgatgctcccccatccccacccacttctacatccatccacaccccagggtgagctggagctccaggctggccaggctgaacctcgcacacacgcagagttctgctccctgaggggggcccgggaggggctccagcaggaggccgtgggtgccattcgggggaaagtgggggaacgacacacacttcacctgcaagggccgacaacgcaggggacaccgtgccggcttcagacactcccagcgcccactcttacaggcccaggactggagctttctctggccaagtttcaggccaatgatccccgcatggtgttgggggtgctggtgtgtcttggtgcctggacttgagtctcaccctacagatgagaggtggctgaggcaccagggctaagcaattaaaccagttaagtctcccagga

SEQ ID NO: 512418 - DNA, 455 bp, Homo sapiens
  misc_feature (55)..(55): n is a, c, g, or t
  misc_feature (58)..(58): n is a, c, g, or t
  misc_feature (74)..(74): n is a, c, g, or t
  misc_feature (95)..(95): n is a, c, g, or t
  misc_feature (185)..(185): n is a, c, g, or t
  misc_feature (221)..(221): n is a, c, g, or t
  misc_feature (224)..(224): n is a, c, g, or t
  misc_feature (234)..(234): n is a, c, g, or t
  misc_feature (246)..(246): n is a, c, g, or t
  misc_feature (250)..(250): n is a, c, g, or t
  misc_feature (257)..(257): n is a, c, g, or t
  misc_feature (271)..(271): n is a, c, g, or t
  misc_feature (278)..(278): n is a, c, g, or t
  misc_feature (290)..(290): n is a, c, g, or t
  misc_feature (294)..(294): n is a, c, g, or t
  misc_feature (299)..(299): n is a, c, g, or t
  misc_feature (306)..(306): n is a, c, g, or t
  misc_feature (310)..(310): n is a, c, g, or t
  misc_feature (315)..(315): n is a, c, g, or t
  misc_feature (333)..(333): n is a, c, g, or t
tgatggggcacagggcccaatgtccgcaaggcaccctgaggaaggcgcgctcaantgntcagtgcaggagaccntcggggtcaccaagccttgcncccccaaggccaaagcaaaggccaaagccaaaaaagggaagggaaaggtttatccgccaagcttggatgccaaggagcccctggtgtcanatggggcttggcccacgccctccctttcccaggccnganatgtgacccnccagggcctttngttngctggtnagctttaatcaatnaggcccngccttgtccctntcantcccnagccccncccntaagngcccaaagtggggagggncaagggattttgggaagcttgagcctcccccaaagcaatgtgagtcccagagcccgcttttgtttttccccccaattccattattaagaaacacatcaaataaactgactttttccccccca

SEQ ID NO: 512419 - DNA, 218 bp, Homo sapiens
tatcgattagcttgatcagctgtacaggatgccggctacttggctcatcttggagcgcaggtaagtgtgtaggctctggcgccattcagataaagacaccagacgactggagaagctctcgatgtatatcaatgtcagtggcagatatgtccatgcccagtgcaggacctgtgaggcatccagcaatagccttatgcatttggcccaatccttgtcca

SEQ ID NO: 512420 - DNA, 237 bp, Homo sapiens
cctttttaaatctttcctctctttcttgaagccttaaatgttaagactaatgtgtaaaaaccccgtttgagcttgcttttccctttggaccctttgcttttgattgcctatccctataaggggctccttttactgttttttgatcctgggggccttatttttgctatgttaaggttgtgttttttaaaacttggattttttttcatatacttccataacccgtggtgtttgcccata

SEQ ID NO: 512421 - DNA, 1793 bp, Homo sapiens
  misc_feature (1757)..(1757): n is a, c, g, or t
taaaccaggaagccaggtcttgcctgggtcagggcaggcactgggcccgaaggaggagggccacttcctgccagccctccaccgagcccacctatggcgcctccccaggaagtgctccggccagcccagggtaaacacgctagccctgcccctctgggaccatagcccggggacccagactcttggccacgctcattcccacccctacccaggaccggcagccggagccttgggtccctgcatgggcctggggcgccctgtgccccttcacctcgtcctcgtccagttgactgctgtggcagccggtgctacccgctgtgtccactgcaccctggccctgttctgagcggtcacagcagctggggagaagggccatcctggaagccgggcagatgaggacggaaccagacagtcccactgtggtgggcagaggttcctcctctcccggccccgccccggcccggccccgccgagcgtcccacccgcccgcgggagacctggcgccccggccgaggcgcgaacagacggacgcaccggcgagcgccgaggggacaggccgagcgcggggcgccggaggcagcaggaccctcccgagggcctgaccgtggaggtagcactgcacacccactccctgtgggccggagccaggaggcacttcctgggtgtcggagcccagaaggaaaccagtggccgggaagcaccagctgggtgtgggacaggcactggcctcagaccggggccacactgaggtctgcccttctcccgctggccgccacccaagacaccatgagccagtccggggccgtgagctgctgcccgggtgccaccaatggcagcctgggccggtccgacggtgtggccaagatgagccccaaggacctgtttgagcagaggaagaagtattccaactccaacgtcatcatgcacgagacctcgcagtaccacgtccagcacctggccacattcatcatggacaagagcgaagccatcacgtctgtggacgacgccatccggaagctggtgcagctgagctccaaggagaagatctggacccaggagatgctgctgcaggtgaacgaccagtcgttgcggctgctggacatcgagtcacaggaggagctggaagacttcccgctgcccacggtgcagcgcagccagacggtcctcaaccagctgcgctacccgtctgtgctgctgctcgtgtgccaggactcggagcagagcaagccggatgtccacttcttccactgcgatgaggtggaggcagagctggtgcacgaggacatcgagagcgcgttggccgactgccggctgggcaagaagatgcggccgcagaccctgaagggacaccaggagaagattcggcagcggcagtccatcctgcctcctccccagggcccggcgcccatccccttccagcaccgcggcggggattccccggaggccaagaatcgcgtgggcccgcaggtgccactcagcgagccaggtttccgccgtcgggagtcgcaggaggagccgcgggccgtgctggctcagaagatagagaaggagacgcaaatcctcaactgcgccctggacgacatcgagtggtttgtggcccggctgcagaaggcagccgaggctttcaagcagctgaaccagcggaaaaaggggaagaagaagggcaagaaggcgccagcaggtgcaggggacagggacggggccggcaggtgcaggggacggggccagcaggtgcaggggacagggacggggacggngccagggacatccatgggggctactcatggaggctg

SEQ ID NO: 512422 - DNA, 1457 bp, Homo sapiens
taaaccaggaagccaggtcttgcctgggtcagggcaggcactgggcccgaaggaggagggccacttcctgccagccctccaccgagcccacctatggcgcctccccaggaagtgctccggccagcccagggtaaacacgctagccctgcccctctgggaccatagcccggggacccagactcttggccacgctcattcccacccctacccaggaccggcagccggagccttgggtccctgcatgggcctggggcgccctgtgccccttcacctcgtcctcgtccagttgactgctgtggcagccggtgctacccgctgtgtccactgcaccctggccctgttctgagcggtcacagcagctggggagaagggccatcctggaagccgggcagatgaggacggaaccagacagtcccactgtggtgggcagaggttcctcctctcccggccccgccccggcccggccccgccgagcgtcccacccgcccgcgggagacctggcgccccggccgaggcgcgaacagacggacgcaccggcgagcgccgaggggacaggccgagcgcggggcgccggaggcagcaggaccctcccgagggcctgaccgtggaggtagcactgcacacccactccctgtgggccggagccaggaggcacttcctgggtgtcggagcccagaaggaaaccagtggccgggaagcaccagctgggtgtgggacaggcactggcctcagaccggggccacactgaggtctgcccttctcccgctggccgccacccaagacaccatgagccagtccggggccgtgagctgctgcccgggtgccaccaatggcagcctgggccggtccgacggtgtggccaagatgagccccaaggacctgtttgagcagaggaagaagtattccaactccaacgtcatcatgcacgagacctcgcagtaccacgtccagcacctggccacattcatcatggacaagagcgaagccatcacgtctgtggacgacgccatccggaagctggtgcagctgagctccaaggagaagatctggacccaggagatgctgctgcaggtgaacgaccagtcgttgcggctgctggacatcgagtcacaggaggagctggaagacttcccgctgcccacggtgcagcgcagccagacggtcctcaaccagctgcgctacccgtctgtgctgctgctcgtgtgccaggactcggagcagagcaagccggatgtccacttcttccactgcgatgaggtggaggcagagctggtgcacgaggacatcgagagcgcgttggccgactgccggctgggcaagaagatgcggccgcagaccctgaagggacaccaggagaagattcggcagcggcagtccatcctgcctcctccccagggcccggcacgacatactcttcccagaattcccctttggaaaggggatcactctagagtcaa

SEQ ID NO: 512423 - DNA, 294 bp, Homo sapiens
aggcaacactaacattaagaaatacatgcagacatgggcttcaggagtaactcaccaatgactgtagactcatttataagcagagaaaatagccaatctctttccctccaaccccactagctggagaattaatctatcataacgctaaagaaatcactatctttgggagaaaggtaggttgcctttaaataaatcagttgaccactgagtaaagggggaaagtccttgactatctggatgtttcggggactagacttcaggtaagcgtaatggaaagggaggtgtgttaggcca

SEQ ID NO: 512424 - DNA, 637 bp, Homo sapiens
  misc_feature (1)..(1): n is a, c, g, or t
  misc_feature (79)..(79): n is a, c, g, or t
  misc_feature (92)..(92): n is a, c, g, or t
  misc_feature (154)..(154): n is a, c, g, or t
  misc_feature (161)..(161): n is a, c, g, or t
  misc_feature (168)..(168): n is a, c, g, or t
  misc_feature (203)..(203): n is a, c, g, or t
  misc_feature (228)..(228): n is a, c, g, or t
  misc_feature (290)..(290): n is a, c, g, or t
  misc_feature (377)..(377): n is a, c, g, or t
  misc_feature (455)..(455): n is a, c, g, or t
ncctcttccccgggcggcaagggtgagagtgggagccagtgggggaaatgccaggcacttttaacaccatcagttctcntgaaagctcactntcatgagaatagcatgagggaaactgcccccatgtttcattttcctaccacaacacctgggnattttgnggttttnctttcaagatgagacttgggtgggggtacatccanaccatttcattccatttttggctgnaatttacttcaggcaatggttattttctttgttcaaagtccattgatgctttgagattctgngcttttttctggtttggaaaacagactttgcatctccatctccattggatgtttgctgcctcctgtgatgttccaggaatgccatgnttctcccaagtccacagtgcacatttgccttaaagtgcctgctgcaattttctggtcgtcggctcccaccctggctangccaacacaaagtgtctcctcggtaactgctggttcttctcctcgtattctttgattttgaacaatctccgggggctgctgggctgcttggtttacactcatataccgtggaggttcatagatcttccttcccttgattagattttccaaagactgctcctttactttgatgtctagtaaac

SEQ ID NO: 512425 - DNA, 1303 bp, Homo sapiens
  misc_feature (1114)..(1114): n is a, c, g, or t
taaaccaggaagccaggtcttgcctgggtcagggcaggcactgggcccgaaggaggagggccacttcctgccagccctccaccgagcccacctatggcgcctccccaggaagtgctccggccagcccagggtaaacacgctagccctgcccctctgggaccatagcccggggacccagactcttggccacgctcattcccacccctacccaggaccggcagccggagccttgggtccctgcatgggcctggggcgccctgtgccccttcacctcgtcctcgtccagttgactgctgtggcagccggtgctacccgctgtgtccactgcaccctggccctgttctgagcggtcacagcagctggggagaagggccatcctggaagccgggcagatgaggacggaaccagacagtcccactgtggtgggcagaggttcctcctctcccggccccgccccggcccggccccgccgagcgtcccacccgcccgcgggagacctggcgccccggccgaggcgcgaacagacggacgcaccggcgagcgccgaggggacaggccgagcgcggggcgccggaggcaggtgtgggacaggcactggcctcagaccggggccacactgaggtctgcccttctcccgctggccgccacccaagacaccatgagccagtccggggccgtgagctgctgcccgggtgccaccaatggcagcctgggccggtccgacggtgtggccaagatgagccccaaggacctgtttggtgagtgaggtttgagaacgggctggacgtcacaggggagaaatgggcactgcatccaggtgggggacagctgctcctgccccacagctgtgcctggtctggcccaggggatctccgggtgcccagggaggcctctggaccctaatcaaccttccgaaagctcctggccactggatcccctcccccacacccgtaaggggagaggcctttactaataattcagggagcatcaatattgattccgctgcactcattgctgtaacctgatcacagcgaggttcaggcaggataagccgccaggtgtctgctccaggaggggggtcccagcccggcttcttcccactctgagagcttgncagcttcactctccctgccctcccaggtcttctcgctttccagactaggcaccttgtccaaagacataagtgaagggtgcatctagctagcgagagggcaggtcgtctctggggaagggcagagtggggggagtgtggtggctgccaggcaccctcctggaggggtacgaggcccgaattcgtatcatg

SEQ ID NO: 512426 - DNA, 959 bp, Homo sapiens
taaaccaggaagccaggtcttgcctgggtcagggcaggcactgggcccgaaggaggagggccacttcctgccagccctccaccgagcccacctatggcgcctccccaggaagtgctccggccagcccagggtaaacacgctagccctgcccctctgggaccatagcccggggacccagactcttggccacgctcattcccacccctacccaggaccggcagccggagccttgggtccctgcatgggcctggggcgccctgtgccccttcacctcgtcctcgtccagttgactgctgtggcagccggtgctacccgctgtgtccactgcaccctggccctgttctgagcggtcacagcagctggggagaagggccatcctggaagccgggcagatgaggacggaaccagacagtcccactgtggtgggcagaggttcctcctctcccggccccgccccggcccggccccgccgagcgtcccacccgcccgcgggagacctggcgccccggccgaggcgcgaacagacggacgcaccggcgagcgccgaggggacaggccgagcgcggggcgccggaggcagcaggaccctcccgagggcctgaccgtggaggtagcactgcacacccactccctgtgggccggagccaggaggcacttcctgggtgtcggagcccagaaggaaaccagtggccgggaagcaccagctgggtgtgggacaggcactggcctcagaccggggccacactgaggtctgcccttctcccgctggccgccacccaagacaccatgagccagtccggggccgtgagctgctgcccgggtgccaccaatggcagcctgggccggtccgacggtgtggccaagatgagccccaaggacctgtttcccccacagagagagcgtcaccccacagaagagcgtcaccccacagagagagctcgggatcctctagatcaccg

SEQ ID NO: 512427 - DNA, 352 bp, Homo sapiens
  misc_feature (124)..(124): n is a, c, g, or t
gacaaacctcatctatttcactgctttgtccacatcgacaatgacccactactcggaacagttccctactccccaccgccctctatggtgcgtctcccccgaccccttggtttgcatggccccncgtgtgccagtctggtccaagctcacctggtcaccatcaccactctcagcaccctagtcacccaaattctcagagcctcagtttcttcatcttaatgatcctacaagtcctgtcagtctcacaggactcagtgaggttgtgttcttgaaaaccttccgtgggctgcctcatgccacatgggtgaaatggtcaccttgagaggatgagtggaagggcctgctgtgttct

SEQ ID NO: 512428 - DNA, 629 bp, Homo sapiens
tgtccggactgagatgtctgagatagggcaggagctgagaggctgggactaaatattttatttttatcaaaggtggagtctatgccttgtcgcccagggtggagttgcagcagtgcgatctctgctcactgcaacctccgcctcctgattcccagcaattctcccacctcatcctcctgagtagccgggattaccggcgcgtaccaccaggcggtggaaatgttgggaatcattgaggagagacagggtttcaccatgtatcgcaggctagtcctcgaactctggacctcaaagtgatctgcctgcttcggactcccaaagtacggggataacaggccttagctactgagcccggcccaatactcaattccaaccattgccatcttgtcccctggcactgctttgggggcagctgtgacctcggtggcttgaagctcaagcatccttcttagtcataatctcacttgagtctcctagcagatttgaaccccattgattcctccctcctcaaaaccatctttccttggcttctggtggcatcttaaatactttaacttgccttcctccctctggttgcccctcatagcctctctgtcatctcctctggtgtctgtgatgtttgtgccctc

SEQ ID NO: 512429 - DNA, 1533 bp, Homo sapiens
taaaaaaggttatgcctcaaagtttacagggggggaaggtgcacctacaaataaagaaagccaaaaaaaaggggggggaaaaagatcagggggggaaaaaccgaagggtccgatatatagacgaggcatgtattcccagagctcgaacgcacatcgggagccgcaataaggcgcaaaagaacgaaaccagtgagagggcacacaacggaggagaaaagaaaaaacagggtgagacaccccgaaaaataaaaaatgggcgcaaagagccagacaggccgaaaaacagagagaacaaacaaacaaaggcagaacaagaaaaacaacaacaaaaaacatcagagcgacaaacacacaaacacacgcccgaggagagatacaacagcgaacactagggcgcactgagccacctgattccaccacacaccaacttacaccgtgcacagcacccacgacagagcacacgagaaacacaaacaggcaacaacaacaaatagagcgcggactcacaaacacaacagagaccaaccacagagaccagaaacacggaaatgcaaaaaataaaccaccccacgagagaaaaacagataagcaaggaagataaacaacaagcagacacagaagctcacaagccacacaaacatcacaggcaaccacaacatctcacaacagacacactacaatcacacgaccaaaaccgcgagaaccaacaggccacacaggcccagccggccagcagacaactactcagccagcccgcgcaactacaaaacagcccgcgaccacgacaccacccagtacgagcagcaccacgcgagtgtcgcacgacaacccacaaccgaacgagagaacgactacgattccaacccagataaatgatagacagcactgccaacaagacaagccacaacatcagcagagacacaaaaaagcgagaaaagcaggagagggcagccaaagacaacaagacgagacatgcaaaccaacgacaggaacagaacaccaaccacgagaagatatcagacactacaaacaccgtaaaacgcctcaagaccaaggcacgaccagaagaaacaaacaacaccggcagggagaacacaaacaagcacgaacacacaagcagacaaacacgaacgaagactcgaacaccaagaccgacaaacacacaaaaaaaaaaacgaaagaaagagagagaacgaacaatagagaagaaaaacacagacgaaagcgcacgagtgcgacaaacaacacacgacaagaagaacagcgagcacagagacaaagagcgacgaaagcaggcaactagaagaagataaaagcaagcagaaaacaacgagaaacgagactaggcgagcagacgcgaatgagagacgacggagagcgcaacacaacgatgcagaacgtacacgacaagcagaggaacgaaggagaacaccaacaaaaccaagacaacgaaacagaagcacagagcgacgaaaccgaggcagcgcagcgacgagcctaacaccaacgctgcacaccgcccgacctccgcct

SEQ ID NO: 512430 - DNA, 1004 bp, Homo sapiens
  misc_feature (25)..(25): n is a, c, g, or t
  misc_feature (64)..(64): n is a, c, g, or t
  misc_feature (96)..(96): n is a, c, g, or t
  misc_feature (107)..(107): n is a, c, g, or t
  misc_feature (116)..(117): n is a, c, g, or t
  misc_feature (170)..(170): n is a, c, g, or t
  misc_feature (196)..(197): n is a, c, g, or t
  misc_feature (200)..(200): n is a, c, g, or t
  misc_feature (203)..(203): n is a, c, g, or t
  misc_feature (207)..(207): n is a, c, g, or t
  misc_feature (226)..(226): n is a, c, g, or t
  misc_feature (229)..(229): n is a, c, g, or t
  misc_feature (253)..(253): n is a, c, g, or t
  misc_feature (258)..(258): n is a, c, g, or t
  misc_feature (261)..(262): n is a, c, g, or t
  misc_feature (321)..(321): n is a, c, g, or t
  misc_feature (327)..(327): n is a, c, g, or t
  misc_feature (337)..(337): n is a, c, g, or t
  misc_feature (356)..(356): n is a, c, g, or t
  misc_feature (372)..(372): n is a, c, g, or t
  misc_feature (375)..(375): n is a, c, g, or t
  misc_feature (385)..(385): n is a, c, g, or t
  misc_feature (417)..(417): n is a, c, g, or t
  misc_feature (427)..(427): n is a, c, g, or t
  misc_feature (434)..(434): n is a, c, g, or t
  misc_feature (455)..(456): n is a, c, g, or t
  misc_feature (465)..(465): n is a, c, g, or t
  misc_feature (475)..(475): n is a, c, g, or t
  misc_feature (480)..(480): n is a, c, g, or t
  misc_feature (482)..(482): n is a, c, g, or t
  misc_feature (504)..(504): n is a, c, g, or t
  misc_feature (513)..(514): n is a, c, g, or t
  misc_feature (547)..(547): n is a, c, g, or t
  misc_feature (557)..(557): n is a, c, g, or t
  misc_feature (593)..(593): n is a, c, g, or t
  misc_feature (796)..(796): n is a, c, g, or t
  misc_feature (884)..(884): n is a, c, g, or t
  misc_feature (896)..(896): n is a, c, g, or t
  misc_feature (932)..(932): n is a, c, g, or t
  misc_feature (1004)..(1004): n is a, c, g, or t
ttgaaatagtcaaaagatgagaganaatttgtatcatttctattcccttttctgtaaccaagangaaggccaaagtggtcttaggaaccttttgtnttcctgatganttcttctanngagtcccactgctccttggagacctttctcaggtcgttgaattcccctgaaanaagtacttcctctccaccgtcaaaannaangantgcnccattaatccaagaagcanaancactacaaaggaaagcagcaaganttgcnagnncttctacagtccccaggcgaccacagggaattctgccaatcatttctttctcaaatgtnccagtngggtccaganggctaaaggcacctttggnttttataggccctggntgngtcacattgnatcgcattccatatttaccccattcagctgcnggggggttgntcatggnttccacacctgctttgggagnngcacttggnactacaaaanctgancnagtttcagcatagatagtagtnatagggagnnatgctgctcctttctgtgctttaattagttgtnttccaatttntagtgttacgaaggctgtgccatttagaactatgtnagttatggttttccaagcattaggagaaagtttttcagtaggagaaataaaattccctgctgcattgtttatcacaatattaggatgtcctgcaactttgatcagttctgacacagtgttttgaaccatatcaggatccctcacatcacactgaattgcatgaaccttatttccagtttgagaagaaatttgttctgcggtantttcaaaacatccatcttccggctggctatcacgcactgagcacctaggctggacagaagagttgtcattcctttaccaaggccagtncctcccccagtnatgaatgccacttttccttgaaaactattaggtggnagcatcgctttttgaagaggtgaaagaattaagattgcaaagcttcagtgttttgatatatatttttgtccn

SEQ ID NO: 512431 - DNA, 340 bp, Homo sapiens
acagtttttttaagctttataacgcactctctgcccttgacatactccaaccttcacacattgactattgtgaagaaatatattgtgggcacagacccatgcgcgtctgcacctacatcaatgaattgtctactttaatgcacttatcttttatacactttccctccaagtcttcattttgcacgagctgttgagcagttatctttagcataatatgaacaaacgttgctgtcactgccttgtgacagagcacaacatgtttagtagattattcggtgtaggattttcttttaatgtactttttttctttgggggcttttctttattattaaattatttc

SEQ ID NO: 512432 - DNA, 932 bp, Homo sapiens
taactatgcactagacgttacgctattgggggacgacttgcaaaggtgtgggttgttgcgacaggtggttctgcgacaccgtgtggggatctactgttacagcgcctgtgcgtcataccgggtggtcaagctggtgtacgacgcgcgtgcatggacctgatcgagggggacaaagtggggtgcccgtaataaagcgctttcctggggggatcgcggggaccccctgtggtgtggttcggcgatcccgggggacggctgtgtccacccccctaggtgactaccattgttctcaacgggccaatccactccccataaaagtgttgttgaagaggccctcccgtcgaagaacaaggatggttccgggtgcagggtgggatagaaaccaaatggggggtgaacggggggcattacccaacgtggcgtgatcattgatccgacggggggtgcgttgtaagtccagagatggctagtcaattatgcttgaatggggggggatgaatgacaggcacggatttatgggccccgcctgggaagaacccccggggccggtctctcctcgacagtagagacccccattgttaagcaaacttcatcgtccagacagagtcctccccgaatggagtggaagaccctcagacccacccccggtggggagaccccacacaaggtgatgaaccttttgcacaacgacctttttctgaacaaataacttacctgtatcaaacgatgcttatatgcacgcaagaaagaatataatatcttccactagtctgaccacaatgaccgcttcgcagagctctctcccttcgcctgctttaataacctcacgaagaaccccactttctgtgagaactcctagacccatttatgatggtgaatccctttcaaccatcttcaaaaacccacttttttcatccaaacacaaacataac

SEQ ID NO: 512433 - DNA, 581 bp, Homo sapiens
ggagaaccagtaccacatacccgttaggtaataaggtgtccatgcagaggatgacggtcagcggagataagcagggccagtctcagtggcccgtgagtacgaacactgtgggacaattgtcaaaggagcgggggacgggcaaattcacctagcaggttgctaggaagtttagaaatatatactgtaattcagacactcagcttctgatctgagtatagggtgaattgatggaggggcatacgctagtgatgacagagctcgcctcctacaaggaggagaatgttgcaaaccgtttgtccccttcccatacctgggactatatgatttcttagccctccaggggacttatgagtagaaatacttgaagccaccaagtctagacttgatggtgtccaagaataaataatactgattgcctcccgtaggtccttggtccagctaactcagctgttgtataattgaagggattcaacaaaattatctctagcatcaggtgctagacatggttcgaatctcaccagtggtttagtgacttggtagatacgctataacggtaaggtagataagtacaatgactgcta

SEQ ID NO: 512434 - DNA, 337 bp, Homo sapiens
atgactacggaggaggttctatgccacttctgtgaccctggactactttaggaaattcacgcactgagacgatcatgggctggagaaaatgtacgctgacactgacaccactttcgcaggtacaggattaatctctcctaaaaagtaactgggccattcctttcagtgacatataaatcgttacaggcgctatgtacagattgattttacaaatcaaacctttactcaattatttaaaacgagcaaaaagagagtggaagaatgcgcgagactgctacccaccaccatttgtatgtgagtgacagcaactgaatacttctttactgagacgaatcct

SEQ ID NO: 512435 - DNA, 449 bp, Homo sapiens
gctcacttccattatccctttatcttttttttactctatgtatttatttgtatgtgggttcacgaatgccatagaacccgtggtcagagcatgcatggttgggcatcagttatcctctaccatgtagatcctaaagatcaaactacatcactaggagtggcaacaagctgtctccctcacggcccctcagtctcactttgaaggacccgacagcagcgtagctcggggttattggataagaagatattttcattgaagaatgaaacagaagagttgttttaatccctctgaaagtcacttctccagagcttggggggcaactctatggtaaagtgcttgcttagcatctgcaagacacagggttcaattcccagcaccacaaacaacaacaaaacaaaacaacaaaaagcagaaagtcacccctgtctatttttatactgggtcgacgc

SEQ ID NO: 512436 - DNA, 700 bp, Homo sapiens
tctggagatggagtctcactctgtcgaccaggctggagcgctgtggtgcgatatcggctcacggcagtctccacttccggggttcaagcgatcctcctgcctcagcctcccgagtagctgggactacaggcgaggcgtcaccataattttggtattttaagtagagacattgtttcgccatgtgggctgggctggtctcgaactcctgacctcaagtgatctgtccgggcctcccaaagtgtggggataacaggcgaaagccaagcgctcccggccaggaacaactttagaatgaaggaaatatgcaaaagaacatcacatcaagggatcaatataataaccatctataaatgactatatgtgggctcattatgactatttcccaagcattctacgtgtgacggcttgaaaagagttgttggtccttgcatggtggagaggggagaagggccaggactctctaaggtggactcaatctgggggtaatgacttcccaaattagccaccccgggccccaccaggtcctttaatggggctcgtggattggaaaattctttacccatgtgattgtccctggtctctccaatagtgggccaacagttgcccaacaggtatgctcacaggttaagtatatcccacgacgagaaccgggggctggattctacaaagggggggctgcctattctccgaggaacaaatg

SEQ ID NO: 512437 - DNA, 310 bp, Homo sapiens
  misc_feature (120)..(120): n is a, c, g, or t
  misc_feature (255)..(255): n is a, c, g, or t
  misc_feature (283)..(283): n is a, c, g, or t
  misc_feature (299)..(299): n is a, c, g, or t
cttcaatgggtaaaggctttaacagcttgttttattcatactggggattaattacttgccacaaaacaaactgtctcgataattttcctcttgggtttggcagtgctgtagccttgcagncctttaggagggagcgctcccatccgtccttccctttgctttgtgtgaccacatgctttctgtaccattcacttacttgggaaagaagtggacttatctcctaattgttttagaattttgcttgtctatttagcnttcctttttggatctcatgatttatggnacaataaatgtcatgnaaatgctgaaa

SEQ ID NO: 512438 - DNA, 318 bp, Homo sapiens
tgggccatagctgattcctgagggtaaacctacgtcagcgagagcggaaagcatgctcgaagttgttaccaaccttaaaaacagcgtcacagaattcgtattatggctgcaaagtcaaatcatttcatctcctatgttgagctttttacaatttacagtagcatttacaataatatgagacgttttacctgtgacaaaataaacttccacaagctttattttgatcccatgagataaatgaaaaaaaatattatttgaattaattgattttctgtttaaaacacctggtaatactaacataaaactggaataatttat

SEQ ID NO: 512439 - DNA, 327 bp, Homo sapiens
ctctctgaaacacctgtctgtgtttgtcctctttcctttttgggggtgtgtttttcttgttaacatttattaagtaggcactcggctgggagcagtggtcacacctgtaatcccagcactttgggaagccacggtgggtcagtcgcttgaggccaggagtttcagaccagcctggccacaacagtgaaaccgcatctctactacaattacaaaaaattagctgggcatgtttggctcatgcctgtcatcccagctactcaggaggcctacggcgggagaatcacttgcaacctgggaggcagaggttgccggtacgcagggcatcat

SEQ ID NO: 512440 - DNA, 806 bp, Homo sapiens
tggaaaaagtctggggggccagggggtgggttggaaaccagcttgggggggttcgatcccttccttttgggtctaaatttaatgtataggggttcttcgaaggtgtgggtaggggggggggatccatatagtcactccggggttatagggagggttcttcatacatattaggacttttcgcttcgaagcgaaggcttctcaaattcagtgaacacttttcaatatctacggcgtggtagagaaagtgaagtgagcctacagatgactaaggagtgtcacagggttgggtgtagttgcatcggggtagtccgagttaacggtcggggcatcccggaatagggccgaaaaaggtgtggcgggcaaacaacgcggtttagcagtctccccccgagtccaattagtgattacggtgcacacgggactcttcggggcgatagcgcttgggccctaggggtgctacgccggtgacgaatatacggggcgaacactccagcatgaactgggaaccccgtcccatactgacgttggccaaccaccaagcgcgcaaaccggatgaggggcaacatcagtgggcaacggtcgacgcatcaacaaagggacacagcaacgtgagtccagcgcgtagcacacagcagcgtccccaccgcgatagcacgccacgggcaaatcacaccaagggcccagtcacgagggccccccaacacgtggcgaccaccgccacaacagggacacccccagcggggaccaagaagccacggccaggcaccaatcccctccactccacggctacccccggcccattccgc

SEQ ID NO: 512441 - DNA, 515 bp, Homo sapiens
  misc_feature (10)..(10): n is a, c, g, or t
  misc_feature (36)..(36): n is a, c, g, or t
  misc_feature (105)..(105): n is a, c, g, or t
  misc_feature (110)..(110): n is a, c, g, or t
  misc_feature (118)..(118): n is a, c, g, or t
  misc_feature (154)..(154): n is a, c, g, or t
  misc_feature (156)..(156): n is a, c, g, or t
  misc_feature (160)..(160): n is a, c, g, or t
  misc_feature (166)..(166): n is a, c, g, or t
  misc_feature (183)..(183): n is a, c, g, or t
  misc_feature (193)..(193): n is a, c, g, or t
  misc_feature (200)..(200): n is a, c, g, or t
  misc_feature (231)..(231): n is a, c, g, or t
  misc_feature (306)..(306): n is a, c, g, or t
atacgatcanaggcgaaggttacggccccccttgantcgacggtatcgatagcttgttatcgaattcgcggccgcttcgaccggctgcgagaagacgacagaggnaggantggccgcntggccaattcatcgacacggggccggttgtccatcncngagnttgccnaagccagcaactcctcntcgcttgggnccgggantccctgcccaagccccagcttgaccccatcnttcctcttggactcagagttggtgtggcttacctggctatactcttcatcctccccacctcctggggaatgatgntgtggccaggcagttatagattaaaggcctgtgagtactgctgagcttggtgtggcttggtgtggcagaaggcctggcctaggatcctagataagcaggtgaaatttaggcttcagaatatatccgagaggtggggagggtcccttggaagctggtgaagtcctgttcttattatgaatccattcattcaagaaaatagcctgttgcac

SEQ ID NO: 512442 - DNA, 201 bp, Homo sapiens
ggttgacagcatctggaaggagaaggcagttgtacttcgggcagtggagtgaactgtgtgcgtgcctgaggaagagggccgggagcgtgaggtcgggccctgtcactgacacgggcactggaggaggagcaggaggcacgtgaggagctggagcggcagaaccgggccctgcgtgctgagctggaggcacttgctgagcag

SEQ ID NO: 512443 - DNA, 176 bp, Homo sapiens
gccggtcgacagtctgagtactatggtttagaaatttgtttgaaatcaagtaaccaagcttggaaacaactcttgggagcgggtagaagactacagtccagaattctagaaattttctcccatgcagacctgtggacacctagtgaaaacggagctggcttcctgtatgtctcagg

SEQ ID NO: 512444 - DNA, 159 bp, Homo sapiens
gaggtgacactactgcgtgctctactaggggaggctggcacattagatgtttgtgataatttcataatttggaccatttttgccttaagaaatatgaggattcttctgcttgggcaacaaggttgttgtaaaacataaaagcattaaaacaaaaaaaca

SEQ ID NO: 512445 - DNA, 329 bp, Homo sapiens
ctactactactatattcacgggcggcggacgaaagaatttcccccttatagcctaggctggagtgcaatggcgcgatcctggcccacggaaaacgccaactcctgggttcaagcagattctcccatcccagcctcacaagtagctgggattacaggcacgcaccaccatgcccagccaatttttgtatttttagtagagacgggatttcaccatgttgggccaggctcgtcttgacctcctgacctcaggtgatccacccacctcggcatctcaaagttctgggattacaggcatgagcaccacgcctggcgaggtcgacgcggccggc

SEQ ID NO: 512446 - DNA, 148 bp, Homo sapiens
actgttggagtgtgtcgtgtgtgtctgtgcatgtgcacatacgtggtgcacaggagaattgcagttaacactgttttatgcccttccctttcccatccctgtggaacctatgggactgtgccaggttacagatgctcttcctgcaaat

SEQ ID NO: 512447 - DNA, 872 bp, Homo sapiens
  misc_feature (26)..(26): n is a, c, g, or t
gggcccacacgccttaagggggtgtntgataaacaagttatcgcaagtgcggtgtctgacgtgaggtgccaaagccgcttaagtaatcaggtgaacgcacactcgtttgaatgggaaaggtattgaggactgacatggatgtatgataatggacggtgtactcgcatgagggagtttgatgggccggcacaacattggcccatcgcttgccgctggcgtggtccgtttgtactgtactcgcactcgcgactcacacgacactctcgcacgtagtaagtttgaatgtgttggccaccgcgcacggtatacagacacatacgctctgaacgcagtgttgttgtgatatacccggccttcgtaagttgggtgctgtcgacgcccttcgccgtgcgctgtcttcgctctctctcttggtggagggcgttcgtatcgtctccgcgccggtcatgtatccggggagttgtttcatggccgcgcgcaatgggcggctcgcggttttttcgctgagctagtgtgtgctcccccgagaagattgcacacactggcggctgtctactcttcgcttcgccctcgttctctttttcgtactccgcccagttcgcaccgcctgtctctttaatcgcactcgacgcttctgtgcactctgcgtcccgctcattggtattatcccctcccttctcacacagattaccccactagtgtagacaggactatgattattagaaggactccatttgaacaacaacccacacatgccccccgccactattctcctccacgacacacttcttgccccctctactcgacgccgtttacttattccttgtttcccccctgtaataataagaatcttgaaacatccatatccaaaa

SEQ ID NO: 512448 - DNA, 384 bp, Homo sapiens
atgagatcaggagctggatggttttcctttgtcgagaagactgaggaagatggtaagtgaacaacaacagaatatgccgtattgagtgagggacgtgatcaggctctggcctgtctgacagaactcattctcaccaataatagtctcgtggaagtgggtgatctggaccctctggcctctctcaagtcgcggacttacctaagtatcctaagaaatccggtaaccaataagaagcattacggatggtctgtgatctataaagttccgcaagtcatagtactggatttccagaaagtgatactaaaagagcgtcaggaagcagagaagatgttcaagggcaaacggggtgcacagcgtgcaaaggatattgtcaggggcagatga

SEQ ID NO: 512449 - DNA, 662 bp, Homo sapiens
attggcacgcgcaccggcatgtacggcaaccagggcccggagagcagggaccggctggggagcatcaagcatgctgtgaggggcatccaggtctaggccgtgtggtacccagaagtgtcccagcccaccacaccgtttacctccctcgccctgccccgcaccgtggggatgcccaactcacagtgacttcccgtttggggcccggtgtggccgcgggcgggtttatccaaagggatggctggaaattggccgctcccacgaggctccctccatgcttggggccgaggtggccctatctgtgtgcatatgggcactgaagaattacaaagtgatttattttttatttcaaaagaaatctcaagagcagctcaaagtcttcatttggaagtttaatggacaaggtttttaggtaatatttcggattttaaaccatattattctctaatcttttaaggcttgttagggtattccatatcttttttgcttgttgtctttatattattttattttttttctcaattatttgacatttttttttttatgttatctattgactctccatactttatttatttattatattctaatatctttattaatagtttattttattaataatatatcattcttatatttattattttttataacataatctttca

SEQ ID NO: 512450 - DNA, 111 bp, Homo sapiens
atcttactatgaatccaagagttctaataggatactgggccctctggagaaatggccctgctgatcccattagttaggactctagttagctgctgtggctcatcgctgcag

SEQ ID NO: 512451 - DNA, 568 bp, Homo sapiens
agcggagagttccgctgttgtcgtccaggctggagtgcaatggtgcgatcttggctcactgcaacctccgcttcccaggttcaagtgattcttctgcctcagcctcctgagtatctctgggattatgacacccatcatcacggctggctaattttgttttttttgtttgtctgttctgtttgtttgttgttgttgttgtttgtatttttactagagaccgggtttcaccacactggccaggctggtctcaaactcctgacctcaaaagatctgcctgccttggtctcccaaagtgctgggattacaggtatgagccacacacctgaccacacaacatacgagcaaacgagtgacgtaaagctaggtcgtaaggcaggggtaagaactgcgcacgagacgcagacgcgctcaagaccagtcgacgcgaaagcgaccagctacacggaacgacaagacgacgaaaacagcactgaagcactcatccatgcacgacacagtactactcacaaaacagcactcgaacacatgcgaacactaagcacacaaaaagtcatgaaccaaacctggg

SEQ ID NO: 512452 - DNA, 115 bp, Homo sapiens
agacccgaatggacgacagagcctcagaaataggtctcacatctatcaacctctgatcttgagcaacttgacacaaacaagaagtgggggaaggttccctatataatacataggg

SEQ ID NO: 512453 - DNA, 412 bp, Homo sapiens
  misc_feature (24)..(24): n is a, c, g, or t
  misc_feature (407)..(407): n is a, c, g, or t
  misc_feature (409)..(409): n is a, c, g, or t
  misc_feature (412)..(412): n is a, c, g, or t
caacatccctgttgatttccatcnaaattcctgtgcagccagcctttttaatttgaagtaatcctgaagtcatcctattttttcctttgctttcccggggtttgagtttaaatcataaagtcactgcccagctgggtgtggtgattcatgcctgcaatcccagcattttgggaggccgaggcaggtggatcacttgaggccagtttgagaacagcctggccagcatggtgaagccccgtctctactaaaaatacaaaaattagccagacttgatggcacacacctgtggtcccggctgcttgggaggctgaggcaggagaattgcttgagcccgggagatggaggttgcagtgagctgaggttgcaccaatgcactccagcctgtgcaaaagaacgagactctatcncnacn

SEQ ID NO: 512454 - DNA, 170 bp, Homo sapiens
agtatagcagcagagtctgtgcattagtctccaacagatctcaggttgaggggcggcagagagcacatgctgctaccacgcttttcacacagtcatgtcaggctcccgggcatgaggctgagggctccctgctggatctgaggtgctctccaggtgggtggtgagagcgc

SEQ ID NO: 512455 - DNA, 644 bp, Homo sapiens
ttgctggctccaccagacgatggagggtcgacccagcttctgatgagcatggtcattgctgtgtcttactgccaatcctgtccctgattagttgcttgcttcagtcaccaataacagaaggcgtggcggccacccgagcgtgcttgaacaaataccagagggagggtgctgaggctcacttagtggatctatcagacatgtgcgttccaagcgagctccaggatcagaatttacacgactgcgctgggtcaatgttcaccattgataaggttgtgcgccagtgtttgaggatagcccaaggaatcaaggttcgtagtagccgtacataaagatatcccacaggcttgtcttgggaaagtccgatgtacactcagtgtcacgggaaccagcttgctatccaaaacaatattattcacgcaaccaccgtcacactattcgttgtaagcgaacaccaaaggtgacgacactggattcaatatcacaacggacgcacgactgctgtggccattacacagaacacacactcagccagcacgttagacaaaaggaccctgcgaagcccagtgagggacccaggttacttccaaaggcctaatatgggactcccatggccttactaccacacgctggttgtgcgtgtctaa

SEQ ID NO: 512456 - DNA, 477 bp, Homo sapiens
ggactaccgtggtagctttggcgcttggcgctttcagcataggtactgctattcttacaagtgctctacctcagtaaaggttgaggggatccaggccttctcatggaactctggtatttagctggattgtagctggaaggagaatgcacattgccaacataacaaaacaggcgctgggcttactgagttccttcgccaaaacccaggaatgtagacttgttctcatttcctcattttatactcctgtgaggaattcttggggctgcataaagtgattaacccaggagccagctccttggcgtgtcgggtagagaggccaggcttaatgagtgtactttctcctgccttgatctcaaggagctcagcaaagtcgtttgtgcaaataaagtatacagtggaaaccactgtttactccattggattaggctaaaccagattgtaaaaggcagatgggaaaaataaaaaataaataaatct

SEQ ID NO: 512457 - DNA, 256 bp, Homo sapiens
gtatgatatgagcggagtagtagatactgcattcatggagtgggggggggtaacagtattttaattttaaaacaaataacaagtaatggttgtcaagattcccatctccccaactttatttgtcgcattggttttcagaaattttaattttttaaaaatcagatgccttttggaagttgtatgtttatctgagcaataactaaattttatttcttcttcggttgtggaggtgtgttaaatttgaagaagataatat

SEQ ID NO: 512458 - DNA, 380 bp, Homo sapiens
tttttactcaaaccttgtggggcctatagactctcctgtgaagtatctggattcagcatcgatgcttacaaattgaattgtgtgtcctgtcagcctcgagggaagggactggagtgggtcgcatccatctatagtcgcaggggttatgtaaactacgcagagcgcttttaagggcagtgttcaccgtctccggaggcttccccgaggcgtcagtttatctcccaatgaacttcctgagagacgacgacacagcggtctattattgtgtgcgacaaggaatacaacattatgactatcgtttggacgcctggtgccaaagggaacaaccggtcgtcgtctcgtcaggaataccccgaccagccccaaggtcttccccgctg

SEQ ID NO: 512459 - DNA, 170 bp, Homo sapiens
ccttctacgtctcatcactgaagtctcaccacctttaaccaacagacatgacctgctggaacaattatcttgtactgatcccatgtggtggcaggctcgggctgcagggcatgggagggtggtcgtctggacagtgctcatggatgcccgcagtgatgagacgtagaagg

SEQ ID NO: 512460 - DNA, 106 bp, Homo sapiens
  misc_feature (1)..(1): n is a, c, g, or t
ngccggtaccgacacatgcaggtgccttgcagaaacaaagtcaggttcttcaagtcacaaagggaagggcaggaacaaatcttgcctctcagtcccacacaaggca

SEQ ID NO: 512461 - DNA, 263 bp, Homo sapiens
ggtgggcgacgaccctttacaacccctacaagtctctgacgacaacccttattacagactactacgatacttatgaaaggcccagtacctgggggcaggtaccggcccggagtacggcactggcttacttccagctacggatctcccacgacctggatggccagacccactactatcatccagcgcttccacgctacgtgcacgaagatgtccatgatacaacctgcagtatgcgcggcgtgagcgagaacgtgtctgggcca

SEQ ID NO: 512462 - DNA, 305 bp, Homo sapiens
ccaccctaaaattaggttttaaaaggctttttaaaaatcacaaacactggggccgggcgtagtggatcacacctgtaatcccagcactttgggaggccgaggcgggcggatcatgaggtcaggagatcgagaccatcctgactaacaaggtgaaactccgtctctactaaaaatacaaaaaattagctgggcgtggtggcgggcacctgtagtcccagctactcaggaggctgaggcaggagaatggcgtgaacccgggaggtggagcttgcagtgagccaagatcgcgccactgcactccagcc

SEQ ID NO: 512463 - DNA, 312 bp, Homo sapiens
  misc_feature (11)..(11): n is a, c, g, or t
gacgactgacnccccgggtggctgcgtgtatgtgggttagcgtggtctgcatggttctagagtgaaacaggtgtcaggcggtcactggttcacacaaatttttcataagaaacatttaccaggggagcatcttgggactctcggtttttaaaaccttctgaaccatgactgggagccggcagagtaggctgtggctgtggccttcagcacaaccatcaacttggcggttcaagaaattacaggtttccgtccattccaaggtggtaaatgctagtctttttttttttttttttttttttttttttttttttt

SEQ ID NO: 512464 - DNA, 977 bp, Homo sapiens
gcttcgcaatgcttgcataaatggttctgtgagccataagtttcaattcaggaacttggatacaatcggatgtagcctgtagcacttgtgactctcttctgtttcgtgaactgcgagtggaacaggaatctctgttgacagcttttcgctgtgagcctgcagttttataggcatcattgcctcacggaattgaaaattcccagatctatctgttaggtctgcatgcttttcccgagaactgttttcgtcatcgcttaagtcatccggcacaagaaaccattgttgcactactctctctaactggatgtcttggttgttacgatcccctttaatcgatgcaaagaatgaaagatctggaggagaacctcaatattgcaattgatgtcatagatgcttaccaagaaagcatcctgaatcagagtgggcgtttcttgattattactgacctctttgcgtgaaaaagtcccgagtacatcggtactgggccatgtttcccaaactgaaccaatcaagaccagagttaccctgttgagaccttatgatagtccaagtataacgagtgatgagccactcatccatggatgacgactccctgtgtttattcgcggcatgctgagttgacttgcatagcaccttcgtggatcagtgcaagactgtgctcaagctggcctctgaggagcctcctgatgatgagagaggcgctggctacaccttaggctgtctcaagcgtcctgttgcgaaaatgaattgtgagtactagagctgctcggtatctggcaggttttccctggcttgctggaaagagtgattgatctttttgcagggtgattcatgtagctcggaagaaaggaaaccgaaacccttctccagttgaatggtggttgcgatgacacccgacagtgccatctccaatgttgccaaaggtgttaagattctcatgcctcaccgttggatcgggaactctggtcccagaatta

SEQ ID NO: 512465 - DNA, 472 bp, Homo sapiens
  misc_feature (158)..(158): n is a, c, g, or t
  misc_feature (160)..(160): n is a, c, g, or t
  misc_feature (266)..(266): n is a, c, g, or t
  misc_feature (268)..(268): n is a, c, g, or t
  misc_feature (307)..(307): n is a, c, g, or t
  misc_feature (328)..(328): n is a, c, g, or t
  misc_feature (394)..(394): n is a, c, g, or t
agcccaggacccagctgctgaatgactctcgcctgcctgccccccaaactctgatgactggagatgactttcttcgtggctgagagcgtagggagccatgtgtggggcccccggagcctttgcttctgtggggagcgggcacacagccccctctgcananccagtccgggctggcagggtgtctcagacaggctgctgacaggcatgaagcagagctgtgggacaggtgtccaggggtggccccagggtccatgtgtgtcttcaancnatctgcgctcttcaccgcaggcttcataccttttgtacntttatacgtggactgcagacnactttgtgggagggcagtgacatatcagcacacagactcgatggctcgtgatattcctggtgacancctggaggctctcacactcgaggggaagagctgttagttcataaaacctgctggaaaaaaagttccgaaaaactgtta

SEQ ID NO: 512466 - DNA, 140 bp, Homo sapiens
caggatacgacgcttgatgttgtgctgtgtacttgctgtatgttctccatgtgagcaagattgaaatgtaagcttttatttattattttagaatgtgacataatgagcagccacactcgggggaggggaaggttaggtag

SEQ ID NO: 512467 - DNA, 320 bp, Homo sapiens
caaggactaaagcctttgttcatagaaatttgaacatgtaggccaggcacggtggcttacacctgtaatcccagcactttgggaggccgaggtgggtggatcacttgagtccaggagtttgagaccagcctggccaacacggtgaaaccccatctctactaaaaacacaaaaattagctaggcgtggtggcgcatgcttgtaatcccagctactggggaggctgaagcagaaggatcacttgaacccaggatggggaggctgcagtgagccaagatcatggcactgcactccagcctgggcgacaaagctgactctgtcc

SEQ ID NO: 512468 - DNA, 703 bp, Homo sapiens
cctatgccgcagacctgatttaggccaggcctgcgagaattagaggatgacggccaccaagatggaccgattgctcaaggtcatgaggatcacagttactgacggataactatctcttgtccctgcctatcaaggaatcaacgagcattgctatcatgctactagactctataaaggatgaccgactgacgatcatgccagtgcagaagcagagccgagcctgacagctaaccaggttcatggcatctgttgctatcagctacaacaatgttcacgtgcctctggtacacaagggctgctaggatgtggacatctgcatccctaaggacatgatcctgcccaagctctacatcgtcatgcgcgcagagatatactagagcaacagagcgtaaagtccgacactagcccttgcaagatgacgggctactacaggatctacgctgctaacgatcagccatgccatcaattgtaacagcaattggcttccccaaattgccctaagatacttatcaaacagtctgacactcaaaactgattcaacctatcactgatctcactcgtcattatggcaaacttagcaaagcccccttgcaaccatgtctaaacccacatctacaagctcctaggccctagaagcacccggattcaactttactcttacaagtcaatcccctcttagatcactatcgccgtctcctccccg

SEQ ID NO: 512469 - DNA, 248 bp, Homo sapiens
  misc_feature (28)..(28): n is a, c, g, or t
tcactcttggtcttgtccattctatggntcttaacaaccaaatgatgacatgtattcaccattatggtatcatgcagaatagtttcactgacctaaaaatccactgtgcttcactcattcatccttcctctcccttctaacctatggagatagtaaaaaattgatctttttactgtctctatagttttgccttttccagaatgtcatatagttgaaattgtatagtaactagcctttttcagattggg

SEQ ID NO: 512470 - DNA, 168 bp, Homo sapiens
  misc_feature (13)..(13): n is a, c, g, or t
  misc_feature (44)..(44): n is a, c, g, or t
  misc_feature (51)..(51): n is a, c, g, or t
  misc_feature (65)..(65): n is a, c, g, or t
  misc_feature (68)..(68): n is a, c, g, or t
  misc_feature (90)..(90): n is a, c, g, or t
  misc_feature (95)..(95): n is a, c, g, or t
  misc_feature (137)..(137): n is a, c, g, or t
  misc_feature (149)..(149): n is a, c, g, or t
gggctttggcccncccatttttactattggccaaaccctttttntaggaangggctttttttggnacncatttttacccattttacattntaaancagggtaagttgtaaattactgttttttatgtccaaggaccnccaataaatcanatggaaatttatatttata

SEQ ID NO: 512471 - DNA, 165 bp, Homo sapiens
tccactcttctgctcaaaaccttcccaaagcttgttccctcactcagagtaaaaaaaaaaagaactcagccaggcacggtggctcacgcctgtaatccgagcactttgggagtccaaggcgggcaggtcgcctgagttcaggagttcaagaccaacatggccaac

SEQ ID NO: 512472 - DNA, 126 bp, Homo sapiens
aaggttgagtctcagcaggcatcccggcacaggcaagtcagcaatttcattggtgcagtcattcaagcagcgggtgccagccgtccatggtgggtcacggcagctcggcaattcggtcaatccatg

SEQ ID NO: 512473 - DNA, 1372 bp, Homo sapiens
gccgtgggcagcctgctcctgcatggcccaggccagacagcgtggtcctggagtaggctgtcctgggctccacagcgcagatcctgtacggacctggacctgacgtcacagcagggaggtgcctggtggaagcgcgtcaacacccttatgacactacaatgtcctgggatggagccaccctcatcctgtccaaggtgggggtctcccagcagccggacggacagacatgcaggacctgactggaggagcgccatgccctcctggacggacgtgagaaccgtggtgtggcacctggtgcggacgaccgacgaggtggacgagtggccagtccaatgacgctggtctgcgtcgacaagacgaacgtgacgcggaccgaacgtgccatcaccgacgatctacgctgacgcggctgctctcagctcaaggcgcccactgcagacagtcatatgtaggacaacatctctatccacgaggcgctgctaggccgccatgtggccacagctgcgtgcacaccttgacaagtacaaagtacacttcttcggaactatcctggggaccgagcagtgcagacgaagcaccaaaatcacacaggcatgacagcacacccatcccaccttcttgcgacacacaccgacaccaagtattaccgactcccggtacttgggctagaacatacctcccaagaacacacaccaacttccatcctattagacagtgcactgtaccaagacggcagggtaaggcacggctacgccatggtcacagtacacaaccgaacgcaaggcaacatacccgtggcaatgccatcgtgaccagccgccaacgggtagccactcacaccctgagagcccgccagaacaccgtcccagagacacgcaagcactggctgacacacgccagagagacactttcacaacgctatacaacaaacgaatggatgagagcgaccacctacgaacagaggcactaccggcgccacacatgagctgacagcgaaacaggacccaccggacgacgaccaccgacacgacgagggacagcgaaaatacagagcaagaccagaagctactacgtaaacaccaagcacgcaaccaccccaccacaccaacaccaaattagcctcaagaacacaaaaataatcggaatacaccacttgtctgaaaccactccactccacacaaaccgaccatatacacaaaaccattgctgtcgctcacacatccaaacaaaaaagctcaaagaataattactttcaatacaaaccacaagccaacgcatgcaccacaacacacaccaactaccacacaccactcaccgtcatcatctctaccatcgcgttcatatcacatgcatacctctacaacccaacctg

SEQ ID NO: 512474 - DNA, 293 bp, Homo sapiens
tcaatgacttccttaattgtaggtcaatgaaatactttgcttactttatatttaagagatgtaccatgttaaagaggcgtcttgtattttcttccatttgtaatgtatctgatttatatatgaagtaagtcttgaaactgtccatggtatcctgcgtgcatttgtgagccaaagagaaaagattaaacttagtgagacctgtatttatattagagtgcccttaaaataatgactttaagacctttactgtctgtaagagaattctaagattgtacataaagtcatatatattg

SEQ ID NO: 512475 - DNA, 377 bp, Homo sapiens
gcgatccccagattacgtcacctagacggcaggcccatcgtatcatctctctcaggatcaacatagattcatgtgttcattcatctcaacgacagcatggcccatgttttcattccgtttctgacttggaaagagccctggcgttcattcatctcaagacagcatggcccaggtgttcattcatctcaagacagcatggccaatgtgttcattcatctcaggatggcatggccgatgtgttcattcatctcaagacggcgtggccgatgtgttcattcatctcagaacggcatggctgatgtgttcattcatctcaagacagcatggccgatgtgttcattcatctcagaacggcatggcccaggtgttcactcatc

SEQ ID NO: 512476 - DNA, 221 bp, Homo sapiens
ctgaggtgactctagaggttccgctgatccgcttagaatatatgcttccttaatgtcccgcttacgtcctggtcgatgcgctggatgtgctcagatgacctcttgccttctccttcatgatctggtatcttccgcgggtttttcaactatcatttccctcagtgttccaggaggactgaccacatacgggcccccggatgttcatgtggcatttcccttgt

SEQ ID NO: 512477 - DNA, 331 bp, Homo sapiens
  misc_feature (16)..(16): n is a, c, g, or t
  misc_feature (46)..(46): n is a, c, g, or t
  misc_feature (310)..(310): n is a, c, g, or t
tgagacagagtctcgnctctattgcccaggctagagtgcagtggcnaattctcggctcaccacaacccctgcctcccgggtgcaagcaattctcctgcctcagcctccggagcaactgggactacaggcgcatgcagccctgcccagctaattttttgtatttttagtagagatggggtttcactatgttggccaggctggtctcgatctcctgacctcgtgatccacccacctcggcctcccaaagtgctgggattacaggcatgagccatcgcacccagtcatttgcttttttatatactagaatgancaactgggaatttgaaatttt

SEQ ID NO: 512478 - DNA, 363 bp, Homo sapiens
  misc_feature (8)..(8): n is a, c, g, or t
  misc_feature (323)..(323): n is a, c, g, or t
gacggagnttgctgtgtcccccaggttggagtgcagtggatgatctcagctcactgcaagctccgcctcctgggttcacgccatgctcctgcctcagccgcccaggtagctgggactacaggcgcccgcaacacgcctggctaattttttgtatttttagtagaaacggggtttcaccgtgttagccaagatggtctcgatctcctgacctcgtgatccgcccgtctcggcctcccaaagtgctgggattacaggcatgagccaccgcgcccggcgaaacttttgcaattttcaaacatgtttttttccaaagtaaaccaatnaattcgaactcaaaggttccatatcatcattaagctttga

SEQ ID NO: 512479 - DNA, 499 bp, Homo sapiens
taaacaaaaagggagtaggggtctggcaatgtggtccaggctgacggggcctcaagtgacccaccttagcctcccaagcagctgcattaacgggcacaagccagggcttcgggctctctatctcttgattctgcggctgcttaatggacttaattctcaggcttctcaccccatatgcccccgtgcaattccggagtttggggggactcagggtttaaatcatcaaagcacccaggtgggctcctaaaaaaagccctgtgagtggcttggctgggacccatcaacagtgtccagagacgactgacagactatccaggagatgagtggccagatgtgcccacttctgtggtaccgggagaccggggtcacttgacatgcagcccaggcacgacaggacaagcccgtgttcggtgacctcacagccagactcggtgggacacccgcggggacgggggctcccgggcaacaggctggcgggggtcccggaaagaatccccaa

SEQ ID NO: 512480 - DNA, 975 bp, Homo sapiens
ggcattggagtggttacctacgctgcaccctggaggcgctgcggactgttagctattgtggggcgcagactcgggtctggcatgcatgcgcgccttttgtgttgcctgtagtctgtgttcagtatcttcgtatacccatgcttgtgcctgtgtaccccgctgttcggggttggttgcacccccgcccctggggcgatgattgtgacccacacctggggttctcccaacacgggattgtgttccgtcagcacacccactgtcaagatttggtgcctctcccagagttgggagttaatggtcgcccgcccccagtgttccagaagtccgcaccagcattttctgccccaaaacaattttgtcagggggaccccaacccttttacaatggggttggagatccctaaacattcttatggaacgtggggctcccccccaaccggggttgattatatttcgcggccccccccaatcgggcgtctccaatcacggcgcacccactattctgggacgacgctcttgccattcgcgttggctataaatggcggcggaaactcttccacccactcattcctgacgatgtctatcagatagaacaatgtgggatgcattttctaattataactacagatggtaccactgacgacctttttgttgggtccccccgcagtagcacgcggcgttgagcccctagttgataatgacaatgtgtatgtctcctggggtagcccccagcacacgaatcgtgtttaatcagcccccccctggacaccaccctgggtaaccctactccctccccttttctccgcggtcccccctgttgtctgaaactgcttgtttatggtggcccgaaaacttgtgagctgtgctaatagcttgacgatctcttgtttttaagaaagatataattttggtaaaattatcctccccagaaatctcttaaaaacaaaagttttttttaagcccccatatccaaaat

SEQ ID NO: 512481 - DNA, 910 bp, Homo sapiens
gcccgccgttagggtgctccccccgcgagtttgccggcgcggttggttgccccggaatgaattgtggaagaccactctgtgggggccgataaagaacgagccaaagagaagtgctccggatgggggttcatttatttcagtcagagcggaaaaagaacttgttgtgtatgcagaccccaccgtggcttctgtttgggttcgtaaacagagagagccgtgttgcagtgatgttctgttgccccccccccagcagtggcggtcgcacccccacacgaatgtacagagcgagagcattaattagagaggctgtttctccccacagacagcacccaccctgcagatgtactgcactgtgtgtgtcagctcacccgcggagaggaacccgagagacaaagagacctctctccagcgaggtcgcatgaagagagagaggagagcgagagagaggggaaaaaagtgagcttcggcgtgatggaagacacccccctcccgcagagatgaagaggaccacgcgtgcgagaaaggaaactccgcgagccaccgcgggcgtcggtgtagttggtggccgagctattctataaaagcaacacacgtgcgacccgagcactcgcccatccacctactgcctctcggtgttacagtcctcaccactcacccctgcacattactcataggattaacccccaccccacccacgcatactgacttctacgtgacaacgttccactcacgacttctttcaataaagacatacgccaccatttgtcgccacacaccacattacacaagacaagaacccactctgaaaactccagtcgtatgctccccacagaagtcgattgaacagacagagactcatgcaacacaacagtacagtactaagcaagaacattatccgaccccatcacag

SEQ ID NO: 512482 - DNA, 123 bp, Homo sapiens
  misc_feature (119)..(119): n is a, c, g, or t
acagacaggtgagaaagaggtattgcagtgggagggagggaaagtggcgggagaatgagatggaggacagctgccctcgtcagaccctaaacctgcacttcttatgatattacttttangtaa

SEQ ID NO: 512483 - DNA, 1036 bp, Homo sapiens
gaggaggggccctgcccccagccaagagggccaagaagccagaagaggcgtcagagagtagttgaggagggatcttgaaagtgaggatggaggccccatgcagggacacgaagccatggtaaatgtgcctctgaaaaaattctccagtgtcatgagctgcctcatgcccactgccaacggggacccctgtggaaatggcggctaccccgagcaccccactgcggaatgtgcaggggcatgtaagcctcaccatgacacaatgtgcagtggagagccagcagcgaggactcacgatgatgcaagacatgcgagggacgtcatcatagacaaggtgacgcgacggagaactgcccacgctgcctaactggccccttgcctttcaagggctggaatgggcctccagtgagaaaaacccgtcatccagtgtctcggacgcttgcgcatcaatgaccacaccatggcacaaaagtgggcaggttccccgcaccagtgtggaaaacctgggacatgcattgccgcccgatgctgcccaccccctgttgggcgacacgaccaccggtggacccttggccaaggttaggccccatctgggccccaaggcagtgcggaccccgccgggcgcaggggcacggggaccaatcggcacacgcaaagccctaggcccaagccgggaacgcgcacaccccgccgggccacaggggacagcgagaggaggcaagggaccggcccaatgcgcaccaacgtgaccgcaaccccaccaatacgaccgaggaccacacggggacccacaccccgcaaagggttcccaacgaaacgccgcggaccgcaccgaggcgccgcacggtgcgccacaacaacgggcaggtcgcgcccaccccacgggggaacaccggggagcgctgtgcgcccgacggccaacgcgcttcacactataacgaacgacacccagggtggcgccattggcaaccacggagccacgaaggagacaccacaagggaggcggaaggaaaccagcgaggagcacggaggcgaacac

SEQ ID NO: 512484 - DNA, 577 bp, Homo sapiens
  misc_feature (134)..(134): n is a, c, g, or t
atcctagaggatcccagctgactctggatcgcaaggcagtacagcataaaacggtagttaaaacgcagtggccacatataatcagatacgtcattggtgctgaataccttgtgatattgccgcatcccaattancgaaggttgcgcatattccacacaacctaccctcagaatcgcctctatcactacgtagtaatcacgccagcaccacttaacaacagactggatcgaacaccaatatgaccaagcctgccaatcccgcaaaaacacaacaacggtttggccccaaccccttgaagaaagagattaaacgcaatagaaaacctgattttcctctagaaccacatcacagaataggaaattaagaatcctcaggagatatgagccataagaaattcttatctatggaaaacacgcaaaaaaacgccggaagcaggtacttccggcgttacgagaacgatctctaatgagaccctagattacagaacctgaacttggtcagcctgcatacctttctggccttgcacagcaacgaaagaaactttctgaccttcctgaagggacttaaatgggtaccg

SEQ ID NO: 512485 - DNA, 315 bp, Homo sapiens
  misc_feature (45)..(45): n is a, c, g, or t
gagagagcccgtctgaatgggcagcaccgcctgatacttgggcgngaggctcaccggctccggctgctgcaggctcccccccaatgccggcttgcttggtggccgggggcggacagggcaagggtaccgaaccgccccagctctcttcctgcctgccgtgggcctgcctcggccgggagtaacaacgccccggccttctgccccgcagccggccggggaaggcgcggtcccgcctgtgaggaggccagcgggggccccggtccttgagcttacggtgccgggggaggaagtggcttcggtcgcccaggctcgtcc

SEQ ID NO: 512486 - DNA, 218 bp, Homo sapiens
gatgtgagtgaatacccatgccagcgcgtaatgaccaggaatacccaaccaacacgagactgaccaggaataccccaatccaacacgagactgaccagtgaataccccaatcccgtgcgcgagactgaccaggtaatacccacaacccgtgccatcgagactagaccagagcataccccaatcccgtgtcgcgcagactgaccatggaataccccaat

SEQ ID NO: 512487 - DNA, 567 bp, Homo sapiens
  misc_feature (437)..(437): n is a, c, g, or t
tgagacttgaggagcaggggctgccgtggtgtgtcctctgaaagaggccttcgccacgaaagcacagaagacccagggctcactggaaccatcaagggtcctctggttcttcttaaagtcaaagattaggtgccaaaatgtcagtttatgtactggcaaatatcatcttcttccttggggctttaagtactcagataagatgcaacagaatgaactgtcccacagagtaaataactttctgggagtaggtaaaagactctcagaaaagcagtcactcttttagaaggccacaaatgaatacaatcatttgttaagaggcaccacagtacaacaagacaccatattttggggatatggactgatgccttctagtcctccataaagtgctgatataacaaaaagatgttagaaatgtattagacaacttcgtaacaacntgaagaaaacaaaatttaaaaaatccacattctggctgggtacagtggctcacacctataatcctagcagtttgggaggccgaggcaggtagacggcctgaggtcaggagttctagaccagcttaggcca

SEQ ID NO: 512488 - DNA, 415 bp, Homo sapiens
acctcattcttaggtcctcatgagcaggacactgtcacttcttggtgcatgggatcatggaaagttaatgatgacctcggagaatttgtcacgaatttcacggatccgtacacccttctgcccaatgattgtgcgatgaaatctttgctcactgattagatcctggatacgctcatatttccatgcgagatgcaagctccagacagctctcgcatggaactgactgcacgccctgtgggatccccctcgatgcggatcaaattgctcttctcactgtcaggagggatgcgcacggacaccttgtactggtctatgattctgtatacttaggcatctgctgagtgattatggccaggttctgccctttcttgccaatgatgacacggtgaagccaggaaggggcggcgacagcgga

SEQ ID NO: 512489 - DNA, 213 bp, Homo sapiens
gtgccttaggcccgggaccgtttgcacccggcctgcccccgtcaggccgttttaaaaaagctttttcttgggcgccccccgtttttggcccgaaccctggaaagcctaaacccccttttgtgctgtgttttttatttttggaaaccttttattttttcccgtaagtcccccaatacttttataaaagcgtgccttgtaataaagggtttatta

SEQ ID NO: 512490 - DNA, 185 bp, Homo sapiens
  misc_feature (18)..(18): n is a, c, g, or t
ggccccctaaaaaatttnaagggccctgtcccctttttacaaccccgggaggagcccaggatcctttttggtttaaataaaaaattttaggggggggggcccccttttttcctttttaaaaaaaaaaaattaaaattgggccccccgggtttggggttaaaaaaaaaagggggttgcctttttca

SEQ ID NO: 512491 - DNA, 167 bp, Homo sapiens
agtaggagaagtgttacctcctgtaatattaaatgaaaatgttctgtgaataactgatgtttattatttaaacgtttgcagaatcatcagatgacgtcatctgttcatgaatgtttctttatgggaatttcgtagattaaccattcaatctgtatattattggagac

SEQ ID NO: 512492 - DNA, 134 bp, Homo sapiens
ctcttccttttaccttgatctcttccaccaacttcctatcacttattaatttttgaatctgtttttctctgtgctgttttgttttgtgtgtccattgtgatttctaacttttttaaataatataaaacacaaaa

SEQ ID NO: 512493 - DNA, 1640 bp, Homo sapiens
  misc_feature (997)..(997): n is a, c, g, or t
gccgttatatgtgatcgtcacgtgcccgcatgagttgttggagacatggtataccagaatacagacgctatgttgtccgcaagtgaccactctctgtagtcacgtcgctcttgtggtgtcgctggacaatcgatctagtgttggagcctgctatcgctgctggctctgtgccttatgatctgggacgggaaggtcgacgctatgtcggcgatcggattccttctctgtgatcgccttgagtcggtctgtcctccttccatggtgcacaattgcgtagcaactagcttacattagtgaggtgcaaacatccaaagtgacatacctctagtcacatcgttttcttgctcgggatgccgctcgcaaagcgcgacggctgggattgcactttctagcctaacttgacgcatacaccactaggaataaccgaagaagtcgcgaatatgccgagcattaccctttgtttgcctggtgagcaccggcagttattggaggcggcctacaccactagccgcggaggtcaccccctggcgatgtgttcgcccaatgaggcggcatggtgtgttggctgtccccgtggcgcattgaactccggcactctattcgctaggtatcgccgcgttttaaccgcactttgccttcgagtgctaatcactttgggcctaaggtctagggaggctcatattcgcgtatctgttcggcgcggaatccgtgcctgggaactcggtcccttattgttagacgtatcctccttcggtggtttccttcactcctcatgtctgggcatatgtggagctactagcgttaccagctgtaattagactgcgctttgtgcgtcctctgctacgaagccgcatatcggaccggttcactatatacctgattggcgccatccccatgttaccgcgttctgggtttcgtttcaatggagtctcggttccttacatatcgactgcctcagtacgcgcgtccatcggctgaaccccatcgttggtgtctntcactcagtgcgccgttactcccaccgtctgtgcggcagccaatctctggtctcacaacgaatctctggtgctccgccggttcctgagcgtataccccgcgcgggtacgacactcgttcccctgcgcgtgacgactgcgcttgtgacatgtgggttccgttcagtcgaccagactgtgggcaagcgagcgcttcaaatgtgtggacttgtgatgccacatttggacagcgctgtgaattagcctttggcgctctgagtggcccctatggcactcagcggccgctgtggcaaccaggacagtgcaacaacatatatcttgcagagcccgactatgacaagctgggggggtcgtcagaaaaacacattagaccaagtattgcactacattagtgttcgctgtcttggcaagagccagcgtatcacgctatttacgacaaatggtaatagcactggctaaccaatacaccgtcagaaaagggataggcaacaccccgccaaataaacacccatacatcacgccaccctgtgcaaggtgtagcattccgagcccaataattggtcgcacccgccgaatagcaagaggggtatcactagtgaacaagagtcggtctcacacatctcaaacagtgtcatccctcatcca

SEQ ID NO: 512494 - DNA, 235 bp, Homo sapiens
acacgttgaccagatgggttatgctgtgtctgcagatcatcaccttgaggacacctccgtgtgtgctgtggcacttaacatgtttacatgtgtcagtcccactaaactagaagctccttgaaagtagaaactgtatcttcagctttttattttcatgcccaccacaacttttgagccatactatgcagcaacaaatatttggtggttttgaataaattttactacactgtaacac

SEQ ID NO: 512495 - DNA, 551 bp, Homo sapiens
  misc_feature (14)..(14): n is a, c, g, or t
  misc_feature (158)..(158): n is a, c, g, or t
  misc_feature (162)..(162): n is a, c, g, or t
  misc_feature (336)..(336): n is a, c, g, or t
  misc_feature (351)..(351): n is a, c, g, or t
  misc_feature (361)..(361): n is a, c, g, or t
  misc_feature (371)..(371): n is a, c, g, or t
  misc_feature (383)..(383): n is a, c, g, or t
  misc_feature (413)..(413): n is a, c, g, or t
  misc_feature (421)..(421): n is a, c, g, or t
  misc_feature (442)..(442): n is a, c, g, or t
  misc_feature (444)..(444): n is a, c, g, or t
  misc_feature (450)..(450): n is a, c, g, or t
  misc_feature (471)..(471): n is a, c, g, or t
  misc_feature (489)..(489): n is a, c, g, or t
  misc_feature (538)..(538): n is a, c, g, or t
gatctggggacttnctatgtcattttccaagggcttcagcctatgttggggggcgcgagaggagggggatggtggaataatatttattttgataagaaactacagctcccagcagaggagaaacatcctctgagtttccggcccagactcaggccaancttnacttgcttcttggcccaccctgcaccttcttccttttctctggatggaggtccccgtttggcagaaacaccttgtcttccagctcctggcactgggtcccatattcagagctcagaggagggggtgtggcttgtaggatggcagctgctccctagagccatcaccccacccacnacgcccaggctcagnctgtttgggnaggtcccagntggaagcctcanctggggggtggtgggtaggggtgggggtanagtggtanagtccccagatactggctgtntnaaaaanaaagaagaaggaaagataggnggctgggctgcgccccantgggagcccagggttttctcgtgaccagtgcacgtgccccctgtccccntggctcagagtgc

SEQ ID NO: 512496 - DNA, 192 bp, Homo sapiens
tacgaatcgagctggtacccgatgataacgatattcgccaagtgggcttcaaagggtgagtttgtgtcgcgataccgggccgtcgccatttcagccccggcttggggaacatcaccaggttgcccgagtaggatcaggcacaggcccagcagggcgtggaagtgccactgatagccttcgtagatcgttgag

SEQ ID NO: 512497 - DNA, 165 bp, Homo sapiens
tccgcatgtggtgggttcagtacaggaacaatactacgtagacataaaatcacaggttacattcactgagactagaaggtatcgactttcacccatcttagagaacagagaacacacgttggaacaggtgctcatgcagtcagatctgtttgtggaggtagcact

SEQ ID NO: 512498 - DNA, 369 bp, Homo sapiens
gtctctacttgttgtcaggccgcactccttctggaactggacctcagtgtggttctccagacacctgtgggtggttgaggatcgggtaggcgtccaggaccgcagccccagccgggggcgatcgggcatccgcaaaggtaaagagtagttcatggagataatgatggggcggagtttgtcacggaggttgtccatcaggagcagctccagcttctggcagcgcatctcgggcatggagaagaagccgtggaagacagcggactcactggcggcaaagcggagccggggcgggcggcggtccctgtcagcctccagagtgtaggccagggtgatgtttcgcctgtcgttagggttcccggcactctggtt

SEQ ID NO: 512499 - DNA, 87 bp, Homo sapiens
agggaccccccccccaggggccctgctccgtgaaataatgttaaatacgactgtgggcccaacccaataaaacctctgtttgttcga

SEQ ID NO: 512500 - DNA, 1230 bp, Homo sapiens
cagcctggacgcgtagctggattatctgtgcgctgcgcaactttaacacacggtctcttacacgcagcgcttctcggcaacccctcttagcaacacctgccctagctaagcccagcagagcaactgccctgctagttctcttgcctggcagaaacctggctgctcttctggcatccttcttacatcctccttctgaccctgcttctcaacacaggctctgaataaatcagcagacacgacaggttctctggacgactctctgtacacgccaccttacaagctgctccttacttcttgccttgctcctgaagcacgctcactagccctagcggcaaacttctctagcctgacacaactgggccatctcccatccttcacacatcacgacgaaacgtacacaactactacgacgactactcgcaccacgcccaagggcccacgacgccctagcacgcacacacaacctccatacacattccctaaaatctccctgcacccctccttcctaacctcaacccaacaacatgcctacaactataattctctcactgcttctctctacgaccctcgtgtctccctcctatcttcccattcccctgctactttaacacctactcaccacgtgctctacaacttcgcatacacttaaataagcatacacttgaactcactggcactcaccctactctgactactacactgaactcctccccctcaccccaacttcttccccgaaactctccccctgccccacgccactggccaatccctactgaaccctctaccaacgctcgacccatctaccaccctcccctccacttccaactccccctttgcccttccacgcgaccctttcccctcactcctctcccctcaccccacatggaccgcctcttctccccgcgccccccaaacagcgcccgcccccctccggacgacaccaccacccaccctccaacaccccatgcaccacccacactggcccccagcaccaccattctacgctctgtatcgatccccccacgcgcccattcacacacccgccgccgatcttctacaccccataaactccaccacctaacaccactggtcccccccccacatcactgaccacaccacccctccccactcccccctcacccctccccccgctcaccacccccccacacctcctccgcaccacacaccctctactactaacacccaccatcacctctccaccaactcacg

SEQ ID NO: 512501 - DNA, 409 bp, Homo sapiens
gatctacacgcacatgccaccaccaccagctaattattttggtagagagggagtctgtgtgttcccaggctggtctgaactcccaggctcaaatgatcctctagcctgacctccaaaagtgcaggggttaaaagtgtgaaccaccatgcccagcagaagacgttttttaaaaaagaaaaattgaggccgggcacggtcgtcacgcctgtaatgtcagcctccccagtagctgggattacagcatcatgccaccatgcccagctaatttttgtattattattattgttttttagtagagacggggtttcaccatgttggccaggctagtcacgaactcctaacctcaggtgatccacccacctctgcctcccaaagtgctgggattacaggcatgagctaccacacctgg

SEQ ID NO: 512502 - DNA, 173 bp, Homo sapiens
gggggggggggggggaaaattttttcccccgggaccccccttcccccttgggccctttttggggcccctttaaacccatttttttccaaaaaacgggggggggccgggcggggttttccggggtttttttcccccccggggccggggacccaaaaaattttttttttttttta

SEQ ID NO: 512503 - DNA, 438 bp, Homo sapiens
  misc_feature (54)..(54): n is a, c, g, or t
aaaaactgaaaaagtcaaagtgttttttcaattctctcactcaacaataatcancactgaagactcctgtgaccaactctgtggggatttctcctcaccaacaagcagtcagttctgtagcagacaccagctgggtaccctccaatctaattcaattctgatgttacctacctggaggtagcgtcagatgccacaggttgagggctcagtcccacgtgactgcccctaacttatgataccagtcaaaagccccaggttgttttatttgtgcttctgactgaccgtctataagtcagggatcccctgaacccctttttgtgtgtgattaatttactggagcagagcttacagaactcaaggaaacacttaacatttactggtttattattgtattagttcgttttcatgctgctaataaagacatacctgagacttggt

SEQ ID NO: 512504 - DNA, 113 bp, Homo sapiens
acgaagatctgcatcccacctctgagcagtgcaggtgactctttctggatgttgtcgtcagccagggtgcgtccatcttccagcggtttcccagcaaagatcaacctcgtgcg

SEQ ID NO: 512505 - DNA, 389 bp, Homo sapiens
  misc_feature (389)..(389): n is a, c, g, or t
gccgccagagcacaggtgctatgagtactacccctatgagtcacagtgtggaccggagagactcatgctcaacattgtctgcattcggacacgttacatgactgcagagtgcaccagtactggtcatctgcatgtataagtgcgagggcatcgactatagaccattgactaatctgagaaggagcgctgctgagacgctagcgagctattttgagtatgccagggccatgtgtaaactgaccgctgagcgtgaacagtggatctgcatcagacatgtccttgagcaataccgtgactaggctgtgctaagtcactatctgacgcgccaccacacagagactgtgatcacatgatcaccgtacctctcaggctgacagtgctgtactggn

SEQ ID NO: 512506 - DNA, 241 bp, Homo sapiens
  misc_feature (6)..(6): n is a, c, g, or t
  misc_feature (36)..(36): n is a, c, g, or t
  misc_feature (38)..(39): n is a, c, g, or t
  misc_feature (77)..(77): n is a, c, g, or t
gctgtnttggctaaccctcaaacactggggctggcncnnctcttggtttcttcaacaggagacttttactgtgttgnctttatggttccattgtttggagacatgcctgggcacagtttggtccgttagaattaaaagttgaatttttttttttttttttttttttttttttttttttatttcgctaaaaatttttttacaaaatacacaccgggcccaaaaggggtttttccacattttt

SEQ ID NO: 512507 - DNA, 422 bp, Homo sapiens
atattatatatgcagaagaatgaaactggatctccatctcttactatatacaaaagtcaaatccagtcacaccagtacactccagcctgggcaaaagagtgagactctgtctcaaataataaaataaaataaaataaagataatttaaagacttaaatgtaaaaccccaaactacaaaactactagaagaaaacataggggtttcagcatgttattctgggtcttaaaaaaaaaaaaaaaaagaatactgagcaacatagtgagaccttgtctctacaaaaaaaaaaaaaaaaaaaaaaaaaaaattagaccacagtggcttacacctataatcccagtactttgggaggctaaggcaggaggatcacatgagcccaggagttcgagatgagtctgggtaatatagtgagaccctgtcttta

SEQ ID NO: 512508 - DNA, 921 bp, Homo sapiens
acatgccgattaacaaccttcgcgctgacacaaaaacagtaagcgccgcggctagatgacagtccggattatcctttggacgccagcgtacacaatgggcgttcggcggggccacaatcccagcggcttggctgtcaccacaagcccgttccccccactcttagggttccaaaaccatagaaaaggggccccaagtgggtagacccgcgcccgaggagtgcccgcggcagaaagatattaatccgggcccgcaccacgaaatggggtggcaaggaaaaccccccgctaggccagggccccacaatgcggcgcacaaaacccctggggtaacgcaagacccagccttgtcactgcttgctgggatccgcgtgcaaacaaaaacgtcccccaagaagattttatggcgtgacccctcccccctgcccccgccgcataataatggccccccctttttgtggagaggagaagccccataccaaggaaccccacccgccccctgtggtgagagttcggcggaaacaccacaggcccacggccaagcccaaggaggcgacctgtaaactctttattgggagtgagattccccccggcgctgttggtagagagaaaacctcaaggcgcctgcagatataggagccacctcgttttcccagaagggtataaaaaacttgttgccgccaatccaaaccgcccttaggcgcttatacacatcaccacttttaagcgcatcttcccgccccgtcccctgagagatatagagaaagaaaatgatagatctccaaagaagtataatctattcttgtttttctctttttctctttggtgttaaaccccaccacccccgtctttaaaacacactaaaaattttttaaccctttcccctttttttttggttccaattaaaaaaaaagggaaaaaaaa

SEQ ID NO: 512509 - DNA, 283 bp, Homo sapiens
  misc_feature (58)..(58): n is a, c, g, or t
ggtcctaggttaaagcacagaaaaaaaggatggcctattgtggcactgtcccacaganactttcattattggccgggcgcggtggctcatgcctgtaatcccagcacttcaggaggctgaggcgggtgaatcacttgaggtcaggagttcgagaccagcctggccaacatggtgaaaccctgtctctactaaaaatacaaaaattagctgggcagagattgcagtgagccaagatcgcaccattgtactccagcctgggcgacaaagcgagactccgtctcag

SEQ ID NO: 512510 - DNA, 204 bp, Homo sapiens
attgacgcccttttttgcatatgaggtaggttagggtccaacctcattcttttttttttttattccctctcccactcctcagctccaacttcattctttccagggggatatccagtttccccaatattattaatggagagaccatccttcccccatggaagggcccgggcaccctggtcaaaaactcaatggggccgcggggac

SEQ ID NO: 512511 - DNA, 1072 bp, Homo sapiens
gcactccagcccaggcgacagagcgagactccgtctcgaaaaaaaaaaaaaagtataagggagagaaataactttaaaggtttattagacaaaacagagtatagatgccaagatgtctggtaaaatggattttttctgggttataaagagatgtgggccattattttctaatccattttaaaaatacaggacaaaacacttctttaaacagaacaaggaatgaaaaaaggttaaccaagggaattatccttttctcaccaatcaacactttaaagaaatatatatatatattatacacacattatacacagtgccttcatatatatggataacttaagaaaaaatacttataaaaagactctcattttaaggtgatggacaagcaaacgggctccatttaaaaaaaggtccctacttataggtcaacgtaacaggggggttattattaggtgggtattaaagtggttatgggtttcgggtatatggcagggggtggtgggcggtttggaaacggacgctctaggccctggtaggcctaaggctgggagtgcgcaggggccgcgaatctgggccccctggcaaacctccggcctcccggggtccaaagcaaatcctacctggcgctcaaggcctccgcgagaatagaccggagcagatacaacagcgcgttgcttgctcaccccacgcccgtggaataaatcacacacgggacatagagaagctacaaagcacggggggtcaaccacccacactgggccaaggacggatcctacacacacacggaccgtggtagaaccaagcgcacacatcgggccactcacaaaagcggccggaaattacacgggaattaaagccacccgggcctccgggccccacaagaaggggggactatagggaggaaaaaggaaccacactaaccgacgggacaaaagcggggcacataagaagagactaaaagggggaacacaacaggagaaaggggaacaaccaaaacagagcgaacagaagttaaaaacgcacacgtacaacaccaggatatctcacaacacacgtccagtagagagaacatccg

SEQ ID NO: 512512 - DNA, 282 bp, Homo sapiens
attggatatgcggataggggcgggagagggaagggtggcctcgtgaaacccctaactgtggctcctctaaagatggtgcagacacttcctgtgcatgtccagctcccctgccaacatgaccaccgttggctgccatccagttggtacccatgcacctgaagcctcaaagctggattcgctctagcatccctcctctcctgggtcccacttgggcgtcttcctccccacctgatcggtgttcccccacatcttggggcgctttttgggtttgaaaaacccacc

SEQ ID NO: 512513 - DNA, 984 bp, Homo sapiens
ggaagccgggagctcggcacgggtggcgaggctgcggtgaggcctggtctccggtgccagaccatgctgagtgtgagcacgctgaaggttcgcctcagcgcttgcgggaaatggcgctgcgccggaccgacacggggatccggcccgtaaaggttgcattgcaacggcagtcacgggggatcgacggcccatttgcggcggaccgggggccacaggaagacttggagcgacgccgacccggggaaattacgaatcaggggaaggttgctggacagttaccctggtgggtcgccctggatcatcccaagaaaacgcggatcaagaattaatgcaggagatttcaaaccaacaagcgggacacttgggatctatacttggaaccggacagtctgcgcggaaacattcggttttaacttccctaaaatcaacatttgcggcatggggagaactcccccgattaagatatgtggactataccgcatccaagggcccatggcatcacgcgagcatttggaccacctcggtctcaacacatgggttactgagcaagctggccatacgcaactcgacctagtgtggcgacgccacacgtctgctcaactggattacaactataacgctttccgcacacacacacacctgttagtccacagacaacaacgccgctactagtcagctgccacacagctgtatgatctgtttgaagattaaacccagagtaattaacccgtttctgttaaacagaccacccaccacgggtggcagccgggtttaacactacagtgtcgacacagcacgcacacagcaattgtgatttccccgtcgcaccttacattccccataacgcggagtagcaccgtggttcactataatgttacacagatatgtgtattcgtacttacagacgccacggggacctgtggattcgctataccatcgaagggccttcctgggtctggaacagacaacaaggtttcgccaccg

SEQ ID NO: 512514 - DNA, 1470 bp, Homo sapiens
gggaggttctagtgtcggagttgggtgcagtgcagtgtgccatgggcccgcttgaggcacactgaggggacgctggtggcttggtgccaatgtgcctggctgctcgtgtgcctgcctgcctgccgctgcctcaggctgtgggtcctcggcctcttcatggcaaccatgccgcctcagagagctgggtgcttggggatgctgctggacgtgatgttctcccggactcagtaccgggccaaggatggcagcgggaccggcggctctaaggttgagcgcattgagaagagatgtctaggagctgttttggccgagactactgtatcagcgatgattccaaaacaacgaaatggggactatcttgtgaggcacctataccccgcgacactctcgtgacctcgcgggtattactgacgagctgctacgagagaaaaaacccagcacccgtcagaaacacacccggaacaaagaggtaagacaaagtatggcaaaaaacataaaatcacaactggacaacccgacattggcccacaggtagacaaaccagacacagaatatgatcatgaccacaagaaaaatcccgtgacacaaggggaacaacaccaacactaaacccacggattcagagcccacaccatgtacaatgacattcgcttaaacagcaatgttaattaacaaccaccatcaaatacaatcaccaccataatttataacaaactacaagtattataccacaccaaatcccctcacaccaccacccacatctactaaacacaactcaacacacaaccacaaaatcagagaacatagctcactacccaactacctcccctacctcactgactactataaatagacactagatacccagaaaaaaccactaccaataaagaaactaaacttcaaacaatacaactatctaaaaaaacatcatatgacactcaaacaactactatcaaattatctaatccacacacacacaaaactgcaagacaaaactaccaacacagaacatagatctatgacaacataactaacactatcttcacacatgtttcaccatacaataaacaagatacaagcaacacgaagcgaacaaacacatataattgacactagacacaaacacacacatacaacataaataactcagtcaacattattaaatgacgagtaacatatatagtaacatatcaacgaaaatgaaaacataaaacgaaactaataaaacgaagacaatccaaattcaaaaaactaaaacatagaaataacaaataacacaacatagagacacaaccaacaagtaactaagtcacaaaaccataaacacttagacagtgataaatataaacagacaaaaaacaaacacagtgaagaactattacataataaaaagaacagtaacagacagaaaaaaaaaaagaatctaacaatataacaaaaaaactaccaatataaacaacacaccaaaaa

SEQ ID NO: 512515 - DNA, 382 bp, Homo sapiens
  misc_feature (108)..(109): n is a, c, g, or t
  misc_feature (112)..(114): n is a, c, g, or t
tcgcgcacacatccttcgcgcacacatccttcgcgcacacatccttcgcgcacacatccttcgcgcacacatccttcgcgcacacatccttcgcgcacacatcctcanncannntagagactttaggaggaacagctagctgatttgaggggagaagaaagtatgtgagtttaaatggaccaacgtgaagtcacgcttagaaggtctaacatttcatagggtgtgcaagccacgcggtgttttgctcaggttcaatatctaatgtggacaggcatagacaggaataaacacactggagcaatagctttggcctctggataggaggacaaacggttagtgggtagactatgtattattctaggggatgtatctctctgcgacg

SEQ ID NO: 512516 - DNA, 550 bp, Homo sapiens
gcagccatctccttctcggcatcatgggcgccctcagaccccttgttgaggcccaggatcgtcaatcaagagaatgcaagaagttcatccgggcagcagtcagagcgatatgtcaataattaagcgtaactggcggaaacccagaggcattggtacgaacagggttacgtagaagattcaagggaccaggatctgtgatgcccaacattggttatggagagcaactagaagagaaacagaagcacatgctgcccagtggcttccggaagttcctggtccacaacgtcacaggagctgtcaagtgctgctgatgtgctaacaaactcgttactgtgcctgagatcgctcactagagtgtgttcctccaagaaccgcaaaagccatcggggaaagagctgcccaactggccatcagagtcacgcaagcccaagtgccaggctgcgcagtgaagaagaatgagctaggcagctcatgtgcacgtttctctgtgttaaatcaatgtaaagaactgccagaatgaagatcaaaaaaagataaccccgtggggggc

SEQ ID NO: 512517 - DNA, 129 bp, Homo sapiens
catggatttgctggtgcagtacaactaggcttaatagggacatggaaactgaacaacctgctcctgaatgactactggataaataaaaaaatgaaggcagaaatagagatgttctttttgaaaccaaaa

SEQ ID NO: 512518 - DNA, 183 bp, Homo sapiens
atctgtagaggagtgaggaaatgggttgtacttgttgaagacagatgggagaaatgatgggggcgccttcatcctcaagggccccatgtgagccctcggaatgaaactgaaggcataggagagtagtccgtggggtcagggaaatgggtgggggggaccagtgagttgacttaatgtccaatg

SEQ ID NO: 512519 - DNA, 413 bp, Homo sapiens
acgttttgtctgtggacaccctctgctgtttttaaaccctgaaaacccttattacctctttgcttgagacaccccttctgctctaaacaaagtacagacgatagtgtagatttcatggtagagcagtgcactatccactccaccaactaaaccaccaactaccacccatcacccatacactgtccactcaccaccctcccctactctattgtctataacatactataccaccctgtactacttggtctaatacatcttcctaccctacccacttatacagtttgctctattttccatccattgccacttagtatcccacccatcctcccatcctcttgtacatctctccatccattcattcattcactccctcattcatcctctatcccatcatctgtccatccatccatcca

SEQ ID NO: 512520 - DNA, 1194 bp, Homo sapiens
tgccatactgggggcttgttcatcacgatagggattgcatcccgttttgctgacgacttcgttcgtcgacgtcttgtgatgacaaccgaccagtgaggttctgtggacgccttcgtctgtcttctcctctgcagttgctgcctcttgtaataatagttaggatcctctttatcttatgggccgtattgcgtggctgtctcgaatggttccccgtcgcaatgtttttgggtatgtgctctccccgagtgcccccattgttgggccctccgcgggtgtgctcactttttctgagccacatgtaatcttgtccccaggtggtccgctaggagccgccatgttgttcactctacgcgttggatgtcggcgctctctagcctgttgttgctgcaccacgaccggttgttgttttactggtgtctccccctcttttcccatatgccccattcccccctggtcaactttacccttggcctcctgagttattctgagcgaccctttagccttagccggtttgacgtcaatccctctgattcagggttgagcagtcaagactcaattaacgcccttgatcggcgcacttcggagcaagtagcccccacaatgctcatatggagtcaccctagccatcagtctgacgtatcgagacatgtactaataagtgggctcctgtgtaacctctgccagcccggatgcaccacaccaaggacccctctgattactcctgccatcatgacccttggccataatatgatttatctccacactagcagagacccaccgtacccccttcgaccttgccgaaggggagtccgaactagtctcaggcttcaaacatcgaataccccgcaggccccttcgccctatttcttcatagccgaatacacccaaacacttattataattaacacccctcacccacctaccaattctttcctagggaaccacaacatatgacgcacctctgcccctgaactttacacgaacatatgtttgtgcaccaagaccctacgttctaacctccctgtttttatgaattcggacagcatacccccgattccgctacgaccgaaatcgatacacctcctatggaaataacttcctagccactcaccctagcattacttatatgatatgtctccatacccattacaatgctccagcattccccctcaaaccttaaagaaaaaaaaaaaa

SEQ ID NO: 512521 - DNA, 327 bp, Homo sapiens
cccccccctttttttggggggggggggggtgcccccatccccccgggggggggggccttttggcccggaaaaaaaaaaaaggattggggagcggggttttttccccccaggggccctggttttcccccggcccaaacccttcagggggggtgggccccttggggccccttttccgtttggaaccctttggccccccccggcccccccgcccatttgttaaaaaaggggggggggggggtttcccccctccttcccccccccccctttttttaaaaggcccccaagggcttttttttttaaaaaaaaaaaaaaattttttttggggga

SEQ ID NO: 512522 - DNA, 81 bp, Homo sapiens
tgagaccacatctcattgtgtcacccacactggagtgcagtggcataatcacagtttactgtaaccttgaactcctgggct

SEQ ID NO: 512523 - DNA, 231 bp, Homo sapiens
gtcccacagtgagtaaatcccctagagcatagcattgagcgggtcagagaaagtcagcaagaaaaggctgtggtgtggcatgctgacactctcatctacgtctctctctctatgctctaggggatttactcacttggggacaaaagcaataatagtagcatctttacagtggcccaagggtaaccagaagtggtagatcagatcacaggataacacgttcgcgagggggga

SEQ ID NO: 512524 - DNA, 303 bp, Homo sapiens
cgtttcgtttaaaaaattgtattgacacctgtttattgttattttgatttagttattgttagaggcagggtctcccagtgtcactcagttggagtacagtaacatcatcatagctcactgcagcctcaaactcctggactcaagcgatcctcccacctcagcctccgaagtatctggggctacaagcacatgccaccacccccggctaatttgttaattttttatagagatgggggtcacttcattgcccaggttggtctcaaacccctggcatcaagcagccctcccaccatggcctcccaa

SEQ ID NO: 512525 - DNA, 411 bp, Homo sapiens
tgtagctgtgtcaaaaaaaagaactggcctaaatacagacatttgtaaaacatagtcatgccttctgcgtctttggttatgcgttacagttagaagattttgtctttctccccctcctctctcttttttttcccttcactttgtcctggaatttaaaaagtgtctagagcccattactttagccttagctttttggacagcgttatctataaaccttcctgaaagtgagctgcaaagcagaagaaaacttgtttctttttctttttaacctttaccacaattctgtgggccaaagggatcaggagacagacatagagcagtagaaaacctgagacagagaaaagaagaatgagagagactcataacagatggtaaagtagaggaggggtgagggatttgccaagaggtgac

SEQ ID NO: 512526 - DNA, 255 bp, Homo sapiens
aattaaaaagtgaagcctctacttactcttaccatataataactatagaagaaagtagactatacacacacacacacacacacaccacacccagttgtgacattgttaaatgatggggatgcattccaaggaatgcgttgtataagcgattatcatcattgtgcaaaaatcatagagtgtacttacataagacaagtataggatggcctattacacacctaggctatatgtacagcatgttactgtactaggaat

SEQ ID NO: 512527 - DNA, 108 bp, Homo sapiens
agcctccgtggcctccagcagtaataatttacctgttctctagctattccttaatccagtcaagttgacacctaaaattaaccatcatacttgtggaatgctttatta

SEQ ID NO: 512528 - DNA, 979 bp, Homo sapiens
tgtgaagtgtaggggtgtgtgtgtgtgtgaagtgtaggggtgtgtgtgtgaagtgtaggagggtatgtgtgtgtgtgtgtgtgaactgtcccctccctgtaggatgattttagataggaggtaggcgggatgtgagggtccgctgctgattctattgccgcaggtgccccccatgtgcttgtcactgtgcccatgtggggaagctaagagatgacgccctcttgggggcgtggttttgggggaggggacacggcatcacacgagggcatggctgggtgtgtgcaaggagcaggtgggcatgggaggagcgggcagtttctacggaacgtggagaccccaggtgtgggaagcggtaggtgcagcccacccaggtggagaggaggcacctaggcaaaggtgcagagccatgtggtgccctgggaccacctgcttctcttgggtgtttcatcatcagaaccaaacacaagtgagaataaggagctcagatttgtatctcgattttccaaatagttcacagacccagggcaacataccctgaatgagaagaaacgatgcttcaaagtcagtgctttggcaagtagaatgtagtctctcttgggttgtgaaaagcatctttcctgtgaagatgtcgtcgctgtagtagcctagatgatggagcatttggcaggggatacgatgtggtacgatcgatggcaacttggatacgaagaagtccaggaaattgaccccctcccccaaaaaaaggagagggcacacacaacaaacaaaacaaatttttcaggatcacctcaagtaaaggtgccacgggaaatccggcgggtgaacagacactggcttgttacaaacggtgtcttaaccattgggccgctttttacacaaaagaccctgtgcggtacacaacgggttaaagggccccgggggcaacgccgttaacaaaacctgtgcaacgggattctgaaaacgggagcggtggagaata

SEQ ID NO: 512529 - DNA, 534 bp, Homo sapiens
tgggcgccccccttttttgggggaaaccccgggggggatcggttaaaaaactcggggcctggccccccccggtcccgggggggcccaaaaaatcttccccggggcgcgggcaacccgcgaagcaccgcggtgtggtggccccatatttggtgagtgagagggaaagggggggttcatcacgcggattatcgtggcgtgatgcgggcgtgacacaaaatcgtgtaaacatacttagtgtggggggcgccacgagggaacccccacccctcttgtacttagtgggggggagcaatactgtgtaggccaaccctatatctagagggcggtgtgtgtctagacaaaaagagagcgggtttctcgggtgggtgcgcccccttaccgagagaaacaagggagctattctctctcagagtgagcgcgcgcctttcttacaaagtcagcccgccccacagaggagatctatctccaaccagctgtgaagagtgtgtccaaaagcacaggaggttggttcatgtaagacaaaggcggtgttcc

SEQ ID NO: 512530 - DNA, 739 bp, Homo sapiens
tgaatgctcgcagctcccgggactttgagtactataagcagtatctgtgtatcctggcttcaagaacaataaaggagtggctgagtgtgcttcgagatggtagactagccctgctgtcctcatccccagcaaacccttggcccggagatgcttccccgctatccacgcctacaaggtgtgtcctgatgcgtgtgcgcaatgagacgacctatgagtgatgggcatggctcccggaaaaacatcacagacctggtggagggctgccaagaaagccaatggagtcctagagtgcgcggaactcgccatgaccgccaattaacttttatgaaacggaatataataaccaaacacaagttaccttccccccggtactggattatcataggcctggtcattgccatggcgatgagcctcctgttcatcatcctgcttcgcttcctggctggtattatggtctgggtgatgatcatcatggtgattctggtgctgggctacggaatatttcactgctacatggagtactcccgactgcgtggtgagggcggctctgatgtctctttggtggactcggctttcagacggatttccgtgtgtactgcacttacggcagacctggttggctttatgatcattctgagttccttgagtcatatcatcttggtggcatcttctcggaagagatctctcgcgattgcctcaagagcccggctttggaactctgtgctctgtctacatgtcc

SEQ ID NO: 512531 - DNA, 285 bp, Homo sapiens
cattatgtgaggttgcaatatgactgctgataatcatagtattagtacaggaggctgagctcagtggctcatgcctgtaatcccagcactttgggaggacgacggtaagtggatcacctaaggtcagagagctcgatgaccagcctggccaacaattgtgaaactccatctctattgaaaactacaaaaacttacggcaggtgtggtgagtgtgcaccctactactcccacgattactccggaggactgtcggagacgggacgacggatgtcggagacgcggacg

SEQ ID NO: 512532 - DNA, 496 bp, Homo sapiens
gggcagaaacagcaagaaaaatagtatcagaaatggagcctgaaaatgtggctgaagagctgcaatctcctcatcaaacttgaacagatgtggagctgcttcttaggggtgcgcagagaaagtggtctcttgagatggaatctactcctggtgaaaaggctatgaacactgttgaaatattggcaaagaatttagaatattacataaacttagttgacagtgcaacagcagggtttgaaaggattgattccaatttccaaagaagttctactctgggtatagtgctatcagtgtcacatgctgcagggaattcttttgtaacaaggggagtggtggcaaatttcttgtttcttactttaagaaattgccccagccaggccaggcgtagtggctcatgcctgtaatcccagaacgtttggaggctgaggcgggtggatcataaggtcagagttcacaaccagcctggccaacatagtgaaaccccgtctctactaga

SEQ ID NO: 512533 - DNA, 633 bp, Homo sapiens
agcggggaacaatcacttctgtagactgaattggggattttttataaagagggcatggagtaattgaatcctggaaggaggaagggagcttactgcttgggaggagaggagatcttgtagattatgagaactgtggacggtggtattctggctgaaagttagtttcctgctttctagagctaagctggctaccacttctagtgctttaaagcaggctggctacccttggactgtgttatctagtggtttagagaggtaagctacaggggcaaaggaaggaggatttcctttctgtggtcctaagacaccgagggctattcctcagctttcagcagtatagagagtgaaaggtggggagatatcaggtaaggacggagctgacgcagggacaagagcagttgggagttggtggaagctggggagtatgttatgtgaggggtttaggggttcatggggagggcctttggccacttcatagaggggatgagctaggagggcaaagttggaaatccatattctaaagaagcctgctagccctgggaaggaaaggatttcgcttgtggaggagggtgggggtagattttctataaatgctgccgtggtggagtatagctgggccaagggaagttgatt

SEQ ID NO: 512534 - DNA, 115 bp, Homo sapiens
gtaaaccgagttagaagggaatgcaacagaagaaaagaccaaagacctgggtttcaggtctgggaaagaaagcaagacagatggaggaaatgaggcctcaggacatggcgtctca

SEQ ID NO: 512535 - DNA, 356 bp, Homo sapiens
aaaaaaaattttcccccaccacttaaatataattctggaggtggaccaaaaccaaacccaaaagggggggttggaatcccttaaaagattgggatatttttcaagactggccttttaacgcccattgggatagagcatcttttgttgactcacgaaccctccaaggggggggccttttgttttatagaaaccaggaaaaagggttctgggcccatcagaatgggtggaagggttcccagccaggaacacttattttgaacaatgcagacagtacttgccagagtcccaaatgctgaattattgaaccatgtttttttttcctttgttaaaaaaaataaaccagggtgatttctata

SEQ ID NO: 512536 - DNA, 139 bp, Homo sapiens
cgtctctacgaggatccccacagtttgatcgagcatgcgtgacttgttaaaaaccctggcgagccttggaaataaatctctattaaaccgctttgtaaccaagctctggtaccctctgtctccatctcctgagtccact

SEQ ID NO: 512537 - DNA, 136 bp, Homo sapiens
  misc_feature (38)..(38): n is a, c, g, or t
  misc_feature (92)..(92): n is a, c, g, or t
cccagaccgaactaacttcccccggggtgtgtccagcngaagcaccttccatgctgggcagctccgacaggtgcggggaccagcagaatttnccctacggtgtgaccccagcctctccctctggccacagccaggg

SEQ ID NO: 512538 - DNA, 292 bp, Homo sapiens
aaacgcgcgagtatacaaggggtaagtaacatagagagacctaccgcctagctcttggatgacccactctaccgtccagaaaatgaacgaaagtacgtctatgggagtatggggatacccaagataaggtagccgcaagtacaaggaggagtatagggtacaactatgcaaactaggaggagtcatagctagagatcctgcgaggagtacgtactgcactaaccgacgatctaggtagaagggtcagaccaataaaatcagcttagtaagcgcacagcaaggggcttgggac

SEQ ID NO: 512539 - DNA, 242 bp, Homo sapiens
  misc_feature (90)..(90): n is a, c, g, or t
aaggcgccccggggcccgcgatttaaatgggggggccccccccccccctttttggctttttaacccccccccagggggggggggttgggnttttaaccccccccccttttttttttttgtcttttgggggtttgtgccccccgggggttttttcccccccccctttgggggggggggtttgcccccggttttttttttcccccccccctttttttaaaaaaaggggttttttaattttttta

SEQ ID NO: 512540 - DNA, 495 bp, Homo sapiens
  misc_feature (488)..(488): n is a, c, g, or t
tttgaatatttatgtcaaattacaaaccagtttaaagctgcctatttggcaaaatgatctgctgcagaattttcattttctgtctctagaatgcagaaaaatgtcttaaagttccttaatttgcttaatttaatgtggtttccagaagatgtgaaaacctcctttatttttaaaatacctgattccacattggtcaatagtttcctctttaatttacctctctcctctcactttatctataataagcagggagaaatgaagacacaccatcaacacgtttgcttagatatgtcctcaactaaatttctagtgtcacttactaattctaatttcatccaatataacataattaagataaattctataacaagctacacatactttccagttctaataccatgtttgtgatggaaacaaagcaggagtgccctctgcaaggtgatcatctgagggtccaagatgaaggggcacacaggtattttatctgncccacac

SEQ ID NO: 512541 - DNA, 121 bp, Homo sapiens
tcatcccaaaactggaaatggaaacaaggcttcaaacactcgtctcacgccgtgtttgagatcaccgactcaccagtatgcatcatagatggaggtggtttcagtatgtgggtgtgtgtga

SEQ ID NO: 512542 - DNA, 1432 bp, Homo sapiens
  misc_feature (1432)..(1432): n is a, c, g, or t
ttggaagaagtcacaggtgacagcgcctcctgagtgcccacgactttatgagggggtccatgatccagaagagacccatgcacaacggtaagggatgattgatgtcccatgcgagtacgagcattgctctgtacagaagtgagctcgctctaccacgacatacttactcacgcacgctgaccgagtaacacactcgatgctagagcgagttctgcggtcaatccagcctcatgcgcatgtgcatggttgctccatggacctctcacgttgcactattggaacgttgacgaatgaagcaccttcagtccaaagctctttgtggattcctcacttcttgtacagtcgcacgtatgcatggatgctaggtcgggcatgtgtccctgtggtagactcccgtcttcaggcatagagacacctcaacctccgaactcacagccacgcatgtgaatctctgcgtgcctcgagcaaaggaggacgtggagccgccaggctcagtattcctctcacgagacctggcatgatcactgtctgtaggggcggggaggcccaagatctgtgattccatgcaggtggagctacctctatgctatatagtgtatcaacacgcacagattagttgtattaccttttccgatctaaatgtggctaagtatatataactcgtacgacaggccaacggtaccatagaaggactcccctggggggcatgagaatctactctattgagtgaactctcgaaaagccgcactgacgagtcccagtacgcggagccaaaggacgtcacaatacagaaacaaacaaaaccaagggacaccacgcagaacaaattccaagggatcaatagcatgaaccataaaagtgaagggggctgaagagagaacctgcacgcagaggaggccaatccaagggcataacagagccacaataatcacaaaggtgaacagaagactgagaggaccacatatatacaaggacgagacgacgcggagcaatagacacacctgggaccgagaaccaaaggaaacacagagggggaacaagaagataagcgcaaccacccagtgagacagacgggaaaaaagtggggagccaacgatattcacggacaagtgtgagaacacggccagagaggacaacaaacaaaggggaacacgggagagagtgcgtcaaaacccagtaggaatgccagaggcgggcagaacaacatgagcacgccgacacagagggaacgacaacccaggccacgagacggcatgaacagaagaggggagcagacgatgcatggggagagcggacgaaaacagacaaggacacagacgggggacgagcacgcgagcggcaggggctccaacaggagcaggacacgggcagcacgcagagacgcacaggagcgagaaagcaaacagaggacacgacagatgcgaacaagggn

SEQ ID NO: 512543 - DNA, 217 bp, Homo sapiens
ctccccaattacagaatatactgcttccccccacccccaactctgtctcccaggctgcagtacggtggcatgatcacggctcactgcagccttgacctccctgcctgaggtgggaggatcatttgagcccgggaggtcaaggctgcagagagctgtgtttgcctaactgcactccagcctgggcaacagaatgagaccctgtctataactgttcttt

SEQ ID NO: 512544 - DNA, 309 bp, Homo sapiens
gatgacactagggtagttttgcaggtggtaagccatttacaagatagtgtaggtaaagaagggcagatttattagagaaattgtgaaaatatgttgcagtgggcagctcagcagagaaggggctacctgcaaagaggcaagggctggaggaaagttttatagggtcctgctgaagggtgctacgtgtggaatgaggtcattgtgcccgcaggttgtttgtgattagctgtctctaacaattgttcatacaataattgttcattattgttctcaacttggggctctccccaacctggggacccttcctta

SEQ ID NO: 512545 - DNA, 563 bp, Homo sapiens
agtacctttgatattattgagaatatttggctcacttgttttttttctttgttccctttattttagggcaaacactgtatccttgatgtgtctggaaatgccataaagagattacagattgcacagctttaccctatctccatttttattaaacccaaatccatggaaaatatcatgtaagtgtaaatgcctaaggcatagcctctgtgtacaaattcagtcactgtagggtaatttatttactctccctgcatctcagtttatctataaaattgagataatagtagtatgtttattcacctcagattatgtggtgaggattaaataagcactatgggttataaattgtcattgtaatcatcatcattaatattactaaagtataaggtaacatgtgttagaactttaaatagccccacgtgtgactagtgtgactagtgtaaatagtgactagtggctactgaagtacgcagcacagctctcaggtaaccattaagagaataaaagaatgtataaccattacctaatactttcaggggacaaaaaaatagaatctaagtaaa

SEQ ID NO: 512546 - DNA, 258 bp, Homo sapiens
aatttagtgacccggcggcatttaacggttgccaagtccccttggcattttgtgaaatgcgacgaaatacggatccgtaatatgtcaatttgccaaaatatttcgggccgtgtttcatcacgagacgttccgttgatatctatgtcgtgtgtctggaagccgcctcgattagccatagcactacagaggatttgaagcgtcgttacgacctttcagattctgattccaatctctctggtgaagaccagagtgcttggt

SEQ ID NO: 512547 - DNA, 214 bp, Homo sapiens
atttggccccaaataacccaaggttaaaaattttttacccctttttaattttttccaaagggttttaccctttgaacccttttttaaaccccccgggctttttttttgggccttttttttttgggcttttgggggccccaaaccccctttccctttttttttttttttccccccccccccaaaaatttttaaaaaaaaataaaaccctttttta

SEQ ID NO: 512548 - DNA, 184 bp, Homo sapiens
cagcactttactccttcggctgtgatcaatctccagctcacttttagccagcaccaacatggccttgcagtccccctgactttcttcattctgttctgcgttcctttcgtggctttcgttggaggtctttttcttctcatacaggccatgtcttgcaagtctatgtttgggtgcatttttcttg

SEQ ID NO: 512549 - DNA, 1188 bp, Homo sapiens
gaacgatggcgctcaccaggctttttacctgggcctactcagctatctcaggaccagcttgagggctgaagaagaggcgagatcccagagatcagcggcatgaccgtcacgtggctctccatcccgaagagaagcctcccccggtacggataccggaataggctggagtacctcgggttattagaggatttcggagatggaggtgcttgtccagtagatccatgtggcccagctagtccactggatatgggacgaaagaagcaaaaatgtcgaatgcgctggccatgtcaggtggactgctgacggaaaaatgaaatacgatgcaaattgctcgtacgaggacaggtcaaaggacagaggtcagtcgataagcagaatacagtgatcgtgggttccagaaggaggttatgagatgcagatgatcgcgagaggtgcaaagggccgatgaagaagctatgacaaggagatacccacgaaaagacaagagtagccttagaaaaatctgtatcacagaaggtcgccggcagcatgccagttcgagcagctgacaaatgtggctcctgctcagtatatccgatacacaccatctcagcaaggagttgcattcaactctggagctaacagagggtgatccggatggtagagactgcgacacgatccaattggagcctccaaggtttcacgattactaagacaattccccggagaacaactttctcgctcctgcgactggtattggcttcttcctagccgaaagaatgactgtaaacggaacaaaagcagtggaagatcctccatgggattgtctaaagtgcgacaactgcacaagggtactacgagttccatcaaacaaacgtttgttgctgacggaacatgacacagacagtcacacatatgcacctcggccacagaggcaaaaacactcaaccaagcggaaccgaaggctcaggaacacggggaatggcgcccccaacccgccaaagagccaaacaaacagacacacgagaagccgacacagcgcaaagcggcgacgacaaaagcacaccaccgaacacaagaggagcagcacaggaaagcgagaggcagaagaaaacgcacacatcagaccaaacgacgagaagaaatgagagcaccacaaaacacaagacggagagttgacacagacacgacagaccacagctccaacca

SEQ ID NO: 512550 - DNA, 839 bp, Homo sapiens
gtcaggatccttagtgtttgacactcctcgtgcggggctggcctcctgcggactctagtttcgcctccttgatgtggcgcctgggatttcttcacttcagagctgtatttttacaggcaagagtaagttcctgggcacagtggctcatgcctgtaatctcagctactcaggaggctaaggtgggaggattcttagagcctgggaggtcgaggctgcagtgagctgtgattgtggccactgcactccagcctgggtgacagagcgagactctgtctcaaaaaagaagaaagagtaagagctgaggcatataatagaattctgctaaagcacttaaggtgaaatcacattttcttttcccaggatgttgctcacatctttcgtttttattgaggtgtcatttatatacaataaaatgtactcattttcagtgtttttgaattttgacaaatgcagcatgacctcaggcagaacaacataggacattttcatcacccaaagaaggttctcatgccccttcttagtccccccaccccatcctaagcaacctatgtgggtgggttttggcttttctagaatttgatgcacgtggaatcctgcagcatgttcacgtttgtatccggcgtcttgcgttcctgcttctgttccctgatccctacacttacactgtctcctgggtcagggcagccccttgttagtatcttaaacaatggaacggtttgaggagagctcgagggttgaaaaacactaagcgagcggaaatgtaatgtagtaagaaacagaactctaggcggggagaaaacctagggaggtaaaaggctgttcttcccgaagcatcactg

SEQ ID NO: 512551 - DNA, 185 bp, Homo sapiens
aggcgaagactgggggtaggcaccgggacatagcacatcttctaaccgctccaggcctcggcagatacgctttcctcagtctctttcccctggccggtccgggaaaatctccatttccttccagacggaacacctccacagtcttctccggatccacagtcttcgcgggaggggtaccgagctcg

SEQ ID NO: 512552 - DNA, 104 bp, Homo sapiens
  misc_feature (32)..(32): n is a, c, g, or t
  misc_feature (100)..(100): n is a, c, g, or t
tgaggctctaagaaataccagacatgaaagcnaagacatcattcctcagcaacagttcgggtcagtcttattgttctcatttatagataagaaaactgangctc

SEQ ID NO: 512553 - DNA, 270 bp, Homo sapiens
cgccatcgcgaacggcgtctgctctttctgcatcttgcgcagcacgtcgacgagcccctgcgtctcgggcacgaagagcacgtcgcgccgcagcgtgaccaggttgggcagcttcacgttccgcgcgtcgcggagaaaatccttccagtagagatacccgacgacctcgtcgagctcttcgcccttcgagagcggcacgcgcgagtactcgtgcgcgcgcaggaactcgagcgccgaggcgccggggatgtcgatcggcacgtagagcgc

SEQ ID NO: 512554 - DNA, 114 bp, Homo sapiens
cagccggtaccgaatcttcgtcccatcagcggatttctatacattgacctcttgttggttatcaacaacagcagtctaacgacgtgtcaacagtgacgctggtttgatggtagc

SEQ ID NO: 512555 - DNA, 366 bp, Homo sapiens
ttctagaggatccctcaaaacgtatagaacgatgagggagaatgacgagggagcaagcctgcatcagagcacggctgatgtcacggaagccaccaaaggcacccaccagagccttccccacctgcaaagccccttgcagcacccgagagggcaagctggcttattggaggccatgcgtgagtccagtgacagagtgggacatgtgggactgggctggcctgttgcgagtgcgctgttcactgtcaacatgtgctcacgccaagtgcagtgacggacagaggatagagacgccggggcacgctgacctgggcccgcagattgccgctcacatggagacggcgtcttgcacacacgctgagcaacttg

SEQ ID NO: 512556 - DNA, 257 bp, Homo sapiens
gaagctgacccttggtgacgatgtacgcccggtcgcacagcaagctgctcacaaacctcacagacaaagtgctttcggtgccaggccagactcttccacacgctggatagtcctcagcgaactattatctcaatcgcagccggagacaccgggtcccgcagaactctcgcagtaaatggctggcccgcaccagtggtgcaccgatccgttccagcaagctagactgaaggtccaccaagcggcctcggacgcacttg

SEQ ID NO: 512557 - DNA, 205 bp, Homo sapiens
gcaggcgaggcccgcaggtctacagaccaaggcacgcacgcaagcgccgtgaagagcgcctccaggccaagaaggaggagatcatcaatgcactttatccaaggcaggaagagaccaagaaataaaacctcccactttgtctgtacatactggcctctgtgattacatagatcagccattaaaatataacaatgccttatctgcg

SEQ ID NO: 512558 - DNA, 462 bp, Homo sapiens
gcaatttcactaattcacttatctatttctgcctaaacataacactgttacttacaaatacggcttatatttgaatctcgttcattgtttattgggtaataaatcatactttatcaaaatattatatattcctaaccatgaacactcaacgtctttccatttagttctgttttctgcaacttttttctgcaaagtttagtatattatcagtgtataagtgtttcgtctcattggtcaagtttattcctaagtattttattctttttgatgctactgttaaatgtgatttgtttcctcaattgccttttcagattgttcatagctgcttcttgaattgtaactgacttttgtgtgttgattttgtgtcctgcaactttgctaaatttgtttattagttctagcagttttatgtgttgtgtgtggaatcattagggttttctacgtacaagatcatgtcaccta

SEQ ID NO: 512559 - DNA, 958 bp, Homo sapiens
  misc_feature (957)..(957): n is a, c, g, or t
gagcggttggacgtgttcgcttgggttcctgctgcggcagctacctcgtcggatctctctgcatcgatcgccgcgtcgctaatgctactgaccgtactcgcgcgcgtattaggagccgcgttccagcctcacaccccacggtgctgttcttcgacttcacgtaaaggatctagtctcagacacagaagcgcctcaggcgcggcgcaatgctcgagcggcacggcgggggcggccggagcctctctcgggggagccgcgcctgatgaggcggacagaacccccctgacgcgattggcgtgtgcttctgcccgccaccgccctcccgtatctcacccgggccgtccctggctcatcgtgtccctggccgcggtaggcagtcggcggtcagcggctctcctttccacagccggcgctccgcgaccgcttggctcctgagcccgtcgggtaggctctcctcgagttcccgctcttctccccgttccctcacctctttctttcgttacccgtccccgagcccaaccgatgccgggcctcagtgatcgccggtccatggtgtgtcggagtccactctgaaaaggatctggatttcgggccgctgcttgagcctggcgtccccgagagtgcaggcgtatgtgcgccattgtcggtgccatctcggcgtgcctccccgtgtcgggatcgggcaccgtcgctccttcttcgttgcggcgctcgctgagaattatctccgaatggagcatcccttcggcgaggtttctccgctttccggaccaatcgtcctctaccccgtgttaggtgcgcaggagcttttcacggtttcatgacggtcgttgatctgtgcagcctgtttcttggcggttcccggttgggtcccaaaaaaactttctcggtgggtgggtcggggtgcctagccgtcgttgttttcacctactgggctcactttcgtgcgtgttctcng

SEQ ID NO: 512560 - DNA, 168 bp, Homo sapiens
ctccattgcacattgttacctgtgagtgtatacgtggtgagagaaagcagtgagacctctctctctctctctctctctctctctctctctctctctctctctgtctctgtctctctctctctctctctctctctctgtcttctcttttttcttctcctcctcgtgctc

SEQ ID NO: 512561 - DNA, 86 bp, Homo sapiens
ggatttgctggtgcagtacaactctcgaattcgagttcaagcttctaacgttagaagcttgaattcgagcagtagtagtagtaggc

SEQ ID NO: 512562 - DNA, 354 bp, Homo sapiens
  misc_feature (321)..(321): n is a, c, g, or t
ctagcattgtcatgctcgctctgtgctctcttcatcttgtctggcccgagcaccctgccacctgcagaattcacagtcctgtctctcttgtctccctgcaggctgtggttcgtgagcacttctgaggagcagggctgggtcctgccacctacctggaggcccagaatggtactcgggatgactccgacatcaacacctctaagactggagaaggtgagggcttgcaggtccaaggggcagggagcaacgcggcctctggaggcagctctctcactctttccctagaaccaacagaacccttaaagtgagctgagccatatnctagcctcctcccttaggatcccatctcagtac

SEQ ID NO: 512563 - DNA, 210 bp, Homo sapiens
tgtagaaagtcaggctggggagcaggctcttggcggggtgcgggggtgttatgcaatgcagcagccgcagtgaagcagtctcaggtcacgctcagggtctcagggccagtgacagctattgcgatatccagagcaccaagatagtacctcaccctgtagcttgtaccgtcaccctgtatgctgtaccgtcaccctgtatgctgtacctca

SEQ ID NO: 512564 - DNA, 221 bp, Homo sapiens
cactggcagcggaggtctgctccctagagggcgaagggggcactgaaggtctcccatcagtagacctcttactctgatcgcttcctctattcagtgggctggtgagcatctgcgccagcacaagtttcgaacgacctatctcccaaggagaaccaaggacacacatgaccgttcaagaacacatgactagccagtgaacaagggcacaggattaggggtgg

SEQ ID NO: 512565 - DNA, 134 bp, Homo sapiens
ggggtgatctagaggatcccatctcaggcaggtacgacgagctggagcccaaaatcacccatgagtccaggacaaagccaatgtcatccgcggctctcccactcctgcatccagtccctccccaagcctgagat

SEQ ID NO: 512566 - DNA, 307 bp, Homo sapiens
tcagcggactctcctactgtatctacaattctactcctggattttaaccacagagaaatgaaaatatatgtccacacaaagatctatgttcgcaaatattcagaggagatttattcgtaatagccaaaaactgggccgggcgtggtggctcatgcctgtaatcccagcactttgggaggttgaggtgggcggatcacgagctcaagagatcagaccaacccggctaacaaggtgaaactccgtctctactaaaaatacaaaaaattagccgagtgcggtggcatgcgcctaggatacagtagggaga

SEQ ID NO: 512567 - DNA, 513 bp, Homo sapiens
gtagaggtcatagttactcctttttagcttttttgagcccaaggcattatctcttatctttttatttgttccccaagattggcaacctcttctgccagaactgctgcagtgtcaaatctcaagagtattagtcttgtgttttcagtttgtttttcattcttggtccttgggggtttatattaactttttataagcatagctgtgaatcatttaaaaaggacagttattataattttatccacatttctacatgtttcgcagtgggataagttgcagggtctcttaactgccaaggtaccaagtaggaagttcttgtccaactcgttagatgtacctttttcattgtgttatcttgttggtttctaccagttattcaagtacttcctctcagtacttttttttgttaacttttgcaatttttttgtttttgcagataataattttacaggcttttgctgcaaaaatggaatcagtagggaagctataaaatgacatacttaatcttggtttgtg

SEQ ID NO: 512568 - DNA, 228 bp, Homo sapiens
cgtgagttccttgtctatgaactatcagtatattattaaagttatgtgtacaaatttttaaataaattcattatatgaataatgtatgagacatgagatttccataatatgtgctttgcccttttccgcccaggcattctcccaactcccactcctatatgatatacaccccttcataaaattgattttacctcaggacaaatacaaatgaacagacaaagggaaaca

SEQ ID NO: 512569 - DNA, 279 bp, Homo sapiens
aaactcaaaagacgacagtaaacataacaggacaggtacgcacgtccatgtacttcttacgtcccacaccaaaaacacttactcacgttaaacacctggaccaagaaaatgttcaactctcacaaaggattccaagcttaatacataccaaaaaagggctagactatctgacaagagcacagagagaaaaaaaaaaaatttcaaaacaaacaaacatgaacaacaccaacacttaatttacacttcactgaagtatatatggggacaatcctatttaca

SEQ ID NO: 512570 - DNA, 130 bp, Homo sapiens
  misc_feature (77)..(77): n is a, c, g, or t
gacagtcctagagagcccgtagcttcttcgctgaactcaacggaatgagcattttcccccgcaatgaagagcatcgngcgtggcgagattgtctcgatgtcattgaacggatagaagttcatgaacctga

SEQ ID NO: 512571 - DNA, 102 bp, Homo sapiens
agctggtaccccaccggaggttgtactcagggtctgcttttctctgccaagctggctgataaacggttaccagcgccacctggcagtacaacctgccggtgg

SEQ ID NO: 512572 - DNA, 274 bp, Homo sapiens
ctgccttcactgctcacaggtcaacggagcttgggcccagctcacgcaggtattcagcagcaggcatggcacgtcagccagcaaacaagtcactcccatgcatgaaaagcatgcagaatggaaggtgccatgtgccgtgaaatgatacatgatcctctggtccttcagggaaacccttgactcttcactaatcctcaaccttgacatccctttgtatggcttttgtcacagcgagtcaccagttcccctacgtgcacaggcagcacacatctcg

SEQ ID NO: 512573 - DNA, 360 bp, Homo sapiens
cccagagtctacaatgtgtctgaagtgtactgagaattccagtgagaataagtcacacgtggcttgaaatttatgatgctgtctaccaaaaccgtgggctagaggccagcacctaaaaaaccaaaatcaaaatttgatcaggccacaaaagaaaacaggacaccctcaaacacagattaccttacgttggctcctgacgagattacaagcctcttgtcaccaaaaaacggaaacagcggttgagaaagaagccgggcgcatagcacaggccttcaaaggttcgctttaagcacagaaagacagcgctttcccgagtcctcgccccttggggcgatctgcgcgagtcgggacaacagacag

SEQ ID NO: 512574 - DNA, 202 bp, Homo sapiens
cccctttgaaaaaggggggtttttttccaaatttgagggccgggggtattttttgggtgggtttcctttaaaaggggaaagatttttggtttgggggtattaagagccccttgggtgggggggggggggtattcccttccccccttaaccttgggggggggggtttttccaaagaggaaaaaaatttttcttttttttttta

SEQ ID NO: 512575 - DNA, 183 bp, Homo sapiens
taggcggactgatatgcgtctcacagagcatgtagcagcaagcgccccctctaacaggtctgtggattctctggcttttctggtagtagttcttggagcaaaagttcacagtgtgattctctgtgcacgctctgtccgtccaagtgggagctgcaagttagtcctgcctcctatctgccatat

SEQ ID NO: 512576 - DNA, 183 bp, Homo sapiens
tcatatagcccaggtttatcatcaagaaacgcaatataccagcaacagtgatcattaagtacaaatgcatatctccagcaagcttcctgagaatttcttcagacctggaacgcctctcttgatatccgccgactccatacaccctctttccacctggacgctccgatcaagttacactatctt

SEQ ID NO: 512577 - DNA, 119 bp, Homo sapiens
ctcccacggcaagaaagttagagtttacgcccgattaactactgactatgtcaaattggattttggcgttacgtttggtctatggtgtagcctgagaataggggaaatcagtgaatgaa

SEQ ID NO: 512578 - DNA, 377 bp, Homo sapiens
agatgaagcacgtgcaatctaaaggatacccaaaatgaacgttttgtaacttctcaccatactttcctctaaggagattatctcatctggactcatgatattacattgcaagacgctggcctttgtcctctagagactgtctttgttcaggaaagaaattagacaccatggcttgacctctctcaggttagcccttttttcccttttcctgtgagatacagtgatcactaagtatgcattttggctcataggaccacagagccaatgttgggcaagctagtcaccttccttctcttatttcttgatctctcctataatcagtctctttctccccctttgtttctgtctcctcttctgttttctcgctccccactccg

SEQ ID NO: 512579 - DNA, 361 bp, Homo sapiens
atctctcacggatcccacgctgttaaattaactataagacgatcaattgttggtcctgctcacagcccagaagacaacagcaaagtgtttggcgcttgcacgcgatagggacataaatgttaggaagctcacatctctgttttcattcattcttgcttgagtgctgtcatgaatcctctggactatccagcagaatgctcatataagtcagtgcatactcttacctgaggtgctttctctcgctcctggcctgagtcacattgcttggccctatggggtggggattaggatgtgagaggttcgaaccgtttctgcctcatggccaagactttgaatggtgtctccgtgttactttgacgcg

SEQ ID NO: 512580 - DNA, 702 bp, Homo sapiens
aatctttattgtaataactatatatatgtgtcggaatggttacatattgcagcccttagtatttgtggtagtataaatgtatcacttctaaacagcaaactgtaaaagttttaatagcagatatctgaagtactattaaattgcagggttcacaggccgtaactgtctactacttatgctataatctgtatacatcctgtatgctgagctggtaaaaatacactagtaaataaaatactaaaatattttatctgctaaaaacaagcgcaggtgcaacacaatatattaccatagctctacattgatgacctgtcacaagttgcattaacattaggtgatttatgcctaacataaagtgactaactataaaagaatacataaggctacccccgtaccacatcactgatttcaactagaaacactggacgtggtacacacgataacaaaaaacataccacaacatggcactcaaaagccaggtggtacaaacactactagacgcactccgagtggagtaccaactgactgaatagcgccgataagcaacacgcacagcgggacacaccggaaaggcgactccaacgaacgagcacgcccaactgacgactctcagaacgcaacggatcaccctaagacaaaaagccagcggccaacgctgaaccacacacaagacgaacgcagaccaaccaaaaaaaaaccaag

SEQ ID NO: 512581 - DNA, 306 bp, Homo sapiens
  misc_feature (98)..(99): n is a, c, g, or t
  misc_feature (239)..(239): n is a, c, g, or t
  misc_feature (267)..(267): n is a, c, g, or t
ggaccgtatgtatccccaacactaaggtatccggtgttatgaatcttctgagggcatcttcaggtagatttgttagcctcctggtgtgcttttctttnngagatggagtctcaccctgtttcccaggctggatgcaatggcgagatcttggctcagtgcaacctctgcctcctggtttcaagtgattcttctgcctcagcttccggagtagctgggattacaggcatgcatcaccacgncgggctctttttttgtgtgtgtatcttnagtagagatggggcttcaccgtgtggggcgataacatca

SEQ ID NO: 512582 - DNA, 331 bp, Homo sapiens
cgagaatgtacgtgacaactcaagaaagttctgagcatggtggacaactatgtcattatgatgataccatttagagactattccagcaactcctagctgcagttaatcagagaagattccattaatcactgcaaaaagtgaagatgccagctgcttgtctgcaaagtctgtggagcagtactatggtctcggaaaattggaaaaaggagagccgctgagtggcaaagagcaatgacaatgcgaaaagtcttacaagaaatcctggagaagaatccgagatttcaccacctgactcccctcaaaaccaagcacatcgctcactggtgccgct

SEQ ID NO: 512583 - DNA, 757 bp, Homo sapiens
ttgtgccatgggccaccccagcttcgtgatgagtaactccttcaccaaccaggtaggatggcgcagatcgagctgtgtgacccatccatgacaaagtaccccgttggggttcaatttcctgacccaaggaagctgtgcatgagcgcagtaggcgtgaagcctcgaccatgggcaagcgtgaatgtgaagttgaccaagctaacgtgagaaagcaaagcccgagataccgtgaggctatgtccatgtgatggcacccattcaagccggatcagctaccgcatacttgagagccaggtctgcgtttcacccatccaggcgtgcgtgtcctatgacgccagcgcccacatcatctccgtcccgtaagagactacactggacatccaagcgtttgctcgaatatgggtatgttgtcgagatcgtccgcctcatcgacatcgtcatgagagggcgtgagtcagctgtagtattttggacctcatgctgacagcacgatccatactgtatcctaaatgttgcgacacgcgtggtaacatgaggtacccatcttgcaagcacccgtgtcgatgatggaggtcccagacacagggaaccatgagcatcagtggtcttggaacagctcactaagtcagtccttcctatagctctggaagtcagtcgtggagtcacgaagcccatgtgtggtagtcatctaggccttcactggtcgtggactttatacctgttataggttaaaggccagaggtctcagccttgacaa

SEQ ID NO: 512584 - DNA, 258 bp, Homo sapiens
tttcaccatgttggccaggctggtctcgaactcctgacctcaagtaatccacccacctcaacctccaaagtgttgggattacaggcgtgagccaccgcgcccggcctaatattggctagtattttcagtacaacgtttattaaatggtgaaaaatggtttcctgtctcattcttttttttttttttttttttcaagacagagtcttactgtgtcacccaggctggagtgcagtggcgtgattttggctcactgcaacc

SEQ ID NO: 512585 - DNA, 406 bp, Homo sapiens
cacgcgtcggccccggttcgcgcgggaagaaccccgtgcgcactggtgctccccgtgcggtcctcaacccgttccggcgctgcgagcgtgagcccgacccagcgtgcgccgctccgggaggtcgtgggatctggggctgccgcggggccgaaatgcggcgcgagggtcgcgggttccagagctgcggtggctagggacgtcgctgggggcgtctcagggagcgggctaaggagagcgcgtggccgcagcctccctcgcgcagcgccacacgcggtttccgtggtccgctctcccgtcgcccggagactgcgcgtcgaacctgtcattcccttcctgtgccgcggggacgtctttgggatccccggggcccaggcgccccccccccagcctctggcctcgggctcca

SEQ ID NO: 512586 - DNA, 118 bp, Homo sapiens
aagcaattagaagttgtctatccatctatctagaaaaaaatctatatatagagagaaaaaatgtatataatatagagaaaaaatatatatataactatatatagttttatagtttata

SEQ ID NO: 512587 - DNA, 370 bp, Homo sapiens
taatttaacactaaccaatgaaaattcccttcctcaccagttcagaagtatcctacaaagaaaaaaaaaaaggataatttaacactaaccaatgaaaattcccttcctcaccagttcagaagtatcctaaaaagaaaaaaaaaaggataatttaacactaaccaatgaaaattcccttcctcaccagttcagaagtatcctaaaaagaaaaaaaaaaaaggataatttaacactaaccaatgaaaattcccttcctcaccagttcagaagtatcctaaaaagaaaaaaaaaggataatttaacactaaccaatgaaaattcccttcctcaccagttcagaagtatccgtcgacgaaaacgcgaatttagt

SEQ ID NO: 512588 - DNA, 368 bp, Homo sapiens
  misc_feature (37)..(37): n is a, c, g, or t
  misc_feature (106)..(106): n is a, c, g, or t
  misc_feature (144)..(144): n is a, c, g, or t
  misc_feature (157)..(157): n is a, c, g, or t
tcagccctgctcccagctgctttcatgggctggcagngtctacaacttttcaggcagacagtgcaaggtgttagtagatctacagttctggggtctggaagacggnggccgtcttctcacggctccactaggcagtgtcctagngtggactttttgngggtgctccaaccccacatttcccttccgcactgccctagcagaggttctccatgagggctctgccctgcagcaaacttctgcctgaacatccaggagttttcatacatcctctgaaatctagtcagtggtttccaaacctcagttcttaacttctgtacccctacctgcatgcccaacaccacgtgggctgccgcttgagacttgcacct

SEQ ID NO: 512589 - DNA, 767 bp, Homo sapiens
tgctgacctgctgtgctcgcagtagattccaaaaaaaaaataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggaaaaaaaaaaaaaaataaaaaaaaaaaaaccttgtgagccgcttggcccaagggatttttaaattggggcaagttaatattgggggcccaattatgggctaattgggcaaattccccttttggggggggttttaaaaataaaggggccggttttaaaaaacctcggactgggaaaacccgggggtaacccaatttaaaccctttggaaaaaattccctttttgccaatttggggaaaatgaaaaagggcccccccgatgggcttttccaaaaatgggcccaccctaattggaaagggaaaattgaaggcgtaaaattttgtaaaaatttcgggaaaaatttggtaaaaacacgttcttttttaaccaaaaggcccgaatggggcaaaatcctttttaaataaaaaatttgcccggaataaggttggagggtttttccacttagaccaaaacgcccttttaaaaacgtggcctaaacgttaatggggaaaaccctttttaggggagtgcccattgggaaacatcccctataaagtttttggggtaaggcccgcttaaagggaccttagggggccccttttgattttgggcccttatacgggcg

SEQ ID NO: 512590 - DNA, 2490 bp, Homo sapiens
agagacagggttttgccatgttgcccaggctggtctcaaactcccaggctaaagcgatctgcctaccttggcctcccaaagtgctgtgattacaggcatgaaccatcacacccggccaaaattttgccgctgatttttagaaattgaattattattttagactgaagttgtatctttttaaaatgaaagccatacctccgtatttctaagaaatcagatgggatcatcatcccatcaggtattcactgagctcctgcttgtgctccactgtctgctcagtgctggttctgtattgcggagaggatctaaccagaaagtaatccaaagggctacatctgtctttcttaatgacgaaccgacggctttccaccttacccttttggctacaaccagtgggattgactgctgtcttattgactctgtttatctagatatggtggacatattgcccagttagatgggctaagataccgatagccccccaaaatgccagattccagaataaatgaaatcactcagtcattaaggtgatatatttaactgggctggctgggctaatttgtccatgttaccaattattattgagcagacaaagtcaggtaatgatggcagcaaaagcccatctggggcctgagactagaggaggaggaggctggccagaccctcctcagatgcgcagaggacagcttcaggataaggagagatcagatcatgcctgctccatctcggcgggctcatcttctctcgcccccatctgcatggtcctcttgattttcttcataataataacactgaaatcctttgagtgctaacattactgtaagtgtcagctgtttatgctgttatatgccttaagttatttcagccttaccacatgcagtgaaggagacactagtattatccttatgttgcagctgaggaaactgaagtgtggagtttaagtaactggcccaaggtaacagatgcagtgatcagaggagcagggacccacagccaggcactgtgacacagagcctgcgctcctcactcatatcctgcttcaggcttcacaggtcttgggaagaaaaagagaacgtttacaccctgaataacattgcaaaaggatagtgcgctgtgtctgccggtcagcagagctctttgatgatataagtaggagacacctaagcaaagtaaagttgaggtcagtgagctccataacaggatagtgcgctgtgtctgccggtcagcagagctctttgatgatataagtaggagacacctaagcaaagtaaagttgaggtcagtgtagctccataacaaaagatagggaatgctctaggtctcctcaagaaaaatctacaccatggttttctgttttcacctacagcttagttgcccaggaagattcatttattatttatttaagtaatacatcacagggacgagattcattgaagtgaaggtatttcacttccaactgtcctacagggaaacaatgagcctaaataaatcctacaaattctccctggagagggagcagtgattgattcatttttgcatctgtcaaatgcctctatagtccaaagagtgcgttttgttccctcccttaacaagattctcttacctttgttttgttcaggctttattggcgctgtgtgtataaataagattacaatgaatagaaattaacactgtatcccagttttctgagtcaaagccccaattccaaacagaaaaaaaaaaatcttgttgttaaataatatatgggtattatttgtcacatatgataaatattgctactcatgcccaaaaagagactttacaactgtccttgtgctagacgaatgactggtctacaggctacagactattcacagagctttggggaagccctgaaactcacctgatagcagtgtccttgggactgaatataaacttctacagttacaaggccttaagaggttccaaagtagagcaagtttggggacttcaaaagcagtgcctgggatggcagacaatcattgccgtggtgcaggggcctctctatgatcccatcgctgtgcccccaccgagacccaggtggacagtttggaggtggggagggagctgggatgtgactcagcagtcatgtggggcaaaaccagggtgggggcacgaccctgctagattagcctgaaggtggggcaaatgactggcaccttgtcacaagacattgttgtttttacgcatttgacttgatttcacccttcaggctcagggctggccctgtgaggcctttccactgcattcagttgttctttcttgaatgttagagggaggaagttggagtctctgttctggggaactgaacacaccgcacgcagcccatctggcctgtgccgtgacccacgcagcacaaatcactagttccagcggcgacaacactaacatttatacatcatgcaagttgtagtcttttattttaacttaaactttttattttcaaataatttcaaactcacaaaaagttat

SEQ ID NO: 512591 - DNA, 1081 bp, Homo sapiens
  misc_feature (1081)..(1081): n is a, c, g, or t
agaagctgcagaattgaaagatccaacagatcattaccacgctcagcctctggaggataacctttttgaatggcacttcacagttagagggcccccagattccgattttgatggaggagtttaccatggacgcatagtactgccaccagagtaccccatgaaaccaccaagcattatcctgctaacagctaatggacgatttgaagtaggcaagaagatctgtttaagcatctcaggacatcatcctgaaacctggcagccttcatggagcataaggacagccttgctggccatcatcgggtttatgccgactaaaggagagggggccataggttctctagattacacacccgaggagagaagagcgcttgccaaaaaatcgcaagatttctgttgtgaaggctgtggctctgccatgaaggatgtcctgttgccattaaaatctggaagtggttcaagccaggctgaccaagaagccaaagaactggccaggcagattagttttaagtatggcgcccagaatccatcaggagcacccttgccagagactacccagccagctcctaagaatacctccatgagccctcggcagcgcagagcccagcaacagagtcagagaagggcatccacttcccccgatgtggctccaaggtcaggcaccaagagcccacaaaaagagcacggcgggtccgcatgcgtgatcataatcctgagtgtaggcattggggggctaataattcgaggaaaattattggggcaagagtacatatatgacgttgagatataatagcaggatagtgaaaaaagggggaaaagagggtattgagaattgcgggggggaaccacagaggggtgacacgaacgttgccggttgtctccgcgtaaagttaagaggcaaaacactagccagaaagagaaaaagcgggtgcaaaaaagtgtcgtaggaagtgtggaacagaccgggtaggagagtaagcaaaaaacttagggtgcacacaggatagtagataaaaaagaacgagtagaagactagagagtaaatagggaaggactgactagtctgtttgctgtacatacaggn

SEQ ID NO: 512592 - DNA, 418 bp, Homo sapiens
gccaggaggagggtggatctccccagagcaaagcgtcggagtcctcctgctccttctccttcaactatttatcatagttcatcgaaaggagcataccagtgaaagtacaactacaacttagacagatgcatgcgcgatgtcttatatgctacatagacaggttacaatatcggacagaggatcacgatcacatcttacggagcccattactctagagactgatgtactgcgtacatttgttaatcaatgtatagtacaagctggacatactggtgtttgcaaataagcgcaactacttaacacttaccactatacgcatgagcatcatgtgttgcattagctgaccatctcagctatcacctggagatacataacatgaacatatgaatatgtacatgactacaatgcttccaggtgt

SEQ ID NO: 512593 - DNA, 112 bp, Homo sapiens
acccaaaccaactccgagccggccaaggtttactacgcgtgacgaacttacaagcgattttggactgggctaatgaacatgacacgtatgtcattttggatgaaatctatgg

SEQ ID NO: 512594 - DNA, 122 bp, Homo sapiens
tagttagaagttcaatagcaagaaatggatgtagctagagtagtgtcaggtaaaaacagcatcttttaaatggagttgtgggcttctaaaatctaaatacattgctattgaaacttctaaaa

SEQ ID NO: 512595 - DNA, 1271 bp, Homo sapiens
tgcgtggcaatccctgacgcaccgacgtgatgcccagggaagacagtgccgaactggaagatccaactacttccttaaagatcatcccaactattggcatgcattcatccagcaaatgttatccattgtgggcagccagcacaatgtgggcatccaagcagcatgccagcagcatccgcaatgtccctatcgcgggcaaggctgtggtgctagatgggccaagcaacacccatgatgcgccaaggccatccagcagggcacctgagaaaacacacccagcatctggcagcaaactgcatgcctccatatcctggtgtggaatgtgaggctatatgtgttcaccaaggcaggcacctccactgagatcagggacatgttgctggacacaataaggtgccagactgctgcccagtagctggtgccatatgccccatgtgaagtcactgtgccagcacacagaacactggtactcggagcccgagaagacctccattttatccaggctgttaggtatcaccactaccaatctccagtgggacaccattgacaatcctgagatgatgtgcagactgatcaagactggagaccacaagatgggagcccagcgaaagccacgcgtgctgacacaatgctcaccatactcccccttcctccatagggagctggtccatcccaagcaagcgtgctcggaccaatgggcacagcaatctacaaactctgaaagtgcttgaaattcagagacggaaaactcgtggatatcctctaataccctagacatgggtgtaccgcgactagatgccaagatagtctatgacctgaagacattgggctacacagaactgatcgcattcacataccccgacatgcaatgatacaaccgaggaacaaaccgactcctgtccttgacagacgcacacagatacacaaacacacacttacggaaaaagagatcaggcgccgcactgggccagaaaacacgatggacatatagaggaccgggataacccacatacagaagtgggaacgccacaacagaatacgaccctagtagactgtacaaaggaccccccaccaagataatacaccacgggacacactgacgaggtcgccaccacagactcgacctacgcagagaagcagagcacacaaacacaccaacaagatacaataaatactaaaaaacacacaggaggcgcacctaacacaagaggacgcaccaacacagccacctacaagctcgaacagcatcacaacgacagccagaagacagg

SEQ ID NO: 512596 - DNA, 249 bp, Homo sapiens
ttgttcgtcgataagccccccggctggcgagcaggctgatcacttctttgagtgcaggaggaaacaaaccccgagccctgcacgtaaaataacgtaggggcaaaatcgggctccattctgagcccctcttcagcggagcattccactatctgggcaagcttgagcttcacatagacctcatcgcccggctgctcacccagcaacaggcgcaaatccggacgtgcgctacggatctggcaacgagcatcc

SEQ ID NO: 512597 - DNA, 151 bp, Homo sapiens
ctagaggatccgcctcgtgccgtgtaaggttgcaataaatattagttgctgtgatcggaatgaataatcatgaagtgtctcatgtgtagttgcatatctatcgtacttagatccatatagcgcttggacgacccataacccactggatccc

SEQ ID NO: 512598 - DNA, 599 bp, Homo sapiens
ataatatcacgcattgtacgtagtgattatcatagccacaagtaggctgcaactacttatcattacgtgctttagatctagcacagtcatgtgtgctacagatactagagtgagctagtagctgtgaagagatagatggtatggcgaggtcagtcgtcctagatcagatgtgacgcagagcttattagccatgaagaatcctacagtcatagtactcaagtgtaactttacagtatttaaaaagacaaagtattttgtgcgtgcagattatgcactccatgaaaagttcctctggactctggggccaaaagctgttgattctcataagttgaccgatgtcaatatatcgagctgttcccgagttagtcaagtatgtatcacccctagcatgatataaaaaggcacacagcagttgaatgaaaaagtgagcataatccactttgtaataagttatagtcctaagggcatttgtaccgtcctcccattttgtgtctcggaagagttaatgtgacctgtgtaagtcggcctagataggtagctttaacctatgtcaaaatgtctgcagcagtttgtcactgaagattagtccttttttaatc

SEQ ID NO: 512599 - DNA, 1342 bp, Homo sapiens
cggacgcgtgggtcgacccacgcgtccggttgactccaggtgctctccatgtcttctcacaagactatcaggattaagcgactgcctgtccaagcatatacaaaagcaagatcgtaccattccccagtgtaattcggcgttatggctggaaataatatcatggtacacagctccacagaagggagaacaattggtagggaaaaaccagaggactggcgtctataagggagattgcaacagtgagatggcaccagcagtagtatactgctgtctgcagatggctcacgatacactgtttaccaatagtcgagaagcctgacaaatgtcgaccacgtatcgtggcagggattacggacagatggttttctcctcatctgataatcgtggtctttgaaccaccgcttgcgtatggctcgagcaggttcaggactacagtagaacctaggtggtagacggtccatttctcctgtttatagacagcaagaaaaagcatggacacacataaaccacaccaaagatagaaagaacaccacaccatagcacagaagaggcagagcggccggtcagtccgtgcacgcgtaagggaagctctcaccacgcaaagggaagagagtcgccaaagggccgtactctgagtgtggacgcgcacacgtaatcctccctaagtgcgtcaacaagtggagcgagtgccacacacgaagtgggcgaggatgctcaacggatagtacgattagcacacacgtgaagtacatggtgttcaccgttgcgaccgcgcgttcaccttatgaacacacacgtgttcccaagtccctatatagattgagcggcgaacacacctgtgggcgttgtatacggcgatgtgttgcagtgaaactgtcctttgtggtaaagacaaggcacaagagtggacccatattatggccattcacggagatggaagggccagacgtacaatgcgaaatgtgttcaaagatgatcgcacaatgagtaaataacactataagagttattagcagagtactattgatgtgtcaatgagggagcgacaattaagtgtgggtgtgcgattgataagcattagtcataatacaagagatatatttatatcacgcagtagagtgtgtggatataggtgattggttgggtaataaaatataccatctgtggataaaattatgggaacgatggaagtggggatgcgtgtgtagtagaagtaaatatggggaattagtttgcacatcatccagaggcgtgtgaatatgtgagattaaattagatacagtaaagaaagaataaaaactatgtacagaagagggagagaatatggaatatatgataaata

SEQ ID NO: 512600 - DNA, 159 bp, Homo sapiens
tagagagtgtaacataagatcagtggttgacagggatgagaggaataataggggtgactgcttaatgaatgcaagatttatattgggggtgatggcaatgattctggaactagtgtagatggtaactgcctgcacaaccattatagaagtttcttgttg

SEQ ID NO: 512601 - DNA, 341 bp, Homo sapiens
  misc_feature (1)..(1): n is a, c, g, or t
ncagtgcagtaagtcgagctcacgttcctagaccatttcattatataagttgagcaactcatacatacagcgggaatgatgacttatatgggcgtgtcaagacagcattcatccgcatttctgtggccaaatgcgttctaacattcgataagcgagtactcagtggaatgtttggcaaatgtctcgtgactatgggaagctcgtccccatctgcatgctaataggatctcattctactcgtgtcacattaatactcccatttaacaggtacggaaagcaaggcacagaggtcacttaccgttgcggtcaccaaatctaggcagagcaaggctcgaagcaag

SEQ ID NO: 512602 - DNA, 749 bp, Homo sapiens
gggttcccttgcaagagtaaaattaaaatcactctttcgtctgggtgcggtggctcatgcctgtaatcccagcacttcgggaggccgaggttgggggatcatctgaggtcaggagttagagaccagcctggcacaacatggtgagaccccatctctactaaaaatacaaaaaaattacgctgggcatggtggcgagtgcctgtagtcccagctactcaggaggctgaggcaagagaatcgcttgaacccaagaggcggagactgcagtgagccaagatcatgccattgcactccagcctgggcgacagagtgagaccctgtttcataaataaataaaatcactcttttacttcatatatttctgagacaggatctagtggtacgcaggctggagtgcagtggtgtgtgatcacagatcatagtacgccatcgagctcaacactgggaatcaggcagtcattccatgactcagacatcctgagtagctaggactacagagtgtaaggccaccaatgcacatgggacctataactcaataacaaatagagacatgtacagggtacgtcacgcgtataatcccaaggggttaacacgttaaccaaacaatatgcagaagtaaccatgagtaatgtcaaacatgacaagatcaagagacattggagcttcacgactatcgtgacgggagtcataggggtcaatgccatataacaccaaagaacgttggagacggccaaggaaaggcagatccc

SEQ ID NO: 512603 - DNA, 369 bp, Homo sapiens
aaaaattcctgtttgggatttaaaatccagggctgtgtttccagtaaaaaaagcaggcagtcccttttagtttttcctttttaaatttttttgagatttttcatttcaggatttaaaactaaaccagtccattttaaggaaagtgtaactcccatggccccaagtttgctagttgcacttgaatgctctatcagggttgtttattaccctttttacgttttggaccccttgccgagactgtttaacttgaaaattaaaaaaactattgcaaatgccagggcatcaaaacctaaaagtggtcaaaaattatgggcaatttttttgtaaaaaaattttaatttaaaataaagtttaccagtttaaaaacca

SEQ ID NO: 512604 - DNA, 2557 bp, Homo sapiens
  misc_feature (422)..(422): n is a, c, g, or t
aatttgtagtcagagttgaagaccactgctctaaattagtgcaggaaaatgcttttatttctcccatgttaacttttaaaactagtaatgtacccagttaagttttgatggtttaaattccactaaagaacatattcttctaataactagcatttattacatgaaatttaagagtttaagttccatcaaactagcccttgtgtaagattattatttcttctctataacttcaaaatagatatttcattcaaactgttcaggtgagaaaacataatggatttttttttttttcctctggagctgcctgttcagggcacgatggaggaggtgggcacatttaaggtcagttcattaacctatggtccagagttctgatcatatggaagttgggaaaagagagcttatcacaggttggtatgctngtgaatggatagttttaattctcactgtctcaaaagagaatcagctctccagcagttctagaaaagctttgacaatccccaaggggcagtgttaccttactccttcactgcttcttagaaggtagaattaagtttctggaattgcacctacatgttttcttattaacattcagaattgggaatattaatttttccagtgagtagttttctgaaattggtaacttggagagtaaaataacgtattttgcttttcaattttgtgtttgtttacttttatgtaaaaatttgatatgtgaattacacagttctaataaaacctcatgccttttcattacatctaatttgaactctcaacttcatgttacagaatgctttaaagatgctttaatgaaaagtattaagaaaatatatagatttgtatgtcagtttatacttcagaaatccatatatttgtcatatttatttttttagaaacctcctaattggataactagatggtatttaaaatgaatgcccaaaaatatcttgtacctttgtccaaaagtttatctgttggaagccgccagccattcatgtagagagtttataagaaaataatttaaaattgtatgcattttatattactatggtatctgtgtaccatatttctaagtattcattattaaattggtacttcttaaaaccataacctggcttgccttttagtgttaaaaaaaatacaacattgtatatagagatttcttcttttatgaagaagagctgacgtaatttattagcagtgatctgagaaagacattaaataagtttctgagagtgatacattttcaaacatgaagagtgacaaccaccaaattaagaaaaggaaacaactcagacttggaattttatacgaatttcatttctatatgtgcctggtattgcctctggcataacttagaggaaattgttctacctatatgtcctcagtttcttcatctacaagttgggaaaaacattttcctcttaaaattgtgaagaggatttatatatttatatgatatattgtatatattaatatatttaaattgcttagagtttctagcacatagcaaataataaatattagttattagtataaacataaggcttaaagtcttggatttgatgcatatgacttaatttgtatttgtgctagtagctgtaatgtcagtgacaggataacaagcaaatgattagaaatctaatagtaatgcttgttcctttgctatctatgctaacaagtacatagatagcctaagataaattatacttaggatgaagctaaaatgcataactgagacaccttaaaattgtactaccttgtgctgttcactgccatcagggaggtagcataaaatgaaagataaagtctgaagactggatccaggcaaattcatgttctttctttgtaactcactttcttcgtcaacatttctgtgactcaatggatagcatatttccatcaagtagcacgtataacgtgatgctttcatgtttctgccttaaataaaataaccctcaaaaaaccaaaaaaaaaaaaaaaaaaaaactcgaggaaaagcaccgaaacccaattcaccctatactgaagggggtgccaattccctgagttgccctataccgcgtcgtgtttcaataacctgtcgccgttttacagtgactcgactggcaaaaccttgccgttacccaacttgacgtaattgcaataaatccccttttggccaactctcctaatagcaaataggccctgaccgataaggccttcaagcaatcgcctatcctgaatgtgcattgccaaattggcagctgtaatactgcgtacaaattcacccataaagcttgatcaataaaatcccttataaaccataggtcttaatcgagataagcccttatgaataacacgattgacccgatagcgatatccgagatcccgatttgaactgaaaccctaaaaacgaccttgattcaaaggccaaggcaaaaccctattctaagaaatgctctcttcgggaacctaccctcataaatttttccgttaaagggcccccaattcataaactgaacctataaggggccacctattaggactccccggttaaaacctaaggcggtgaccc

SEQ ID NO: 512605 - DNA, 1339 bp, Homo sapiens
  misc_feature (422)..(422): n is a, c, g, or t
aatttgtagtcagagttgaagaccactgctctaaattagtgcaggaaaatgcttttatttctcccatgttaacttttaaaactagtaatgtacccagttaagttttgatggtttaaattccactaaagaacatattcttctaataactagcatttattacatgaaatttaagagtttaagttccatcaaactagcccttgtgtaagattattatttcttctctataacttcaaaatagatatttcattcaaactgttcaggtgagaaaacataatggatttttttttttttcctctggagctgcctgttcagggcacgatggaggaggtgggcacatttaaggtcagttcattaacctatggtccagagttctgatcatatggaagttgggaaaagagagcttatcacaggttggtatgctngtgaatggatagttttaattctcactgtctcaaaagagaatcagctctccagcagttctagaaaagctttgacaatccccaaggggcagtgttaccttactccttcactgcttcttagaaggtagaattaagtttctggaattgcacctacatgttttcttattaacattcagaattgggaatattaatttttccagtgagtagttttctgaaattggtaacttggagagtaaaataacgtattttgcttttcaattttgtgtttgtttacttttatgtaaaaatttgatatgtgaattacacagttctaataaaacctcatgccttttcattacatctaatttgaactctcaacttcatgttacagaatgctttaaagatgctttaatgaaaagtattaagaaaatatatagatttgtatgtcagtttatacttcagaaatccatatatttgtcatatttatttttttagaaacctcctaattggataactagatggtatttaaaatgaatgcccaaaaatatcttgtacctttgtccaaaagtttatctgttggaagccgccagccattcatgtagagagtttataagaaaataatttaaaattgtatgcattttatattactatggtatctgtgtaccatatttctaagtattcattattaaattggtacttcttaaaaccattaaaaaaaaaaaaaaaaaaaaaagaaacaaaaaaagggggggggtaaaaacaccggggggcacagtctacgctccccgttttggcaagggggcccaaggggcggataaaacgaggcggcgcgggaaagcgggcggacatccccgggctgtgcggcccctcgggcggcgatggaccccacagaaacccgagaacaagttgggaccgcatcctgcgagttgtaaccacccggt

SEQ ID NO: 512606 - DNA, 1021 bp, Homo sapiens
  misc_feature (422)..(422): n is a, c, g, or t
aatttgtagtcagagttgaagaccactgctctaaattagtgcaggaaaatgcttttatttctcccatgttaacttttaaaactagtaatgtacccagttaagttttgatggtttaaattccactaaagaacatattcttctaataactagcatttattacatgaaatttaagagtttaagttccatcaaactagcccttgtgtaagattattatttcttctctataacttcaaaatagatatttcattcaaactgttcaggtgagaaaacataatggatttttttttttttcctctggagctgcctgttcagggcacgatggaggaggtgggcacatttaaggtcagttcattaacctatggtccagagttctgatcatatggaagttgggaaaagagagcttatcacaggttggtatgctngtgaatggatagttttaattctcactgtctcaaaagagaatcagctctccagcagttctagaaaagctttgacaatccccaaggggcagtgttaccttactccttcactgcttcttagaaggtagaattaagtttctggaattgcacctacatgttttcttattaacattcagaattgggaatattaatttttccagtgagtagttttctgaaattggtaacttggagagtaaaataacgtattttgcttttcaattttgtgtttgtttacttttatgtaaaaatttgatatgtgaattacacagttctaataaaacctcatgccttttcattacatctaatttgaactctcaacttcatgttacagaatgctttaaagatgctttaatgaaaagtattaagaaaatatatagatttgtatgtcagtttatacttcagaaatccatatatttgtcatatttatttttttagaaacctcctaattggataactagatggtatttaaaatgaatgcccaaaaatatcttataaactctctacatgaatggctggcggcttccaacagataaacttttggacaaaggtacaagatatttttg

SEQ ID NO: 512607 - DNA, 177 bp, Homo sapiens
ggcaggctctctagctgtgtaacagcacagctgtcacaaggcgataatgagtaaatcataaaaggggttggtttcttcccacattattctataaatgggacaccggatgggtacgtgaagcaagggttttggctgtccaacttcgagaggctggtgggtggcgggggtctacgttct

SEQ ID NO: 512608 - DNA, 548 bp, Homo sapiens
agaaattagacttaactctgatactacagctgtgcacctagcagagcagttgcgctaacacccagtaaatataggtggggagacaattaccatccactgaatgtttcactacataaactattcttattaatgtcattactttaagcagagtagcaaatagactacataatatacgtgggcaaaaaggcaattacgtgaatctcttgaaacactaaatgtataataaacagcatattatcaacatttacatgattcacatcaaaatgataacatcctaaaaagtattccttttaaagagatagatttataaataaaatattacatatcttttaatactctggtacaatacttcatatactgcaggaaaattaattgtaggtctagtcatcagcttaatcagggatccttttcccattagcttttattaataaaagaatcacaattaggtcataaataaacaggcaaattattaattacatgatttgaggcttcggatgacaacttgtcaaaattagttagatatacagcaaagttatacaacacactaa

SEQ ID NO: 512609 - DNA, 189 bp, Homo sapiens
gatcccccagccaatatgcgtccatctctgcagcgtcgagctggctctcgctctgatgtgacacaccatgctgtcaccgcacagctaccacaggtccctgctggagcagggagccgacctattggggagcaggtagtatcttctctacactattttttctcttttcacagcaaagcaccaagtaaaata

SEQ ID NO: 512610 - DNA, 159 bp, Homo sapiens
ggtgacttaaggatcgtaaagaggcatgagcgtttgtgttgctgtgattgtttaacggaggaatgggctgggacatgtgtagattgcacgatttacacacacacacacacacacacacacacacacacacacacacacagagacatatacacacacact

SEQ ID NO: 512611 - DNA, 1105 bp, Homo sapiens
gtgctttgaagatctcctttgaggatgtgcagtcttttttatttatattatttatttttgaaatggagttgtgttgcccaggctggagttgagtggcacagtctcggctcacatgaaacctccacctccgtgggttcaagcagtattcctcggtgccgacagccctcccaagtatagcgtggaacatacgggcatgtgcgccaccagcgccaggcataagtttgtgggtattttaagataaagaagtggggtttacaccagtgtctcaaacttccgtaaccctcgaggcagattccacccaccttcagagcgttcccaagagtgtggcgtgggaaattaatagtggcgtgtgaagtccagcgcgacacgcgtgggcgcatatatgagtgtgggctcctttatacattatagggaaaacccaaactcataaagggggacaaggggaagaagttgtgaccgtgtcaaatttgtgggcccccacacgaggaaatgtgtgtgacacgctgtgtggtcaaaggttgcccttctcagtgaagagtgtcttgtggccacacacttgtggtagaaacgcgcccccccagagggttcacacagtgggagcggagtgctcaatgtggccggaagtttggccaaacagaggggccatttctccgggggaggacaacgcatgtgccccatggggggcggtttattgtggtgcccacaagaagaaccacgcctgtggcgctaatcccccgcagtatccgcgcgggacggcggggaggcacaaaaaacgcgcctcaaatatagagtccccgccccaattttacacctatgggtatcaactaccccgaccttttgtggcgatcttatccacaggggggatgaggtaggcgacatgttgaacgattggctatctcctgtggaagaacaacgcgtcttgtaagagaaccgtcgtggggtggaaaacaaggacagaaccagatggtttggtaagtttcccacccactagtgtggagaatttatatgtgggaggggtgtgaggccaatttaacaaatgctcgatggaacacgctgtattgtcggaatatactcccccaagaggtgaatagaggtcccccccccc

SEQ ID NO: 512612 - DNA, 151 bp, Homo sapiens
  misc_feature (43)..(43): n is a, c, g, or t
  misc_feature (124)..(124): n is a, c, g, or t
aatcgagagaaaaaatgatgacactgtagcaatatcgtcggantccacctactttgggatcagcctatccatccgtgtcttcctatttaaatcgtctatcctctatccttcccctgtctttttntgaaaaggaaaaaaaccaggaaggtgt

SEQ ID NO: 512613 - DNA, 103 bp, Homo sapiens
gccggtccaacggcctttgcacaccaaggaagatctagaagctgtcaggaggagctgcggcgggcgttgatgaaccagttacagacctgaaatcatatcggta

SEQ ID NO: 512614 - DNA, 256 bp, Homo sapiens
cacttagctatgtaagaggtgactgcggatttggcgaaaatcgccctgcacgtatacctacatgtggctcctgaagatgggccagagttgctgcaatctcaggataacacatgaaccgatgaggagtggcttctgagggatgagcaaagaaagtggcttattgagctggaatctactcttggtaaagatgctgtgaacattgtggaaatgacaataaaggatttagaactagtccataataaatttagggttgatg

SEQ ID NO: 512615 - DNA, 180 bp, Homo sapiens
  misc_feature (175)..(175): n is a, c, g, or t
  misc_feature (177)..(177): n is a, c, g, or t
  misc_feature (179)..(179): n is a, c, g, or t
tccggggggaaatggtgggaacacttgaacttggggagtatcctgcttggcaagccgttacggcagttggcccaggccccctacctaacaattcgaccctcccttcccaagaatctgtccccaccatggttcccagtccctccaaaattcccttcctaaacccctcccggaatanananc

SEQ ID NO: 512616 - DNA, 112 bp, Homo sapiens
ggggataatgctgctcctgatgacagcatcttacaaatgctacctgtctccatggcgttgctagatccacggaggtatgaaactgctctctcagcatactccccatggaagc

SEQ ID NO: 512617 - DNA, 202 bp, Homo sapiens
tgctagccgactctagaggtatccccacccagctccctgcccccggtttccatacactcatatcaccctgtagtctagtcctcctcccacatacacttcactatactatctttcacttatataaatcctttaatgtgagccagtgtgcaggtggactcacagtcatcttagggaagagccaaaggctggtgttgtgaatcac

SEQ ID NO: 512618 - DNA, 392 bp, Homo sapiens
ttgggggtttttttggggcaaaattttttttaaaaaaaattttcccggcccttttggtggccccccccccaattttttacctttggttggaaatggtgggggcctttggggtgggggttttttttttttttttccccctttttttgcccttttttttttttttccccgccttttttcggggtttttgtttgggctttttaaaaccccttttttaaaaaattctttttggggggggggttttcccccccccggtttggggaggttaatttttttttttgtttttccaaaaaataaggttttgggagggttcccccccttttttttggcccggaaaccatttttttttttggcccaaaaaaaaattaaattaaatttactttttttgcccggga

SEQ ID NO: 512619 - DNA, 460 bp, Homo sapiens
  misc_feature (165)..(165): n is a, c, g, or t
gggaggagggaactcagatgccaggtgcctgactcccaagacgccctgctgaacggacttggagtctaccagctcccacatctccaaacaggcctgtgttcttgtcggaggagaccccctactcatacaccaatctgtgaaagccacagcagtaccatgtgagantttgcctgtgctcgaccctcaccggtgcggcgccactagaccatgcagtagaatcgcgacgtgtccctcgcgtgggcgacgaaatcgtgtggagcggcgttagagcgcaggatgggacagagctcgagggcgaggagtccgcgaaaatgagagtgcgagcgcaggagagagcgatcgagagagcgtccaagtacacgccgtgtgtgttaacgggcgttccgagctgcgccaacaaccttcgcgagattgtactcccaaagaccctcaagggaacatgtggtctgggattctaccg

SEQ ID NO: 512620 - DNA, 111 bp, Homo sapiens
ttgactattctctacaaaccacaaagacaatggaacactatacccattattcggcgcatgagctggagtcctagggcacagctctaaggcttcttattcgagccgagctgg

SEQ ID NO: 512621 - DNA, 567 bp, Homo sapiens
  misc_feature (1)..(1): n is a, c, g, or t
  misc_feature (150)..(150): n is a, c, g, or t
  misc_feature (152)..(152): n is a, c, g, or t
  misc_feature (154)..(154): n is a, c, g, or t
  misc_feature (161)..(161): n is a, c, g, or t
  misc_feature (169)..(169): n is a, c, g, or t
  misc_feature (313)..(313): n is a, c, g, or t
  misc_feature (338)..(338): n is a, c, g, or t
  misc_feature (348)..(348): n is a, c, g, or t
  misc_feature (355)..(355): n is a, c, g, or t
  misc_feature (359)..(359): n is a, c, g, or t
  misc_feature (362)..(362): n is a, c, g, or t
  misc_feature (368)..(368): n is a, c, g, or t
  misc_feature (373)..(373): n is a, c, g, or t
  misc_feature (428)..(428): n is a, c, g, or t
  misc_feature (432)..(432): n is a, c, g, or t
  misc_feature (435)..(436): n is a, c, g, or t
  misc_feature (440)..(440): n is a, c, g, or t
  misc_feature (444)..(444): n is a, c, g, or t
  misc_feature (446)..(447): n is a, c, g, or t
  misc_feature (455)..(455): n is a, c, g, or t
  misc_feature (463)..(463): n is a, c, g, or t
  misc_feature (466)..(467): n is a, c, g, or t
  misc_feature (478)..(478): n is a, c, g, or t
  misc_feature (491)..(491): n is a, c, g, or t
  misc_feature (536)..(536): n is a, c, g, or t
  misc_feature (543)..(543): n is a, c, g, or t
natggcatttcataatcacccatcttgattgacatgggctgacacacatggcgctgtcaggatacacaaggacaatagccaaagagttacaaaaaataaatccatgattcttaaacaattgcaaccaaaaaaaaaaaaaaagttacaagnancnaaacttncagatgcnttgcattgaaaagaaggtttgtgcacgtcataatttaaagaggcaaaaccaaggagctactgaaacctcacgttaaacagtttattataaagctgatggaaaggagcaagttgtctctctgtatcagcttcccttaacagtttnccattaattgaagaaagaggggggnggggggaatncattttngcangcncaagangtacngcttaacgaaacactatcagcttgttttaaagggatcttttaaataccaacgggngccnggnnggcnaatncnncccaaccncccccatnacnnccgccgagatnccccatagaccancaggcacagcaaaaggccccaccagaacacactcccccacacaanccaaaangggggccccggggggcccaaagca

SEQ ID NO: 512622 - DNA, 349 bp, Homo sapiens
  misc_feature (114)..(114): n is a, c, g, or t
actctacagatctatgtggtctgtgctggacactggatatgcagaactgtagggaagagaccgtccgtgtcgctaaaggttgagtgtagagggtgacggagaggcatccgaggnggtgtgggtgtggaagctgctctgtctggcgcggtggtggcggacacctgaccgtgcctctctcagagtccgctggacggcaccagcatggagctaagggaggaggaatgcagacagcggcccatgaaccgcagaaccacactgtggctgtgaagaaaggagctcttttcagtggccttgggaaaggcgtttgactgtggttcactgtaaggctgaagacaagaaccacacgaca

SEQ ID NO: 512623 - DNA, 105 bp, Homo sapiens
ttctcctacgataaggactaaacggaacaaagcgaatgcttcgcaaatcatgaaaataattaatattattagctgtctagagaaagtgaatgagccaacagatcg

SEQ ID NO: 512624 - DNA, 126 bp, Homo sapiens
  misc_feature (3)..(3): n is a, c, g, or t
tantggcttcgggaagaggctgcaacaggtcttgcagaacgtgtactgtgtctgcgggggcgagccccagccagccagctgcctgtcacgtctgttgggcaaactgcccgagctgcggaccctgtg

SEQ ID NO: 512625 - DNA, 151 bp, Homo sapiens
tccagggcaaatttgttaaatttttaaaaataacggagtgggcaaaataaaattatttaactctccacatctcactacgtggtgtgtacacactgtgtatagaggctcctctgtgttcacaaagaaaatatacagtgcaaaattagtgtgg

SEQ ID NO: 512626 - DNA, 1378 bp, Homo sapiens
  misc_feature (616)..(616): n is a, c, g, or t
cgggctcccggaggactgcaggcaggatgacgcaagaacacggtgatagtgaatggagtagctatggcctctaggccatcccagcccacccacgacaacataccacaaccaccaggttacagcgatatgagctgcaacgaacgataacacaaataagtacgtacggataagaacgaaacaggtgcaccctgaggagattggctagagccaaccgactaggccaggagttggttagatgagcagtctggctctagtgggtgacctcagatattgctgggggttgtgagtttggagtatcaaaaaagaagaagacacagtccagaggagatcccctagagacaagatcgaatcagaagcctgcgggactaatagctgagtctaaaagctgaaaaagtccaggaggtgaactgcagcgtggcagtgggggcatttagcgcttagtttggcattagtagacagatcgggcctggataagccaaaaacttaaagccggaggaccgatggaataagacgctatgttctttattttggactcgcggagaattgagagcgagattattcgaaacgaggggctatggaagatcggaacggaaagatgaatctccagcgaattcgntgattgatagaaccgatgcccattcgagaaaccattaagctaaagaaatgccgcgggaagatggagggaagctttgcgagaaggcatcgattggattgaaggaataaatctggcggacaaaggaggctctccttgtaagcgatcggcgcgaaatcggcgctaaaaagataaatcgtatgaggaagaaacgaatgggttgcagaaagagcggtatccaaagaaacattatgcggcaaatgattgagaggcaagtgacgattgaggtcgggttagtggtaaagttaacgtataagaagcgttggcacacgctaaggatgtggcgcgatagagagaagctgaggggagtgtagttccacgttaagacaggaagagcccagccgaattcgaagaagtaagcgcgagagtttccgcgccagagaagaagttctccgtggagactcggagaaaagtgggagttttagaggttccggaagaactaccacacgtagcggaccacggagagtttcttggggagcccccgagtagagatggtttttgtcccgtaggaagggggggcaagtgggaagtttggttgcggagtgctccgggcagagttgggcgttaggagatcgtttgggtaagggcccctcggggaaagttcttgtccccgccgagtggtgtcctcctctgaaggagagctttgggcgatgcgtggggctgcggggcggcggtgtgttttgaatgcggggggggcggtaaaccaggagttgttgttgggagaga

SEQ ID NO: 512627 - DNA, 1182 bp, Homo sapiens
  misc_feature (250)..(250): n is a, c, g, or t
  misc_feature (507)..(507): n is a, c, g, or t
gcccaaatctgtttattatctcagtgaaagaagtaagtgactgctatggaactttgccactcgttctgcgtcatgtggatcatctagtcttgcaggtcggtctcgtggaagagttcgctggcgacagaggtgagcgacatgtagagagtcccgtagaaggcaagggcgaggtgggacgggcttccgctaagcgtcccactgctcagggtccgtagcgccacagtttattgcttgcttactacaggctagngtatcggtgacttgctagggacataagttcctacggaagcatagtgccggtgttgattaccacgtgcaatcgcagccgccgacattagactcatcagtgcagttgagatggtagattaacccatcgcaggctgcctcccggagtagataagaggccagtctacagccgtcttgatgacatgtgtcataccctgtgatggctaatcctctcttcatgggtaatgtgagatctggctctgcacatgacgtcactgcaanacaggttcctagaagcaaggtgtcacgggtccgtcttgccctttatagagggctacttagctgccctgagctggatgcagaagacgtaggagaactatgggacggatagcgagctgtgaatgggttcgaagcactgagccaaggaaggcatgaattgagcgtgtagcgtcagccagcatccgatggcagagatcagtagagcttcaagatgtgcttcatcttcaactacctagtctaacaccagtcttcctgcagacagatccgaggagcaggtctcgatggtcacttgccccttttaagagggctctcagctgctcgagtgcgattaggatcaacgtgtacagattgatataagactaagaaaacaatcttagacacctaaatacaaattcaactagactaactagtggcccaaccatagcctaccataacggaaccgcggacacaaccgcacgaaaagaacattcacaaaaatagaaaatatgggccgaacactacaaaacactatatgtgcacctaagcaacgaccgagaagaatcactccaacaacacaaaactgcagaaaacataaagacaaagaggaaacacaaacgacaccaacccaagagaacactataacccacgagatacgccaaacgcaccacacaaagagaacaaaccacagagcagaaagtc

SEQ ID NO: 512628 - DNA, 397 bp, Homo sapiens
  misc_feature (18)..(18): n is a, c, g, or t
  misc_feature (123)..(123): n is a, c, g, or t
  misc_feature (180)..(180): n is a, c, g, or t
  misc_feature (195)..(195): n is a, c, g, or t
  misc_feature (205)..(205): n is a, c, g, or t
  misc_feature (286)..(286): n is a, c, g, or t
  misc_feature (312)..(312): n is a, c, g, or t
  misc_feature (320)..(320): n is a, c, g, or t
tgtttaccggatgccacnctaagacttccagccactttctggtggcaacagaaaaaacggcaaataaaaaggacacaaaaccaaaccaaaccaaaaccatcatgtggaaatgccacagccctngaggcacattctgggtgcctggacttgtgtaggtattggctccaaaaagaatcccangagcttatacatttngaaataacanaaaataatgcaacacaaaaagtgatcccagcaatttttagctaaacctaattttccgtgaatttttaggaaacaattcctngttaactctaaatataggtgtttcancagaacanaaacaacgagttctctcatcaaaaggttggcaaagtgttaaaaacctcgtgttacacaatagggttttctttggaca

SEQ ID NO: 512629 - DNA, 174 bp, Homo sapiens
  misc_feature (24)..(24): n is a, c, g, or t
agtgctgctttagtgatctaaggntccccgcgctagcggcttaatgacggggccatcagacccgaggccgagtcgcccgggagtgctggtcgacagcgcgggccctcggaacaaggcccgatgcgcccaggagagctggttgacaccgcgggcgttcacttaatgccgctagcg

SEQ ID NO: 512630 - DNA, 521 bp, Homo sapiens
  misc_feature (382)..(382): n is a, c, g, or t
  misc_feature (410)..(410): n is a, c, g, or t
  misc_feature (454)..(454): n is a, c, g, or t
  misc_feature (468)..(468): n is a, c, g, or t
  misc_feature (488)..(488): n is a, c, g, or t
ggtatcaagtgctaagaatagcaccacttggaaatatgacaggactgcagccagtgtggataattatcattttcaactacagatctctctcagccttgtctgcttatcacactggcttgatcgcgcccatgaagatccgcacagaggcccctgggaaccttcgtttatacagtgggagccccactcgcagcgagaaagagcaggtctccatcagctccttctactacaaggagcgggtaagtgccagagccgcagcctttgattcttaccccttctcctgggattcttgttcctcatctcctgcctgggcgcagagctaggattagtaatcaccctgttagcctttcactttcgtaatcagtttgttcaagaaagtcattantttgttcctttcagttggttttacccgntattaaatgtgtgtgtatggggtcgggggggcatttttatgggnccctaaatttttantccccattttaggccttgtncccaattaaaattaagttgtaatcattttaaaa

SEQ ID NO: 512631 - DNA, 655 bp, Homo sapiens
  misc_feature (516)..(516): n is a, c, g, or t
  misc_feature (544)..(544): n is a, c, g, or t
  misc_feature (588)..(588): n is a, c, g, or t
  misc_feature (602)..(602): n is a, c, g, or t
  misc_feature (622)..(622): n is a, c, g, or t
aagacagcgcttcagctaccgtttgcactccccaactctgtcactccccccttaccgacgtttgcgcgggctacgcggcttacgggtcgtaccagacgccaacattccctttcctaggacttctggggccaggttctgcggagcaagttacctggtgtatttcacaaggcccatgacaatgcatcgggcggtgtctcccacagagcctactccgagatctctctcagccttgtctgcttatcacactggcttgatcgcgcccatgaagatccgcacagaggcccctgggaaccttcgtttatacagtgggagccccactcgcagcgagaaagagcaggtctccatcagctccttctactacaaggagcgggtaagtgccagagccgcagcctttgattcttaccccttctcctgggattcttgttcctcatctcctgcctgggcgcagagctaggattagtaatcaccctgttagcctttcactttcgtaatcagtttgttcaagaaagtcattantttgttcctttcagttggttttacccgntattaaatgtgtgtgtatggggtcgggggggcatttttatgggnccctaaatttttantccccattttaggccttgtncccaattaaaattaagttgtaatcattttaaaa

SEQ ID NO: 512632 - DNA, 525 bp, Homo sapiens
ttcccaatataagacatgtctataactaagactgttactagaagaatgatatatgctagtatagacacttgtatagtagtcgagaaaaagatcatattgttctatattagaaattactaagctctgaaggtactacagctagatccttcttacagtaccggagacttcttctggagtctgtagctcttgacagtggtacttcactttaagaggttgccagggtaccagaccaagtgaatgcgacagagaattattacctgtgtggataattcatgaagtagaacagtataatcaaaatcaattgtatcatcattagttaaccactgcctcacactaagtgaggctgtgccaagtagtagtgtgaaacatgatgtaagtaatacccaaatcacgtaagagctaccaaggaaagccaactcccagatgagtctcagagagggatcaatatgtccatgattatcaggtatgctgactatatccaaggtgattacaagttgctccatatgcttgtaaagcaagtaatcc

SEQ ID NO: 512633 - DNA, 395 bp, Homo sapiens
ggaagctactcctgtagtctcagctacctgagaggcttacatgggaggattgcttgaacctgggacgtggaggttgccattagctgagattgtgccactgcttctaccctgggcaacacagtgagagtctgtctcttaaaaacaaacaaacaaacaaaaaaactagctggatgcggtggctcacacccgtaatcccagaactttgggaggccgaggtgggtgatcacctgaggtcaggagttcaagaccagcctgaccaaacatggagaagcccccgtctctactaaaaatacaaaacttagctgggcatggtggcgcatgcctttataatcccagctactcaggagactgaggcaagaagaatcgcttaaacccaggaggcagaggttgcagtg

SEQ ID NO: 512634 - DNA, 267 bp, Homo sapiens
  misc_feature (158)..(158): n is a, c, g, or t
  misc_feature (168)..(168): n is a, c, g, or t
tttttcgtaggcctctccaagtggaccaatcatcgaggagctgagatcgtggcagacacgttccgggacttcgctgtctcaacggtaccggtctcaggctcctcgcacctgcgcggcctctgtggcatggggggacctcgcaccgtggtggctggaanagcgaggctnccaaaaagcagtcagggcaatggcagcgctgactgatcacccctacgcctctctgaccctcccagatgatgcagctagtgactgtctctttcttgcgtc

SEQ ID NO: 512635 - DNA, 761 bp, Homo sapiens
tgggctctagaagggggtaaagggggtgctatagggtaaaaccgggcactattccaaaaattgttagggggacataattctaggacgatgggcttgaaactgtggttggccccacaagattccaaacctttgaccggtaatatacccccggtcgtgtcgcgggcagaaggtgggttgggtttagactgtcgcgggcattggcatctgttttctacgcctaattggggggacatgctcatgagtcgcgaagcaggtctggtgagtgtagtaatgtagtacgagttgggggctccattcgggagttccactcaagtggtcaccggcgcggagtcgcgtgtcggcccgggtccttagagaataatgggggggaattgtctggtacgagagtctgagactcactacgtttccccgccggaagtcccctggattgccccctaaggttcaagttacacattgcctggcgtggccacctgatcgtgatagagatgggtcaacgggaagcgagatcctgggagaccgctcacgatcgcgcggttcgtgacagggtacccctttacgagagttgaggaacagggtccattgtgcgacccacgtaggatgaccgcgagggacatgggcatagtcccgcaacgcggtttactactgtactggacccgtgccacaatcgccagggcactaacagcactatgggggcaaaaaagctggccaaggaaaaggggcactaccaagcattgagaacccgataagagaacctcgtacgg

SEQ ID NO: 512636 - DNA, 1109 bp, Homo sapiens
gagacgttcttcgccgagagtcgtcggaggataccatgctgcaacagtgctatggactggaacccggcgctcgtatccccagccccggccggccgcccatagccagacctccgatcacctcttcacgcgcacccgcggactgccccaaggcccccgccgccgcgtccagcgccagcgcacgcacacgacgccagcgcacgactctacctgagctcgccgggatgaccgacgcgtccaccgtcgcaggtgcgccaggaagataccagccaggacatcagaggccagccatcaacgcgccagatcaacctgggagacccctacgtccatcactacgctacaccggttcccatgtactcaagcgtactccccgaccggcgaccgatgtggtcctacggacagcaacctctgcacaacatagcttctctatcaccaatgtcaatgaggtgagaagggcacaccatgactgccgcacaacacgaactgccaccgggctagggcgacggaaaccccaaactccgcgagggcagccgcacacacaccacaccgcgacactaccaagcgcaatcgctcgccaggcaaacagaccaccggacccgggcaggacatgacacccgcgccgcaacgcagcgcgcacgccctagccaactggccgacaggcgcacgccggctcgccccgtccaagacacacctgcgcacacagaacaccaactgggctagagactcacagggtagcaacactaacccggggacacccctgggaccccacacaaccgcgggaccaaacaggcaacaccagtacacacgccctgaacccccgccgcaagccaccggccagcatcgacacccgagcgaagcccaggccgggaacacatcccaccctaccacgcccggacacaacctgcaagccaaccccgcgcagcgcaacgacgacgccactaccagccccgaaaaccagacggacgcatagaacaccaccacgcgacagaaccccagcaactccgaccggccaacacaactgcggcaaccgcgacacccgaaacgtcttgggactgggcgccgcgcgacacaccaccatcgagagtagggagacaatgccggccacccacccg

SEQ ID NO: 512637 - DNA, 153 bp, Homo sapiens
gcaatcatggcgccacctgtgagatacttgcatccccggcggaacgtcttgtgtaactttggaggaggggcaggccggggcagcggcacctacacccgccacggcgtacatcttttcgtcggttgccggctgtctgatgaggagcagcagaat

SEQ ID NO: 512638 - DNA, 443 bp, Homo sapiens
acttctctcctcttggttgtctattgtgtgtggtggctcaccacctgcagggcactaaccctgaatcagcaataggaaggagtctaagaactagtctttggtggccccacacttctggttcttggatgcacctctcccctttaataatacttttccctcttttcctcaagactctactaccttcctgcatttcctctgccaccatcaacatggtttgaggaccaggtcagaaacccttttgtattagggttgagttgccagaattaagttctgcctacgttgcatttatttgcatttcagtgaagatcaaaacataaaggtgaggctgagtgtggtggctcacacctgtaatcccagcactttgggaggccgaggcaggcagatcacttgaggacaggaatttgagaccagcctgggcaacatggcaaaatctcgtctctact

SEQ ID NO: 512639 - DNA, 134 bp, Homo sapiens
tttgagattgacaaggctccactcagacagaagacctcatctgtggccctgtgaaagttgctggtgcacctggcgctctgatgactgcccctgagtactacgaagtgagtgaggtgggaggaacaccaacctaa

SEQ ID NO: 512640 - DNA, 1175 bp, Homo sapiens
aactcggaagtatgagcctgaacgcatcctgctggaattctcatattcatctcggacagttgtcaacaccaccgtgagatggctcgagatagtgcctagatggccatacaggcatggagaatggcgatggatgtcactgagaagttattactggccaggttccactgttcagtagtatattagctcgtcatctatagtaaagatatccaatgtgtgtcgcctgtggtatacagaacctgcaacactgtgtggtatatgttgtacagcttatcaacagatgactacttatagcgttgaaacgactactgttgaattagtagaagacctctcgattcatactcttttccacagtcctgcaaggaagagctagcctgcaaagagtaaggtatcattgcttgttatgacttcagagattgtgatgtcagggacagtatacctggaccatgaatgttcttcaccgttgctggctgttttgcgtatgcgattgcaaaggaggatgacctactcggcattttcgttgcacgtacttgtgcgaacttgcagaaagcactgaacacattccagttgacctttaggtaattaaggcaccgtaacattattgttgggcgctcccatacaaaggtcattcgaggtcccaaaaggcgcagagtggaatgcgataagttaaggaacacagacgggcaacacattttaacataaaatttggaaaccagcttgtattgatgggccaagcgaattttagtaggaatcaccccattttccaaggtagttattggacaatccgaacgaagggataacaggagtccactccccgttaatgaaagagagaaagcgcgaagggttcgttacacaagaacgagaaagtttctgtgggcacaagacccgtttgtgatttcgaccacttcgcatttccacttcctcctcggagatcaacacacaatttgtgacaagccgatccagataaagattcccacggttcgcacaaaagaaacagggggacaaacacccatatgcttcctttactcatcagaggttggcaccccgctcgggtagttcggcagggacgagcaacgtcggcgtcatgggcacacgtagggtcggaaacccccagagataggatcgggactaatccttcaagcgttaggacaccttcttacgtctcataagcaacacta

SEQ ID NO: 512641 - DNA, 141 bp, Homo sapiens
gcaatgtgccagcccctcacattccacaggcccatggactcactattgtatcaaactcctaccaacactgaccaactaaaaaacactgtgggtgttcttggtattttttttttttatttttttttttggtatatttaattt

SEQ ID NO: 512642 - DNA, 1519 bp, Homo sapiens
  misc_feature (189)..(189): n is a, c, g, or t
  misc_feature (605)..(605): n is a, c, g, or t
  misc_feature (1519)..(1519): n is a, c, g, or t
gcagcaacgtgcagaagaagctcaccgcgcgcgcagcgagaaggttctccagaagctggggagaggcatatgaagaccaaggatgtgaggcagatgtgtgaggcatgtgcgatccatgaagtcttcaacctaatgtcagactgacgggagtggcagcgcgtgtctggcggacaggattctccgagatcntatcgcgtggccgtctcgctcagaaggccgatgcactgatgcgcttccagaggagagctgaagtgagctgtctgctaaggacgggtgtagtgacgtcgcctgatttggtccacggcggggagtgcaaggctaaactaagtattcgctatgatgaatcgagacgagcactgcgtgtgtgacctggaattcagctcgagcacaagaaggacttgtgtagtgcactcatgtgccgcctggactgaactcgattgggatctaccgttacgcttgtggcccgagatttcgcccgcaacgatcgagagttcgatcgtcaatttggcctagagcggtggagacggccaaggcgtggcctgggacgttacgtatcagttgtccgcgggtgaccgagatacgcagatccactttcacaagggtgntgcagagaagagcatggcactggaagaccgataaatgtgcctaatggtgcagaggaaggcagcgtcaattcacataggcgcgcagaaaggggtggttctggaggggaagagtcgaactgggtgcggacttcattggatcgtgctgggacggccttaggcgcgggcccattggtgttgggccattgcaggaaggtacgggcttggtgacagtcaattgaaggtatccaggacaagacttcagtgggagggcgtttggttgcgggaaacaccactttcccgagcccatgggggacaattggacgtggaaggttcgttgacttgcggggggagcccctttgatgtgagtagtcggctgtgggcctttgggccctggtttaacactgcggagcgaacgcgggatgggagaaccatcccttttggcagggggtccgatgggctcccattccccagcagtttcgaccaagaagggcgcacctttgcggcaaaaagggcgggaaccacacaacaacagtggtgccatttttagcccatcccaggatatgttggggtcaccccgcgtggtgtgagagcacaaccaaccgcacgccgagtgaatttttgggagcagcaggcaagacgcagaatggagggggccccaaagagaaaccgaggtggcggcggggagggcgccacaggcccccaggggggtgaccaccccagtacctaacgagaagagaggacacgcaactttctaaggacgcaccacgcgagaaatagacggccggcaacaaatacgacgactggtgaggaagaccaacaaaagaagacccggttcggaacgaagagagtcagacacagcaagacacacagtgactcacacgcggcaggcaggagaaccacaggtgtccgacgctaagtagaaggtatgaagcacn

SEQ ID NO: 512643 - DNA, 151 bp, Homo sapiens
caaagtggcgcaatgtgacaacatagtcaactaatgtggcattcactaatctcccaccaattcatgattgaatctaactctgaaaagttgtaaaatcatttcctagtcactattgccaatgacatagccctacctgaagatttcaacgtct

SEQ ID NO: 512644 - DNA, 718 bp, Homo sapiens
  misc_feature (40)..(40): n is a, c, g, or t
  misc_feature (70)..(70): n is a, c, g, or t
  misc_feature (99)..(99): n is a, c, g, or t
  misc_feature (112)..(112): n is a, c, g, or t
  misc_feature (141)..(141): n is a, c, g, or t
  misc_feature (163)..(163): n is a, c, g, or t
  misc_feature (182)..(182): n is a, c, g, or t
  misc_feature (184)..(184): n is a, c, g, or t
  misc_feature (188)..(188): n is a, c, g, or t
  misc_feature (198)..(198): n is a, c, g, or t
  misc_feature (223)..(223): n is a, c, g, or t
  misc_feature (234)..(234): n is a, c, g, or t
  misc_feature (252)..(252): n is a, c, g, or t
  misc_feature (270)..(270): n is a, c, g, or t
  misc_feature (273)..(273): n is a, c, g, or t
  misc_feature (298)..(298): n is a, c, g, or t
  misc_feature (300)..(300): n is a, c, g, or t
  misc_feature (347)..(347): n is a, c, g, or t
  misc_feature (359)..(359): n is a, c, g, or t
  misc_feature (377)..(377): n is a, c, g, or t
  misc_feature (379)..(379): n is a, c, g, or t
  misc_feature (381)..(381): n is a, c, g, or t
  misc_feature (386)..(386): n is a, c, g, or t
  misc_feature (392)..(392): n is a, c, g, or t
  misc_feature (394)..(394): n is a, c, g, or t
  misc_feature (396)..(396): n is a, c, g, or t
  misc_feature (420)..(420): n is a, c, g, or t
  misc_feature (434)..(434): n is a, c, g, or t
  misc_feature (451)..(451): n is a, c, g, or t
  misc_feature (469)..(470): n is a, c, g, or t
  misc_feature (472)..(472): n is a, c, g, or t
  misc_feature (480)..(480): n is a, c, g, or t
  misc_feature (487)..(487): n is a, c, g, or t
  misc_feature (510)..(510): n is a, c, g, or t
  misc_feature (514)..(514): n is a, c, g, or t
  misc_feature (518)..(518): n is a, c, g, or t
  misc_feature (547)..(547): n is a, c, g, or t
  misc_feature (555)..(555): n is a, c, g, or t
  misc_feature (557)..(557): n is a, c, g, or t
  misc_feature (571)..(571): n is a, c, g, or t
  misc_feature (652)..(652): n is a, c, g, or t
  misc_feature (682)..(682): n is a, c, g, or t
ctccccgccgccaggctccagtttccgccatgtgtatgantcgtagtccacctgccaatctggactcagnggaaaggcaagctcctggcctcggaaganccagactccaggnatggggctgcttttgttggttccaaaaangatgacagtggggggggggttnttcctcagtttgtccagtngntggnacattccggngatggggttgcggctcatgggggtntgggtgggttnttcggggggggggtagtntgggtgccaggggggggngcngtccttttcaaggtgctcccagagntntgggggtgcacggagagtgtgtgctcattggggtgcttgcgcttganttcttccaacanaaaggtactcttggcccngngnccccnggggtnantngccttgggctcagcagacagggtntgatcaaattcatnaatctcctcctcaggcnccggggaagacgcctttnncncctccttnggctcancctggggattatgatttttttcncgtnaacncttctctttccgtggtgtgtcctttttangttgggtntntgcaaactttttancatcaaactgggccatcttctcacacagtttcacttcccccaagacagcccggaactggggctggttaatgcaggtgaggnaccagcggttggtattgggaaaggcctggnggaaagaaggctctagaacctgcttatagagccaca

SEQ ID NO: 512645 - DNA, 221 bp, Homo sapiens
gctgttctgaggatcccctgtccgctcagtcatggtgatcacgacagctcactatcccggggatcacggcctggggcgtcggtctcttccccttcttgcctgtggctgcctccatcatcgagtgcctccttttccttctccatctgacacgccatccgcacggtcagcatctgaaaagctaccggaggaactagggtggttggggtttggatttggcatcg

SEQ ID NO: 512646 - DNA, 350 bp, Homo sapiens
  misc_feature (1)..(1): n is a, c, g, or t
  misc_feature (244)..(244): n is a, c, g, or t
naagttaagtcatctggtctgtcgacaggtgtctaacgtgtaaacttggaatcaaactgacttacatcctcttcagattgcaacagaggtttaaaggggggctccacctttcgagccaagagttcttcacagttaatgtgtctaaagaatgaatgagcttcagcagctttttaagcagatctctggcttcttgtgtaagatagggaggcaaattgagttccatttagattgtgcaatgtttctnaattctccacagtgaatgggggtgctacagtcagcatgtcatacattaatgctcacaaactccaacaatccacagcacgattgtggcctcttctcatcaagatttc

SEQ ID NO: 512647 - DNA, 814 bp, Homo sapiens
gatttagactgcattttcctggttcgggaaggttaaagcaaatgtatattgccttttctagtgaactaactcgtagagatgttctcagcaggaagacagtcttagcactgtcacttagcagattgcacttaagtcccttgtgctggccagatggcgtggcctggttgcctggggtatgtcccagtgacccctgttttttggctgccctggcctctccctcgtgctcctcaacgagcccagtccatacactgtggatgtcatctgctgtcgggttaaggaaagtcatttgtccctagaacgccctggcattggtatgacccacgagttcactgagctggactcatttctctgcttggggctcacttggtcaattctttccatgcaacctgactttgttgcttggcggaatgggcccgaggaattgggcgggccccaagccacattgtacctagagccctgccttgggggggcccttggcttgggtgacggtccttgatagtgggcacgccactgtggaaacaattgcacgccattgcgtcacattccttggttggaacccgaagtgtggccgatccctcattcttgtggggcaacgttcgtcatggacctattggcgctcattggattggcaccccattgggaaccccgtttgaatacccacattgggccacttattcatctcttttgccatttcataggccattaccccacttatggcgggggccataacccaccccattgtgggtgcccaccattacgcagtggcgatccgtatgtgggccaacaaaccttcccccttacaagggggaagacc

SEQ ID NO: 512648 - DNA, 123 bp, Homo sapiens
actgtgtctcaccgtgtgcgcctcacagtcacaccttcacagtcacaccttcacatgtcacaccgtcacatgtccacagcgtcacagtcacccctcacatttccacgccgtcaaagtccacgc

SEQ ID NO: 512649 - DNA, 170 bp, Homo sapiens
tagaggatcccccagttacaacagctcagtgtactagatatatgtatgacatatgtagccttagtagcgtttgtgtgtgtcagcacacctatgttgtgtgaacatgtgtgtaatacgtgtgtgtaggcatagcattgggtctgaatgtgtatgtctgttttaatgttcac

SEQ ID NO: 512650 - DNA, 179 bp, Homo sapiens
ccagccttattgcccaaaggttgatccaacttcgccacagcccaatcgcgttcaatatcctgctcagaacgcttattctcatccatccacacttgggtgacattggcggtgccgaacggtttggaatcgccattctgacctgggctgaacgtcatgtccgtgaacttatcactcaaaca

SEQ ID NO: 512651 - DNA, 101 bp, Homo sapiens
gtcaaggagacaactaattgagaaactgattattgatgagaagagtatactatttggagaaccctgattttgtgtgactttaccattgaccaccagtcttg

SEQ ID NO: 512652 - DNA, 82 bp, Homo sapiens
gacagcagcttctacatctgcagtgttttattggggggtgggtatggctacaccttcggttcggggaccaggttaaccgttg

SEQ ID NO: 512653 - DNA, 200 bp, Homo sapiens
catgcactgtcaacaggcctcattagcacactctctatagtaatctgtctgcagaaattcccctactttaacctcccttctcccaagactcctcatcttactgcaattgcctcttcttcttcttcttcttcctcctttttgtttttttttttatttcgcctgattacaaaattaacgtgtattaacaaaggtgcattggg

SEQ ID NO: 512654 - DNA, 485 bp, Homo sapiens
acatatgcttaatttttacaaagtggaagtataggagcattttacacattttcctatttctttgcatgttcttataaaaacatatcaaattctgggccaggtgtagagcgtcacgcctgtaatcccagcactttgggaggccgaggtggatggatcacgaggtcaggagatcgagaccatcctggctaacacggtgaaaccccgtctctactaaaaatacaaaataattagccggacgtggtggcgggtgcctgtagtcccagctactcaggaggctgaggcaggagaatggcgtgaacctggaaggcggagcttgcagtgagctgagatcacaccactgcactccggcctgggcgacagagtgagactccatctcaaaaacaacaacaacaacaacaacaaaaacccatcaaattcttttttgccattagcttctggagttatttactcacctattaactcctcccctccccctgccctccatc

SEQ ID NO: 512655 - DNA, 359 bp, Homo sapiens
caagtctgcaacttattctttcataaaactgtcagcgctctttggctatgcaacttattcttaatcggctcagaaatgctaataattagggaatctgggtgataagtgtgtgagaacgccgtaatatatgtattttgcaacttacaaataaatgtgagattatttcagaatttaaaaatatttttaaaaagaacattaacatttacttcaagaaactttctgccattgtcaaatcctaattcctcttactgattacagatcaaataacaaaacgaagcatattgaagaagagaacttgattgacgaagactttcaaaatctaaaacctgcggtcgaaaggctttaccaatcttggagca

SEQ ID NO: 512656 - DNA, 337 bp, Homo sapiens
  misc_feature (337)..(337): n is a, c, g, or t
tcatacgctcgactcttgagtataaaaccgcggcgagttcatgcacccggttggtgttcatgacaaagtgggttccaacctgcgttcctattgccctgacttggctcagggcgggagttctactagcagattccggaagtccccggaggtatctgagcgaaccatgtcagagagagacttctgatacttctcttggaactttgctttgatcccctgaaggtccacctcggccctggtcacgactatgcgaatcaacgtctcctcatcggtccccgcacccttcatcgacttgtacagacgttcagcaaaatagtcctcacaatcctgggcacatctn

SEQ ID NO: 512657 - DNA, 906 bp, Homo sapiens
cctttagatgtgcgcgtactctcttctcactacgagtgtctctgtggccgccagtacctgtggttgggagataccctctccgcgatattgtcttgtcgcatgctcttataaaaattttctggtgcgcgcgtgtccccgagaaaaatgccgcctgtgtttctctgtcccctctcccgccggggagttttatgtcaccggacgcccactcggtgttaggctttgtaacccgccgccaacggggtatccgattcaggcccgccttcgttccgtctagactccttaaccgtatactgctttctttctggactcctccataagggtgtctcttcatcccatattcccactttctgccgtatagcacccccttcgttcctaaactatttacgcgccgcatcgcctttcgacacgtcgaatgttcttctccgcgcctcaatagaataaattgattggtatacccacgccacacccgtcttatttgtcgcgttcgaattcgacgggcaataccacgaactcgactaacgtgaatcgcggtgcatccctcgcctcattattgcacatacccccccacaccagttgagcaaatctctttctttcatctccaattcccgcattataactctttttaaactacccctgagaatttaaatatatggatctctacagatctgatgaatactgaatattgaaaaatccgacataatagccctaagattttagagtaaaaccctcctcccccttcaccagtaggggaaaactagtggaactccccccccctatccaccccttatttcaaccatccccggtagacttatttgacaatttctgcccacataaagtaaaactgtacccccccctgctgcgttttctcccccccgccggcccccaacaatttttttaaacaaaaca

SEQ ID NO: 512658 - DNA, 134 bp, Homo sapiens
tcactttctacacgaaacaaatgtatttctaagtattcatgtgatgcacaaaaaaatccaaagcagaaatgataataaaccaagcttagatgaaactaactgaagaacttagaacctgaggtgtagaaattgaa

SEQ ID NO: 512659 - DNA, 986 bp, Homo sapiens
  misc_feature (381)..(381): n is a, c, g, or t
  misc_feature (397)..(397): n is a, c, g, or t
  misc_feature (431)..(431): n is a, c, g, or t
  misc_feature (434)..(434): n is a, c, g, or t
  misc_feature (448)..(448): n is a, c, g, or t
  misc_feature (481)..(481): n is a, c, g, or t
  misc_feature (515)..(516): n is a, c, g, or t
  misc_feature (549)..(550): n is a, c, g, or t
  misc_feature (571)..(571): n is a, c, g, or t
  misc_feature (589)..(590): n is a, c, g, or t
  misc_feature (607)..(607): n is a, c, g, or t
  misc_feature (610)..(610): n is a, c, g, or t
agcgggccgcgcggcggcggcgggcgtgcgcggactaggtgcgcggcggccatggccgacggcgtcgccgcatccctggacggtacttctgccacgtgctgctccgtggaggctcgtcccgcgcctgccggagttatatctgtccaagatgcgagatcctgggttctcatcgaggagcttccggaagagaccaggagcacagaaaactggttctggcgcgcgctctcaccagcaaggacgttccccaacaagaccagagccggtcaccgttggagcacgtggaccagcacctgtgcaacgctgccgcagggctacggacagtgtgctttcggcatcttcgatgacagcttcgagatccccacgttccctcctggggcgcangctgacgacggcaggnaccctgagagccggcgggagagagaccatccgtnccnggcaccggtacggngcccgacagccccgcgcccgcctcaccacgcgncgggccaccggccggcacgaaggcgtccccacgnntggaagggatcatccagcagctcgtcaacggcnntcatcacgcccgccaccatcnccagcctgggcccctggnngagtcctgcactcaaanccntatggactacgcctggggggccaacggcctggatgccatcatcacacagctcctcaatcagtttgaaaacacaggccccccaccggcggatcatcgtacgaagatccaggccctccccaccgtccccgtcactgaggagcacgtatgctccgggctcgagtgccctgtgtgcaaggacgactacgcgctgggtgagcgtgtgcggcagctgccctgcaaccacctgttccacgacggctgcatcgtgccctggctggagcagctacgacagctgccccgtctgccgaaataagcctcacgggacagaacacggcacgaacccccctggcctcactggggtgagcttctcctcctcgtcgtcatcgtcctcctccag

SEQ ID NO: 512660 - DNA, 305 bp, Homo sapiens
ttgagacagggtctcacactgtcaccccagctagagtgcagtggtgcaatctcggctcactgcaatctccacctcccaggctcaagtgatcctcccacctcagaaccctgagtagctgggaccacaggcatgcgccaccatgcccagataatttttgtatttttgtagagacggtttcgccatgttgcccaggctggtcccaaactcctgagctcaagtgatctgcccacctcagcctcttcaaagtgctagggattacagggcactaactataaaatgtcttatctttaaataccaaaacaaat

SEQ ID NO: 512661 - DNA, 1272 bp, Homo sapiens
tactatgtagtggtgattgacttctacctatactggtgccatgtcactatgaggtgcctgtgccaattgtagttattcctcggggggggtctgtgcgagttgcatgttgggtcatggggcttggtctcccctggtactgacatattcttgatctgcttcacactctcatgtggtgttgtttctgagtgtttgtcgtaggcacttggccccatgtgttcatagaggtgttgagcatgtcagagaggtgacgccaattggggttgttgtgctggatgtctttcggtacatttgtcccttctggctcttgccagtctattgtataatgtgcacatgtgtttagggctgcggtaatggcctatgcaatctggccggcatatatattggcctttgggtgccacgtcggtgggagtctatctgagactccctgccctgatggggaccaggatctgtgaagcgctgccgagtatggtgaccgatgtaatggtgcgtgtctgctcgtctacagaggctctgagtgaccaccacgagtctatccatggaaggcaccttggctggaagcccaacatggtcacccgcaggccatgcttgtcactctagaagttgttctcactgatggagattcggccattggcgacgcgtatcactagcgctgcgacctgcatcagtgcacccccgtatgtgcatctggtgatgcgaccttcgctgtcctggaaggccagatgtgtaggtaggtacggctgtctcatgcaacctgctaatgcgcagttagacatagtgtccccgctgtctgagagcccgtgtggctcctgacgcgttctgccgtacgagccagagcgcctcgcaggcctcatggccctgaagggccatgagggccgggaagaatggagaaccgtgaatggacatgcgcacggacggagtatagtcatagtcgagtccacatggccaacagggccttagcgctgtacaaggaaagtacagctgccgaagacggttcaggtcatgaggtgctgtctgcacagcgagtccctgcgtatcgtcctcgtaagccatcagccatacttaagtcggaggtgattacccagggtcatgctccccgaatcacttccaggccctgccccactctccactcttgaaagaaggaggccgcctcctcggggctccaggctggcttgctccgcgctctttcttccctcgtgacagtggtgtatggtgtcgtctgtgaatgctaagtcgatgacatactcctgactactgccgtataactagtagttc

SEQ ID NO: 512662 - DNA, 277 bp, Homo sapiens
ccattttactctttctgtgagttcatctttttaaaatttgacatatatatacccagaaatgggcttgctggattatatggcagttctattattaatttgtggaggaatctccgtaatgttttccataatggcttctaccaacagcgtacaaaggttcccttttgcccatatccttgccaacacgtattatctgctgtctttttgataatagccatcttaacaggcatgaagttatatctccttgttgttttaataaaatcacattgttgtacaaaaa

SEQ ID NO: 512663 - DNA, 312 bp, Homo sapiens
tccccctcttgatgccccttgatgctgcgagttacagacttactgactggtcatattagttgcacagcagtaaaatttaggttatatgtcaagagatataagcctgaagactacgcacctagaactataagttagagctctcaggcattgttgacattataaatggattcctgctcttgaatgactcttacaccacagttcttggtggtgaagtggaacaccttattgatgaaatgggagttacatgagaagcttatcaaaaatacaatagaagcattgttggacctgtcggtggtccaccgccttttgtgc

SEQ ID NO: 512664 - DNA, 407 bp, Homo sapiens
  misc_feature (102)..(102): n is a, c, g, or t
  misc_feature (112)..(112): n is a, c, g, or t
  misc_feature (117)..(117): n is a, c, g, or t
  misc_feature (122)..(122): n is a, c, g, or t
  misc_feature (139)..(139): n is a, c, g, or t
  misc_feature (144)..(144): n is a, c, g, or t
  misc_feature (148)..(148): n is a, c, g, or t
ccggtccaacacttcgtcactccgattgcacaacttcgtcacaaggattgatcttaagaagtgtgtggatgctcggcgtgtgcagcaacaacttcgtccacngtgacttganttcangaagngtatggattctcggcgngtgcntgcncacgccgaggatccacacacttcttaaggtcaagtctgtatgacgaaattgttgctgcacacgccgaaagaccagaccgccgcgaggtcagtatggacggaagtagtagaaatctcaatggacgaaggccacaacttcgtccatcgcgatttctctgcgctacctttctcagtctatagccttcgtatggtacttcggcgtgtgcaaaaacaacttcgtccaccatgacctgtgtcaccaaggggtagggtcccctcgg

SEQ ID NO: 512665 - DNA, 954 bp, Homo sapiens
ggaagtgatcccagatggtggttccaggagcccaagctgtgtttcgggagggcattccaggcgcggggctatttatcccgcccgggggaggtcaattcagggaagtgcaatggcttttcgccctcctgcgaaggttattccttgaaatgtcgagtacgtcgagtacaatcaagtccggttccttcagacagctggggacctacctcgttgatgttgtgagccccgggacagcggttgggaacacttggacgaagaacgacctgccgataccccggtcaacctaaccgacgattgggactaccaagccccaggcgcggggcatgtcaagttcgcaataatgttcgccaattgtggtctgtcccagatgtagggatggaatcgggcgtaggggctagcaccctagtggattgggtcacccggcagacctagggaaggtgtaggcgaggtggggagttgtgcagaatccggcatacctcgcagatttagctgagtctgtcttgatgcagagggccagagaatggcattaccgggggcccaggttggatggggaaacggctaatggtgtcagaccccgaccccagtatacccctgccacgtcagcccagcgcccatcctgcagctcagctgggagcatcaattctccatgctttgtaacatagggtgtggtcgcctggcacgtggccaccatcatgtactagggccatatgctaaggaggcaaatggccaggctctgcctgtgtggtttctcaacacgtagcttgttctgatatggagggcagcacctgcctcgtgaatgggaatattatgctaactactcagaatgtgtcctcgtcatctaaagctcactctgtttaatggtgatgcctcgcgtagcaggatactggttacctgtgcagttgtgaatacacagaggttgggcagatcagtgtctcatacctaccaggtcataagatc

SEQ ID NO: 512666 - DNA, 566 bp, Homo sapiens
gggaggctgagacaggagaatcacttgaatccgggaggtggaggcagaggttgtggtgagccaagatcacgccactgcactacagcccgggcgacagagtgagactccgtctgaaaaaaaaaaaaaattactcagtgtggccaggcactgtggctcacgccttgttaatcccaagacttggggaggccaaggtgggtggatcacctgaggtcaggattccgagaccagcctgggacaacattggtgaaagcccatctctactaaaaacacaaaaattagccgggcctggtgggtgtgtgcctgtaatggccagctactgggtaggctgaggaatgagaatcacttgaagctaggaagcagaggttgcagtgagccaagatcatgccctgcacctccagccggggtaacagagcaagactctattctcaaaaaacacaccaaaaggtgtttccggggggaaaccctcaaatcttgggaaacaggttttgcattccttcagcagatctacccttggggagttagggactggaaagtttccccagcttgtgtccctttactaaactctg

SEQ ID NO: 512667 - DNA, 373 bp, Homo sapiens
tgaagattgcgaaatggatggcttggcccacagtggctctgggttgagggtggaactgtggacaattgggacaaaggcatgtcattctatcttgctcctggagaggctgattgtcctgggggctttggtgtcacagttcccagaagccaggttggccagaccatatgtcttacattgtggtgagcttgcctttgtaaattaatctccaagatgccagatcgagagggatggtggacctagactgaagccaaaccattcgggagctctctttccccagagagaaactccaaatgtcttgaaaggagccctaaagcatacccttagaaggggcaagccatgctctgagacagaaagaggattaacagagcaaagt

SEQ ID NO: 512668 - DNA, 120 bp, Homo sapiens
ggtctttaaaattgtttttttaattaaaaatattttgtagagacagggtctttctatgttgcccaggctaggctagtcttgaactcctggctgaagcagtcctccgtcgcgttggcctct

SEQ ID NO: 512669 - DNA, 285 bp, Homo sapiens
tcatcgtgccatgttccactccgacaacgcctactacctggtcgatgccaccgtgcacgcccaccgctgcaagaccaacactgcctccaacaccgcctaccgtggctttggcggcccacagggcatggttgccatcgagcaggtgatggaccacatcgcccgccatctgggccgtgatccgctggcagtgcgcaaggcaaactactacggcaagaccgagcgtaacgtcacccattgctaccagaccgtcgagcacaacatgctcgacgagatgaccgccgagct

SEQ ID NO: 512670 - DNA, 169 bp, Homo sapiens
cacctacttgtggtctgtgcctcccctactctcttctcatttcgtatatacgaagtcagaaaactcatcatcaggcgacgccctggcggctgggtggagaaggaaacctactattagccccccgccctgcacgccgtggagcatcaggccacacactctacatgcatca

SEQ ID NO: 512671 - DNA, 363 bp, Homo sapiens
tcgttgtatcaagccacgaggtatgacatgaactatatcatagccaagaaagggtgaaaacagccacaatatatgggcaatccaggctctattattacagtactgcacacttgagatgtaatggggatatcagaaaggagaaaaattggtagaaatgcagtattttagccttaataacagactcatgtctcatactactatgctgcaacgtaaagaatagataaacaattttatcaacaacacctgtatacatcacacacctattcacctcattcctaaccacctttggttggagtgagtataaggaaaaatgaaacaaacttcttgtatgacaggaactcatgattttctatatacattttg

SEQ ID NO: 512672 - DNA, 1257 bp, Homo sapiens
gggatggaatagtcacccgtaaggatggcaatgccacgtggaaccacgctgcttgagcgttctgtactgcatccgtacgcactcaagtctgatcactaactggacgaatgcccgttgccagctcgtgccctctccaatggtatgtctaccaaatatgtggatggttattggctacttgtatccatggtttggacagatgtgtgagcacatgagatgtctcattaaaagcccggtggtatggatggtcgacctttttgcttcgctagtcaacaggttgatcaactgggaataggtaaagaattcttgtcgagaagttgcatgctatggaatgcgtttgtgaagtaggaaaggtgtctttcacttgtgtggagcacattgtaggggtcgttccacatcgttgaaggataattgtaggttattgttgcaagggcaatggttcgaggtggtgcgcagagtggttggagtgggtgacaggggacagacaatgtgaaagccaattcacaaaattggagaagccgaaggatgggctacgcaattcgtggtcttcagggagttgatttgattccgtagaagaccgagtgactaggggtcgcaaaattaacaggcgtccctggcttaacttgccatcacagtgatattcgggacactggaccacctaatgagttcgtgcaactatgttgctattggcaaaggatggggtgtgatggagtcttggaaggggacaacaacgcattttggagatgcggacacggtttgtcgtgggactaaaaaaaaggctttggtgatagaggaaatgcgtacgcataaaaaaataacgtttggaaagggggttagttggtgtttagatatgacgtgtgacagaacattgggtttgggaattaattgggcatgttcccatgacgagagagggcacaatggtatgttgattcgaaggaaaggattttacaatgcaagagaaggaataaatttcgcaatgacagtttgtgggcgtggaaacggaggataagggacaaggagaacgggatgtagataatttgaatgacgatcggaagacaacgttgtggtcgtgaatggagagtgggagtcaaatatcacaacaaagggcaggtgtgtggtaacactaactaaaaagggggttgtagcatgtgaggaaggcgttgtgacgaaatgggatcagcaacaaaagattgttggacgccagaaaaaagggtgcataaaaggcgtatatatgtagaagtcattaaactctcctagatg

SEQ ID NO: 512673 - DNA, 134 bp, Homo sapiens
gagctcgaccgcttctgcttctgcgcacgacatgcttgcccacctcccggctgtgacacggcccgtgtaccacttccctgttcacacgcacctccacgtgcttcctgcttctgcctccagggctcttggtgagg

SEQ ID NO: 512674 - DNA, 1249 bp, Homo sapiens
gaagaagctgtgtgaactgcagcctgaggagaagtgctgtgtggtgggcactcgtgttcaagggctcatgtccgctgcagtcctccatcctgcgggaggtcatgcgaggagcagcaacctggtcccccagctctcgctcggatgtatatactatacacccagatagactgagctggtcttggaagatgaagtgcagcgtatcatcactaaaatggcagccgattgacgtgtctaaagcctggcttacgcgggactgttacctggctgtgtttggcgtccgatgaagagacgactgggacatgtttctggtggaggactatatagcttctgtgtgactctatgctccgcctagaagcccgtagccccacttgacgatcgagatagagtagtgctacgtaggtgtccgggcctgggcctagggtggcgggggaggcgagagcctgctggaggaccccaagttgcattgagtgagatagtagtgtgacagtggtgcagccttggcgggatgatcgtgggaagtcagtgcaagctgccaggccaatgtgtatcccggggttagtacttcggcatgggcaaagccttccttcaagacatatagagaatccgagaatgaccagggtggggaattctctaagttcattacttaagggggcaaaagaatagtcccgttctatttcgaaagaagaaagaacgcccaggggccaagtacaccaaagacggatggcgtaagggccttgtatttcccagtacttgggccttgcgcactggaagaattcccttcccgtgttacatgccatggaaggccgattacatacatgtgagctgtaacaattacgagggaacacgagagaaatgtgttgaagggtggacacaattaatatggcccgggtagttaacaatgactagtgctactgagaagggcacatccagccgttggataatgaattcggattggaggcagaatggggaaatcacacattggccagggtagtcacagggtctatcaaataatggatgcccatcagagaatggacacacgctagtgaagtaagccatcattaagggtgtatagagctagtaccccagctccgatatgcataactacagaaattagctggggaactccacacgacatcgagaattatcagttttccgcccaaagaacaatgattagcccccgagagccattgtgtatactataacaccatttatataggtacatgtagtgtcaaacaacatcacataccag

SEQ ID NO: 512675 - DNA, 312 bp, Homo sapiens
gaatctcgggtcaagctcttctcctgcctcaaataccaagtagctaggactacaggcgcccgatacacgcctggctgattttgtattttcagtagagacacggtttcaccatgttggccagagtggtctcaaactcctgacctcaggtgatccatctgcctcgatctcccaaagtgctagaattgcaggtgtgagccactgcacccagctagaaatcgcagattttttttgggattaaactaagtctcaatctgtggcccaggctggattgcaccagtatgatctcagattgagccactccgcccggttaaa

SEQ ID NO: 512676 - DNA, 859 bp, Homo sapiens
  misc_feature (9)..(9): n is a, c, g, or t
  misc_feature (73)..(73): n is a, c, g, or t
  misc_feature (81)..(81): n is a, c, g, or t
  misc_feature (83)..(83): n is a, c, g, or t
  misc_feature (92)..(92): n is a, c, g, or t
  misc_feature (115)..(115): n is a, c, g, or t
  misc_feature (117)..(117): n is a, c, g, or t
  misc_feature (119)..(119): n is a, c, g, or t
  misc_feature (142)..(143): n is a, c, g, or t
  misc_feature (147)..(147): n is a, c, g, or t
  misc_feature (149)..(149): n is a, c, g, or t
  misc_feature (154)..(154): n is a, c, g, or t
  misc_feature (166)..(166): n is a, c, g, or t
  misc_feature (168)..(168): n is a, c, g, or t
  misc_feature (198)..(198): n is a, c, g, or t
  misc_feature (206)..(208): n is a, c, g, or t
  misc_feature (215)..(215): n is a, c, g, or t
  misc_feature (222)..(223): n is a, c, g, or t
  misc_feature (225)..(225): n is a, c, g, or t
  misc_feature (249)..(249): n is a, c, g, or t
  misc_feature (256)..(256): n is a, c, g, or t
  misc_feature (260)..(262): n is a, c, g, or t
  misc_feature (264)..(264): n is a, c, g, or t
  misc_feature (272)..(272): n is a, c, g, or t
  misc_feature (289)..(289): n is a, c, g, or t
  misc_feature (291)..(291): n is a, c, g, or t
  misc_feature (294)..(295): n is a, c, g, or t
  misc_feature (298)..(298): n is a, c, g, or t
  misc_feature (301)..(301): n is a, c, g, or t
  misc_feature (306)..(306): n is a, c, g, or t
  misc_feature (309)..(310): n is a, c, g, or t
  misc_feature (312)..(312): n is a, c, g, or t
  misc_feature (330)..(330): n is a, c, g, or t
  misc_feature (348)..(348): n is a, c, g, or t
  misc_feature (352)..(352): n is a, c, g, or t
  misc_feature (360)..(360): n is a, c, g, or t
  misc_feature (364)..(364): n is a, c, g, or t
  misc_feature (368)..(368): n is a, c, g, or t
  misc_feature (370)..(370): n is a, c, g, or t
  misc_feature (376)..(376): n is a, c, g, or t
  misc_feature (378)..(378): n is a, c, g, or t
  misc_feature (380)..(380): n is a, c, g, or t
  misc_feature (391)..(391): n is a, c, g, or t
  misc_feature (393)..(393): n is a, c, g, or t
  misc_feature (401)..(401): n is a, c, g, or t
  misc_feature (405)..(405): n is a, c, g, or t
  misc_feature (407)..(407): n is a, c, g, or t
  misc_feature (507)..(507): n is a, c, g, or t
  misc_feature (539)..(539): n is a, c, g, or t
  misc_feature (551)..(551): n is a, c, g, or t
  misc_feature (859)..(859): n is a, c, g, or t
gaagctggngtcattttgattgcggggaagtctggatttaatgtcttccatcccactttgtatcgttgcattnacttcacncnctgtccagnttttattctttcttgctcgtttncntnggtccaatgcactggacccaacnnacangngtggnctcggggaaggnantgctccctccctccaaattctgagcagtanaaggccgnnnggggggngtggggnngngaaaggaatgagaccccaaaaggnagaaggnaagnnngngggggggngggatggggtggggggngnggnnggnggnggggnggnngnggtccccggagtccgagngcgaggggcccatatgcnacanctcagggntgtnctcngngggggngngngggggactaangnggcccggnagcngnggccaccgtcttctgtcccgtggctcctgcgaacacaggcagtggggaacaggcagtgactgcccacccccaccgttcctcctccctgaccctgcaaacntcggggaagctttcaggcccgggaaagcagancaggccccagtntccctcaccctttccctgggtctgaaggtcccggatcctgcgttcaaggatgacgctgaaactctctctttctcacatgggatctgtgatctgggccctcacaactcagcagagcaccactgtgtccccctcacatggagaggccgaggtctgtggagatcctgggacagagccagcgtcaaggactcagagggtgtcctggagtctcctaggacggaagacggcggccccaggtggggaaagactcagaccaggcctgcgcgctccaggtcctgcggcaggatgcggcccttcttgcgggctctgan

SEQ ID NO: 512677 - DNA, 110 bp, Homo sapiens
cagcttgtgctacagcttctgtaatcagaatccgtcaccagtatccgtctttattttgagggattctgattacagaaagctgaccattaggcccgaggttaggcccgaag

SEQ ID NO: 512678 - DNA, 718 bp, Homo sapiens
  misc_feature (8)..(9): n is a, c, g, or t
  misc_feature (646)..(646): n is a, c, g, or t
  misc_feature (678)..(678): n is a, c, g, or t
ggggctcnntagatcgctgagcgatactttcggcagcacctccttgattctcagtttgctggaggccgcaaccaggcccgcgccgccaccatgtttcgaaatcagtatgacaatgatgtcactgtttggagcccccagggcaggattcatcaaattgaatatgcaatggaagctgttaaacaaggttcagccacagttggtctgaaatcaaaaactcatgcagtttggttgcattgaaaagggcgcaatcagagctgtgcagctcatcagaaaaaaattctccatgttgacaaccatatggtatctcaattgcggggcttactgtgatgctagactgttatgtaattttatgcgtcaggagtgttgggattccagatttgtattcgatagaccactgcctgtgtctcgtcttgtatctctaatgtggaagcaagacccagataaccaacacaacgatatggccggaggaccatatgggtgtggtctccttattggctggttatgatgatatgggccctcacattttccaaacctgtccatctgctaactattttgactgcagagccatgtccattggagccgttcccaatcagctcgtacttacttggagagacatatgtctgaattatggggtgtatttaatganctagttaaacatggtctgggtgcttaagaganaaggttctgggaaaggctggttaaaagatggtcctggatg

SEQ ID NO: 512679 - DNA, 128 bp, Homo sapiens
  misc_feature (112)..(112): n is a, c, g, or t
  misc_feature (118)..(118): n is a, c, g, or t
gatcgcacactacgctccagcctaggtgacagagtgagactccatctcaacaacaacaacaacaaaaaaccacaaaaactatatttttaatcatgtttggtagcttgaaaantaaatnctttctgcct

SEQ ID NO: 512680 - DNA, 666 bp, Homo sapiens
  misc_feature (8)..(9): n is a, c, g, or t
  misc_feature (594)..(594): n is a, c, g, or t
  misc_feature (626)..(626): n is a, c, g, or t
ggggctcnntagatcgctgagcgatactttcggcagcacctccttgattctcagtttgctggaggccgcaaccaggcccgcgccgccaccatgtttcgaaatcagtatgacaatgatgtcactgtttggagcccccagggcaggattcatcaaattgaatatgcaatggaagctgttaaacaaggttcagccacagttggtctgaaatcaaaaactcatgcagtttggttgcattgaaaagggcgcaatcagagctgtgcagctcatcagaaagatgctagactgttatgtaattttatgcgtcaggagtgttgggattccagatttgtattcgatagaccactgcctgtgtctcgtcttgtatctctaatgtggaagcaagacccagataaccaacacaacgatatggccggaggaccatatgggtgtggtctccttattggctggttatgatgatatgggccctcacattttccaaacctgtccatctgctaactattttgactgcagagccatgtccattggagccgttcccaatcagctcgtacttacttggagagacatatgtctgaattatggggtgtatttaatganctagttaaacatggtctgggtgcttaagaganaaggttctgggaaaggctggttaaaagatggtcctggatg

SEQ ID NO: 512681 - DNA, 502 bp, Homo sapiens
agagatgaagaagctataaaatcacaacaaagatgctcaacactcagactagataaagaccccaaagtcagaaagcctgctcttcttttacaccagttattcaccttttacgacatgtagagtctacactgactttgctagcaaaccaggctagcacatggccctgacatttcataaggttctggtaattcaaacagagagttcataagactacactctaaggtcattaactttacttacagttatattaaaaattagaggtagatgagtacagtttattgtatgtctattacacttcaataaacgtgtaaaaaataaacgagagtagtcatcaaagttagtatgactagtaatatgacaaagtgacatcatatgcctcttgatctaatgactgaggacaaagcatcattcttgtgatattcctgccaaaacagtataacttcaatttaattataagaaaacatcagaaaatcctggattgaaagcatattctaaaaaaaaa

SEQ ID NO: 512682 - DNA, 983 bp, Homo sapiens
tactcatcgacgacgagtgttacagggtatttttgcaatataacttaattgctattgctgggcacatttacatttacaagagtcatttatagggttggccgtgagttctatagttagccagacttcttgagcgatactttgcgttgtactaagcctccatgtatagcgatgttccaagagacagtctagccaatagaagaaaggcgaagaagccccttgctcaagtgcgtcatatgtccgcagccataacatgacacccatttgtcccagtagataaccacctctaccacttggataatgatatctttaccagaacgtattctctaatgaagtttagtagtgcatagtgctaatgtatcactggtagttcctatcatagtatatataggtcgatgacacctttgctcccgttcttcgggacactagactgaggcatgccgagagaccagagaactctgaagatcaaaacctgggttataacgccaacagagtagagtgcggaaacgaccggagaccgtactatacctcagtcgtactgcgtgctcttgaacatagcttcttcctacactagagcgtttggtcgtccgatgttgccaggattcggactaaagggacttagctaacagcagccaaggaatgatcaccgactaagtaccgcgtcctagatatatctcgcgatcttcctgcgtttccctagcgtcacatttaagggtctccaattttcttaaaaggttgctttactgtgaggtggcctcgaaaagcggcttggataaagtaaagacttcccaagagtccccttattacacctgcatggacttagactattgggcactagtttgggacgccccgagtcatacctaatttcgcggtgttacgacgcaatgtagataccgccccggtgtttgaaaacgctggcggggccttgcacaacggacatcagttatagactccttgcggaggttaggaatctcgaaaaatgcaag

SEQ ID NO: 512683 - DNA, 1059 bp, Homo sapiens
aactcccccaaagacaagtgagttaagggagagaataagaacggcggtaacagttattggcaaaaagcatgaaaagagaaagcacttggaaatttattactagcttgctacccacgatgaaatcaacaacctgtatctggtatcaggccgggagacagatgaggcgagaggaggaggaggaggaggagaaggctctggagctgcctcgtggcgacaaacatcacacaacatcaaagcaacaatacaataacacattttcacaagaatcaatacaaacattcgactcatatacacatatcacaagcaaatacaaaagaagtctcagtggcagctattggtcaaaattaatatccatttctttttatctacggtgaatattgcgcaattatagatctggattttgaaccacttaatgaagcggcaacaccaggtgtttagaggtgttggcattcttcgctgatttggctgttcccaatgtttacattatttaatcttgcaaaaatggttctgtgcacttggatgtgaaatgctgtccagttttatttttattatgtggttatccttggatgtaccaaaaattcagaaaatgatctctgtagatattcgggttatgtgggtcatctttagaagttatcaggaatgtgtgtaaaacaagacgagaacttttgctaaggaatgactacatagaacagatttcatatacaatgagtggtaagattgtgtcactaggtagcatgaaggtatctggccaagtcatgcaatgggcacatataatgtagaaaacacacacagaaaaaacagacacagagaaaaaggacaacacacaaaacaacagaacaggcgagcagacaagacactcaccgagagggcccccagataagcagacacgagagttatgagacagagggcgacgaaaaggaggacgaaaacaccacgaagggcagcgctaacacagaggacacggacaacgcatggagcacttaccaaagcaacaccagtggcgtaacagtggaacacaccccagaatcacaagagaacaaaaacagataagatgacaac

SEQ ID NO: 512684 - DNA, 131 bp, Homo sapiens
ttgtggtatcagagcggctcttcaatgtatcaaggtgattttggaagaacgattctcggttctgcaacattgtgtcacagtgggagcaatttggggtgagtctctctcttatgatctctcttaatttcatg

SEQ ID NO: 512685 - DNA, 348 bp, Homo sapiens
gcctacatgttttgcatcattgacaagtcattgccccttccaaatgacaaaaccttactttacaatccatttcctcccacgaatgaatcaaatgttatccggaggggcccaggtcatgcttttaaaatttttaaaaaaaataagcctctacttttcatggattttttggatgaaagaacacttgtggcagtaaaacggcctttggatgacatcattggtcagctccccccccccattaaaaagaaaaaatttggaacctaaaacagggccctgtttgggtccttccttgaactgtttaccctgttgcttttcacaaatcatggtaataaaacaagttatttttgagga

SEQ ID NO: 512686 - DNA, 188 bp, Homo sapiens
atgaggatatttcattgtcgcgctccatttatgcaactagttgcaaagaattgtagagcgcactcctcgtttatgcaagcagttgcacagacattcgcgtttgtggtgttttggcgacggcggcgccgtgttggcctgccgatcaggcgcgcgcagcgagccgggcctcgatccagccgagaatgtcg

SEQ ID NO: 512687 - DNA, 102 bp, Homo sapiens
cacagtgacctgaagccggaaaacagcctctgtcagcaccccaaccaggtctcccccgtgaagatctgtgacttcggcctgggcaatcggttgcatggtacc

SEQ ID NO: 512688 - DNA, 206 bp, Homo sapiens
taggctgtacggccggaatttagggatggtcgtctggtgagaggaacctgcgcgagagtagcacctgtttcttcagagttgctgtcaaaataatcactgcgcccgcctattagtgacaagaagttgcaagaggacgggaccatttgtaaacgggagacgtacagggtactgcagaacggcgcgaggggcggggggggggggggagg

SEQ ID NO: 512689 - DNA, 1028 bp, Homo sapiens
gggtttcccggaacagtccgcgcgtaggacagggaggaaaaagaagccaccctgcggtcctggggcctggagctggagcctgcgctgcctgcctgcctgccgctggcctgtcttggatgctccctcctgctgctggtacgatgccttgccggtgcccgtgcctggggctctggggcggttgatggcctctgggttgctgcgtgtggtagcgtattgtgcgactggcatatgcgctggtccagcggctgccggcttgtacagagtgtggagcccctggctggcggctggcgtggagcagcactgtacggccaaggggtgggcaacggtgttctggccgatgccctccgacaagtcatggcaccagcgaagaagcttggcagcatgtacagttctatcgagtacgctgtctgcacaagtcggtgcccgagaagtcacgctccagtagccttccttgtctgcagatccgactgggatgaagaacatcacgcatgggggagccccactgggttacctcgcgactccctgagtggttgctgtcttctagggacctgtactagcgccggacggccttgacatgaacgaagagggcctagcagaagccactccgggcgaaggtgccgaaagggcccttcgcagggacctcatacgtctgcttgcatggactggcccccagaccaccaggttattgggcgaggtagtggcccctaggtgaccacaagttggtccgtcaggggcgtccattggcgtgcgtggcgtatcgtttctcaggcgcctttcagtgttacaccggacggcattccccacggggtgtgtccccccggtgccagcgctgcgtgcattgccggaagtctagggacctcgccagtaaggtgccttcgccatggtttcgacaggacccatacttcgctgattggccacttggaggcccgtccaccagtgaagcccagagggcgttcccgagcgattggctgggccaaatgcagaaggttgacagccttcctagtggtatgtccatcgatgaggacaca

SEQ ID NO: 512690 - DNA, 554 bp, Homo sapiens
gagcgggatgttccgagcgaccgatggagatggcggctgcggcatgagtgacggacggtggaggccctagagcccgtggcctgaagggggggactaaaccctgggtgcccggcgaggagcccgggcagggttgtcttagcaaggtatcaagaacttactatagtgtggtcgaagtaattcaatcgagggtaaagagcatcaagtagaaacttctgcttggttgataagtacttcaggacattcccccagtggctgaagtggcatatgaatcatgaagttggatcagtttggactgactggctcctcctactccagagaggaaagctcatccagggaccatgaagccacattcgctcaccatctgtgtgctgcttaagctagtgctgcgggaaccatggtatccttgggaggaatcaagcatgagctcttgggatgagacttcctgccatatcctaggggttgagacgcggacacatgccattggcttcatctggatcgacccaggggaagctgacaggaggggcttcgctctgaaccgtctggggcctgtagga

SEQ ID NO: 512691 - DNA, 1254 bp, Homo sapiens
agcggagcgggcgcctgcgacagtgaacgatagtgaccgtccgctcgccgcccggctcatgaccaagccgagccagcgcagtgacataacgagcctagcagagacagcgtctgcgcagccgtggctgaggagcctgtggcggcagacgagcggatgtgaaccagctggagcagccgagcgagttagttgtcagccgaggggcgaaacctggaagggcggggctgtgccagcgtaagcggactccccggtgtgcttgagagcctcagtggaccagtcgctacatcgtcgcgcgaagagcttttacttcccctcctatgagaaagaagccgagcgtcatgatctgagcggcagcaaattccgtgacgggcagatcttgccttctcaggaaacacgtgagctggttggagccgaccatgcttaccactttgctctgcaccaaactggtagggctgctttcacaccaaagcgaccgctgtggaccaaaccaagtcacagctacacctgggtcctgcacgcagaaccttgcttgcaacctttgggcaccccaactttggcccttgtgcgcattaggcccataggaacttgacacaaagtaaaccacggtatttgctaattgctgggccccgtttggcgcacaacagtcacgttttaaccccccatttgcagcttaaacattgaagggcgcgcacagcgcggggtaccttcaaggcgttcccaatgtcgtcccaaaaacgtaagttaacaccactaagttgcccccaagaataggaaaacctgggtgcctgttaacatgggtgacgctcaatacaaacttggttttcccagcgaatgggcgcttttccatgtggcatccgttggttggccttaaacgtaaattaaatcgttagccgtggaaggttacacccaaaggccaacaatacaacagcaaaagtaatatacaaccgtctttttccacaagcgtccgcggttgaaaaactaccgggcggccccaaataaaaggcaggcgccataagaatagccaatttccaagaggcggggcggggaggcacccagtagaataccctacacggctattcggtgagcgccgcccttttaaaagcgagaacgagcacagcataaaactctccccgaacacgcatatgggaggaggaaaatccccatggggggctacagatacacgctgtggatctaccgctcgggggagtcgacacggacggagcaaccccctacggcacaaacaatggtcacagacat

SEQ ID NO: 512692 - DNA, 171 bp, Homo sapiens
acggattacaggcaccggccaccaaacatggataattccagtatggttagatagagatggagccaggctaggtttcaaactcgtgacctcgtgatcctccctccttgggctcccaaagtactgggattaaaggtgtaagccagcatacccagccagaagtgcgcctgggtg

SEQ ID NO: 512693 - DNA, 267 bp, Homo sapiens
  misc_feature (8)..(8): n is a, c, g, or t
  misc_feature (42)..(42): n is a, c, g, or t
  misc_feature (46)..(46): n is a, c, g, or t
  misc_feature (48)..(48): n is a, c, g, or t
  misc_feature (95)..(95): n is a, c, g, or t
  misc_feature (115)..(115): n is a, c, g, or t
  misc_feature (168)..(168): n is a, c, g, or t
tgcaacantggcagacccggttgagatatggacagcaaaatnaccncngtatcggtatcgttctgagcgctggctgaggccggaaaaagatcgangatatggctgtcatagcctntggctgctgcaagattcgcggttgcctgcgcctcaagagaacgtccgtaaatnatcagcctgacgcatggcctgaaccccacctcaaagccattgagattccagcccgtccggttttgcttgggcaggcacaccagcgattgtgcttgcggt

SEQ ID NO: 512694 - DNA, 140 bp, Homo sapiens
caaaattctaagaaccagcattgcacttaacctatagcaacctgccagagactccaaacaacatccgtatctgccacggatacttcaggcaccattggatctgctggatcatatgggcgaagtggcagagcagtttgcat

SEQ ID NO: 512695 - DNA, 406 bp, Homo sapiens
gactgcatcctctggtcccgtcacagagaagagattatctagactcaagcttgagagttcaccttcggcgggcggaagttcatcattttcaaggccgccaaattcacgattaacttcatggctacagcccatgagagcaacacttaatgcactacaaaaaaaccaagcgaggaagatcgatatttatttcatgagttcagtaccttaagagataggactgaaatcacactagagaccttatgcgcagctggatactgtcagaattaacaggtacgcagaattcggcgctggcgtattacagcaggcatgaaaaagcccgcgggctaggcgggcttttaccacagataaatttcagatcagaacctgaacacttccagatccgtacgaatcggcgtggccagaagga

SEQ ID NO: 512696 - DNA, 887 bp, Homo sapiens
gtatgaattgtgtatacgggatgttggctatatggatacatttgttagtcccgtgtgggctgaatccgggtctatcgtctgttgatcataagtgggtacctgtgttgtcatccgctcaagaccaggtagcttagagacattattgggtactgaatgtcatcgttgtagcacttcagtctatattatggatctgtgtatatgattttggaggtgtgagtgggagtgttgaatatcgtaaatacacatgttcaggtatgggtttgtgtacacatttataatgatagctgttctagaaactcactacataaaattctagacaagggggcaagtggcacaaaaatgaaggaatcttttacatgaacagtgatggattatcttgttaacaaacacgcacctcaactggctggtgtttgatttcaccaacatagacttgacatctgagactgatgaacattccagatattcatagcttccggacagaggcagaacggatcaaataattcagatgctaatggccctgtcctctcaagggcaagatgttgaataactaacaacaataaaataccccctttgtggtctgaaataccgccaatctcgtattagatttaaacctctccctgtttttaatttcctgtgaactttctgaaagaggtggttacatcgtaatcttcttgcgctacacatctggtccttaacacttggcacctgaccattctgaatttaacaacctcctcgggtacacgaagatccctagtttctgggtcatcttaacttcatttcactactcattaagtcttacactggcggcacatacacaacaaaccccaccacaccacaaaaaacaccactcttgccccgcctgtgctccccaacccctcagcaccccg

SEQ ID NO: 512697 - DNA, 709 bp, Homo sapiens
tcgtcacctaggcgtgcagtgtgcactgctgggctcccccatcccgtcctatgccggaacagccccgggcaggaggcgtggaaagtcgagggggtaaaccgcgagtgtgcgttgtgtcagccacggcgcagggtggggcgcgggcgggacttgggcgggcgggttgggcttggccgagctggcctccgtgggtcacctgaccgcatataagtgcatgtcggactggacacagaccatcccctcgaccgctcgcagtcgcatttggcacgctctccctaccgctccaagccccagaccctcagtccatggcatgccccctggatcaggccattggcctcctcgtggtcatcttccacgaagtactccggcagggagggtgactaagcacacctctgagcaatgaaggagctgaatggagctgatccatgaaggacgctcaccattggctcgaacgctgcaggatgctgaaattgtgaggctgatggaagacttggaccggaacaaggaccagtgaggtgaacttccatggagtatgtcaccttcctgtggggccttgtgcctttgatctacaatgaagccctcaaagggctgaacaataaatagtggaacgatggatgacaccctctgggggtcctctctgagtcacaatccagtgctgggtacatgtacataaaatatgccgtgggtcactttaatatcgagacaaaga

SEQ ID NO: 512698 - DNA, 481 bp, Homo sapiens
  misc_feature (26)..(26): n is a, c, g, or t
  misc_feature (195)..(195): n is a, c, g, or t
  misc_feature (245)..(245): n is a, c, g, or t
  misc_feature (291)..(291): n is a, c, g, or t
  misc_feature (293)..(293): n is a, c, g, or t
  misc_feature (358)..(358): n is a, c, g, or t
  misc_feature (369)..(370): n is a, c, g, or t
  misc_feature (379)..(379): n is a, c, g, or t
  misc_feature (404)..(404): n is a, c, g, or t
  misc_feature (416)..(416): n is a, c, g, or t
  misc_feature (425)..(425): n is a, c, g, or t
  misc_feature (458)..(458): n is a, c, g, or t
gtccggaattcctatgtcttactttntaaaacatgatggggttgctatgtgccagactagagtcaatggctagtcacaggcacaatcataagagtgcatcctttaactcctgggctcaagctgttctcttacctgaacttcgtgagtagtgggactacaggcacacaccactgtgcccagcttgccttacttttngtattgtgccccaccacatcctggacccctaaaacaacactcatgtcttntgcccacaaatttgcaatttttctcaatttttttttttttttggananggaggttctggtggcccaagcgggagtgcaagggtgtgactacagctcactgcaacctcggcctnccaggtaaaanngattctccngtctcactcagcctcccaaatagcngggactacagtntcgtgcaantacaacgggctatggaatttttttagtagagangggttttggccatgtaggccggg

SEQ ID NO: 512699 - DNA, 936 bp, Homo sapiens
attatggtgccctttctggctaccgattgtcaaacgccctgggcctctttttgtgcgccccgtttcgtcgggctctattccaccatgttcacagggggtcggcatcaatccctaattagcgcgaaattcgcactatttggggcccaaagctccacacaacttcttggagtttagtcagaccctcttccacgctgttgctcgactaaggccggatatcgcctttaaagggggcgcccttttattaacgtcccctcctcgactttgtcggcactgcactcggacgtagccccgccggtcaataatgacgcgctcctattgggggcaccctgcggccgccaacatacgcccggtgtcatcggcgccctacgcttctgagtgttcgactgcgtcgagcccctccttctatgacgcctttgcacgtaaaagcgggcttacggctaaaaatggctggctaaggctattacaactacgggattgcatcatagcctcggaggcctctctctctcccccgggttttttgtgtctaataagccgcacgagagaggccctcgcactacgtaggttatgtagctgaaacgggctcgccgctcgcccacagcctacatagtgttctgctctagtgttaccacagacataataagcgcacaattcttcccccccgatatattatgacgaccctacaataattttgtttgacgcctccttcaaaagcgcctcatttctaaaagcggccccccactgtttgttctcgtaagtgtggccgcaccacaacaatacccgcgccttttcgcggtagatgcctcactcattacgccactcacccctctcttcgactacaatattgcaatcaccgcaccccgcctccgccgattatgaattggagacactatgcccatcaccagctcattttcgggtcatttcccgccccacatgaca

SEQ ID NO: 512700 - DNA, 270 bp, Homo sapiens
cgtccttatcatacctaccatctcagcccaaaacgttttgaactgataaggcaacttcagcaaagtctcaggatacaaaatccctgtgcaaaaatcacaagcatttggttacaccaaataggcaagcagagagtcaaatcatgaatgaactcccattctcaatcactacaaagagaataaaatacctaggagtacagctaacaagggatgtaaaggacctcttcaaggagaactacaaaccactgctcaaggtaggtatgatgaaggacg

SEQ ID NO: 512701 - DNA, 146 bp, Homo sapiens
gctatctgcggggccattcgtaggatgggtgagtcagatgattccattctccgattgaccaaggccgatggcatcgtctcaaagaacttttgactggagagaataacagacgtggaatatttgtcataaataaataacgaaaacct

SEQ ID NO: 512702 - DNA, 289 bp, Homo sapiens
tttttccctaaacccccccccccccttttttaccggggggggggggcgggttccaaaccggttggtttcattgggccctttaggtttggggggaaaagcggggtttttttaaccccggcctggttaacccctccaagggaagggggaagtttttggggcccccctgggttttttttttgggggggggcggttttaggtttttggtttttaaaaccgggcctttttttggggacccccttgccccaaattttgtccccgatttttgggccccctttaaaaggttttttga

SEQ ID NO: 512703 - DNA, 298 bp, Homo sapiens
  misc_feature (9)..(10): n is a, c, g, or t
  misc_feature (143)..(143): n is a, c, g, or t
  misc_feature (209)..(209): n is a, c, g, or t
  misc_feature (271)..(271): n is a, c, g, or t
  misc_feature (285)..(286): n is a, c, g, or t
tgatgttanncccaacaccctctttctcaggtggtttcaccaacattccaccccaaaactttttatatctcattggccagaacttaatcccagtaccataccttgctgctaaggaggctaagaaatgtgcttcttaaactgancacactgcaagccccaattcatttacattagtaagcaagaagagaatgaatattggcaggcagctnccaatctcagctacaattctagggctgatacagaacaacatgagttctggatgaaagatccnggtggttgagcatnncaaagtgttggg

SEQ ID NO: 512704 - DNA, 395 bp, Homo sapiens
acgcgggtctcactgctcttatattcaacctgatatgaattattcactaatgataacctgacttcaaaaacctttaggcaaagagaagacacatttaattatatttatgtatacagatagcagatatatagatatacatacaattatataaaataattaccaaaacatatccgatctgaatgatttcctccaagttaaaaatgtattgactttaaaataaacatgaaaatgaaccaggtaggaaaaaatagttactccagaaaagattaaaactttgttaccagttggtctattttaatgttctattttataaagttagtatttaaaacaagactccctttgtaatgagttcctccatttaatttaatatcccaaataccttgagagccccataa

SEQ ID NO: 512705 - DNA, 178 bp, Homo sapiens
tctagaagctggggctcttctccctggccctttctcgaggcttatctgtccttgcacctgtgccggctcctgctgagctctggcgacatcagctcagacgcctctcctcaccctctgttctcgccttgtgttggcaccagatgtctgcttttctagctgaaatctcacttattagctg

SEQ ID NO: 512706 - DNA, 204 bp, Homo sapiens
cgacctagaggatcccctataccaacgcgaaagtcacagcttcactgcctgagccagtcgaagaccacgaacccagggcgaagaatgaacaactgcagacgcaccacctgaagagccgtaatcactcaccacgaaggtctggcagctgcactgccatgaaccagcgaagaccacaggacccaccaggaaggacagaaacttcca

SEQ ID NO: 512707 - DNA, 477 bp, Homo sapiens
tacggaatccaatccaagggttcccaaaatcgcccgcacatccactattacctaccggaaactctttattcttcgtttgggagagaaagtttataggttgggggggatattggaaaacttgccggcgccgggttagaactttcttcttagggtagttagagaggggaaggttagggtttcttgtattctcccgcctgcctctcctcccgtttgcccgcctgcccgccctgctcgtccgcccggcctgctgtccatacgtccgcccgtctgccctcccgctatctgtccgtctgtccgcccgtctgtccgtccgctcgtccgtttgtcgtctgactgtccgtccgttcgcccgctcgaccgcccgtacgcccgtcggtccgtccatccgtccgcccctccgcccggctgcccgcttgccgtctgtccgtccgcccgcccgtccgatccgatccgtccgtccgtccgtccgtccgtccg

SEQ ID NO: 512708 - DNA, 551 bp, Homo sapiens
tgatgtgtgcatcttgtagtttagtcttcgtttctgatactgtcttattttccatttctttccttgagtttggaacagctctatatttcaagaatacttcctggctcggctggactggtttttatttggagtttttaaaaacttttggacgtggccgggcacggtgactcatgcccggtaatccccagcacttttgggaggccaaggcggggtggatcacttaggggtcaggagttcaagaccagcctggccaacatggtgaaaccctgtctctactaaaaatacaggaattagccgggcgtggtggtacacccctgtaatctcagctactcaggaggttgaggcaggagaatctcttgaatctgggaggcggaggttgcagtgggcagagatggcaccactgtgctaaaaaagcaaaggccctagagattttatgattttctacttgatgaaattaagtgataaaaaatttgagtagaaaattaacatattttgtataaatatgtacatataggggcctaagtagacgtccttgggatttcaaaaaggag

SEQ ID NO: 512709 - DNA, 944 bp, Homo sapiens
cagtgtggaccgacaggagatccgacatacatgattcaaatcatatgatgcattagttataccatattgacatagtcgatgagagattgtctaaaggctgagatatggaatatgtcatggctgctaaaccctgtctcggcagctaaggtattgatatgaatgaaataattctggcctgctgtatcggttacttgaaagagtagaatggcattattaagatacgtagcatgttgaataatgagttttggcagtaatagaggaagtgcagggatgtattcatacagtacttgtaaaaatatggtttactggtagagcataagacatgcattctgggaaaatactatccgggaaattaccgtgataatcgaatgggtgagagggtcgttaataaagacttgggtaggggaagtgaataagcagggctaagattaatgtggcatctaaagatgtacctgattagtactctatggtcgttcatcttggaaaagcttttgaaaagtggaaaggtcattttgtttgcattttccccatttctagttttttaaaagaccaacaaatctcaagccctatacaatggttgtattgaaccttttacattttgaattacaagatgttcacccagtgaagtctttcatgtattcaacgtgatttataaagatggcgcggtaggctacagaaacaagaacttgacaagtaagaggttaacgcagctgccggggcccgtgacacacgcctggaatccagcactttggaggcgggggggaggaacaccggaacaggggttaaaacaggcggcacatgggaacccgccataaaataccaaatgcgggggggggaggccgaacccgcactcgggagggcggaatgtgcaccgaggggcggggaacacgccccggaagagcctcaaaaaaaaaggcggccaaacaggggcaaaaataaaaagc

SEQ ID NO: 512710 - DNA, 233 bp, Homo sapiens
attcctcgattgtggccacctctgaccgctgcctgtgcccagcgctgcccggaagccatgatctgcgtcattgccaatccggttgattctaccatccccatcacagcagaagtttgcaagaatcatggagtgtaccagcccgacaaaatcttcggtgtgaccatccttagaaccttgtgggagccaacacctttgttgcagagctgaagggtttggatccagctcgatgtcaa

SEQ ID NO: 512711 - DNA, 349 bp, Homo sapiens
ggcactcaagcagatggggtgcaaaaaaaaaaatctacattagaccccttggtgggaaggcttaacactttccacagaacagaaactacaatacccggttctacaattagtcacaaatacagtcctcgagtttttggcccatacacatgagtattggtctaaaacatgtcttcttggtagcagctaggcccggccacccatggtgctgggctgagttcacaaatcgtgtggtaaccggtagtttcccggtcagttctcgggctctcctctccggctaagcttggtttcctaatgaaaatcttcggccattggcatagctagggcggctatggaaacttctaaaactagg

SEQ ID NO: 512712 - DNA, 652 bp, Homo sapiens
ggcctgatgtgcgcgaagtggtgagcgtgggcctggctgctcggagccgggaacatgatggtcgctgggagcactaaggcgctgagatagggagcacggcgcgcgctgcgtcgtgctagccaattgtgtgttgaacactgtaaggccagaaccagagtctcagtgcgttgcactaaagagcggtcggagtgtaaatccgcgcaactaattcgtttccctccgtggacatgtcacgtggctgggcctggcgcatgtccgtcccgctagtcccacgcgcaacgggtttgtgtcggacccttctgggcccttgggcagggcagtcctagttgtctccgggatctcgcgcgtgtgacagcaggctgcctccgcctgctgctctcactatggcccgtgtaggtctggcagtcccctgtgcttggacctggccaaggggcgttctctgaagatgtgttgtcgaccgtggttataattgatgaccatgggtcgtcgggtctccgacgtacagcgagagtgactcctgaaatgtcaccggaccaaaaacgggggccgcccccttatgatgtcccgggggtccccttgtacttcttcgaaaaaccggcgtgacttatagggagggcccgggtaaacttcatccttgatgtgtgggcgttgg

SEQ ID NO: 512713 - DNA, 869 bp, Homo sapiens
gcgagcgcgcgccgccgggccctcgccgcgcggtcctggatatgtcgccaacatgtacatgggtcggagactacgtctactttgagaactcctccagcaacccatacctgatccggagaatcgatggagctcaaccagacggcatatgggaacgtggaggccaaacgtggtgtgcttctaccggatggctgggacatctccaagcagccctcaatcgtccctggccgacaaagcacgcaatgggcgggggtgtcctggctccgatttcctcgggggctggtgaatgaagtcctcgtcacgccccccggtagtggtctgtctctcacgtggcagtcctctgcaagcgttgtcatggtgtggctgggtgtgggcagtcattgatcgaggcttctttttcccttctatgatgacttctggagactttccaggctggtgggaccctgcgtgactgcgacttgccaatgtctctctctttttaattttgcggagaggcttctgttgggattgctgagtagtgttttcaggaaagcagtcctctccttattctttacgattcaaacccaagtttatgtaaccctggctgggaggggctgcttgtggccagcacagcgtgtgggaggaagccactggctgcttgggaatgccctcagccttggggggacccatgcttctcccccgggcaacaggtgctctgcaggtggtgcgatgtctcctgtgccgggggatgttgacttcagagccaggagccagaggcaccccacgccctccgacatgctactgaccagggctgccgagcttgggcccacttgcccagaaccagtgttggtaccccacctgggggccttcatgtgtcggtgggggccggccta

SEQ ID NO: 512714 - DNA, 313 bp, Homo sapiens
gtagacataggccccgatgaagccgactgaaagtcaccaccatgtatcagtgtccctggcgtggtttcccccagcgcctagccacgtctgatcatctagtgtcgaagtcagccacgcatagtgtccgactgcgccttggtagacatacggcagcacagcgtaggccccaccaaaggtcagcaatgctgccttggtgaagaaccagcccatttgggtcagtgtgccttcccagccgaagaggacagtcaacatacccatcggtaaagcccatagcacggcgccggtgagtgcgagcgcggccaatttcaaccaa

SEQ ID NO: 512715 - DNA, 245 bp, Homo sapiens
cgctttgctgtcgtgatatgagacagacagttgcgggggtgtcacaaagcagtggacaagaaggctgcgggagctggcaaggcaccaagctgcccagaaagctcagaaggcgtaaatgaagtataccctaaacctgccaccccaccttaatcagggtggaagaacggtctcagaactgtgtgttcaattggcgcatttaaggttagtagtaaaagacgtggttaagtgataacaatgcacgtaaa

SEQ ID NO: 512716 - DNA, 345 bp, Homo sapiens
  misc_feature (250)..(250): n is a, c, g, or t
  misc_feature (326)..(326): n is a, c, g, or t
aaaataattcaaatattgtttacctgaatagtaatacttgaaaatccactccctatttttataactgaaatcaattctactatagaacatttaaagccatgcaaaaattaaaataatttagttaggcaggacatgaaaataactaaattatatacacaaagtcttctaggagtttgactattacctttatttgctgtcttctctaacaatctggaagtaaagtattgagaaggaaagtgttgtatatatncttcattaagtttccaataaactactaagttaatctaaattaaagaagggaaaacacatgggtttaatttttaagnatgtattttttttaaaaca

SEQ ID NO: 512717 - DNA, 441 bp, Homo sapiens
atcatggaggaccactttctgataggacataaccttatcttctatactgtattcttacccttgtttggcaacaaagccattatgcagggaatattttttaatctgtagtattcaagatgaatcaaaatgatgcgctggtaatacggcaataaggtagcaaaggcaggtgctttgcagacagaatgcttggaacacttgcgtctccctagaggtgaaaagtgagcagaggcccctagaaaccctcctctgaatcctcctaattccttaagatagatgcaaaatggtaagccgaggcatcgcgcaaccgctggtgcgatgcttcagggaaaatggacaacccacgcaagactaatgatcgcttccggttccaacaggtgtcacctacctgtatcagaccagttagactttccatcgccttatccttccatcagttgcctggct

SEQ ID NO: 512718 - DNA, 125 bp, Homo sapiens
gcaccatggcggactgcgagagaacatggcccagggccttgcacgcgcgagactgggtgtccctgtctggtgctcgtcgccatacggcaccgccgtgacctgcggccgtcaaccctggcgtcgtg

SEQ ID NO: 512719 - DNA, 1603 bp, Homo sapiens
  misc_feature (135)..(135): n is a, c, g, or t
  misc_feature (1215)..(1215): n is a, c, g, or t
gtgctggtagtccatcgtcgatggctgcagtattaaactgtcggccaagggctgtctcctttgtcactcgctgtctagtcgcttcctcatcttttctttgtttgtgcatgcctgctgggttcatttcccgacggnctaagcatgagggatcactcagcgctcttgtgttttgggtctctcctctctcttaaggggggagttctcctcacatctgtcccgggccctcccttgctgtttccccctcatatgagacggggtggatgagtcgttctctttagtgtgtttccttggcccagccggggagaccaccacctcgtttggcgggggccccccaatttgctgtggagcttcccccacagagggggcacacaggacagtgtctgatttaaaaaggagaaaagtgtgatgcgccatatttcttatagttccgaataattcttcccaagaaggcactcttgggggagaaaagctttttttgcgttggccaaacttcgtggccacaaattgtggtgtgccccgacgtgggaagaccccctgtcgttggaattggtccaggtggtttataaatccccctcccaaggggaattattcttgtcccacagaaaggggccttttggtctgtagagttttgtttggcctgcctgccaccactgggggagccactccttcctccacaatttggcgttgtgccccgcgttgtacgaagcatacccttgggggacccgttctgcactttataccgcagaattccccaaggctcagcccctttccccggggggagccccccgggccttttctttttggtggtttaacgtggacccccacccagtggcgtgtgaccccaacacacagcccgtctgtctcacgcgggagggcgcatctgtttaaatggttaacacacgtgaccggttgaccccattgcccgctttggtggtgaaccacacagaattcttctcttcttgccgcttttatgttggcacacatttgcgcccatctcctccaaagcgcacacacacacacacagagggagactctctcacacctcagatggggtgtttgatagttggttgtgataatctctgggcctccgggggaggattcttgccgcacatagcggtgcgcgcaccccattgtctcccgtgtaaccacaccccatggggagagtctcaagtcctctggatctctgttacattcttcacacagagagagatctcntggaagagagaaattgaaaaagaaagacccaggctgctgcttggagaaagcgccagtgcacccaagggaggaatattccagggtgaataggacatgctctcccgctcctggagattccacatgcgtacacctcacgacctggaggttcgccagaacatggtctgaagagtgtaccaggtgccctcttgtgccttattctagccaattccctactgaagaactggagcgctccagcctgcccccggaagaacatggtttgccagctccccactgctccaggcccacatgaatgggtaggagccaacccctgactggtcttaagactgtttttgcataggctcttaagccagcctgggaaaatggttgatggaaaataaacatccagttt

SEQ ID NO: 512720 - DNA, 375 bp, Homo sapiens
  misc_feature (144)..(144): n is a, c, g, or t
  misc_feature (203)..(203): n is a, c, g, or t
  misc_feature (206)..(206): n is a, c, g, or t
  misc_feature (209)..(209): n is a, c, g, or t
  misc_feature (281)..(281): n is a, c, g, or t
  misc_feature (305)..(305): n is a, c, g, or t
ttagggtacatcataaacagtgctatcttaatttattgtaacacttacatacttgagtgttgagaaaatgtcatgctaataagatcctttgctgcttagccaagtgtaaatgtttaaaaagaagctctgatatcagtagtatgncaattatcatggggtgaattttgcaggctcattcaggaactgtcgcctgataacactgnacnacnacctccccttcaaggcacaggcctctcattctagaacatcatctttagaatatgaatcggacctttacaggnaccacaagtaggggctagaagaancataatatccattatcatttaattttaaaggttcaacacaccatcaccatttaattttggttcttacctg

SEQ ID NO: 512721 - DNA, 258 bp, Homo sapiens
tggcgaaaccgtctctacaaaaaacacaaaaatcagcagggtggctgggagtagtggctcacgcctataatcccagcactttaggaggcaaacgtgggcagatcacctgaagtcaggagttcaagactagcctggccaacatggtgaaaccctgtctctactaaaaaatacaaaaaaattagccgggcatggtggcacacgcctgcagtcccagctgctcaggaagctgaggtaggattacaggcatgatgcactgcg

SEQ ID NO: 512722 - DNA, 170 bp, Homo sapiens
gtatataaggtctcctggcagcagagattaatttggaaatgggcatgttaaccaatcggggccaatgagatggagggagaaacaaaaaaagacagttgttcttttatttcactgcagaaagaagaagcgatcaagagtctttcttatctcccaccaccatgtatagccat

SEQ ID NO: 512723 - DNA, 1204 bp, Homo sapiens
gcaacgaacatgcctgctggaggctgacatgctacctgcttcagaggatggcggccgcggaggaggaggaaggggagtgagtggctgaggcgggaggtgcagtgagtgtgaccctctgccagtggtgtccactggtgccatagatgtgtgctggaatgatacctggcctggtgccaaacattgtgactactgctgcttcctgtggcctccatggcttgagtgactgtgctggactgcccggccctgtggccctgtgctggaatcgcgcctgcgaagtctttctgcaatgtcatggggccacctgtggacgctcagacacctattaccagagccccacaggagacaggatcctgaagcaaagttgagctgactctatacctgggccctgcgtgtgatctcaccctcttcgacttcaaacaaggcatcttgtgctatccagcccccaaggcccatcccagtggcggttgccagcaagaagcgaaagaagccttcaaggccagccaagactcggaaacgtcaggttggaccccagagtggtgaggtcaggaaggaggccccgagggatgaggagcaaggatgacactgacacagacccagctttcattccctgctccgtgggtgctgtgagaacttgtggaatcagcttctcaggggatgggcacccaaaggcaagggtcaaaagttgtgcaaagactgtcgagcaccatgacgcaacttgcccttcaacccggggagaacgcagcacatgttcaagcgggttgggctggctgggggaacgttgtgcgcccggccaggtagacacgcagcaggtgtatggggcctgggcaccgacacgtgcacaccggacgcggccgatatgtggcaaagcggagggtgcgcgagtagacaggagagagaccgacacccggagcttggtgcagagacgcgcaaagggatagacagagcgagggagaggcagccagagcggactgtgggacgagttcaagttgcaaggagacagcaggagcatgtgtacacacaaaaaaagagacgacccaagacgattcgtagtgtgagtcggtaagaccacgacgaagctgcaaatagatcatgaaggctcaaccaacctggcgccgacctcagtgaacagagagaaagcagcaggcaagactacccgtaccacagaagacatacagacgacagagggggagccggtgagaagagg

SEQ ID NO: 512724 - DNA, 642 bp, Homo sapiens
  misc_feature (223)..(223): n is a, c, g, or t
  misc_feature (296)..(296): n is a, c, g, or t
gctgcgcagaccagacttcgctcgtaactcgtgcgcctcgcttcgcttttcctccgcaaccatgtctgacctaacccgtatatggctgagatcgagaaattcgatgaagttcgtaaactgtaagatagactaggagacgccaggtagaaataatccactgcctttccctataggatatacggattggaatctaggtagtatagcttagtcaggcgtaatcgtnatattgtaggccgtggcgctcgccccatattatggccactgtgactcattgcctatctagctattgcccttcnttattgttacttcttttagctgtttaactttgtaagatgcaatagaggttggatcaagtttaaatgactgtgctgcccctttcacgatcaatagaacttactgactacgaaggccgcgcctgcctttcccatctgtctatcatctggctggctagggaaggaaagaacttgacatgattggatgaaagaagaagatggggtggaagaaaatgggataggatagaacaatgaataatatagaagataaaaccaaagattggaccacaagattattcctgactggttttaatgtctgtttaattttgtgtgaccattttatataatgagcgggatgaacttaataaat

SEQ ID NO: 512725 - DNA, 1195 bp, Homo sapiens
gcagggccgtaggcatgccatggcgcccagccggaatggcatggtcttgaagccccacttccacaaggacttggcatgctgtgctgctgtggccactgtggttcaaccaggcctggccctggaatgactcctgcatgactgtaaggtgccctggcaatgccaatggctgctgcctgacatctgcgtcctgtgccgcctgtgtcggggtcccaataccagagccacatctgttgctgacttgaccccaacggattactgtgtaacccacactgaatgtgtagctgcagccctggcctgccgtgactatcatgtccttgtgacggatgctcaaggtgtgagacctgtgacattccacaaagaaatggttggccctggaaccatacggacatttcttgtgtgatcccagaggagtgcggaaacaagtccacgggagtacccatgcatggccaaacgtagcagccgtgcttgaatggacgtaccaggtcccaaacattacattcctcattcacccagtgaagcacctcgtgaccccagaagaacggtgcagaccagatatcttgcatgcaagaagcatgaacacatggaccaccaccagcttgacctggacgcggtacatgcccgtccgggaacgttcttataaagaaggagaaagctcgagtcactcacttgacggacagagacgaattttcaacgccttcgactagtcatccgtatgtgccccggtgcaaacgcccaggctcttaccggaatacaggggccacacatgatgccaaggaacgcccggacacaaccaggcatggtccgaacaaggaacaaaattacaacgccactcctgtggggaccttggaaatcagtaagagaaacaacagtgagggtgcgacagcaccaaaagattcccacagagaggggacaaagattaacgagtacccaagacttcttgaccaaggttgtgcccacaatctaagtggcaggtcgaaatcaactaaagacaagcgacaggtgccagaacgtataaaaaccgtatcatatgctgttgtaaacccctcatcagcgtgcgacatcatttgttgaaagaacacattaatacggttgcggggccacttgggaacaacacctaagcagtaaccacgcatacgagacttaaatgaggatattgtggaaacaatagaaagtagaatgaaaatgatagcaatat

SEQ ID NO: 512726 - DNA, 229 bp, Homo sapiens
atattcagtcgagccgtgcaaccatgcccggcattgatatgcttttttctcatcgccttctgaaacggatgccttcaacgtcatgagccaactgccctttctgccgttctccaagcccaccattgatgaagccaccatctcggcggtgggcgacgtactgcgctccggctggatcaccagcggggccaaagtgcaggcgttcgaagcgcagctgtcggaatactttggc

SEQ ID NO: 512727 - DNA, 369 bp, Homo sapiens
aagcagtctgcccacgtaggcctcgcaaagtgctgggatgacaggcatgagtcactgcacctggctggaatttgaatttaatataatttttacatgtctcaaaatattattcttcagatatttttaaccttttaaaaatgtgaaattcataggctgggcacagtggctcacgcctgtaatcccagcactttgagaggctcatgcgggtgggtcacctgaggtcaggagttagagaccagcctgaccaacatggagaaaccatgtatctgctaagaatacaaaattagccgggcatggtggcccatgcctgtaatcccagctactcgggaggctgaggcaggagaatcgcttgaacccaggaggctgagg

SEQ ID NO: 512728 - DNA, 268 bp, Homo sapiens
aaccggatatctgcacacacagtatgtaaatgaaagtagggtttaccatccagggcattaaaaaaaattttccttgtcatcgagatccattaaatgatagtactgtatgagaagcatggaccttaagtattaaagatggctatataatcttcttcttcttatttagcgtagaaactagcaacagggaacaaggtaactgaattcacggtccactcgcaggcgcacacgtccccagggatccgagacaaatgttccctgcgtgcggccg

SEQ ID NO: 512729 - DNA, 393 bp, Homo sapiens
aatgtaagagaatgaagaagatattggagacacagcaggttcagagaagtttttgaagagactggtataaaatcagaattcaggtacagtcacatgagtattcaggcaacagcaccaaaatcacatggagcttttgggaagtcagatatgtatatcatctgccagctaaagcaatattcattcaacataaatttttgcaaggaagaatgcattagatgtgagtggatggatctcaatgacactggcgaagactgaaaatacaacatcaccatcaccagcagagttgataggatgctgcagtatgggtacagagaagggttttacaaaatttgaccagacatgtggaagacttcaagcagtttacacaggaatgttttataaactctatcataa

SEQ ID NO: 512730 - DNA, 533 bp, Homo sapiens
atatttacccccgcgaaaatccttttttttttaaccccccccgcccatatacatactttcctctccccccaatcttgttgcctcttctcgaaaaaaaaaaaaaactccccctcccttcttccccttctccctatccggcctatccctttcttctttgcaaaagcttgctccctcccacattggtcggcctcttccttttttgccccccttctttcctaacatccccccttcatttatttcccccccacaacccccttctatctctttctccgggtcctcttgtacaattatttcttcccccctcttctggcttcgcccccccccctctctattcaccttccgcctcttctctttttttttccccccccctcacattctcccggtcccacctctctacatcttcttcttgcgtgtaacatctaactctcctctctctcctcctctcctttcctccctccccttaccttatccttctccccctgcctctctccgcgcgggcaaccccccatacttcactttctcctccccttccc

SEQ ID NO: 512731 - DNA, 110 bp, Homo sapiens
tttttaaaacccattttgttgattgtggtaatttctatttgccctgggcctttccccccccgaacccttttgaagatggacttgggttttatttaaaagttccctttgta

SEQ ID NO: 512732 - DNA, 330 bp, Homo sapiens
aggggtaagttgggggttttcagggagcctgttaggggccccctttttttttttcctcaatttaagcaaaggggtttggcccccattatttcctgggaagccaaaggggtgcctttccaacggcttgggccggggaggggacactccagtttttttagcatggcctaaggtatggggtatgggcatgtggaggccagggtaaggtgaatggggaggctgggaggactggggttgccctttggagcttggtgaggagggggggcctaggggttggggagggccccttttggcaggtttggaaatttcccaataaatccttttgtttattta

SEQ ID NO: 512733 - DNA, 343 bp, Homo sapiens
ataataataataaatttaacggccgcttcgattgggtttgtcatagatagcacttattaaattgaggtatgttcctttggtgtctagtttgtagggagttttaacatgaagggatgttgaattttatcaaaagccttttctgcatctattgagataatcatgttgttttcagttttagttcaatttacgtgatgaatcacataacatatgttgaaccaaccttgcatcccaggaatgaagcctacttcttcatggtgcattggcttttggtgtgctgctgggttggatttgctagtattttgttgaggagttttgtgtctctatgttcgtcgacgcggccgca

SEQ ID NO: 512734 - DNA, 476 bp, Homo sapiens
cccggcgctcgttccccaccccggccggtcgcccatagccagccctccgtcacctcttcactcgcaccctcggactgccccaatggccccccgccgactgctccagtcgccgtgcagccaccgacgccgccgccgtctctccttagtcggcgtcatgacgatccgcgtccaccgtcggccaggtgcgccagaaggtagcaccaggactcagaggccgccatcaaccgccagatcagagcctggagcttctatcgccttcctaccgtttacactgctccatgtctttactacttgtaccgcagatgatgttggcattagaagagcatttgccataatactttcattcacctaaatctcgatgtcaggcgcagggcaaccatgctgacgaaacttgatgaccgcttgccacgcaacctacacgaggtggcaccgcaatcttccttcaggcatatcaaggaatgcagcactggtgcata

SEQ ID NO: 512735 - DNA, 104 bp, Homo sapiens
tttagaactggacatgaagtacaataaactactaacaaacatactaactgctacatatactaactaaaataaattagaatagtcaagttaataccagctaccca

SEQ ID NO: 512736 - DNA, 974 bp, Homo sapiens
caaaatagcttgcctaaagtcacacataagtaaatggtggctcacgcctgtaaacccagcactttgggaggctgaggcaagtggatcatttgaggtcaggagttcaagaccagcctggccaacatggtgaaagcccacctctactaaaaatacaaaaattagctgggcatggtggcatgtgcctgtaatcccagctactcgggaggctgagacaggagaatgcttgaaccaggaggtggaggttgcagtgagccaagatcgctctactgcattccagcgtgggcaacagagcaagactccatcttaaaaaaaaaaaaaaaaaaaagcctaaagctggggatttaaacctgattatgtggggcccaaagccttggctttaaaccaggggttctaaacttaaagggccaataggaaccgctggaggatctggtaaaacgcaaatatgggtagtatagatatcaggtaaggccgggatcctatagtcttaaagggcccccaggtgatgtggatgggtgctggtcatacatactacagtcaccatcttccctttctcctaaccgtattaatttggcagcagaaactacctttcccatgctgctgtgagggcttaatagtctcaaggtccagatgctctccttaggatagactcacattttcctcaaaaagcttatcctgcctgtgttttccttctaggataaacagacattcctgctgtgttcccctacccattagggtacccttgtaagaagcagaacactgattatggcctttttggaaatcttcggcggcatggggccacgctggatcccagaacttggaggcaggggggacacctgaggcgatcaacccgtgcacatggaaccgttataagaaaaatcgcagcgttggctgggcagacacacgaacgaggaatgacgggggggagatcctcacgggcattcaaaacacgttggacgaggctgcgagagctgaag

SEQ ID NO: 512737 - DNA, 124 bp, Homo sapiens
ttttttttttggggggggggggttttaggttttgtttttttaaaaccggcccttttttgggggaccccccccccccaaatttttgccccatttttttggccccctttaaaggtttttttgggga

SEQ ID NO: 512738 - DNA, 315 bp, Homo sapiens
cagcaagaaggagtgacactgggccctgctgtgagcaatctgaaacctcaaagcccacccccagagacacaacgtcctccaagaaggccacacctcctattagtgcaactccctatatgcctttttattcaaaccagaacaggcccagaaatgaatgcattatagcagaggatttgaacttgagctctttcctcaggaagcagcagattcatggagtccaggctatttcttccaggtccccgtattaaagttttctctagcaacatgaagccagttcgatatatcttccttctgcttgcactatagtcactacag

SEQ ID NO: 512739 - DNA, 796 bp, Homo sapiens
agcggagaaggccgcggcccgtgacccggaagagcattctccttagcaactgcgggactgcggcggtcggccgggcctccggggagaaacgcgaatgacatagtagagctgctcaacggcgtggaactctgagctaatgcagtggaggtttctctggatctggagagaagagatgaccttggagccaagtaatgagccatcctgactacagacatgaacctccggtccctggggacccacagaggtgtgtctgctgtggctggtccacatgacgattggtgcttcgccaggtgacaatagagtcacaagaatcaggtccacacgtggggaagaaaaatgagcatatttgaaagcttacatcgtccaacggaggatgtcatcaagaaggctgtgcaagagaggaacactcatccagggtgtatgtgagaattattgccgaagaagtctcatggaagcctctcattgccttccccggatggtgatcgagacattgagatcgatggggaagagctcgtaatacgagaccttaatggggatctggtggtctgtgaaacgtgcttccgcgaggagcatgggaatggtagttaaacacagagaactagtgacaaaggaaacagcaagcttgcgtatgaagtcagaatatgcgcccgtaggaggctctggtgagaacgagcattcttccccgcaaacaggtcccttggaaatagtctcactaattgaacaggtccctgcattgtcattgtcagaagcctcacagtttgattggcccgcgactcacagcaagattggccatggg

SEQ ID NO: 512740 - DNA, 163 bp, Homo sapiens
gaactccagaaatcatcaccacaaaactccactgatgtctaattatttctagagatccgctgcaattttaatacaagcctatgacttgacatctgaagtacacctttcgtgggtccgtcaaagcgaagccccattagaaatgcaaaacataactcgtaccaaa

SEQ ID NO: 512741 - DNA, 167 bp, Homo sapiens
taaagcaccgtggtgtagtatacacgtctgcctgaccaatgcaacatctctatttctattatgtaactcactcagtatccacttatctgaatggctgtaccttcatgcaccacgggcagccaggcactgccatatgctcaacaccagggcacagtgcaaactcatag

SEQ ID NO: 512742 - DNA, 196 bp, Homo sapiens
aagtatcccactgggtaaccgttcttactgcgaagcgtttctttatgactgagggcgatagctgctgtgtcgtggctgttcgcaggtactcgggatccgggatgaaggcgagcttccccctgggtctggggcagtggggagggaaatgaccaaagaagaagagctgcagcttcggaaggaaaagaaacagcagaag

SEQ ID NO: 512743 - DNA, 167 bp, Homo sapiens
ctatatgaattcatactttatcaaagctctctactatatataggaaaaaacgtagtatatatagggtagagatgcgctctagtggtatcaggatagtccactagggagtctatggaactatatcccctagccgatagagtaggtgactactagtataagacagcaat

SEQ ID NO: 512744 - DNA, 110 bp, Homo sapiens
aatagcttgttcatctttttccccaacacttgtttctcctcttcctagcagcttttttattttcatattcctttgggttttcaatgtagaaaataaaaaagctgctagga

SEQ ID NO: 512745 - DNA, 138 bp, Homo sapiens
tgacggagatttatgggtggagttgagggaactggagtggagagatggggtaggtggagttgagggagatggggtaggtggagttgagggaactggagtggagagatggcctgagctggtcagcacatgctgaagagg

SEQ ID NO: 512746 - DNA, 226 bp, Homo sapiens
  misc_feature (10)..(10): n is a, c, g, or t
  misc_feature (45)..(45): n is a, c, g, or t
  misc_feature (83)..(83): n is a, c, g, or t
cggaacgtgntccgcatcggcgtggaagagctcaagagcttccgngacgtacccagcaaagtaacgctcgacgaatgcgtggngctcgccaagcgcttcggcacggatgactcgagcagcttcgtgaatggcgtgctcgataaggtgcgccattcgctcgggagagccaacgactgatggccgccctcgatcccgcccgcaagaaagcctggaaggcggcgctggc

SEQ ID NO: 512747 - DNA, 237 bp, Homo sapiens
ttaacagacctggaacgtgtaggccagtgccatctgagaaccacccgtacaaatgtgtgggggtggtcccttagcaacccactctcgttccctgactcatgtatgggaaaagcaaggccaagaaaactactttcccagagctagtttgaggagaacaagggttagaacctaagggaactaattgataacttactcggggattattttgacaaatctctgcctcaccccaagggaaag

SEQ ID NO: 512748 - DNA, 335 bp, Homo sapiens
  misc_feature (11)..(11): n is a, c, g, or t
  misc_feature (49)..(49): n is a, c, g, or t
  misc_feature (151)..(151): n is a, c, g, or t
aaagtttatgnaatattttagtaaatttgattcaaaagacatttcttgnttatccacattggttctcaaagtgtggtcccgggaccagtgacatcagcattacctggggcacttcattagaaatgcacatttcttcagggcctactcctgnactcccaatccagaaacacagtgtggggtccaacaatctgttttaacaagtcctctggttcgctccagggctccagggtggggacagtcactggtgcttctgctgggctgggacaacagggccccactgtggaacttgaagcctgtgaccccctcctaacggctcctctcagttcccgtggtcc

SEQ ID NO: 512749 - DNA, 744 bp, Homo sapiens
gcgccgcccggccccgctcgactccggaggctccgcagccccggcgtcgccccgctggccctcctccgggggccagtggagggtgcccctgggtctagcggcctcaggttgggtgcatctcctccagcaggctgcctcgcgccgactaccatctccgttccggatgcccaacgttttctgcgccccaagagcaggaataccagcaggacttgttatgcgtggctgtgacggttctatgagcgggccctgggcttgggcctgagccttcattggtcatcctgctgtctacctcatccgctatctgggtggctgacggacccccgaagctccgcaccaggggtaccaagatccccatgcggcccgcggaggacggcgtagcagtacaatcgtgcgaagctgccatgagtcagcccgtatacttatgcacgggcatgcacctggcgatcggcagtgcgggatgctatgggaagcgagatgagaccagttgactcggagcgtggtccgcacagctcgagcgctcctggcgcttgctggccctagcccaagcgcgacaacactgccagccaccacatgtgaacgcacaccgtgggatgttggcgcagacccgggtggatgacggcgcctggcgcaaaagggccggcggaacgctggacaagactctagagacaacgccctgggacggaagaggtgttccaaggccagccgcatgcgggcagcatgggtgagcgtgcccggcccgcaggg

SEQ ID NO: 512750 - DNA, 630 bp, Homo sapiens
gagctcggtaaaccgtcagtcgttacctgcggtcgtaaccgtgatcactataaaaaggcggtagaagaggccgtcagccgccgcatccatcaccgatatggagcatggtcgaacaaatcatcattcccggacggtacatcgactaaccgttgcttcaccattgccgctgtggctaacagaccgtggtgcatcccggtctacaatggtaattcaccaccggcgaacatatccagcgcccacaaggcggtggcggcggtaaaggtaccgggcaaagccggctactctggcgaaggcatggataaattcgtattccagatcactcaggaagaattcctcgaattcatgttcgaagacctcgaactgcccaacctggttcaaacgcaacctgaccggcaccgataccttctagaccgtacgcgcagggaatcatcaacgagggcaacccgtcgcgcatcaacatcatccgcaccctgcgctcagcccatgcacggcgtatcgccctgtccggcagcagtcgcgccaaattctagcaggccaaggaagagttggcacgcttgaagcgcgaagacccggaccacttcggcgatatccaggacatagaggcggaaatccgaaaactcagcgcgcgca

SEQ ID NO: 512751 - DNA, 285 bp, Homo sapiens
  misc_feature (11)..(11): n is a, c, g, or t
  misc_feature (13)..(13): n is a, c, g, or t
  misc_feature (41)..(41): n is a, c, g, or t
  misc_feature (132)..(132): n is a, c, g, or t
  misc_feature (253)..(253): n is a, c, g, or t
acaaagcagtncngacaactacaaaacaccagtaacacatntagcccaggaactgctaacaaacatacagtgcagtggtggcttaagaagttttgcaaggaagagagccttgaagatgagggacgtgatatngggccatgggaaagttgacaacgacccaatttgagagccatcattgaactacatgaaaaatttacagaaggactcagcgttgactattctacgggtcattagggtccgttcagcattcgangcaatttggaaggttaaaaaagcttgataagt

SEQ ID NO: 512752 - DNA, 181 bp, Homo sapiens
  misc_feature (94)..(94): n is a, c, g, or t
gtccctatcttagtcggggttgtgtgtgtgtggctaaaaaggattcagacctagaagtcttggctcttgcggcagaacgaggaagagacagcanactcgcgccttttccacgcagacagggcatcaaggcttggggcgggaggggaacgcgcaggcagcgcctcccagcaggcaaagcaag

SEQ ID NO: 512753 - DNA, 929 bp, Homo sapiens
ttgtggtcaatgagagatagtggctgcaaatgggaatatcctgttgtgggttgtttacctggttggagttgtataatgcgtctgggtatataggtcagataagtgtgggtgtgtgtgaatgatagagtggtgccaattatgttgttgggtgtttttggagacactattttgcgacggttggttggaatgactgttatgccttatagttatgtagtcgtacacttggggttccgtggtgttgggtgtgatgggtgtgggtgttagataggttgatcagtcacgcattatcgggtagtgagtttggtgttcgcattccggtgcgaaaggtgtctgggcttcgtggtgtggtcccgaagttgcactgacccgtgggccccatatctgcctgctttccccaattccgggtgcccgccctggttgcccgtctaccgaagctgccttagtccgtggtgcgttgtgactacccagactgaacttccgtggcattaggctcgcgcaagccaccctggtcccgcttggcaaatggttgaccagggtcacgctgtgctggcgtcctcgtgcttcggctaacgtccgtcagtcccctggcagtctccatgcggtgccaccttggcactctgtgcttcacagcagcccttgttgcacttgaaggaacgcctcgcttcagtgatggactgtgtatgcggatgatctggcctgacgacactgcaagcacctgggtgctgctactggccacacctggggcaagcttcgtccaaggcacaacctgttgatggccatttgctaagacactacatgctacactgactcccacgacactcctggaaggagactgtatcccccccaagtctccctatcaggagttcactgaccacctcgtcaagacccacaccagagtctccgtgcataaagaactcaggctccagctg

SEQ ID NO: 512754 - DNA, 376 bp, Homo sapiens
agctccggggattcacagcaagtgacttggcaataagtgggtgagtggggtcaaggggtggctagaaagggatatagagacgctgtaattatttgacctactttacatcagtgcatgccgggcaaaatacaatgcgtaatgtctactgtcaggcctcagtaatatcaaaaaaggcagatctctaaggatcgtggaaggtcatgtggttgcaagtgaaaggtaattcagctccggtaataaggagaaactctgtctccatctaaactcatatttcagttgagcagtaacattaggtttagtgtcctctcttttttattttttacacttaaaaaaagtttgaatttagtccccatgaacaaccccaaaaaaaattaga

SEQ ID NO: 512755 - DNA, 111 bp, Homo sapiens
caactgtgacaggtcgggaaatagaaaccgtctgaactatctgcacgcatcatcctagtcctcatttccccctctattgatccccacctccaaatatctcatcaacaacct

SEQ ID NO: 512756 - DNA, 851 bp, Homo sapiens
cccaagggctcctcttccgcccacattagtggttctacaaaaacgtactttccccattctataaggagagctatacaccttgtcaaggtcaccccccctaaaaagccgttttcccaattgccttcctagtcccggtatgcccctggttccgagacacacttcccccacccaactttaactataatacctaacattttcaacaaaccctccactggaattatgagaccccctttgaaactaattcctgccccccccctcaatcctatggtccctcactcgcccttccaatccctatcgcactccctttaacaataacacagaacgaaggtccaacagatccccttcccttaaccacgtccaaatcacacttgggcccccccaagggtaactgaagacctattcgagtatcacccgagcttcgcgcggagctaatcttcacaactcctaacaaaacttctccccacttatttcctagagacccggcgaaccttcgaactccttgaacgttgaccaatcgagtatgtaactccccgagttgaaagcccccacatttgtataaatataattaacactcacccaagaacgttttgcacactcacatgagagctgtccccaccacataggcttataaaacacgaagccatttcccggaacgtttataacccaaccaccttttcacccgctaacaccgaccgcggggtataactacggtcacaatgctttgaaattctgtggaggccaaccaccacgtttcatgcccctcgtcctagaattaattccccttaaaatttttgaaatagggcccgtatttaccctatagcaccccctctaccccctttagagcccaccca

SEQ ID NO: 512757 - DNA, 232 bp, Homo sapiens
atacacacttgcaagggaggagatattcctggctgcacccatcatagtgcaaaattttatgacgcaggggcaccaaatggcgtaaatttgaggggatctctcagtgcatagtatttcatggtgtatatgtgccacattttcttaatccagtctatcattgttggacatttgggttggttccaagtatttgctattgtgagtagtgccacaataaacatacgtgtgcatgtga

SEQ ID NO: 512758 - DNA, 285 bp, Homo sapiens
agactatgaggcagactaccaaataagtccaaaaaatatgtgagtcttaaatgacactccttctagtaagagaaagaaccctgtacatatgactcataccccatggctaggccttcactgtggacgcctggcgacagaccgcaggccacctgccttctgtgtgccgaagtgaagcccactgcaccctgcgttggagaggcgctgacggagtgaggccgtgggaggtcgcagctggcgaactccaggtgtgggctgctctagcggctgcttagaattgcgaggatg

SEQ ID NO: 512759 - DNA, 196 bp, Homo sapiens
ggaggctggaatctagctctgttgccagcctgaagtgcagtcgtagtgtatcagtgcgcgtacggtgtgaagagaccaccaaacaggctttgtgtagagcacatggctgttcatatcacctggttgcaggcgggctgaggtcgacaagagagtcagcactgagtggtgggttatcattagtcctgacaggttttgg

SEQ ID NO: 512760 - DNA, 360 bp, Homo sapiens
acactgtagctgtcttcagactacgggtggttgtgagccaccatgttgttgctgggatttgaactcgggaccttctgaagaacaaatcagtgttcttatcccctgggccatctcaccagccggggcacacacattcataagagatactttgctaaagctcaaagcatacaacacaccctacacaataatagtgggaaacttcaacgccccactctcagcaatggacagatcatggaaacagaaactagacagtgacacattgaaactaactgaaattatgaaccaaatggatctaaagatatttatagaacatttcatcctaaagcaaaagaatataccttcttcttagctcatcatggt

SEQ ID NO: 512761 - DNA, 583 bp, Homo sapiens
ggtcgtacccttaaatcctatagatcagtgtctacactgtagttactatttttgagacggagtctcactctgttgcgaggctggagtgcagtggcacaatcttggctcactgcacctctgcctcccggttcaagcaattctcctgcctcagcctcccaagtaactgggattgcaggtgtgtgccaccatggctaattttttgtatttttcagtgagagatggagttttgctatgtcggccaggctggtctcgaactcctggcttcaagagatccactgacctggcctcccaaagtgctgggattacaagcatgagcccctgtgcccggctaggtgatgtatttctgacagtagtccaggcaggtaatgctaaggaccttaagttggtgatgtgatagcatgattgagaaggcagagggagaattaagtttacttaataggtgtctaatcaactggaccttacaagttgaagaaaagattttctggtttgagtacttatgaacactgtgaaactaacgtacctaggggagctcctaagtggagctgcccagtaggcagatgatagcccatttaggggtagacct

SEQ ID NO: 512762 - DNA, 733 bp, Homo sapiens
  misc_feature (360)..(360): n is a, c, g, or t
  misc_feature (733)..(733): n is a, c, g, or t
gcttcttccttctcgcctaacgtctgccaatcatggtgttcaggcgcttactgtggagtgttggccgtgtggtcttatgtctcctttggaacctcatgccggaaacatccggtcgcgatggtaacgatgttattgatcacgaacagggctttggtcgatggaccttgcactcaatgtgagtgagacaggccatgccttttcaagtgcatgcatgtcactgatttcatcctcaagtttccgcacagtgcccaccagagacgtatgtccgacatagccgtggctacgaaggctacgacatctaaatacaatacatggtgcagactacacgagtgcggcccatgcaacgcatttgaaggcctngcacgaacaggacacatgcccacagactcgacagattttgatacgttctataaaggttcttgaaaggcgaagattaatgaagtgaacagtaataatccctaatgaagtctaagatcgcttcaccaaggcagatctccgtgtcacagcttctcccaataaatagcatgctggtactaatgggtactgctgatggttgactgcttgctgctgctggtgctatagtatccaggcagggtaagatcacgcgacgtgagttacagaaggctcgcgagccctagaatgggttgcctgctccaggaacatgccataggccagaaagcagcgcctgtcccaaaagctcagaagggtcaaaaagctccagcccaagaaagcn

SEQ ID NO: 512763 - DNA, 756 bp, Homo sapiens
  misc_feature (690)..(690): n is a, c, g, or t
  misc_feature (727)..(727): n is a, c, g, or t
  misc_feature (730)..(730): n is a, c, g, or t
gacattgtagaaaaagatattaggaatatttccctgctttcagcattttagaagtgcaaaagttaaaaatatataaagtatgaagttcagtgtgaactcaaaagactatagtgctgaaagccacatggtgtgtttttgtcttgtttaatcaactaggcagggggaaaaatctagacagtttctgtactgccatagaattttaagaagtgtcaggttctctcatctgtatacatccctgtgcgcatatattggctcatctaaatattaagaacccaaaaaacattttctaaaaccatttgaaccagcgctgatgtactatatatatatataccctacataaccagccggggaatttccaacacatgccctgaagatctatacatgattgggctctttttctttctttctttctttctttctttctttctttctttctttctttcttttttttgcttaaaaacaatgaagtgtgcaagtcagatttcttaatgaaagtgaatgaatatatagaataatattcctgaaaattccacatattttaattcttggactgctaaatttttcatatgtggccatatatctatacaggtgtttgggtgtttatgtaaatttgccaggcttggtgtgtatgtgggtatgcttctgtaagtatctgtgtatgtgtataaaccatcaacagtaaagtatagnatttgtgatccagccttataagttactggcctcttgnggnaattatccataacaatcttcatgtaa

SEQ ID NO: 512764 - DNA, 398 bp, Homo sapiens
  misc_feature (11)..(11): n is a, c, g, or t
  misc_feature (50)..(50): n is a, c, g, or t
ttcaagtcatnctgggtgcacccagctgctgggaacgctgcttttggagnctcctaccctcaatgaaaatgcctgcaacctgcggggtcccactgcaccccaaaccccgcccgcagagggaagagcagggagggaatcccatcccccagacaacccatgcttgcagagacgaactccgcacccaaccttcaccgtgtctcccacgaccctagttaatcaatttaaaatgaggtcactagggtgggccccaatcccaatatgactgataactttataaaaaggagagatttggatacagaaagagacagagtgaaaaccatgtgaagaaacataggaaaagatggcagctacaagccaaggagaagcttgcagtgtgtattcatctgttctcatgctgt

SEQ ID NO: 512765 - DNA, 336 bp, Homo sapiens
aacgggtgatgcggttgctcacgcccgtaatcccagtgtgtccggaattggtgggttcttggtctcactgacttcaagaatgaagccgcggaccctcgcggtgagtgttacagttcttaaaggtggcgtgtccagagtttgttccttctgatgttcagatgtgttcggagtttcttccttctggtgggttcgtggtctcgctggctcaggagtgaagctgcagaccttcgtggtgagtgttacagctcttaaggcggcgcgtctggagttgctcgttcctcctggtgggctcctggtctccctagcttcaggagtgaagctgcagacagctttttt

SEQ ID NO: 512766 - DNA, 454 bp, Homo sapiens
  misc_feature (122)..(122): n is a, c, g, or t
  misc_feature (125)..(125): n is a, c, g, or t
  misc_feature (167)..(167): n is a, c, g, or t
  misc_feature (187)..(187): n is a, c, g, or t
  misc_feature (191)..(191): n is a, c, g, or t
  misc_feature (196)..(196): n is a, c, g, or t
  misc_feature (211)..(211): n is a, c, g, or t
  misc_feature (223)..(223): n is a, c, g, or t
  misc_feature (241)..(242): n is a, c, g, or t
  misc_feature (249)..(249): n is a, c, g, or t
  misc_feature (253)..(253): n is a, c, g, or t
  misc_feature (255)..(255): n is a, c, g, or t
  misc_feature (260)..(260): n is a, c, g, or t
  misc_feature (263)..(263): n is a, c, g, or t
  misc_feature (276)..(276): n is a, c, g, or t
  misc_feature (288)..(288): n is a, c, g, or t
  misc_feature (308)..(308): n is a, c, g, or t
  misc_feature (337)..(337): n is a, c, g, or t
  misc_feature (359)..(360): n is a, c, g, or t
  misc_feature (375)..(375): n is a, c, g, or t
  misc_feature (402)..(402): n is a, c, g, or t
  misc_feature (421)..(421): n is a, c, g, or t
  misc_feature (438)..(438): n is a, c, g, or t
gctcttgggccctgctcaggccgtttttgctgacttgcctggcttacaataaaagcccaataaatatttgttggccatatgtgttggacactgtggggccctgtccagtcccctttaccaanatnagacccccatccccaactgctttgagtttggggtgcaagtgntcccagcttttgttttccanaaantgganaattgccctcagganatgagagccatntcccctcccccaggagtnncttcctntttncnccccnacncctggttcatttnattaaaacgganaaaactccagggggctatgnctgctttggcccccttgggtcaggccaangtaaactttttttgagccttcnnccggggtaagctctntcccttttttatcctgtttcattcccncccccaaaggggttttccnaataaatccccctgtcnatcccatggttttgga

SEQ ID NO: 512767 - DNA, 1570 bp, Homo sapiens
  misc_feature (1140)..(1140): n is a, c, g, or t
  misc_feature (1327)..(1327): n is a, c, g, or t
agcccgtcgtcgcgccgcctcttgtgtggtcggcgtctgctgcctccccgcaggttgtaagtgccgccgtgtgtccgccctccgttatgtgggtgtgttcgccgagtgtagccccgcgcaatgtatcgccggagatgtttttattgagtggtggacaccccccgccgtaggatgttgagggagccctcttcgtgggaaagggggaggttctgcccacccccccagcggagtgtggtgggcgagcacaccgggataaaagctcctccaggaggcctctcttgtttttgataaataaatccggctctcccgcggcgccccgccggctgtttgttatcgttctattgttaatacccggcggctgtgtcctccttctcataagggatgttgtttatctgtcgctgaagaggccctcctcgtcggggtgtgggcgcggcgacaataattttcggcggcccaccaccggcgaaggaggtgcgctttctgcctccgcggtgaggcgccccccccttcggcgggaagattttaagaaggccgccgcctgcttctgcggcgcccccaccagttgtttcactaatgtactgcctgtccacagcgctcggcggcggttccacagcggttgtgttttctggcggcggtgatgagaatagaaggagtagtttttactgcttgtgttgttgtggcgcgctgtgttgctggcgaagagcccccccaacagcaaggagaggggggttggatgcaaccgcggcgcgtgcgctgccgccgctgttatttgtggagtattgtaaagagccagcttctcggcgtggtagagagaattttttgttgtagtagagtgtagaaatagttttgtaggagtgttccaccagtgtagagaacaaccccgtggtagagcaccccacagcgtcgtagagatgtgatagagaggagatcacgcgcagaacaaaccacaccagctggtcccacaccactgtggaggacccacaacatcatcacacaccagcgcgtgtgtggggagaatggttcgcagcagcgcagcgtgtagagatatcacacacaccatgcctcttataaggagcgcgtgtgtgtagagaaatattgagcccccccctctagtaagagaccaacacgcagagagacacnctcgcgtatcacacagcgcgtgtgagaacacgcgctcgagagtatatttcgcagcgagagaaatataccactcttcgcgtatttttatatatttctatcaccacagcaccacactcttacacctctcttgtgagatacacacactcacactcttgtggtaagatgtttgagacacctcatcaagagntgagaaattattataagaaaaagggagaagactgttgccacaggagaagaaggccacgcaggaaagaaggagaagaaggaaagaaggaacctggccctggcacagaaggaaagaagggggtcctatggccgatataatgttcttctccaaagatttccaaagtcatatgagatttgggatattttttgtcccggttggtgtttgttttaagtccctttttaatataaactaaaatgtgggacc

SEQ ID NO: 512768 - DNA, 771 bp, Homo sapiens
acgagtgggacaggctgcccaaggagagctgaaagtgcttcttaggatatgcatgaaaacaagacttctcatgcttccttgctgttcccgctttaccctccaaagcactgcccgcacccctgaccgcgcccccccccccgcgcacaacacaacactaatggcccggcggaaaagcaaaacctaaccgtggaaatcgtccataatgggggaagaaggaaaacaccgaggaatatccggaaagacttggccacgtgacccaagacatctaaatgaactggaacccaggcattataacaaagcgctatcaacaaccaacaacaatataccacaggttacaccacagcatgtgacacacagtcagtgggacaaaaagtgccacgttgcacaacaattgtgcaacagcaacagtgcaacacaacgacaaggaaaatgaaagtgatatacatcaacacaatgtgcatgtcgaggacaaacaccctctcaaacagcaacatgtggtgacacacacattacaacaaaagattaaagaaatcgccccatcaagcgagatactcaacaaactcaaggaaggacaaagatgtgctaccaaccctcatcgagaacactctatcaaagagcatacgatgggtaagggggatatccaaaatgggggcaataacaccagatgtgttgaagaagacggccataacaaaaaggaacaccaaaaaagccccacaggatcaccccattagggacacggcccccaaaacaataaaagtcaccagtccacgg

SEQ ID NO: 512769 - DNA, 166 bp, Homo sapiens
cacaccaaccccaacatatcatgccaggtgggtgtaagcaaggggacatgcagcatgttggccaggcgcatgcagcatgttggcacagcgcagcatatgcagcatgttggcaaggcgcgcatgcagccatgtatgcgacagggtgtccatgcagcatagttaggca

SEQ ID NO: 512770 - DNA, 277 bp, Homo sapiens
  misc_feature (2)..(2): n is a, c, g, or t
  misc_feature (8)..(8): n is a, c, g, or t
  misc_feature (10)..(10): n is a, c, g, or t
  misc_feature (40)..(40): n is a, c, g, or t
  misc_feature (62)..(62): n is a, c, g, or t
  misc_feature (66)..(66): n is a, c, g, or t
  misc_feature (83)..(83): n is a, c, g, or t
  misc_feature (85)..(86): n is a, c, g, or t
  misc_feature (112)..(112): n is a, c, g, or t
  misc_feature (114)..(114): n is a, c, g, or t
  misc_feature (130)..(130): n is a, c, g, or t
  misc_feature (132)..(132): n is a, c, g, or t
  misc_feature (136)..(136): n is a, c, g, or t
  misc_feature (140)..(140): n is a, c, g, or t
  misc_feature (170)..(170): n is a, c, g, or t
  misc_feature (186)..(186): n is a, c, g, or t
  misc_feature (203)..(204): n is a, c, g, or t
  misc_feature (213)..(213): n is a, c, g, or t
  misc_feature (215)..(215): n is a, c, g, or t
  misc_feature (219)..(219): n is a, c, g, or t
  misc_feature (229)..(229): n is a, c, g, or t
  misc_feature (240)..(240): n is a, c, g, or t
  misc_feature (263)..(263): n is a, c, g, or t
  misc_feature (265)..(265): n is a, c, g, or t
  misc_feature (267)..(267): n is a, c, g, or t
tntatttncngtcatattgccaactggaaagtcaaaattntctaacaactttaagtaagttntttnaagacttagtgctgttntnnatccagtttagaaagtaacttaattntnataccgctactaaaantncganaatntcttctttaatcacattcaatatggttaanagaacaacactaattnacattgcgtgggctttnnctccctttntntaanatgtcatttnttgagcaaganttgtatagtattatctacttacntnangctgttaatt

SEQ ID NO: 512771 - DNA, 181 bp, Homo sapiens
cgccgatattacctctgtggcattctctagatctgctttgtgattctcaaagataatagactggttattcttgttgaggtagaaagcgaagacataagtttacatgagtggcatgacactcgcagaggacatcaactgctttcttcagtaactgcatctcagtccagtacatgttgtgctg

SEQ ID NO: 512772 - DNA, 295 bp, Homo sapiens
cgcttaccagatggtcagattgactctgcggggtttgtttcacacctgcagatggtgggagtgggggtgggctgtttgacgctgtgagggctgctgccgtcaccacgtggccggctcacggggctccggactccactgaccgacgcactcatggcacgcaggcccagcttccggggccacatcatgacctggccgcaagctagtgatacgagatcaggtgtcgtgggtgtgtctgtggtgcgtgcaccgttgtctttacctacggaacgtgcaccagatgggagcatcaagacat

SEQ ID NO: 512773 - DNA, 488 bp, Homo sapiens
  misc_feature (2)..(3): n is a, c, g, or t
  misc_feature (367)..(367): n is a, c, g, or t
gnnggagaccaaggcttctgtatttaggtattgactttatttagtcagaggggagaggggactcacagctagcatgcctctatctgtatcaaacttcacagtcgatgttcaaagaatgaggcctgcgagggggacacgagaaactattctcaagagcaaagcaacaggccttccatgtcaaatcgaaaaatacaaccaagttaagcacaatcatgcacccgtgcacgtccaccccctacccacatattctgatgagactcaacatccagggggagagagaaaactgcgcgagcctggagctgcacgggaatgcggacagagacatcctctccagcagacgccagccaaagtgggtgcaacgggcggngagggcttgaatggttcagcatgaaaatcccccacttgattgtaccatacctgaagcacagcctcagttcctactcatttccaaccaggaaaaaaacatgcattctttagaagctcttccc

SEQ ID NO: 512774 - DNA, 101 bp, Homo sapiens
caattttttaaaaaaccaaaaggaatttgacccggtcctttttctttccacttggaaattttaaggaccaaattaaggccaacctttgcaggtttaaaaaa

SEQ ID NO: 512775 - DNA, 183 bp, Homo sapiens
ctcccaaagtgctgggattacaggtgtgagacactgtggtcaagcaagttagtcttacggaccatctgtgtactatgcacatgctttcataaatctctaatcaagaattagcttttgcagtcttctaagtaagcttacgctttggagattcacagtacgagactagggtttcactacgtgttg

SEQ ID NO: 512776 - DNA, 240 bp, Homo sapiens
tgtggagacggggttcacaaaaaaaacacagaaaaaaaagaaagccacaattggtgcgtgcacttggtatggaaccagttacttctgcttctctagaaggtcccagtgggggaatgcaagcctgtggctgaggtggcctttaatggtgttggattggactcagggcaggacatattcttgagaaacagccaattcaaatgtggtatttctggtctcaaaagggatacagggtatatcccc

SEQ ID NO: 512777 - DNA, 270 bp, Homo sapiens
ttcctcctttctccctctcccctaaagccaaatattcaccaagtcagtactattctaaaactctctttaatattctgtctttatccccatgctgcttctttgtccaggcttttatcatctctcatttagactatttcagtgattttcaatcttgcctttctgtctagtctcttaccatgccccccaacccgcttcgtgcagtctactgacacaaagtgaatttctaaattgaaaatttagtcatgccatttcactgcaaagaacaaatca

SEQ ID NO: 512778 - DNA, 136 bp, Homo sapiens
gtgggtgtacaataagaatgcttaattagggggggtgtcgattcacatgaacaacaacctatgtagctgttcagccaaacttgacccggacgagtgggcgagagggagggggagggaggtgggggtgaggtgaggg

SEQ ID NO: 512779 - DNA, 429 bp, Homo sapiens
  misc_feature (257)..(257): n is a, c, g, or t
  misc_feature (324)..(324): n is a, c, g, or t
  misc_feature (342)..(342): n is a, c, g, or t
  misc_feature (368)..(368): n is a, c, g, or t
  misc_feature (382)..(382): n is a, c, g, or t
  misc_feature (415)..(415): n is a, c, g, or t
acaagtaattttggaacagaccatacctgaggtaaggtagtgagcccacaggtgatgtaccacattatgtggcacaaaaaggatgagagatctctagcaaataaaagaaagaaggactcaaaatttgaggaaagaacaaaaagaaggagaggcaaacaatgaatattttgcctctcccttcctctaaattcaaatattagggagattaaggcacaaacaaggttccctctatttttcctatttgcttcacgttgtgngtagggaattatggatattgatccaaggcaagggtgagccatacactatttaacaagtctggggaantgttttatgggtctggantacattgttttattttgttaggagcnggatattaaaaacnggggtaatgtgtctccaggtttaaaaataggcnattttcttaaaaaa

SEQ ID NO: 512780 - DNA, 137 bp, Homo sapiens
acctccacctcccaggttcaagtgattctcctgtctcaccctcctgagtagctgggactatagggcgagactctgggggttcattcaccatctcatgtctcttcacagtcaaaggctcttttctagttctagatcgc

SEQ ID NO: 512781 - DNA, 139 bp, Homo sapiens
tggtcttgaactccttattcaagtgatcctcctgcctcagcctcccagagtgctaggattatacatgagagccactgggcccagcgtcatttggtttgtgtgtgaagatagggtctcactatattgctcaggctggtct

SEQ ID NO: 512782 - DNA, 171 bp, Homo sapiens
aaatacaaatctacaactactctgtagtactaccgaaatacaagcaccattgacgcaagattctttccatgttcgggagcacctacatctgcgaacagctgttctccattatgaaactgagcaaaacaaaatactgctcccagttaaaggattcccagatgggattctagt

SEQ ID NO: 512783 - DNA, 340 bp, Homo sapiens
gtcggacggcagcgcgtgccccgagctctccgcctccccccgcccgaccagcctgagtgcagctctgagccctagttcctgcgtgtgcccagacatgcagcgtcctgatgagcatgccccagtatgcatgcgccatggccagggtggaacgcctacatcgacaacctcattgctgacgggacctgtcatgtgacgcggccatctgtgggctacaaggactcgccctccgtctgtgccgccgtccccgggaaaacgttcgtcaacatcacggtactgcgaggcctgcgcggtccggggcactgctccggtttggaccctgagggagggacttgggtggggt

SEQ ID NO: 512784 - DNA, 524 bp, Homo sapiens
aatccacaaacaggaaagaaatactggtgagttggagaaactggaacctcctatactggtaacagaaatggaaaatggtacaaccactttggaaaacagtctgatagttcctcaaaaagttaaagatacaatgactgtatgactcagcaatttcattgctaaagtatatatgcaagggaaatgaaaatgtatgtccatgcaaaaacctgtacatggttcacagaggcgttattggtaatagtcacaaaaagtagaaaggacccaaatgtctacttactgatgaatggaaaaataaaatgtggtatatctatacaatgaaatatcatttggtaataaaaatgaagtactgatacatgttgcaatatgtatgaaccttgacattatgctaagtgacagaagccagtcacaaaagaccacgttatcatttcctttatatgaaatatccaaataggtaaactgtatgaaacagaaagtagattagtagttacttaggactagggtagttggaggggtgcaagctaaaa

SEQ ID NO: 512785 - DNA, 312 bp, Homo sapiens
acacgtttttattggcacaaagagagtgctgcttttggagccagaagtgtcatgtgtgacttatggtgactagcttaagaaccagatctgctgtcagaaagggcacacctacacgcttagagagccgatgtcttattagagcgcaggttgcgcgtcgtgatttgcgaactaacagtctccaaacattgcagtgcattgaaagtttcatccgctttcgcatataaagattgttcccatgtgagagacttgattctgacaatagcgttggagacgagcgtgagagctacagtgtgagattcagcatagccatct

SEQ ID NO: 512786 - DNA, 780 bp, Homo sapiens
tgtcgtgtggttagtatctggcggatttgtgtggtgactgctgataggaagatgtcttcaggaaatgctaaaattgggcgccctgtccccaacttcaaagccacagctgttatgccagatggtcagttgaaatgatatcagcctgtcgtgagcttacaaaggaaaatatgtgtgttcttctttctaccctacttgactgttcacctttgtgtgccccagcggtagatcatggcttgtcagggatagggcgaggaagaattgttaacagaaatctacaagcggtgccaatgtgcattggggtgtcattcctggtgggatatctactactttcttgtacatttctcagacattggagtcaatagttactaacctaaagtaaactacaggagggagcgtgtgacccatgaacgattcctttggtgatcatgacccgaagcgcaccatgtgctcaggatacatggggtcttacatgggctgctgaaggcatctcgttcaggggcctttttatcattgatgatgagggtatccttcggcagatcactgtagatgagctccctgtgtggcgctcgtgtggatcgagactttgggactaggtcagggcttccggttcacgtgacgaaacatggggaagtgtgcccagtttggtggaaatctggcagggatacatcaagctgatgtcaaaagagcgaagatattctccaagacagaagtgagcgctgggttgtaaagtgcaggctggggggcagcatgaaacaaacctctttggatttttttccataa

SEQ ID NO: 512787 - DNA, 577 bp, Homo sapiens
tcacaactaagacgagaaatgaacaggtgagcagacctcagtctcaggccccctccgaagtccgggcagcctcattgctttgacgcagccttggtgcgaggatggtaccaagcagagcacgttaattgtgcgagatgggacatgttagtcttcacttaaagctacagcagaggtctgcactcctgttatctcgcttcactctctatctattctccctcagtctcaatacatcattcaatcgcaaccctctggccttgttttaacttaatgtgtttagagctaaaaggcaggaaatgaaaaaaggaatggctgggggagccctgagagaggtcgcatcccatgtgaggaagatggtagagcaggagctaagtcggaggagaggagagccacttcctcctccaacacagcatggtaacagcacatggcaactggatcaccctgtgcatatactccctctccagtatgcccacattttaagtccccacgactgtactcaaaagctgggccagctgctgataagggtataaagaacactcagcggtacacgtctcctgtcctgggcaccttttcaagtatt

SEQ ID NO: 512788 - DNA, 294 bp, Homo sapiens
gcgtctgaggatcccgtctgagcagctgggaaaacggggatgagggttacttcttggatgtgctgtgaatacacaccctttcattcctcttgttgcaaaagaggattcagcctcgctggaggaaaatatgaaaaaataaactaaaactttttttccaaactacactcagattctaccttgtctttcgtgaaggggtaaaataaaaccgtttgtcttagccacacctccgtaattggatgaaagacaggggagtgtattagtttggaatacatttctgaaagcaagtatacatgt

SEQ ID NO: 512789 - DNA, 459 bp, Homo sapiens
tcatggaacgtgacacaatgaggactggcaggagaaacagaccagagagaggtctggagttaacggctgttgtctatcagatagcccctgagctcccacactagctctgccctagaaccatcctctttgaacctttacccaccctgaggccagaacttgcaggccctctgcagatctcctctggccactgtagcccctccaatgggcttcttctctcatgcattccctggcgctggaggcgtcagggaccccacatcctccctgctcctcagactcacagcccctccatgttacctcccgcacctcctccctggggcagctgctccctgggcctctgaggatgtcagctcctggctccctgcctctctcccactccactcctggctcagtcttagagatttctatgccctcatggattctacccctgccttcctggcctcttgattcttggcttgcctc

SEQ ID NO: 512790 - DNA, 427 bp, Homo sapiens
acaaacaaaaagctcaatagcacctgagtttcgcaaagatggagttgctgcagtgtcttgaactaagagagcagaagatcactgcttaaaaaaatgttgagtttattctcacaaaagatttctaaggatttaggtaatgtgtctttaaagctccaacaaaccatggaatcaacttgggaaggaggccgaattagcctttgttgtgtggttgaaagcaaattagtgctttcagaacactggtaggggctgttgaaacagacatctattgttcaaagttttcttttcccttcaagaatggtattttgttgaattccaggaagccagtttgacttcctctttagaagaaggatttctgagacacattcaagtgattaaattcaaagcaaattgtcaacatcacaagggggatgcaatgttgcatctttcg

SEQ ID NO: 512791 - DNA, 2514 bp, Homo sapiens
tgctaaataaagtgaaatacccaacctcagccgtgtgactgtcctgaggggcttgctttgctttctcttctaatgacttccagcccgccagtgctttagagctttcagctcgtctgctctgacctgcagagtcccggaggatgggatgggttgccctgtttcccagctggggacacacggctctcagaggtcaagtacagcttgcccagtgtcacctggcaagtgatgttttggggatggggccctgtgctgtctcccacatgctctgggcctctgggtaaaaggatgggtggtaaggggcaccacgtggaggcttggctgggcaggcgggtacactgacggggaactccggggggctctgggatgatgtgcaaggggctggaggatggtgggggtggttgtggcagtccctttggggcacctcaggggacaaagatgataacggggagtggaggaaaggcagcagctgaaggcatggcaccacccccggcagcttccataatcgtcgcccccagctgtggctgcctccacctcgcgccgtggagcagcatgtcccgtcccgtcccaagccacccctctggctctgatcccaactctagccctccttggacaccttgctgagccgatgatcttgtcttcctcgtccccttcccactccccgttcagttgcatttgaatctcccaccttagaagccagccgtccctcctttcagcagccaggcttttggtaattaacactatcaaacagattatcattgcaaaaaatatagagagacatgagtgagagtaaggactttaccctctgtctctcattctccagagctcttcactggtccactgtcacccgcctctcgtgtcctctgtgtttcctccttcaacaggttagacgtctagagattccacacagtgactgagaggttcgagtttgtgctgctttcacgggtttgggagcctgttcgtgaagcctgaagagtaatcatgatcctccttattgaagtattttattaacacttttcccaaagcagttcctttccttgaaaaggtagcagatcgtgtgtttatgacaggccctgcttcggagcgattgaggcacataactcatttcatccacgacgctcacctgtcaggtgctggagggctttaggccaggtgtgtagagccgaggcccagagacgagctctccacggctgctacaatcacgtcatcggcaccacgctcaccaggcttcacctttaatttttggctctaaattggtcttcaccgaattcctgaattactaggccaattagtgtcccatactagatggttctcagccttggctgtgtattggagttccctggagaactgagaagagcctgccttcttctccagttctggctgagtgtgtcaggtggagctggggcaagggtggcttcaaaagcccctgcagtggttttaacaggtacccaagcttgagcacaagacggagttagggcccatgctgtggcagcaggtgttaaaggtcccacgctgtggcagcaggtgttaaaggtcccacgctgtggcagcaggtgttaaaggtcccatgctgtggcagcaggggttaaagtgatcgtgccggtctctacttggctgtcacggtgggcacccctttccattggaacatagccttgttgtacctaagaaaagttgattgtttcaaaattcatacctagaggtgcttccctagaacgatcgatgtgtattctgacatccgcatttcacacacgcaggaccgtgatgccatagtctatgtttttgccatgtgtgtctaaaaatttgaggtatttcatcatacaaaagttaaacgtgaatgtgtggctatggacctgccgtgcgacgtgagaaatatcacggacgcacttggatccctctgtctcctcctgccaaaggtgattgctgcaggatctgactttttgtgtctgtctgaaaatttttaccacagggatatgtatctctacatacattgtattgttttgaatttctgaagactaagtggtacatggacgtattcctcaacttttgcaattcagcatggttggtgagtctttggattacatgtggctcaagatgggtgtttctcactgtgaggtatgaacagactccagtttctccattctgctgctgattggaggtggtttagggcttttgctctgctacatgatactgctctaagcactcctggatgtgtcttatttatttatttatttatttatttatttttgagacagagtcttaaactctgttgcccaggctggagtgcagtggcacagtcttggctcactgcaacctctgcttcctgggttcaagcgattctcctgtctctactaaaaatataaaaattagccgggcatggtggcaggtgcctgtaatctcagctacttgggaggctgaggcaagggaatcgcttgaacccaggaggtggaggttgcagtgagccgagaccgcgccatccattgccctccagcctgggggacaagagcgagacttcatctc

SEQ ID NO: 512792 - DNA, 270 bp, Homo sapiens
tttttttttttgggggggtgaaaaaaggagaaaacattttagaccccaaaggtgaattcctgtttttggcaaatgcctttggaaacagcgaggaaacacaaaattcgtgccctgaggtttttctatggccacttggggtaaacccccccctgggggtaacttttgcttattttgctggacagttttttacataaagcaaagggcatgtgaggggtgggattccttgttactcttactgcaataaaaatcaattgtttgaaaaaaaaaaaa

SEQ ID NO: 512793 - DNA, 353 bp, Homo sapiens
attactgcgaccagtgactgggggattaatgaaatgcattttgaaatgcattgccaggtatctctgaatagacgtaaaatagtatcatcttgtttgaaatttgcttttccttaattaggaacaaagctgacccttccatatgcttattaagtcagttgttgctttttttcctctataaactgattgtgtatatgcttgcgcctacttttcctggtgagtttatctcgtgacttaggaaatatgtgaagtgaatttgccttattaaaggaaattaagtaccttactgcacatattacagatattttctccagtttgccattgattttgatggtgtttttactccatagattttg

SEQ ID NO: 512794 - DNA, 162 bp, Homo sapiens
aataagaatgacagcctgaacagtagaatggccagacaggagaaaggcatatacacgacacatccccccacatgcacatcagccacagtctgattatcatggacagcacattgcaattgctgcatcgctgggaattagcccacatacatatctctggcacca

SEQ ID NO: 512795 - DNA, 382 bp, Homo sapiens
  misc_feature (190)..(190): n is a, c, g, or t
cacgaggtgttttgttttgtttgagatggagtctcgctctgttgcccagggtggagtgcagcggtgcgatctcggctcactgcaacctccacctcccgggttcaagcggattctcgtgcctcagcctcctgagtagctgggattacaggcatgcaccaccatgcccggataatttttgtatttttagtanagatggggtttcactatgttggccaggctggtctcgaacacctgacctcgtggtccacccgcctcggcctcccaaagcactgggattacaggcgtgagccacccggcctggcctagaatgacttttaaaagataaattaaatcaggtcactcctttgcttacaacgcagtgcgttagaggtaacccatgtct

SEQ ID NO: 512796 - DNA, 341 bp, Homo sapiens
  misc_feature (1)..(1): n is a, c, g, or t
nggcccgtacatctggatctctgaggtagtcacaagactgggtagtcacatgggtagtcacagactgtgactacccatttgtgaaaaaaaaaaaaagggggttcctctagaattcaactggcgggattgaatgttgggaatgggcggttttataaaaaggtagaatttgtgtatgtaaattttatgtatatatataaaagataatatatacaataacatacacacatatataaactagtagtctcgctgatatataatacacacattataaacttatttatatataaatatctatggaacaatagctatcacgtactttctctaatctgggtagtcacaga

SEQ ID NO: 512797 - DNA, 157 bp, Homo sapiens
  misc_feature (144)..(144): n is a, c, g, or t
cggaccgcagtcatgcttcataaagtgtttttttctcctcctctattgtgtagacttttagctactgtgctattcattttccagaatgattcactcattccatccggtctctcccagtttaactttcttgggtgggttttcttnggcattattggcc

SEQ ID NO: 512798 - DNA, 443 bp, Homo sapiens
gtcagagtgaactttggggatgtccaggtttggttgaatcactgtgggaggaatggaatgccactttgttagagtctgtctcgttcgctgtgatcgctggcatccatgctattaggtggtctgttgtagaggtcacccctcctgtaagaaggtggtggtcccttggccaggcacggtggctcatgcctgtaatcccagcactttgggaggccgaaggggtggatcatgaggtcaggcattcgagaccagtctggccaacatgatgaaaccctgtctctactaaaaatacaaaaattagctgggcatggtggcgggtgcctgtaatcacagctactcagcaggctgaggcaggagaatcacttgaagtgggaggcagaggttgcagtgagtcgagattgcgccattgcattccagcctgggcaacagagtaaactccgtctcaa

SEQ ID NO: 512799 - DNA, 144 bp, Homo sapiens
  misc_feature (100)..(100): n is a, c, g, or t
cgcgccatctctgtttatttctgtaccttcacagtgaagtgttgtgatttttttagttttaaatggttcaatcggggacgcatcagttggtcaaaaattncctttaaagcacttatttttattgtgacatcatcaatttgcaaa

SEQ ID NO: 512800 - DNA, 270 bp, Homo sapiens
ttagaggatctcggctagcaagcttgcaggttggaatttggcagcggggcgaaggggttaggaggttggaggtggacctcaggaccgttgggcgtgcttgggcttccagagggggttaatgataccctttaatgccttgtgttgtgaagcagactgggtctctggtggagggcatcctgggtccgaggggagatgggcgagtgctggtgggcatgggagtgggaggcggggcggttgctgctgcccccacccccgccgctgctgccgctg

SEQ ID NO: 512801 - DNA, 327 bp, Homo sapiens
aatgctggcagaaatgtggagcaagcagaaacccttcttcattggtgctggcaatgcagaatggtacagctactttggaggacagtgtggtggtctctcataatcctaaacatactcttagaatatgaaccagcaacactgctccccagtatttacacagatgggttgagaaacttctgcccacaaagaaatctgcagcgtgcacgtttatggcagctttctttatcactgccaaaaacttggaaggaaccaagatatccttcaataaatgtcttactacattctggtggttgtaacaaaataccatacaccgcgtagctgaggcag

SEQ ID NO: 512802 - DNA, 258 bp, Homo sapiens
gctgaggctggcacgctggttaattctgcttcacaatgatcggaacgagcccgagcatcgaacgatcataaagcgacttccctattaacgctttgtccgcctcgatccctagttatccccttttgtaacttttctgtcccccacatgcttaaaacccaaaaggtcagaaggatcgtgaggccccgctttcacggtctgtattcgtactgaaaatcaagatcaagcgagcttttgcccttctgctccacgggaggtttc

SEQ ID NO: 512803 - DNA, 266 bp, Homo sapiens
tttttttccccggggggccctttggggggatttggggggttaccagggggttaatagggcccccccccccccccccccttttaaaaacccccttttttgggggttttttctaaggggaaaaaggggggggggggttgcccaacccccccccccccccctttttttggaaaacccccggtttttttttttttaaaaacccttggccccttttttttttgaaaatggggttttttttttaaaaggggggcctttgggggcccccccca

SEQ ID NO: 512804 - DNA, 973 bp, Homo sapiens
gcacatagcgctcggatcaaattatcctgtatgttggtgacctaaagagaattacggttttcattcatttcatttcccccgtagcaagatggaagtgagaaaccgtctgagaaaatgaaaacatccttaaccactatctttccctcccatatgattattttatgtcagaaatttgcaaaagtcctgtctgcctccttctcttccttgtggcttaactttttaattcatgccatagtgcaggatatccaattatgtgcatcctgtgaataaaccacgtcttggtcactgtcatattttgaaccatctcatcagaggatgaataagtatctgtgttaccagagagagaacgaatgtaaggcacatgcccaagttaacaaagaaaaaatgtgctcaaggttgtcctttgggttaaatctggcccttccttggcaaaagcacataaattctcgcgccctgagagctcaacatcgttcgaaaagtacaaccagcaggaaaaatgggccaatctgccagtttaggcgttaccagcatataatttttaatatctttacttctatcatcccaaatcaagagaactcttctctattatgtataatcaattgcgagcaaatagatttttcttgtaacaatctgtctgccagaaggtgttttcacttttccttgtcttttgcttctttctgtcgtttgcctttctctttcgtctggagaaatcacttagactctgtgtgcttcttctaagttgattactggtctgctatgttaactgctaagctgttcctagggagcccttatggattgatggatgtgggaacttacacttcacttgacgaaagcaaggcctttggaggcccactgaagctaacgcgagtgtgccaaggaagggaagcattcaggtagtcccccaacgggggatcagacaaagcaacccagaggaaggctgcgcacaagaggagatttacacggacggccaacc

SEQ ID NO: 512805 - DNA, 215 bp, Homo sapiens
ctggccagatatcggcttgatagtgactctagtaactcctggtacctgcgtcatgacccagctttggacattgccttccgtgccttctttcactccgactctgtgtgcttgtactgactggttcttcatcgatttcatgctgctgccgccagctgggcttgttgtgtgcttgcctgggtggaactcctgttcttcaagctctggtacttgattca

SEQ ID NO: 512806 - DNA, 822 bp, Homo sapiens
  misc_feature (788)..(788): n is a, c, g, or t
agggccactgtatacaagtaggaacttccgggtccgtcacttccgcttttaacccttagtcagagcatctcagccgtttgatacctcgattctctcctgcgttggacagaggcttggtggcagtgcacagcctgattgcttacgacttaccgtgccatctgatccgcgccttcaagatggatggacagtgtagcttggctatttgataggagtggggacatgggtagtgggcattctcctctctacccagggctgcgctgatccccgtactgcaacgtaactgttgccccgccaagcccgaaccacccaggttgaggagttgagagagtgcaggctggggtcaggacagcgctgcggatgctgtgtgcctatgggtgagttactccggacccacctatgtctgtctaatcgtccatggcctttgcaaccaaaatcgctccaccgcctgccaattgcggatggggacatgttcaccagccgttgtggtaacgggatcaacacccataaggactggtcgccagtagtctatgaggtagccgtagccacgcctctgccgttgtacagtaactcccgaccccttacaggatcaggcaaagggaatagcacctagaaccccgtgcggtagggaaagaaaggagggacaaaccataaaaggaatacttataatgagaaggtttgtaaatagtccatgatgaagtcgcggcagagtctgatttctatatagaggtgactttttatttaagtactgtgcaagctctgtgcttctataatgtgggaaatggcttggntaaatcgcctgcggggagcatgtaatggatagtc

SEQ ID NO: 512807 - DNA, 281 bp, Homo sapiens
tgtgcgatagatagttttatggaaattcattgagcggacacattgaatatgtgcctctgctatagaagctttgacaaaattattatctccatgtgatattacatgaccatgatccagtgattcacgatgcattactcactggacccctagggagccaggcgacatcgagtcccacccaacaggattaatattagtctagcatgcaggagtatttctcaaaaattacccaaggcataagagctcttctagagccatttgtaatacatacagaattccacgag

SEQ ID NO: 512808 - DNA, 576 bp, Homo sapiens
  misc_feature (10)..(10): n is a, c, g, or t
  misc_feature (94)..(94): n is a, c, g, or t
  misc_feature (128)..(128): n is a, c, g, or t
  misc_feature (141)..(141): n is a, c, g, or t
  misc_feature (182)..(182): n is a, c, g, or t
  misc_feature (210)..(210): n is a, c, g, or t
  misc_feature (259)..(259): n is a, c, g, or t
  misc_feature (339)..(339): n is a, c, g, or t
  misc_feature (346)..(346): n is a, c, g, or t
  misc_feature (354)..(354): n is a, c, g, or t
  misc_feature (369)..(369): n is a, c, g, or t
  misc_feature (391)..(391): n is a, c, g, or t
  misc_feature (423)..(424): n is a, c, g, or t
  misc_feature (436)..(436): n is a, c, g, or t
  misc_feature (443)..(443): n is a, c, g, or t
  misc_feature (561)..(561): n is a, c, g, or t
ctggcctgtntccggcccggggctcccggcgggtctcaggcggcagggacaatggcaaggccgctcaccacttgaggaagaccatcccggccangacggtgtagcccagcaccaggaagaggaccttnagcagacggtcantcttctcctccagctccttggccaggatctccaggaaggtnatgaagaggaaggtgccgcccgccaggncctgcagcagcacggacgccacgctgcccggcacgccctgggcgctctnaatgcccaggcccaggccgatgcccagggggatcatggcgctcacggtgaccgccagcttggccgcgtcccgcagggcantggcacntcgggcantgcatgattgcccangggccacggccaccaagatgtnttgttgacaggccacccccgacagaacaggcnntaccacatttcntcccccntcctccctgcgaggccccagggcccaggcccctctaaaggaccggagtggggccggacagcgccgaaggcccagggcttgacgcacggcgcaccggggggtgggcgcgcgagacggcncttgaccgctcacgg

SEQ ID NO: 512809 - DNA, 728 bp, Homo sapiens
  misc_feature (25)..(25): n is a, c, g, or t
  misc_feature (81)..(81): n is a, c, g, or t
  misc_feature (94)..(95): n is a, c, g, or t
  misc_feature (107)..(107): n is a, c, g, or t
  misc_feature (109)..(109): n is a, c, g, or t
  misc_feature (126)..(129): n is a, c, g, or t
  misc_feature (138)..(138): n is a, c, g, or t
  misc_feature (143)..(143): n is a, c, g, or t
  misc_feature (146)..(146): n is a, c, g, or t
  misc_feature (174)..(175): n is a, c, g, or t
  misc_feature (180)..(181): n is a, c, g, or t
  misc_feature (183)..(183): n is a, c, g, or t
ccgccatggccgacaaggaagcagncttcgacgacgcagtggaagaacgagtgatcaacgaggaatacaaaatatggaaanagaacaccccttnnctttatgatctngntgctgacccatgctctnnnnctggccccngcctnacntgcccagtggcttccagcatgtaaccannaccannangggaaagcattcccacgccctccatccgccctcgctcctgcgcggcacccaccaccctcgcccctcgccccccccccactctcgctccctacgccacgtgctgcccgcatcccctcacctgccctgcctgccctcccgctcccgccctgccgcctctcccaccctcacccaccccgcctgcacgcaccccccgccgccccctccccgcccgcgctccaccgcccctccgcccccgcctggcacccacaccatccgccccacctacgccacccaccccacccgccaatcaaaccccccacccgcccacacgcggcaccccacccgcctcacccacaccccgcgccccccccccgccccccctcactccgccccccccccccctcccccccccccccgccccctccactcccgcacccccccccgcacctcccctcacccccccccgcaccgcctacccctcccgccccccctccccccccccacccccccccaccccacccccacccccccccaccccacccttccccccctcccccccccacccc

SEQ ID NO: 512810 - DNA, 872 bp, Homo sapiens
tttgtgaggaggttccctcgctctacggaagattgcttcgagcaatcactatgtctaaacaggcaacatcacgagtgttgccctatcctgtcataatgaggacacgcatcacgcgctactcaggaattcacttgcgaacaatgcgtagaaagacgggccaccagttcgtacccggttggcaattacgcagggttttgcatctacccttggtgtgcatatcgcgcaaggttatataaactcgacagagcagtggttaccattactaagagatgctccactatgcatcctgatccatgatgcgtgctggcagcccaacggcgttagtatgctaggacgcagagtgacttgaccggtagtgcgcgctattccgatgctatcggggcaattctgatgctataatagcccataaggccttatgaacgaaggagatgctagtcttgggtcttgtccgcgaagagctccgcttgaggtagcatcgtcgttattattaaatgttaccctattatggttcggaaataaaagctagacttctggtatgggttttacgataggtcaacatcggcattttgacactattttggcttcccatttcttgcatggcttgatcttgcttaggtggaccgttgtttactaagctgactagttttcactagctaggtcattcacggcaggtcaagtctagttagacatgtcaccttggtgtcacttgctggggggtttggaatggtccacgttctgtaattccctaggatgatcgtggtcctttcaaggttcccgggccggccaagggtctcctgttgctgcgactgttcgccctccgggcttgggaagagcccaatgccccggtcccctccggcgccttacggacggcg

SEQ ID NO: 512811 - DNA, 140 bp, Homo sapiens
gggtgggcggcggctgtgcgggatggtcgcctggaccttcccaggtggactgggtgggcggccggctcttcccagggtgggccaggtgggcggccggctccgcaggacggtcgcctggaccttcccggggtggactgggt

SEQ ID NO: 512812 - DNA, 1198 bp, Homo sapiens
gccggagccgcggcgggagaggaacgcgcgagtcgagcactatgggaagtccaggtccggcgagtccactggtcggtggaaggaggaactgaaatgtgtgataagttcttggctctacgtcctcctcgctggagctttgtgacgccttgatgcgagatgggactgatttgccggtgggtgtcggggctcagcttgtcctgtagtcagaccataatccatggggctatgccctgagctctacgtgattgtccagtggtcagtcatcgcagtgggtgttttcctcttcctggtggctttccgttggcgcttgctagcagggagctctgcaagggagaactattgtcttatgatcacgtttgccagtcttactagtctctcatcatgtaggtggaggtagtgcgcagcacatgtgcatggcatatgtgttcagagataaggtgatgtccagacgtcgaaataagcaaacttccaggacatgcagcatcggacgaatctgagcacgcggatggaagaatgcaacagtggacttgtctcatcctgggtgcagcgatgcacgggcaggaatgtaaccctgctagtggggattggtaaactaggagaagatttggggagaagcatcccttaccatgtcgaagaaaccgaagtaccgcgactctgtgcctgcattaatcgttaacttgtcgggcttgtggaaggaattaactttttcaacacgagaaaggcgaactcccaatacaaggagggcatgtgatgaaagaagcacttggggcggcctgggcttgacggcacgaaccactggttagctagggaatgggtaagactggacaacagggaacccattggataatgtgcccgatttgatcagaacgagatctttgggggcaatttgggtctatttggtccaatgtcatgcacttcggatgccacagaagcgaatcccaggcaaacgttggcgcaataccgacggggtgaagtggcataggggaggccaacagggacctacagcgcaagtgcaccaccccacaaaccgggcggagaaaagggacaaaaaacgtgaaccaaaccaaagggcgatgtgccaaaagtgacagaacgacattattactggaagtacagaaacccacacgaagacacaaaaaacaacagaacaacgacgcggaggcagacaacatacggggagtcgagggaaacacagtaa

SEQ ID NO: 512813 - DNA, 454 bp, Homo sapiens
ctattcagtgactcacttgcgtcattttaacaagtggtgcacatgctggagatgctggccttggtgacttactactcataggatgttttagttttatgataaaactaactggcctgacagaaacagcaatgaactaaaatccagatgaaccaagtactagcccctgcttcattatttggcagttaggtaacaatggaaaagttcccttttttgtctcaattttcttctatataaaacaacataataataatgctttgttgatatataacaggtctgaggtaagatgtgattgtcatttgtgtataaaagcaaaccctcagaaattcttcctacaaaatcaaagtcattactttaaaatatatacacattatttgttattgcagagtattaataagtttctaattaatgcatcatataaaaatcagcttttatacatgggcttttagattagaat

SEQ ID NO: 512814 - DNA, 283 bp, Homo sapiens
cttttgtcgcacgttgatattctctacaaacccaccaagcacatgggcaacactcatacctattatacggcgcatgagctggagtcctaggcacagctctacgccatccttatacgagccgagctgggccagccaggcaaccttctaggtaacgaccacatctacaaggttctcgtcaccgcccatgcttttgtaataaatcttcttcatagtactacccatcatcatcggaggcttaggacaactgactagtacccctaataatcggcgcccccgatatggc

SEQ ID NO: 512815 - DNA, 679 bp, Homo sapiens
gggggaaaaaaattaaaaaaaaaattttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatttgggccccctttccccccaattttttaaaatctcccaatttttttcttggggccccaatttggctctctttgggaaaaaccccccttagggggcttttttaaaaattatggggccggtttttaaaaaactgggctgggaaaaaccccggggttcccccaattaaaacctcttaaagaaaaacccttttcccaagggggggtaaaactcaaaagccccccccctcaccccttttcaaaaaagggccccccctttaaggcgcggggaaatatgggcgcgtaaaattcttggaaaaaaaccgggaaaatttttggtaaaacaccctttttttttcaccaataggcccaaaatggaaaaaccctcttaaaaaaaaaaaaataaccccccaatggggcgtgtggattttcccattttgaaaacaaaagccccctttttaaatcggcttcccaagctaaagggggtcctctttattagggccgtcccccccttcg

SEQ ID NO: 512816 - DNA, 333 bp, Homo sapiens
atttttttttaaggtaaataacaacataatgccacagggctaaaggcatttatgatagaatgaaaaggcagccaaattaatttacttgagaatttagccaagaatggattttaaggtacttgaggtaattcgtttcccaaagattatgattttaatgtctttgaaggagatattttatcaacccaaacagtaaaccctgaataaaatgacagttgggtctctttttgggaggtcaaagggagttcctcctaaatgggaccagtttaaattttacccctccttcaaaagattggtcaagttgaacatcctcaataaatcctatggctggtccca

SEQ ID NO: 512817 - DNA, 412 bp, Homo sapiens
cacaaaggatgcttagacatattacaggctgcctaaggtagcatctgtgcccttgtagggacacaatgttgtacattcatccctgacaactaccagaacataacgacagctttacaagtggtgtcacgggagattaaggtgattgagagccttactgaccaccccctgcagagatagtatgcatctctgagctctggtctaagttgggctctcataatcatagatagcatagcaggaatgttagtagtaggttggtgcactctgtattgtggcctataagtccagggtgcttccctatgtgctcaggtccccactaagaggatcctctcggcctagggagtggagcataaggaacatggctgcactgcagccaagcagtcataggccgaggtaggcatcctttgtggcagca

SEQ ID NO: 512818 - DNA, 228 bp, Homo sapiens
cgttagcgtaatccgtttcatccccaatacaacgcgcgaggaccgtgtgccatgcctgctgccacttcgcttaactttgagacaaatgatactgtgttaccttctgttgacgcatataaaatattaattttgaccatgaccctcttatcccttgtaacgtgatgtgcttaaatcgagcaactttcacactcgttcacaccagattccttggtgattcatccgaaaatt

SEQ ID NO: 512819 - DNA, 319 bp, Homo sapiens
tcccctcttttttggacacagagtaaagaggacaaataggtgaattaataaatgaaaggctggaatcccacttccgccgctgtcccagagcacagcagcaggagggacaggaggcagccaaccacccacagagatgaaactcacccataaccactgcactgactggcatctctccacggtaggaagagaggagcaggcgaccatgcgccagtacgaacccgcctccaaaccccgcttttactgttcgggatgcaccatagactttcctgcatcactctgacttgttgagtacattgggatcagtcttgtgtaaactgat

SEQ ID NO: 512820 - DNA, 341 bp, Homo sapiens
  misc_feature (103)..(104): n is a, c, g, or t
  misc_feature (136)..(136): n is a, c, g, or t
cccccccccgagttttttttggttttggggttcccccccccccccccgcttgttttttggtcaaaaacccgtttgggaatggggcaacccagggggttttttnnttccccccctttttcctcccaggagtgagganaccccctggggcaggggtccacccccccccccttgttagggcctgtttgggaatggccttccccccccaaccagttaggccccctatggtttttattagggttggaacaaaaccccccaaaaaattttttcctcccccccccttcccttatgccgggggccccaggctgatttttaggcccaaataaaaaagggtttattccgga

SEQ ID NO: 512821 - DNA, 178 bp, Homo sapiens
tcaaaaactaacggagaagtcagaacgaaagaagccagacgcatattacatgattacacttatatgaaatatccagaatagataaatccacagaaacagaaaacaggcggtggatcaccagtggaccagtaggtaagggggaaacagagaaataatcaccatacgggagtatagaagt

SEQ ID NO: 512822 - DNA, 166 bp, Homo sapiens
caggtgggccaggcgggtctcgatctcttcacctcgtgatccacccaccggggccactcaaggggctggggattacagggtgtgagccacggcacccagcgccagctcggtcctttcatttcagggctctcggcccccatttaagaaccaaatcaagccaaatccg

SEQ ID NO: 512823 - DNA, 494 bp, Homo sapiens
actatggaaagaaggaggtaagctctatcaattgttctaagctgggtgaagcctaatgtagatggtgatgaagtaccaggagaggaatccaggaggaacatacttggtggggcagatagagtggagtctatagggaagggtctatagagatgtccagtaggtaataccaatcaacaactatgtggatgggcagaggagtcatccagccggggctcggcgggggagctgggggggctgggaatagaggtcctccctggctcagggttgtaggggcgggagtccaggcgggatgtggatcttccccatttcattatctcaaatgagcaccagccttgggagaagtcaagggctttgggagctgcaagcagcaccgggtcagcgccaaaactgggaggggaatggaacacactaaaagtggtaaaactggacagaggagtgacacacaattttctaaagaggtggccggtccccctccctttcccttactctacttt

SEQ ID NO: 512824 - DNA, 335 bp, Homo sapiens
aagctcggcaccgtgtatcagtctgactgcagatgattgccggacgatctgagaatacaagttataattaattaaatttctgcggagaagttgtaaattcgtgcgcttcattgttgatccaaacttttacttctaatcaccttccccatttctagtacatctactctaccttattttccactttgtctttcgcatctatctattgaagttctgacttggattgatagtccttagagccagttgcattgttgcgccattcgcgttaagttaaccgctgaatgttttagaagaatctggccttagcttattgcctacgcctgccactatgcaccatg

SEQ ID NO: 512825 - DNA, 212 bp, Homo sapiens
aatgccagtcactaggccatctatatcagcgctctgcaagtgtctgggcctcgtgctcgcgtcctcctgtgatcccaaggccacgggtgggttaatggcttgatagccggactcctggcccagaagacgttgacaatgccgatgggacaaatccagctcttctctccaagggcatgcttggaggtgacgatggcatgacaatggcatcccta

SEQ ID NO: 512826 - DNA, 386 bp, Homo sapiens
  misc_feature (29)..(29): n is a, c, g, or t
aaattacttccctggtcctgacagtcacntggggtcccccctttccctggttccaccttttttaggaggagcctggagtcaggggtgggttttggattaacccatccttcctagttaacccctttttgtttttaatttatttaaattttgtttgttttccccgggggggggttttccaaatttatttacctctgtttcccctttttccttttttttttaataaaagagcaaagcttttttatttactttgtaatttaaaaaactgaaaaaaaaaaactgaagaactttggggggaattttggacttttttcctgggtaaaaattggacttttttgagctttatcgtggttgttaatttgaagtaataaagtagaaagataaagtga

SEQ ID NO: 512827 - DNA, 108 bp, Homo sapiens
ggactttgcgcttcagaggctcggacacgccgccatccagatgtcgatgttgttgggcgtgccatactgctcgatcagtttcctcgccaatttcaggttcctcagcac

SEQ ID NO: 512828 - DNA, 405 bp, Homo sapiens
gctctattctactacggcaccttattagactatgaatagggacggctagctaaacccgactcctactaccaggtgtcatcccctggtaaagagagcgctagtatacccgcacgcaccgcagtggtagactaccgtagtacccgtgatacaggccctatatgactagtacgccccgtggtacccacaaacgagaggaactactagatacaaccgccatgtgagaactaccgcacactagaccaatacgatagtaggctatacaactgtagaggcacacacgatagacactagtacccagacgctacctacatagccaatagaggtaactacctaatgagcgaacacagacgaagcacgaatagttagataacgaccctactcaggcaccaagataccccgaacctg

SEQ ID NO: 512829 - DNA, 570 bp, Homo sapiens
  misc_feature (13)..(13): n is a, c, g, or t
  misc_feature (24)..(24): n is a, c, g, or t
  misc_feature (37)..(37): n is a, c, g, or t
  misc_feature (49)..(50): n is a, c, g, or t
tggcctaatttgngctgacaactnttagaaaccaccntgggcttgtaannaaaagcagtgacgccgagtcgattagcacagccgacagccaggagacaggcagcccagcgtgacagtgcagagagctgaacgtgatcggactgactggactgctgctcagtgtctgcactcacactggaccactggagactcacgggctccggcagtcggctgcttgggtggatccgggtgcccgaggggctgtgggagggccggggctgactgtcccccgatggctgtcttcctcacggcggggctgaccctgtgtccacgtgctaatctggagggacgccccatctgcctcctgccctgccgcactccggggagcggggccttcgttccagaggacgtggctgtgacagcgtcagggcttgtggtggtcagcgatcccatccatggggctgtccatgcactccagcacacagcccgggaccccgggggccactgggtgacagtgggcaccttcctgtctccccgagggctggctgtggatgccctcaaccgcctcctggtgacggactacttgcctgg

SEQ ID NO: 512830 - DNA, 242 bp, Homo sapiens
gcttgattgtaccggcacgcagtcctcgctgcggattggatcacggtgtacgtcgggacgagcagagattgtggggcgccccagcacatgccacctcgtcctcctccttgagcatctcatagttggggggctggccactgttgacaggagagaagaaggtttggacagtgtgattcatggtgtccagcgaagaccagcggcggtcgggttactgggatggttctcccccggtacatgcaagg

SEQ ID NO: 512831 - DNA, 1278 bp, Homo sapiens
attcctacaagtgcaacgcggaggagcacgtccgtgtcactgaaggggcgttttcagatcaactatattcacaagtgtgtgtgtccaagagcttatcaaggctggaaggtggccagttatggcctctgtgtgagtgagtagtctcgctggactgaggaacagcatgcgttgatccccaatcgcgtgtgggctggtgcccttggacgggcgcttgagtccttcaatcgtccatcatcggccttaccatcgtctggcaggaagagggagtcacgcaggcataccaggacatatctacgccttggtgcacgcagggcacagctaggcttgcagggggcctctagtttcctttgtctcttgcgagctataggggtcctagtccgaaggggagagagcaccactatatctgggcataaggtaatctcgacgattcttgcttcgattccaatggttgaacgtttcacttctttgccaggccattttaacctaattgcaccaaccaggaagtagactaattcggaacattgacggctgtccaatttagtgcataagctggggttcaaaccttatttgcgggcattaacctggggcttaaaacaatttacttatttatacccataacgtagcgaatcttctgacggggctgccaggcgctgcctcctactcctgcagccggagcgtttggcgaggttgcccggacgtggttcctccttgaaagggggggcgttggaccgatggttgccccggcgttgcgttcctcctagaaaggcgcccgctagccgcgggagtatgcccccggggtctatcactccatagcggcgcagagtttagtgggcatgtgcacccgcgtgtgacctctccttgcacggcgccgctacgtgcagactcaccgcggtaccacaccacattaaagaaggcgaaaattgggcaggagtcttcacacgcgccaccaaacacaaccaagaaaacgggcgtgttggtaaaactggcacgaggataaaccatcattaagagagggaccgtctcaagaggagaaagacaggaacacccacacaacatggggggatcgccgagatcacatgcatggcgcgaccaaatcgaagagagacgccgcacgagatcgagagaacgaccaccaccacaacacaccacacgggggacacacagaagcaaataaaacccctctcatcacaaacgggggaggaggaagaactcatcgtacagccatcccacacacagacagagacatgcgacacaaaacggcaacaccactccaggagg

SEQ ID NO: 512832 - DNA, 170 bp, Homo sapiens
  misc_feature (19)..(19): n is a, c, g, or t
  misc_feature (81)..(81): n is a, c, g, or t
  misc_feature (116)..(116): n is a, c, g, or t
  misc_feature (127)..(127): n is a, c, g, or t
  misc_feature (169)..(169): n is a, c, g, or t
gtgcagctcagtgtcactnaggacagcttctgctgctgcaagctcagcgccggtggggctgtgccaccacccagtcctggnatctttcctccctcagtgaacatggtgatcaaggntcggccctcanatgggctgggcgtgccgtcctccagcagcggcatggcttccna

SEQ ID NO: 512833 - DNA, 602 bp, Homo sapiens
gagtgacatatatcgacctaagggaaaggggaagagcaacagtaactccaaagtgtcagagagatagttaacattcaaaaaactggttttcacatggaccaaagagatgtgccatataaaaatacaaagcctctggtcatcagcagccgggaccactttagaaatgaaccagttcatggcatgctgaagcgacatggtgggtcaagaaaccagtttctggcatagcgctataggtagttactttggcttgctctgagagactgcagataataagatgtaaacatcaacacctcgtgaatacgatgtaacttccatttagctatagcttaagtcagcatgacggtagataaggatagcagcaaacaatcatgggagcttaatgaccatgtttaacaataattaccagggcctcccttctacttgtgagttctgaaattgtccttttaatttgcagggataccgtctaatttaattatatgatctgtctgcactcagtttatgccctactcaaatctcagccccatgtggtgctttgttatggtcagaacctggtgagttgttttgcacagaactgtgtttccccttcctgtaaggatgtcgtg

SEQ ID NO: 512834 - DNA, 4720 bp, Homo sapiens
  misc_feature (3015)..(3015): n is a, c, g, or t
cccctccagagcgttgccagagccacaggaggcccagaagctggcagcagagcgggcccgggcgcctgtggtgccctacggcgtggacctgcactactggggccaggagctccccacagccgggaagattgtcaagtctgactcccagcaccgcttctggaagcccagcgaggtggaggaggaagtggtcaatgccgacatctccgagatgctccggagccgccacatcacttttgccgggaagtttgagcctgtgcagcactggtgccgtgccccgaggccagacggccggctctgtgagcgccaagaccggctgaagactttccacagctgcccaagaccttccggctccagaggagggacggagccatccccacgtccctgtggctctcaggacgccctcctctgaggggcgcgtgattccagtgccctttccatgggaagattgttccacgggacgacgaaggacggccgctcgacccggaagacagggctcgtgagcagcggcggcagctgcagaagcaggagcgcccggaatggcaggaccctgagttgatgagagacgtggaagcagccacagggcaggatctcggctcatccaggtacagcgggaaaggcagggggaagaagaggaggtaccccagcctcaccaacctgaaggctcaggctgataccgcccgcgctcgcattgggagaaaagtcttcgccaagtaagagtggctgctgggtcacctcccaccgcgtggcccccccgtgtgagggtgttcgaggggggccatctgagcgccaagatattccagggacttggggcctccaggggctcccctgctttgagttcccctgggggaccacccagcctttccccggggaggggcagtgccagccagcaggggcagcaggcaggtctgctcaggaacgccccccagcattccccaggataagaggggctcgaccgccaggcaccgccatcctcgcttcctgggggagccatgccaggacacaggccttggctggtgcagagtgagcccctcgtctctcccttgcctggctgtacccccaggtcagtgcctgcgtatttctgcagcggtgacttcagggagggcgatgactgcaaaggcgggcagaacgggggtccacgcgtcagccccagcagagcccagccccagcatgtcttctcggagcactggctctgggaggctggcctggtgtctctgcagcccagcatgggcctgtgtgactggtgaggacttggcagggccagagtgcgaagcccaccagcccggcgtccctgcgtgcagtctgtcagctggggcaccagccactcgcacggccttgtgtttctgtcttcatattgccttgttctcgcctaagaaaatccagaatgcttgtttagaagccacctgaggctgttgactccctcccaaatctgtgtcaagtccctgctggtgcaggtttgtctggtagcaccagtgaggtggcccccacccatcgccatcccagaaaccctcccttggacacacctggaaggtgctaagtgcaccgggcagaggaggcccctcctggccagcatgaccgtgcaccggcctgagtgggctcgggtgggaggcgccttcacagcactcagaccaggcttcccccaggcttgtgggtggtacatccacagccttgcttgggtggggcaggggcgctggtgggggctgtggagaggctgcctggggcccctggcacagggctggacccatcccgtatgccagccacccaaggcaccttagcccttggagctcagggtgaggctgttttcccgtggatcagccaggggcagaggccagccttggtgctgatgcccaggaggaggaatggccagtgggcccatgccaggcctcctccctgtgtctcatggggacactgaagcccatggcaggagctggctcttcgccacagctgtgtggcccagacccctccctacagaaaggatctggggtgaccacaggcaaaaccctgcctcgaggggcccccacagcagcgcctggcagccccacaggggccgcagctgagcggcagcttcaccacattgtggcctcaggccctgctggctccacagctccacaccctcgtgggtcgcagcagctgagctggtcagcacagcacacctcatcctgctccccggaatgcctgcctggcccgtgccccccctgctgcagccctccaggtttccagccctggccgtggagccgtgcgtgcagcagcgggcagggctgtcctgacgcctcctggctgcatctcctgcgaggccgctccccgggaggccaagggggaggctgccctcatcctggagtgcgggaggccacgggagaagtgccaaggtggggctggggccaccttcaccgcgcagaaccacccgccgcagactccgcttctgggacctggggcggccctttctaagcctgtctgtctcgggccagggccaaggggcccgtcgcccatctgtctctgaaggtggcacccacaggcagtctgtcagtgtccgagggcagcagttgccccaggaccagtgcctaactttggtgatgccgccactgggagcccaggcccctggcggaagcctcccaggtcacatcttgccttgtttccccacagggcagctgtgcggagggtagtggcagccatgaaccggatggaccagaagaagcacgagaagttttcaaaccagtttaactacgcactgaactagagagcggggcccagtgcactggccatcagcactttctccctctgccagtgtctcaggacagcagagtgggcgtgggtctgggcagtaaccatgctttgtctattactgtgtttgatgtaaagaaatggtgtgttgcaatgccctgaaggtacggccgctctgctgctacagggttcggcatcgtctggtgatgggtctggcctcgcagaagaggccctcgggcctggagatgtgaacacaggcagcgaccctgttccagagggcttctgcgagtcctcgtgagnccagtgcttgtcgtggtgtggggttcagcacggacggaatgtgtgtgcagctcagccttcagagcgtgcattccccagccaggaggcgaccactcagaggaactctgggaaacccacttttgtgcaaatgctgtttttaacacaaacacaaaggctagtgaaccgttcagtcatctgctttctgtttctggatgtgccttttcatacatgtgtcctcttgtccctggcttcttacacttggcgttgtttttaaggtttatccatgcagttcccctccaatgtataaaacaaaggaggtgaaaacctgtccatgcggaagcttgtgcacccatgttcacagcagcattggagaaggataccgaacatcttctcgtgggcttactggccatttgtgtatctcctttggagaggagtctattcaaacctcttgcctatttttaattgaatgatttatcttgagttgtaacagttgttttttttgtttttccttttagagatgggcttttgctcttacccaggctgagtgcagtggcagaatcatagctcagtgcagcctcaaactcctgggctcaagccatccttccacgtcagcctcccaggtagctgggactacaggcacacaccacaacacctggctaattttttaaattttttgtagagatgaggtctcactgtgttgcccacggtgatctcgaactcctagcctcaagcgatcctcctgcttcggtctcccaaagtgttgggattacaggcatgagccaccactcctggccaggagtttatatgtatactgtggatactagatcctcatgtgatttgcaaaaactttatttatttatttatttatttttgaaatggaatcttgctctgtcgccaggctggagtgcaatggcgtgatctcggctcactgcaactaccacctcctgggttcaagcgattcgcctgcgtcagcgtcctgagtagctgggactacaggcgcgcaccaccacgcccagctaatttttgtatttttagtagagacgggatttcactgtgttggctgggatggtcttgatctcttgacctcgtgatccacccacctcggcctcccatagtgctgggattacaggtgtgagccaccgcactcagctgatttgcaaaaactttcttccatactgttgtttcactttctggatagtgtcctctgaagcacaaaagttaattttgatgaagtacagcaatttatctgtttttttcttttgttgcttatgcttttgctgtcacatttcagaagccatcacctaatccaagatcacagagatttacacctagtttctaataagcattttataatttcagctcttatgtgtagatctttgatccattgtgaattaagttttgtgtgtggtgtaagagcccacattcttttgcatgtggatatccagttgtcccagcaccatttgttgaaaacattatttttccccattgaattatcttcgcaccattattgataatcagttgaccaaaaatgtacaggcttatttctgggcacttgactctattccattgacctgtttaaccttatgccagtgccacagtgccttgatcagtgctgctttgttgtgagaagttttactttgttctgcttcaaggctgttttgactcttctgcatctcttgcatttccaaatgaattttaggatccactcatcagtttcttcaaaaaa

SEQ ID NO: 512835 - DNA, 213 bp, Homo sapiens
gggcagagggggtaggcagaatgactgcaaacagaccaaacgcgatggacgcgcatgagagccatgaggaagcagaaggaagacgaaggcagctagggcggcgggtacatggcattcttaggcttgtgaagctctcacccttctttgtctttcttgattacatgctttctcttctccccctgtatgtgctgtttatcccgtttctggctgtgt

SEQ ID NO: 512836 - DNA, 2022 bp, Homo sapiens
  misc_feature (45)..(45): n is a, c, g, or t
  misc_feature (317)..(317): n is a, c, g, or t
accactgattaccgaatttcgagctccggtaacactggagggcanggacacttggccatcagcactttctccctctgccagtgtctcaggacagcagagtgggcgtgggtctgggcagtaaccatgctttgtctattactgtgtttgatgtaaagaaatggtgtgttgcaatgccctgaaggtacggccgctctgctgctacagggttcggcatcgtctggtgatgggtctggcctcgcagaagaggccctcgggcctggagatgtgaacacaggcagcgaccctgttccagagggcttctgcgagtcctcgtgagnccagtgcttgtcgtggtgtggggttcagcacggacggaatgtgtgtgcagctcagccttcagagcgtgcattccccagccaggaggcgaccactcagaggaactctgggaaacccacttttgtgcaaatgctgtttttaacacaaacacaaaggctagtgaaccgttcagtcatctgctttctgtttctggatgtgccttttcatacatgtgtcctcttgtccctggcttcttacacttggcgttgtttttaaggtttatccatgcagttcccctccaatgtataaaacaaaggaggtgaaaacctgtccatgcggaagcttgtgcacccatgttcacagcagcattggagaaggataccgaacatcttctcgtgggcttactggccatttgtgtatctcctttggagaggagtctattcaaacctcttgcctatttttaattgaatgatttatcttgagttgtaacagttgttttttttgtttttccttttagagatgggcttttgctcttacccaggctgagtgcagtggcagaatcatagctcagtgcagcctcaaactcctgggctcaagccatccttccacgtcagcctcccaggtagctgggactacaggcacacaccacaacacctggctaattttttaaattttttgtagagatgaggtctcactgtgttgcccacggtgatctcgaactcctagcctcaagcgatcctcctgcttcggtctcccaaagtgttgggattacaggcatgagccaccactcctggccaggagtttatatgtatactgtggatactagatcctcatgtgatttgcaaaaactttatttatttatttatttatttttgaaatggaatcttgctctgtcgccaggctggagtgcaatggcgtgatctcggctcactgcaactaccacctcctgggttcaagcgattcgcctgcgtcagcgtcctgagtagctgggactacaggcgcgcaccaccacgcccagctaatttttgtatttttagtagagacgggatttcactgtgttggctgggatggtcttgatctcttgacctcgtgatccacccacctcggcctcccatagtgctgggattacaggtgtgagccaccgcactcagctgatttgcaaaaactttcttccatactgttgtttcactttctggatagtgtcctctgaagcacaaaagttaattttgatgaagtacagcaatttatctgtttttttcttttgttgcttatgcttttgctgtcacatttcagaagccatcacctaatccaagatcacagagatttacacctagtttctaataagcattttataatttcagctcttatgtgtagatctttgatccattgtgaattaagttttgtgtgtggtgtaagagcccacattcttttgcatgtggatatccagttgtcccagcaccatttgttgaaaacattatttttccccattgaattatcttcgcaccattattgataatcagttgaccaaaaatgtacaggcttatttctgggcacttgactctattccattgacctgtttaaccttatgccagtgccacagtgccttgatcagtgctgctttgttgtgagaagttttactttgttctgcttcaaggctgttttgactcttctgcatctcttgcatttccaaatgaattttaggatccactcatcagtttcttcaaaaaa

SEQ ID NO: 512837 - DNA, 832 bp, Homo sapiens
cttatacagggcccaatacgctcactgagtctcaattctcagattcaggtgatcctccccccccgccctcctgagtagctgggactacaggcgtgctgccaccacacctggctatttttttttaattattatttttttgtagagatggggtctcactttgttgcccagcctggtctcgaactcctggacttgagcaatcctcctgcctcggcctcccatagtgctgggattacaggtgtgagccaccgcactcagctgatttgcaaaaactttcttccatactgttgtttcactttctggatagtgtcctctgaagcacaaaagttaattttgatgaagtacagcaatttatctgtttttttcttttgttgcttatgcttttgctgtcacatttcagaagccatcacctaatccaagatcacagagatttacacctagtttctaataagcattttataatttcagctcttatgtgtagatctttgatccattgtgaattaagttttgtgtgtggtgtaagagcccacattcttttgcatgtggatatccagttgtcccagcaccatttgttgaaaacattatttttccccattgaattatcttcgcaccattattgataatcagttgaccaaaaatgtacaggcttatttctgggcacttgactctattccattgacctgtttaaccttatgccagtgccacagtgccttgatcagtgctgctttgttgtgagaagttttactttgttctgcttcaaggctgttttgactcttctgcatctcttgcatttccaaatgaattttaggatccactcatcagtttcttcaaaaaa

SEQ ID NO: 512838 - DNA, 322 bp, Homo sapiens
  misc_feature (168)..(168): n is a, c, g, or t
  misc_feature (259)..(259): n is a, c, g, or t
  misc_feature (261)..(261): n is a, c, g, or t
gctcgacctcttcggcaccaccgaccgcgacaagtacgagcgtgaactgctcaatgcccgcaaactggctgaagccttgttgcaggaaaagaccgccactgaagtcgcgctgcagcaggcccaagctgaactgagcagcgcctatgaaatcgcccagcgccgggcttnattgccgagcagatggtcgcgattgtcagccatgacctgaagaacccgcttaccgcgatcaagatggcctcggagttcctcgcccgtggcngncagccgccaaggagcgccaactcctggggcatatcggcctgtccaccgaacgggcgtcgac

SEQ ID NO: 512839 - DNA, 309 bp, Homo sapiens
  misc_feature (154)..(154): n is a, c, g, or t
  misc_feature (177)..(177): n is a, c, g, or t
tgctgtaacctctttcagcagtatgttgtggcacctggttcagtcaacgtgctgagtgggagggttccattataggcgaaatacacagtttacataatttcatgaagaaagatttcttacagttaagcagagtagtcaggatatcgtgtacatnatccatttgatgtagaagttganttttatgatgtttagaagctgtaacaattaggatggaagatgattctagaaaaattcatacattccagaaatactattgtaataaaagtataaaatttctataataaagaggaagtaatcccaaaaaaaaaa

SEQ ID NO: 512840 - DNA, 224 bp, Homo sapiens
taagttcatgtatggctaatcaagtacctgccatcagtcacttgtatgtcacacaacctcactgcttactagaaaatgctaaacactggaaacaatggaattaatacataggttttcttacattcggacagatattcttcagacagttaaaactgccttccacaaaatttggtgtgtatatggcacaaggtgacagccaaaaagtgtgatcgtatcttgcatgc

SEQ ID NO: 512841 - DNA, 117 bp, Homo sapiens
aagatggggacagatgtgaggagagctcagagcatggtcacccaccgccccaggctatatcagatagtcaccaccaccccgccatcagtggagattacccaggaaaacatgtgagca

SEQ ID NO: 512842 - DNA, 331 bp, Homo sapiens
attcactcacttccttaatgattgtaaaatacagtcccgatctgcaaggttgcttattgtttcaaatccagtgcatatcttgacctacgtggcttgagtaagataattggttttcccaatatccgtgttattgcaagtggttgctatctggattcagcccgattccgttaccttatgggggataggctggcgagttcacccttttagctgtcatggctgtgtcctttggtgaacatggagattccagtgtgcctgtatggagtggaatgaatgttgctggtgtctctctgaagactctgcacccagatttagggactgataaagataagga

SEQ ID NO: 512843 - DNA, 228 bp, Homo sapiens
ttttattttttccccccccccccttttttattgccccaatcctaccataaggttctgtttgcctttaaaattaaattcaaagccctttggaatttggggaccaaaaaattcctttcctttttaaaattttaaagcccgttttttgttcctaaaatttccttttttttttttttgggccccttttttttttgaatttaattaaaagggccattaaattttttttcttta

SEQ ID NO: 512844 - DNA, 344 bp, Homo sapiens
  misc_feature (31)..(31): n is a, c, g, or t
  misc_feature (46)..(46): n is a, c, g, or t
  misc_feature (63)..(63): n is a, c, g, or t
  misc_feature (70)..(70): n is a, c, g, or t
  misc_feature (158)..(158): n is a, c, g, or t
  misc_feature (193)..(193): n is a, c, g, or t
  misc_feature (215)..(215): n is a, c, g, or t
  misc_feature (217)..(217): n is a, c, g, or t
  misc_feature (266)..(266): n is a, c, g, or t
gaggtcaggcgttggagaccagcctggccantatggtgcagccccntctcttctaaaaatacnaaaattnagcccaggcgtggtggtgcacgcctgtaatcccagctactggggaggttgaggcaggagaattgcttgaacccggttgcagtgagctnagattgcaccattgcactccagcctgggtgacagngcaagagtctgtctcaaaaatngnataaaataaaaataatagaagaaaacataggtctttgtgaccttgggtnagaacacaacacttaaaagaacaaattcataagtagaactaaatcaaaattaaaaactgcttttcaaaagacacttta

SEQ ID NO: 512845 - DNA, 131 bp, Homo sapiens
  misc_feature (85)..(85): n is a, c, g, or t
ggtccatggtggcgggtagacaagggatgcctgggctgtctgggcagagtaagctctagctctgactgtcactcggctctccctnaccatttggctctggaagctgcttggcacccccaagatcagggcct

SEQ ID NO: 512846 - DNA, 365 bp, Homo sapiens
  misc_feature (2)..(2): n is a, c, g, or t
  misc_feature (172)..(172): n is a, c, g, or t
  misc_feature (255)..(255): n is a, c, g, or t
angtctgctacaaaggcactacacctttggcaaataggggtgagtgaaggcgtgcattcatgagccaagaccttctcacaggagtgaaactggcattttgctacgcagggcatatttcagggtaacacacaggcgactggaacataaacgataggtgtgtctattgcctctnaggtagcagcgattaaggacttctaagtgtgtcagcagaagcgatgcttagggccaccgagggcagctttactccctcattcnaaattatggatgttgcactcgccagtgatcatgcgatcgttcatgctataaaacaagtcaggcgtaagaaactgctctctaacaaaggatctcaaccttggcggatcctc

SEQ ID NO: 512847 - DNA, 1057 bp, Homo sapiens
gacgctggtgggccctcaacgcgtgcctggttgccaggcggtccggtgtgtgatcaaggagactgcgcacccgacacctgtgttcccgagactttctggcaccgcacctgcgcgctgcaggcgcgcttcgatgacgtgccagtgttccggatgcatttgctccatgccctcgcctgcctgcagggccccggtgtggccccggtgctgcgctgcgcgccagacccccgcgggtctgtctactccaactgcgagcggtccgccgtactatcgagcgcgtcctcagcgccgttggcctgcctatgccacggcccgcctctgccttgcctcgctagggccagacgcgtctatactacactgcccaggcactagcgcagataccccctagaggcactccggcattgaagccagcttgcgtactggttgctcgtggccagatacacctaggagcagagcccatagagacgcatcacgagggagtgcgtgcaggcctaggtgccagctgtgcgggggaataccgaacatgctagaccttcctggcggcaaatgcgggtggactggcccggatgcgctcggagagagcttacctaaccaaaagcctgaggagccaacgcccctctgaagaaacattaccatctgcttacatgacggggagggacaacttgtacccctgggcaataccataagggcaagcacctggtgacatgaaagggacggctgcgtggaaagacaccaggggccggcacaagaatggtcttatggaccccgaaaacctggaacaaacctgatctgagtggaactgagaggacatcaaccctacaactgttggctgggcatgaaccatgcaaaagaattggacttccttaattggacaattagggaacccaggagggaacaaaggcaaaacaccaaagtagccacatgagttaaaggagaagaccaccaagggcccaatagtaagaggtacaatacaaaagacagacaaggaaataaggtggaagcattacccagaaggagaaatataataggtaccgacgcacataaaaggcatagaaggagc

SEQ ID NO: 512848 - DNA, 838 bp, Homo sapiens
gtgagtgagtgaagatctggcaagagctacttaaggttactatcaccaataacatggttctgtggcacgaatgtgtgctgtgaatgagaaaataaacagagtcgtctttgttggaaactttcttacgtgtcaataccctctcaatgagactttggcatatgcactggattactggtcaaaaggtcaactaaagagcatagtttctagaacatgagggttactttggagcagttggtgcacttcttgggctgccaaaatttcacgctaaagcatcaggtctctctctctgctaataaatgtcatccaagaggaactacagaaccagaggcattattactgcatagtctgtcactgggaaccaaaggataacagagtagcataagctgctgaatgtcgccatattcaacaggacgagcacactccggttatcgcgacgtatttctcattgaaatgctatcccttcttgtatatagccagtgttacagccttaactggcagacggctctgatgattgagctcctcttaaaagatcttacttaaatgtaggccaactgcaagaaccggttgcttcaaaccgacatcctaacggattggaactgtacgctcatgaaaacaaccgggccgacaattggaccacgccgacacgggcgggagcccaggtaacagacaaagctcctggatccaccactgacgggggaaaagactacggggccacaaggcggcacacagctgggatacccaacgcatcaggacacaccgtcaacagagaaagcgaacacacacagaaccaccgaccgaccaaacacggtgcccgtctcttctcccatcatgcacggga

SEQ ID NO: 512849 - DNA, 620 bp, Homo sapiens
gtgcctggaggggactcgccgccatctcaggtctcttggctttgccaggcccaccggagaaaactgacgacccgtttctgtaatccttatgggagaccaaccttgtgcctccgggagatccattcttcccacctggaaacggcacggggaagccaagcttccaaaaaagcgctgcctcctcgctccggcgtggggattatccggaaggaactcccaagcggagggtagtaccattcttacccttcggaaccttcctccgttgcatcaaggcggggccttgaaagttcggcaaccccttccctcctccgggagaacgtagagacaataaatttctcccaccctaaaccagtctttgagttgattggcaagtatgactccatttccctgtgtgcattcatataaatagttcacctgctgaaacccaattgaaagcattatttaccaagtgttaccctgcttttacgtggtgtcctgaacctggaagtggtggctttaacgtcttatgatgtactcagcacgaatttcatttcctgaaattcgatgaattctaagactatggcaacgatcgggttgtaagacctctgagatttaaggcaatgtctggatcatggtgaacttac

SEQ ID NO: 512850 - DNA, 823 bp, Homo sapiens
gggccggccgagggcgcgcctctgctctggctggactgccgcggagcgaggcgagaaggaatccgatcgctggggggcttgctcgggcggcagcgactgctgctgccggatgggagcgggccggctcggcgcgcccatggtgcgccactggtaaggtcgttccgcgcgaacctctcgtgctctgtctggcatgggggatgcaggctggcctgggtggagcccctgaagggcggtcggcagtgagccacgtgcggcgccgtggcgacgcagcgcgtcggtggcccgcggtcggggcctcgggtgtgggcacgaggcgggagtcgactgagggctcttgacagcgagaccccatgctcgagtctccctgccagcgcgtcgataacgcctgaggaaatagtgcggccgtttatttccactggtgtgggactgagtactcggtgtggacacctcctggtcgaggctggtgataatttgtgaagcctcatggatcatttccagtgctgaataaagactgagggacagaacgtggaaagtcttaagagcattcggaagttaaccttgacctccaatgttggcatttatggggtctagcaaggctatccggggagctttgcaaccctcgaggcgtgaaaggacctagactctgtgtgggatcgcaaatggcaagcttgcacttttatacgctttcccacttcatgacatgccttgctttttattcaaaatggggcagagataaaaacttctcgagtctcccacactgtcttttggtggcccttgggaggtggaagcgtaccaaattttgacgcaggattttcttcacgat

SEQ ID NO: 512851 - DNA, 491 bp, Homo sapiens
  misc_feature (263)..(263): n is a, c, g, or t
  misc_feature (367)..(367): n is a, c, g, or t
  misc_feature (383)..(383): n is a, c, g, or t
  misc_feature (405)..(405): n is a, c, g, or t
ctctgctcatcacatgaagctgggattggcacgaggaacaaacagcagatgccctgccttccagtccaagaaactgcttcttgaaatggatttaacaacagccacttaccttttcctcctgagcctgctctctgatcagctggatccccacgttgagcaacagcgtggcccagtgaaaggctgcctgcagcaggacaggtgtgttggcgcgtgttgacgagccttgacagtgactacctcgtatcttagaaatctgagtacangagcctgacggctttgtgctttatgtctttttttagatgacgggctcactccacgcttcatatggctgccaacgacgttgactgcttctgacggttggtctaancatctctggatctttnagagccaccagtatctctctgngcccatacaaatatcagagcagacggaaatttctccctgcaagcgctcagtctcatcccagcaagtcaaagacctcctggccaagt

SEQ ID NO: 512852 - DNA, 330 bp, Homo sapiens
tgacagagctagtattcagaaactaatctaatattgacaaacttctattacagaaataccgacatacaaccaccaaatgtatactatgcagcaaatgaaaggaatcatgtctagagatactcaaacacaagacatgagcacatcatgtacaaattcattgtacacttacaaaataagtttcacaatttctgcaaaccctcacatatacaaactcagaatcctctttatttatgagacagggtctggctctgtcaaccagactggagtacagtggcacaatctcagcccactgcacacctccgtctcctgggctcagtcaaacggcactgg

SEQ ID NO: 512853 - DNA, 308 bp, Homo sapiens
  misc_feature (272)..(272): n is a, c, g, or t
gctcattgtacccattctaatcgcaatgggcattcctaattgcttacccgacggaaaattctagggttatattcaacttccgcaagggcccccacggttgtaaggcccccagcggctaatcacacaccccttgggtgtgagggcacataaaactctttcacacccagggggcccctctaaaaacccgcacacatatccctttcacctctctcaaataagcgtccccgggcccgtgtctctccactatgtctcttactactagagcgcgcccnctccaaataccccaccccgcggcaaaatccaaatca

SEQ ID NO: 512854 - DNA, 113 bp, Homo sapiens
tacagcaaactaaggccccgagctcagggcagctgtgctcggtgagctcttccaggagccaccttgcccacccattcttcccgttcttaactttgaaccggcggtgcggcgtg

SEQ ID NO: 512855 - DNA, 494 bp, Homo sapiens
  misc_feature (269)..(269): n is a, c, g, or t
aacacagggctattatttagctttgaggtgaagttatgaggaccacattaaattatgttgtgaaagcactgctggaacactgcatggcacctgacatacattaaacttcaagattactaaccacgggtctgatttctcaacatcagcaactgctacaaaggacaggagatggacctttggatagttcagacactaagagaaaagactggcacaaggacagccagccccaagaagctggctagagaggagtgtgatttggtaaggacatncagctcctgctccaaaactaatgtttctgggaagccacttaatggtctcaaagtgcccccaacagtggctctgggaggaggtgcaggagacaccagacacacgggcctgatgctctttcagagggcacctcacactaccccctcctgtaggcatttccctggctcttccctggcacaggagagcccaaggatctaacagctaggaagcaggcctaaatcaaagaa

SEQ ID NO: 512856 - DNA, 393 bp, Homo sapiens
agaggccccagaggcatgcagctggccagatccaggagatgattggcagcgtagaggagcagctaggccagctcgctgcgagatggagcacgcagaaccaggagtaccagatcgtgctggacgtgaagacgcggctggagcaggagatcgccacctaccgtcgtctgatgaagggggaggacgcccacttttcctcctcccagttctcctctggatcgaagtcatccagagatgttgacctcctccagccgccaaatccggaaccaaggtcatggatgtgcacgatggcaaggttggtgtccacccaggatcaggtccttcgcaaccaagaactgaggctgcccagcccggctacaggcttaggaggcccccccgtgtggacacagattccca

SEQ ID NO: 512857 - DNA, 929 bp, Homo sapiens
gaggtcaggagttcaagacgagcttggccaatgtggtgaaaccccatctctacaaaaatacaaaaattagctgggcatgatggcagtgcctgtaatcccagctactcaggaggctgaggtgggataattgcttgaacctgagaggtgggggttgcgggagctgagattgtgccatgcactccagcctgggtgacagagcaagactccgtctcaaaaaaaaaaaaaaaaaaaaaagccaaaaagcaaggggggcccctcttcccggccagggggggcggcaaaaaggtggggggccggaaatgtgggaaagaggggctccctctccctataaaaccgcaacgcatagtgggggcccgcgggaactcaccgagaacttctccaagctcctcacagaacaccttgatggacaacaactaagtggtgttagcgccgcagattatagatagataattattctgttattataacggcctgtggagccaataacttacagaagacagtcggggctagagggcggcacataagacaatatttccccccctcgaaaagctctaaagcaggaaatgtaccaaaaaactccaacgaggggttccccatctccaggaggtacaagggggccacaaattatcaaggggcacaaccagagggataaccaggtagggggcccaaggaagaacaaatataagatatagcgcacgagggtccagtgtcaccccaaacataaaggcggcaggggggaggagaacacataaggcccagtgggacagcctcaagacctgggggccaaaggtaaaccaccggggcccaaaccccctgggagttgctgggaaccggggggtgcattcacgcatatccgatggcagagttcaagcattaggacaaaggggagccgcgtatatggtcacgatgggctgaaccagtgtctaggc

SEQ ID NO: 512858 - DNA, 313 bp, Homo sapiens
aacacgcacgccctaaccgggcccccaacctgatagttttccaaagccttagatataaataccccgtgggcggctaagcaaacccttcagggagccatttgctggctgtgaagaaaatgcagcctcagcagggcccccagcctttcccccagtccgagcttggctgcctgtcggaatccctgggggagcggttaaaagatacagatgctgctccccagccccgtcaactcaacccaaatttttgcaagaccccaagggccctcagcatttttataaagctttttttctgatttgaatgtataataatggttta

SEQ ID NO: 512859 - DNA, 518 bp, Homo sapiens
  misc_feature (498)..(498): n is a, c, g, or t
gttagaggatcccctcttaaccaccatgaagctggaaatgctccacacaaatgcattagtttagaaaaaagcactccaaacatacccaaatgtcatgctcaacgcatgccaacctgccacatctggcacgttttaatgagtcctgggtacagccctcttgaaatattccgcctgattggcccaatcacctaccgactcgacctggcccaatgtcttgacctttctcaggttgtatcacacatatcccagcacaccccagtcatacgcgcattgaacctctgattccacatgacattcatccatgccccctcagggttgattgattcacctacccatacaacacactgttgataatgtctacgaaatacagcacacacccacacactcagcgcgccttacgccgcgcacgcgggtgcgcgaattaataaacctgtggaagggtactgaaaatccaattgagtgtagatctgggccggcgtgatgtccggatgacctaanatctcctgcacaccacgcaa

SEQ ID NO: 512860 - DNA, 664 bp, Homo sapiens
  misc_feature (1)..(1): n is a, c, g, or t
  misc_feature (135)..(136): n is a, c, g, or t
  misc_feature (141)..(142): n is a, c, g, or t
  misc_feature (196)..(197): n is a, c, g, or t
  misc_feature (209)..(209): n is a, c, g, or t
  misc_feature (221)..(221): n is a, c, g, or t
  misc_feature (225)..(225): n is a, c, g, or t
  misc_feature (250)..(250): n is a, c, g, or t
  misc_feature (281)..(281): n is a, c, g, or t
  misc_feature (287)..(287): n is a, c, g, or t
  misc_feature (290)..(290): n is a, c, g, or t
  misc_feature (294)..(294): n is a, c, g, or t
  misc_feature (296)..(296): n is a, c, g, or t
  misc_feature (303)..(303): n is a, c, g, or t
  misc_feature (307)..(307): n is a, c, g, or t
  misc_feature (311)..(311): n is a, c, g, or t
  misc_feature (318)..(319): n is a, c, g, or t
  misc_feature (324)..(324): n is a, c, g, or t
  misc_feature (326)..(326): n is a, c, g, or t
  misc_feature (332)..(333): n is a, c, g, or t
  misc_feature (342)..(343): n is a, c, g, or t
  misc_feature (346)..(346): n is a, c, g, or t
  misc_feature (348)..(348): n is a, c, g, or t
  misc_feature (350)..(350): n is a, c, g, or t
  misc_feature (352)..(352): n is a, c, g, or t
  misc_feature (360)..(360): n is a, c, g, or t
  misc_feature (369)..(370): n is a, c, g, or t
  misc_feature (377)..(377): n is a, c, g, or t
  misc_feature (383)..(383): n is a, c, g, or t
  misc_feature (385)..(386): n is a, c, g, or t
  misc_feature (390)..(391): n is a, c, g, or t
  misc_feature (395)..(396): n is a, c, g, or t
  misc_feature (398)..(400): n is a, c, g, or t
  misc_feature (405)..(405): n is a, c, g, or t
  misc_feature (407)..(408): n is a, c, g, or t
  misc_feature (410)..(411): n is a, c, g, or t
  misc_feature (417)..(417): n is a, c, g, or t
  misc_feature (429)..(429): n is a, c, g, or t
  misc_feature (434)..(434): n is a, c, g, or t
  misc_feature (442)..(443): n is a, c, g, or t
  misc_feature (451)..(452): n is a, c, g, or t
  misc_feature (454)..(454): n is a, c, g, or t
  misc_feature (458)..(458): n is a, c, g, or t
  misc_feature (464)..(464): n is a, c, g, or t
  misc_feature (467)..(467): n is a, c, g, or t
  misc_feature (472)..(473): n is a, c, g, or t
  misc_feature (475)..(476): n is a, c, g, or t
  misc_feature (480)..(480): n is a, c, g, or t
  misc_feature (482)..(482): n is a, c, g, or t
  misc_feature (485)..(485): n is a, c, g, or t
  misc_feature (489)..(489): n is a, c, g, or t
  misc_feature (496)..(496): n is a, c, g, or t
  misc_feature (507)..(507): n is a, c, g, or t
  misc_feature (510)..(510): n is a, c, g, or t
  misc_feature (513)..(515): n is a, c, g, or t
  misc_feature (517)..(517): n is a, c, g, or t
  misc_feature (522)..(522): n is a, c, g, or t
  misc_feature (525)..(525): n is a, c, g, or t
  misc_feature (533)..(534): n is a, c, g, or t
  misc_feature (537)..(537): n is a, c, g, or t
  misc_feature (539)..(539): n is a, c, g, or t
  misc_feature (556)..(556): n is a, c, g, or t
  misc_feature (661)..(661): n is a, c, g, or t
ntacacagctttaaaaacatcataaattaaaacatggagtcttatttatagtgtccccccgtatagagctttacggtttataaaaaacaaatgattgcagaattaagcttaaaaaaaaaaaaaaaaaaaaaaaannggatnngcttttgtcaatacagaataaatatatcccccaaatacttgggaggtacaactnnaaccaacacccngcacttgcagancccnctaccaatttcaatatttgcaaggncggtgattttgtttgtttaaaaatctgcagnaattgnaantccncnaaaaaangccngagnaaaaagnnccacncngggacnngtatcagannacncncngnagcagaanccaaccgcnncaggaanacaagncnncaanncaanncnnncacanannannaacaancagcccacaaancccgngcaggcgnngccccggnngncggnggcagnggncaccnncnnaccncnccncgcncaccacnccgcccaaacngcntcnnngncaccncgnacaccagnngcncnccgcacaaccacaacancccccaccaccgccgctacgtccaccccacccggcgccaccaccccagccgcccccgccagcccaagaaagcaggccgcccggcgcagccagtccacaaaggtanccc

SEQ ID NO: 512861 - DNA, 567 bp, Homo sapiens
  misc_feature (394)..(394): n is a, c, g, or t
  misc_feature (512)..(512): n is a, c, g, or t
cttattattattggctaagcagcctaataaggggggggggtagggtagtaaaaggtgaaagggttttcatggcagtttcttggtaaatctcttccaggtcaatttaaccaatcgcaattacatttaaaaattgggttctatcttttttgctggtctcaggcataggtccttgggcactaggagaaaggtatctaataaggtcccatagcaggcaaataatttaaggctggtagggtttttaatggtgagaagattccgctcggcttaagaccattctttaaaatgggatttgaggtgggacctgggaaattctggattggcaggtcgttaaaattggatgtcaggacccatttaaggggggtgaggattttggacacactggatgggggagggncaatattttttaaaaaacaaattaaagggtataattcagagagttactacggctaaaaggctaggtgaagtgtcacccatttaaggtagaacgaggtgtccctagggatcatcctggntccagaataattgatctgaagccctttataaccataattaaacggcggagactac

SEQ ID NO: 512862 - DNA, 206 bp, Homo sapiens
ccgtcagagccttcgagtacaacctgacactaaatgatcagcacagcacttatactagttaccattttaatcctaggctgatttatgaatgagcctaaaaaggattagactgtgttgaattgtaaatagtttaagtcaaaataaatgattttgactcattagattatggtagaccatatttaccaaatccctgcgattagggttag

SEQ ID NO: 512863 - DNA, 94 bp, Homo sapiens
tcgacccacgcgtccggagctgtcttagctcaaatctgttgtgtttctgagtctagggtctgtacacttgtttataataaatgcaatcgtttgg

SEQ ID NO: 512864 - DNA, 164 bp, Homo sapiens
ctagaggatcacccctgacactgctgcctccctcccagcattggtcaggaaggtaaccctgaagcagggggtggcgtggtagcaggggcttgcccagtgtcagcttatctcttggaaactcccattttgggtcctctggaagttcatactcggagacccctgcc

SEQ ID NO: 512865 - DNA, 1755 bp, Homo sapiens
  misc_feature (453)..(453): n is a, c, g, or t
  misc_feature (775)..(775): n is a, c, g, or t
  misc_feature (779)..(779): n is a, c, g, or t
tttctgtgttgtattgatctatctgcttctttcctgcattacggaagcacgctgctgttgtcttgctgctcgcaggtcgtcgttcgatctccctgccggctcgtagcattgtagtccatccccctctgtgtatgtgtggtttgcatgtgcagtcgtggttctggtgcgtgttacttgcggtcatagctatctgatgtgctgctgctcgctgattgaccactggctggaatgtccctgctaccacgctatctactcgatgctggcgtttcgtgtacgtgcgacctgcagctgtgttctgactatgtcgggtgtagtgggctgctcgctgttggatctgccccgcgtctactttgtaggatggtcgtgctgtactccgtgctagctgcgctacgcatgcatgtctgtctccgtacgacagcagcagacgtgcgggagggagggtattctaataanaaccggacaggtcgtctctgtttctggggtggcaaccgccccgcccgcttcgttcgctctccgggtgtggcgccgcccctcccctccgcccccgcctgggtgttggttgccccgcccccctcatagtatgatgcgcccccccctgggggctgcgtgatttactctagacgctctctcgccgagatggttgtttgtgcgtactttagtggagctgccccgctggggccggggtagtgttaacaactcattgtcgtttctccaccaaccacgtgagatcaagacgcctgttgttggttccccccctttatgtgggcgcgccctntatntgtgggggggggtcgtccgcctctctgttgtggtgcgccacacaattgttgggttctgcccaccacaaagatgtaccgcgcgctgggggttgtttccctcctctgctctccgcgcggtatttttttctcccgccgcgcggtatattttttctgtgtggcccccactcccgcgcggtttgcgcgcctctgtttttacagttgtttgtcgtgtcgtcgcgccgcggtggataatatatgatatagatgggtcgagtatgcggggatttttttgtgcgcctacaagaagagatttgtggtttctctagagaggggtgtacacgctctcgcgagatatatagaagagggcggaatatctcgcgcgtggagtggagacagcgctctctctctctctgtgtggggggcgcaacatatacacacgctctcgctctctgcatctatatatatccttcggcgcgcgctgctaatatatatcaactctttttttcgccccgacacacacacacttatttcgcgcgcctctcttctcgcgcgagagagcacccgcgcgcgctgtttcttcgcgcggttccccccgcgcggagcactcacaccccccctcgtcggtatcactctctctctctttcttctgtgtggggggcctcttctcctcttttttcttcaccagcccgcgcgtatatatattaaagaatattgttctcggtgagattgtgagagaagacctctctctctctctctgtggagagcgcggaaaatgatcttctcataaatgtagagagagagacacacctcccctctcacacccgcggggggaacaaaagagagagcccccccccccccccccccactcgcggagaaccccgtagaacacacacaaaatatttagggacccaaaaagagagaagagagaaacaggcacccccccccaaagacgggttgccaaccaaaccccccgggcccccacgggttttttccccca

SEQ ID NO: 512866 - DNA, 1016 bp, Homo sapiens
  misc_feature (15)..(15): n is a, c, g, or t
  misc_feature (98)..(98): n is a, c, g, or t
  misc_feature (100)..(100): n is a, c, g, or t
  misc_feature (102)..(102): n is a, c, g, or t
  misc_feature (111)..(113): n is a, c, g, or t
  misc_feature (115)..(115): n is a, c, g, or t
  misc_feature (122)..(122): n is a, c, g, or t
  misc_feature (124)..(126): n is a, c, g, or t
  misc_feature (519)..(519): n is a, c, g, or t
  misc_feature (525)..(526): n is a, c, g, or t
  misc_feature (591)..(591): n is a, c, g, or t
  misc_feature (614)..(614): n is a, c, g, or t
  misc_feature (628)..(628): n is a, c, g, or t
  misc_feature (640)..(640): n is a, c, g, or t
  misc_feature (646)..(646): n is a, c, g, or t
  misc_feature (653)..(653): n is a, c, g, or t
  misc_feature (661)..(661): n is a, c, g, or t
  misc_feature (689)..(689): n is a, c, g, or t
  misc_feature (710)..(710): n is a, c, g, or t
  misc_feature (741)..(741): n is a, c, g, or t
  misc_feature (750)..(750): n is a, c, g, or t
  misc_feature (818)..(818): n is a, c, g, or t
  misc_feature (840)..(840): n is a, c, g, or t
  misc_feature (906)..(906): n is a, c, g, or t
  misc_feature (908)..(908): n is a, c, g, or t
  misc_feature (944)..(944): n is a, c, g, or t
  misc_feature (994)..(994): n is a, c, g, or t
tttatttggagcagngctaattcacaatttcatggaacttgcctgacacccccacccccttgtattaaaaaatgattatttatatgatgatttcaganananctgcatctnnnangtttggnannngggagacctacatctgctgctcttggggagcgtgggggtgggagaggagtgctggagggggctccagggctgggcccggttgtgggggaacaggggcccctaggctggaagggagaaggcagttctcgggagtgcttctgcgtgtgtgatatgcctctgcacacatgtcttgtgcatgtgggagtgtcacatgctgcacgaggctcacctgtctgcccatctgtgctgtgggtttggttttgtgtacacttccaagtgattcacatgtgggcacatgagtgtgtgcaggcagatgtgtgggcacacattcaagactgtgcacaagtgtgtgtgtgaatatagtgtgcgttaaagggtgatgtgagccggcctgactaggtgtaaaagaagcanatagannttatgatggggcggggggttaatctgtctcccccagcgccacgaggggcaaaatcttgggagtgngttgtatgcccagtgccccatgngaaagtgtactccnaagatccgtgcntgggangaggggnatcaaagngtgcggggttcaatggcccactccctgngcactagttcctagggccccnactggggttgtcccacagtgcctaagcctcnactttgcangccccgcctacaccctgcaaaagctggcagggaacttccagagaccttgggcccctccagccatcaancactgaccctcggggtctattnatcccctctccttttcctccccctctgttcccctcgctggccctctcccccagtggaaggcaagtntncagatccccacaccatgttcctctgaaattaaaaanatttgttagctctggacagcaggaagagtaaaaaaggaaagtaggggggnttcctctgagcagatcgccagc

SEQ ID NO: 512867 - DNA, 818 bp, Homo sapiens
attgacttctaaagactcttggtatgtgaggaagaaagctggaagaggaagaggaaagcacaggagtcaggatggctcttcctcagggtctattgacattcagggatgtggccatagaattctctcaggaggagtggaaatgcctggaccctgtttcagaggactctatacagggacgtgatgctggagcaattcatagtgaaccctggtctcccgtggacgttgtcacggggcatgtgtccattggcagtacctgcctacctgagtgtactcccaggccatcgaccgatcagtgcccagggagctcgaggtgtggcatgagcttagagggaacgcccccaagcacgctgggtcctgtgtgtgtcctcagctggctcctccctggtcggatatcattgttctcatgtcacgtgaccggcaagtggagcaatctaaaaattaccagggaatgacagaaatgactctgggactactgttctgactgctgagtcaccgagggcaccagagagtcgcctgacgcggacactgctgtcccttccctgatgtgatctgcctggggctcatgctctggggcagcagctccagtcgttatgcatcctgcgacaggcacaaagcggcgggtccagcaccattcataggaccagcgtgtccccaatcctcccctggaagtccggagctaccaaaacatcctcttggagcaggaaacggacaaggaggtccccgaagtctgacacttgcagattcatggggtttgagctgacaggcggccaaaaaggctgctgatgggatctccaatctgtcaggccagggtggaaatg

SEQ ID NO: 512868 - DNA, 126 bp, Homo sapiens
taggtgaatcatctcccacactggttgttccatacggaaacatttagtaggaaaagaagcactacgcactataagcttcagaagaacccagagttttttcccttcaggaccatggagtaatatgca

SEQ ID NO: 512869 - DNA, 95 bp, Homo sapiens
ggatttgctggtgcagtacaactaggcttaatagggacatgcatgaaaaactttcttcaccctctcgtaaaagaacaattgcagaatctaagaaa

SEQ ID NO: 512870 - DNA, 1014 bp, Homo sapiens
  misc_feature (108)..(108): n is a, c, g, or t
  misc_feature (110)..(110): n is a, c, g, or t
  misc_feature (213)..(213): n is a, c, g, or t
  misc_feature (434)..(434): n is a, c, g, or t
  misc_feature (483)..(483): n is a, c, g, or t
  misc_feature (848)..(849): n is a, c, g, or t
  misc_feature (912)..(912): n is a, c, g, or t
  misc_feature (915)..(915): n is a, c, g, or t
  misc_feature (917)..(917): n is a, c, g, or t
  misc_feature (936)..(936): n is a, c, g, or t
cgggtgagacgagggaatacaataggtggcatctagcggaaaacgcaggaatcaagaaactccgtaggattcctcccatagtcgaactgggatgcgactatggagagncncgtaacagaagcgaaagcctatggcaacacgtcagccagagcggccggtttggcggagctggaccatcggtgggcatattagacacaagaacactcttgggtnaatgagcgtaattatgggaatagacagtatatgacctttggaggaggttgatacagttaacggcagtagctacgatcggaggtataaggaggcagttaagtaaggatccttgaatcagccctcacgtaaagggaaagggaccgcagaagctcccgcgcgtgtaggccaaacgggggccagtttaattaattttgagggaggcggcatgcggcatggacagnattgatatccagggttcagttatttaggttacacggtctctcgtctttnatgagctggtgcagcagaagttcgtattgtagttacagggtccgttaaagagaaggaggtacggaagttgtccggctgccgtaggattatttctatatacagccgaaagagagccgcgcattgagtaaatttctggtcgccgccatcgagccaataagatgggcagaaccactatagctaacctgaatggaagctatttgtaacatgcgctggataattctgttatctatactgttgtggcgatcgggactattatatatgctctctcggaatcttttatgaattgagagctatgactctctctcttgaagtctgtgagcatcacataaggattgatccgtcattgaatgattcattcatagcgnnctgtcttcgttgagtggtcttcacaaatctcagcagattgatgatggcggcaggtgttatccnggnangcgactagcagccccgatncgtctgtgtgacgactaacaatgtagtttctctcgacacttcatgtggacaaagcacacatccctgtatagtcacaat

SEQ ID NO: 512871 - DNA, 291 bp, Homo sapiens
gcctgatccgcgtagcacgaggtcaggagttcgagaccggcctggccaacatagtgaaaccccgtctttactaaaaatacaaaaaaattagccaggtgtggtggtgggtgcctgtagtcccagctacttgggaggctgaggcaggagaatctcgaacccaggaggcggaggttacagtcagctgagaccgcaccattgcactccagcctgggtgacagagcaagattccgtctcaaaaaaaaaccaagaagaaaaggagtgaattagaacttcttctgcttggacttaagc

SEQ ID NO: 512872 - DNA, 319 bp, Homo sapiens
  misc_feature (43)..(43): n is a, c, g, or t
  misc_feature (99)..(99): n is a, c, g, or t
  misc_feature (108)..(108): n is a, c, g, or t
  misc_feature (255)..(255): n is a, c, g, or t
cgagagggggaattgattatttcttttctgagacccttatatnaagagaaacagaaagaacacatccatattggggagatgaagcagacatcgcagatngcagcaganaatattggaagtgaattaccacccagggccactcgatttaggctagatatgctgaaaaacaaagcaaagagatctttaacagagtctttagaaagtattttgtcccggggtaataaagccagaggtctgcaggaacactccatcagngtggatctggatagcttcctgtctaggacattaaagaacaccagcaaagagccatctgtgtgtg

SEQ ID NO: 512873 - DNA, 359 bp, Homo sapiens
  misc_feature (1)..(1): n is a, c, g, or t
ncatatgtaatttgtgctgaatttgaaatgacagctaggcatttcaggcagtgtccagtaagaggatataaacttggaactaactcttgaactgagtctaaattttagagtcatcctgcttataaggctatagttggggctatgaaaatggccaagccctcttaaagaatgtgtaaatagaagactatgactccaaggactgagccctggggacagcttgcgatgaagggttggaaagaggcttgtggagggaattataggtaacaggaggagtggttgggagttacaagaagatttacaggagtttagttgtggaagccaaggaaagggaaattttagttgtgagagtcaagaaaaga

SEQ ID NO: 512874 - DNA, 327 bp, Homo sapiens
cagataattagcaggatcctggaagtaaatagcatggggttctccctgtcatataccatattcagagcaagtgaaagatacatgggagtcacaatcaaaagaggattcagaagctggaatgccatccgctgcattccttgtactagacagtgaccttctgcagtcctcctctgaagaagacctcccatggtctgcactagcagatacttgggtaactagggcgaggtgtgtagagcctctccacttcttcaatagaaagtccgagtggaggagaagattccagtggaatctgcccaatcggctgctttaggcgcatccctggtctag

SEQ ID NO: 512875 - DNA, 138 bp, Homo sapiens
tgcagttacagacagagtgtttccaaactactctatgaaaagaaagcttaaactccttgagttgaacgcacacatcacaaagtagtttctgagaatgattctgtctagtttttatacgaagatgtttccttttctaca

SEQ ID NO: 512876 - DNA, 443 bp, Homo sapiens
gcacgaggattttattaattagaggttaaatgttctttgactattgtattataatatagttttaactgaggaattacaatgaagatactaaaaggaagcttaaggtttctggtattaactaggttctgttaaatgattttacttgttttagaatatatagaaatatactgagttagaatgagtggcgtattttctaaataattcaaataaaatgggagagagaggaggagattggaaggaatgaaattttcctgttcaagctgtaaacactaaaacctttaattttgtaggaagacattatatactctggtcattcaacttgtgtatccttagtctatttagtagtcaaaaacttctaagtaaatatgtgtgatttaatttgtgctgctgagaaacagtgatcaaaaatggcaataaaagtcacataacgaaataagaatact

SEQ ID NO: 512877 - DNA, 111 bp, Homo sapiens
gggaatgctgcctagggtatggccactgtggaggtacaactaaaggctttctcctcattaactctaagacttgtactggttttgctgtcaatagcaatgaatttgtaattt

SEQ ID NO: 512878 - DNA, 341 bp, Homo sapiens
gtaattttgtgtttggggtgtgggggtggtgaaagggaagtagaaccgaaacaagattagtcctgagttaacaatggctgcaagctggatacatggaattcagcagcacttttctccctcgtactgattatgctgtggaaatgtgcgcttgtaaaacatgtagaaaacaaagacggaaaaaaatgtgattggtttctgtcttcaagatggcattagaattgttgcactggaggaggattgtcccttgcttctgcataaagtgttaactccataacttataagctcactctttattgttactttgtaattgacaaatggaaattggatattggaaaaaaaaa

SEQ ID NO: 512879 - DNA, 328 bp, Homo sapiens
  misc_feature (252)..(252): n is a, c, g, or t
  misc_feature (296)..(296): n is a, c, g, or t
gaggataaggtggcgtgaaaggcagccggaaagagcgaaagaaagaagtggtggaggaggaggagaacggggctgaggaggaagaagaagaaactgccgaggatggagaggaggaagatgaaggggaagaagaagatgaggaagaagaagaagaggatgatgaagggcccgcgctgaagagagctgccgaagaggaggatgaagcggatcccaaacggcagaagacagaaaatggggcatcggcgtgacccntgccaacaggctggggttgggaggcctctctgggctgggaggtnggggttggggcagccaagtccagccactcttc

SEQ ID NO: 512880 - DNA, 464 bp, Homo sapiens
caggatcatttgtacctcaaacctcagcatcatactataaacccagataacaaacttgcacatgtacccctgagtttaaaataaaagaggccaggtaccatggctcacgcctgaaatcccaacactttgggaggctgagacgggcagagagcccaagagttcaagaccaacatggtgaaaccctgtctctgcaatagccaggcatagtagcatgcatctcaggagggtaaggtgagaagattgtttgagcccgggaggcggaggttacagtgagccaagatctcgccactgcactccagcctgggcagcagaccaagactgtgtctgaaaaataaggctaggtgcggtggctcacgcctgtaatcgcaacactttgggaggccggggcaggtggatcgcctgaggtcaggagtacgagaccagcctggccaacatggtgaaaccccatctctactaaaaatatc

SEQ ID NO: 512881 - DNA, 329 bp, Homo sapiens
aggggccctcccaaaagtaaatgggccttcctgttgctccagggttgccgatgcccttttggccagcaaaggggcctacctgctcatggagttagccaaaagccaggacaagactctcaagatttatgaaggtgcctaccatgttctccccaaggagcttcctgaagtcaccaactccgttttccatgaaataaacatgtgggtttctcaaaggacagccccggcaggaattgggtcccccccctgaatgcattggccggtgcccggctcatggtttgggggatgcaggcaggggaagggcaaaaatggcttttcagatatggcttgca

SEQ ID NO: 512882 - DNA, 587 bp, Homo sapiens
gaaaagcaaaattcatgctccctccagaatcagagtctacacatgccttcgtaatttagtactcacaaaataaaaaacctgaggctcaagtcactattttatatagataaatggagagttgactgtaatcatgtaatgactttagtctctttaacatgaaaaaattcacaagaaagcatataataaaaagattaaaaagcactgccatgacatctaaaagcatttatttaatgcaaaacaacttaaatatgattatgtgtacacataaagtgcacaccattacctatgctgaacaatgccaataaacataatatattgatgcaacagtttactaaaataaacataaacacatgagcccagaccatcagacaaaagcaaaacatttatttccaaatagcacaatgctgaaaatggatagcaatcctaaaacacctccaactttccttaaaagctagccaaagtccaactattaggaaaaaattgatttcacttacattaataacaatctggtgccaaacataataaaaccaaagtgctggacagactttactccttataaattccaaatataccaacatactcacagg

SEQ ID NO: 512883 - DNA, 412 bp, Homo sapiens
tactacgccatccaccctccactgacctgccaggatactcctgatcttgtgtactctctgtctattcctgacaccccttaaactataggtgactgccagacttccaaacttggaccctgatcatcaggtacttggataggtctcataccatataacagggtaatgcagctagcctctcaagaagaggatccaatcctgaccccagcccggttgcctgctagattccacaacaccagacaaacccaaccatcctctctccattactagttcctgttctatctctcggtaaatggcatcgccaaccatccagtccccttccctgcagccaaagagatacatggactatctccctctaaccattatcctctctccctatacaccccagatgataatcagtcagcgactttgatgt

SEQ ID NO: 512884 - DNA, 252 bp, Homo sapiens
gtatcccctagcggtatgaggtggtatttggtcgtggactgatccggctacgctatctctggtcccactacaatgactgtatttgaagattagagtaccagttctcgagtctcttctacaaagagcgaactgagacaccccaaacctaaaaatgccaagggtcacctgtcccccgagacagatactttttcattgggcagtggtgatcgtgctgaccatctggaaaggcctttggctgtggatgcatcataa

SEQ ID NO: 512885 - DNA, 438 bp, Homo sapiens
ttgtccatttgcatgtcagcttctgaaactttttgctgttgtctctcacattcttccgtggatttgtgtctttaaaaaacaaaaaggtggaaatgtatgcccttagcctgcagtcaccccactttcttggaagacatcattctccttctctgcctctgccagagcatggggctaggtttttacttgatcagcatcataaggatttgttgtatacttaaaatgcatttgtgtaatcattggttccgacacgtttttgctttgaggcataagggacttgattgtatattttataaatatttgccagataagatagccaatggcttgcagtcatcttaaagataaaaattgatgttatagccttgaattaagttgaagtactgtatttgctctgagtggcatttaacctaataattctgaacttaaactttgaaatggaaa

SEQ ID NO: 512886 - DNA, 157 bp, Homo sapiens
gccagtgacaatcatgagcactgtggtgtgggtgtgtgcatttatcacatttaacattattccgatcccatagaaatcacaatatgggatgcacatgttgtaattttgctgagaaaattctataaataaacatctgatccctctgaggcctgactta

SEQ ID NO: 512887 - DNA, 161 bp, Homo sapiens
atgtgatttttggagataaatgtgtagattgtgagttgtgttttgcgtggttgtgtgttgttaatatagtaaattagaaatttttgataagaagtttaatagaaaaaaaaaaagtggttaatataaaatagatggtagttatatattaagaagagggaaat

SEQ ID NO: 512888 - DNA, 318 bp, Homo sapiens
gctaatgcactttgctgtctcctggattccatatctactggatgctgccatcttgcctctagccggacagcaagcaggcacaccaactctttcctttccagtatacctgggcccagagtttcttctcactcagttacaatatttgctctacgaacattccacttaccaactgatcagaacagtaaaggtgactggcatggtgtagcagtgagaggtgcagcgtaacctcagaggtgaacatcagtgctgggaccattcggagcagcatgtgagtaaccacccaaaatgggaaccacggccttctggctcgacctagag

SEQ ID NO: 512889 - DNA, 382 bp, Homo sapiens
gtgaaaaacagagtgtatagatggaatatatgtctttgtaattacttgtgatgtgttaaaataaaaattttattcagatttgtgtaaaaaaaaaaaaacaaaaaaaactcttgactaggtcctcgtgccgaaatcggtacgaggggcccagggtctggggcaccagagccattgcattatgtttcccagggcaacttgagggctgacttttggcttcctcgccctaagagggtcttcctctcttttggtcaatcacctttacaccacttgtgagctgacccccaggaacagtttggctgttccaccagagcagagggaatcattggtggactggaattcttctgtggggaagcaccatgatggtgccagagcttcatgctgg

SEQ ID NO: 512890 - DNA, 376 bp, Homo sapiens
  misc_feature (79)..(79): n is a, c, g, or t
ggtccccctctaagtaaaacaaatattcagaccacaggctttaatgtaaactgccaaaaagtgggatgtggaggatttntgttaagtgtcaatcgaagttaaaaagcaagggtttttggccaggcgtggtggctcacgcctgtaatcccagcactttgggaggccggaggcccggcaaatcaatctaggtcaggagtcgaacagcctggcacatgtgaaaccgtctctactaaaataaaaaaatacccggtgtgtggcagtgctgtagtcccactacttggagctgagcagagaactgttgaacccggaggtaaggtgcagtgaccacgatcatgccactgcactccagcctgggcacagagcaagactccatctc

SEQ ID NO: 512891 - DNA, 103 bp, Homo sapiens
  misc_feature (3)..(4): n is a, c, g, or t
  misc_feature (22)..(22): n is a, c, g, or t
  misc_feature (56)..(56): n is a, c, g, or t
  misc_feature (59)..(59): n is a, c, g, or t
ggnnggattaaggagccaacanatctcttgagctgcccagcaatagtccaagaccntancaatggcaacatcacatgggctgatgtggaggccagtatcctct

SEQ ID NO: 512892 - DNA, 786 bp, Homo sapiens
  misc_feature (3)..(3): n is a, c, g, or t
  misc_feature (9)..(11): n is a, c, g, or t
  misc_feature (14)..(14): n is a, c, g, or t
  misc_feature (20)..(20): n is a, c, g, or t
  misc_feature (23)..(24): n is a, c, g, or t
  misc_feature (33)..(33): n is a, c, g, or t
  misc_feature (36)..(36): n is a, c, g, or t
  misc_feature (64)..(64): n is a, c, g, or t
  misc_feature (66)..(66): n is a, c, g, or t
  misc_feature (73)..(73): n is a, c, g, or t
  misc_feature (75)..(75): n is a, c, g, or t
  misc_feature (86)..(86): n is a, c, g, or t
  misc_feature (90)..(90): n is a, c, g, or t
  misc_feature (135)..(135): n is a, c, g, or t
  misc_feature (138)..(138): n is a, c, g, or t
  misc_feature (146)..(147): n is a, c, g, or t
  misc_feature (149)..(149): n is a, c, g, or t
  misc_feature (151)..(151): n is a, c, g, or t
  misc_feature (155)..(158): n is a, c, g, or t
  misc_feature (160)..(160): n is a, c, g, or t
  misc_feature (183)..(183): n is a, c, g, or t
  misc_feature (191)..(191): n is a, c, g, or t
  misc_feature (197)..(198): n is a, c, g, or t
  misc_feature (205)..(205): n is a, c, g, or t
  misc_feature (212)..(212): n is a, c, g, or t
  misc_feature (237)..(237): n is a, c, g, or t
  misc_feature (242)..(242): n is a, c, g, or t
  misc_feature (265)..(265): n is a, c, g, or t
  misc_feature (276)..(276): n is a, c, g, or t
  misc_feature (278)..(278): n is a, c, g, or t
  misc_feature (280)..(280): n is a, c, g, or t
  misc_feature (294)..(294): n is a, c, g, or t
  misc_feature (297)..(297): n is a, c, g, or t
  misc_feature (300)..(300): n is a, c, g, or t
  misc_feature (307)..(307): n is a, c, g, or t
  misc_feature (316)..(316): n is a, c, g, or t
  misc_feature (318)..(318): n is a, c, g, or t
  misc_feature (327)..(327): n is a, c, g, or t
  misc_feature (331)..(331): n is a, c, g, or t
  misc_feature (346)..(346): n is a, c, g, or t
  misc_feature (354)..(354): n is a, c, g, or t
  misc_feature (363)..(363): n is a, c, g, or t
  misc_feature (373)..(373): n is a, c, g, or t
  misc_feature (378)..(378): n is a, c, g, or t
  misc_feature (381)..(381): n is a, c, g, or t
  misc_feature (388)..(388): n is a, c, g, or t
  misc_feature (397)..(397): n is a, c, g, or t
  misc_feature (408)..(408): n is a, c, g, or t
  misc_feature (415)..(415): n is a, c, g, or t
  misc_feature (421)..(421): n is a, c, g, or t
  misc_feature (425)..(425): n is a, c, g, or t
  misc_feature (427)..(427): n is a, c, g, or t
  misc_feature (431)..(431): n is a, c, g, or t
  misc_feature (434)..(434): n is a, c, g, or t
  misc_feature (440)..(440): n is a, c, g, or t
  misc_feature (444)..(444): n is a, c, g, or t
  misc_feature (447)..(447): n is a, c, g, or t
  misc_feature (452)..(452): n is a, c, g, or t
  misc_feature (457)..(457): n is a, c, g, or t
  misc_feature (473)..(473): n is a, c, g, or t
  misc_feature (502)..(502): n is a, c, g, or t
  misc_feature (514)..(514): n is a, c, g, or t
  misc_feature (529)..(529): n is a, c, g, or t
  misc_feature (541)..(541): n is a, c, g, or t
  misc_feature (547)..(547): n is a, c, g, or t
  misc_feature (675)..(675): n is a, c, g, or t
  misc_feature (686)..(686): n is a, c, g, or t
  misc_feature (747)..(747): n is a, c, g, or t
tanaaaaannnaangtctgnaannaaaattganaancaaaaaaaaaaaaaaaaaacttgcatcnanacacaananggcaggagtcnccangtcttcttgagcagtgagtttgcaggcccccacaggcccccttcncanggtaaaanngngncccnnnncncaaaggagacaaaaacccggcancccaaacnggcccnnccccccnccccccngcaccccagtgcccccaactgggcncaggnaaaaaaaaaataaattgagtggntggggaggaananangggaaggggcaaanccnaanggagccngacccccanantggggaaanccangccaacaaaacgggnggccaaanccacccccngggaaaaaanctttntanttcaaanttcgattantgtgtccttangacaaangtccancccnanaaantanctgggngaanaangcaantgtcncgacagggcttaatcnccacccccaggcatggaaccattcagggngaagcctgggangtgggcacaagaaantcaagctgaaanaaaaanaacaaaatcagtaataaaaaaattataaaacctgttgcttgtctgaatagatttgagcaacagtcttgcttttgttaaaatcctggagccgttaagtcctgaatattcttctggacatcattgctggntggagaaaggngccccaggcccggctcggctgacatctgtcagggtttggaagtctcatccagctgcctgtnctcctgagagatccttagggctgctgggagcaggccggg

SEQ ID NO: 512893 - DNA, 182 bp, Homo sapiens
gggattaagtcagctcccccaagatgagctgagcccccagagagagctctgacgtcacaagtaacaggcccagctccaggccccaactccgcccagctctccccgtctggatctgcactctaacattcgactctgctgctcatgggaagaacagaattgctcctgattgaacacaccacggt

SEQ ID NO: 512894 - DNA, 189 bp, Homo sapiens
tagaccatataccgaatattatgagtcttatttgttattgttcatagtagtctaatatcatcaaaatatcacaatcttataatgtcatatttaatttcaaagattaaatgaaacctatattgaaagtggtttgagatagtggtatcagaaagcatttcttatgacttattttgtatcatttgttttcct

SEQ ID NO: 512895 - DNA, 726 bp, Homo sapiens
attctaatatatttatgggaatgattaatacattttctgatgtcaaatgagagggagaggattttattttataaatatgttaatgcatgctcacttgcttaaaaactgggtactttatgactgccagtgtaaataaattaggcaagtagattctcattgcatcacactctattcattgcacaatggtgtttataaactggattagaattgcgtgctagtgcctcatcttgtaactctgactgctctacctatcccctgctatgtcagggaatgttgagatggcaagtgatagaaataatgttgttaatattctttttttctttcacatcactttttttcacagtgtttttatgtagaatttgtttctttgtttttagctggacatcactgggaaagtcagcaaggtttggtgtggtagttatcacttttagaatggttttcacattcggaatctggattttggttgccaaatatggggatggggcataataagttgggcagagtccaattttttgatctcttgatattgtcttttagattgaagttagttcaaaaagtttcgtgaatggtaaaccatgggtgcgaatgtacgtaaatgagtaagcactgggggggacaggtgcgcaggataaatggggcaggtgattaggtatgtgaatacttacgagagaaaattcggttatattaatatgaaattgtacagtattatttgctgctgtttgaaaa

SEQ ID NO: 512896 - DNA, 132 bp, Homo sapiens
gttggtccagaaccatccagcttctctccctgtgactagtgtcatgttccctgtgggttcctagcttcaaactcgtacaagacttgcattttcagtggctggcttggagctgtgacagtgggtacctgtgct

SEQ ID NO: 512897 - DNA, 665 bp, Homo sapiens
  misc_feature (56)..(56): n is a, c, g, or t
  misc_feature (168)..(168): n is a, c, g, or t
  misc_feature (177)..(177): n is a, c, g, or t
  misc_feature (180)..(180): n is a, c, g, or t
  misc_feature (188)..(188): n is a, c, g, or t
  misc_feature (212)..(212): n is a, c, g, or t
  misc_feature (217)..(217): n is a, c, g, or t
  misc_feature (219)..(219): n is a, c, g, or t
  misc_feature (230)..(230): n is a, c, g, or t
  misc_feature (255)..(256): n is a, c, g, or t
  misc_feature (337)..(337): n is a, c, g, or t
  misc_feature (362)..(362): n is a, c, g, or t
  misc_feature (375)..(375): n is a, c, g, or t
  misc_feature (385)..(385): n is a, c, g, or t
  misc_feature (395)..(395): n is a, c, g, or t
  misc_feature (429)..(429): n is a, c, g, or t
  misc_feature (460)..(460): n is a, c, g, or t
  misc_feature (545)..(545): n is a, c, g, or t
  misc_feature (547)..(547): n is a, c, g, or t
  misc_feature (562)..(562): n is a, c, g, or t
  misc_feature (564)..(564): n is a, c, g, or t
  misc_feature (573)..(573): n is a, c, g, or t
  misc_feature (578)..(578): n is a, c, g, or t
  misc_feature (595)..(595): n is a, c, g, or t
gggcggcggcggccggggaggcggctcgggcacagtaatggcagcgctgtgagcangggaacgcgagctgacagccgccgcgccgccgctccgcccaccttcctcgccggggcttcgtctttcactccttcgggctgctccccctccccttgtcccctgcccttgccntgttctgcngangatttcanactacacttgcacaatgtctttgnaaacnangagtagtagcnttgatgaaacatggaacaaactttnngacgacaataaaagccgtggtcatgttggaatacgtcgaaagagcaacatggaatgaccgtttctcagatatctatgcttnatgtgtggcctatcctgaacccctnggagaaagacttnatacagaaantaagattttntgggaaaatcatgttcggcatttgcataagagangtttggagtcaggaagaacaagtacttggtnatgtatcataggtactggcgaacgaatacagcaagggtgcaggactaatactggacctgcttataataggtatctcaaaaaccangnttattaaaaagaatnanttacagaangggancttcagtatggctatgnggggtagatatgatgaaccatttatggaataggagactagcatggatatgtggggaaatgtggtggaccc

SEQ ID NO: 512898 - DNA, 101 bp, Homo sapiens
aagaagagattgcctttttggagaaactcacgagaggaaatccaagagctcaggctcagattcaaggacagcatgtccaaatcgatgtggatgtttcaagc

SEQ ID NO: 512899 - DNA, 308 bp, Homo sapiens
tgtgcagacgggttctcagagagccagattatgatcctaagagaacctgagtaccagaaaagttacattgtccctactcaggtaatcaaaatgggctgggtgcggtggctcacgcttgtatcccagcacttggggaggacgaggccggtggatggcttgagctcaggaatacaagaccagcctgggcaatatggcaaaaccccatctctacaaaaaaatacaaaaattagccaggcagggtggcatgtgcctgtcgtcccagctactggggaggctgaggggggaggatcacttcagcgggcgaagtc

SEQ ID NO: 512900 - DNA, 701 bp, Homo sapiens
gcctctttttccggctggaagccatggaagggtgtagaacgagaagaagaaggaggtacctgctgtgccagaaacccttaagaaaaagcgaaggaattgtcgcagagctgatagatcaacgcgcctgagaaagaggttcgcccaaaaggatgcttcgaacaggcaagggaggaatgcttatctatgacctagcacagcactatcatcaaggaatataggcagatgtacagacactgatgttcgaatggcgaggatggctgagaaaagctggctagatttctatgtacctgcagaacccaagattggcgttggtcatcagagtcagaggtatcaatggagtgagcccaaaaggttcgaataggtgtgtgcagcattcttcgaccttcgtcgaaatcttcaatgggaaccttatgtgaagctcaacaaggcttcgattaacatgctgaggattgtagagccatatatggcatgggggtaccccaatctgaagtcagtaagatgaactagtcttacaagcgtggtttatggcaaaatcaataacgaagcgaatagctttgacagataacgcttggatgtgcgcgatctcttggtagatacggcatcatctgcatggaggatccgattcatgagatctatactgtctggacaaccgcttcgagagaggcgaataattcctgtggcccttcagatggtcttctcca

SEQ ID NO: 512901 - DNA, 432 bp, Homo sapiens
ggggtgtctagaggatccctgatggtcaccgctccaaataattttctatttgtagtagagacaggctttctccacatgggtcaggctggtctgaactcccgacctcaggtgatcctcccacctcggcctcataaagtgctgggattacaggcatgtgccaccacgcccggcctaattttccactttggatgatctctgccatttctctttatggagcatgtgcagtgttgagaatacgtatttggatgcagtacgtgtagtacagctctgaatggtgtcctttaacttggggtaagttcttttttagtagacctggcttcttcggaatatttcttctcttatagtgcctaacacaataattatgcccaaattagacaaattaacattggagtgttcacagatttattactgtatttaaaccatggatcttca

SEQ ID NO: 512902 - DNA, 966 bp, Homo sapiens
ggaatcttggtatggagttgcctcataagcaggttaaaggacagtgattagaatgattaaggcttaaaggtatcgtttaatacgatgttcagttggatgattggaaacaatcttaaatgactcaggtgaaaggcaaataataaagttcgtacttcgttctatagctcgctgtcaatgcacagggtcactgaccagaaaatgatctggattcgatgaaaggtcgattttggggcaagtcattgagaattgcttttcagaatgtttcatgctctcttggatctccttattaacgatgacctgggcatcgggcagcattgccacaatggactgggatagatcagtcagatgtgttcaatgactaggtcatccccaggatgacttctaactgttagtaatccacgctgaaagaagaaaagaaggcgcttgaagatgaaaaaccagaaccgaagcagaatgccctagggcaaatgcaaaatatccaggtttctatttgtatgcagtcagcattacaatgaaggaacagtaatgaagtttcagaaaattacaggtgatgctagaattcctttgcgcatcgtcgactgcctgtatcctggtgcgccacgttgtcgtacatccacgacgggcttcaggaacattccgagcaacaacgtaggagtcccagctactgagcagcggcaggagtcttttgaaggattcattgctagaatgtgttctcctgtcagccagatgcgagcttctggaactggaagtcaaagaaaagaagaggagtggtccagaaatagcagatcttcttcagagaataagaccaaaacaggggatataccgacagacactctgataagcaacagcctggaaaggacctgcattctctgatctgactgtcctgaaaaccagaaaagcaaagaaactagggaaacatagttctttggttaatgaaccaaattaaaagtaggtctatgaaaaaat

SEQ ID NO: 512903 - DNA, 250 bp, Homo sapiens
gatgcagtctgcgaaagtgagctatgacattggagagaggcagttcccaaaccaagtcccagtcttatggtgccaacttttcttggaccaaagaaccagagtattcccaaataggttggactgactatatctctggttgactgtgaataaagtccggtatgccggatttatagtccctgttttatacaatacctctcttaatctcctaaataaaattggacctttagaactaccaaaaaaacaaaaacaa

SEQ ID NO: 512904 - DNA, 104 bp, Homo sapiens
ctagaggtctattggaatccaatgctagcttagaatatagcacagttctgctggagtgtgctcacatgacacactctggacgcagccctgaaaccagcaacatg

SEQ ID NO: 512905 - DNA, 309 bp, Homo sapiens
  misc_feature (65)..(65): n is a, c, g, or t
tttttggactcctgtgttttggggggggggggtggctttcccaacaaagccccccctcctgtaangattggaagccccagggtaagaaccctccccccccggcttgaagaaaggcccctccctgaccccccccttttggtttacccctgttgggccccatcccaaaaagactgctttttaaaaaacggccccgggttgatttttttctttcccaggaatgtgactttgggttatccccctttgggggccgggggcccgttttgtacccaagtgagttgtgtgaaaataaattataaatgagttgtttga

SEQ ID NO: 512906 - DNA, 700 bp, Homo sapiens
tctcaattaaaggattggatttatccaaggtttggtgaaaactttctacaagggaaactcttattagatgcggcatggtacggggctagggaccacgcacttacagccaggcggtttcaaaagatctttgaaatgtgccatgtgattagttttaaaaactctacacccgagtggagaactcgaggaagacaatttaagtgtttcactctgaactccagagggtgcactcaagattaaagtgacagcctccacttgggcaaataattagcgggttactggagggtactccaagaagaaagggtgtggctgagtggataaattcagaaagtgcttccccaaagggtggggtggctttttaaaaagttttcaggtcacaaccctggcagaaaacacgtgatgcccaacacacgtgaattcgcggctccaggaaacacgggtcttccaagttcccaaggggcgtggggttcccccaagcgatcaagttccgtggtggcgtgtaatcaagagggtccttgggacgggatagggagcactggggagctgtacaccatcagtcataagggagggcagtgtaaaagatgatccaaatgaccatgaacaaggcaaaagaggtcataaacccttccttcgtgagctcccaggtgccaccatatgcttcctcatcaatctgtaggtaatgctgaagtagaggtacaggacc

SEQ ID NO: 512907 - DNA, 149 bp, Homo sapiens
ggggtccgtgtagtctgtcttggggggcgggaagtcccagtcgtcgttcgaaggagccggactccgcctggctgtgtcaatcttcacctcataggtgtggtctggccgcacaagtcagtgtgtacaggtgtgtaaactcatcatccttg

SEQ ID NO: 512908 - DNA, 498 bp, Homo sapiens
taataaagcagaaatgtatttataaggcacccttgtttcttacagtggagcaagatccacgcctgagcgcctgggaagtatatcgaggttgcgggaatctacacaaaacatacggggtagccagggcccacccatggaacactatttggctgaagttgagaccggcgaggtgatcccggcatgaggctgggggtggctcctaggctccacaatacactgaggagtgggtggggacacccatgacagctacccaaacactggcagagagggaggccctagcacatctgatgcacatgttggtgggcctgccagggcgaggaggatcctggatagttcatcgcacggggccaggttctcagggccctcaaaaaatacgaccgcctatactcgacaccgttgacttacaaacacacgttggggttgactaagacctgagaggtctcgacgttttttatctgtgcgggcgaccactgggtgttggccgggtacatgcattta

SEQ ID NO: 512909 - DNA, 610 bp, Homo sapiens
  misc_feature (581)..(581): n is a, c, g, or t
  misc_feature (586)..(589): n is a, c, g, or t
tccataataacttctaggcatataggtccttacctctttggtcaggtgtattccgaggtatttgattttgtgtggtacaattttaaaaggtatcgtatttttgtattccttttctaatgtttcattgctggtatacagaaatgcaactgacttctgaatgttaatcttatatcctgccactttgctgaatttattaatcagttcaaggagttttggggttgagtccttagggttatgagggcgttttctcgtgtgaatgagggtttgatgttgttaatgtggtgggtgtattttcctcgttgtgtaataattagtatgtagagagagtagagagctgtaattattatgtttattcctatgagaataattgtgatgttggatcatgaaaatgatgctgtaatgataaataattctccgattagattgatggatgggggtagggctaggtttgtgaggcttgctattagtcatcatgttgctatgagtggtaggagtgtttgcagtcctcgggctaggattatggttcggctgtgtactcgttcatagttagtgttggctaggcagaatagtatggaggatgncgacnnnncaggtctaattcgggtgtgat

SEQ ID NO: 512910 - DNA, 141 bp, Homo sapiens
catcatggggatgggggtggactgcacaggacgaacactggccacaggcttttcatcacccttcaaagttggctgccagtttctctggctgaaggcggggatgctggtcaggctctgatcgctggcagggtaatactgcgc

SEQ ID NO: 512911 - DNA, 421 bp, Homo sapiens
ccgtaaaaagctgactttcctgaggtcacagagtgaagtggcagcagagcagctctccccacttcaggccctggattttccctggacaaaacactcttggattcttacatccacgaaccgattttttcgatcccttttagaaataggcgaacggatcacattcagtaatctcccttactctgagccttgcctacactggcacattcctgaaaagtgtaaagctgtgtgggactagccacttaatcataaccaaacccctgcccaggtccctccacagaagttagtcaccatccctgggaggagggctggatcttcccttggggccacaccacgctgatccctggaccacaaggatgcttatgaggtctgctcactggaatcccaaggactttataaaaaatgccaaggggcaaattccact

SEQ ID NO: 512912 - DNA, 484 bp, Homo sapiens
  misc_feature (455)..(455): n is a, c, g, or t
  misc_feature (460)..(463): n is a, c, g, or t
gatctgaaaccaggggtgagaccaactgaagcatgacttggaaagtgaagaggaaggctggacatgggagagcgcatgccgttgagggattaaggagtgggaatgaacatgagggcgttttctcgtgtgaatgagggtttgatgttgttaatgtggtgggtgtattttcctcgttgtgtaataattagtatgtagagagagtagagagctgtaattattatgtttattcctatgagaataattgtgatgttggatcatgaaaatgatgctgtaatgataaataattctccgattagattgatggatgggggtagggctaggtttgtgaggcttgctattagtcatcatgttgctatgagtggtaggagtgtttgcagtcctcgggctaggattatggttcggctgtgtactcgttcatagttagtgttggctaggcagaatagtatggaggatgncgacnnnncaggtctaattcgggtgtgat

SEQ ID NO: 512913 - DNA, 341 bp, Homo sapiens
caatttgccctgcctggagttccccctgggtttaggacactttaacaagctttgtccacgggtttccccatttccaccagggcctggacacacccactccgtaaccttttccctggacctgtgccaaacctagcacttgttatgcctccatgccccgagggccctttttcagttttgggaggatgactccagtccctgcacgccctgggacaccctttacggttgctacccaggcggccaagcttcaaaccgtgccaaacccaggtgccccagtgcctttgtttatattttgcttccagcctgccaggcccaggaggaaataaacatgccccagtttttta

SEQ ID NO: 512914 - DNA, 701 bp, Homo sapiens
  misc_feature (78)..(78): n is a, c, g, or t
  misc_feature (594)..(594): n is a, c, g, or t
  misc_feature (663)..(663): n is a, c, g, or t
  misc_feature (679)..(679): n is a, c, g, or t
  misc_feature (690)..(690): n is a, c, g, or t
ggggactaggctgagagtgaaggcgtaggatacggtggttttaacgtagttagggtaaaggttagttttgtagatgtntgacgttggatattataattgggatggttagaatagttagtgtggttaatgtgagtgaggcgaatgggtttattacttttatttggagttgcaccaattttttggttcctaagaccaacggatagctgctatcctttaaaagttgaaaaagccacatttttaagtgtggaagcatgagttagcagttcttgcaaactttttcggtagataagaatatttaattttctattactagattcacaatctagggtttttattaaactatatctacagtaaaggggtcctaggattattttagggtttaaggtcagtagtagtagtggtagaatatgtagggctatgagggcgttttctcgtgtgaatgagggtttgatgttgttaatgtggtgggtgtattttcctcgttgtgtaataattagtatgtagagagagtagagagctgtaattattatgtttattcctatgagaataattgtgatgttggatcatgaaaatgattaaagctacgatccccancatgcatgtcttcatgggcactcctggttttggtaacctgcacttatcatttttaggctgacacatcanttcaggattacgaggngttcgcctganatccggtgcag

SEQ ID NO: 512915 - DNA, 599 bp, Homo sapiens
  misc_feature (78)..(78): n is a, c, g, or t
ggggactaggctgagagtgaaggcgtaggatacggtggttttaacgtagttagggtaaaggttagttttgtagatgtntgacgttggatattataattgggatggttagaatagttagtgtggttaatgtgagtgaggcgaatgggtttattacttttatttggagttgcaccaattttttggttcctaagaccaacggatagctgctatcctttaaaagttgaaaaagccacatttttaagtgtggaagcatgagttagcagttcttgcaaactttttcggtagataagaatatttaattttctattactagattcacaatctagggtttttattaaactatatctacagtaaaggggtcctaggattattttagggtttaaggtcagtagtagtagtggtagaatatgtagggctatgagggcgttttctcgtgtgaatgagggtttgatgttgttaatgtggtgggtgtattttcctcgttgtgtaataattagtatgtagagagagtagagagctgtaattattatgtttattcctatgagattgtttgggctactgctcgtagggccccgatgagtgcgtattttgagttggat

SEQ ID NO: 512916 - DNA, 198 bp, Homo sapiens
  misc_feature (141)..(141): n is a, c, g, or t
gcttcgtcctgatcactgtagccctggccctcatgcactgggtcttgattcctaatcactggcgtctgggggttaccaaatggcccctggattcctggattccttactccgggtccttaatcaaatgggtcctctgcctcnttgaactttccttggacgtccggggtccgtcaatcaatccattccgggttcccttaa

SEQ ID NO: 512917 - DNA, 623 bp, Homo sapiens
  misc_feature (78)..(78): n is a, c, g, or t
ggggactaggctgagagtgaaggcgtaggatacggtggttttaacgtagttagggtaaaggttagttttgtagatgtntgacgttggatattataattgggatggttagaatagttagtgtggttaatgtgagtgaggcgaatgggtttattacttttatttggagttgcaccaattttttggttcctaagaccaacggatagctgctatcctttaaaagttgaaaaagccacatttttaagtgtggaagcatgagttagcagttcttgcaaactttttcggtagataagaatatttaattttctattactagattcacaatctagggtttttattaaactatatctacagtaaaggggtcctaggattattttagggtttaaggtcagtagtagtagtggtagaatatgtagggctatgagggcgttttctcgtgtgaatgagggtttgatgttgttaatgtggtgggtgtattttcctcgttgtgtaataattagtatgtagagagagtagagttacgtttgtgatagtgttagtataatatttagtactctttttcggagtttaccgaactgattgtattgcggtcccgtatattgcgggtcggggatcctctagtattc

SEQ ID NO: 512918 - DNA, 694 bp, Homo sapiens
gcatcagataactcttttggcacagccatgtcttttctttcttgttcaattcagtttgttgtactcgtgggcctcttgtccatcatcttcaccacattgtgttgctccatttccattgtgcggtcattatcccattccagttcatcgtcaggttgcattttttgcaaacgggtcccttttggacattctactggtactcttagtaagacaatgcatgcgcaccaatttctcacattgttatttcccaaggttggggttctcattcacgtcctcattttggggcgcttgccatccaagcacaaatgctccttgggcagcacaatcaaatctcgtctcgcgccactctcagtcgcaccctgctccacttcctcttcaaacaacctccaagggggcacacaacaatttcggggccaccccaattttgtccaagcacgtggccccaattttcccacaaaccgaagcaaccaacttgggcaaattcacagatttgtcctaaccaccaccgaaccagcttggcggccccatcaaggcttctcgggcaacaattccgttcaagttgagggcgggccaattcagccatccgttaaccggagcaagggtttataatccgtcgccccctcataatgcccaagccaaaacaccagccaatatcgcgcgatcggacaattcttatgcaacaatctgtccacaaata

SEQ ID NO: 512919 - DNA, 755 bp, Homo sapiens
ctcgctctgctagctatccctgtgcagcaccccggcctggagctcctgagaccaccgccctgcatgggggcttccagaggcgctacggtggcatcacagatcctggcacagtgcccatggttccctctcatttctctcggctgcctcttggagggtgggcagaagatgggcagtcggcatcaaggcaccctgagcccgtgcccgaagagggctcggaggatgagctaccccctcaggtgcacaaggtatagacaaggctgagcagggttcctgtggcccaggatggaggccaccgctgccctgccatcccgtctgcctgccatgggacggctcctctgagtgttccctggccccacgtgtgatggtgtaagtgtgtctgtgactgaccaagggaggtgacaaacactgggcttgccacagccccaggagaggaattagggagctaggaacccgagggcacacgggactctagacctcatccccaggacccccttggctcagaatagtgggagcagctggtcccacagcccaggccaactccagccacgacaccccaacactgcaagtccccacaggctccccagagacgagctgccgccaggagacccggccaacgtgcacgcgcggcggccagacccaaccccgcccgcgcctgaccagaccctaccggcggaaggcccgacccgcgcgaggacagacacaggccagaaggaatcaccgaccgcgcccccgcgccagcccaccgacgagcagag

SEQ ID NO: 512920 - DNA, 537 bp, Homo sapiens
gaatgcaggggtattggaaggctcgtgtgtgatagtgtgtttgggatcgaggatactcaccagacacgacaaatgcgaaacaatcaatgtccgagtatacaccatgcgtatgcagagctgggagtttgcaatccagccatatacaactggaaaacagctttttgatcaggtggtaaagactatcgtgctccgggaagtgtggtactttggactccactatgtgcctcatcacaggatttcctacctggctgaagctggctcagaaggtgtctgcccaggaggtcaggacggagaatcccctccagttcaagttccgggccaagttctaccctgaagatgtggctgaggagctcatccaggacatcacccagaaacttttcttcctccaaagtgacggaaggaatccttagcgatgagatctactgcccccctgagactgccgtgctcttggggtcctacgctgtgcagggcaagtttggggactacaacaaagaagtgcacacagtctgggtacctcagctctgagcggctgattcc

SEQ ID NO: 512921 - DNA, 127 bp, Homo sapiens
cccacggttgatctgttcctgcagctacttagatgtttcagttcattgcgttcgcttcccttgccttatgtattcagcaagggatgacccattcgggccgggtttccccattcggatatctgcggat

SEQ ID NO: 512922 - DNA, 586 bp, Homo sapiens
  misc_feature (265)..(265): n is a, c, g, or t
  misc_feature (365)..(365): n is a, c, g, or t
  misc_feature (380)..(381): n is a, c, g, or t
  misc_feature (536)..(536): n is a, c, g, or t
aaaaataaaggtctgggtgaggggcgcggcatttcatctgtcctcattctctgcgcctttcgcagagcttgcagcagcaggatgttgggccagagcatccggaggttcacaacctctgtgctccgaaggagccactatgaggagggccctgggaagaatttgacattttcagtgggaaggcaagtggactgcactagctaagatgagagcgtacgcaggatctaaatttggtacacccttccttgcagtaagacaccaactgctnaaaacatcaggaccgagcagtattttacatttaatatcccatgaagaggaagctaagtggcacgagcttttgtatagtcattcctctagcacgaataggncatgctggatatgannccccttaagcgtatgccgtaaaaaaaagaacttctttttattaagctctctttccactgcaagattcattttgattgacgtccactttaaagtaaggaccatatttccttaaatggcgttacttaaaaaaacctcctataccccaccacgggganttcactaatctaccccccctgatcacaactccttgtactgctcttgtgct

SEQ ID NO: 512923 - DNA, 247 bp, Homo sapiens
aaaagattcaatacggcaaccacagcaaagagaaatttctagttctgccactaacacttcctttaacacaactctctcaaacatgtgcctttcattgcattcaaagttatcggtattaccagctatcattgttttggggtttctctgctaattctattggcatgcattctaggtagttgcccattgtaactattaaattgactattttaataacaaagcatattcatggagactgccatctaggtat

SEQ ID NO: 512924 - DNA, 201 bp, Homo sapiens
  misc_feature (127)..(128): n is a, c, g, or t
  misc_feature (163)..(163): n is a, c, g, or t
ggcgcagctcttagtcgcgggccagactggtgtttactccgtcactcgccgaggttccttgggtcatgggttgccagcctgactggagacagaggacgctcccgggagacgaatggaggaaccaccnntcctcctactggttccaagtacaggggcctggtcncgcaacaggggaacgaaaaagcaaaacagaccgacaaa

SEQ ID NO: 512925 - DNA, 206 bp, Homo sapiens
accgcgatacccgaacgatgcctacaaggcgcaggaaaagcgcgccaagggggcgctgctggcctactcgctgggcgcgaccgtgctcgacagcggcgtggtcggcgacgtgatctgggacagcccggcgttcaacgctgggctcgcgccgggcatgaaggtgatcgcggtgggtggccgcgaatacagcagccaggggtaccgag

SEQ ID NO: 512926 - DNA, 634 bp, Homo sapiens
attgttggttgttgttttttgagaaggagtcttgctctgttgcccaggctggagtgcagtggtatgaccttggctcactgcaacttccgcctcctgggttcaagtgattctcctggcctcagcctcccaagtagctgggattaccagcaagcatcaccacacccggctaattttcgtatttttagtagagacaggatttcgccatcttggccaggctggtcttgaactcctgacctcaagtgatctgcccgcctcggcccccaaagtgctgggattacaggcatgagccactgtgcccagcctagaagaatattttaaatatttgtttagaagaggatttttgtgtttttttttttttggacatggtcttgctctgcctccctaggctggagtgcagcagcttgatcatagctcactgcagcctcaaagtcctgggctccagaaatcctcccatctcagccttccaagtagtctgggaccacaggcacaaccatcatgcccagctacagtggcagatgggatcttgcaactgttgcccaggatagcctcaaactctggggctcaaacaatcctcctgccttggcctcaaaaaagtgctgggattataggcatgagccatgtgacctggcttaga

SEQ ID NO: 512927 - DNA, 126 bp, Homo sapiens
  misc_feature (5)..(5): n is a, c, g, or t
agcgngggaacatatcacttttatgatcatgacctgatccaaggtaaagtacattgtagatgggaatcctggaggaatagttggcaagttcaaaagacgtatccataagtattgttacttgcagat

SEQ ID NO: 512928 - DNA, 470 bp, Homo sapiens
gactgaccggagaaagtacagatcccccctccccagttacccctattgatcactacacacaatcacacattcaaaatagggaattaccactaggacacacgtatcaccccggcacgattacacgcactttccaaccgcagacacagtgctacataaagttacatggtcacactctcacattctcacgttactgagttatttctgggtagtagatttactcagtaaggcatccagtacacttaagtgctgctaacagtcatacaaacacaattacacacacccctcagactaacacacagtcacagcctcatcagattctctccacacaaacaccctccacaaatgtcacgcagagttacacagccacacacaatcacagtcccaacacgggacacagtcatacctacacatacagccttacattgttacaattacacagctacaacgaggatatacaatcacacccgcgc

SEQ ID NO: 512929 - DNA, 132 bp, Homo sapiens
ttcatgaagcaatgttattagcgtatcatttagattctcttgcaagagtctcatttgttgtttttccaaatgcctgccaatattgttctgaaaatttacaacactgtgataaactgtatcttcaaagttaaa

SEQ ID NO: 512930 - DNA, 679 bp, Homo sapiens
agcgtgaaatcttgctggtgtcggctacggctggacagtgcgagtatcgctgatctcgtgcgtcgactggactagacagagactcgtgtgcttccccagctacatagtgattgctcgatgccttgagccctcccgaggtacctgggatcggacgcgactgtgctacctatgtcactggctcacagttttccgctattgctccgtgcgacgattcgtcgaaggcgcttgtcgatcgtgttagcttgtcgtctgctaggctcttcgatccttgtgaatggaagtttgtatcacgaatgtacttatatgtggatggacttatatatgttggagtatgtaagctgcagtgccatttcgttctgagtctccttatactgattgtgtattgcagtccattttactgagagagttgagtaccacaaaagtaaaatcatcggattatttatattactttgggaacaggatgtgtgttctttgtgtggcaatccagtcaattttggtattccacacatgacaggacttcagctgagattgctgcaatttgtgttggatttatagcaagttttatgttcctacttgagctttatcactatgctgtatgaaaaacgacaggagtcccagctgagaaaacctgaaaataccactagggctgaagccctcactgagccacttaatgcctaaa

SEQ ID NO: 512931 - DNA, 811 bp, Homo sapiens
  misc_feature (1)..(1): n is a, c, g, or t
ntggtcccctcccgaaaaaaggttggtctcccgaggctttttcccggacctgtgaagcgggttgactccctcccgcctcacccaatggtgccacgagcccaccggttggaaaccagggcgagagtatttaccccgtgtgacaaattagggcgcgcacaaataatgtgctgggacgtactcgggaccctcctctttgatggtggagcacccacacttcggcgagcaattgttggcaccagaaaggctctagagaagatggggtgccggacaattcgttgtgctgcagaaggtggcttttcaagtaagaaagacccttgtgtcttataagcgtgcggtatcaatgaatatgcccctccagaatctggggccaaagccatggacaccccttgtctctactattgggaagatggtaaatagtacacagcattctgtccaagaagaacggtccaataaagaatgagcgtcttacagtgccctgtgatagcaacatgcaccctttgtcccgacgtcttgtttagtgatccccctgtagaccaaagggtatgcaaggtaatatttcgcgagcgcagtgacgcccgccgggtgtgtcctcgcatggtgtaatgaggtccataagcagggagggcccctccagatcacagcagttttcgcgatagatcacatataccccattttgtgggaggacagttcattctataatggaggaatgattgactgggggggcgaagaacgacaaaaattatgtttacttgcactgtgaaaagtgttggccctcagacacatgtgttggatcttcagaattatgtgacca

SEQ ID NO: 512932 - DNA, 303 bp, Homo sapiens
  misc_feature (205)..(205): n is a, c, g, or t
gtcaactggtaaggatgaactgacaccttgagaaaactgaaacagcttgtcaagactagtttttggaacttgccccactccatgtgagtggaagcatggcctgatcacccacggtgtgcctgtattgacatctttgttctggttttgacttggcttgacttggtaagactagtctttggaacttgccccactccacgtgagtganagcgtggcctgatcacccacggtgtgcctgtattggcacttttgttctggttttgacttggcttgacttggtaagactagtctttggaacttgcccca

SEQ ID NO: 512933 - DNA, 346 bp, Homo sapiens
  misc_feature (72)..(72): n is a, c, g, or t
  misc_feature (75)..(75): n is a, c, g, or t
  misc_feature (77)..(77): n is a, c, g, or t
  misc_feature (165)..(165): n is a, c, g, or t
  misc_feature (170)..(170): n is a, c, g, or t
  misc_feature (175)..(175): n is a, c, g, or t
  misc_feature (240)..(240): n is a, c, g, or t
  misc_feature (319)..(319): n is a, c, g, or t
  misc_feature (343)..(343): n is a, c, g, or t
gtttggctacgtacaatggaactttaagtcatatatacatacatatatatatatatatatatatatatatanttntncggggggatatgttatatttttctgtttctataagagatgaatacagtggatactttttctattggtaatgattgagttcacctcttncagangacantttctttctcttctgagtaattgaaataaaatctggcccttgtgaaaccctgggacatcttaagnctgttgaaataccaggttaaacacattccaagagatctgttcaaactcaaattcttttgtatacttctgaggtgcctgnggattagacttccattatttttgngga

SEQ ID NO: 512934 - DNA, 300 bp, Homo sapiens
  misc_feature (56)..(56): n is a, c, g, or t
  misc_feature (238)..(238): n is a, c, g, or t
gaaaaaaaagaaaagaagaatattttgagacatgtgaaaatcatcctaaattcaantttcaatgtccacaaacaaagttttattggaacacagccacagccatttgtctgtgtattgcctatggctgcttccacatgcactcacagagctgagtaattacaacagagaccgtgtggccagcaaagattgaaatatttactatctggccctgtataaaaaaagtttgctgacccctgtnctgtactgttaagtactattggtactattaagtactagtagtagtactattaataatagtat

SEQ ID NO: 512935 - DNA, 1326 bp, Homo sapiens
  misc_feature (1125)..(1125): n is a, c, g, or t
gcagaatggccctgtgagcctacatggccagagctggagagtgcagtgaatggagctttacatcccatgctctgtgctgatgaatgcttggaacatgcatgtgactcacctgtgaatgcccatgccctgtgcacatgtgctgctgtgatgactgcctgtgcccttgtgatgcttgccccatcccacagtctgtgccctgccccttgcccctgatctgtaggtgcccatcacatgaaaaccttgcttctgcgtgattgcattgtgagtgcacaaatgaccggatgatctgcattgtggcccattgacatacaagaacttgtgatatgcatgtgcatacacactgtgaaaccacttggaatttgtaaccaatgtgtgacaaggatcaatccatactttcacgcagaggggcattactgtggcattgtgcgacaccttggacataccagttggaccatggataccagatagagaacaacaacactatgacatgataataccaatgagcgaacacacgtcttggaggcatagcatatgagtgaagtccccgcctgtgcaacacatattgccacactcagaccaacaatacacaatcttgaccacacgacttgagcacttcaccccaatagggggaacgagtgaaaagcacacatactatcacacaataatgtggctataacacattgtataggagcacacaaaggacccccaatattaacgagacaacaagtaacaggattgggtcagatccaacagatataagaatcacgaatgtatagtacactaaacataatggatatggagaacttagaaagctggcccaaacgaacaacacagcaagtcacacaaacgacaaatggaatatatctataacccacatagaatgctgtagatcgacagaaacggtcgtgtcccgagggtgatgaccccaattggtcactgaggtcgatcgtcgtagagtacgacacaggagacatggacaccatcaaacccatagtccacaatacgggagcaacacaaccatatgacacctcatggtgcacagcgtcacacaagcgtgcgtggaagtcgtggaccaaacccaatacacctatggacctatatacaaacgatgagtgaaccaactantgtgaagacgagcgactagtaggaaagtgcagacaacggaacatggatcacaaccacaccagcgcaatgtacacaaccatacccggaattgagacaagacggaaacacggacaaacattatgaatgaagacagtccaacgcagcacagaagacaccgatgtgatgatacacttggatttggcacgcaattggtggaaggca

SEQ ID NO: 512936 - DNA, 657 bp, Homo sapiens
tataggaggcagccatggcgcccagccggaatggcatgatactgaagccccacttccacaaggattggcagcaagcgagtggacacttggttcaaccagccggcgcgcaagatccgcaggcgcaaggcccggcaggcgaaagcgcgtcgcatcgcccctcgccccgcgtccggccccatcaggcccatcgtgaggtgccctacagtgagataccacaccaaggtccgggctggcaggggcttcagcctggaggagctcagggtggctggcatccacaagaaagtggctcgcaccatcggcatctctgtggacccgaggaggcgaaacaagtccacggagtcactgcaggccaacgtgcagcgcctgaaggagtaccgctccaagctcatcctgttccccaggaagccttctgctccgaagaagggagacagttctgctgaagaacttaagctggccaccagctgacaggacctgtgatgcccatccggaatgtgtacaaagaggacaaaggccagagttatcacagaagaagagaagaactttaaggcttttgccagtctccgaatggcccgtgccaatgcccgactctttggcatccgagcaaaagggcgaaggaacgctgcagagccaaagatgttgacaaacaaaaaaagcaaa

SEQ ID NO: 512937 - DNA, 161 bp, Homo sapiens
gtgatttacccttttgatgagaatactgcagcccccagtaggaaagttatatttttgaattcccgcctcccagtacaggataacagcccctaaaaatggaagccttaggccgttcctccccctgcactccagcctggctgacagagcaagactttgtctca

SEQ ID NO: 512938 - DNA, 204 bp, Homo sapiens
ccccccccctttccccccccttcctcaaaagttgaagggttcccccccccttggttgggaaaggcaaccccccccccaagcccctttgaaaaaaaaccagtttttttttttaaacccccctttttttttttttttgagaagccccccgtggggcccttttttttttaattgggggccccccctttattccttttttctccccca

SEQ ID NO: 512939 - DNA, 942 bp, Homo sapiens
  misc_feature (34)..(34): n is a, c, g, or t
  misc_feature (104)..(104): n is a, c, g, or t
  misc_feature (116)..(116): n is a, c, g, or t
  misc_feature (164)..(164): n is a, c, g, or t
  misc_feature (169)..(169): n is a, c, g, or t
  misc_feature (257)..(257): n is a, c, g, or t
  misc_feature (259)..(259): n is a, c, g, or t
  misc_feature (265)..(265): n is a, c, g, or t
  misc_feature (277)..(277): n is a, c, g, or t
  misc_feature (291)..(291): n is a, c, g, or t
  misc_feature (295)..(295): n is a, c, g, or t
  misc_feature (299)..(299): n is a, c, g, or t
  misc_feature (303)..(303): n is a, c, g, or t
  misc_feature (309)..(309): n is a, c, g, or t
  misc_feature (312)..(312): n is a, c, g, or t
  misc_feature (317)..(318): n is a, c, g, or t
  misc_feature (320)..(320): n is a, c, g, or t
  misc_feature (323)..(323): n is a, c, g, or t
  misc_feature (331)..(332): n is a, c, g, or t
  misc_feature (337)..(337): n is a, c, g, or t
  misc_feature (340)..(340): n is a, c, g, or t
  misc_feature (342)..(342): n is a, c, g, or t
  misc_feature (346)..(346): n is a, c, g, or t
  misc_feature (360)..(361): n is a, c, g, or t
  misc_feature (366)..(366): n is a, c, g, or t
  misc_feature (368)..(369): n is a, c, g, or t
  misc_feature (378)..(378): n is a, c, g, or t
  misc_feature (394)..(395): n is a, c, g, or t
  misc_feature (397)..(398): n is a, c, g, or t
  misc_feature (401)..(401): n is a, c, g, or t
  misc_feature (405)..(406): n is a, c, g, or t
  misc_feature (410)..(410): n is a, c, g, or t
  misc_feature (418)..(419): n is a, c, g, or t
  misc_feature (423)..(423): n is a, c, g, or t
  misc_feature (427)..(427): n is a, c, g, or t
  misc_feature (429)..(429): n is a, c, g, or t
  misc_feature (438)..(439): n is a, c, g, or t
  misc_feature (443)..(443): n is a, c, g, or t
  misc_feature (483)..(483): n is a, c, g, or t
  misc_feature (494)..(494): n is a, c, g, or t
  misc_feature (506)..(506): n is a, c, g, or t
  misc_feature (519)..(519): n is a, c, g, or t
  misc_feature (532)..(532): n is a, c, g, or t
  misc_feature (534)..(535): n is a, c, g, or t
  misc_feature (545)..(545): n is a, c, g, or t
  misc_feature (550)..(550): n is a, c, g, or t
  misc_feature (553)..(553): n is a, c, g, or t
  misc_feature (556)..(556): n is a, c, g, or t
  misc_feature (572)..(573): n is a, c, g, or t
  misc_feature (575)..(575): n is a, c, g, or t
  misc_feature (577)..(577): n is a, c, g, or t
  misc_feature (587)..(587): n is a, c, g, or t
  misc_feature (646)..(646): n is a, c, g, or t
  misc_feature (667)..(667): n is a, c, g, or t
  misc_feature (673)..(673): n is a, c, g, or t
  misc_feature (695)..(695): n is a, c, g, or t
  misc_feature (727)..(727): n is a, c, g, or t
  misc_feature (734)..(734): n is a, c, g, or t
  misc_feature (739)..(739): n is a, c, g, or t
  misc_feature (775)..(775): n is a, c, g, or t
  misc_feature (783)..(783): n is a, c, g, or t
  misc_feature (796)..(796): n is a, c, g, or t
  misc_feature (799)..(799): n is a, c, g, or t
accccattcatataatatttatacatacccatcnaaatttttaatattttatttaatcatctatactataatacatttttaattttaacccacatcaaaattcncaataaatattnccatacttttcatcaccattttttattaaatttacttttatatttatnaaatntacatctattcatttttattcccccatttttatattaataacctctctcccaataatatcaccattaaattcattacactaatctccncnaccacnaaatatttaaanccatattccaaatnattnaatncttnctcatntcnccttnnanagnaccacccnnctgtnatnangctnaagcgcaacattcnngcctntnntgcccatcnaaactacaagaagctnntnngcncctnntgcncacacaannagcncctnantatcctccnngcanaactggaagcgctaggcatgaagggtaccccttccctagngaagtgtcggnccctgaaggagnagagggaggaggnagctgaggtggcnannttggatgttncgaanatnatnagtggctcgggccggnnangnagacgtacancctggaaccctttaggagaagcagcacccccaggggagctgtaccgacggaccctgganacagatgaagagcggccccgncccgcncccccagactggtcacatatgngtggcatcatcagcagtgatggcgagagtaantgagctntgccncccccaggagggacccttgatacatgtacaaagcanacatagcnccccttgccctgngtntgtggaacagaaacagcttccttcaaagaagactgcagctcccaaggacccaagctgttgggatgctacttttcagcttcccgctgtccctttaaggggttttttttttaagactcaataaaggagggtttttaatcccccca

SEQ ID NO: 512940 - DNA, 932 bp, Homo sapiens
  misc_feature (11)..(11): n is a, c, g, or t
  misc_feature (34)..(34): n is a, c, g, or t
  misc_feature (54)..(54): n is a, c, g, or t
  misc_feature (108)..(108): n is a, c, g, or t
  misc_feature (142)..(142): n is a, c, g, or t
  misc_feature (167)..(167): n is a, c, g, or t
  misc_feature (679)..(679): n is a, c, g, or t
  misc_feature (696)..(696): n is a, c, g, or t
  misc_feature (715)..(715): n is a, c, g, or t
  misc_feature (725)..(726): n is a, c, g, or t
  misc_feature (850)..(850): n is a, c, g, or t
gagatcaactntaagcattacattctcaattggngacaaaaattggttcttggngtgaaaaaatattagatatggctcgtggacttgcaatatcatcctatccaacanaatcttattccttagtattaatttatctcattgngaagaaatttgtagttaaaactatntaatgtaattggaatttaatttctgtaattgggaaggagggtaataatgaacaaaaagtttgagaaaaaaatgctttaatgggttttacaggcatgctacaatccaggactgtggtgttctatgtgccgtgtatggtcatattagtagctatttgttgcaagatacttgaagccaaatgtttgcagtataggttcctggctactggttatgctgtgatttcactctgtctatcatgggcagtattagaaaacacactggttttcactatctgggttacaaacactatcattattttacctggattgaagtgcagaacttggcatatcgatgcatgcaatgtgaagaaaaacacttgtaaaacttgtaaatgttcagctaaatctcagatatactgtgggatgagtatctcagggtaagtaccataaaacaaaccaaaaaaatcacttgaattttttccttacagtcagtagctttgtttgatattaacaatacgtatatggtgatatacttngaacttatgttcagaantgtcactggatcataccantgagcattannatatcaagcttatgactacatgaaagatactatctcatgtatgctttaattagagaattatcttctttaaaactaaagctattctttcttaaaaaaaaactcgggggggcgcggtacccaattnccctattggaggggttaacattattggcggtggttacaactcgtactgtaaaaccttgcgttccacctaatcgcttgatact

SEQ ID NO: 512941 - DNA, 987 bp, Homo sapiens
  misc_feature (19)..(19): n is a, c, g, or t
  misc_feature (38)..(38): n is a, c, g, or t
  misc_feature (44)..(44): n is a, c, g, or t
  misc_feature (47)..(47): n is a, c, g, or t
  misc_feature (54)..(54): n is a, c, g, or t
  misc_feature (59)..(59): n is a, c, g, or t
  misc_feature (61)..(62): n is a, c, g, or t
  misc_feature (65)..(65): n is a, c, g, or t
  misc_feature (68)..(68): n is a, c, g, or t
  misc_feature (71)..(71): n is a, c, g, or t
  misc_feature (76)..(77): n is a, c, g, or t
  misc_feature (83)..(83): n is a, c, g, or t
  misc_feature (111)..(111): n is a, c, g, or t
  misc_feature (124)..(124): n is a, c, g, or t
  misc_feature (129)..(129): n is a, c, g, or t
  misc_feature (183)..(183): n is a, c, g, or t
  misc_feature (185)..(186): n is a, c, g, or t
  misc_feature (188)..(188): n is a, c, g, or t
  misc_feature (197)..(197): n is a, c, g, or t
  misc_feature (215)..(215): n is a, c, g, or t
  misc_feature (358)..(358): n is a, c, g, or t
  misc_feature (459)..(459): n is a, c, g, or t
  misc_feature (465)..(465): n is a, c, g, or t
  misc_feature (473)..(473): n is a, c, g, or t
  misc_feature (477)..(477): n is a, c, g, or t
  misc_feature (550)..(550): n is a, c, g, or t
  misc_feature (553)..(553): n is a, c, g, or t
  misc_feature (555)..(555): n is a, c, g, or t
  misc_feature (564)..(564): n is a, c, g, or t
  misc_feature (649)..(649): n is a, c, g, or t
  misc_feature (656)..(656): n is a, c, g, or t
  misc_feature (893)..(893): n is a, c, g, or t
  misc_feature (977)..(977): n is a, c, g, or t
ggcggcagcggttggaggntgtaggaccggcgaggaanaggaancanggcggcngcgcngnncgngcngcnggganncgcgcngctgggcacccacggagcctccggggcngccggcacagtcntcacnaccgtagaagaccttggctccaagagactcctcacctgctccttgaatgagagngnnanagaggtcanaggggaccgctggctganggggggcgtggtgctgaaggaggacgcgctgcccggccagaaaacggagttcaaggtggactccgacgaccagtggggagagtactcctgcgtcttcctccccgagcccatggggagggccaacatccagctccacgggcctnccagagtgaagggcgtgaagtcgtcagaacacatcaacgagggggagacggccatgctggtctgcaagtcagagtccgtgccacctgtcactgactggggntggtanaagatcantgantctgaggacaaggccctcatgaacggctccgagagcaggttcttcgtgagttcctcgcagggccggtgagagntananattgagaanctgaacatggaggccgaccccggcgcagtaccggtgcaacggcaccagctccaagggctccgaccaggccatcatcacgctccgntgcgcancacctggccgccctctggcccttcctgggcatcgtggctgaggtgctggtgctggtcaccatcatcttcatctacgagaagcgccggaagcccgaggacgtcctggatgatgacgacgccggctctgcacccctgaagagcagcggggcagcaccagaatgacaaaggcaagaacgtccgccagaggaactcttcctgaggcaggtggcccgaggacgctccctgctccgcgtctgngccgccgccggagtccactcccagtgcttgcaagattccaagttctcacctcttaaagaaaacccacccgtagattcccatcanacacttcctt

SEQ ID NO: 512942 - DNA, 348 bp, Homo sapiens
  misc_feature (73)..(73): n is a, c, g, or t
  misc_feature (79)..(79): n is a, c, g, or t
  misc_feature (101)..(101): n is a, c, g, or t
  misc_feature (133)..(133): n is a, c, g, or t
  misc_feature (140)..(140): n is a, c, g, or t
  misc_feature (145)..(145): n is a, c, g, or t
  misc_feature (181)..(181): n is a, c, g, or t
  misc_feature (189)..(189): n is a, c, g, or t
  misc_feature (202)..(202): n is a, c, g, or t
  misc_feature (205)..(205): n is a, c, g, or t
tgggcagcaccagtggttaggaaagttacttggaaagggaggtaagtgacaacgaggcagggggaggccccgncccgcncccccagactggtcacatatgngtggcatcatcagcagtgatggcgagagtaantgagctntgccncccccaggagggacccttgatacatgtacaaagcanacatagcnccccttgccctgngtntgtggaacagaaacagcttccttcaaagaagactgcagctcccaaggacccaagctgttgggatgctacttttcagcttcccgctgtccctttaaggggttttttttttaagactcaataaaggagggtttttaatcccccca

SEQ ID NO: 512943 - DNA, 524 bp, Homo sapiens
  misc_feature (6)..(6): n is a, c, g, or t
  misc_feature (11)..(11): n is a, c, g, or t
aattcngcacnaggaaggaaagagctgctgtctgtctatccatctatccatctacttgttggtccacatagtgtggacagagggatctgtgaggggcaggacttggatgagcatctagtgggtggcccccttttccatggtgtcagcagccatggggatgctcctggggtctggctggaccacctcaaaccaagttgggtggcttctgctcttttaggaccatcagacgtatgcacacacgcctaggctcacacccacaagcacaaatacacatggacatcagagaatgtatgtgttgagatagttggtctgaggtcacttggaaatggtggcccctaacctgtgcctgactctcactcaggccctggatcacctgggccagtccagacagctctgcctggtctgcacaggaaatagacagggcttttcttcctggcagaggactggaataagctgggtggcaagctgaaaccactgggtcctccaagctttctcaacttcctttcttaagaaaagaaaaaaaa

SEQ ID NO: 512944 - DNA, 682 bp, Homo sapiens
  misc_feature (526)..(526): n is a, c, g, or t
  misc_feature (621)..(621): n is a, c, g, or t
gagtcagagttttgctctgttgcccaggcggaggttgcggtgagccaagatcacaccattgcactccagcccaggcaacaagaccgaaattctgtctaaaaaaaaaaaagggaagaatagcaaccagtaattttgacagttttaacagtcatcatagtataactttatgtataagttaggtggctcattataatttcagcagtgaaaaaagaaggcattgtagcctttctaatatacaatgatatttagttacatacttgaatttttggtagtttatatgaagatacatttgcctaaagactttgtttgtttaacttgcagtatttgtccttagctaggctaaatcataagccagcttcatgaaaagaaaaatttaaggcttctctgctttcaaatatgaacagttattatctactcaaacaaagcaaggaagtcaaaaaagaaagagcaactttgccaaggctaatctttcccttagactgtgtgggagtaaagcttttatttcttataagaaaaaagatggcanaatgtccaacaggttgagtggctgcaaaatattgtagctctaatagggggtcaatttgaatgtttttttgaaatttatgaggtcttatgacattntgacacatgttataaatgtaatgattttttccaaatcaatatgtataaaaggattgcttac

SEQ ID NO: 512945 - DNA, 433 bp, Homo sapiens
  misc_feature (18)..(18): n is a, c, g, or t
  misc_feature (109)..(109): n is a, c, g, or t
  misc_feature (418)..(418): n is a, c, g, or t
  misc_feature (423)..(423): n is a, c, g, or t
  misc_feature (425)..(426): n is a, c, g, or t
aaactcctttgtggaaantcaaatctgaacatcttgccctcctagctttccccgggtcactttttagcccatttcctatattttggctcttctggttcttagttcgganactgctccttagctaatcaattaaaggctgcccaatctagcccaggcacagtggctcacacctgtaatcccagcactttgggaggctgaggctggtggatcacctgaggtcaggagttggagaccagcctggccaacgtggtgaaaccccatctcaactgaaaacacaaaaattagccaggtatggtggtgggcacctgtaatcccagctactcaggaggctgaggcagaagaatcgcttgaacccggaaggtggagattgcagtgcgcagagattgcaccattgcactccagcctgggcaacaagagnaaatnanntgtctca

SEQ ID NO: 512946 - DNA, 891 bp, Homo sapiens
gtcctctatatcgtggggccggtggtcgcctgtctgtgttgttccctccgcccctgtgtgttccttggggtgtactcctgcgcgttgcgcccatagcggggggggctgttgtctcggtcgtgggtgtagtggacccacccacggcgttcgtgttccgtcgcgttagcacccgtctggttccccgcctgggggcgtcggcccacctgttccatcgtgtggccacaacggggggaaagacgaaattttttgtcggggccactcacacaagggtgctccccgccttgtcgcgggtgaccccgcctatggtggtctccgcccagcacttgctggggatggcgcctcgtgccccccctctttccccacgggggaccttgcccgcccccccgcccgcatgttcgttttttagcagtgccgtgggccgcagttccttcggcggttcttagcacgctgtgcgcaccggtggtaccccccttgctttggtcctatctcggtggagggtcataccccttggggagaccaatctgtcgggttgtttcaacccacaccgctgcggagcgctcccccccgtgggtattctctgtgaaggccgggcttttgcccgtgcaaaatactgccttctagcaccatcactcttgcccagcgtgcaggatctccacaaccagtttcgtcatttgcccagagggacgcccacgacgacggctgctcttctttctcctcgcggggaaaggtggtattcccccctccccaccctgtgctgcaaagatacaaaacccaatagcagtcggcgcgcccctacacggacgcactctggcgtgacaaattgggaccccggggtggaccactcctacgagtccttggcaaaaaaaaatttgggccaaaataaaaataaca

SEQ ID NO: 512947 - DNA, 137 bp, Homo sapiens
ggtaacttgcttacactgtatgttgaaaatgattttttcctgatgctaggaactttccctatggaatcttgttcaaaagaatccacctggcattatatgtttgccttcttctctgttctatcttcctgttcctagta

SEQ ID NO: 512948 - DNA, 511 bp, Homo sapiens
cctgtaccgggtgggagtatggaatgcagagtgtgtggccatgagtccacggcggtgcaggacggggggctaatagtaggtttccttctccacccagccgccagggttcgcctgatgatgagtttctgacttcgtcatatacgaagatgagaagagagtaggggaaggcacagaaccaccaggtaggtatgaggggatacatccttaagagcaaaacccattccagggcaagtaggacaggaaagcagccagggcttgtcttcttcaaagagtgcaaatatcaggatcttgtcctttcatcccctgctgaaagaccgaaatcctcctggtctttaccagatgaccaaagtcggcccaactgaaccaccacgatacttgacgaagaaggctgtgtggcacggtgacattccaggaattttccttcttgtcatacggtccactgctgcccgggtggttgttttccaaatcggttgatccagcgggtccatcccagtccaactcgggaggcccc

SEQ ID NO: 512949 - DNA, 106 bp, Homo sapiens
catgtatcgcggtgctaggccgatggagtagactagagcgcggtgggcttcgactaccagggcaagacggagaagcacgagtcacagagagattactccaaaggtt

SEQ ID NO: 512950 - DNA, 262 bp, Homo sapiens
cacgagggcgactgcggcaaagcgagagcctcggatacgccgctgccgccagcacagccggcgacctgagccgacactggggggagtccgcgagtcccgcactctctcgatgagtcggagaagtcccgttgtatcagagtaagatggacggtacctttgattgtgattgcggtgagctggagccacctgatcactaacagaagacatcatctgttaaccaacattcgccagggcttcctgttgaaataaatatctagcaaca

SEQ ID NO: 512951 - DNA, 544 bp, Homo sapiens
ccaattgacaagattcgagcaagagataaaaattcctttccggtgaatgatagctgtgatcaccccagcacccatttacttgtttctggtccatccgatgagacggatgctctgatgctctgaggcttctgggatggctgggccctggaggcaacgtgctgcatgcgcactctgtcagagtgaacagcaccgcgagacaggccaggctcgtggctcggaagacaaaccccacacacactcaacggggtctgaaaacaaaccccacacgagggctctcacctccttctcctaggtagtatgtattgtacagcacctgtttgatgcagttttaaagtcctctacctattggcactgttcgtgactcgtaggcacattatctgattgttgtacgaaaaacagcttggttactacgacctcagcatactattttagtaacatctggagagaagatattctggtgactgacagtatggtcgggtgtcagcatctaaatgtgcaaatgccttcttgctgtcctgtcggtctcagtaccgtcactgtcatc

SEQ ID NO: 512952 - DNA, 328 bp, Homo sapiens
tgtgaggcagatcgaaaatgaataatcatccagtaatagaaagagcccagctttaaatccggccgtaccgagtccatgttatgtcttggttcctccagagctggactattacaccattattattccaccttagaaggtttgggtgaggacgaaatgcgctaatgagtgtaaagcatctatacctgtatagcatgctggcaaatacctccacagattattcagccagtgctggtattctttccctctccagggtaccaatatttcgggtttccattggcttatctcaggtcctcctgtttcacaccagggttctgggggggcacacagg

SEQ ID NO: 512953 - DNA, 946 bp, Homo sapiens
  misc_feature (946)..(946): n is a, c, g, or t
gtagaatgaatccaatcacaatagtccagctaacatgcaggatgatcgcttgtaccgagagagaacaagactggtaaatatgaacaagcgtggttctgcaatagtagaacaaagctggcgtgattagttgaccccgggtacagtctctaaagaagctggccgatagagaaaagatatagtattgatgtgtctgtcacctccctactcctgtcattagcactttactttagttaagaagcaaaataactgttgtgctgtatccatcttcctgtgccaagttttcctaccccttcgtaccctctccttagaaaaaatcagaaaataccctctatgaaatcaacatgtactgtacctgggttacgttgcagaatagattactaagtgcttcagttgtttctgttgtatttcatctccagtttgcaggcagtgatcttgatgatgtactttaagcttgtaagatgaattgttagtacaagaggtgcttatgcgttaggcttgatgaccaggatgttattttgaacaaaatgattgctgaagtgtttcatcctggctggtccgttcacttgtgtggtttgcaagtggtgtgttgggaatatggctacgagagaatatgaaccaattctgttaaccactttggacggcggatcggagttaaaatccctggggtacttaaagagctcaggggcgaactaagttacaccgttgcgtttactgggaaggcccgacactggggggggcacgtatcgggggccggcttgggggacggcgatctccctttgggcgcggggtgggccccaccgggcgcgaactctggtccgggggttcgtttaaaggtggcccgataaaaccaaggctgaggagagggcgccacaaaaaaagagcggagagaagagagcgaaaaagacagagagaggggggacccaaaggggtcacgaggggcgatagn

SEQ ID NO: 512954 - DNA, 448 bp, Homo sapiens
  misc_feature (198)..(198): n is a, c, g, or t
ctcaagatcaccacgccctagaccttggatggtcactgctgtccaactggtgggtacacagcactgagggttccttctcctgacctaagcagtgatccagaactttccctgaaagaggacatggacatttattgcaagtggtgggtcactcaagtttcctttccagtgtattcttctccattgtcaggtgggcatatnaggcttctagacctaggctgagtgtgtaaagcagcgcttcacagtgtggttcaccttcctagattcctcatagaacacagctcattaagccacagacacagcaccagctcagcccttagctcatcgcccctgctgcaaccaggggacacatctctgtgctagcattcctggggcggcccaccccatccagccttccctatccacacctgcctggccctgcgtgcctccaccttctgcatctgctgggccg

SEQ ID NO: 512955 - DNA, 572 bp, Homo sapiens
cgcctgagtgagcattttcaaataatggcgttcaatatcatcgcgatgttcttcgttatcgcgccagaccagcaatacctgcgcttctcccggctggcggttctcttccgctttgtgatgacgtcgccaccagcgtcgtgccgcgctctgtccaggcaggttttccagctcaaactggagaatatcttcgacaatcggcccttcaaggcgtaccgcgtaatcctgtttagcctctggaccgtagctggacatatgctcggcggagtaattcagcccgccaataaaggctatacgcgcgtcgatcaccacaattttgcgatgcatccggcgaaacacattggtgcgcataccaaaaaggcgagggcggggatcgtagtagcggaacactacgccagctgccgtcagttcattgacaaactcatcgctgagatccggcgaaccgtagccatccagcaagacttccgctttaaccccgcgttgggcttgctgccagtagtgccgcatgcagttgtttgccgccgtcatccccaaaccagataaacggttcaagaatgtgcgttcttgtgcctcgc

SEQ ID NO: 512956 - DNA, 135 bp, Homo sapiens
tcttctacgaaaagggcacattaatgcaaatagtccccagatggcaactacaaagtatcccctggtaccacatatattcattagtgagttaggatatagagcacattatctaaaccatattgtagttaccaaaaa

SEQ ID NO: 512957 - DNA, 334 bp, Homo sapiens
gaggaagcaactaccaggacacatctaaatagaacatccacggatcgaaaaccaatcaagcttgaacactttaggcatttccccacaggagaatacatgcccactcaaagctgcacatgttattttaccacctaaatacaacacggccatcatggatgatcaggtacgctcagattacagaagcaagtccacactgtttaggaatggttcacactagggcccaagagaaatcagaacatcacagcacagactgtgcaggcttctctgcaataatatttctatacactgcctaagactccaattgctaaaattctttaatacatgtatttcttaa

SEQ ID NO: 512958 - DNA, 185 bp, Homo sapiens
taacaactgagataacgaggaaatattctgaaatgggatcccaaatatttcatcttaattttgttttgtggacacctgaccaatacatttttttcaaagacagagccaattacaacagagaggcagtcacagcctaccttattcacatctatcaatgtcacaggtatttgctaatttcttaaaac

SEQ ID NO: 512959 - DNA, 315 bp, Homo sapiens
tcaccacttaaatgactagctttgataaacaatttcagattttaactatgaaaacgacctttccctctgcatttttatcttgattccaattttttttctatggttaaagtgtaaatgttttccgatggtcatttcacttctaacttggtataggaagcttagctctttacatacctatcatgtgccctgtatcacagaatgattcaggaaaaatccacttgggatatcaaagaaaatggaacttctttttgaaaagacaagcatccatgttaactgtattgacacatcctcaataaatcctgttgtctgatgcta

SEQ ID NO: 512960 - DNA, 317 bp, Homo sapiens
  misc_feature (57)..(57): n is a, c, g, or t
gcagaccacgaggtcaggagatcaagaccatcctggctaacatggtgaaaccctgtntctattaaaaatacaaaaaaatcagccgggcatggtggcaagtccctgtaatcccagctacctgggaagctgtggcaggacaatcacttgaacccaggaggtggaggttgcagtgagctgagatcatgccactgcactccagcctggcaacagaacaagactccatcgcaaaaacaaacaaacaaacaaaaaacctggttcaatgatcaaatattgagtcagggataggctaagccagcaacaaaatcaacccacaggga

SEQ ID NO: 512961 - DNA, 167 bp, Homo sapiens
cacgacggtgtctgtgggcgcgccccagcctgggcgcgtccatcgtcgagtaccttctcctctgcctcccccatccttggctgcaatgctgttagggtcaatctcactgatataatcccaatgtcgtcttcatcgtccgtccggtagcacacagatcacccttcgtg

SEQ ID NO: 512962 - DNA, 514 bp, Homo sapiens
agcggacattgcatattactcttgtccaccctttcagcttaagtaaatagtgactcctgatgtgctcaaggtgagtctctgaagacagcagatacttagttggggacttgtatccattctgccattatatgtattttaagaggagcatttaggccatttacattcaatgttggtattgagatgtgaggtactgttttattcatcgtgctatttgttgcctgaatacctttttgcttccattgtgtaactgttgtgtaggtcatcagatttacgctttgagaaggttctatttgggtgtatttcaaggttttgcttcaacatttagaactccctttagcatttcttgtagtgctggtgtggtgatggtgaatcctctcagcattagtttgtctgagaaagactttatctttccatttatgaaggtccctttggctccatatgaaattcttggctggcaattattttgtctgtagaggctaaagataggatccaaatcccttcggtgttgtagggg

SEQ ID NO: 512963 - DNA, 407 bp, Homo sapiens
tggggcaacaatccggcttgaaagaacggggcttgcttcttttttcggcattggggggggtcggccaactgttttcgtggacctccaaaaggggggggcatctggcaaaaaaggcacttttgctggtggattcaagggctctatttcaccaaatatttgggactttgttcacaacaacttgcgcaaaaacaacagacaggcctatgctgtcagtgattaacaggtcatcagactagtgctgggtcttggggtactgcagagctgggctcgaatcccaaagttcgaggtggggggactcaccgctctggccaggggtgctttttgaaacatgtgtcgtggggccgaatgtttgcacaaccacctggcgccgtgcatcgtagagtgacacccccgatacgctctgtttt

SEQ ID NO: 512964 - DNA, 796 bp, Homo sapiens
  misc_feature (761)..(761): n is a, c, g, or t
  misc_feature (772)..(772): n is a, c, g, or t
  misc_feature (796)..(796): n is a, c, g, or t
taaagggccacaccttttttccaacggttcctttttttgccaaagaaggcccctccaggttgcccccctaccgacaggattgccctttcaattaagtatgaattcaaaagctccagtccaggttggcctttctgaagatgaacctccatttggttcttgcccccattccacagcttgcccttgcaagccattgaaccatgggctcccggtcccccgtcagccctcttggtccattccttccaaccagttcggccgcaattgactcccttagcaaccagttttccttcctgaaagagcaatttgggatcctgttcctcaaaataagactcgtgattgcccatcgccccagggctggctttaccccctctctccgccttcaaccccccatgcccttgcccaacatgctgggggtccaataagccacttcggggttactgaccggaaggccaggcagggctttcctcctcttcctcctcccgttcctcgggaggctccccagaccttggcatgggatgggctgggatcttctctgtgaatccacccctggctacccccaccctggctaccccaacggcatcccaaggccaggtgggccctcagctgagggaaggtacgagctccctgctggagcctgagacccatggcacagtccaggcagcccgcaggctggtttgggcctcagtagggcctgctgcttgacccccttcaaaatattcgttctcggcgttctctccaccttcggcttccaatggggcccggtnccaggtaagtnggctccaacggggaggggagaagn

SEQ ID NO: 512965 - DNA, 1213 bp, Homo sapiens
  misc_feature (143)..(143): n is a, c, g, or t
  misc_feature (240)..(240): n is a, c, g, or t
  misc_feature (359)..(359): n is a, c, g, or t
gggcccaggtcgcgccgacagggggctgagggtagcgaaggtagaccgcgccgaggtggaggcgacgggggggctgaaagatggcagctgaccgtcctcttcggtccgactttcaccaggatgtgtgatccatgtcaaagacncaacatctctgcgcatggatgatcattggtatcagtatgtacgtatatacggaactgtctgctttcccgcaaggtcttgggcgtcatccaaggactntggttacctttcgcaattaagggtgcaagatgagactgactgttgacgtaccaatatctgagaaacaggatgctgggtgaccacttcctctgagagatgactatataatcaagatgggnactatacgagggacctcacccgcttatgatagacaacatgtaagagagataaaggtggggattgacgaggaggtttaggagctcggagtcattagagctcaaggtaaccatggctgagcaaaaacaagaattcacacgaaaagcggaatttagagtacgggcgcgggtccaaggattaagcagttggacaatttgagataatattaaatgagaaaccagtatggaattaactgtggtgtatgggacagttgaccggtttgagaagaatgcgtaggggtccaggttaaaggggagttaatagttccaggaattgggggtctggtggaagttgcttcgtaaagagacatgaagttccattttgaacgtatgaaacagggttactttttgggcatgaaatggtatagcacaggaagtaccaaggtgattagagggcgtaaaaagcgcaaaaaaggcatacctggtttaacgggatgtttcccatgggaattaacccttaggaaaaatatgtgcgaaatgaacctggtagtgaccaaatcattccaaataggggtgtgaacatttatttttccaggggtaaagttggagggaagcaacatgaggattccttattgtcctaaaaagggggagcttgagggtgaacgtgggattattagaagaggagtggggcaggacaaaaaagggtggggttcagtacttaagcatccacactggggcaggtatcttttatttagcaccaattaacgtggacaatctggatggcgtatgggaaactacacagggatcctacatggggaccaacttggggcttttaagagggggggcagtaaatcttcatgaggacaattaagtactta

SEQ ID NO: 512966 - DNA, 348 bp, Homo sapiens
ctctgaacttagggtagagagagattcaaccagtcagtgtaaaagttggagataggccgtgcgccgtggctcatgcgccagtgtaatcccagcattgaggaggccgaggcgggtggatcacctgaggtcaggagttcgagaccagcctaatcaacatggtgcaaccccgtctctactaaaaatacaaaaattagcctgatgtggtggcatgcacctgtaatcccagctacttgggaggctgagacatgagaattacttgaacccaggaggtggaggttgcagtgagccaagatggtggcactgcactccagcctgtgcctcagagccaggcctaagttcagagccagg

SEQ ID NO: 512967 - DNA, 1442 bp, Homo sapiens
  misc_feature (838)..(838): n is a, c, g, or t
ctcttgccaaaagagtgcgtccacaagcagaacaacacggagggtttttccttgttcccacaaaaggggggatatgtgttttctcctgtttccctgttgtggggggaacaaaaacccgtcgtggttcttgttgggggtggacgccccgaggccccgcagaaatgagttggtggagccccctcctcccccccatgtgggggtgaagaaggcccagaccacctttgtgggacctattttacgcacaccatggggccttcatctaaggaggggttggtgaattttttaatttcgcctcttggggagagcccgctaatagtcccccaaggggcctccccgaacaaaatttatagctccgcccccggcggcctttaaataggcgcccccccccccggttatatattatcgggagagatttttggcagcgacacacaacggggggcagttccaaaacaacaattgttggcaacatatgtcaacaaagagggtttttttgtgcctctgtgaagagtcttggagaaagaggggagaaatagagagtttgtggaggctctccgccccccggttttctgcttgggggttataaaaaaaagagcggtgtgtgacaaaagatttggggccccccctgaaaagattgtctcgtgttgaggaaaggcgtcttcttggggttgaaattgcgtctgcgcccacgactttgggttagaagataatatggggggtttctcctcttggggcacaaaggccgccccaacattggtgtggttgtttttgagagaggagcctctttctcctcaaaagagactctagaggcccacacccgctctttgtgggtgttctgccnctttgctactgtgtgtgtctgcgtgaagatatatgagagacacacagactacacggttttgtctgcggggtgtggggtgtgtcacattcacaaagcacacaggtgggagcacacacagagaaggcctgtgcttgggagagccttgggccacaagagttccaccccacaagtttctgggctccacgagaagaggctccaagagaaggggctataaagtgagaatattttatatcccctatattatcctcgtgtcacacccccgacactctcttataaatccacagtcggtgggaaagaaccggtttcacgagactgttttgttttcacaatgtggccacatttaaagtttatagtatagtaaaaagagcttggtgtaaatgagatataccacacatgcgacatcctggtaaaacccttcacagaaaggagaaaggaggaatgttgttgtggagccacactcttggtgtttcttttttgcgctgtggcacgttttaagttagttagctttttaaaatcacgtgaactcttttaaatgggaaacacacacttgagcccaaaaatttgtcacagaattttgagaccccattaaaaaagttaaatgaga

SEQ ID NO: 512968 - DNA, 136 bp, Homo sapiens
cggtccgacgttgaaatgtgtttgttactttgcatttctgtagtacagtcagcatgcttactgatggggatatgttctgagaaatgcactgttaggcaatttcatgttacgtgaacatcatagagtgtcacttacg

SEQ ID NO: 512969 - DNA, 196 bp, Homo sapiens
tattaatgtgagaagctagcaaaatgccacaggaaatattaaatcaggatgctgcatggggaacaggattgctggccatcaattttaattgaatttttgacgggtcatgctacgttacattattgctgaaaaaaaagtgcaactcacatactacaaagagattttttaagctttaaaaaaagtttggtatcttttg

SEQ ID NO: 512970 - DNA, 637 bp, Homo sapiens
tgtgatggcgggcgccgtagtcccagccactcaggaggctgaagcaggagaatggcatgaacccagaaggcagagcctgcaggggccgagatcgcgccactgcacctccagcccgggcggcagagaaagactccatctcaaaaaaataaaaataaaaaaaaaaaaaaaaatttctgtgcttcaaaaggcacctaagaagaacggtaaaaagataatctatataatgggagaaatatttgcaaatgatatatctcataaaagacttgtacccagaatacatgaaagatctcacaattcataataaaattaattatgatcaatttaaacatggggcaaagaatctaaacagatatttctccaaaaaatatggtaccaaatggtcaataagcacttgaaaagatgtcaatatcattagtctccagggaaacacaaagtcaaaaccaaataaaataccatttcacacccattaggacaagttaagaaccaaaaaatcaaataataccaagtgtggaagatggataccagagatatagaactctgtgtacactaactcgtgggaataaaaaagtggtacagctactatggataacagtcgggcagttctcaatgaacacagttacctattttttcccaggaa

SEQ ID NO: 512971 - DNA, 351 bp, Homo sapiens
ctcaaaacctacgtgtgggaaatgcaaatggtgggaaatacccttgtaaatatagttattttgaaagcagtggaccaggtgtggtggcacactcctgtaatcccagccttttgggaggcggaggggggtggatcacttgatgttgagaccagcctgggcaacatggcgaaaccgcatttctactaaaaatacaaaaattagccacgcatagtggtgcatggctgtaatcccagctactcgggagactgaggcaggagaattgcttgaacctgggaggcggtggttgcagtgagccgagatagtgccactgcaccccagcctgggtgacagagcaagactccatctcaaaaa

SEQ ID NO: 512972 - DNA, 465 bp, Homo sapiens
tcccatctcaacctttccaagtagctggagctacagaggtatgcaccattgcacctggctaatttattttttatttttatcttttggtggagatggggtctccctatgttgcccaggctggttaggaactcctggctcaagctatactcttgtctcggccttccagactactaagattaggccgggcgcggtggctcacacctgtaatcccggcactttgggaggccgagggggtggatcacttgaggtcaggagctcgagagcagcctggccgacatgatgaaaccccgtctctactaaaaatgtaaaatattagccagttgtcgtggtgcgcgcctgtggtcccggctacttgggaggctgaggcagaagaatcgcttgaacccgggaggtggagggtgcagtgagatgagatagcgccactgcactctagcctgggcgacagagcaagattccatctcaaaa

SEQ ID NO: 512973 - DNA, 625 bp, Homo sapiens
ggcggcggcggccgaggctgaaggaagatggcggacggcgtggaccacatagacattacgcggatgtcggcgaagagttcaaccaggaagctgaatatggtgggcatgatcagatagattagtatgacgatgtcatatctccatctgcgaaataagtggagatgccccaggaagaccgagattacgtgggatactctcccaccaacgtgttggtgatgcatgtgggtacaaggagcagcgacgcgaaatgttgtctgatacatatagctggaacaggagaacttgcagttatagtagtaggaaagtctaagcatgtgtggacaacagcatgagagacttagactgaagcagttcatctcgttcgggcagtaaagtgactagtttccggagcactaacaatcttggcgaacaactcagagcaagatcggccagtacaaacggcggttgtgcccctgtgtagcgtgtgggactctgacagcatcgttcacaagaacagttcacatggatctcgttgaccgtagagaagagaactctcatgggtcagcaatcctcgtggtaagctccgatgcaaataagacagttgccgtgagctcaagtctggaagactgcacggtccagggacaaa

SEQ ID NO: 512974 - DNA, 430 bp, Homo sapiens
atccggctgacggaactttaagtccacatgtcatactacttatagtgattaaaaacttaacagataatcgattgttttattttttttcttttgagacagagtctcgctcggttgcccaggctggagtgcgagggcgtgatctcagcttactgcaacctctgcctcccaggttcaagcgattcttgtacctctacctcccaagaagctggaattacagacatgcaccactatgcctgattaatttttgtattgttagtagagatggggtttcgccatgttggccaggctggtctccagctcgtggactcaagtgatctgcccaccttggcctcccagagtgctgagattacaggcatgagccagtgtgcctggcccagataatcaatttgaaacatgcgtcacaaatcataaaaagttccgttgaagccgt

SEQ ID NO: 512975 - DNA, 871 bp, Homo sapiens
atggatagaccccatttgtttattcacacatcattggacattggattatttctggttttggctattatgaacaatggtgctatgaacagttgcgtacaagttttgtgtgaacatatgttttcaattctctcattatatacctaggagtagaattactgggtcatatggtaactgtatatttttgaggaactgccaaactattttcccacgtccatgcaccatttcacattcccaccagtaagtaagagggttccaatttctgcgcattcttgccaacactagttattatctgactttctggttataatcattctaatgagtgtgaagtagcctctggtgtcatttggatttgcatttctctgatgagtgatgctatcaagcacctttgctggtgctgttggccatatgtgtatgttccctggagaagtgtctgtgctgagccttggcccactttttaattaggcgttgtctttttattactgagttgtaagagttctttatatattctggattctagacccttatcagatacatggtttgcaaatatttctcccattctgtgtggttgtgttttcactttatcgatatgtccttagacatattataatttgtttttaaaagtgactgaattgggtgtggaagtgggtcaagctggtaatccagcacttgggagacgagtgggtgggtcaatgaagaggcaggagtcagggaagctggcagttaggaaatggttctcttaatacaatgtcgggtggggggtggaaactcaggggggagacatttacgggagaggggggtgaaacgcagatttgttgaaaaaaaaaaggggggcaaattgggggggagaattcaggtaacagcagaaggagac

SEQ ID NO: 512976 - DNA, 420 bp, Homo sapiens
  misc_feature (297)..(297): n is a, c, g, or t
ggttcccatgggtttgcctggggggtgtgagagagacacaggaacagggaggcagtgtaataagcagggcctcaacgttgacagagctgggtttgagtcctgactgtgctgctgactggctgtgtgaccttaggccagtcacttggcctctctgagctttgctttcctcctctataaagtgaggccacaataaagcccatcccattgtgggcattgaatgctcagaacaatggaagctgttattgttttcagcggttgtgtgtgagagagattgacagatgggcggggcatccacgntctctgtgctcctggcacccaggccctgggctaaggggttggtctccacccaagggccaggatcccatgggtggttttatatccaggctccttctcagaagctgcgtagggggtgggtgcacc

SEQ ID NO: 512977 - DNA, 252 bp, Homo sapiens
tcgtgagtccgtagagcttcatctttcttttcaccgtagtgtggctgatggcattgtattagcaaactcatcatagacatcgtactacacgacagtaatacgttgtagaccacttccactatgtcctatcaataggagctgtatttgcaatcataggcggcttcattcactgataacccctatactcaggctacacccgtagagcgaaccatacgctttttatccatttcactactcatattcatcggcgta

SEQ ID NO: 512978 - DNA, 176 bp, Homo sapiens
tattcatacatcttctgtcgtagtgtcattagctactgcctcatctgtttttgctagtcgtgtttgttcaacattcaggttgtcacgttgcttattcatcatgtcagtcaattcggcagtatcattaacctgtggcgcaaacttatataagagctcttgcgggaactgtgcgcctg

SEQ ID NO: 512979 - DNA, 325 bp, Homo sapiens
  misc_feature (72)..(72): n is a, c, g, or t
accgtatcttgtgtgtgccagtggtgtgggtgtgtagttgtatgaatgttctctacactactgtgtgagtgnacacaacatcagatgtcacagctctcagagctagtcagaagagaaatcaattgtgtctaacccatttgcatattgacttgtcagtacctttaactcaatttaatataacaagaaatcgtaaaatacttataacctatcttagagaaatgagtgctggttttgagagctgtttttaacctgaaagattatttctagatgggtagtgctttgtgctggtttctgcttccatatatatcccagcacaagaaccaca

SEQ ID NO: 512980 - DNA, 402 bp, Homo sapiens
ggaaaaatggctcttgttcattgttgccaagtataggatccgggtgtttaaagcaatataagaatggtagctaagcagaaatgagtgtgggaagttatgttcatccttccctagagaaggtctagaatgcatgttgagaaatttgaactttatcttgtaggcaattagaagttaaaaaggtaacgtttgagctgttattaataggcataattttatgtgttttcctcggctcgtttcggttagtacgtgtgtttctgagatggagtctcgctctgtcacacaggttggagtgcaatggcgtgatcttggctcactgcaccctccacgttttgggttcaagcgattctcatgcgatagcctcctgagtagctgggaatgcatgcgtgccacaccatgctcggc

SEQ ID NO: 512981 - DNA, 156 bp, Homo sapiens
gttcaacctgggctaaaaatcactgttgtgagaactccaccgacgccgcagtttgaggtcacaaggacgctttgccagtcagtccttagaggacacacagatgccagtcggacatctctagacttgactgacctcagcatctctaccgcaagccct

SEQ ID NO: 512982 - DNA, 935 bp, Homo sapiens
  misc_feature (45)..(45): n is a, c, g, or t
  misc_feature (62)..(63): n is a, c, g, or t
  misc_feature (66)..(66): n is a, c, g, or t
  misc_feature (72)..(72): n is a, c, g, or t
  misc_feature (75)..(75): n is a, c, g, or t
  misc_feature (182)..(182): n is a, c, g, or t
  misc_feature (184)..(184): n is a, c, g, or t
  misc_feature (192)..(192): n is a, c, g, or t
  misc_feature (307)..(307): n is a, c, g, or t
  misc_feature (412)..(412): n is a, c, g, or t
  misc_feature (505)..(505): n is a, c, g, or t
  misc_feature (538)..(538): n is a, c, g, or t
  misc_feature (667)..(667): n is a, c, g, or t
  misc_feature (672)..(672): n is a, c, g, or t
  misc_feature (684)..(684): n is a, c, g, or t
  misc_feature (689)..(689): n is a, c, g, or t
  misc_feature (691)..(691): n is a, c, g, or t
  misc_feature (694)..(694): n is a, c, g, or t
  misc_feature (698)..(698): n is a, c, g, or t
  misc_feature (704)..(704): n is a, c, g, or t
  misc_feature (722)..(722): n is a, c, g, or t
  misc_feature (794)..(794): n is a, c, g, or t
  misc_feature (842)..(842): n is a, c, g, or t
  misc_feature (870)..(870): n is a, c, g, or t
  misc_feature (874)..(874): n is a, c, g, or t
  misc_feature (912)..(912): n is a, c, g, or t
tattgtttattttaatgaagctggtacagacaatgtccatttggngcccatttcccaggccnnacngtacanatngcatccaaaagggcagtgttctgttgtgttcatttctgcatgtgtagctttattaattgctaatgaaaattagaacttttctgggttcttctgacaagatttttaananatcttaanatgccttttcttcagtgaagccatctttggagttagtcattactctcaccttatctgtcatcttgacttcaacctgatattcctcttcttttggtccagaccctcaaattttaanagtagcttcaggttagggaaaggtcatttttccacagttcagttctctgaaaaacttccatctcccactgaaagtcacagtccgggggtgaagtaatcacatgcnagaacatcggggccaattgggaggtcattatgaacacttgcattggtcgatcttatttatcaccacaagcctgaaaatgcgatgtcctggaangggtgacctctctgtgcacacgtgatttttagnagggggggggtaatatgaggggggctgaggcttggtcaccaaaaatcagcacaatgaaaacaaacaataatgaataatgagcactagaattcaaattaccggatgtttcagggagatggggtgccggtnttccnttccgttttggncaccncnttncaanagagcnatttttgagcgataaaanaggattgagggaaaagaaaaaaaataaaaagaatatctaaactgttgaatgacccccgtttgttcctgatanacttcaatcacatcttcttcctccattcccagttcttttggagtatgnttatcagcaattctctgaccctcaaagngaancctgtgtgaattcattggaacaccctgtctttgacaanatgattctttgagtttcttgaga

SEQ ID NO: 512983 - DNA, 122 bp, Homo sapiens
aacaccagtacttatgacactcaaagattaggggaagagagaagatttcagagatgggacgactggtggaaatgttgggctgactggaaggctggtctggtcgaaggcacgagtttttctcc

SEQ ID NO: 512984 - DNA, 280 bp, Homo sapiens
gcgccatggggctcagcgacggggaatggcagttggtgctgaacgtctgggggaaggtggaggctgacatcccaggccatgggcaggaagtcctcatcaggctctttaagggtcacccagagactctggagaagtttgacaagttcaagcacctctaagtcagagagacgagatgaaggcatcttagagacttaaagaagcatatgtgccacactttctcacacccccttggtgtgcatatcttaagagagagaggggcatatatgagagcacagattta

SEQ ID NO: 512985 - DNA, 130 bp, Homo sapiens
gaacttggcaccttggcaggcgttgtactcatcgtccttgatgagactgcgccaagccaaagtctgcgatcttgcacgccagctggtccccaaccaggatgttggctgccctcaggtcgggggatcctct

SEQ ID NO: 512986 - DNA, 140 bp, Homo sapiens
ggttcacaagcccagggggccaggatatctagaaaagaaggtgttcctaagtaagtcccttccgagattgaattgaggtggggacgtaaggcactgagaccactcaacccccacctgggaggcgcaaagagaagccagag

SEQ ID NO: 512987 - DNA, 585 bp, Homo sapiens
ttggagcacactctccatctctcctcaccccaggcctggaaccagtaagttgctttctgtctctacggatttgcctattctggacattgcatatagacagaatcatatcatgtgatcttttatgactggcttctttcttagcataaacttttcaaggtttatccatgatgtggccaatatcaggactacattcctttttgtggctgagtaatagtccattgtatggacataccacattttctttctcatttatcagttggtagacatttagcttatttctactttttggctattaggattaacgccactatgaacattcatgcacgagtttgtgtgtggttgcacagatgtaagttttaatttctcttgagtatatacttaggagtagatttgctgggtcacatggaaactttacatttaactttctgaaggactgccaaactgtttttcacaacagtggcaccatttcacattgccatcagcaatgtacaagggttcaaatttctccacattctagcccacacctgttactgatttttttattatagcttccctagagagtacaccgtggtgtcttactgtggg

SEQ ID NO: 512988 - DNA, 156 bp, Homo sapiens
caggcgggagtgcggggcggggcgcggcgccctggccttgcgcgcttacggggtcctctccgagccgctctggggcctctgacttaaaatagggaggactgggccaggagatcgagacaatcctggccaacctgttgaaaccccgcctctactaaa

SEQ ID NO: 512989 - DNA, 398 bp, Homo sapiens
cgggccccccccgggggccggcctgggatcccggttaagggccggcggaaaaggcccccatgggggggggacccccccctccccccacaaagcccggggggcaggggggggccagggggctaatcccggggcggggtccccttacccagcgccccccctgggaaccccgggcaggggaaaatggggaggccccccaccctcccagtgggggcggggcagggcctggcctgggaaaagcccccctgccgatccccggcctttggggccccccccccaaaccacccaaacccgggcccccccagtttcccgccccccccccccccccccccccggttttttttttttcaaaaattttttttttttttccctgtttttaaataaaacccaaggttttttta

SEQ ID NO: 512990 - DNA, 1074 bp, Homo sapiens
catgcgccggtgagctgcagcgctgagacccccagacctgaccccgtcgtggctcccgtgcggggccccatcatgttctccaggaagaacacgagagctcatgaaaaccccttccatctcgaaaaatgaaccgctgcgtggaatgccccagcccgcacgccctcggtgggatgctgcccaggaatggatggggctgacgcggtgttcccactgtagaccaagcctgtgagccgcccgctgagagatacactcacgtgctgtcataaagtgcccacagggaccctctaagctgtgtccacccatgctgagccagcacgccatgctgctggataggcttcccacctgatctggtgtgctagccctaccatggacaacttgtggctcggtatgacaccaggagacccacttgacacggccgctcagcccctggtgcagacgctagcaccacccgacggcggtgcccatggcccagagacagtcagatcgacggacaatctcccccattcttgctgggcctgggcactgtgtggcctcggctctctgccttgcagcggcccttttcagcaacacctttcacgggacgtggtgtcgtttggcggtggacggaccctccatttggactggccccgcctgccctgcgtggcccctctagagtggcctggcgctgacggcatcttcgccgatgctaactggcaattccacaatccaatcctcccatcagatcccccgcctggcacataaaacacaccgtgctgcggcacgccttcaccggggatgtccgggcaaccctccatcagcccaagggatcaacagcctttccaaaatatagagcagcactaacttgaactctaggacacaaccatcgacgtcccgcccaaaggaccctggtggaccccagcggcagccgtgccctacacatcaagcacagctcaccgccagaccaccaattgcgattgataattcggcagcatcccctctctacacgtgtcccccgtgagaacctacgccgaccccgtgtaagccgtaatcacaccgatctgtccgcacacacccacctgtgcacccgcgcccgct

SEQ ID NO: 512991 - DNA, 544 bp, Homo sapiens
ttgagacagggtcactctgtaacccaagctggagtgcgggtggttcaatctcggctcactgcagccttgacctcccaggctcaattttcccatggacagggttcagggggacggttttcggataaaactgtcccaccttagatcatcaggaattagtttgattctcataaggattgtgcagcctacatcctttgcttgtgcagttcaaaatagggttcatgttcctatgagaatctattgccaccgctgatgtgactggaggtggggctcaggcggtaatacttgctggctcctttgtacacctcctgctctgtggcccggttcctaacaggccatgaactggtacccatccacggcctggggcttggaaccactgctttaaatcctaaattactttaatacctaaattcctaggttacttataatacctagtacagtgcctacttttaactttatgggtgtggattggacttagtattgggctcaggaaacatccaatttttgctttttgcaactttgtgaaatttaacattttttggaatat

SEQ ID NO: 512992 - DNA, 182 bp, Homo sapiens
caagtgagcctctcagttaagaagactgaatataaagaaagatgatgagtttttccatttcgcctcctgtgctttgccatcgggccttgctgggtgtatactattacgcagactggtcatgtctcttggggtcggcctgctcaccttcgcctcctgaaacacgtgcatctccttagacttcg

SEQ ID NO: 512993 - DNA, 119 bp, Homo sapiens
gaacgtacgtactaacatcgtagagacgctcatagtaaatagaaagcgttgaacatatcggcacgccatcatcctagtcctcatcgccctcccatccctacgcattcaggggctcaatg

SEQ ID NO: 512994 - DNA, 255 bp, Homo sapiens
gatgggtcacgcattccaggtcttggtggtcatagaagttacactggtttggagagcagcagggggtctggagagaagaccaaagccggttccccagaaggccagggtagtaggcaaagtagaccagggagtggtcattcggctcataggaggagagtccattgcccacagccagcccctgaaggttcatgctggggatcctgcatgaccagcacggccaggggggggatgtagatgccagcatagctctcccgg

SEQ ID NO: 512995 - DNA, 436 bp, Homo sapiens
tcaacacggagcccatataaaatagaggctcagtaaggctagcacataaactaccaaacaatgctcaataacagagtcaaagcttgtagtacagcatgtagctatgatggacaggtccccctcctaccattctatgccctctggagaagtgattcctgcagtgtagaaatatgaacagtggtatggtcgtgatttggggaaaggggaaagagaagcagtaaatacactccttatcctccccaaattttaagctctattactgtgccctaagtcctagacacacattagactacagggagttttgtcttgaagaccaggtcccactgacccctggataaaaagtctgctataaaatgggaaaacaacgtatgagcaggggtaattaggcacttaacagtatactcaggtgtactacgtactggcccttccaggataa

SEQ ID NO: 512996 - DNA, 826 bp, Homo sapiens
tgccgctgccaccgaaccccgtcatggagcggcgtcgctgcgcgcctgctcttcggcgccgctgggctgctgctcctgtctcctgccccttctccttcgttccttcctcttctggacaccgtgcgggccctgcgagccgggctcctgtccgtccctgcccccgttgggctgcctgctgggcgagacccgaagacgcgtgcggctgcgtgcccttatgtgcgcccgttggcgagggcgagccgtgcggtggagataggcgggtgccaggcagaggagtgtacgtgccgcgccgaggcagtggagagtgcgtagaaagatgccgctaacgagggcggatcggaggtaaacagccgtgggctaagcaggccaggcagagtccgggtcgtaaggcaggcgtgagcggtgtagcaaaaagccgcaaccacgggtgtgcaggcgaggacgggacggcaaccgaccgtaaccacgcagaaggcgggactgccgagaatgctgactgccgtgcaaggccaacgagggcgcccgagaagccgacggcgggaggaaaaggacccatcaaaccagggtcacgcgaaaggggcacccatggctgaagcaagcgatccctaataccaattaaagtagaacaaagcaccacccccaaaagtggaacaattcctaggaaacttggtacactagggtgttagccccaagcgatcgcaaacatatgaagggcctccgtacaatagggtccaattccagtactatgccccagaccaacccttggtacactcactgtcataggacaccaaatggtcacaaaaagcggggtcacaataattgggag

SEQ ID NO: 512997 - DNA, 374 bp, Homo sapiens
gtgccccacctctttgcttaaaaaaaaaaatgtcaatagccaggcatagtggctcacgcctgtaatcccagcactttagaaggccaaggcgggtggatcacctgaggtcaggagttcaagaccagcctggccaacatggtgaaatcctgtctccactaaaaacacaaaaattagtcaggcgtggtagtgggtgcctgtaatcccagctactcgggaggctaaggcaggaaaatcacttgaacctgggagggggaggttgcagtaaaccaagatcgctccattgccctccagcctgggtgacaaaagcaaaactccatctcaaataaataaaaaggaaaaaaaagtcaataaactgtacaaatttaattacagta

SEQ ID NO: 512998 - DNA, 257 bp, Homo sapiens
aactggcccggggaaagggggcccccccgggttttatctttaagggttgccctttcgccaaaaaaatgtttttcccatgtgtccaaacctatgtaatgtgggtggggggggaaatcccccccccaagggtttgtcccccgggggggcccccccccatgtggtcccccgtcctaaaaaaatttccgtttgtgctgccaaaccaaaaccaggggagggggttttcttttttgtaaaaaaaaaaaaccggggggttttta

SEQ ID NO: 512999 - DNA, 281 bp, Homo sapiens
cccggatgacactgcacacatatgtactaaacatatgtgttgctatttcatcattcacatccttcttttctatgcttggtgtaattattgtaaagataaattatatagtttttttgtatgtgtgttggtagtatatgttcagaaggcaagcatcttcattttgctagctttgcagaatcttaaaatgtgtactcgttatttctaatgatgtaaaaaaaaatccctagtcctgtttagcatttgacttttttatatgttttaaatgttgcagtgtgcttccg

SEQ ID NO: 513000 - DNA, 314 bp, Homo sapiens
actctcgttcatcttgttgatggacatggtggattgtctccaccttttggcctattatgaattaggctgctgtgatccacttggtatttaaggcatctgtttgctttcctgtcgttcctgctttcagttgttttgggtatatacccaggtatggaattgctggatcataacgtaaatctatgtttagctttttaaagaactgccaaactgttctctatagtggctgtaacatcttagcatccccacctaggaatacatgaatgagagttccagtttcttcagatcttggcaatacttatttgctggtttcccgg

SEQ ID NO: 513001 - DNA, 858 bp, Homo sapiens
agcacaaaaaaaaagaacagtccgctcttgtggttctgtacccctttcgcaacacatgtcccttgagagtgtcacagagaagtctgggttaaacagcacattgggggtcacatcctaagccctttaataggggcttcccataatttgatgtatttgtccagtcttgaatctcgtgattagcacttaacctgtttctttgaaaattatcgcgcgttttacatcaccgtcgttcttttaaaggaaattgcgcaatttctgtgatcaacagcaagtcccgctcggggggcatttgtccccctcccccctccggtttgtccaccccccattcgcgtgagggtctccctagggcggcgcagcctaagagtttcaaccggcgtgaatagcagaccccttcttcataagcgtgacaaggactctcctgtcctcctatggcggtcacaacagaccagggtgcggtgacatctgccgcgcagtctccgccccccggtaagttctaccagacgtgtagacaccggggactctggcatgacaacccagctcagatcggaaaccctgtgtgcgagacaatccctgcttcgtcagcccttggcaaactagctacggatcaccaaagccttgtctctcacatgccaagttctcttgttacgctccaaccacaccaccttatgtcgatagtgtcatggcgaccgatcataaacgccttactccccttatataacaccaccacaacgggcaccaattttatctgagcgtcataaaatgcttttccctcaaaaagtagtagactccccatcttcatatccaccaggggtttgggattcaattagtaaacagaccacaaaagttcccccacataac

SEQ ID NO: 513002 - DNA, 661 bp, Homo sapiens
  misc_feature (75)..(75): n is a, c, g, or t
  misc_feature (89)..(89): n is a, c, g, or t
  misc_feature (141)..(141): n is a, c, g, or t
  misc_feature (159)..(159): n is a, c, g, or t
  misc_feature (281)..(281): n is a, c, g, or t
  misc_feature (305)..(305): n is a, c, g, or t
  misc_feature (461)..(461): n is a, c, g, or t
gtcgcggaatgcagtctgaagtgaaaacaaagttttggtggcttggacaggagctgcagcagcccatttcaaagntgaaggcccggctnaacgtgtgaaaaagagctcgctgggccccgggccccggcccccagacccagnaggtatttcccatgcgcnaagtggagcccccagccaagaagcagccaccccagcagagggatgcgagggatgatgacattgccctgtttggcagtgacaataaggaggaggacaaggaggcggcacacctgcgggaggancggcttcggcagtacccggaaaanaaggccaaaaagcctgccctggtggccaagtcctccatcctgctggatgtcaacccttgggataattaaacggacatggctcaactggaggcctgtgtgcgctctatccaactggacgggctggtttggggggcttccaaactggggcccgtgggntacggtatccgaaaactacaaattcagtgtgtggtggaggcccacaaggtggggacaaactttctggaggaggagatccccaagtttgaggagcacgtgcaaagggtcgatatcccagctttcaacaaaatttaaagcctaagtgtgggtacgggggggggggggtgaggccctcccccaattaaaaactgaggccggca

SEQ ID NO: 513003 - DNA, 406 bp, Homo sapiens
ccgcggtgtgtgcatgcacttacactacacgtctgatgttcattgacacaggtcacacagtctcacatgcacacatgcatgcacacaccagacgatcactctcacattcgcacagtgtcacacacgttcacattcatgctcaatcactcaggttcacatcacacacattccttcacacacaatgtctctgtcacatgttcacaatatctcacacatgttcacacacattcacacatattcacactcacattcacacacgtctcacacatattcacacatacattcacaatgtcacacaagttcacacatgttcagtcatccacattcacacagtcacattcacacgttcacacacacacaatatctcacgttcacattccatacaccgccatacatttgcacacgg

SEQ ID NO: 513004 - DNA, 990 bp, Homo sapiens
gagccggttgtgactgggggtgtgttgtgtgtgtgtgtgcggtgctgtgcgtgtgtcgtagtattctcttgtgggagactcggggacatcccccctgctggtgttgtggatgcctgttgaccactagtggtctgacatgttaagaagccagatgcaggtacagaagataggtgctgcgtggcaaggaggagaatggatgcatgaaattacatggaatgtccgacttcgcctcctggtctcaatggcagttgccactcgtgtgctctggagtggggccgcagagttcgatgtcgacgccgggagggcttgacaggcgggcccttggatcaccgtcgtggaggtgctaggactgtttactctctagagagtgcagaggtgggaataacggaggaagagctggctggtgggaacgtagtgggactgggaaaccatggggtacgcgggatactgagggactatttgctctgctacttgtaggtttaaacttaaggaacgaactgagggggtcgtagctcgatagatagttgtcccaggtgagtggttaggttcaaatctttttaagaagagtataagaagaaggtggggggggttaaataagaactaaagttgggggatgtacaaaaatttgttgtcaccaccaagcgtgtaattgggtggatggacaaggtttatgcttctcacatgagacgagtaggggacttgctaaattccttcgtggtggacacatagggctccaagatcgtgttaaccttagggggaccggaggctgaaataaaggtatttggagaagagggtacgacagggttgactttcgggccgacgcgattttcaaggtttggttttcaggagagcacaaggcagggtgccttggtaagagagttgtcgaaggaagttttattggagtgtgcgctgatgggccacattggggaaaggatgttgggtagtcacattgagaaaaagggggcaatcaggttttggaggaacacggga

SEQ ID NO: 513005 - DNA, 347 bp, Homo sapiens
  misc_feature (48)..(48): n is a, c, g, or t
  misc_feature (72)..(72): n is a, c, g, or t
  misc_feature (74)..(74): n is a, c, g, or t
  misc_feature (96)..(96): n is a, c, g, or t
  misc_feature (130)..(131): n is a, c, g, or t
  misc_feature (175)..(176): n is a, c, g, or t
  misc_feature (188)..(188): n is a, c, g, or t
  misc_feature (194)..(194): n is a, c, g, or t
  misc_feature (197)..(197): n is a, c, g, or t
  misc_feature (199)..(199): n is a, c, g, or t
  misc_feature (206)..(208): n is a, c, g, or t
  misc_feature (210)..(210): n is a, c, g, or t
  misc_feature (212)..(212): n is a, c, g, or t
  misc_feature (233)..(233): n is a, c, g, or t
  misc_feature (305)..(305): n is a, c, g, or t
tttagtatcaagcaagaggagactttgcttatcactacagaacatttntatgacttgagttacaaaagaatncnacattatttgcacttgtaattngcttccctttttacccatgtcggccagcctcaanncaactagcatatggctgacagataaaataactatattctatggnnacctttacaatntgaggngtngnttatgtnnnangngtagattaacatattttgttnacctattttttgtttaacactagttcactccaagttattttttttccttttgcatgacctatctttttcatnttcagactgggagaataacaaaattttacatgtctttccccc

SEQ ID NO: 513006 - DNA, 744 bp, Homo sapiens
gggctggatcgccaggtcaggagaccgagaccatcctgggtaacacagtgaaaccccgtctctactaaaaacacaaaaagttagctgggcatggtggcgggcgcctgtagtcccagctactcgggaggctgaggcaggagagtagcgtgaacccaagaggcggagcttgcagtgagccaggatcacgccactgcactccagcctgggcgacagagcaaaaaaaaaaaaaaaaaaaaaggaataacacgtgagcttaacagtgatgctctgtgtacaattccattggaatctagaaggtgtatcttatggaatatccatttataaaattcacaaaatattgggtgtatcctaaaggctttatttaagcaaagcatttttaatagaaccgttgccgggccaccttgtagttaattggtttataattaaactctaatgaagaacgggggctaactttcaacatttgggattacacagctgcatgtggcatcaggatcgtgcgacggcagggggatgtcatttttacaaaggatccatgtgtatgattcagggctcatccacctaccacttcattttaaggcctggtgggcgggcactgtgtccagctaatcgggaggtgaaggcaaggaaaagcgtgacccgggagggcggagctggagtggagttgaagatccgcaccagttggattcaaggccctcagcgtggcgagcagagcaagacccgggttcgaacaaaaaaacaaagggg

SEQ ID NO: 513007 - DNA, 475 bp, Homo sapiens
  misc_feature (185)..(185): n is a, c, g, or t
  misc_feature (299)..(299): n is a, c, g, or t
  misc_feature (350)..(350): n is a, c, g, or t
  misc_feature (454)..(454): n is a, c, g, or t
aatttctgttgaagaaatgcatgcacgcatgaatgaatgcatgagcaaacaaagattgttaggcaggcaagtgctttcccgccagggttagagagattatttagcagtgcaaaaagaccatggactaaaaaggaatgagataatgccccttgcagagacatggatgaagctggaagccatcatcntcagcaaactaacacaggaacagaaaaccaagtaccgcatgttctcattcataagtgggaactgaactatgagaacatagggacacagagagagtaacagcacacatcggggcntattggggtgggggtgagggtgaggggaggggaagtatcaggacaaatagntaatgcatgcagggcttaacactagggtgacgagttgataggtgaagcaaaccaccatgccacacatacagttatgtaacaaacctgtaagttctgcacatgtntcccggaatttaaagtaaaat

SEQ ID NO: 513008 - DNA, 146 bp, Homo sapiens
ttagatgtcccgcgacgggaacagacgctccaaagtcacttcccctcgcacatctgacttcggggcagaaaccaggtagtcatgacaccagcgatgggagcactataggtttctgagattcctagcagaacgacggaaacgtcttg

SEQ ID NO: 513009 - DNA, 298 bp, Homo sapiens
  misc_feature (263)..(263): n is a, c, g, or t
  misc_feature (286)..(286): n is a, c, g, or t
cgcagtgcctccgccaccaccgccgcctcctcttccttggccaccccagaactgggcagcagcctcaagaagaagaagcggctcttccagtcagatgagggatgtcattaggctaataggccagcacttgaattgcttagggcttaaccagactgttggatcttctaatggaaggagtctaggatgtctgtttagaacatccttctgtctatccaaatttccgaaattagtgtcatggaaagagacctgggtatatggcaganaagtgtccctgtatgtaactatngccatttaggtg

SEQ ID NO: 513010 - DNA, 209 bp, Homo sapiens
ttttgcttctgtattgtgcagttacacaataaggtaattagattatagaagtactcagatcactgtaagtggatgtatgtattagttaaaacttgagtggtttgcttttggctgtttagatcaaagttttttctgattcttctgtcctcatggtgaacataagccgtgtagttgaaacagtcaaacttattttagtaatgttagagata

SEQ ID NO: 513011 - DNA, 178 bp, Homo sapiens
aagcatctcatctatatcccaaatccaagaaatatgggtttagccatatagtaaagtccacaaaatgcaatatatgctattatctttactagtgctagtgtatatataaaataaaagagacaagattattcactgtatattaaacaacgattcggataaatacctcgaaacaagtagt

SEQ ID NO: 513012 - DNA, 182 bp, Homo sapiens
ttggatttcactggatcccaggatgcgactcactgggaaacaatgttggactaggcatgttcagtgaatgagccccgaagttctatgacacactgtacacatccatctggctcaaggggcaaatgcagtacgtacagcattggccgtggtgcgtcacaggtggcataactatttcacactaa

SEQ ID NO: 513013 - DNA, 213 bp, Homo sapiens
ttgtagaaggtggtgcgtgggcagttgtatggtctggaacatggtacatgggtagttgtgtggtctagaatgtggcatgtaggtagttgtgtggtatagcacctgacgtgtgggcagttgtgtgttgtggaaggtggtgcgtgggcagttgtgtggtctggaatgtggcacatggtagttgtgtggtctggaacatggcacgcgacatcgcca

SEQ ID NO: 513014 - DNA, 640 bp, Homo sapiens
  misc_feature (46)..(46): n is a, c, g, or t
  misc_feature (48)..(48): n is a, c, g, or t
  misc_feature (55)..(55): n is a, c, g, or t
  misc_feature (63)..(65): n is a, c, g, or t
  misc_feature (67)..(67): n is a, c, g, or t
  misc_feature (72)..(72): n is a, c, g, or t
  misc_feature (74)..(74): n is a, c, g, or t
  misc_feature (80)..(80): n is a, c, g, or t
  misc_feature (87)..(87): n is a, c, g, or t
  misc_feature (94)..(94): n is a, c, g, or t
  misc_feature (100)..(100): n is a, c, g, or t
  misc_feature (110)..(110): n is a, c, g, or t
  misc_feature (116)..(116): n is a, c, g, or t
  misc_feature (118)..(118): n is a, c, g, or t
  misc_feature (122)..(122): n is a, c, g, or t
  misc_feature (245)..(245): n is a, c, g, or t
  misc_feature (271)..(271): n is a, c, g, or t
  misc_feature (379)..(379): n is a, c, g, or t
  misc_feature (395)..(395): n is a, c, g, or t
  misc_feature (420)..(420): n is a, c, g, or t
  misc_feature (535)..(535): n is a, c, g, or t
  misc_feature (545)..(545): n is a, c, g, or t
ggccgtggcgcggagaactctgcaatgacatgaggctgaggattgngntagatanaaaccagnnnangccgnanccccgngagggangcgtctncgttgngtccggccgntctgcngnactntgaggaaaagctcgcaccaggtggacgcggatctgtcaacatgggtaaaggagaccccaacaagccgcggggcaaaatgtcctcgtacgccttcttcgtgcagacctgccgggaagagcacangaagaaacacccggtactcttccgtnaatttcgcggaattctccaagaagtgttcggagagatggaagaccatgtctgcaaatggagaagtcgaagtttgaagatactggcagaaacagtgacaaagctcgctntgacagggggatgaanaattacgttcctcccaaaggtgatnagaaggggaagaaaaaggaccccattgctcctaaaaggccaccatctgccttcttcctgttttgctctgaacgatcgcccaaagatcaaaagtgaacaccctggcctattccatnggggatactngcaaagaaattgggtgaaatgtggtctgagccgccacgccctgaataaccacccttttgaaccggatagcaccttagctataaggtgaatatttg

SEQ ID NO: 513015 - DNA, 135 bp, Homo sapiens
ctgacggagtggccagagctgtgaacagccgcggacacagctcagtgtccctttgcaggctttctcagaccaggcttctgcagctgtctgcaggctcctggtccccttgatcagagactgtgctcttctgagaag

SEQ ID NO: 513016 - DNA, 354 bp, Homo sapiens
tgctcgttgactatttgttggcatctcgtctggccgtatcatcaacctgatgagcaagaaggtatataattcctacgccctcacagccgatgaacagttggaataggttgtgagcggtaactaaaaatcagaatggtatttaggaagatcaagtagatatttgaagaactgacttacatgtatggctctcgagttcactttttcaccagttagattcctattatggaccatgtcacgaacacatgctacacgtcatgaatattatgcgagaagtagtctactttgaagctcagcgagagctgggttgtccgaggtgtggcctcagtgccagtctcgagactaagtaacttcttg

SEQ ID NO: 513017 - DNA, 205 bp, Homo sapiens
acctggaggtctgatcgggcttccccgggccctgctgcgggactggccacccaagggccgccctggacgcctccctctgtgaggtcaggtcctcgctgtcgggggtcaaggtatgcgcagggtcgctgttatccaaggtctctgaccacggggcgggagacgatgcatccgcttccacagcaggtggcgtggaccaagcttctcc

SEQ ID NO: 513018 - DNA, 531 bp, Homo sapiens
  misc_feature (468)..(468): n is a, c, g, or t
acccgagcctaagggctacccctaggacagaccatcagctccagcagcctctgtagccagtagatgggctctgtgtatgtccggtgtatgtatgcgcctcctcccaagggcccatcttgggcgtgggacgggggcaggcagggagacagcagggtccctgctcatattagcaccccccgatgtcctatcccgagagcacccagacacccagctagcagacagagaaatgtggggcagtggaacagcaccttgcctccaagctgggccccatgttgccccacagaatcccccgagcccaggcctcagagatcatgtgtacaggctggcggtccccttaggaaagatggactccataccccactcccatcccagctgtcctgtcacgtgagaccagtgttgtgcacagaactgacaagactcccttctgatgtgtgctttccatcccaatcaccagtaggagctcctggngccctgccatgaccctactccagagaatatcctttcttcctttctctgaccaattgagattgt

SEQ ID NO: 513019 - DNA, 1715 bp, Homo sapiens
  misc_feature (960)..(960): n is a, c, g, or t
tgcttagattatgattgccgttgttgagtcccttgcttttttcgtagtgatcgcggtgtactgcatctggattttttatgtccgcgggtgtattcactttcatccgtggatacggttgttacgcctgtggctccttgttggggaccctattgtaggcactgtggttgcaccaagaggccgtggtgtggtgcgctgctcggatgttctcccgcggagttgttcttcgaaccaccacggtggttcgcgacactagataccacttggggcggtgtgtgccacaaaaacacagcgcctcctctttctccaaagggcgcgcgcccccaaaaggggggcccacccagaaagaaaagcggggggtgtagcacacacactgtttgctaaagaagaagagacgttggggataatgaaagtgtgggaagcaccacccacctgccttaagtgggtgccacaaataatgtaataagccagattatatttgtgggtaaaagaaacgggcccttgctgttcgtctaccaacaacggggaccctcccctacgggggggagcccacacgaaagtgtgtgtctacttctctgcgaagtggggttcgtctcacccaacagagtgggtttctcgtgcgggttgtgttgttttggtagaagtgtggagagttcttttgtcgtctggaattgtttcgccgacgacaagtgtgtgattggtaaagtagtctgcgccgactttgtttaggaaagtattttgccccaaagcttgggaatgttttacctgctggagaaggaatatgttttcccacagcgggggtttaaatataaaatcttcgcctcttcggagcctgtaacactcgtttgcccacataggggccacataggggaatatctttgtagccgccgccgtgtgacaccaccacaaagaatagtgtgtggtgttgtccacaactacgggggtgtcccccaataaatattnggcgccacacgaccccccaatgttgagtgtggaagaagccttctcaccccgtgttgggagattttgcaaaaggagactcatcccgcgagatgtgggtttataacttctgggctgttcaggtgtctctggtgtgtctctggtgtgtgtgggtgttttataactatatataatatccgccgcacccactgcacagaatattccgggaatagagcccctcttattatggcgctcacagcgcccccacacacacgggttctccccacacaatctccggagaagagaagagatgagaggggagaaactcacatgagacgccgagagagagggcgcacagacacacacatgtgagaccttgagaaaagaagaggtggcgtcacaatataaattggagtgttcgcacgcagccacgccacattgtgagaataagacacactatgagaaaaggggctctgccacagcaattctatgtttaatcctctctctccactgagatgttctttcgcttatgagaaaagtataaaaattggctgagaagagagcccacaaggtttgaaattgggaaagctcactggaggcttcactggtgaaaggcacgtagtttctggagaaaagccacctggggaacgaagacgacaggtgctataaagttgtgaacgagagctgaatggagatattgaaccacccacgtcccacagaatttgttttataagttcagacttccaatagtggccaatataaaagtgctatttggttga

SEQ ID NO: 513020 - DNA, 155 bp, Homo sapiens
cgctcggcccctatcttttatttctttttgcatcagtgacagcgatgaagttagcttcaggcttttttggtgtgcccttacccatatccatttcgcccacttccagccaatgccatttccatagagtttccatggtttagagcgtaattttgccg

SEQ ID NO: 513021 - DNA, 185 bp, Homo sapiens
aaagcgtgttgtacagttctacgggttttgatgcatgacacgcatcatgtatcagacagaatacttccactgccctaaaaatcccctgtgctggccgggcgcggtggctcacgcctgtaatcccagcactttgggaggtcgaggcgggcggatcacgaggtcgggggatcgagaccatcctggct

SEQ ID NO: 513022 - DNA, 333 bp, Homo sapiens
gagaaagcatctcactctgtcacccaggctagtgtgcagtgacgtgatctcagctcactgcaacctctgccttccaggttcaagtgattctcctgccacagcctcccaagtagctgggattacaggcatgcaccaccatgcctgactattttttgtgtttttagtataaacgggccagtataaatgttggccaggctggtctcaaacccctgacctcaagtgacccacctgcctcagcctcccaaagtgttgagattacaggaatcagtcactgcacccagccaattttttgccgtccttaagaaatccgtcgacgcggccgcgaatttagtg

SEQ ID NO: 513023 - DNA, 242 bp, Homo sapiens
ctcgatgccttctttccacctaccacttatctcttcttatacggcaatggcatcatcttttcagtttcaaaacaactggcatcattatatctatcttttttgccgtttctatttaggggtaatagttgatcaaatcaagtcttggttgtggcttgctgaattaaatatttatgagtggtgcatttttaagtatcgtgaccaagacaccactattaacgtcccgtgatcacacgcactctata

SEQ ID NO: 513024 - DNA, 494 bp, Homo sapiens
  misc_feature (39)..(39): n is a, c, g, or t
  misc_feature (258)..(258): n is a, c, g, or t
  misc_feature (325)..(325): n is a, c, g, or t
  misc_feature (328)..(328): n is a, c, g, or t
gtcgcctgaccttgcctgcctcgccgatggcggcggggntgtcaggaggataccagttcggcattggtcaacttcgccacagtcgcgccgcgtcaccttgggtgcttagcgccgggtggagcgggagtgtgcttgatggcttggaagtggggggagggctaattgcgaccgacagctatcaggctaccgggttcgcgctcggtgctcagccgtggacgcaggctcagatgcaatggtcgctgggctactcgcagccgntgcatcaggagagggggatgcaaagccagatgaccctgaaccagcagtttgccggcggatggggagnggncttgacctatgggctgcagagccaaagttatcaggacctccagcaggcgcttgagccgtcaggtcgcttggagggcttgcgcgattttttcagcgtcggcctgtcatggcagggcactgggctgtgcaacttcagtgtcgggggcggccaatcgcgcacgcgtaat

SEQ ID NO: 513025 - DNA, 191 bp, Homo sapiens
gaagaatctagtttaggccgggtgtggtggctcatgcctttaatcccagcagtttgggattgcttgcatctaggagttcgagaccagcctcggcacataggagacccctgtctctacaaaattccaaaatttgtggggcatagtggcatgtcctctagtccagctagtcaggaggctaaggttgggaggac

SEQ ID NO: 513026 - DNA, 180 bp, Homo sapiens
gactacaggatctttcttacgccccaaactcctggcgagagatttagagagagagagagagagagagaagggggggatgctattaatgtaaaaagaaagtggcgccctgtgtaaataaaactccacaaaatgcgccctccacagtagtgacagagagagagagggtttctccacctaata

SEQ ID NO: 513027 - DNA, 1018 bp, Homo sapiens
ttcgcaggagtcctcgcgaggaggaagcagtgacccatgcgtccgcctgctctcactggaggagcagctttcttctgggactggacagctttgctccgctcccaccggccggggccacttcacaagttcctgatatacaagcttgtgagtcacatcgagcggaattgaaggcggattccagttgacaaaaggaggtggtgaggtggaacagggtaaatacagcacccatggttggcttgtgggcattgtgggctacgtggaaagccctcaaggactcccggaccttcaagatgtgtcttcgctgagcacatcagttgatgaatgcaagaggcgtagctataagaattggcataaatctaagaagaaggaccttataccaagtactgcaagaaagtggcacggatgaggatggcaagaagcagctggagaaggacttcagcgagcaatgaacgaagtacatgccaaggtcatccgtgtcattgcccacacccagatgagcctgctatgctctgcgccagaagaagggccgagctgatggagatccaggtgaacggaggcaatgtggccgagaagctggaatgggcccgcgagaggctggagcagcaggttacctgtgaccaaggtgtgaggcaggatgagatgatcgaccgtcatcggggtgacccaaggggggaaggctacaaggggtcgcgggacgatggcaaacgaagaaagctgcccgggatgagccactgaggcctgcggcaggtggcctgtaattggggcgtggctctgcgccgtgaagcttgactgaaggagcgcagtggaaaaggtacatcacggcctgaaatccaggcagatttataagatgacacggcgatcgttaataagaacgatctggttcgtcacaggcgcagattgaccatggagacgctacacattgtcggctgaacacaagaaggagaattgttacagagaagagacggacacaacaagacaacatgtcactagaaagagcgagactacagaagacaaacca

SEQ ID NO: 513028 - DNA, 377 bp, Homo sapiens
cgactcactggcattaccatgaagagggctggcgggagctttgccctgtgcacaccgtggtaacctggcaacaagaacatttgccaccctgccagtctgaagaacaaatgaaccactggagggggcgaaatcccaaaaccacctttggcttcacccaaacttattaaatgaaaaaaactgtcttttcttgggccaagtccctggcatgtctggctcctgttcccccccctggtccctctgccctgtggcaaggagcccacgtgcaggctcataggttgttccgctgaagtgcctcacacaggttctggttggtgtcgggctcctccgtcagcacctccacagcctcccactccccggatcggctcgaccggcgttcg

SEQ ID NO: 513029 - DNA, 241 bp, Homo sapiens
tcggttagctgtgataatatgggaagggaggaaattttttttatttcctaaaccaggcctcactctatttacccaggttagaatgcaatgccacatgtcacatgttcccgtgctgctttgattccctgggttcaaccaatcctaccatttcagcctcccaagtagcttggactacaggcacttgccaccatgcccagcctccttttggtactattttagaacagatgtgcggtttcaccat

SEQ ID NO: 513030 - DNA, 183 bp, Homo sapiens
actattctcaggcatatagttctatggcattacgtacattcacatacttgttcatatatcactatccatctccagagcttttcgccaaatgaaactgtagccactaactccccattccctcctccccacaacccctggcaaccatagttccactttctgtcttcattatttgactactctagg

SEQ ID NO: 513031 - DNA, 81 bp, Homo sapiens
  misc_feature (46)..(46): n is a, c, g, or t
  misc_feature (54)..(54): n is a, c, g, or t
ccacagagaaaacaccttcatgttcatacactatcccccctcctcntatccttnaacccgacatcattaccgggcctctac

SEQ ID NO: 513032 - DNA, 101 bp, Homo sapiens
atttgtagcatctccacaggctgctgtaggtctgcagaggacatgcaccgagcaggtgaggtgctgacaaccagagactcgacaggccccctgccccccac

SEQ ID NO: 513033 - DNA, 306 bp, Homo sapiens
  misc_feature (300)..(300): n is a, c, g, or t
ctccttcctccatgacacccagggtcattcacagaacacagcatcccaggagcgctcgcgcctgctccttcctccatgacacccagggtcattcacagaacacggcatcccagcagtgctcgcgccttctccttcctcgacacccagggtcattcacacaacacggcttcccaggagcgctcgcgcctgctccttcctccttgacacccagggtcattcacagaacacggattcccaggagagctcgcgcctgctccttcctccatgacacccagggtcattcacagaacacagcaggtnctcacg

SEQ ID NO: 513034 - DNA, 549 bp, Homo sapiens
  misc_feature (132)..(132): n is a, c, g, or t
  misc_feature (171)..(171): n is a, c, g, or t
  misc_feature (273)..(273): n is a, c, g, or t
  misc_feature (326)..(326): n is a, c, g, or t
  misc_feature (366)..(366): n is a, c, g, or t
  misc_feature (434)..(434): n is a, c, g, or t
  misc_feature (444)..(444): n is a, c, g, or t
  misc_feature (458)..(458): n is a, c, g, or t
  misc_feature (492)..(492): n is a, c, g, or t
  misc_feature (548)..(548): n is a, c, g, or t
gatgtgggcccaggctgagaaggaggcccagggcaagaagggtcctggggagcgtccccggaaggaggcagccagccaagggctcctgaagcaggtcctcttccctcccagtgttgtccttctggaggccgncgcccccggaggaggacaaccccgaagtggtcaggccgnacaatggccgagtagggggctccccagtgcggcatctatactccaagcgactagaccggagtgtctcctaccagctgagccccctggacagcaccacccccnacaccctggtccacgacaaggccaccacaccctgctgacctgaagcgccagcnagctgctgcaagctgaacgacccccacctgaggggccganagccctgagacagctgagcctggctgctggtgacacggtacccccagcctgactgtggttcagggcangcggggaccnaccctgttaagctnacaagcccgggcggtgaggttccgtggagaggangccggctgctgtcatgtgagctgtgttaacatcaagggcctgtcgcggcacgccgnt

SEQ ID NO: 513035 - DNA, 803 bp, Homo sapiens
agcgggctcgtccggccggccccgagcctcgacgtcccgcgcagtacccagaccggacccagccgacccgactctactgccggctccgcgcccttccccgagggctggatgatgggctgttacgtcctgacaaacgtgtggacaacggatgctgactcgatggactacggtggagtggtgcccgctgcaatgctgcaggtgaacctgttggcgtgcgggatctaccagctgcggtcggtcggaggtaccgagacgtgaccggacaccctagtaagcaaggtgtcacatcccggtgggcttgacatgccctcttgggcttggccgatgccagttggatccattacaattgcttcacgcctggttggaatcttgaggctcaaggtgacttgcactctgatccgtgtgtggtgcacgataggtgcgacactgaaagtaccacgaggggataggggacgtgaagtgccttggtagcatgatgtaacagaccaattctattcctacaagactcgagtcgtcatctttcaaatagggtgaacataataataatacatacggtatctaaagactaagtgttgcgagtcatactgtgtaaagcattgatagttgctgctcactaacagtcgcgaactgccaatgatgggaaagctccacactcaatgtggtcacccaagccagcaatggggcctgaaggtcgacaggcgaatgctcatttggaccttgtccaagtgcgattctggaaaggtactcctagaggatgaggctggagcaaaggaattcttaaggatatgatggctgggggcccc

SEQ ID NO: 513036 - DNA, 587 bp, Homo sapiens
ccttttaccactccaggctagactcctaccccccaattaggagggcactggaccccaaacaggcatcaccccgctaaatcccctagaagtgccaatcgcataatacacatcctgtattgatcgtcgcatcaggatctatcatatcacctgagtctcacggccatagtgctaatagaagaacaaatcgaaatcaaagtgaaatattcaaagcactgtgttgatcacaatgtttcacatgggatcctcatagttagtcaacccgtccatacaagacctcaagagatacattcgagttcttcccttcaccatttctccgtacggtcattcttacgagtcttcaactattatattgtagcgcactaggcttccacggcaccttcacgtcaatttattgtgctcaatctttcctcactatctgctgtcatcccgtcaacatctataatattatcagttaactagtccataatcattcatcttgtggtcttacgaaggccgaccgacctgatactagggcattgtagtacgatgtggttagacttatttctgtatgtctccagctattgatggaggtgtcttgagcatagaaa

SEQ ID NO: 513037 - DNA, 101 bp, Homo sapiens
cgagctatttatttattttggagacaggatctggctccggtcacccaggcgggagggcaggggtgtaagtcctgggctcactggcggcctccaccgttccg

SEQ ID NO: 513038 - DNA, 253 bp, Homo sapiens
acaggcctgggttcaaggattcgcatctgttgagttgtcagcccagacaggacaatttgttgtgcggtgagtgaggagtgggcgcaccggatatgaagcatctttgcacaactttttaccatgtacttattggcacaaattcgggcagcctccaaggcttcagaggacagctgctcatattcatctgacaccatgtggccacaaatgcggaaactcatccacttttggctttttccggcccaggtcaaaaatg

SEQ ID NO: 513039 - DNA, 382 bp, Homo sapiens
actatcatcacagaacgttcaccatagacactgacactagtgtgattagatagtgttcgtgtggaggtagtgggagacagagtttggctctgtcatccaggctggagtgcaatggcacaatcttggcttactgcaacctctgcctcccatgttcccatgaggaatgctcatgccttagcctccagaatagctgggactataggcatgcaccagcacgctcggctgattttagtatgctagtagagacagtgtcaccatgtagcccaggctggggtcaaactcctgagctcaggcagtccacctgcatcggactcccaaagtgctaggattacaggtgtgagccagcgtgcctgatcctaactgatgggttcttacatagatg

SEQ ID NO: 513040 - DNA, 192 bp, Homo sapiens
aggaaggaaggcatcctggaatccccacatttcagtctcagataaggacaaagggactcccaagcccccaaataatcagaaaacagcaagggagcaggatgagcttgtagccggccccaggtagcctaaaagccataccagccactgtctacttcccatcctcctctcccattccctgtctgcttcaaacca

SEQ ID NO: 513041 - DNA, 245 bp, Homo sapiens
acctggtgtccagcagatggatgggagccctctgcagacacaggagaagacaaggatgggacggtctaccagagaacgagtgggggcccgcgaggggtttataacaaaggggcccctttgggagtgctaagggagatatatttggcattcccactcagtggatctggtttcatgtgtttgcctcatgcagacaccatgagctcatgccacagaccacgactatgtccaacccatgtgcatgcatg

SEQ ID NO: 513042 - DNA, 533 bp, Homo sapiens
gaacgggcgtgcagcttgcttctgcaggtgactcttaggatcccctctcgttaactgggaaatagtctgcctctgagataggagttcagagaatgagcttgacgctccccggatgggatgtgcgtgtgctgtgaccaggtagcatcagagagtcaggtgtgaccaagcctgagtgccagggggctggggaggaggttccgaggagagtgggacgggttcctgtggctggctcggggccaccgtggccctgattggagcggctcttgacaatgatgagaaggaatcaggcggctcggggccaccttggccctgatgggagcggctctggacaatgatgagaaggaatcaggcggctcggggccaccttggccctgatgggagcggctctggacagtgatgagaaggaatcaggcggctcggggccaccgtggccctggtgagagcagctctggacagtgatgagaaagaatcaggcctccagtttagggactctgttcctggtgatccctgggctaaaggactaatcaggggaa

SEQ ID NO: 513043 - DNA, 166 bp, Homo sapiens
  misc_feature (24)..(24): n is a, c, g, or t
  misc_feature (42)..(42): n is a, c, g, or t
  misc_feature (90)..(90): n is a, c, g, or t
  misc_feature (113)..(113): n is a, c, g, or t
  misc_feature (128)..(128): n is a, c, g, or t
tacaatttaataaatctcttcatngcagacatgtatggctgnttggtagtattcagaaacatcacagtaatgggagtttcttcacttggngtgtagtcctcaataattatttntgaaattgctgtcanaccagtaagactgcatttatacatccatcattgttcag

SEQ ID NO: 513044 - DNA, 136 bp, Homo sapiens
gagttgcgaactctacatctgcttcaccagttactctgacatcaggaccaattacaatgtgtactctcacatgggttagagcgatgcaaaaaaaatgggtaccgagcctcgacatcacgtcacatcttggatcttc

SEQ ID NO: 513045 - DNA, 211 bp, Homo sapiens
gttgaacccggcagcagaggttcgcagacagccaagattgcaccattgcgctccagcctgggcaacaagagtgaactccgtcccaaaaaaaaagaggagagagggcgattaaccagaaccagaaccaaaccaaagtggttatccagtatttatttggattagcttcttaatttgaagcagcaaagtgcaccaccatttaggttattgccac

SEQ ID NO: 513046 - DNA, 320 bp, Homo sapiens
attaattcctatgaagtcaggaactgaagaatatactctcttcttacttcttctggaagtcacagtgaccttttgaagggccatttaaatggcccactcatttccatcttagattacaaaacttctaactaccacatgctgagcattctaagcccaacactcacatcagccacagtaatcatcagttccataaaaggcccatatatttcctagtgaggtgaaattcttgatggaggtatgatggcaaataacagtgttcactttcacttctccgaaaaaaaaatacagtatgctagactgtgagttcttataaaagagcc

SEQ ID NO: 513047 - DNA, 340 bp, Homo sapiens
  misc_feature (105)..(105): n is a, c, g, or t
  misc_feature (126)..(127): n is a, c, g, or t
  misc_feature (130)..(130): n is a, c, g, or t
  misc_feature (150)..(150): n is a, c, g, or t
  misc_feature (153)..(153): n is a, c, g, or t
  misc_feature (157)..(157): n is a, c, g, or t
gctacgagtatccatgcttgctgatgaattgctgagaaactgcagattgtgccttgcatacaaacgcatgcttgagaattgcgatcagtttctctggtcgcatcnggccttgtgggagaagattcnncangatgttctgacttggaaaanccntgtngatcatgctcctgaaccttctgaacgcatttgttattgaaggaaagacaccacccccaaatcctgccatcttattggggctacttttgtcagtgtctgtacccttggcatcggcatctgtgactctttatccatgacctcagtgtttcttaaccaaagttgtactcagcattcctcgcaacag

SEQ ID NO: 513048 - DNA, 1463 bp, Homo sapiens
gcggtgaacctgcaccactgcgcaccaacgtccacgcctctccgctgcctgcctgcttctgacgtgccacctgtgatggtgtgtgctgctacctgtgtctgtgctgagcaccatgtgcctgacctgtgagtgtgtgccaacctgtgcactggccacactgtgccgtcatgatctctgtgctacaatggtgccacctgtgagatctgccctgcataccattgcttggatgcatgggctgcccatgtgttgaacctgtgctgcatgctgcccaatggtgccaagcagctgtgccacttgcaatgaacttgctgacctgagatcctgtgcatgctctgtgacgactccccttggcaagcttgccttgccttgtgtgtgttgcaatggggccctgccatgggaaacctgctgacctgtggcgtacctgtgccacttgaacactccctggccttgccatcctggctgtgccgcatggctggttgacccagtgttgcgccaacacccccacaaacacctctgcttgctgaatgtaccccgtacaagttccaatggggacggcaatgtcacccctgtgccgccaccgtgaacgccacctgtggtacttgcaatggtgggtgtgaactgaatgtgtctttcccagtggacgaccatatgtggatgcccatttggacgtctcccgcctagtacctggacacagcgaaaaccccgcaccggtaccacgaagcgcgcagatgtgggcgaccacagggtgggcggtggcttaggcttatggccatgagcctgaagcgagcagcccaattccgaatcgtctgcggtcggatgacccattttccacatggaatatggcgcatatatggcgcagaatgtggggcgattcctccgatttatccaacccctgccaaatgggaaaactgggtgggacacacacgaccccaaggccgttttgggaagtcacacccatgctggctgggtggcaaacaaacctttccgctctcttcaaccccacggacatcacgaccctgcgccgcgttcgggccctcttgggacttccatcccaccgaagtcccccaacgctgcgcaccacatcagggacgtgggaccagaccgggccctgttgtgaccacatgaggtattgggagggcaacaccaacctggccccgaccagtttactcgagcaggcaacaaaccgtttacattgagacgcattaggggaggcggcaaatgcgcctcctacatacccccgcggccggtaaaccgttttggctctttggtcgggcactctttttcacacacgtcgaccaaccgagccgacgacgaacgactacaaccttccacttcctgccagacgtcatatcgcgcctgaccgatcgctcctcgcagcacagttcacacaagcaactcagcatacgccagctcctgctcgtccgcgaccaacgacggcgccccgatccggcaggagtcccccc

SEQ ID NO: 513049 - DNA, 335 bp, Homo sapiens
  misc_feature (100)..(100): n is a, c, g, or t
  misc_feature (121)..(122): n is a, c, g, or t
  misc_feature (125)..(125): n is a, c, g, or t
  misc_feature (145)..(145): n is a, c, g, or t
  misc_feature (148)..(148): n is a, c, g, or t
  misc_feature (152)..(152): n is a, c, g, or t
tcccctgttctgatgtaatcatggccaatcaggcagatggctctatgcattcaatcgccatcttggaggaatctgccgatcagtttctctggtcgcatcnggccttgtgggagaagattcnncangatgttctgacttggaaaanccntgtngatcatgctcctgaaccttctgaacgcatttgttattgaaggaaagacaccacccccaaatcctgccatcttattggggctacttttgtcagtgtctgtacccttggcatcggcatctgtgactctttatccatgacctcagtgtttcttaaccaaagttgtactcagcattcctcgcaacag

SEQ ID NO: 513050 - DNA, 736 bp, Homo sapiens
ggtgggtgggaggtgaagcggaacggtcccggcgggactgaatgcacgtcgggaaggggaggacgggaagtctagccgtgttgtgaccctgcccactctgttacctgccagatgactgctgaggaaactgcttttcttctcgaggctccgttgcctcgtctgtgcccgggcggtggtgcttaccctggcggggtcgcagtggaggtctcgtgtgctggcgcgtgttgggtctgcgtttcccctctggggtgcttgtggccgcatgagcccagggctgtggacagccttgtgctcacgggtttgtgggtccacagacttcccaatgaaggacagaccgagtgcgatggcttgttggtggccaactgcagacggcttgtgaccccatgcggacacgtgggcctgtgtgtggacccggaactcagagtacatctacgttcttgcttccaaacacctttgaggaggactgcattatgagcttggtgggaatcattgtgggcactccctgccaggacgacagcatagaggcgtacggaatctgtcgaggggcgtccccagggtatgtgaactcgggacacacgacttgtaggtcattgggaaggttccctttgcagcaacgccttggtccaaacggggaggcttgataatcatgttacccacgtactccttgccacaagatagaaaacccaaacccccaaggattccacatgttcccttgtgaccaccaacgtgcaaaaca

SEQ ID NO: 513051 - DNA, 784 bp, Homo sapiens
acccctaaaagccaaactgggaacaggcacagactcatatcaagcatagtcgtcatggacacgtagattcgggcaagtccaccactactggccatctgatctataaatgcggaggcatcgacaaaagaaccatcgaaacattggagaaggaggctgcggagatgggaaagggcgccttcaagtatgccatggcgtctgtggattaaacgtgaaagctgagcgtgcaacgtggtatcaccgattgatatcgtccttgttggacattttggagaccagctaagtactaatgtgactatcattgatgccccaggacaccaggagactttatcacaaacatgattgacggggacatctcaggcggactgtgctgtcctgtattgttgcgtgctggatgtgggtgaatgtgggagagctggtatgctccagatgaaggttgggcagtagcccgaagagcatgccctatctggcgttacacagtgggtgtgaaggacgatactaattgtgcggtgttcacacaaatggattccactgagccaccctacagccagaggagatcatgaaggcatattgttaaggctgtcacgaacttactctttaagattctttggctacaggccgccgacacagttagacacttcagtgcgccactgtactgggtcgtgaaatcggtgagtagcatcgctgggtaggccaagtcgctaagcattgcctatgggtttcacctgggatgcgccctcgtcatgcccgtagacggatggtgcctgcctgtggaacctcggctggt

SEQ ID NO: 513052 - DNA, 139 bp, Homo sapiens
ggcctattggccaccttccttcccttgcctcttccatttttgcaagtgccgctaccaccatggcccctctttttaaggttccctaaaagaccacttgaagtcaacgcagagcaggatgaaagggctggggaaagggtgg

SEQ ID NO: 513053 - DNA, 968 bp, Homo sapiens
agcggggcttccctgagcgctcggcccgggaggaaacgaagatggtgctggcatctggacttcgtcctcgggtggactacaaggaggggacccacgccctcatcagagcagcacgcaggagcaagcgctctcaaggacccggcgactagctggaccagcctggctgaacggccgcacagcgcagctggcgacgactccaccgctccctgcaggtccaccagattccacccctatccgtcacagacccccctccccagggtcgccggtcggctccccgaggcttcctcccccatccccagaaaaacacacgcctgcagtccgcccgccggctccactccccactcttcctacctcccaaccccggcgcgcgaccgaccggtccctctccaccggcgtgctccacgtgccgctccgctgcccactcgactcccccggctctctccctgcagacctgcgctcacctctctcgcacaccacacgcacgacttccctctccttcgcgtactccgcgcaacgcactcctcgcggccgttgcgcaggccccgctcctgtgcgcccccacaacctacgattgaccccctggaagccttctccggcaacgcgcccattccccccggacacacttatgcggcccatcacctcttgacaccaaatctccgacaaaccagctcccttcttcccggctgcgctacgcaattccagcccctggtccgaagcgcgcgcacttcgccccgcacggcgcccgcaaggcccaaccagacacaattttcgggtaccactccgcctgcttggtacaccaccctttggttctctaaacatctcggggtggacactttttctcgctttggggaacggtcgtccctcatgccccgcttcttctcacagcacggaacccccttcttgggccccatcggaacggctttggcagggcccataagcaatacccccgttgtgggaaaccattggag

SEQ ID NO: 513054 - DNA, 436 bp, Homo sapiens
  misc_feature (395)..(395): n is a, c, g, or t
gcccactgcagtcatgaagaaagaggtgctgctgatggggaatagccggtcgtggaagaccaccatgatgtcgatactctttgacgattacattgttcgcgacacccgtcgcctgtcggccagcattgacgcggaacactcccgcgtacgactcctagggaacctggtgctgtacctgtgccactgaggcggcctagagaccgtcttggacaattactttgccagccatcgatacggtgtctgacgtaacgtggaagtgttgatagacgtgtttgctgagtagagcctgtatctgtgtggcatgccttattgccagtcttgtctgtaggccgtacttcatacactctcctgactccaatatcttctgcctggtgcacagagtggatctggttcangatgatcagagtgacctgatttttgatgagcgataggcctc

SEQ ID NO: 513055 - DNA, 226 bp, Homo sapiens
ttcctctcaaaatatctataatatttagattggagagaccgccccgcagaggttcaagccagtaatcccagcactttgtggagcctgaggacgaagcagatcacctgaggtcaggagtaagagaccagcctggccaacatggtgaaacccattctctactaaaaatacaaaaattagccaggcgtggtggcacacacctgtaatcccaacttctaggggaactgaa

SEQ ID NO: 513056 - DNA, 153 bp, Homo sapiens
ggctgcggggaagacggctggctgggaaccctccggcaacactggccttccccccaccacctctcacctgatcttcccgccctccagcccagcccaccttgtccggtctggagcaccaggccacgctgtctggtgtctcttctgtgccgcggg

SEQ ID NO: 513057 - DNA, 870 bp, Homo sapiens
atcggggtgtggcggggggccccgtgcacgtcgacagatgggttgcagccggtgtctgtgtgtctggtccccttggtccccgcgtttggttttcacgcggctcgcgggttctgttcgcttgtctccaatgggttgtttggttttgccgctttgtcccgctgggcgagtggcacacgccctcatgtggctagccctcccggtgcttgggatttgtgccgttctgggtagtatttttggtccctgggcgctttgtatcttgatatccgccttggatgtttgagacttgttgctggttgctgcccttgttttggagctaacggttccccctggtactttggtgttaatccctctgttgacatatctctggggttcgacctttcggtacgtcgtggcttggtcacttcggtggctaacggttagtacgtgcttgtggttagtcaagtctgtggcttgctgtgctctgttcgggcccgtccgcctttgatctgtggtcccggggtttttacctgtcagggctcgaactgttctgggctttctctagaggctggcagaccccgttgttttctcttgcgggtctctccggcttggtaggtccagcccgtacggaccccgctttcctttcgttccgctgatgtctttggcccgacgccggtgggctgttacttgcctttgatgttggccccgggtttgcattgacgcctgtaagatgtagtctattcctattttacgtaaggttttttctggtacgcatgtcgtccggattcacttgaagagatgcaccaccaactttggttttcaactgttatatgaggacattaggccccacgcacagcgtcattgtgtaagagaaaactaacaagtgctcccgta

SEQ ID NO: 513058 - DNA, 114 bp, Homo sapiens
cggaccgcacctccgtccatcaggaatttctatatattgatctctgattggttataaaaacagcagtccaacgacgtgtacacaatgacgctggtctgatgggagcaagatgcg

SEQ ID NO: 513059 - DNA, 244 bp, Homo sapiens
  misc_feature (55)..(55): n is a, c, g, or t
gacacgtgaagggttatttatggttatgatgaccctgtcctgcaactagggtacnttcagccactactgaggaggagggtcccatctctctcttgttttttttcaccgaggtcacagccagacgtggggcaaaggtgttccctgttctacccagccattcctgggcctgccgtctaggggcttacagggcccaggagttcgcagtttacaggccagggcattaggccaggcgcgctcggtgcac

SEQ ID NO: 513060 - DNA, 371 bp, Homo sapiens
  misc_feature (114)..(114): n is a, c, g, or t
tagaggacgctactgagtcatggtcacgtctggaagccctaaaacttgagaggtagaggcggctggatcacttgaggtcagcagttcaagtccacccttggcaatattgcgaanacgcatctctactaaaaatacaaaaaaaaaaaattagctggggtgagggtcgcttgtaatcccagctacttggcaggctgaggcaggagaatcccttgaacctgagaggcagaggtttgccagtgaaccgagatacagccattgcactccggcctgagtgacagggcaagactccatctaaagaaaaaaaagaaacgggaaatcaaatccttaagtcacctagttaaattttactgtatgcagccattgcactccgg

SEQ ID NO: 513061 - DNA, 484 bp, Homo sapiens
  misc_feature (81)..(81): n is a, c, g, or t
  misc_feature (150)..(150): n is a, c, g, or t
  misc_feature (154)..(154): n is a, c, g, or t
  misc_feature (164)..(164): n is a, c, g, or t
  misc_feature (183)..(183): n is a, c, g, or t
  misc_feature (207)..(207): n is a, c, g, or t
  misc_feature (212)..(212): n is a, c, g, or t
  misc_feature (221)..(221): n is a, c, g, or t
  misc_feature (230)..(230): n is a, c, g, or t
  misc_feature (235)..(235): n is a, c, g, or t
  misc_feature (248)..(248): n is a, c, g, or t
  misc_feature (261)..(261): n is a, c, g, or t
  misc_feature (264)..(264): n is a, c, g, or t
  misc_feature (266)..(266): n is a, c, g, or t
  misc_feature (273)..(275): n is a, c, g, or t
  misc_feature (279)..(279): n is a, c, g, or t
aactgcttacccacaatctgctgagctcgcatgtgcggggggtggggtaccgtggctaccccctgcgccttcaggccaccnaggtccgtatctgccctgtggaattcaaccccaacttcgtggcgcgtatgatacctaaagtggagtggncggngttcctggangcggccgataacttgcgtntgatccaggtgccgaaagggccgnttganggatatgangagaatgangagtntctgaggaccatncaccacctgctgntgnangtggaannnatanagggcaccctgcaggtccccggaatcttggacggtatgtccccattaagccgcgggaatcccaaacaatgctgcttaagtaaagaggaaactaagagttgattgtccaggcgccagtttttcttgtaatgactgtatattgtgggtgatctataccctgtttccgaattctgcggtgtgtatcccaacccttagaccaatgatac

SEQ ID NO: 513062 - DNA, 136 bp, Homo sapiens
agaggtcgaggaacgctggcgcagtatggcgaggtcagtgacagacactggcggtcgggtctgaggagggagctggaagttaattaacaccagagagaagagttcctgtcccagaggtcgtaactatgctgtccca

SEQ ID NO: 513063 - DNA, 361 bp, Homo sapiens
  misc_feature (81)..(81): n is a, c, g, or t
  misc_feature (150)..(150): n is a, c, g, or t
  misc_feature (154)..(154): n is a, c, g, or t
  misc_feature (164)..(164): n is a, c, g, or t
  misc_feature (183)..(183): n is a, c, g, or t
  misc_feature (207)..(207): n is a, c, g, or t
  misc_feature (212)..(212): n is a, c, g, or t
  misc_feature (221)..(221): n is a, c, g, or t
  misc_feature (230)..(230): n is a, c, g, or t
  misc_feature (235)..(235): n is a, c, g, or t
  misc_feature (248)..(248): n is a, c, g, or t
  misc_feature (261)..(261): n is a, c, g, or t
  misc_feature (264)..(264): n is a, c, g, or t
  misc_feature (266)..(266): n is a, c, g, or t
  misc_feature (273)..(275): n is a, c, g, or t
  misc_feature (279)..(279): n is a, c, g, or t
aactgcttacccacaatctgctgagctcgcatgtgcggggggtggggtaccgtggctaccccctgcgccttcaggccaccnaggtccgtatctgccctgtggaattcaaccccaacttcgtggcgcgtatgatacctaaagtggagtggncggngttcctggangcggccgataacttgcgtntgatccaggtgccgaaagggccgnttganggatatgangagaatgangagtntctgaggaccatncaccacctgctgntgnangtggaannnatanagggcaccctgcagcggcccgaatatggacccatgttgccgattagaccagggatcctcaacatgctggtgagtgaagagga

SEQ ID NO: 513064 - DNA, 498 bp, Homo sapiens
  misc_feature (4)..(4): n is a, c, g, or t
  misc_feature (25)..(25): n is a, c, g, or t
  misc_feature (44)..(44): n is a, c, g, or t
  misc_feature (89)..(89): n is a, c, g, or t
cggntcttagatggtttttttggantaggccctcaagacccttntgggggttggtgccttcccaccctctggaagacggtccccactgnattagttaacaaacgacacgttactagcagtcacttgatcttcgtggctttgggttaaaagacacacttgtccacataggtttaaagataaagagttgctgttcaacttgagcatgttactgacagagggggtattggggtttatttttttgtaggaatagatttcacttaaggcggcccttttgaatataaattttttaaaaagcaaaattatagaagtttaaaatttaatcaaatttgaagggtttctaagaaatttttaaaaaattgctggttgctttaactgtttcctacctctgtttttgaggaaattggaacaggccttgaaacaaaacaattgaaattttgaaacttgaaggcttttgtaaaaacggttaaaaaaaattttttttttttttaaaaaaaggaa

SEQ ID NO: 513065 - DNA, 949 bp, Homo sapiens
  misc_feature (41)..(41): n is a, c, g, or t
  misc_feature (123)..(123): n is a, c, g, or t
  misc_feature (135)..(135): n is a, c, g, or t
  misc_feature (156)..(156): n is a, c, g, or t
  misc_feature (231)..(231): n is a, c, g, or t
  misc_feature (292)..(292): n is a, c, g, or t
  misc_feature (336)..(336): n is a, c, g, or t
  misc_feature (381)..(381): n is a, c, g, or t
  misc_feature (390)..(390): n is a, c, g, or t
  misc_feature (402)..(402): n is a, c, g, or t
  misc_feature (489)..(489): n is a, c, g, or t
  misc_feature (509)..(509): n is a, c, g, or t
  misc_feature (650)..(650): n is a, c, g, or t
  misc_feature (671)..(671): n is a, c, g, or t
  misc_feature (705)..(705): n is a, c, g, or t
  misc_feature (723)..(723): n is a, c, g, or t
  misc_feature (754)..(754): n is a, c, g, or t
  misc_feature (763)..(763): n is a, c, g, or t
  misc_feature (806)..(806): n is a, c, g, or t
  misc_feature (843)..(843): n is a, c, g, or t
  misc_feature (922)..(922): n is a, c, g, or t
atattgagcatttacagtgtactaggcaaatagaacttacngataacattgtccctgctcttgtaggtgcttacattctaaaagaaaaaatacaccttttttgaaatggcatttttgtttggngttttctgcaangtactgaggaaatattttgtnaagtgagctttggtgtataacttagccccatcattatttgagagaatgggggaggaagagggaggaaggattttnaaggcagacaatgacagaccattcaggataggtagggttttaaagggggataaacacagtntcatcaactaaggggagatttgctgcagtaaataggatgagggnaatagtctgtgggatgcaagcaaaggaagcagggtgccttagggnctgagtggngccagaaagatnatgcggggtttttcgcgggtacatggcgcaccaagtaggagatggttggtgacaagacagaaggctaaaacaggaaggtaatcttgngcgcctgacagatagggggnataaaggatcaaaattgaaggcaggctataagagtatcaagaaattcttaaaaaccgaggaagtgatttgggagcacaaaacttacagttaatgctacccaatgtcatgatgggcccagaccattgtggcttccgtaagtnagaaaatgccatatgccaaanttttgaatggaacacactacatttttttctagtngatccccccctctcccanaaaaaaaataggaactcatttttttcagggnggggaggangagaggggatcatgggacatggaaacagtagttatattagtantatttttgttatgataaattttgtgtttaaacttggnaagagcccatttagctgccaagagggaatcaggaataactttcaaaaaatgtacaatttcctttagagacgtatcaganccaagactaatttacatgaaaagctgt

SEQ ID NO: 513066 - DNA, 468 bp, Homo sapiens
acttatttacagtaatcctttccagattaaaacaaacacaaaatgaagaaatttggggccgggcgcggtggcacatgcctgtaatcccagcactatgagacgccgagacgggcggatcacgaggtcaggagatcaagaccatcctggctaacacggtgaaaccccgtctccactaaaaatacaaaaaattagccaggagtgttggtgggcgcctgtagtccttgctactctggaggctgaggcaggagaatcgcttgaacgctggaggcagatgttgtagtgagccgacatcacaccattgcactccagcctgggctacagcagcaaaactctatctcaaaaaaaaaaaaaaaagggttggctaaaagtcgatcaacctcctgccgagcactgtaaggagagaagcatggcctgggtcacaatggtgtacacctgggccttgggtggccacacggtatctgagagggg

SEQ ID NO: 513067 - DNA, 1254 bp, Homo sapiens
ggtgacaagtttgtcttgcgcagtgctatactccagctgtggcatgcaggtgtcagcaagtatagatcagcaatgaggcggtggtcaatatcctgtacgagctcatcaccacagcggacaaaggtgcactgcctcaacatggacaaggctctctttcacagcatgggcctctacctcagcaccacaacttcctccaggccatccaaccaccatcgagccggggcagacagagctttgtagcaggtcagagtgtccccatccgtacatccgagttcctgctccagttagacagctgacaccatggacttggaggcctgagggaggcaccgtggaactcatccagggccgggccatggcaaggtgcaactgtgtgagccatgcatgtccccaagccccgaggggtgacccgaagcttcaggattacatcctccacttcctacacagtacccaatacccaaaagcggcaccctcagatgcacggtagccctgacgtcccaagaccgggtctcaagacccaggaagtccaataggacctgatcttcatgcgcttgaacatcatcagcccttgaccatggtctgggttgcaacaaagacaagagggcgcttcgtaccatgcccggccggtgactggggaaagtcaccatatgggtggacattacctcattagggggaccacttggatcacgtgagctggaactcttgagttaccaatcttaaattcagaacaacagacgtttcgccacaggcaaagacgggaagccaccagagggatgcgcacagggcggcatcgagcacacggaaccaacgcaacggggagaaaacaagagaaaagagagccaaaaacaaaaggaatacagagggaaagaaacaccagaaagagcaaaccgccacggaggtaaacaacaaaggaaagggaatgggacaataaagaccccaccggggacacccacacgaggaggacatacggcgcccaaaaagcaccagagaggcacggacccatgaagagcaaaggacgagacatagcatctggagaagaacacaacatggcgcagggtacaaaccaagaacacacaacagggggggaagccaaagactaccacagccacaaggatgagcaacaaccacaaaaaacatgggaaagcgacacatcggacaaatctcaagggagcagataacccacataaccccggaacgaagaacacaaaacagcataagagagaggcgcatgaagcgagcaaagaaggcgagagagac

SEQ ID NO: 513068 - DNA, 623 bp, Homo sapiens
agcccctgagtacctcagaacaggcgctcctgagacctccagcgctgcctggaggagaatcaatgagctccgaggatgccatccggcagagcaaccagatactgcgggatgcgctgctgaggagcttctgcatttccaagccagccagagggaggatgaaggagttcctcagtgtgcaatgttccaggatggccaggaaactggtggagactgactcggcctggagaagctcgatactgaatgaggcaccgaaagtgagcagagctctgacgtggagtgtggagacacctgaatgagatgccagccagcacgatggctgatggacaaagggcactacatgtgaaagcccagtgtgacgtccttgctcgtggtgagcttgcaggagagccagagtcgcttgtgagtgctagccactcaagtgaatgccaaggctctggagggtcagggcccggggacggccagctgagcaaggcgacgggagcaaggagacgtgagcgcggaggcgcatgaagaagagaagaaacagcgtgcaggtggaccaagctgcgcatgcagggacagagcggtggaggacgagccccgatggagcgccaggcgcctcggaggagaagggaacgggccaa

SEQ ID NO: 513069 - DNA, 355 bp, Homo sapiens
cagattttaaaataatatttctacaaaatatataatttaaacagaaaccagactattaccttggaaagcccagctctctccttggcaagcttctgtttctttcttcctgcaagaaatgcaaagttatatttacattttgtcattataaaaatgggaattaaaagaattctaactgctgtggcagtcattaattccatttgcaaaacatttctaactctaggaatctatccctccctgtgatctgtcaagagcatatgacatgttctggtcaatgagctgtaggaaatgtgacactgcactggagcttttctccttccctttggggcagaagatctagcaatttgcaagatggggg

SEQ ID NO: 513070 - DNA, 215 bp, Homo sapiens
attcgcggccgcgtcgactgacttttaaattttgttgttaggtttgactagccttaaaaaaatttattgttggccgtgcacagtggctcacgcctataatcccagcattttgggaggccaaggtgggcagattacatactcaggcgttctaatcttgaccctccaatatggcgaaacctgtctctactaaataatacaaaaactaaccgggtgtg

SEQ ID NO: 513071 - DNA, 240 bp, Homo sapiens
atcccgaaagaggatcatcgtgccacgctaggccaatttgaaatgcgtggctttccagttttgtgtgatgaagtaatccaccgtcagggtgtagggcaccgtttcatttacataggtcatgagcctttagccatggattaaccggcacccccccaattagtaattacccaatttgcgcattgtccaccaagcgcagaagattcgccagctcgttgtccagccgttgatcatcgaggtgcg

SEQ ID NO: 513072 - DNA, 168 bp, Homo sapiens
caaatctatagagatgtgtgtgaaaacagaaggtagtccaccgagattcatatccagattggacagttagtgttgagtcgaaggggatgatgatgaagacccgtatgttgcttaattgcttgagttgttcgaagatgactctgatcctcctcctaagaaacgtgctcc

SEQ ID NO: 513073 - DNA, 825 bp, Homo sapiens
gttataattactatacgtcggccgcttattcgtgaaacacttaggtatcaaaatcgcaagacaagtggtgccaccacgccaccggaattgaaaatttgtcatatcataaaaatcttttccaattcgacaaattttttgcggtccctccaagtacaaatgtgaacactgtgcaagcccgctccccccccttttaaaaaccctgcatttccctacataacaccccgacttcttgctgatcagccacatacccgaagcatccgtatctaaacttatgcactggccccaaaccttgagagggtgatatttgccgcccaattagccactctgcgacccctctttggcaacacgattaccttttctgcacaccccttgctaatatatagctcccaacaagagggtacccccgttcataatacatgaggcactctacctttcggattatcaaccgcctacaatacaaccccggcagttttataagggccaaatccaagactccccttcgcccaatcttgctactccaacaatggcccccagagtttcaccctcccatacccctccacacaagtgtatttgcacctttatgtgcacccctcttaatcttgcccacaaattcttcatatcgttaaaaataacaccccacctctcttcccacccctcctctgtgggctcaataacacccttgggcccccatcatcatctcttgaaatatccatgcccccagaatagaccagtgactgttttacccctcaaagtgagattccaggtattccaaaatttcccctcccttttcccaaaagcccacgtttaaacctcccccacaagaca

SEQ ID NO: 513074 - DNA, 111 bp, Homo sapiens
ttacattggcgaatttgaaatcattgatgaccacagagctgggaaaattgttgtgaacctcacaggcaggctaaacaagtgttgcgcgatcagccccagatttgacgtgca

SEQ ID NO: 513075 - DNA, 405 bp, Homo sapiens
cctagccgaggtgacagagcgagatctgtctcaaaaaaaaaaaaaaaaattcacactataattgggaaatgactacttctcttctgctaatatccaaaacacattccgagcctcacaaaacaacttgtggcagtaaacagcacagttaagaacttacactaagtccaaatattatgttattagctggtacggtatttgggttcatcaaatattgagatgataagccaaaaataacaactttaatgtaacttaacttagtttcaaggaatcaaggggtattatgcacttttaccagaatctttataaaaagctagaaaaaatttatcaataaattaatcaccactgatgtaagtcacctgggtaaatattccacagtgcctcatttcaaatgtttaacacacttaa

SEQ ID NO: 513076 - DNA, 116 bp, Homo sapiens
taaaaaaaggttggaaaaattactttatgaatccattatttctatgaataattaattaaactgtaatcctggattagatacaatttaataatagttcaattccaaaataaaagtta

SEQ ID NO: 513077 - DNA, 126 bp, Homo sapiens
  misc_feature (86)..(86): n is a, c, g, or t
cactctagaggatctcggcggatggggtctgtaggcccagctgggaggtccctcactgggtcagaccccgagacctccatgccagngagaattcaagtctcagccccagaacactggcgggggtgg

SEQ ID NO: 513078 - DNA, 126 bp, Homo sapiens
gatgctattactgttcggatgatgactcaggggtaggcaggcgggggcaaagctggcggcacgtccttgagtgtgtggcgcagctcgcggcgaggttctggatgtacagccgcaggccctcctgca

SEQ ID NO: 513079 - DNA, 1691 bp, Homo sapiens
  misc_feature (403)..(403): n is a, c, g, or t
acacatgctttgtactgatatgtgtcggtcgctgcgccagtttaatcatatcccgctgtggtgtctagatacaacgcaaagtacgatgttttgggcggacaagcttgatagttagtcgtcggctaaggaggggatcctctccaccataggggttgtgtacatccataataacgcctactggcgtttgtggtttataactcgccgcggccgccccagttgtttattagtatccgcggttctctaatagtggtattgccgaagggccccttgtgggggtggtcgacatattttttcgtggccaacccatatcggggcggcacaatataaatgtgtgcgctcattcgcggataatatttgctccccaacgataatgaagagggcgatagattttgttggtgtctcncgttgtgatgtttggcgctcaattgattttctcctgcaacatgtcgggtgatcgcttggtgaaatggaagagtgttgttgcttgtatatcattgcctggggggaactcttctgcctcgcttgaaaaagaaagttgggtcactaatactttccttgggaaaaaatttgtaaggaggtgttgctcggcatgaggtttaatacagcccccagcatgatctccctcgtggtttctcagtgggatattgccttgcctggtagttggcggcttgatggcgccaccgcccgccgtgcacaccacccccacgagaaattggtttttcacttgggtgtgagagaataagggggccccggcctcggatattttctccggggagaatccttgatacttctgtcttcgttatatttttccacaacaaatgaaagcgttgttgcggctttttgtcccacaagaaaaggggcgcacattgttatagacagcccttttaaattggcctcgaaaaaaataaggtggggcccaacacctataaagagggtgtctctttggtgccccccagttgcccccccagcgcgcaggaagttcttctggcgcggtgtgcccccaaaactctctctttaggaagagcgcgtctgtcctctgttgtcgccgggaagaggcccttctgcttataaaggtgtgttgtgctatgtcacgagtgtttctcatatcacatatggggagaaaagttgtgggcgcccacatagagcgtgcgcagagagtttgttgtgggttcttgtggatatactatctctgtagagcacacagaagaggcgtttaatactccatgtaagatttttgtggtatggcctctgtgatggatctccaccacccgtgtagaaccccctgttttatacattactttaccgtgtgtaccacatgcgtgttgcgcgccacacagatgttttgtctctcagacacacagagggtgttgcttgtggcgcatctcaagagtgtatagatatctcatgtcgtgcccctggggacacccacacatgggttaagaatttggcccttaagtatagcccctgccctgtacccacagtgggaccattttggtaacaccctaagaatgtagaattcttgccccacccacacccccatttccagaaccagaaagaggtgggaagacccagaaccccctgcccatagcccccacccgtccccccagcataaccgggtttccttgccagctgtattttggaatttggatgttgctcttcttaagaccctttaataaaatgtttggtaccaa

SEQ ID NO: 513080 - DNA, 132 bp, Homo sapiens
atctagaggactccccgaaacatctcgaggctttatacatgtataaaatcagtacaatcactatcttccctttgtacatattatttggcatgtatagacataactatcactcaatcagtttgcatctattct

SEQ ID NO: 513081 - DNA, 932 bp, Homo sapiens
tcgccgttactccgacggacgactaccacgtcggtacgacggacgaccgtcgacggttacgacgggacactgggacggcactttgctgtctgcaactcgacacgttgacgggtgcacaacacatgcgtgacgtacctacaacaaccttttaactatggcgcaagcaaaaccatactccaagaaagcatcatcaacatcaccaccagcagcagcaccaccagcagcaacagcagcagccgacaccaccgcaatagctgcaaatgggcaacaggccagcagccacaactgcaaggcttgcactcatggcactgcacagcacattttcagcaaaacccaggcagcagcaagcaccttcaccccaacgacagccgtctttatggtagggcaacatcttccctccccgcacgatccactgcaggcacagcacaatgcaggcaacactcatttgcagcacaaatcatggcacacaggccaggcgccacagtctgtcccatcaacgatcacaggcatccacaggcataacgcgatatactatcccgacaaagagaacaaagcgacgaaaaccctcagacggacagaataagcaccaacaaaagatagagacggcaataggcggaccgcaaacacaacctagccacgaccaaccccacggaagggcacagaaggcacagagcaaccccagaaagctagcccgaccaccagtgatcgccacccatagcccccacgtgaccgccggcacaaactacccaccctatacaccacagaatacaccagaaccaacacacgccatgccaccataccacgtactagaatgggctagaaacacccaacccagacaaccgctggacaatgcagacaaggcaacaggcaccgagcaacgagccgcggaagggacaaacgagacacaccacagggaaaccgaaaagcaggcc

SEQ ID NO: 513082 - DNA, 1017 bp, Homo sapiens
catggtggctcacgcctgtaatcccagcactttgggaggccaaggcgggaggatcacttgaggcaggagtgcgagaccagtgctgtcaatgtagtaaatcctatctctcccatgtaaaaaaatccattgcaccaggcgatggtaggggaggggaccatgggtggctccacgcgcatatctgggaggagcgtgtggtaccaaagagcagttcagtcaggagagcgtggtgaggcagttgttccagcttgcagtgaggaggatgggtgcttccccatgcatgtccaggctgggtgcgagagttatgaccctgtgtctaaagaagactcggcgggtgccctgataagcgaggattgtaagacgtcatgcgttggtcttgcagggactttggggagggcaagtgcaggaggatctccctagaggggacaggagttctgagaaacaggcctggggcaaggggaggagcaagaaccgtattctctccctctggagtagaggacaaaatcgtcagcctatgatattccacacgatctattggggccgagctgcggcacttagataggcatagtaaacaactgcaggggctacaggagagccgcctagactggaggagcttggacacagactctgatgcccaagggatcccctgggtcgaacgtggatgggggcgtttacatctggcgcacaataaagaatcgggcgtggcgaagcgggtgttgtgaggcacaccgcaagttgtcgcttggggacctcggaagccttcaagagggccggcagggactatcaaataccggcgggggctacacatgagcgagtccctacgcgccgcggtgcgcccgacactttcgagacgcagacgccagtctgacagctgacacgacaccctattaagaggcagttgactagacttaagcaacaatccggcgcaggaacggtacaacgggacaggacacataccgtcacgggcaactatcaatctggtgccacggacaaacgtgatacgacatcacctacaagatg

SEQ ID NO: 513083 - DNA, 563 bp, Homo sapiens
agcggagatctgcctctcgctgtgtttctccccgaggggtgcttgtggccctcgaggatctccctccctccctcgctgccctcccccctcctcccccgcctgtggcacgggcagcgaggcccgaggacgtagcgacacgacgctgcaggacggcgaacagcgagaggacgcgcgctgatgcgcggtgagcccacgaacccaggaagcgaccggaggatagagccacgagtgcacacaccaaacgggagaccgatcaacgccacaatacggtgaagcacgcgcggtaggcgctcagggacacgatggaggtaccagacgggaagccagggccaggacacaaagagcccagtagaccacgagggaagggatcgcgtggagagatcatgcagaggggagcataagggcacgaaagcagtagcagtccacaagcgagaaaagcccgcaagaagggaagtgcgccaagcacaaggagagaaagggcaggaacggtacagccgaacgagatcggacgacagggggcagcggaacggtaagaaatgagacagggatcacgagggaaacgg

SEQ ID NO: 513084 - DNA, 318 bp, Homo sapiens
  misc_feature (26)..(26): n is a, c, g, or t
aaattcgcggccgcgtcgacctgaanattcgaatctagcgacaacgatgaattacatagaggcggactacgaccatatgcgtgctgttctacatgagcggagtcgggctcagggcgctctgagccgagtgacacgggttgatccaagtggcaaaccctctgcccccttacccgacaaaataggtgtgcattcacaggaaaccgttcaaccagagcccaagaagctgccagctgcacaacaatctagcagcacagaggtcagtattgatcggtggaccaagtcgactgaccgaagcgcgctacagaaggctctcgagct

SEQ ID NO: 513085 - DNA, 761 bp, Homo sapiens
tctggagaatatctgtcactcctctaatctagagaagtgaccgttattcagaagatgactacggacctatttgtagatatgttcacgacggacaattgtgagcagcaactttgaattaaacatcttccagtgtgaggacagttgagaaacgtacatcaggcgaagtctgctgtctactgtcaccatcgtttatgtctccccatagtcccccaggagctctttcctttcccctctagtttggggtgtgcatgttggagttgtagtgggtggttgtaacactggagccattctgccttgtatgggttgtacacgaaagcctcattcttttctgtgaccctttcggtttgcatacaccctccttcccacctacctgtcctggggctgttgagcagcataataatcccgggagaatgattcccctcatagaaagacaaaagctccatcccctcatagttaagtacgccacgtggtgtcctgggaatttctggttggatttggtgccctgaacttttttattaagaaatcagatcccagggtgagagtaacaaggccaattgtggcaagaaagaaacctgttgtgttttctttgtgagctatgaaaaagaccctgtttggtgaactatattttagaacggagaggacggtggtctggagaaagttgggtctggttttctggcacaaaaatgtgatagttgcggaggaacactttgtatggttggagttcagaaagctgatctcaagttgggggctagtcaaaaatg

SEQ ID NO: 513086 - DNA, 184 bp, Homo sapiens
  misc_feature (62)..(62): n is a, c, g, or t
  misc_feature (65)..(65): n is a, c, g, or t
  misc_feature (68)..(69): n is a, c, g, or t
  misc_feature (73)..(73): n is a, c, g, or t
  misc_feature (112)..(112): n is a, c, g, or t
tcgtagctcttctgtcccttgatgaggagatgcctctcatggtctcagagtgtcccagtggnacnggnnccantacctcttgggttcttagctagagactgcatccctggcncaagccaggctctgtatcttgctctgcttctctccttgctctagccttcctggctgcctcgagacaactccc

SEQ ID NO: 513087 - DNA, 672 bp, Homo sapiens
  misc_feature (271)..(272): n is a, c, g, or t
  misc_feature (293)..(293): n is a, c, g, or t
  misc_feature (311)..(311): n is a, c, g, or t
  misc_feature (348)..(348): n is a, c, g, or t
atctgtctatatactactatcaatttgctcggattctgacgcagtcgggggggaacgttactagggcttacttccatagtgatcgcaatacagatacacattctcttactgaataagtatagactcattagactgttcatcaccagccgggcaaagccacagtcaaaaaggcatggggctgaaagggagagtaaaattttgctcaatttcttggtacttaggataaaaggtcctgttttaaaccatggctcatctcttcctcaagatgttnnacagatattgaagctacatgnggctggaggctaaatagntaagctcaaactcagaaaaattgaattgaagggtttnaggtctgaggagacacacatctaccaagatcacaatcagaagatcagcgatatagcagagttgggctgaatctatcgaaaactacaatccagttcctgaccacgctcaattactgaatcagatgtaaatgaccagaccagccactgtggcttattgcctgtaatccccggcactttgggaggccgaaacaggcagattgcttgagtctcaggagattgacacccagcgttgggcgacgcatggcaagagccgtgtctcacacgtagataatacaagcaaagctaggccaggtcagtgtagtgcagtgcgctgtagtcggccagt

SEQ ID NO: 513088 - DNA, 104 bp, Homo sapiens
ctctggaggatgaacatagtggatgcctcacattttcagcatttctgtacagtctcactggctcttcataatgtgtctgtagaacagatgctctatttcacaga

SEQ ID NO: 513089 - DNA, 117 bp, Homo sapiens
ggctcggaccctcgtggtgattgttacagcagccagaggaactagatagactcatcctaaaacccacgctgcacaccatgtttgttctctttagccccgtgagtctcacggaaagcg

SEQ ID NO: 513090 - DNA, 371 bp, Homo sapiens
ttttttgtagtttagaaaaattgtttgaattttagaaagctgttattttcatgagttattttcattttgaaaaacttagaggctggaagtggtgctcgtgcctgtagtcccagtacttggggaggccgagacgggtggatcacttgagcccaggagtacaggaccagcttggggaacagacgaaactctgtctctacaaaaaataaaaaagttggccggacatggtggtgtgtgcctgtagtcctagctgtttagggggttgaggtgagaggattgcttgagcctgggaggttgaggctgcaatgagccatgatcacgccactgtacttcagcctgggtgacagagtgacaccttgtctcaaaaaaaaaaa

SEQ ID NO: 513091 - DNA, 408 bp, Homo sapiens
gtagaggataaaccgacgccgaggaacctaagctgcgagcttactatcatgtcagatgtatgtatgaagaaaggagactagtgagagggggtatttatcgcaactgctgcattaattgcctaggacctcaacagcttcatgaaagtctggggaatgttcatgcataaggttattgccttagctgacttaaaattgccccatacaatggtacatatcaacccttagtgaagccttttaaaaaaacaaacaggttgaaaaatgggttaaagtaggcaaatacagcatatctgcctttagagctatcaactcaggaattctctcaattatgaaatcttgcagagaagttatatttctttctcaaaatccaggtgatgacaatattccttactccagatctggcatttgggt

SEQ ID NO: 513092 - DNA, 176 bp, Homo sapiens
cgctgcctcaaagctcctgagtagctgggattataggtgctctccaccactcctggctatttttgtattttttttagtagagttggggttttaccatagttgcccagtgctggtctcaaactcctgtatgtcacgtgatctagcctacctcccaaagtgttgggaactgaaatgag

SEQ ID NO: 513093 - DNA, 377 bp, Homo sapiens
ggagcctgctatcgctgtgcagcggttcatcatggagagtggtgccaaaggctgcgaggttgtttctgtctgggaaactcctagacacagagggctaaatccatgaagttagtggatagcctgatgatccacagtcgcataccctgttaactactacgttgacactgctgtgcgccacgatgttcgctcatgaccgggctgtgctgggtcatcaaggtgaagaatcatgctgccctggtgacccaacctggtaagaattggccctaagtaagccccatgactgaccacgtgacgcattgtcgaaacccaaaagatgagatacttagcccatccacccccgatctcagcaacaggacattggtgggaaacccagaact

SEQ ID NO: 513094 - DNA, 104 bp, Homo sapiens
gtcctcttctataggacataagagggaccaaagcatgaatcggaaggtgatgcagttcatgggaaagaaggtggatgaaacagtgctagataaaattgtccggg

SEQ ID NO: 513095 - DNA, 647 bp, Homo sapiens
gcacgagtgcatactggtagggacactaatatacatggatgatgaggcaattgacatggcactaggcatacaattaagggttataaataaccagttacacttaacctctaaattataaaaattaaagaaataactcatcctcttaaagatactaaaacagaatagaaaagtaatatatccataaaactaaacataactttatcccatttctaaaaacctcttccttactatatcataccagaccaccctaacctctaaacccctaaaactactacttcttaaccccagtaatccactaccacacatctaaccctctccaccccatactaaccaactacttttccctaaaccaaaaacctcttacaatcccttcttactcacacacaaaatggacccactattctagatactaccctattttacaatgatgaaacttagacactagcaaatttaatacactaactcatattcctacagcctataaaccctaatacttagaacttacaccttcaccccaatacacccactctacttttactatacacactatttaacagactagttatatctgtacccacaaatagacttggatacccactttaaattgtctttccctttaaaatcggtccttccttttcccctttgtg

SEQ ID NO: 513096 - DNA, 245 bp, Homo sapiens
gccgaattgtttgcaccaaccaaaacctggcgccgttggatcgtagagtgaccacacccaaaaaccgttacgccatctgttctgccctggctgcctaagccttaccagactctggtaatgtttaaagggtacatcgtatttgggaaggttcctgaaacctccctttggatagtttaaggataaagttaaggttacaggaggcccaggaaggctgtttttgctcctaaagaatctaaagcctggat

SEQ ID NO: 513097 - DNA, 347 bp, Homo sapiens
accgaatgatagtcgggatctgtctagtatatacgaggacccgctatggaggcctccctccgcgaaaatggtgaagaatatgaaaatcagccggcacgccaagtacacttggctctttctgtggctaagccgatgatgagtagacggagctgtggggaactggcactgtggttcctggcactgaacgacagtggctggcggtgccgggacgtacaataccacttccgctggtcacggttagagtccgtgcatcataagactgaaggagttgaaagaccagtagacgctcctctactctttgagacatcactggcctataataaatgggttaatttatgtatcaaaaa

SEQ ID NO: 513098 - DNA, 207 bp, Homo sapiens
  misc_feature (63)..(63): n is a, c, g, or t
  misc_feature (132)..(132): n is a, c, g, or t
  misc_feature (162)..(162): n is a, c, g, or t
  misc_feature (171)..(171): n is a, c, g, or t
ggaagcaaaaaaacaaaactaagctcgaatttgcttccaaacctgtagattgcatctaaccangtgtccctatgcacctcagagtactggaatacgaacccagcgagaccttgtcccctcccattttgctgnacttttgttggtgaaaatgagaatgagttnatccctacntacttagtttaatgcatttgaccccagaaaacccca

SEQ ID NO: 513099 - DNA, 141 bp, Homo sapiens
ccccaaaaaactgtcagcagctgcctgcttttttgtgatgtatgtatcctgttgacttttccagaaattttttaaaagtttgagttactattgaatttaatcagactttttgattaaagggttttctttcttttttaacca

SEQ ID NO: 513100 - DNA, 213 bp, Homo sapiens
gatggacgtattatatatatacatatatacataatatacataaatattcataaatctatatacacataatatataaatatatatatcataactatgtatattcatatcataaaatatgtacacaaaatctatacactaaatataaatatatatacataaatataaatatatatacacacctcaatgaaaggtattaccctgggtagtcacaga

SEQ ID NO: 513101 - DNA, 259 bp, Homo sapiens
  misc_feature (119)..(119): n is a, c, g, or t
  misc_feature (158)..(158): n is a, c, g, or t
ctagaggatccctttacgcaggataggttggtctatactttctataagtcttagtagattaacatgcagatcccattcagtgagttcacctctaaatcacacgatcaaaagggacaagnatcaagcacgcagaatgcagtcaaaacgcttaggctagncaaaaccccacgggaaacagcagtgattaacctttagcaataaacggaaagtttaactaaagctatactaaccccagggtttggtcaaatttcgtggccag

SEQ ID NO: 513102 - DNA, 482 bp, Homo sapiens
cgatctagaggatctcatgcgcgacgcttccatcaaagttacaaagaggagctggtaccattccttctgaaactattccaaataatagaaaaagagggactcctccctagtccattttatgaggccagcatcatcctgatactaaaacctggcagagacacaacaaaaaaagaaaatttcaggccaatatccctgatgaacattgatgcgaaaatcctcaataaaatactggcaaactgaatccagcagcacattaaaaagcttatccaccacaatcaagttggcttcatccctgggatgcaaagcaggttcggtgtatacaaatcaataaacgtaatccatcgcataaacagaaccaatgacaaaaaccacatgattatctcaatagatgcagaaaaggccttcaataaaattcaacaccctttcatgctaaaaacactcaataagctaggtattgatggaagcgtcgcgcatgggtaccg

SEQ ID NO: 513103 - DNA, 180 bp, Homo sapiens
atgaacctggcacatggttgtcccaggaaggtaaaatatgccagctattgcaggcaacccatacctcagctataataacagactagcgcgcgggggcagcaggccccaacgcgcggtccgagagcgcagagggccccctttgggtatagggtagttggggggggcacctccccggtcttg

SEQ ID NO: 513104 - DNA, 130 bp, Homo sapiens
  misc_feature (99)..(99): n is a, c, g, or t
acaagcgtgtgctcaccctccgcaagtcttgctggtgcaaccaaaagcggcgagctctggagaagattgacttaagttcattgacaccacctccaagtntggccatggccgcttccatgaaccatggagg

SEQ ID NO: 513105 - DNA, 439 bp, Homo sapiens
cacgaggacgcgagacgaactcaatttcttcccgctgatctattggccgatcgtgccgggtgctcaaaaaccatccccggaagcgctggcccgcatcgatgcttacatgaagcagggtggcacggtgcttttcgacactcgcgatgcgatcatggcgccgcccggacctggtggtgaggctcgcagtcctggcatgctggcgctgcgcgaaatcctttcctcgctcgatattccagagcttgagccggtgtcgaaggatcacgtcctgaccaagaccttcttcctgctgcgtgacttcccgggccgcttcaataccggccagctctgggttgaagccctgccgacgcaggacgacctcgatggcgagaccgagaacaagcggccggcccgcgccggcgatggcgtatcgtcgatcctgatcacatccaacgatctcgca

SEQ ID NO: 513106 - DNA, 817 bp, Homo sapiens
tgcctgatgtgaattcttagttctccacttcctgcttgtccaaacttggttacttaacccgtctgtgtcttcttagcttccttatctacaaaatgaagataataatagaatcaaattcataggttgtgaagattgaataagttaatatgttagtacatgtagaatgtattgttataagtaccagcttataaataccagcttctgttattgataagtagaaagatgaatggaaaacaaaaatacgtataatcaataggccaacagctagtttttgaaaagaccaatatgatacagaaaactcaggacacaggagtaataaacaatcaatatgctaaaaatgaaacagagatataacaactagtgattttcggggaacactggccccggtctcttctcaccctgaccaccactatacattactcttcaccgaagaatcacagaggaacttgaatgaccatgacacaatttgagttcataactaacaaaagagatatgggccagcgctgtggtccatgcctgtaatccgagcactctgagaggccagtagggagatcgccgaggacaggagttcgagactagccgggcacacaggcgagaacctgtcactaataccacttcaacagcacagctggccatgtggcgtatgcctgtagccccgctactggcaggcgaagcgaggcctgcgccaggctcaagcgctcaaagggcatggaccccccacgcctcaacatggcgcccagcgcggcacccctcacacacaaaaacaacccacaacacgccgcgcccgccccaaaaccacacccccaccggcacacaa

SEQ ID NO: 513107 - DNA, 274 bp, Homo sapiens
agtaggagatagtggtgttgcagccgtcctcaccattatcacatcaggatgttgtcttgctgtacctcggactgctgggaataaggttctttcaattatgctcaagaatcagagctctcaggctctaagggtgtatgagaccactggggctaccatagcaaagtgccatagcctgagtggcttaaacaagagtgatttattgtctcacagctctggatgctaaaagcctgaaagcaaggtgtctgcatggttggttccttctcagggctgtgag

SEQ ID NO: 513108 - DNA, 194 bp, Homo sapiens
tctggtaaaagaaaagttctcactaatgtggctcaggcgggtctcaaactccgggggctaagctatcctcccaccttggcctcccaaagtgtgggaattacaggcctggcctgtaagctttccccacgtgtgttcacttttatttaaaaaaagtgctcccctctctcccagtcttaaatctcttttccacccct

SEQ ID NO: 513109 - DNA, 235 bp, Homo sapiens
  misc_feature (11)..(11): n is a, c, g, or t
  misc_feature (137)..(137): n is a, c, g, or t
  misc_feature (146)..(146): n is a, c, g, or t
  misc_feature (170)..(170): n is a, c, g, or t
  misc_feature (172)..(172): n is a, c, g, or t
caccgtccggnagttggcgtcctttctccctctccgagtgctgctcctgtcattgtggccatggacgataccctgttccagttgaagttcacggcgaagagctggagaagctggccaagaaggcggagaaggactcnaaggcgganaggccaaagtgaagaaggcccttntncagaaaaatgtagagtgtgcccgtgtgtatgccgagaacgccatccgcaagaagaacgaaggt

SEQ ID NO: 513110 - DNA, 360 bp, Homo sapiens
tttaagggggaaaaaacccccgttttttaagtttttaaaaaaaaccccaaaaagggggttttcgggtttaaaaaagtccttgtttttttcccttttaaagggccgggggggggaaatttttttaaaaacccctgggggaatttattctttttttataaaaaaaaggcctttttttgctttttggccaaagttggggataaaaggaaaaaaagttgtccaaatgtaattttccgtcccattcccccggaaaacaaggttttgaattggcccgtaaaaggggggaatgactactggaaggtaagtcaaaggggttttcccccccgtttttttttttttaaaaaaaagtttcttcccatggga

SEQ ID NO: 513111 - DNA, 299 bp, Homo sapiens
  misc_feature (25)..(25): n is a, c, g, or t
  misc_feature (68)..(69): n is a, c, g, or t
  misc_feature (72)..(74): n is a, c, g, or t
  misc_feature (80)..(80): n is a, c, g, or t
  misc_feature (86)..(87): n is a, c, g, or t
gctagagtgcacttgtggtacgtgnttcctcgtaaccacaagtgaaggtttattactgaagattgacnnttnnngcctanaaaagnnaaaaatgaagaaagtgaaaaagaagatgcctaaatgtggtgaattgtgaaattactttcagtggtttaagaagcaatggagaaaatgataatacagcataatttttacatttgatatcttgttattgatcatacttttttttgaactttagcattgaaaaatcgtacagtcatttcattatttttaaaataaaattttctctttgtctgaaa

SEQ ID NO: 513112 - DNA, 266 bp, Homo sapiens
ccacttatgcggggaggcggatgaagtctgggccaggaacaatggtaattgtgggacttaacaaagagtgagtacagctgaaggagccaggagcagaaagtatatgcatcaggtatgaggaagaaaatagattttggaagttatgagaaatgtagagagtaagtggagcatcgttcgtgattttgaggaccgtctaaaagtattagggcggcagcgggagctgcagggagtatgcgaatgctatgaagcccagggcatagggtggg

SEQ ID NO: 513113 - DNA, 343 bp, Homo sapiens
gcgtcgacccggatatatatatgtatatatgttaagcataacataagaaagaaatttcattagctgggcatgatggctcactcctgtaatcccagaaccttgggaggctgaggtgggtggattgcctgaggtcgggagtttgagaccggcctggccaacgtggtgaaacctcgtctctactaagaatacaaaaaattaggtgggcgtggtggcaggcacctgtaatcccagctgctagggaggctgaggcaggagaacggcttgaacctgggagtcagaggttgacgtgagccgagatcacaccattgcactccagcctggtgacagagtgagactctgtctg

SEQ ID NO: 513114 - DNA, 896 bp, Homo sapiens
cccacgcgtcgtgatttcctgccagaacacggagcctccagaacatgctgaggaacaggactgacaccactgcctctgactggtgccatggaacccctggagtctaccactgtggaagcctgactgcaaggcgatgctactggtctggaatgcagagagagggcggtccagcgagagctgaccacgagagctggcgctagacagtggcggaagcctgtccacggaattctacgctaccctatgcgtcgtatatcgagcaccaactcaagcgcatgctagcgcacgggatgcgctacacgaccactcaaccagtgcccacgggaggctcagaccactccactggcaagtgcacaagagtgctccagacgaagcgtcgacgtgactggcccgacggaggcacagcaccactccaatggtaaccacaagaagcgcggaccactccaccagcaaccacggaagcacagaccatctcctgagccacaggtcgctgcgaaggcagagaccactgcagccatcaagccatggaggcccagaccactgcactctagaagccagtggaagcacatgagccacttccacgcagcagtccagtggaggctcagaccatgtcaaatccacagccatggaggcacagacccactgcatcatgaaagcctacagtgggggccacaagagcactcaaacccccagatgacgacggactgcacctgaccaactccacttggcaaaggcactgggaagggccctagtaccacgagacaacccatgtgtcgaaaaagtgcccttgtacatggaaacctactaccaaaaataaggtctagaaccaccctggggggcaaaaggacgggccattggagcgacctccgttcctcccctccacgcggaataaagtccat

SEQ ID NO: 513115 - DNA, 1321 bp, Homo sapiens
  misc_feature (280)..(280): n is a, c, g, or t
ggaaaaatcagtgaccaagtgcgacatgcgagagaaaacgatagcgaaacgtatagagagaccaccggacacttatgaagaaactgcatcgaatctaacaggccaaagataaccaaggtagcatcataatgacagtgatcgagattaacacgaatagatgagatattaaccttaaatgctatgtgggcatataatgccagaattcaaaaaggatacatgactggtcaatataggataatagtcaacacatccaatcgataggtgcctggtcattcaaggntagcatcctagtcatcaacagttgacagaacagtactgactagattgaggacatcagcaaaatcataaggagcatgcgtgtgaagatattgttacgcaaagtcaaatatggacacacagagagataggacatacatgaagcctagggtgcattgacaggatgcacgtacgtgtgctgctgcataaagaaacagaatctttacacataccaaccatacatgcactacaccaaaaatggcagcaataggaaaagggggtcatttaccagtagacgtgtgtgtacccagggcagtgaaattggccaatatacggcagtagacgtatatctacttcctatcagtaatatttatgcaacctctaaataaacaaggtatgtctacaccatgaattcaatataatagccaaagattctttaaagatggaaccctacgagccgtaggaacttagcgatcttcttctcacacattaaatatattggcgatgacttgtgagaccacttccaaattgtacaattacttaggaccaggggacatattgacgtacatggataatcgcgaagaggaatttaccttgggtacattgcaagctggaaaaaacttacttattggtttttatttaacgtggaggaagggccaaaaggaattaagtttgttataaaaaaacaattgtattatgtggggagccaggggggacccacaatgagggtgataaggaacaaggggagtgcacaaaaagggggacaccgagaagagagacatgtggggggaagagaaaagagcgaagagggttcttcaccaagaaaaaaagacccggggggggaaaccaagaagggtttcgtgggaaaaaccacgaaggagactgagggagaaccacggggggaatctcaacaacgagggaaccaggaggagcgtgcaattaaaactcgcccggggagggggagaagagagaaggggggagcaagacacggacgaaacagagagcagagagagtcgaaaggagaggggagcaaagaaagcgaggaaccacggagacaacaacaaca

SEQ ID NO: 513116 - DNA, 293 bp, Homo sapiens
tgaatgtgattgcagatttgcaaaatttgcagagttgcaaaagcccttttgtacctcatctcttggacaatttaggtggagagaaacatatcattggcagtatgaaaatattgttaccaaggtaacgagagaggggtgtccaaacgttttggaacgctgatttacatattgggtttttgccctgtgaatatttcctctactctttcattttattcttccccctcccaagagtaatttaaattatctgctgaaatggaattgcatatgttttgaggccaataaatttttcagca

SEQ ID NO: 513117 - DNA, 555 bp, Homo sapiens
  misc_feature (332)..(332): n is a, c, g, or t
atgaggctgagacctactgggccacattcccagactgttaaggcattctaagtcacaggatgagaggaggtcggcacaagatcaggcaataaagaccttgctgatgaaacagactgcagtaaagaagccggctaaagcccactaaaaccaagatggccacgagagtgacctctggtcatcttcactgctacactcccaccagcaccacgacagtttacaaatgccatggcaacgtcaggaagttaccctatatggtctaaaaggggaggcatgaataatccaccccttgtttagcatatcaccaagacataactataaaaataggcatcacngagcctcagggctggtctgtctatggagtagccattctttcattcctctactttctcattcaacttgatttcactttactattgactcaccctgaattctttcttccgtgagatccaagaatcctctcttggagtctggatcgggacccttttcctgtaacactgagggtctttctgatagataccttcccgtagttatggaggaatggtggtgaatacatgg

SEQ ID NO: 513118 - DNA, 216 bp, Homo sapiens
aagatgcttacctaccacggcgtactccaccagaaaaccatcgcgaactcctgcgagcagcttgtgacttacaaaccttgttgagaagctgcttacatggacttctgtccttgtaaaagcttccccttggatagtggccctctgtagtatgcctggagatccattccaatgcactcactatcgcccaggatagcaccatacgcccagtgtacggca

SEQ ID NO: 513119 - DNA, 82 bp, Homo sapiens
  misc_feature (27)..(27): n is a, c, g, or t
  misc_feature (45)..(45): n is a, c, g, or t
gatcatgtaggggtccatttaaaaatnaccctaaaacttaatggnttaaaataacaaatatgtatgacacaatttatagaag

SEQ ID NO: 513120 - DNA, 251 bp, Homo sapiens
tctgactgatggacttacgagccagagacagacgaaaacgaggccctaagtggtaggcttcagggctggtgcccaggaagaaaaaccgagcgtagaaagacctgtggagtaggctcagagaatgtcctgaaagattggggagaatcacaccaggaaaagccttgcacaaggtgatggtacggtaaggaccacttaaagaagttcaggccacgaaaggaaaaacgaattcaaattattaaacctttggtgag

SEQ ID NO: 513121 - DNA, 440 bp, Homo sapiens
  misc_feature (16)..(16): n is a, c, g, or t
  misc_feature (29)..(29): n is a, c, g, or t
  misc_feature (39)..(39): n is a, c, g, or t
  misc_feature (45)..(45): n is a, c, g, or t
  misc_feature (57)..(57): n is a, c, g, or t
  misc_feature (61)..(61): n is a, c, g, or t
  misc_feature (84)..(84): n is a, c, g, or t
  misc_feature (88)..(88): n is a, c, g, or t
  misc_feature (114)..(114): n is a, c, g, or t
  misc_feature (162)..(162): n is a, c, g, or t
  misc_feature (407)..(407): n is a, c, g, or t
  misc_feature (423)..(423): n is a, c, g, or t
  misc_feature (434)..(434): n is a, c, g, or t
gggttttaccaacttnttgtgtttgcagnaaacatattnctgttncaaaacttttgnaagnccctttacggtgtctagtactgncagnatgtttttgtatgtgtgcacctctgnaccatgtgtgtacatatgtgtcttgctggaaagggacatattcgctgntccccgtgctgctgggagggccgcctcacaggcctcacggttcccaggccccaggcacagtggagggcagggcgtggctgcattcccctcacggctaccctcccaggcgggcttgtagccctcactgggccagacctccagggtgcggaatcaaataggaagcatgcagagactcggcagcttttcctctgatgtgtaagttatttggaacgcgtgctgtgtcccgcgatgtccctgatgtactntgcaggcgcggtgctncgtcttgtcgncagctg

SEQ ID NO: 513122 - DNA, 232 bp, Homo sapiens
ggagctcggtaccgagcgtgacttgggactatcactgtcccgacactctggctgtccaagggcccctgtgagctgggtgcagtcatgggaagaggtacgggatgcagtctagggagctggattccctgatccgagaccaagtggcatgtgtgtccctttttttgcctgctccagggagctatgaagtagatcaaataatatggtgcgtggtcaagtggctttccaaaggtca

SEQ ID NO: 513123 - DNA, 930 bp, Homo sapiens
  misc_feature (337)..(337): n is a, c, g, or t
  misc_feature (376)..(376): n is a, c, g, or t
  misc_feature (877)..(877): n is a, c, g, or t
gactccaagtgccagttccttcctggtgttcagccactgtgttaatcctctgcgagggcctgctacctgcttctctgctgttgtgaaatgggttgaattcttgatttgattcttggttgaagtctgcatagccaaagcaagataagcaaaaagaacaaatctggaggtatcacattacccaacttcaaactactacaaggctgtagctactgaaacaggatggcaaaggcataaaaacagacatgtggaccaatggaacagaatccagattccagaaataaagccaaatacttatgccaactgatctttgacaaagcaaacaaaaacataaagtggngaaaggacaccctattcaaccagtggtgctgggataatngacaagtcacttgtagtacaatggtactgaatccacatctctcgattataaaaaagaatctacttaagatggatgaaaaaattaaacctaagacctgaaacaataaaaattctaggacagaacatcagaaagtctcttctagacattggcttaacaaggacttcatgagcaagaacccaaaaggaagtgcaacaaaaacaaagataaatagatgtgacttaattaaactaaaaagcttctgcacagcaaaagaaataatcagctgaataaacagacaactcacagaatgggagaaaatattcacaaactatgtacctgacaaaggactaatattcagaatctacgaaaattcaaacagacgagagaaaaacaaataatatcatcaaaaattaggctaagatcatgaattgacaattctcaaaagaaaatatacaaatggacaacaaacataaaaaaaatgctcaacatcactaattatcatggaaatgcaaatcaaaaccncaatgcaatactactgtcctcctgtaagaatggacatcattaaaaaaaaaaaa

SEQ ID NO: 513124 - DNA, 129 bp, Homo sapiens
gaaggaggttagcagctacagagtgccataggcccagcaccatcaggaaccttgctgtggtagcgcctgagatgcaggttaaagtgctccagtccctgggcctgaaatcaaccctcttcacctggccat

SEQ ID NO: 513125 - DNA, 631 bp, Homo sapiens
ctcggaggaggcccacaggggcaacattctcttcggtcgtcccggatccgggttatccgacccccgcgcgcctccaccatccgccgaagtcgacccccacgagatccaagtcgtatacctgagggcacccggaggtgaaatcggggccaattctgcctggccccccagatcggccccccgggtctgtctcccaaaaaagttggtgatgaccatgcccaggccacgggtgactggaagggcctgaggattaccagtgagaactgacccttcagacagacaggccccagattgaggtggtgccttctgcctctgccctgatcatccaagccctcaagggacccacccagagaccagaaagaaaccagaaaaaccattaaacaccagtggggataatcacttttgatgagattgtcaaccattgctcgacagatgcggcaccgatccttagcccgaggaactctttgggacaccttaaagaagatcctgggggctgccccgatcagatgggctgtaatgttgatggcccccatcctcatgacattatcgatgacatcaacagatggtgctttgggaagccccagacccagtttagccccaagggaaacatttccaataaaggatcatttgacca

SEQ ID NO: 513126 - DNA, 691 bp, Homo sapiens
gagcggcgcggccagcgtcacggcggcggcggcggcggctcctccttggacccccggagctccccgcgccgcggagcagctggcccctaggcccctagagccccgagagctccgagagctccgctcggcgtcccgcagcgcctccctgccgctcccgccccgggctggcgatgctgcgccgacccgcgtcccgcgctggtcccctggccgcccggactgctgctcagccgaggctgcttgtgcgggcggcggggtctgggccgcgccgaggaatgcacggtgcaaaagtggtgtgcacaggagcctgactgcagagcatagaacgagtgacatcatacaggattgggtgctgacccacgaagaggacagaccatcagtacaacaagcacaagccctggctggagcccacctaccacggcatagtcacagagaacgacaacaccgtgctcctcgaacccccactgatcgcgctggataacagatgcgcctctgcgatttagcaggtgagattagcggatccaacattcacgggcagaatgtccacttgatgcagtggtagtggataaatccactggtgacgcggagtcattcgttccaacagagaacctggactgtgagctgcagaacagactatccattcaaccatccaggcctaatgactgtgggaagggacctgatggcaccaacgcga

SEQ ID NO: 513127 - DNA, 294 bp, Homo sapiens
tagagatcccccacaaatgttaacctcagcgatatacggagaataggacaacgtaaccaaagaaatctctgtcagcagctccaacaccatctggttaatgctaacgtagtcagtagacatacctcgcacggatacaataagatcccggccgacgaccacaatctcattggagtcacagcagagctcgtggatactctataggccaaagtccgcggcaagatgctcagccctgtagtccctgccgagcgtctgtgtccgcctgttcagtaaccagatacggcagagccgggcgca

SEQ ID NO: 513128 - DNA, 147 bp, Homo sapiens
gggtctcgggtacaggccgaatcttctcaaagagtgaagtcaattgagtctcctcttcagcgagtccatggaacgttctccagtctctctcctcaccagactggaggaaaatatgtacagtacaagtagcgcaccgagtgtatcaga

SEQ ID NO: 513129 - DNA, 738 bp, Homo sapiens
  misc_feature (363)..(363): n is a, c, g, or t
  misc_feature (459)..(459): n is a, c, g, or t
  misc_feature (466)..(466): n is a, c, g, or t
tgtgggaaccacccctatgtatggaaactctttctcgcaaatggtgatttgccccacccaccagaggttttgtgggtttacaccaccgatatataggcccaccggggcgcctttggtaatataatccggaaccgcgcccacggcttagagccctaatttaaacccggggtttccctattaaggttatttcttcgaagggccctcttcgcggtgttgtgggcgagagattttccgcggcacacgcaagggcgccacggctctcttgggccttcccacactgcccaagtggtgaggctcacgaggaactttctaaaggggaaagaaccacgcctggagtttctcgttgaatggtgagaagaaagngcacgtcttctttgggccgtgccacacacttgctccacacacacttttcttgtggccgctatatataaatttctcttcgtatagcacgccacaatnttgaggnctacacctcgaaggaaggaaggcccgggcacagaaaagggccgaagggcctcgccttctgagacctcgccgctgtgcctctgtgccacgcgaaaggaggtaggcacctcttctgagcttattctattccccccccccaccccccggcacggcttggaaatgtaaggactctttttaacccttgttttgttttttaaaaattaatcctgtgaaatcctgtaaaaaaaagaaagaaaaactcgagcattaactcggtcgagaagagatatcgct

SEQ ID NO: 513130 - DNA, 502 bp, Homo sapiens
tggggaggcaagggaggaggattgcttgagtccagcgagtttcagaccagcctggggcacatagcaaaactccatctctacaaacccccctaccccaaaaaaacaaattagcctggtgtggtgcacctgacctgtagtcccagctacttgggagagtgaggcgggaggataaaaaccatacactacaggagtttgaggcttccgtgagctatgatggagccactgcagtccagcctgggcaaaagactcaagagcctgtctcaaaaaaaaaaccaagacagaatcatatgggggacatggttcacaactaagaatgcaaagtagatttcatatcgatcaagtctcgcacacaatacttgccccggcattttggcacaactcttacaccccatagccaaactatggttggcattgctggagcaagtgtcgtctgacataagtgcgatgacagtgaaatctacaaaacctatgtgcgcaactgggacttcatttgccactgatg

SEQ ID NO: 513131 - DNA, 944 bp, Homo sapiens
gcttcgtgcaggttggacgggtggcctatgtctcctttggacctcatgccggaaaattggtcgcgattgtagatgtaattgatcagaacagggctttggtcgataggaccttgcatctaccaagtgatgagacattgtcactggccttcacaagctgcatgcagctcactgatttcatcctcaagtttccgcacaggtgcccgacccagtaagtctgtccggacacagcctggcagaaggcagcactatctcatacaaaatgggccagctcacacgatgggccaggatgattgacgccagagaaaagtgaaagcctaacgtatgacgagcactttttcgcatcagttttaaagtctatgcaaggcgaagaacattgaggcaacagaatattctaatgaatgaagttaagaagcgttcgcaaaggtcagtatctcctgaaagcttctcccaaataaagtcaccctggtactaaggggttactggtgctgctgctgcttgcttgctggtgcttgctaaacgttccagcaaaaaagagactcacacgccacgcagaggataacaaagagctccatggcctagaagggtatctctgcctgagaaacagccatcagtcccaggaaagcagccgtcctgtaccagaacgcgtcagaagggtcaaccagagctccacgcccagaatagtcaccctgctccaacagcgcatctggccaagtactagcagtaatggtggcaactcactaaggaagtaagtcgaagggttctttatgaccctgtttgggcctagacgaattttgccaacaggatctttcgggccccaatatgggaaacccgggacgaactttttgcgtgcgggtgtggcctacaccttttaggaagcccttgggcacctataaaggttgccgcggccccactctttattggggagggttccaggtacggggtac

SEQ ID NO: 513132 - DNA, 380 bp, Homo sapiens
aaaaacagtattgcctttaccccctctgaagacggccagtatgagtacttcctggatcgaccagcggtcaggaatgaaatccgattaaacatcattgggcatggcgacaaaggtggagtgaccttcaaaagcgaattgaaaaatgcgcagtcttattcacccgaagcgttcgttggactgatcgcgcccatgctggaaaaaaccagcgcttcccaaatcagaatgatcagtagtaaatccggcagtacaggtttcgctgaagagttatccaaacgcttgaacgttcccgtgaaggcccccgtcggtactgtcacacagttcgaagtcatgaaggacaggtattggattttggaaaagcttcccacccacgtcgaccccat

SEQ ID NO: 513133 - DNA, 301 bp, Homo sapiens
atttatgatagtagtcctcttaatggctatgaggtgggatgtgtgttttaagttcttagaagtttctagattctgtattctgagttatgacatatactgcagagtttatgttacttagaatgtttgccacgaccatgtcctctgttaagaaaagagataataggcataaatgcacataacttgtaccagatagcttctgaggcatgtggccatatgctttatacttgtgaccctgccctttgaacaaaagaatggcacctgaaacaccagaccaacaattaggtgttttggtggaagaaga

SEQ ID NO: 513134 - DNA, 329 bp, Homo sapiens
ttagcacttgctgtacccatcgtgtgagaggcctcaattcagaagtatttctctctcaaggcatgttgtgaacagcacaaggtcagacataaccaggtccacacacgtttatgtctttccacagggtgggaatatattgatgctatttcaattataaaagccacgagctacgaggagttgcctcgagacaattcccttcagtactacttgttaacttggtagaccatgggcaaagctcaagccagtccacgtgtcagtcaatactgcaaactatacatcatagtgtacttaaaatacaaacgctatggtttaaacattctccatcaaaa

SEQ ID NO: 513135 - DNA, 428 bp, Homo sapiens
atgtctccctcaatagattataaggtccaagaggggatgattgtatatcacgatatcttagtcctagcgcaatgcctagcacatagtaggcacccaataagtatggttaagagaatgaattaatttgtttagtgggttcaccaatgtgtcatcagctgtcgcatatctcattattgttagaaaagcacacttaatttagaataaattcgtcttcaaagaacagttatcattttttctgttggttggtttgttttttgagacagggtctcgctctgttgctcaggctggagtgcagaggcatgatctcggctcactgcaacctctgcctcccaagttcaagcaatgatcctgtttcagcctcccgagtagctgagattacaggcgcgcaccaccacgcatctaatttttgtagtacaacctgccggtgg

SEQ ID NO: 513136 - DNA, 118 bp, Homo sapiens
agcggggaacaatcactttggctagcaacctagcaaaagtgaacaaataggattacatgaagtgaaaaagcttatgtacagcaaaggaaacaatcaacaaagtgattgttccccgcct

SEQ ID NO: 513137 - DNA, 124 bp, Homo sapiens
acagtcccccaggaaccctgccacatctccttcaggcccaacagctccccactgctgcccacggtctgggccaccatgaagcagcgggaggatcctgagaggtcatcctgccaagggctcccgg

SEQ ID NO: 513138 - DNA, 491 bp, Homo sapiens
gagaggaaaggataaagatacccaaatggcagtcaggtttttacattctacacgagggttaacactcattcaaagtggtaaaacactgatagtggctgtgatatgttttttatgtgtattatcatacctagagataccactaagaaaagtatacaaatagatgtactaaaaaacaaaaaaaaaccccaaaaacaaaaatcactgaaaacaaatcaacacagaaccattttttaaatgttcaaataacccacagacaattaagaaaatagaaacagaagaatgaggagtcagaaaaacaataaaagacttagcccaaacatatcaataattaccttaaaagtaaatagtcttaacaaccaaataaaagacagagattgtcagagtggataaaataacatgatccaataatatgctgtctattagaaactgatttcacatacaacttcatatgtagattgaaaataaaaggatagaaaaagatataccataca

SEQ ID NO: 513139 - DNA, 207 bp, Homo sapiens
agagtcaacaggcctgtggattggcatcaaatacacgagtcttacgctgcggggacgtgcgtgtgcgccccgcaatgccacggaaggctttcataattttaacttgtacagagcttgggaaatggggctgcaaaggagagcagttcccacgccaggaaccaacgtgaatagcattggaatcagcataacagccatggaattcaggca

SEQ ID NO: 513140 - DNA, 221 bp, Homo sapiens
tgtcgtctgcaggtgaatgcttctgcgcctcttctcgggaggtcagcttttctcgatgcaccgagggcctgccctgttgtagcgaggaaccatcttcacacgcatcgacgtcggctgagcgtgtgcagccacgtgtggcctaccctgtgaaccggccgctgcgtagtcggccctgggtcgccgcttccagcccggaccagcttcacatgcaccttctgcct

SEQ ID NO: 513141 - DNA, 387 bp, Homo sapiens
tacttgacctctgtgagattttacatttgaagtgttcttataattgttttatatatacgtatagtcttttttttttccctgtcagggtcagattttctatcacagttacttttggttagaaaataaaatatgactggggtcccatttagaaggactttggttaagttctcatctcctcaaaaaggtaaagtttaagttttttagttaaaacatgtaaatgagttccttggtgaaaggtattggtttaagttacttacacttggggcatgcaaaagctgctcttctgaaccagcactaccaggttaactttaaagggaaactgatcatgagattggatgacccaattcctgaaaaagaaagggacgattttgagaaggcccaggtttg

SEQ ID NO: 513142 - DNA, 297 bp, Homo sapiens
ttggggtttttaaatgccatttttaaaaaagcctttttttcccccctttaaaaaagggtaaactcaaatttggttggatttttcccggattccccccaggaattgggtggttttaaaaccccaaatttggggccaaattttaaacctttaaaaagggttttgggggcaaatttttgggggtaaaacccaggagaattttccaaaaaagggggaaaacccctttcaaggtgcccggccttttaaaaacccaaaaagccttttggttttaattaattagccgaggggttgaggcctcca

SEQ ID NO: 513143 - DNA, 253 bp, Homo sapiens
atctcatattacataaacaaaagtaatttattttgattagttcagttacatgcctggaaatggcagaaggttaacaccacgagcttctcctatattgtaattcaaggatgtagctagattctgtgataggagttgtcatggaggccctgatgcatttacctcgtctgtgccccctcaaacacttgttcccggtaatgaatgaaggaggcagctatctctactgatgtgatcaatacagctttctctctccact

SEQ ID NO: 513144 - DNA, 283 bp, Homo sapiens
gagaaagggagggagagcaggctctgaggtttaatcagttgcatccagcttaaattcccccaaacggcggttccataaatgaaacttctttttaagtcagaggccagagcatatgcgtcccattaggaattcggcgaagccaccactgcgcgccccctgggctcactgggctggactcggccctgcccggagcttctcagagccccgtgggctctgccttgccccgcacacacacgcgcgcccacgctccgcgctctcccttggccgagacaactgggcgaac

SEQ ID NO: 513145 - DNA, 676 bp, Homo sapiens
attcccttaccaagaccattcctttttatcttccaggttcttccccacaggttagttgcgtcctactctgagcagccacgtgtattgtccttccatggatttagactggccgtacaatgtattcttcacatggaaacatattggttgagctttgccatcctcatctagccttcgttttgtgacgggttcactcccttccttatcaccccagtgtctctccacatttctgttgtcgttgagcgcccttggatcacgccagttggattttatagctgctccctctatctgtgtcacagaactatgctgcctcaagtgatcttggctccctaatggaccattgtgccccttggatagttatccgctgagaatctctaatctctctggtgttttccctgccttaaccacaaattgtggtgcgttttgtacattgcacgtatccatcacaaagttggattctgactattttgaacaccaaagtcagtccagccttttcaatgtaaacaatatttattaaggcaatctcgagtatgttatggaatccatttccaaagactgttgagacggaatcatgtctgaatataacaagatgtcgattctgtgtcggaacatatggtgacacggagctagtgcttgtgttacatataatgcactctgtctcttaatttatgtaaataaa

SEQ ID NO: 513146 - DNA, 529 bp, Homo sapiens
  misc_feature (240)..(240): n is a, c, g, or t
  misc_feature (324)..(324): n is a, c, g, or t
ggctgcggtgagccgtgatgatgccactgcactccagcctgggtgacagagcaagtccctgtctctcaagaaaaaaagacgcttccacgaactccgaggtactagttcgggtgggaaggaagagcaggaaagagacagcttgcattagttgaatgcctccaaggtgacaggcactgtatgggaaactctttcacgataattttgttcatacagttctgtaggtgggatataattccactntacaaatgaggaaactgaagctcagagggccccagatcacagcaagaggcacagataagttatggctaacttatctactatgtnaatgagaaacaactgaaggacctagaacttgtggcctgaagaagaggaggccctggaagagcagaaccaaggttttcagatatttaaaagtctgttcttcaggagagaggttcaactagcttgtctcttgtctaggatcacagcttcagggagcaaatcaatccatgataacgggtgggcattctcactcacagagctaccaaaa

SEQ ID NO: 513147 - DNA, 129 bp, Homo sapiens
tatgcaggcctgcctctggattcattccgtgccaaagaaggtgaacagaagggcgaagacgggggggagctgacatggccctagtgcagactccaagcaagcgaacttcgaagtggacagcttacacca

SEQ ID NO: 513148 - DNA, 240 bp, Homo sapiens
  misc_feature (15)..(15): n is a, c, g, or t
  misc_feature (40)..(40): n is a, c, g, or t
  misc_feature (44)..(44): n is a, c, g, or t
  misc_feature (46)..(46): n is a, c, g, or t
  misc_feature (211)..(211): n is a, c, g, or t
  misc_feature (238)..(238): n is a, c, g, or t
ctgatcctcgtcagngcttctggttcactggggccaggcncgantnggtttgcctgggtgccagcaggggctggcagagagatccacaggcccaggctgatctcttccctgctcagaggtctttccagtccagatcgtccaagctgcgtccagtggctcctggaggagtcagtgggtactgtggcctggcgcctgggtagctggccgtttngtgccaagtgaccttgtccttgctgtngg

SEQ ID NO: 513149 - DNA, 257 bp, Homo sapiens
cgcattgtttttgcacgtgtagattgccatatactgggccaattttgaattgatcagccatatcgcagcgcaattgcgtctgtcatcagaaaacacggggttctcgtcttctatgtgggtaggcctgccaggtataaataccactcagccacaccaaacacaatggagccacttgtgcctggatgcaaaaagtaaactaagtgtggcatatcctccagcttgaaccataaagcataaagagcctacccaacaatcaa

SEQ ID NO: 513150 - DNA, 122 bp, Homo sapiens
  misc_feature (43)..(43): n is a, c, g, or t
  misc_feature (68)..(68): n is a, c, g, or t
  misc_feature (85)..(85): n is a, c, g, or t
  misc_feature (89)..(90): n is a, c, g, or t
gaggatccaaaaaccataaaattcatcatccccagcaggtgcnctagctatactttattacagcaaancacaaccacacgctganctanntcgtatagataaacaccaatcatgggtcggcc

SEQ ID NO: 513151 - DNA, 308 bp, Homo sapiens
  misc_feature (290)..(290): n is a, c, g, or t
ccagatgagtaattcgtacaccgactattcccacgaccatatgttcctggggaaatcacatgaagaagacgccaagcgaaccttgtgggtagtggctctgaccgtcgtaatgatggttgctgaaatcaccgcaggttatctcactggctcaatggcgttgcttgctgatggatttcacatggcaacacacgctggagcacttggcatagccgcagctgcttacggttacgcaaaaagacatgcctcaaatgctcgctacagttttggaactggcaaggttggagacttgngtgtgctttcacagggta

SEQ ID NO: 513152 - DNA, 808 bp, Homo sapiens
tttttggtaaagacaggggtctcaccatgttgcccaggctgatctcgaacttctgggctcaagggattccttcccaccttcagcctcccgagttagctgagcactacgggcacgttgttcaccacgcctgtggccaatcttttgtgttttcttctcagcctacagacgtgggctttcattactgttgtggccaggcgtggttctcgaacttccgtggacctcatgtgatttccactccggctctcagccttcccacaacgcgtgtcgtgggcacttccagtgcgtgcaagccaccctgacacccgtgccaaggtccaatctgcctctctcactgctttaggctaatcatggtccccacagcagcaatatggcaaccacctttcactgtccccacccatccacacacccacctcgcgctttctcgtccgtctctctctctccgcccgcactacgcgcgtccctgggtctcccgcccccttgctcccccccttcgcgccctttgccccacctcccccgctgcgctggttcgccacctacggggcttctctatccagtcctcgcgctcctccgtccttcccccccagcgcctccaccgtgcattctcttctccaacttctcgatctgtcttcctcctgccacctcagcgcctcgcgccgcaactaactgccttggttggccctatcccactcgctctgggcctcggctcttttctctcctctctccctctccccctcctcccgtacacagccacccgcggcctgctcgctctcttcgtttgccccccagctctcctctccaccacaccctg

SEQ ID NO: 513153 - DNA, 667 bp, Homo sapiens
  misc_feature (77)..(77): n is a, c, g, or t
  misc_feature (89)..(89): n is a, c, g, or t
  misc_feature (93)..(93): n is a, c, g, or t
  misc_feature (101)..(101): n is a, c, g, or t
  misc_feature (111)..(111): n is a, c, g, or t
  misc_feature (134)..(134): n is a, c, g, or t
  misc_feature (150)..(150): n is a, c, g, or t
  misc_feature (155)..(155): n is a, c, g, or t
  misc_feature (182)..(182): n is a, c, g, or t
  misc_feature (191)..(191): n is a, c, g, or t
  misc_feature (224)..(224): n is a, c, g, or t
  misc_feature (235)..(235): n is a, c, g, or t
  misc_feature (241)..(241): n is a, c, g, or t
  misc_feature (261)..(261): n is a, c, g, or t
  misc_feature (265)..(265): n is a, c, g, or t
  misc_feature (299)..(299): n is a, c, g, or t
  misc_feature (301)..(301): n is a, c, g, or t
  misc_feature (305)..(305): n is a, c, g, or t
  misc_feature (320)..(320): n is a, c, g, or t
  misc_feature (331)..(331): n is a, c, g, or t
  misc_feature (338)..(338): n is a, c, g, or t
  misc_feature (347)..(347): n is a, c, g, or t
  misc_feature (358)..(358): n is a, c, g, or t
  misc_feature (362)..(362): n is a, c, g, or t
  misc_feature (373)..(373): n is a, c, g, or t
  misc_feature (388)..(388): n is a, c, g, or t
  misc_feature (404)..(404): n is a, c, g, or t
  misc_feature (407)..(407): n is a, c, g, or t
  misc_feature (410)..(410): n is a, c, g, or t
  misc_feature (436)..(436): n is a, c, g, or t
  misc_feature (482)..(482): n is a, c, g, or t
  misc_feature (487)..(487): n is a, c, g, or t
  misc_feature (564)..(564): n is a, c, g, or t
  misc_feature (578)..(578): n is a, c, g, or t
  misc_feature (585)..(585): n is a, c, g, or t
  misc_feature (588)..(588): n is a, c, g, or t
  misc_feature (595)..(595): n is a, c, g, or t
  misc_feature (635)..(635): n is a, c, g, or t
tatttgataatagttcattttattaaataatctataaagtcagaccagtgcattgggcttgttaggggaaaccattncttcctactgtnacanagcctggnagattatatnaggggccaaaacattcccttttnttcaatttattaatgngagtntgggattaaagtagatccttgcatgtnagggaagcngccacacatctggtttaagtggggcccaaaggnaagttattccncattcnccaacttccccccttgaccncccnccagttcctgtttgctttttccatcaatcaactntnagangccctaaacccaaanagttcccattnaactgtncccaaaggnatagatatggnaganatctcactccnactctcacctttggnattaaataaacctggnacnggnaggggaactatgggtgaaaccaagtnaagatttttaagaagctttgacagaaacattaagaataacacccgnatgcnaatccagaaaaaagcgctactggggggaaatagttttagccaatgttcttaaaatgctcataagggagggttggggnattaccctttaganaaaagcnctnagaactntggataaaacgggaacttggatggataaagtttgggcctnctgggccaaaagttccgagggcggcccggcaa

SEQ ID NO: 513154 - DNA, 228 bp, Homo sapiens
tttttttggggggggcccccttttgggggcccccttttcccttatctttggaacccccccccccaaaaatatattttctcgggggcccccccccggggccccccttgggggggggttttttcccccccccccccttttccctttatttttcggcggaaacccccccgtgggggttttttttttcccctgggggccgccccccccccttaagcctttttagttttttta

SEQ ID NO: 513155 - DNA, 278 bp, Homo sapiens
tgacagtggggtaacggagaggaagaggaggaggtggacagacaggagagacaggacgaagccagagatggctgaacacacagcacttcttggtcccttcgagaataaggcaccagagtcagtaacgtaccccgttgttctgtgcgattaacacgggtgctgaagggagggccggttggctagctgaagagagtgggccttgcaggacgctcacaaccttgcacaccagtggcctacttgagccatgtttgtatcttagaccaggtccacggcctgta

SEQ ID NO: 513156 - DNA, 968 bp, Homo sapiens
ttccacaatcgggcaactttaaggttccacccagtgtgcgccgtgtgggtgcgaaggttggtgtcccttcgttctgtaaacgggctcaggtagtttgttgaagaggaccatacgaggaaaaggtgtagaaggtcttggtccgctcggcgtggccctggttggtacgcgataggggaaagaaacgcaagcttgcgctgtggtatacctaagctcgcgcacacccaagtaagtatcgctggctacacccgtattggtgttccaacattaggttgagtctatttaaagtttgtaaatccccgattgtggaagtgacaacacccttcgagttaaaatcttgtctataagaggaatgagcgcagaagaagtataatgtcgtgggtataataccctaggtaatagcccagtttatcaaaataatctttgtacaagagacttggggtggaggataaactaagagtagaaaacatgaggattatctataagtcaataaaatgaatatagaaaagatattggtgggaaaggacatgtagacgataaattagtaagactgcataacagaaaatccattgtatagaatgagagtaaggatggaataagagactatcgcttaagccattacaattgagacacggtatgttcgtcgtgcaagaaggatacgacggaatgagtcaaggagcgctctgtagccacgccgactacctctgaaggcgtacactggtccaaagaatacaggatggggctcctgggacctgtaacttttagatcatgtagctgagacataaatttgttgtgtactacgtttggtattttgtcctattgtttctctaactaagaactcggtcgtaaatgtggtttgttactgtagcacttaggaacactgaaacataaaacgtgaacagttccaagcgggacagtacatatctgtatgaagcgtgtcctctgaataacttccctgagggctccactcg

SEQ ID NO: 513157 - DNA, 255 bp, Homo sapiens
agctaagtaggaaatgtacataaagcaataagtctgaaactggcttccccaactcccccgtttcttccttttccttatccttataggcctgtccctttgcctctgcccttggattggttggcaaactaaaaggacttgatgtacataactcctgtccctttttcccgttacaaggttggggacttgccccttggcttttgccttcttcatttgtgccctttggccttggggttgcattctccttccctgcccttt

SEQ ID NO: 513158 - DNA, 106 bp, Homo sapiens
ttcgagtgaacgaacatgacactacagtcagacagtggtaaacgttctaattgttcgctcctagtactaggcttagcacttaactatttcactaactactagttac

SEQ ID NO: 513159 - DNA, 1006 bp, Homo sapiens
  misc_feature (1006)..(1006): n is a, c, g, or t
agcggatcatgagttcaagaccagcctgactaacatgctgaaaccccatgtctactaaagatagaaaaattagctggacatggtggcaggcacctgtaatcccagctactcggaaggctgaggaaggagaatcacttgaacctagtaggcagaggttgcagtgagccgagatcacgccatgcattctagcctgggcaacgagagcgaaactctgtctcaaaaaaaaaaaaaaaaaaaaaaaaaaaaaaaaaaaaacaagaaatccgttgtgtgtttttaaacccaaaccccctctttaagggccttgtttgggggctccccgaggggagatatgtgggagaattgaaaagcgccaattttttctgtgtgtggggagaaacacccgtgggtgtgtcccctttttaacagaacacttcttcaacaaacaaaccagcggtttcggcagggggggggcgtcttctcccattttaaagagaggactggtgagctgaggagaaccccaagaggggtttcatagaaaatagacgtgacgactagggggcgagctcgccccggttatatattaccacgctttctcatctattatttttagggggccaccacttggtaaaaactcctcccgcgagggtaattgggttggggctccatctatatagacaatttcccgctagaatgtgtcgcgcgcgcgctgggaaaagtgcgccccaatatgtgggcccgtgaaaaagagcccccagtaagagggagcgcttaaatcatatttctctcccaccaacacaggagacacgccatctatctttacacccaccactgtgtgatatgctcgaacacgaggggtattacttcccaagatgagacagcaccccaatcgagtggggacccgcccaagaaatacatctctctgctatatataatagcccccaaaatgtacccaatctgttcttggaaagagggcaacagtgacaggaggggtgcattgtgccttcacgaacagatgagaataatn

SEQ ID NO: 513160 - DNA, 398 bp, Homo sapiens
agatcttatggctcttgggcctgtgagaaagtgacattctttacttaccacaggtcaggaacacacgttcagggactgtgcagacaaggtatgaggcccggttccccaaggggtgttttattggctctataaatcaaggttaataccttaaagggaagcgacaccattccaggcaaagacttagtaaaataaccaggttcttcaattgtgtcctgtgtcaaataaaaacaggttcttatttcacttatgcgaataactatattggcgcaagtgacgaatacttacaagtgggttccaaattttggagaaatcaggttgagagaaacaaataagctccaaatttcgttcataggagtatacttggtaaaagctgtgtagcttgggttccttggctctgt

SEQ ID NO: 513161 - DNA, 491 bp, Homo sapiens
  misc_feature (31)..(31): n is a, c, g, or t
  misc_feature (33)..(33): n is a, c, g, or t
  misc_feature (61)..(61): n is a, c, g, or t
  misc_feature (90)..(90): n is a, c, g, or t
tgctccgaggactactcgaatcgacggttcncnaaatgtttttccatgccaacagcagcancagcatccaggcactcagaaatacaaatngtcaggtaccactccagacctactaactctgaaattctaagaagtggttttatcaagtcctccagtgtaattacatggtcaaatttaagaactagggctatatgccaaagacataagaggaaactatgtagccaattactgcagaacagcagttttcaagatttcttagtcaaagcctgaatttggggctgggcatcgtggtcatgcctgtaatcccagcactttgggaggccaaggcaggaggatcctttgagttcaggaattcgagaccagcctgggcaacatagtgagactttgtctgtactaaaaataaaattagccagatgtagtggtacacacctgtaatcccagctactgaagaggctgaggtggaaggatcgcttgagaatactttatctcaa

SEQ ID NO: 513162 - DNA, 534 bp, Homo sapiens
  misc_feature (33)..(33): n is a, c, g, or t
tggggaggaggtaaagagggagttgtttccaanagctcttccgccccccctggggaaacacttttttataggcaagggggggccccgaaacccagggttttccccttgcccccttccgggggtaggtttcccaaaaaccgggttcgcctcccctggttgttaaagggtttttttcccacgcaatttccggtggggtggggggccattgggcccccggaaaaaaattaaaaacccccccctcccgggttgggttccggggggttttttttttttttccgcaagttccccgtggacaaagggggggggggggggggggggtttttttttttttccttttgggatggggttttggcccccccctccccggaaaagggctttttctttttttgggggaaaagggggggggggggggcaacccccccttccccgggttttttggtttgggggggggtgtttgggggggccccccttttttttttttcgggggggccgggttggaatttaggccccccggggtgcctggggcccctgcca

SEQ ID NO: 513163 - DNA, 111 bp, Homo sapiens
gaggctggtgactctgaggatcccgcttgcgtgctccttggtctactgcgggcctcagcctggtcagccaggagcttcttgcgggccttatcttgcgcatggtgtacctga

SEQ ID NO: 513164 - DNA, 446 bp, Homo sapiens
  misc_feature (421)..(421): n is a, c, g, or t
tggctcatgtgatccgtcaaactcctgttggttgggtccacttttccctctggacagatgtgagaaattgaggttcacagaatgtgaagggacctgcccaatggatcaccctagcctctcagtaggtattcgggacaattaatgctctttcaggctccaaaggcccatgtggttcctgaagctttccatggacagtggcaaaaacccaggcagccactgagttggtggttggctaccagtgccacagaagaaagtctgtaggaggagatgtcttagatgagagaaaattgcagaaggaggatgaaaaaaaaggctttggtgaattactgtgggttccagcatgtaatagtcccctgtgggttggagaggggacaagatgaggaagtgagttccctagagcctgaaaattgtttcctgaatnctcggggtaggcatggttagctgaa

SEQ ID NO: 513165 - DNA, 241 bp, Homo sapiens
atagaggataccccccttgaaaggtagctagacaggagaggccatagtaatctacttaccgagctacatagcggtaagctatgcaaatacctatagagcatattctataggctatagcaggctagtagtaacttccaataccctagcctaccatatagtcacaattgcctagtactataccctactagtagtagtagtactatacacattagaacattaactactctacttagatgtagta

SEQ ID NO: 513166 - DNA, 206 bp, Homo sapiens
ggggaaagggaaaaaagggggggtgggggggtccttcccttcagaaaatgaagtttttccccacgcctcctttccagggggtttccggggggcggaccccaaaggtttttttccaggggaaccccttttttttttttccccctggcttaaatgtttttaaatggtttttaccaacgggccttttttaaaaagggggttgccccgga

SEQ ID NO: 513167 - DNA, 221 bp, Homo sapiens
tttttaacctttaaaaaaaaaatatggggataaattctccccctagattcctatttggtaagagatccctttttttacccccagtttttggaggtagttttatttgaaacattttcagtcccctttacaacaaaaagcagcttgtttttgcagctttgttagcttttaaacttccagattaactgggtagccatttcagtagccctaaaagattacctcta

SEQ ID NO: 513168 - DNA, 1194 bp, Homo sapiens
  misc_feature (42)..(42): n is a, c, g, or t
ggcctgcttcaagatggcggtgcaggagtcggcggctcagtngtccatgaccctgaaggtccaggagtacccgaccctcaaggtgccctacgagacgctgaacaaacgctttcagcgccgctcagaagaacattgaccgggagaccagccacgtcaccatggatggtggccgagctggagaagactgttgagcggttgtcccgccgatggaactccgtggtcagcctgctggacatggcgtggtggagaagctcagcgtcctcaagaggaatgtgcggtaggaatccataccaggccagaggacgagcagcagaccaagactgtgcaagagccggatcgagacacctcaaagagcatagcagacgaccagcccgcggcggacagagtgtggcagaggaagcgcatggatcgcatgatggtggagcacctgactgcgttgcggatacatacaaaacaggcatgttccaagcttggcgcatgcagagacggaatcagaggacctaagtgaatatagacagctgttactgacagagcccacaagaggtggagggcagtccctagtagaggcgtgtaaaggaccacaccgtgcacattggacctgagtgccacatgacaacacagtcccggaatccggacagcatgaaagagcttgacctggcaatacaagcaccataagaaatccaggacagtacacttgaacatcatccggcacgcattaccgatccatggaaacgcgaaatggagaaccatggaacagcaaagcgacaacagcacaaaagcaggaaaagggaggcccacaaggaacgaagaggagcgcacgaggaccatggagacacgcatggcacaagcgcggccggacaacgaagcaccaccccaacaaaggacccaactgggcacctgacgggggagagaacatagatcaacaaatacccggtagaaacgatatactgaaatcactacatagtgtgaaaaaaaatacagttacacaccacaacactgtacggaggacaattaaagaataagcaaccacggtgactcaagaaaacgtagacataaaagcagataggacgaagagaaaggagagcgaaaactgcacaaccctaccgaacgatagtaagacaccagagaagaaataggagcagacgagaataatacaaaagtcaatacaaagaaaaatactgtacaaaaacaaag

SEQ ID NO: 513169 - DNA, 886 bp, Homo sapiens
atgtgcacggtaatggctggctacttggatatatatttcgagaagaagtgccacaacgagggtcgtgtgctctacgggccctcagagcaccaaaacacactggaaacaatacagtatttctactggaaaaaccatttgcagttaaagcaggtgaagccgttgaaaggaaaggtcacagttcacgaagaatagagaaaagatccacgttctctcaccgtgaccctcacgctgaataattcaactcaaacttatggtctccagtgaaacagccataaaagcacattaccttgtagtctcctactgtgggggtacgagtgggtcagcaggagggagcgggttttattgtgagcacgatggagtggatgatggaccctatttcctaatgagcctcctcaagtaagagagaagtgctcattgtgggaatctgacatagttcagctgatggaagagaatcagctgatcctcatggttcttgccacgtaactcattttcttagacgtgttgctccaccagatttaagcaaatgtaactcccacattgggttatctatatgacaaatcattgacattggctatatttagaagagagatagtctgtggttggtaataagttgcttactatgaaattctaaagcaaatggtggttatgggtatgtattgacctagtacaccggtactacacattctgtatggactcctctgaggggggtttaatggtttggtaaaaagtcggagtctaagattgtttacagtaaattgggaagagcttgacttaataaaaaaatttggaagggagagggtttgagaaaaaggggcaaagagggtccctggggaacatacggaaatttatggggaacaataaattcggggaaggaggaggttaaata

SEQ ID NO: 513170 - DNA, 181 bp, Homo sapiens
ttttggttagttgagatgtgccacccagagtggctgtgatctctagacggtacacttagctgtgtagtcccaccagtaagtacatacccatgtccagacaggagctcatgattccgtaaaacatgtgaacttatacccagcttcccattgtggaatttacattactactgaagggtggcca

SEQ ID NO: 513171 - DNA, 599 bp, Homo sapiens
ggatagtactatagtatttcactacacttctattctcagtaaccaagattgcttggggattaaacctactataagcaaacagtgagaaaggaagtcttgagagccaaaaagagagggcatgcagcactgagtaccgtccatggaccatacgtctaattatacaacgaccgcagcctcacaggggaacgcaagtgaggaacgaataagaacagcaggaggataccgacgtgtcaggagaaagaacgccgcgcctacgtcggtcgagtaccgtcttaggaaagcaggtccagaagcaaggcaccggtgacacaaccacaagcacgaaacgtagaagcaaaaaggaagtacagagaagaaatcaaaacaacgtatacaaacatcattgagaagacaaaaaaaatcacatgaacacaaggctaaatacaaaggacaagaaaacacaaacgaggaaaaaggcagacagagcgaaaatccaacatacaaagagaacagcgtaaataccatccgtaccacgtattaaccaataaacacaactcaggggactgaataaaaacaaacggagaagcaacagaaccattagataacaaaaaacaacgaaa

SEQ ID NO: 513172 - DNA, 762 bp, Homo sapiens
acagaactattttgtggggcagtcctgagtttaagaactaagagtggctgtggttatgtgaatatgttcagttcttgaatttacaactagtaactccaattcagtaaatggtatcactgttccccccttttaaggatttgatctagacttcgattagtaatgttcaactctttcacaaagatggtgagtgccatcttaagacttactggagattggtatatatttagatttatataaactggtcatgtgaatatatcgtaaatacatggggagaattagctttcacgtgtcttagaaccaagcaagagttcacctggtgttgtagtgttcatgtttcagtgttgcgcgtccttaaaggcaagggttgaagataaataaggtagcaatgactatagattttggccttaactatgagcaatctaatgataatttccccgtgtttttaaaatggtttctttgacttattgaaagggatttggaaggtgtggtttatgtgtaatatctaaagattattgcaagcactcgtctttacatcgttgacagatctataaggtcacatgcttgtagaatagttaggcaagttaaaattcactcttgaattgcttttacaatctaagtcaaactaagttatcattaggattgtcttttaaacagcattcaggaacaagagtgtgaactgtggtatttgattgggaatgggctttggcaagttaaaggaattaagtacgaaatatgccatatttagaaacaaaaaaagggggg

SEQ ID NO: 513173 - DNA, 1373 bp, Homo sapiens
ctagatcgcgagcggcctgccctattttttttattttttaatgttcaaggagcacttaaatagtacaacaaattgatagcagttttgtacacaagtacttatgcataattttatacgtacaccagctacaaacttctgacatcactttactagctacaaacgaaacagacacagaggaaaataatttcccgtgtccaatgaacattttcatacactatactgacgatttcccacatctgtcaagtattaggggctcagaaataacaagatagtctaactatatattcacatctattttctctgtataacttataatatattattatattatgagaacacaagggtcctacgactactagtttggccccacggatcaggcagattagacaaatagaagaaacacacaaacaccgacggacatacacatgacaaaacacatacacaagccacacaacgaaaaacaaagaacgaaaaaacatacaccgagaaactaaaaagaacacacaaaagagatagatagagagaaacaaacaacaaagagacaaatacaaacgacacaacacaacaaaacacacacagaacaacaacaaatcaaaagaaaaataaaaaaaagaacaagaaaacaaacaaaacacgatacaaaacaaaaagaagggaacaagagaaagagaccacaccaaacaacacagaaaacacagaaaaagaaaccagacaacaaaaacaacaacgacacacaaaaacagaagacaacaaggaaaaacaacggaagccaaaaaaaaacacaaggaacaacaaaaagaaaaaaaaaaagacaaaaagaaaaacacaaatagaaacaagagggaacgaaaaaacagagaaaacacaagaatcaaaacgataaaacaaaaaacagacaaaaaacaacagaaacgaaaaaaaaaaacacaaaaaaaacaacaaaagaaacaaaaagaaaaacaaaaacaaaacaacagaaaaacaaaagaaaaaaaaagagagaaaggaaaaagagagagaaagaagaaagaaaagagaaagagagaaaacgacaaaagagagaaagaaaaaagaaagaaaaaagacgaggagagagaaaaagaaaaaaaaaaaaaaacaaaaaaagagaacgagaagtaaaacaaaaacactgttctctccgcgctgcactgaagaagagcaagagaacaaagaaaaaggaggagaaaaacaagacagaacaggaagagagagaagagaagaaaaaaagaaaaagggaaggaagaagaagaaagaaaaaaagaaaaaaagagaagagagaaggaaaggagaagaaaagaaaagcaaagcacggtacgatagacaagaagcggacaagattatgatataaagaa

SEQ ID NO: 513174 - DNA, 133 bp, Homo sapiens
gggcaggcctactgagccatatccctagagactaatgccgaaggccatgtatgacctcccactaaattcaagtcgcctaggactagggctggggccttcctagaagccccctctcagaacctgttctcaccca

SEQ ID NO: 513175 - DNA, 135 bp, Homo sapiens
tgaggatcccgattaagacgcagaaggggaatctcgccttgggggacacggatctttggcagtgggaggaaagagaggagcagaaaaaataactatcgggcccgggcacagtggctcacacctgtaatctcagca

SEQ ID NO: 513176 - DNA, 191 bp, Homo sapiens
tgtaatgtcagttcagtgttccctgctggatcaacatggttgtcactgctgactgaggagtcggaggcagtgtgcacctggtagcgcctggcgcagttggccaagcttttgtagagccctacctgcgggatgctgcccagtctcacgctcactgtggtgtgctgctgccctcccaccacaaacgtgggatc

SEQ ID NO: 513177 - DNA, 248 bp, Homo sapiens
ggctcaccgtccgtctgtatctttcttagcaccagatgacatcagtctccaacatgtatctgatcggttggtgtggatcagcaaaaatctcccagtgacaacatcgcaatagtttctaacttctcttaggtggctctgggactgggagaggggtaggatgtacaggggtagttcgttggagaaccagcggtatttcacatgaagctgtataattcattgtcataatgttggttagcaaagattaaatg

SEQ ID NO: 513178 - DNA, 469 bp, Homo sapiens
ggtcgacccgaaattgtgccactgcactccagcctggatgacagtgtgagagtctgtctcaaaaaaaatatatgtatatatattgttaagactaaatgtcttaataaataaagaggctgggaatggtggctaatgcctgtaatctcaacactttgagaggtgaggttgaagtatcacttgagcctaggagttgaagaccagcctgggcaacataggagcctcccatctctacagaaaaatgttttttaaattagctgggcatgatggcatacgcctgtagtcctggctactcaggaggctgtggcaagttgatcacttgagccccggagttcaaggctgctactgtaagctgtgatcgtgcccttcactcagcctgggctggagagtgatactctgtctcaaagaaaaaaaaaaaagtttgcccatagggggcgtattaaaatcgacgcgcccgaatttgtagtattca

SEQ ID NO: 513179 - DNA, 345 bp, Homo sapiens
gatactgtagttggaaccagttgatgacggtgctggtcttccggttgagctgggtggctgaggtcttcgatggtttttggtgacggcgctatggcttttgctgactacgctcgtttcagacgcctccttctcctccggaccccgcaccacccggggtttcttctcctggtgctgcttctgtgtgctggcgccctggctgtcctcggtgcctgactagggctgttcgtacgcttggctgtcactgacttgatctgtgccgccgcttcattgtatgctttctttctccatctcgtttcatgttccactcaggttcttccagagttgtgtggaggtcgcttcagctca

SEQ ID NO: 513180 - DNA, 605 bp, Homo sapiens
  misc_feature (65)..(65): n is a, c, g, or t
  misc_feature (79)..(79): n is a, c, g, or t
  misc_feature (145)..(145): n is a, c, g, or t
tcaataaaagagacggtttaatgaaggccacctcggaataaactcgttaattggccagggtgccncttgtcatccaccncgagtaacgatctcgttcagcacagttgcctgctactaatgattgccattgtctgaggtagtggcngcatgccatatggacgagcatccgtaccagtaatgtaggcatatgtgaggcggtacttgtctctttcaggtcccacgtttgaacatggcatagtctacagttgtggttctaccatcccagtctaacagttccgctcttgatgtatatcggatgcagcactgtgtgcttatcaaatgtatcttctcattttgcagccacatttctgttgtgacagtagcagacagatgtctcggatccttcttagtattgaatacagtttttcttggaatatgcgcggcaatctagtctcttctgaaacacagtccattcatttccgcgacccatcgatttcaccgtagactaagaatagctggttagcttgcagaggtttaataaagtatagcccgctctgtttagcactctattggcaatgtcatgactatctttcccagtgatatcatgcatttgcagcgtgtcgttg

SEQ ID NO: 513181 - DNA, 448 bp, Homo sapiens
  misc_feature (8)..(8): n is a, c, g, or t
  misc_feature (10)..(10): n is a, c, g, or t
  misc_feature (12)..(12): n is a, c, g, or t
  misc_feature (129)..(129): n is a, c, g, or t
  misc_feature (168)..(168): n is a, c, g, or t
  misc_feature (194)..(194): n is a, c, g, or t
  misc_feature (197)..(197): n is a, c, g, or t
  misc_feature (296)..(296): n is a, c, g, or t
  misc_feature (328)..(328): n is a, c, g, or t
  misc_feature (348)..(348): n is a, c, g, or t
ccaaattngncnttttaggaaagcgtgagtgtggcaaaggtcacttgttaacatttttcttaacaagaatgtcataactactcattcatttttattttgtccccacgtttggtatttgttttgttttgngtttttccttcctgatgtcctttgcttttgtggaagatnggcctgttgataggcagaaacatggnggngatcctctatgtaaaatatagttgcttcttacacatcagaagtatttcactcattttggaatcacaggattttcatgttttcataaatacacacattgntttgataattattagcaattagcttattttgnagcattagatggaaaaatgnttaagctaaagagtttaattttcttgattttggttccactttaataattcaagaggcctccaagttcaaggaccaagtccttctattttagaattgggaa

SEQ ID NO: 513182 - DNA, 1340 bp, Homo sapiens
  misc_feature (538)..(538): n is a, c, g, or t
  misc_feature (544)..(544): n is a, c, g, or t
  misc_feature (780)..(780): n is a, c, g, or t
gagaccgcggtcggcacctcgttgagctcagaatctcagcgcgtatgtcgatcctgtggactcgtgcacgaccagcctgccctggcctcatacactaggcatgagtgtattgatcggcccaggagccttacgatccgctcggacacacgggtctcctggcgattgctgtcacacggcccggcttatcggactgggacgatggaagtgccactccctcgcgtgaccggtgcatctctctctctttccagttcggttggcggagctgccgctcctacgtggcttcacaggtgtgctgattgagattgcgctagggtgtcattggtgtgtcgacgaaagtggactatccgtatttgatcgagcgtcgaccgtgagggttcgcgagcatcctcagatgattgattggccactgcctgataaccccccttggatagctcatgccacagtacgcaccagcacagggcacattcgcgttcggcccaatgcatgcaggactcgatgcattgcagaagacacaactgcctgcgcgcgagccaatacnccattntctacgcacaatcgcagggcgttggctcggtgggtcttcctccgcattggcattggcgagcgcgcctgttgctttggtctgggactccggtaggtgggtccctccccttggtacagacctccatagggacgcaaatccggtccgtacaaaaggatagagaccctaggtgattccactgtttccgtcaaattggtctcaaacaagcaccaccatggtctattgttaacgttctgggnctgatttctcaaagagactcgatcgtcttttattctcgctcgtttaatcgactcttgccttgagccaaccggtgatcgctagtttgcgatatttcggttgtaataggaaccatgcctgtgactgtcagcagggttacgattgctatctcaacgaaactagcatcgttggcctcccaattcattatctgaaggaggaggttaagttgctcactttcacgctcccaattggacccaattccccttggcgggttcctggggaaccttgggttttgggaccggggtgaacccttagaacctaggaactaaacgcgttcaattgcaacagaattcctacaaccccggaagacaggccgggagttaacaagggcttttcaaaacacaactccgaagcgggccagaaagccgggggaaacatttctgttggcgttttgaaccattttcacatgggacgcaacaagcctggttgcctaacacgttcgcccccttgggaacgtttcggagccaaaggaaggaattggggcccacacggggttggttttaccaagatttcactgcccctc

SEQ ID NO: 513183 - DNA, 585 bp, Homo sapiens
ggccgggcgcggtggctcacgcctgtaatcccagctctcagggaggctaagaggcgggaggatagcttgagcccaggagttcgagacctgcctgggcaatatagcgagaccccgtcccagaaaaaggaaaaaaaaaaaacaaaagacaaaaaaaaaaaaaaaaaaaaaaaaaaagtgtgtgggggcgcgcgcctggggccccggaaaagcctttggtgaacccattgtgcgtgtgtggggcgccgggggccccaagagagagtgtaagaggagaaaagaggtggcccaagagaggtgtgttcccacgagaggagaacaccgcggggcacgagagaaaagagaggacgggggagttctctgtcaccacaattgataaaaacaccgccgggggggggcaacacagagcgagcgcgcgctatcgtcgagaaaacaaacattctcaacagggggggagacaacaagcgagagggagcgccaaaacagaggggggcagactctatatacacacagacgaggagaagtccaagaagagaggagcaccgcgaatcatctacaatattaaggccccctcgcgcggggggggag

SEQ ID NO: 513184 - DNA, 239 bp, Homo sapiens
atggtatgaagggataacatcctgatgtctccattgaagctcctctgttgcaaaatactacttggcaaagttgctgctatttaaagtagtgagtttgatcttggactttgatctaaatcttttgatcttgaaagaaggatggcgtagcaataccgagagggcaagacagattttcttccaagaagtgtgataaagttaaggggatggtcaagatccagcaagtgactcggacaactcgt

SEQ ID NO: 513185 - DNA, 141 bp, Homo sapiens
ctggcggcgcgcgcccgattctagctgtggtaggcctcggcgactccaaccagttcttccgggacgtctacggcgagactttgagggccagagtcccaatgtgcacccttggatgtgcgggaacgggtaccgcagctcgaa

SEQ ID NO: 513186 - DNA, 437 bp, Homo sapiens
  misc_feature (377)..(377): n is a, c, g, or t
  misc_feature (401)..(401): n is a, c, g, or t
cttgatgcatttcttgtacagtgtaagggtctgtttttaacatcaccagcacagttttaagaatgtgacggttgctgagcggttcaggtcagcttaggaagaaaaagcctttgaaaatggaagttctgtaaacagaatttcaggtgttgcattcctgtcttaaacacatttctttaaatccacacaacggcagacttttctaccaggtaataagcattcgagataactgatagccagcataacttactgacttaccagttaagtatagtcatcacttactgtgaaattccagatgcctgccagctcagcttgtatcttcatccttcgagaagcatctcaacaggctgggtttccctgtgttggtttagaaagctttnctgcctgggcattaaagaaagaangtggccttgtgtctgctctggacagatcctggagga

SEQ ID NO: 513187 - DNA, 103 bp, Homo sapiens
catggatttgctggtccagtccaactaggcttaatagggactcgaattcgagcctcgaattcaagtttctaccgttagaagcttgaattcgagcagtagtagt

SEQ ID NO: 513188 - DNA, 949 bp, Homo sapiens
  misc_feature (949)..(949): n is a, c, g, or t
ggctgtgccgtcccacccgcccaacatggtgctcatccttgctgagacccctgcggtctgtgcccgcgccagccagctgccccggtgcacgcctgtagtcccagctcgcccggtgccacaagctctctgctgggtccatccctccccacctgggttcctgtctcctctgcatggccctgccggtgctcttcctgcagacgccgtcaaagcgtctgttcattgcatgaagttgaggcaggctgtggagtggactctaggccctgattgggccacaactttgtgtggctcacccaggccttagcctttccaggcacccttatcaagtgttgatcccttcccttccaccaaagagcaagttcccagtacgtcataccccgggtttgtgaaaacgatgccatgcttgttacataggtcttccctcagacaagggccactacaagctatttcccgcattcctattgacgcacttgagtctgggatgcccccatctttgtgtatgcaaaaagggattttctgtgggaaaaaaactggtcttttggcccccatttccacaaagatgggcgcgaattacgctcgggcaacccaacactgttggaaacccacctgggaagatatggcgggcccaccagaggaagagaggcacgagatgggacccattccattgggggacccaccccagtttgaaaacggtgcttggtgcttcgaaggcaacccttgtgcccctgtatgggacgagcagggacagggacaatggacgggctgttgaaacaaaaagtgattgagcaggtaccagctgtgcacaaggactatggcttcccccgcgttgtgactctaatagtggccatgggaccaagttggcaccatcaaatggcacaatagaggtgtggaccattgggcacagtgtggccttggcaagcaacttccctacccgcgaatttttaagataacn

SEQ ID NO: 513189 - DNA, 590 bp, Homo sapiens
atgaaaagaatacgggaactgtttacagaatgcgcgattgtgcaaaaatattagcaaagttgtatattgtctcgctgtacaacaatgaagaaataagattaggtcatttacaagaaatgttttacagattacaataggctataacttagtatattatgaataaaattgatggcacatcatacatttttacatcacagattcagtgttaaaagaattcagacatgataaagcttagacttgacaagaatgatgtcatagaatgaggcaactgaaactgaaatggcatgtgtaagtaaaattaatccccaaattaaaggattccttagattgggacataataacatctgctgagtacactttggtcaataactggtcataaagataaacgccattcaatattagttaaaaaatcagtttaatgctgtagtataaataaacaagtacaagcacacagtgtataaaaaataataaaaaccatcttaatattgcttacatcctaatactatcagttatattcggggacagcagactaggatattggtgtaactactataaagataccttctgtatctacatgctgtaactaaact

SEQ ID NO: 513190 - DNA, 103 bp, Homo sapiens
gggggggggcccccccccttttttaaaaaaccccctttttttttttccctttgaaaaaaaaacccgggtttttggggggttaaaaaaaaacccttggggggga

SEQ ID NO: 513191 - DNA, 311 bp, Homo sapiens
atgcccactctcaccactcctcttcaatgtagtactggaagtcctagccaaagcaatcagacaagagaaagaaataaagggcatctaaatcagtaaagaggaagtcaaactgtcactgtttgctgatgatgactgtttaccttgaaaaccctaaggactcctctagaaagctcctagaactgataaaagaattcagcaaagtttccgaatacaagattaatgtacacaaatcagtagctcatctatacaccaacagcaaccaagcagagaatcaaatcaagaactcaaccccttttacaatagctgcaaaa

SEQ ID NO: 513192 - DNA, 103 bp, Homo sapiens
gggctctcgagcgctgctctgagcagcgtcaccctttacaccagaaagctggcggcactatggggaaaaaacaaaacaagaagaaagtggaggaggtgctaga

SEQ ID NO: 513193 - DNA, 285 bp, Homo sapiens
  misc_feature (116)..(116): n is a, c, g, or t
cggctacagcatcacatccactaaatgcacagttgttgaagtcacgccctgccagacctctactaccacattgttccctccggtgaccagtttgtccgtcactgtcaggagaatgncccgtgtcgaatcatcgatctccatccgagccaaaagttttccatatgctgaaattactgaattgccctcgtttatagtatatgatacagtggccttcgttggaggcagatatcaagcatggggataagcagttttctggtccttaagggctctcagcaaatctccgtg

SEQ ID NO: 513194 - DNA, 500 bp, Homo sapiens
gcacgcggggagaatttacgcgtgaggctgtgagctctgaaacccactatatgagctcctttagagttattacacacacgagaacattgtgatacacagagatattctttctttttgtgacaaaacatatttcaaaacttaacttgtgaaggcaaaaattggtttaatacccgtttaaccattataaatatttcatgtgaaggaggaaaacactttggaaaaccaaaatgagatataaggcctatccagggtatattgagaaagtgttgagcttatattggaaattatatggttcaatttacaaggttcatggaaaaaaatttactataggttaacttcctgtgacacattgtgcattggaacacagaacactttgaagtgcactgtcacggtcagaactgtgttgcgaatactctaaatactctggatacacttaagcgcgaatgtgtgtggttaaccgtgggtgaggaaactctattataatttaattgtgaaacatg

SEQ ID NO: 513195 - DNA, 89 bp, Homo sapiens
agcggggcttgggtgtgagggtggcagccttgtgctcaagccgaggctgggctggaggatggagaaggacacggggaccacacacagga

SEQ ID NO: 513196 - DNA, 277 bp, Homo sapiens
gcaccaggtcgacgaaaaggagcgcgcgctcgcgaaattgcaacttcaactcgccgaacaagaggatctgattcgcaaagggttggtgcaagaggaaattgccatgctccgctctaccaaggagcagttggcggcgttgcgcgatgagcgggacaggctgcatctgtccaacgagggcgaacgtgcgcagctgatggaggccgctcgccgcgaatctgcgctgatcgtcgatcagggactttctctgaaggctcactgggaggggttgatctctgcc

SEQ ID NO: 513197 - DNA, 863 bp, Homo sapiens
aatatagtgggatcgtccggcttcggagcggcatatgcgttgtgccagaagtagtcacagagactggcatatgagtgatgtggagaaaggcacagaacgatttgtaataaatcggacagtgtccccatgtgccacgacacgtgtcatgaagggaggcaagcacatatgactggcccaaaatctccagtggtctcttatgcgcggaagacaggtcaggcccctgtgatactctgtagcacagagcgccaagtataggacactaccggcatcatttgtggaagaggatacacgtgatggagtcttgggagaactcctaggaagtacgtcccctgggattcagaacctgatctccgtcggcattaccacagaaggaggatagggcagactataatagcttatctcaaaagaaggctactaatgatgtccctacatgggccatgtgcgttattattacaataagagacattgtctcttgactggttatgttgtaccactcctttattatgatctcatacccagaatttcagatcatgattgctgtccgacttctttggtcgcggcgtcctgattttcctactgatactggctgtggcttcatgtatctggtgcagtttaaggatttctatgtaggtacttcccatcccaatgctctggtgtccctggcacccgtttttcagatttgagttggacttcgtctgaagatgttctctttccaaagaatggccagtgccactttagactacggggcgggcaaattgacctcatactggtttggcaacgcttattgtgcaaagcttttcgttttaaccagcggaacacggggtgtgagagcatggcctaagcagggggcaaaacggaggcta

SEQ ID NO: 513198 - DNA, 1596 bp, Homo sapiens
gccaccgcggacgagcgcggagttctggagtctcggacccgaagccgccacagggcgccccgcctcccgcccgccatgcccgcgccccgcgccccgcgcgctctggcggccgccgcgcccgcgtccgggaaggccaagctgacgcacccggggaaggcgatcctggcaggcggcctggcgggtggcatcgagatctgcatcaccttccccaccgagtacgtgaagacgcagctgcagctggacgagcgctcgcacccgccgcggtaccggggcatcggggactgcgtgcggcagacggttcgcagccatggcgtcctgggcctgtaccgcggccttagctccctgctctacggttccatccccaaggcggccgtcaggtttggaatgttcgagttcctcagcaaccacatgcgggatgcccagggacggctggacagcacgcgtgggctgctgtgcggcctgggcgctggcgtggccgaggccgtggtggtcgtgtgccccatggagaccatcaaggtgaagttcatccacgaccagacctccccaaaccccaagtacagaggattcttccacggggttagggagattgtgcgggaacaagggctgaaggggacgtaccagggcctcacagccactgtcctgaagcagggctcgaaccaggccatccgcttcttcgtcatgacctccctgcgcaactggtaccgaggggacaaccccaacaagcccatgaaccctctgatcactggggtcttcggagctattgcaggcgcagccagtgtctttggaaacactcctctggatgtgattaagacccggatgcagggcctggaggcgcacaaataccggaacacgtgggactgcggcttgcagatcctgaagaaggaggggctcaaggcattctacaagggcactgtcccccgcctgggccgggtctgcctggatgtggccatagtgtttgtcatctatgatgaagtggtgaagctgctcaacaaagtgtggaagacggactaagcctagagaggccgcaaggggaccgccccaggcaccgccagagtgtcctgctacctttgtctcacatgattccagtgcagtagtgccaaaaggccccttcccacgtccctcgagctctgtagcctggtctgtgcattgtggctgtcaaatccatgtgtcccccctgtggtctgtgtgtgacaccaccactgtgtcccagtgtctggcccagccatggctggatgtgcatctggcctatgaccctgtgcccacttgtccatgtgcttactgtgaaccctgtgcctgtgtttcatgttctgtgtcacgtgaccctgtgccccgcctcccggggtgcccgtgtggcctgggtcctcggccctgtagccctggcccggtcccagtccggtgccttccaccctgccctggcctaccacagctgcctccgggcctcggcctggcttcaccgcattccaggggctgcagccccctgcttctcccgccattggccttaactggccctcgggccctctctccgccccggacagggtggcacccaccactctcaggaccaccctgccaaggcagaataaaccggatcctgttgca

SEQ ID NO: 513199 - DNA, 446 bp, Homo sapiens
ccgatgacaagtacttctttatgtccgatatagacatgctgaggcaagcaacgctggcgatatggagagcttgctcaagaccatgatcaatcattagatctagaacgttaagatcatgtccttggctgagaacgatctagattagacttgccttgattgtactagagtaagtaaattttgtactgaggatgactataagtgatcagaatcagaggcttgtgtgacagcagaaactcaccaaattccagctggtagcatgtactaggcgtgaactgagatccaagattaagatggcttagttaagccggacattattctgtcaaagaagatgaactatagaaagctctattacaaccaggtacgcaaaggctacttccttatccagacacgaggtcagtgactattagaggccagccgtgcattacgtctttatgagctgacagcct

SEQ ID NO: 513200 - DNA, 885 bp, Homo sapiens
  misc_feature (532)..(532): n is a, c, g, or t
  misc_feature (885)..(885): n is a, c, g, or t
gcagcagtcctggagctgtgaggagatacgggaccgtcaccctgcctcgcctgcgtcccgccgacgggcgcttctgtcctctggacccattccaacaattctcgtaaaacatggtggagttactatgaacgttcgtaggctcgtgcagcagacatgcgctctgcccggagggatagttacaaagaggcatatcgtgacaactggctactgaagtggcatccagataaaaatcctgagaagtaaagaagaagctagcagcagaaaattcaagcaagtagcggaggcatatgaagtgctgtcggatgctaaggaaacgggatcatctatgatcaaatatggtcagaagaaggattaaagtggtggagggaggaggtgggaagtcatttttgacagtccatttgaatttgggcttcactattccgtaacccagatgatgtcttcagggaattttttggtggaagggacccattttcatttgacttctttgaagacccttttgaggacttctttgggaatcgaaggggtccccgangaagcagaagccgagggacggggtcgtttttgtctgcgttcagtggatttccgtcttttgtaagtggatggtcttctatggatgcaggatttacttcattggggtcactgggtcacggggtcctcactctattctcttccacgtcatttggtggtagtggcatgggcaactataaatcgatatcaacttccactaaattggttaatggcagaccaatcactacaaagagaattgttgataacagtcaagacagagtacaagttgaagatgatggccagttaaagttcttaactattggttatgagcagctgctgtgcttggataacaagtgattcaacgcacgcgcttagctn

SEQ ID NO: 513201 - DNA, 1625 bp, Homo sapiens
  misc_feature (1609)..(1610): n is a, c, g, or t
gccaccgcggacgagcgcggagttctggagtctcggacccgaagccgccacagggcgccccgcctcccgcccgccatgcccgcgccccgcgccccgcgcgctctggcggccgccgcgcccgcgtccgggaaggccaagctgacgcacccggggaaggcgatcctggcaggcggcctggcgggtggcatcgagatctgcatcaccttccccaccgagtacgtgaagacgcagctgcagctggacgagcgctcgcacccgccgcggtaccggggcatcggggactgcgtgcggcagacggttcgcagccatggcgtcctgggcctgtaccgcggccttagctccctgctctacggttccatccccaaggcggccgtcaggtttggaatgttcgagttcctcagcaaccacatgcgggatgcccagggacggctggacagcacgcgtgggctgctgtgcggcctgggcgctggcgtggccgaggccgtggtggtcgtgtgccccatggagaccatcaaggtgaagttcatccacgaccagacctccccaaaccccaagtacagaggattcttccacggggttagggagattgtgcgggaacaagggctgaaggggacgtaccagggcctcacagccactgtcctgaagcagggctcgaaccaggccatccgcttcttcgtcatgacctccctgcgcaactggtaccgaggggacaaccccaacaagcccatgaaccctctgatcactggggtcttcggagctattgcaggcgcagccagtgtctttggaaacactcctctggatgtgattaagacccggatgcagggcctggaggcgcacaaataccggaacacgtgggactgcggcttgcagatcctgaagaaggaggggctcaaggcattctacaagggcactgtcccccgcctgggccgggtctgcctggatgtggccatagtgtttgtcatctatgatgaagtggtgaagctgctcaacaaagtgtggaagacggactaagcctagagaggccgcaaggggaccgccccaggcaccgccagagtgtcctgctacctttgtctcacatgattccagtgcagtagtgccaaaaggccccttcccacgtccctcgagctctgtagcctggtctgtgcattgtggctgtcaaatccatgtgtcccccctgtggtctgtgtgtgacaccaccactgtgtcccagtgtctggcccagccatggctggatgtgcatctggcctatgaccctgtgcccacttgtccatgtgcttactgtgaaccctgtgcctgtgtttcatgttctgtgtcacgtgaccctgtgccccgcctcccggggtgcccgtgtggcctgggtcctcggccctgtagccctggcccggtcccagtccggtgccttccaccctgccctggcctaccacagctgcctccgggcctcggcctggcttcaccgcattccaggggctgcagccccctgcttctcccgccattggccttaactggccctcgggccctctctccgccccggacagggtggcacccacgagcgtgccttcattgaaacccaacctcggggggggctacaatgggtccaatgataaaatannccccaggtacacggg

SEQ ID NO: 513202 - DNA, 150 bp, Homo sapiens
gtcagtgtctctgacagcttatactaaattataagaggactgagctcattcagtccttgtgtgctgcagactacggtgatgtcaatcgcagtcccctacacaggacctttttgggtataatagtataattgggatgcactgggtccctct

SEQ ID NO: 513203 - DNA, 1608 bp, Homo sapiens
gccaccgcggacgagcgcggagttctggagtctcggacccgaagccgccacagggcgccccgcctcccgcccgccatgcccgcgccccgcgccccgcgcgctctggcggccgccgcgcccgcgtccgggaaggccaagctgacgcacccggggaaggcgatcctggcaggcggcctggcgggtggcatcgagatctgcatcaccttccccaccgagtacgtgaagacgcagctgcagctggacgagcgctcgcacccgccgcggtaccggggcatcggggactgcgtgcggcagacggttcgcagccatggcgtcctgggcctgtaccgcggccttagctccctgctctacggttccatccccaaggcggccgtcaggtttggaatgttcgagttcctcagcaaccacatgcgggatgcccagggacggctggacagcacgcgtgggctgctgtgcggcctgggcgctggcgtggccgaggccgtggtggtcgtgtgccccatggagaccatcaaggtgaagttcatccacgaccagacctccccaaaccccaagtacagaggattcttccacggggttagggagattgtgcgggaacaagggctgaaggggacgtaccagggcctcacagccactgtcctgaagcagggctcgaaccaggccatccgcttcttcgtcatgacctccctgcgcaactggtaccgaggggacaaccccaacaagcccatgaaccctctgatcactggggtcttcggagctattgcaggcgcagccagtgtctttggaaacactcctctggatgtgattaagacccggatgcagggcctggaggcgcacaaataccggaacacgtgggactgcggcttgcagatcctgaagaaggaggggctcaaggcattctacaagggcactgtcccccgcctgggccgggtctgcctggatgtggccatagtgtttgtcatctatgatgaagtggtgaagctgctcaacaaagtgtggaagacggactaagcctagagaggccgcaaggggaccgccccaggcaccgccagagtgtcctgctacctttgtctcacatgattccagtgcagtagtgccaaaaggccccttcccacgtccctcgagctctgtagcctggtctgtgcattgtggctgtcaaatccatgtgtcccccctgtggtctgtgtgtgacaccaccactgtgtcccagtgtctggcccagccatggctggatgtgcatctggcctatgaccctgtgcccacttgtccatgtgcttactgtgaaccctgtgcctgtgtttcatgttctgtgtcacgtgaccctgtgccccgcctcccggggtgcccgtgtggcctgggtcctcggccctgtagccctggcccggtcccagtccggtgccttccaccctgccctggcctaccacagctgcctccgggcctcggcctggcttcaccgcattccaggggctgcagccccctgcttctcccgccattggccttaactggccctcgggccctctctccgccccggacagggtggcacccactaggacacctggcaggaataacggatctgtgaaaaaaaaaaaagggggggataaatacacc

SEQ ID NO: 513204 - DNA, 540 bp, Homo sapiens
  misc_feature (34)..(34): n is a, c, g, or t
  misc_feature (43)..(44): n is a, c, g, or t
  misc_feature (88)..(88): n is a, c, g, or t
  misc_feature (475)..(475): n is a, c, g, or t
ggaccatcatcctaaattattatgaatggaaacngtaaactannacgttcatatccactccccaagattacatcaagagtggcaggcntgggacaccagagtttccggaatggctcctcagggctccagctgcaacaaactcgctgtgccaatgtgcatgcagttcctgattctaatcaaataagtatcataaccgagttcacccgaaatagagtatactgcacagaaacttaataatgggtgagaaagacacattcgtgacattagcaattattaccatacgtggtcaaatccatttttattttctgttttctcatttagtgagtcctctgggatctacacacaggtaccaattttttgcctattcctggcaccgcgcactgcttaatcatcctccccacactgactttgttgaccatgctcgattgtcaataccaatagttctccaggggtggctcaggtacccacaggggtncctgagatcctttaagggtctgcgagatcaaacaattttcataataatttaggatgatggtaccg

SEQ ID NO: 513205 - DNA, 1361 bp, Homo sapiens
gccaccgcggacgagcgcggagttctggagtctcggacccgaagccgccacagggcgccccgcctcccgcccgccatgcccgcgccccgcgccccgcgcgctctggcggccgccgcgcccgcgtccgggaaggccaagctgacgcacccggggaaggcgatcctggcaggcggcctggcgggtggcatcgagatctgcatcaccttccccaccgagtacgtgaagacgcagctgcagctggacgagcgctcgcacccgccgcggtaccggggcatcggggactgcgtgcggcagacggttcgcagccatggcgtcctgggcctgtaccgcggccttagctccctgctctacggttccatccccaaggcggccgtcaggtttggaatgttcgagttcctcagcaaccacatgcgggatgcccagggacggctggacagcacgcgtgggctgctgtgcggcctgggcgctggcgtggccgaggccgtggtggtcgtgtgccccatggagaccatcaaggtgaagttcatccacgaccagacctccccaaaccccaagtacagaggattcttccacggggttagggagattgtgcgggaacaagggctgaaggggacgtaccagggcctcacagccactgtcctgaagcagggctcgaaccaggccatccgcttcttcgtcatgacctccctgcgcaactggtaccgaggggacaaccccaacaagcccatgaaccctctgatcactggggtcttcggagctattgcaggcgcagccagtgtctttggaaacactcctctggatgtgattaagacccggatgcagggcctggaggcgcacaaataccggaacacgtgggactgcggcttgcagatcctgaagaaggaggggctcaaggcattctacctacctttgtctcacatgattccagtgcagtagtgccaaaaggccccttcccacgtccctcgagctctgtagcctggtctgtgcattgtggctgtcaaatccatgtgtcccccctgtggtctgtgtgtgacaccaccactgtgtcccagtgtctggcccagccatggctggatgtgcatctggcctatgaccctgtgcccacttgtccatgtgcttactgtgaaccctgtgcctgtgtttcatgttctgtgtcacgtgaccctgtgccccgcctcccggggtgcccgtgtggcctgggtcctcggcctggcttcaccgcattccaggggctgcagccccctgcttctcccgccattggccttaactggccctcgggccctctctccgccccggacagggtggcacccaccactctcaggaccaccctgccaaggcagaataaaccggatcctgttgca

SEQ ID NO: 513206 - DNA, 290 bp, Homo sapiens
  misc_feature (62)..(62): n is a, c, g, or t
  misc_feature (159)..(159): n is a, c, g, or t
  misc_feature (164)..(164): n is a, c, g, or t
  misc_feature (182)..(182): n is a, c, g, or t
  misc_feature (225)..(225): n is a, c, g, or t
gcatacttgacaactgtggactcccagttttgttggagaattgtttttcttaacattacttnagggcttaataatggagatgtaaacttcatggatgtcttcggattagattccatgtagttatttcctttaaaccatcagccgcccttttatatggtnttcantctgactagaatttagtntctgtgtcagcacagtgtaatctctattgctattgccccttangactctcaccctctccccactttttttaaaaattttaaccagaaaataaagatagttaaatccct

SEQ ID NO: 513207 - DNA, 1761 bp, Homo sapiens
gccaccgcggacgagcgcggagttctggagtctcggacccgaagccgccacagggcgccccgcctcccgcccgccatgcccgcgccccgcgccccgcgcgctctggcggccgccgcgcccgcgtccgggaaggccaagctgacgcacccggggaaggcgatcctggcaggcggcctggcgggtggcatcgagatctgcatcaccttccccaccgagtacgtgaagacgcagctgcagctggacgagcgctcgcacccgccgcggtaccggggcatcggggactgcgtgcggcagacggttcgcagccatggcgtcctgggcctgtaccgcggccttagctccctgctctacggttccatccccaaggcggccgtcaggtttggaatgttcgagttcctcagcaaccacatgcgggatgcccagggacggctggacagcacgcgtgggctgctgtgcggcctgggcgctggcgtggccgaggccgtggtggtcgtgtgccccatggagaccatcaaggtgaagttcatccacgaccagacctccccaaaccccaagtacagaggattcttccacggggttagggagattgtgcgggaacaagggctgaaggggacgtaccagggcctcacagccactgtcctgaagcagggctcgaaccaggccatccgcttcttcgtcatgacctccctgcgcaactggtaccgaggggacaaccccaacaagcccatgaaccctctgatcactggggtcttcggagctattgcaggcgcagccagtgtctttggaaacactcctctggatgtgattaagacccggatgcagggcctggaggcgcacaaataccggaacacgtgggactgcggcttgcagatcctgaagaaggaggggctcaaggcattctacaagggcactgtcccccgcctgggccgggtctgcctggatgtggccatagtgtttgtcatctatgatgaagtggtgaagctgctcaacaaagtgtggaagacggactaagcctagagaggccgcaaggggaccgccccaggcaccgccagagtgtcctgctacctttgtctcacatgattccagtgcagtagtgccaaaaggccccttcccacgtccctcgagctctgtagcctggtctgtgcattgtggctgtcaaatccatgtgtcccccctgtggtctgtgtgtgacaccaccactgtgtcccagtgtctggcccagccatggctggatgtgcatctggcctatgaccctgtgcccacttgtccatgtgcttactgtgaaccctgtgcctgtgtttcatgttctgtgtcacgtgaccctgtgccccgcctcccggggtgcccgtgtggcctgggtcctcggccctgtagccctggcccggtcccagtccggtgccttccaccctgccctggcctaccacagctgcctccgggcctcggcctggcttcaccgcattccaggggctgcagccccctgcttctcccgccattggccttaactggccctcgggccctctctccgccccggacagggtggcacccaccactctcaggaccaccctgccaaggcagaataaaccggatcctgttgcaaaaaaaaacaaaaaaaaaaaaaaccgggggcatctaggcgggggggggaaaaaggggcatggcacggggcccggggcaaaagaggtcctggaccagttttctggcccacggggacactgggaggccccaaaaggaggccgaaaatccgaaaagcggggacggacg

SEQ ID NO: 513208 - DNA, 910 bp, Homo sapiens
ggtcctcatgcatgctcctcatgcatggtcctcatggatccggggtcctcatggattccggggtcctcatggatcccgggtctgcctggatgtggccatagtgtttgtcatctatgatgaagtggtgaagctgctcaacaaagtgtggaagacggactaagcctagagaggccgcaaggggaccgccccaggcaccgccagagtgtcctgctacctttgtctcacatgattccagtgcagtagtgccaaaaggccccttcccacgtccctcgagctctgtagcctggtctgtgcattgtggctgtcaaatccatgtgtcccccctgtggtctgtgtgtgacaccaccactgtgtcccagtgtctggcccagccatggctggatgtgcatctggcctatgaccctgtgcccacttgtccatgtgcttactgtgaaccctgtgcctgtgtttcatgttctgtgtcacgtgaccctgtgccccgcctcccggggtgcccgtgtggcctgggtcctcggccctgtagccctggcccggtcccagtccggtgccttccaccctgccctggcctaccacagctgcctccgggcctcggcctggcttcaccgcattccaggggctgcagccccctgcttctcccgccattggccttaactggccctcgggccctctctccgccccggacagggtggcacccaccactctcaggaccaccctgccaaggcagaataaaccggatcctgttgcaaaaaaaaacaaaaaaaaaaaaaaccgggggcatctaggcgggggggggaaaaaggggcatggcacggggcccggggcaaaagaggtcctggaccagttttctggcccacggggacactgggaggccccaaaaggaggccgaaaatccgaaaagcggggacggacg

SEQ ID NO: 513209 - DNA, 148 bp, Homo sapiens
gcacggagctcggcccgcgtgagggccctcccctccccgccgttccctcctccgtcagccccgcaccgcccgggagagacggtttgccaggcctggggcgggcggggaggcctcggggaagggggggcccgctcctcaggcgccgagg

SEQ ID NO: 513210 - DNA, 1603 bp, Homo sapiens
gccaccgcggacgagcgcggagttctggagtctcggacccgaagccgccacagggcgccccgcctcccgcccgccatgcccgcgccccgcgccccgcgcgctctggcggccgccgcgcccgcgtccgggaaggccaagctgacgcacccggggaaggcgatcctggcaggcggcctggcgggtggcatcgagatctgcatcaccttccccaccgagtacgtgaagacgcagctgcagctggacgagcgctcgcacccgccgcggtaccggggcatcggggactgcgtgcggcagacggttcgcagccatggcgtcctgggcctgtaccgcggccttagctccctgctctacggttccatccccaaggcggccgtcaggtttggaatgttcgagttcctcagcaaccacatgcgggatgcccagggacggctggacagcacgcgtgggctgctgtgcggcctgggcgctggcgtggccgaggccgtggtggtcgtgtgccccatggagaccatcaaggtgaagttcatccacgaccagacctccccaaaccccaagtacagaggattcttccacggggttagggagattgtgcgggaacaagggctgaaggggacgtaccagggcctcacagccactgtcctgaagcagggctcgaaccaggccatccgcttcttcgtcatgacctccctgcgcaactggtaccgaggggacaaccccaacaagcccatgaaccctctgatcactggggtcttcggagctattgcaggcgcagccagtgtctttggaaacactcctctggatgtgattaagacccggatgcagggcctggaggcgcacaaataccggaacacgtgggactgcggcttgcagatcctgaagaaggaggggctcaaggcattctacctacctttgtctcacatgattccagtgcagtagtgccaaaaggccccttcccacgtccctcgagctctgtagcctggtctgtgcattgtggctgtcaaatccatgtgtcccccctgtggtctgtgtgtgacaccaccactgtgtcccagtgtctggcccagccatggctggatgtgcatctggcctatgaccctgtgcccacttgtccatgtgcttactgtgaaccctgtgcctgtgtttcatgttctgtgtcacgtgaccctgtgccccgcctcccggggtgcccgtgtggcctgggtcctcggccctgtagccctggcccggtcccagtccggtgccttccaccctgccctggcctaccacagctgcctccgggcctcggcctggcttcaccgcattccaggggctgcagccccctgcttctcccgccattggccttaactggccctcgggccctctctccgccccggacagggtggcacccaccactctcaggaccaccctgccaaggcagaataaaccggatcctgttgcaaaaaaaaacaaaaaaaaaaaaaaccgggggcatctaggcgggggggggaaaaaggggcatggcacggggcccggggcaaaagaggtcctggaccagttttctggcccacggggacactgggaggccccaaaaggaggccgaaaatccgaaaagcggggacggacg

SEQ ID NO: 513211 - DNA, 1562 bp, Homo sapiens
gccaccgcggacgagcgcggagttctggagtctcggacccgaagccgccacagggcgccccgcctcccgcccgccatgcccgcgccccgcgccccgcgcgctctggcggccgccgcgcccgcgtccgggaaggccaagctgacgcacccggggaaggcgatcctggcaggcggcctggcgggtggcatcgagatctgcatcaccttccccaccgagtacgtgaagacgcagctgcagctggacgagcgctcgcacccgccgcggtaccggggcatcggggactgcgtgcggcagacggttcgcagccatggcgtcctgggcctgtaccgcggccttagctccctgctctacggttccatccccaaggcggccgtcaggtttggaatgttcgagttcctcagcaaccacatgcgggatgcccagggacggctggacagcacgcgtgggctgctgtgcggcctgggcgctggcgtggccgaggccgtggtggtcgtgtgccccatggagaccatcaaggtgaagttcatccacgaccagacctccccaaaccccaagtacagaggattcttccacggggttagggagattgtgcgggaacaagggctgaaggggacgtaccagggcctcacagccactgtcctgaagcagggctcgaaccaggccatccgcttcttcgtcatgacctccctgcgcaactggtaccgaggggacaaccccaacaagcccatgaaccctctgatcactggggtcttcggagctattgcaggcgcagccagtgtctttggaaacactcctctggatgtgattaagacccggatgcagggcctggaggcgcacaaataccggaacacgtgggactgcggcttgcagatcctgaagaaggaggggctcaaggcattctacaagggcactgtcccccgcctgggccgggtctgcctggatgtggccatagtgtttgtcatctatgatgaagtggtgaagctgctcaacaaagtgtggaagacggactaagcctagagaggccgcaaggggaccgccccaggcaccgccagagtgtcctgctacctttgtctcacatgattccagtgcagtagtgccaaaaggccccttcccacgtccctcgagctctgtagcctggtctgtgcattgtggctgtcaaatccatgtgtcccccctgtggtctgtgtgtgacaccaccactgtgtcccagtgtctggcccagccatggctggatgtgcatctggcctatgaccctgtgcctgtgtttcatgttctgtgtcacgtgaccctgtgccccgcctcccggggtgcccgtgtggcctgggtcctcggccctgtagccctggcccggtcccagtccggtgccttccaccctgccctggcctaccacagctgcctccgggcctcggcctggcttcaccgcattccaggggctgcagccccctgcttctcccgccattggccttaactggccctcgggccctctctccgccccggacagggtggcacccaccactctcaggaccaccctgccaaggcagaataaaccggatcctgttgca

SEQ ID NO: 513212 - DNA, 637 bp, Homo sapiens
catctacctcctatctacctatcgtctacatacctacctactcaattatcatctagctagctagctatttacacctttttgttttctacaaatgggcatgttgtctgaataacaatctctgaatgtccagtccacttcattcattcattcagtcaacacaaatttgcttagcagtttttatgtcccgggtccaagggcctgggtacaataattaattagacacaatcccttccctaggaatgttcccaatcctggcagaacacaaactcacatagaggcactcacaggcaaaccacaaacacacatgcccacttagccccccacacaggcctgtatacccagaggcgtctatccacaccaacacacacattctaacagacacacatatcaacctcacgtgcccaaaggcacagatgcacatgcagaaagcctcagagaccctcaagtcagccacttacatatttattgtcatgaattactttgtaacaaccaatattttttaacaccccctacgtataaggcattattttaagtgcattttgggcattatatcattccaccctcacattagacattgaaggtagccactattattaccttcaatttagtgacgagtaaaccggcctcgtgccgaatt

SEQ ID NO: 513213 - DNA, 125 bp, Homo sapiens
catgttttttgctactcagagcagtctggaatatagaagcggatggttggggggaagtaagtaactggagtgtgtctttagtccaggtgccccaggctgctaaaattataattttttttctttga

SEQ ID NO: 513214 - DNA, 822 bp, Homo sapiens
tcggcatgtacgaggctgggttttagctcacgcggcctgggtgcatgcggtccggtgtggatcaatggagacgcgcaccctgccacctgcgttccctgagactttctggcacctgcaccgcgcgctgcagtgcgcgcttctgatgactgtgccagtgttcctggagcatttgctccatgccctcgcctgcctgctgtggccccgtgtgtggcccctgtgtgcttgctgctgctgctgcctgaccccctgctgtggtcttgtctctccaacttgcagctgtgtcctgcctgtcttctgagctgctgtcctcatgctgcctgtgtgcctgcctatgccactgccctgcctctgcctgcctctgcttggtgccatgctgctgtcttactacacttgcccatgcactgctgcatgctccccctgcgcactcctgcttgagccatgcttgcgtactgtgtgctctgtggccgatcacctgtgctgctgagccctgctgctgctcacggggtgtgctgtgcgcctagtgccagcttgtgctgggatcctgcacatgctgaccttcctgcagcaactgcgggtggacttggccctgctgcctcggagagagcttcctcccacaccctgagtgagccacgcccttgaagaacttacctctgctaatgacgggaggacactgtcccctgtgcatcctaggcagacttgtgtcttgaatgagctggtggaagaacagtgccgcacagtggctatgacccaactggacactgtctgttactgaggatccctctctgtgctgctagctgcaaggactatgcattggcgagaagc

SEQ ID NO: 513215 - DNA, 81 bp, Homo sapiens
gatgtgatcatgcccccttagcgggtatgtttgagggagggacagaggttcggttttcccttcttttcatcccccccccca

SEQ ID NO: 513216 - DNA, 1727 bp, Homo sapiens
gccaccgcggacgagcgcggagttctggagtctcggacccgaagccgccacagggcgccccgcctcccgcccgccatgcccgcgccccgcgccccgcgcgctctggcggccgccgcgcccgcgtccgggaaggccaagctgacgcacccggggaaggcgatcctggcaggcggcctggcgggtggcatcgagatctgcatcaccttccccaccgagtacgtgaagacgcagctgcagctggacgagcgctcgcacccgccgcggtaccggggcatcggggactgcgtgcggcagacggttcgcagccatggcgtcctgggcctgtaccgcggccttagctccctgctctacggttccatccccaaggcggccgtcaggtttggaatgttcgagttcctcagcaaccacatgcgggatgcccagggacggctggacagcacgcgtgggctgctgtgcggcctgggcgctggcgtggccgaggccgtggtggtcgtgtgccccatggagaccatcaaggtgaagttcatccacgaccagacctccccaaaccccaagtacagaggattcttccacggggttagggagattgtgcgggaacaagggctgaaggggacgtaccagggcctcacagccactgtcctgaagcagggctcgaaccaggccatccgcttcttcgtcatgacctccctgcgcaactggtaccgaggggacaaccccaacaagcccatgaaccctctgatcactggggtcttcggagctattgcaggcgcagccagtgtctttggaaacactcctctggatgtgattaagacccggatgcagggcctggaggcgcacaaataccggaacacgtgggactgcggcttgcagatcctgaagaaggaggggctcaaggcattctacaagggcactgtcccccgcctgggccgggtctgcctggatgtggccatagtgtttgtcatctatgatgaagtggtgaagctgctcaacaaagtgtggaagacggactaagcctagagaggccgcaaggggaccgccccaggcaccgccagagtgtcctgctacctttgtctcacatgattccagtgcagtagtgccaaaaggccccttcccacgtccctcgagctctgtagcctggtctgtgcattgtggctgtcaaatccatgtgtcccccctgtggtctgtgtgtgacaccaccactgtgtcccagtgtctggcccagccatggctggatgtgcatctggcctatgaccctgtgcctgtgtttcatgttctgtgtcacgtgaccctgtgccccgcctcccggggtgcccgtgtggcctgggtcctcggccctgtagccctggcccggtcccagtccggtgccttccaccctgccctggcctaccacagctgcctccgggcctcggcctggcttcaccgcattccaggggctgcagccccctgcttctcccgccattggccttaactggccctcgggccctctctccgccccggacagggtggcacccaccactctcaggaccaccctgccaaggcagaataaaccggatcctgttgcaaaaaaaaacaaaaaaaaaaaaaaccgggggcatctaggcgggggggggaaaaaggggcatggcacggggcccggggcaaaagaggtcctggaccagttttctggcccacggggacactgggaggccccaaaaggaggccgaaaatccgaaaagcggggacggacg

SEQ ID NO: 513217 - DNA, 616 bp, Homo sapiens
cccgctgactcacgtatgttcaccaggctgtgccttaggcgccgggccgtgcgacggcatgacttcgtctgcggtttcgccgaacccatcgccgccacagcagccaacgcggccgccgcaccacgcggacccccctgcccgttgtgctgacgaccatcctgggctgtagcaccctgtccagactggcctgcccgaccagactggcccgattgaccggcaccggtccccgcgccaacaccgctgcctggcccagccccagcaccagctgcgttaccggctgccgcaacgtacggccgcgccaacaaatgcgcacacaaaatttccagcaataactgtggcgaggtggcgccacgcatctgcggcaatcgctcgtttactacgtccgcataatgcgtcagcgcctccgggctaaaccacccagcttgttccttcaacaccgccacgcgatcctgcggggcagacaccagcccctcatcgaaagcctcgggcacagcttggattatcagcagatcccgcaggcggtccagcaagtcttccacgaaacggcgtggctcgtgcccagcattgatgacgtcgttgacgatgcggaataattcgcctttttcgtcgtcggcca

SEQ ID NO: 513218 - DNA, 163 bp, Homo sapiens
cccaacgcgtccgggcatatgtcatcttattgcgttttgctttattgcacctttgcacaataatgcacttttttacacaatggaaggtttatggcaactctgcgttgagccacgtctaattggtgccatgtttcccataaaacttctcctttcatgtctcgta

SEQ ID NO: 513219 - DNA, 385 bp, Homo sapiens
tgtgtcgggggacagagggaccattttagaaagataccaaagtaaagtcaaaagaaagacatgtggctataggcgtggtggctcatgcctataatcccagcactttgggaagccggggtaggaggatcaccagaggccagcaggtccacaccagcctgggcaacacagcaagacaccgcatctacagaaaaattttaaaattagctgggcgtggtggtgtgtacctgtaggcctagctgctcaggaggctgaagcaggaggatcacttgagcctgagttcaacactgcagtgagctatggtggcaccactgcactccagcctgggtgacagagcaagaccctgtctctaaaataaattttaaaaagacatattaaaaaaaaaaaa

SEQ ID NO: 513220 - DNA, 102 bp, Homo sapiens
ccgagcttgagcagtatgaccccccggagttggctgacagcagtggccgagtggtcagagataagtggtcagcagacatgtggcgcttgggctgcctcatta

SEQ ID NO: 513221 - DNA, 484 bp, Homo sapiens
actcgaaatgttgctaacatcatgctcaacaatgagccctggaaaattcctggaatggattattaacacatgagagtctgtaagacactctagaaacagggcacggtgatgtcccatggggccagcacgtgctcgcaactgtacaggcatttgctctttgtaacacggattagatagcctgctcgtgcccaggtgagaacatgcagcacacgcgcatctcgtagtcagcagagattttgacgtgcttctaacaaacatcttgtagacgacgatggagctatgggggttggaggagagaacatataggaaaaatcagagccaaatgaaccacagccccaaagggcacagttgaacaatggactgattccagccttgcacggagggatctggcagagtccatccagttcattcaacacctggttagaaaactggggccagcacacagggaaagggtaagctggtttcatgatcgtatcaatgcgca

SEQ ID NO: 513222 - DNA, 380 bp, Homo sapiens
aagggggcagacgcgaatccggctccttagtggcaatggcctgtgcacaggaagctgccaagtcctgagtgccgcgtcctctggcccgaggtcgctcctgcaggtccgggggacgccctccaaccccagcccagctcctctgagtgccacatccactggcctgaggtcacccctgcaggcccgggggatgccctctgaccccagccctggcgctgcctgctcctgtgtctgcctctctcctgcacccacctctgccagctttcgtttgtccatcagctcggtggcttcttgggcctccagcttgtgaatctctgtccttgcctttgagatttccctctgccgttccatttccaggctctcttcccggaccctctcgccga

SEQ ID NO: 513223 - DNA, 193 bp, Homo sapiens
gactgtacctctgcacgagacatctgtagtatctgtatgtactacagccgtctctagcagatataaaaagagacaaggaacccaagaatatgaaagttcatcatggcaccgacgattctctactgcctatacttgcccttagccaaacgaaagtgtgacattctcatgattaccacgcattggacctacaaaa

SEQ ID NO: 513224 - DNA, 873 bp, Homo sapiens
tgatgtgaatggacagtttctatgcttttccttttttccatcccttccctaccatcaaaagcatacctgctctaattaaaaaaaaaaaaaaaaaaaattcaagttctcagcgtgaattgggtgggtaagccgcacttagcaaggggtataccattagctaagtggtatatttctatttacaatacgggaagctccttaaattttactatttagaaacacgtggtacaataactcgcgggcgtaacacatttttggacagaatttatctcttttgggggtggcaggggggtgctactacactttagtgttcttgggtgaaaataccacgtggggggggctcctctccttacaacaacctttgtggaactaaaaaacaaaacttcaaatctcttctccaccgtggtcgggggaaattccccttttcaggtctttccagcatttggcattgggagggggtccctcttgggattttctcatatttaccatgtgctcaaaatttacttgcgggcgtactcaataaataagcctccaagagttcccccatttataatgtcttcaaacactggggctactgcaggggggtcccaaatccgggcttgggtcaccacttggggggcctttcaaactcctttccaatctgggggtatggctggtcggacccttttggcgagggtcttacagcgccttgggtcaagcggcgaatgggcccattgtccgaccttgatggggcggtacccacgcgcatggtgtctgtcaacacccggttgatccggaaagggccccttttttgactgtttcctgggcttgcttgtccggattttgcctttggcccctatttggggttttgccgcggcaatgcctcctcatgcggtc

SEQ ID NO: 513225 - DNA, 476 bp, Homo sapiens
tcaagaccataaactggactctgctggaaaagcggaggttggagccacccttcaggcccaaagtgaagtcacccagagactacagtaactttgaccaggagttcctggacgagaagggggggcttttccaaaagggacaagaacctcatcgactccatggaccagtctgcattcgctggcttctccttggtgaaccccaattcggggaacttctggaagattgagggtcctgggaagattagggtagccctggcttcaacccaaacctgcccgctccccacgataagcaccattgggactgtggtgacttggtgctggccccgccctgggcccaaaaagttccttggtggcgtgtgggcggggtctcaagggaaattccctgtgagaagtgtgtgaaaatgggtttcctctgacttcgggaggggaatagtgaaacccgtgtgtcacaacatgaatgtagttaacaattggaaata

SEQ ID NO: 513226 - DNA, 481 bp, Homo sapiens
ccaatcagcccattttgtaatcgccccatctctcatgagggagtctcatctcccatttggggatgaggatgtttccttgtcttccaggtggccacgagcctgcttctctgatccaagtgtgctaagagtcaagtatccctccctaactactgttagccatcccttaaagtgtatttcctacctagttataatgtgaagtaatttgatacccccaaaactcaaaaccttcagataacacaatgcaaaacagaacacagcctttgattttgagagggatttatctgcttttaattccttgggtttcatgaggaaaacagaggggttttttttttccccaaaatggggcctgtggcacctcctctgttttcccaatgagtccgaggctaccggaagttatcttggggcctctcctgtgtgcattaagtgtggcaagacaaaaaaagtcgacccccccgcgaatttagtagtagtaggcggccga

SEQ ID NO: 513227 - DNA, 271 bp, Homo sapiens
gctcgacattggttgtcatcccgccccacaccaacataacaaccctcggagccttgccaacaactgccggggtaaatttcctaatgcacgtaggtgtaggtactccccccgctcccgcctccaaggtccagaagcttatggcggtcattgtgttatttgaagttattcagccgcaagccgccacagtcatcagcttcgaagccccaaaggcagatgccacctacccatatctcagcgagcgcttttctcaaagacatgttgcaaagacaac

SEQ ID NO: 513228 - DNA, 189 bp, Homo sapiens
  misc_feature (1)..(1): n is a, c, g, or t
ntcatatgttctcctcgcgacaggtgtgtgaacacctcacaggtcgcgccgtgtgaaaattgcagacaaacggaatgtgatcgacttgacgccgaacgcgagggaacacagaatgacggcgcgtagggctgaaacctaacaccatcaaaaaagcctagggctccacccctgggcttttttggtcgacgc

SEQ ID NO: 513229 - DNA, 701 bp, Homo sapiens
ggggttaaaaaagagtaataaaaggatttaaaaaaaaaaaaaaattttaacaactaactaggaaaaaaaaaaaaaaggaaaaacacaaaaaaaaaaaaaaaaaaaacatttgggccccctctggccctcctagtctggactctagcacacttttgttcgcggccccatttttggccccctttgccccattgccctctatgggggcctgtttcactttcctgggcccctttttccaccacgcggactctggaaaccccggggtgtccccccttttaagccttgcggctcatccccctttttcccctgggggtattatcgcaaaggcccccacctgttgccctttccaaaacttttgcaccccctttggggaatgggaattgtgcccgcctatatttcggtaaaaaccccgtttaaaatttgttgaaccccgtctttttttaccccctatgccccaattgccatatccccctttttttctcaaaatcatcctccgatatgggctagggtgttgcccccttggaacacaagtctccctttttagaaaacgggctctcccgcgttaaggggcaaaaaccttgtttaagggggatgggcccctttgcggccctttccccttagttttggggcccttgggccgtcaaggcctttgggccccctgggggccccccttttagctctccggggccctgaccttgtgggct

SEQ ID NO: 513230 - DNA, 130 bp, Homo sapiens
cataactccagtgtaggcccaagactgtacaacctcattttcatactaggatttctaacatggccctgtgagctgccgaggtcctgcatcacagccttccctgcgaagggacatgcggatctgctgcatc

SEQ ID NO: 513231 - DNA, 129 bp, Homo sapiens
ctcgatcaaactcagagtacatgtcgcttaaacggcatggactgataacaattttattaaaatggataatatattttatcgtttttaataaaattgataacctggatttgctagaaaaatagtgatttt

SEQ ID NO: 513232 - DNA, 150 bp, Homo sapiens
agagccccccttttttataaacttagtaaagtcttggagactaaaagcaagatagtttgtgacccataagcttcccaaaaactagaatagatttttactgaatagtgggaaatctgatgggatatgttttttaaaggtcccaatgtaata

SEQ ID NO: 513233 - DNA, 228 bp, Homo sapiens
gcttcagtggtttcaggtcccgagccaggcccaccacagtctctgcttcaacaggatcccacagctgtggtggccgggcatggatttgctggaacttgtgcagcgcacataaggcccgatgcaggcagtgagcctggagaacttactgggagctctgggccaccacatgtggctggagcaggtactgcgtccagagacttatgtctcacagtgtggcgcatctttcct

SEQ ID NO: 513234 - DNA, 311 bp, Homo sapiens
  misc_feature (9)..(10): n is a, c, g, or t
gccttggcnnctatgccatttctgttgtagtttggggcagtgcaggggacctgtgtggggtgtgaaccaaggcactactgccacctgccacagtaaagcatctgcacttgactcaatgctgcccgagccctcccttccccctatccaacctgggtaggtgggtaggggccacagttgcttgatgtttataaagagaataggttgatttattttacatgcctttgaagtaattgttgaaaaataattccaaaccattttctaacccaaaaaatgacattttttaaaaggacaataaacgttggttcaaaatg

SEQ ID NO: 513235 - DNA, 102 bp, Homo sapiens
agaggattccagttacagcgcaggggaagcttggttgaaccctgtgctggtgtctgaccaccctcccctctcttgcacccgcctctcccgtcaggcccaagt

SEQ ID NO: 513236 - DNA, 256 bp, Homo sapiens
tccctcccctctccaagagcttaaattatttaaaacagggaaaagaggaaaaaaaaaaaaggggcccgccctaacccaattcttgcccctcgcgttttttggctggaagtggaggtagtgtgtggatcctgggggcccccgctggttgggccccggccctcgtgcaaacgccggtgcccccggttaacgcgtcatataatagtcaaagcatggtcttccattcagacccaaaagagcgccggatacactatcgagg

SEQ ID NO: 513237 - DNA, 509 bp, Homo sapiens
  misc_feature (31)..(31): n is a, c, g, or t
  misc_feature (35)..(36): n is a, c, g, or t
  misc_feature (43)..(43): n is a, c, g, or t
  misc_feature (80)..(80): n is a, c, g, or t
  misc_feature (90)..(90): n is a, c, g, or t
  misc_feature (109)..(109): n is a, c, g, or t
  misc_feature (128)..(128): n is a, c, g, or t
  misc_feature (136)..(136): n is a, c, g, or t
  misc_feature (143)..(143): n is a, c, g, or t
  misc_feature (146)..(147): n is a, c, g, or t
  misc_feature (165)..(165): n is a, c, g, or t
  misc_feature (171)..(171): n is a, c, g, or t
  misc_feature (185)..(185): n is a, c, g, or t
  misc_feature (188)..(188): n is a, c, g, or t
  misc_feature (190)..(190): n is a, c, g, or t
  misc_feature (210)..(210): n is a, c, g, or t
  misc_feature (227)..(227): n is a, c, g, or t
  misc_feature (236)..(236): n is a, c, g, or t
  misc_feature (243)..(243): n is a, c, g, or t
  misc_feature (264)..(264): n is a, c, g, or t
  misc_feature (267)..(267): n is a, c, g, or t
  misc_feature (332)..(332): n is a, c, g, or t
  misc_feature (337)..(337): n is a, c, g, or t
  misc_feature (347)..(347): n is a, c, g, or t
  misc_feature (412)..(412): n is a, c, g, or t
  misc_feature (428)..(428): n is a, c, g, or t
  misc_feature (466)..(466): n is a, c, g, or t
agtgtcacggggggcatgtgtctgtgtactnaagnncagtganaaggttgtcagcattccagtgagccctggagccttcncccccccaanaacacaaggtgaaagtgtnctgggcgaggatcgggaanccacgggngtcctantanncattaatggtgaggatgncattgnccgtatggcccttnatnancagctcaagatcctcacccnccgcttcctggggaagntcctggaancctaaancaggcagggccggtggatttngtnggataaaaagtgatcccccttccttccctggcccttggttgtgacacaagatcctcctgcagggntaggnggattgtttnggattcccttttgtttttccttttagttttccatcttttcccccccgggggcccattggaatttnagtaaagtttgggggngggtcccccccttcctgtcccccccccccccagcttgnttttgttggcccgtctttcaataaaaaaaagctgtttggttta

SEQ ID NO: 513238 - DNA, 320 bp, Homo sapiens
aggtcccccctggcttgcttcaggtctctcggcttactgctccctccgtgtctgggattcaagcagttctcctgccttagcctccagagtagctgggattacaggcacgcaccaccatgcccccagctaatttttgtatttttagtagaggcggggtttcaccatgttggccaggctagtctcgaactcttgaccttagatgatccgcccaccttgacctctcaaagtgttggtattacaggcgtgagccatggcgcccggtctttcctatctttctgactgtatcttcagatcactcctgaacctgagacctgagcaag

SEQ ID NO: 513239 - DNA, 803 bp, Homo sapiens
tggcttttattcttagatatctcatgactgacgataatggctgccaagagtggcaatatgggatcttcatgtccgtagtgccatttctattggtcgttctaaagaagatgaactcttgttaacaaatttgtaaaccatatgtcgggactcttgttctcactgtactgctattccctgcctactgtggcatcattttcggaaggcagtatcagcggatcggctctgacaagtcttggctagacggtataagtttattgtgtttctatgtatgttcttgtaaagaaataacaaatgttctgttgcaaacgatctgcttgttggattctgagggtggggagggagagagagggagggagagggtagtgaagagcctgccctcctatatggattcttcagggccctccacatctgaggtggctcattcccatcacacacagattgtcctggtgttcatttcaaggccagtgttcagcagcagcgtttggaacagcagagttcatgtgagaccacccacgcctccgcacccacgcactaccttgcatatgacagcagtacgtaggagtactccatcctagttttcatgcaacagttctatacaagaaactgtgcgtgtgaccttcgcggctaggcctggactctggcaatagagaactacaaatgaaaccccttgtttctctttccgtccaacaatctgctgtagacgctcttcgcacccgtagccctgtccaccttttgtagcattaacgttaaagtcagtgcactgcaggcagataaggatgcgagatagaactatattgtacgta

SEQ ID NO: 513240 - DNA, 703 bp, Homo sapiens
  misc_feature (304)..(304): n is a, c, g, or t
cagctccctcagccacgacaccccaatacagggatttaaaatctgccttcataatttacttgtggccgggcgtggtggctcacgcctgtagtcctagcactttgggaggccgaggcaggtggatcacctgaggtcaggagttcaagaccagcctggccaacatggcaaaatcccatctttactaaaaaaaaaaaaaaagagcgggtcataggggggggtgcctgtaatcccagctacttgggaggctgaggcagaagaagtcgtgtgaatccagggacggcaagtaggttgcagtgagaggccnaaagattcatgccaactgggatctgccagccggggagaacacgagtggaagacgtcatgtctcaaaattagttgaactacactaactagactaaacacttgtatttctacttgggtgggtggtggacctttctggtgaaatgtcctaaaaggctcccttaaaagcttgcatttgcctcgtttgaataagggattaaagagcccctgactctgtataactgatggttatcagacttaactttaaaccatggggagctcttagaatataggtggggtctggccacaatcagattttatcgaatgaataaccgggtaataaacttgttcatagccgttatgcacaattcttctttatgaatggcgttcagcgttttcgtgccgtggcttatgggagtcctcc

SEQ ID NO: 513241 - DNA, 110 bp, Homo sapiens
ggtgatatgcaggtggcagatcagttaggatattgcatcagtctaggcaagagatgagtagggcttgactaagtgcagtgaccatcggagtggtgcaatgagatatgaga

SEQ ID NO: 513242 - DNA, 699 bp, Homo sapiens
cgggggtcaatattggccaggctctcacacccccacaaattttttttttttccgctcgaccaccccacggtcccccggggcggctgagacgaagtcacatggcccaaccaaaaagaatattttttgacgccacgcctgagtccctgcaggaaaacaaaatcccgagtaaaaagccatctgacacgaaccgcacgaaactacggccaccaaaacgcccgcgacgccagaacttacagactataacccagaaccggcaacaccccctacatacgagaaggccgatcttacaaacacacacacgaaacgccccgacacatgagcctcacactaacctccttcctttaacacacggcgcggccggtgaactcctaccccagttctgagtcctgctcacactccgccaagcaccctcgcgataccagtgcaccgcgaaccccctccaaaatagagacgacaccgcccgcatctccaccgcccaaatcgaacacacagccttcccatctgcccacgaacgaaacaacccgaccagcccgcaagcgctgcggcggccgccctcggcccagtccaaccctcgacccgcgccaactgcatgctgcgcgcacggaaattcccgctacccccgcgcacaacccgcctacgcgcgacgcagctatcacaaccacatcgggcggcgcgacctccaaccctcaggcgagtgtg

SEQ ID NO: 513243 - DNA, 1407 bp, Homo sapiens
tcccaggaccacagtcccccaaccagccaacgcctgaggaacgggggaagttttaattaaatccacagaaagtaaaaacccaaattgcgggaggagaaccgtggggagatgtggggccacccacgggacggtggagacgtctcacggccacccagggggacgtgtgggagagtgggggtgacacgagaccaagaaaaccaagagccaggcgtggggtgtggccaaggggggctctccgagcctctcgagggggccaactccaccgaggggcccaccgagaaagagttctcgctgtgggaaacctcgaggtccagacacaccgagaggcgagagcctccaatgcgggacggagggatctcccacaccagacacacacagagagagagagaaactctgtggggtgttcaccgcgaaaagagcgccatgcgatacacaagtgcgcgcgcgtattctccgacaaagaaaagcgcgcgcgtgcacgaagagcgcggcgggaagtagatgtgcgcactgtggcgcacgagtgtcgtgtgcctctgtgtgtgtcctctcacgagatgtacacactgtgtgtgtgtgaaaaatttgtgcgtctgtgaaacaccaatgtggcgggcgcgcccacacaaatctccgtggtgggagccacaacactcgcgcgatgaggggagaagagaagagccgcgaggaaataagagagaggaagacggagaggacaaaacacaacaaatacttccactcgccgtgggaagaggagcagcggtggagcccccagcggaggaaccatcgaagggggtcccttcaaagaaatactcccacgaggggggtggtggcccccaacgccgggggacccgtagggatctcccccgaggagggagaccagcaccaaacagcgggcgtggcgaaaagtcgcgcggagcacataagacccccgaagacgcgaagagtaagtagcaccaagagatgaggaggacacgaagaaaacaaggggaggtcatcaagccggggtagaacacacaacgaacaacaccatgaggagggaggacaccaaacaccaaagagacacaaacgacacaggaccactccccacaaacaactatttattcctcccgcaggcaagcgatgggagaataacttgtggacgacccatgtgtgtgatgctgtgagaaaagaaaaccacctgtatagtggatgaccacccacaacagccaacaaagggcacaccgcaccaaggattgtgattaatacattttggtgtcatcctgtgtatggtagccaccacccacaaaaacatctcccaaccaagaagtgagggaacctagatgagaaaatagggatgagaagcattttggagtatccccacactaacttctcgccttcatctcctcaccctaactacccaccatt

SEQ ID NO: 513244 - DNA, 241 bp, Homo sapiens
agatctgaagatacggtgagactgatgagggagtgataactgcattcactaaaggatccgatcgtcactcagactggccgtcatatatcaagtcaacagccactattggactgtaaccctgaaatagctggcccatcagctccaagaaagcacatcattcacagtcgaaactactggcaaacacaacagctactgaacacgaattcttctttcgcctatgctggatgtatacatcaacact

SEQ ID NO: 513245 - DNA, 151 bp, Homo sapiens
taaagatttaaaacacacttttatatttttcaatgtgtgctactattttaatagagcagtagaagtgcttaccatgacaaagttggtgtttttaaacaaattctgtcattacagacaactgtgatggttactgatgattacactcttttgg

SEQ ID NO: 513246 - DNA, 1062 bp, Homo sapiens
taaccaaaaacgcgggggattatttgggggttggggtgaaaaaaaatttggggggggggggaaggccgacgaaagggggtacgaggaagcgtggtggacaaaagccccgagcgttcccgggggaagagagggtgacagcagcggggggccacgcagcccacggtgggcccccgagggtgacactgtgaagaggcgggagggctccgagggcgaaacgggggatatcaccaaatattaacgaggccaggcaggggaagtgtcccccacgccgcccgtgtgcaggggggcggggggcggagcactttggggagagggcggggggccaaacacgggatactcgaggcgagacgccggtgtgtgtcaaaaactgtggggccacaaggggttcctgcgccaaggagaattactcgagaagagcgggccaatagaccccggaggctccagatgtagcggcccagagcggccacaaggggcaatgtggcccaacataggggacaactacaggggtggggggggggccacgccctctttcggggagggcgccccgggggcagcaagcctctaccgggggaaagatgggggggctcaccatgcgcgaggggaccacgcggcaaattgcttgcgccactggaggctcatggggacccggacgccagggtggttcccaacgcgcctttggctatagaaaactggcggggacaaagaatacccctttattctaagggagaattggggggagaacgctcagtaggggatgccgcccaaccacaagggtgttatatccaacgagaacctgggagcaaaccaggcgtgtggcggcccctcagagaacacctggaagacccactacaggaggagtggacggaacttggggaacaccccgcgtccgcggggagggatgaggtgcccaagccacgaagagaggcgctatgtgggacacctgcacactatagacccccgaacatcacccagggggcgcgggagcccccacacagcggggatgggggagcaccagaaacagagaggacaggaggatactccactacaagaaggttcccgaaa

SEQ ID NO: 513247 - DNA, 747 bp, Homo sapiens
  misc_feature (51)..(51): n is a, c, g, or t
  misc_feature (188)..(188): n is a, c, g, or t
  misc_feature (194)..(194): n is a, c, g, or t
  misc_feature (230)..(230): n is a, c, g, or t
  misc_feature (294)..(294): n is a, c, g, or t
  misc_feature (306)..(306): n is a, c, g, or t
  misc_feature (350)..(350): n is a, c, g, or t
  misc_feature (365)..(365): n is a, c, g, or t
  misc_feature (391)..(391): n is a, c, g, or t
  misc_feature (421)..(421): n is a, c, g, or t
  misc_feature (426)..(426): n is a, c, g, or t
  misc_feature (436)..(436): n is a, c, g, or t
  misc_feature (441)..(441): n is a, c, g, or t
  misc_feature (462)..(462): n is a, c, g, or t
  misc_feature (466)..(466): n is a, c, g, or t
  misc_feature (468)..(468): n is a, c, g, or t
  misc_feature (540)..(540): n is a, c, g, or t
  misc_feature (588)..(588): n is a, c, g, or t
  misc_feature (732)..(732): n is a, c, g, or t
gtggcggggggcggggggcgtgaggaggaggaggggggggggggtgtgggngtgtgcgagggtgctttgagatctgaagaaatcatttcctcctttcttgcgatctgcataagagcacctgtggaagtgtgcgatgctcaactgatactcacacatacagatttgctcataggttgaacagtgaagtntaagtnaaacccattgcacagactgtccctttcatcacaganacaaagaaggtgagagtgagatgctatcaaggaactagccaattttggaccaagcgtacatgcncccttccttctnactccatggaagagactgccccatgggcctttactggacctgtngccacggggagattnaggaggccatccaaggagtgactaancattggccctcttccatggctacaggaatnttgtncctgcgggtnctatncagatttcagcgctagatgtnactnanaaaacctgaaactctgaggaaaggaatctaaggcttatagtgcttgagttctgatggggaacaactgcagcnaacagcaccagggaagctggaggatgctcagtaggtgaatcgcatctnttgtgagtcgcccagtttgttcaagttgggatggcagggcagccgcaccattgggggtggcccacaaagcagttccagcacatcatcccctggagcgggcaggtgttcccggatcatgttggcagttacaaagccctttctgtnggcccaatctttttg

SEQ ID NO: 513248 - DNA, 258 bp, Homo sapiens
gtccaggagaagtagagatttatagcctaggatatggatgtggctcaccgtatggaataattactaacgaagaaacatcaaggtgtaacagtgttctggcctaaaccaacttgtatagcgattattgctgaatggcaggccaaggctggtaaaaccacggaaggcagggcattaaatgaatttgactagcatatcaacaggtagtcatgatactcaagggtggggacggaggaatttgatcatgattttcgcacgtgt

SEQ ID NO: 513249 - DNA, 627 bp, Homo sapiens
gttaaaaattaaaacacaaacccacccgtttgccttggcctcccccggatcaggctctttaattttgggggttcaaccttaaaattttgtaccactagaagggcgtcggggagaataacatgcatggggctgttatttcctatgataacaaaatttttttttggaattccccctgaaggacctggctgagggtgtttaaaaggtaactttttttggttttagaagtagaaagaggggcccctaaaaaaatgatttattttttttttatcaaggtttagtgccctctataattggtggggctttacccttataggcccgggagcacaaatttgtgttccaccgctttcccaccaaaatgtgggcaacccattggctttccctggtttgaagggccctccctcgggaaaaggaattttcaccctccttaaaatttaaaggaattgcgggtttaatggttacacttggtaaccaccccaaaaagttttttaatggccttggaaattattttatttttttgggaaaaaaataaaaataaatgggcctttgaaagggataaaagggaaattttaaattaggggaaatggcttcggaaaaaaaaataaagggggggcctttttttaaactttt

SEQ ID NO: 513250 - DNA, 360 bp, Homo sapiens
  misc_feature (123)..(123): n is a, c, g, or t
  misc_feature (153)..(153): n is a, c, g, or t
  misc_feature (356)..(356): n is a, c, g, or t
tttgccagcttcctgagttttgcctaaagatggccccccagcattggttggggacaaagggcaaaattggtgccccccagtcatgcctaggacctggggcccaaaaaccgggcaacctttggntacaggggccattgggtgccctcccagttnaaaggggccgctgttttgccttgtccgtcagtgccagtgcctgtgccaaaggtggggaggtgagtcctccaaagctttttggccgggccctcctcctgcctgttttgggtcctttggttcccacgctaggtgtcccttttttgattttgggggatcctccctcccctaattaaagtttttttttgcccctttgggggtgcatnagga

SEQ ID NO: 513251 - DNA, 599 bp, Homo sapiens
  misc_feature (565)..(565): n is a, c, g, or t
tctaccaggatctccacactgggttcgagtacaaggttgaggagcagtctgtggacatcagctcttaatatttttcacgtttggagcagtggtttctaggtactgagtgaagtggaaccagaatctctaggggcatgtggtaaagataatcccataatatgtactgggtagagttaaagagaagaggggagagcatgaagataaaccagtacaatcagtcgttcacataccactaactacaatgatactcccatttgcttcctgtgaagtagttactaataatcactgatgtcgctttttaatttcatacatcctttaactgtcttcatataggtattgaaagagtcaacataaaagccacatccattttctaattttgaacaatagttagagaaacctaatatcttctcatattttggtcttgcttctgtctcatgagttcccaaaatagatatattatctgaatgaagagttcatgggcaaatgtcacacttttcttgggtagggtaattatatatctgcgattgcttagaataagattaattttcctattctgcgaataaancacgtgatggcgaaaatgcgtattctgagaaaag

SEQ ID NO: 513252 - DNA, 459 bp, Homo sapiens
atgaccaggaaacagctatcatcagtgacccagagagtcattagggcaacaggccgtgaagaagagcgggtccatcatgagggccttggaaggggaatcaaatccccaaaataggatcctttttctaaaaccaatcttaaaatcgccggctttgaaacataagtggctgtgaccggccagaggaaaaggtcctcaggggccaggggttcttcaggctaccttggtaacgtccatggctggcttctctgccctcaggagcagctgccgaggacagtcttcatgaagctcaagcatatgacaagggggcaagaacaaaaaaaaaaaacagcttattaggtataggtctttcatgataaatggctggtaatatagtttgtgaaactaagcacctatgggataggcataatcactattgcttatttagatttggtaaaatcaggggagctatgaaagtccccg

SEQ ID NO: 513253 - DNA, 1031 bp, Homo sapiens
  misc_feature (1031)..(1031): n is a, c, g, or t
gtggagacgctggattctacttttcaatggatataatgcatgacatgcggtgcagtcattgaatgttcggtcgaagtcatctgtcgcccgtgatagcacaagtacatcatggactctggttcgctggtgatactcggcgttctaagaggttcatggaccgtatgaacatggtattgtgaggtgtcgcgccaactatgtgtctagacgactttcccatccatatcagtatcactcagctatcttatcctcggagaggatacgtgacagctatgtttgcatcaagtcaccacatcatcgatcactaactacatcgacgagctgtcttgtcacggtccggccattgaaatgagagtaggctggtctatccatctgactcagcccaaggtcatgctcgcaaaaccctcaggagagcacgatattctccgttcacgtcctcgcaaaatggataattcagtggaggcataaattcatatgataacttgacgcaagaacatgaatcttcgtggtcagggcgggagagaccaccgtttatttcatcgttgatgtgctccgcctgtgtgggcctattattcgaggggagtactgttactgcttgaggggggtctaaagatgtcctttaatagaaaggtgggtggttattggtgaaacccttgggtcgaaatggagaggcatttaattttggggtggggtactaggactttccaattcaacggaatattgggatagggggtgagaattgtcggtgggatttgcggcgtattttgtgcaaatttgagataccggtgcctgagttaacgccggacgggggtgcaacccgagacggggtgccgagcccaagaaccgtgcgggaacagagaatcagcgacacacctagccgcgcgccgagagttaaaaaccgtcaaaagccctgcggtcaggcgacggatccgacctcttgtgcgacaaacaaaccggggcgcagcagaggggcgaacgcagataggtccctcgcgagcgacccccgagcgtgcaacgccatagcggagaggcan

SEQ ID NO: 513254 - DNA, 602 bp, Homo sapiens
gtggtgcacccgacgtgatcgccttgaagttatgcgtgaaaggaggagagctcatcaattttcagaaaatcccggtaagggacagtcctgactaccatcaggtggacaggacccacgcgaaaaataccaggggttcggttatcatgggtcaggaaatgaacaaagaataattttttttttttttggaaatggagtctcactctgtcgcccaggctggagttgcagtagcgtgatcccggttcacgggaacctccacctcccgtggttcaagctattctccgtgcctcaacctccgtgaatagcgtgggattacggggtgcacgtcaccccacaagagggacttaattaagccttgccttcagggttgtacaataatagagaaaagttacaattactggcctcgtgcgtgtgagacaaaacccagtggcacctccagacacacgagaacttcaaaaggcgctaagccggcacatgcgtaaaccgcaggggtcaagcattcctacgggaccttcctgtcatcaggatctggcttcaaggtgccagaaatttgggccatgggccaagaaatgcccacaggcggggattcctcctaagccgtgtcc

SEQ ID NO: 513255 - DNA, 378 bp, Homo sapiens
  misc_feature (151)..(151): n is a, c, g, or t
  misc_feature (159)..(159): n is a, c, g, or t
  misc_feature (217)..(217): n is a, c, g, or t
caactggtgaatgagcgacagcccaaggcccgggttgtggtgctgggcctgcttccgcgagggccaacatcccaacccacttcgggagaagaaccgacaggtgaacgagctggtacgggcggcactggctggcaccctcgggcccacttcntagatgcngacctgggctttgtgcactcagatggcaccatcagccatcatgacatgtatgattacntgcatctgagccgctggggctacacacctgtttgccggggctctgcactccctggtttttgcgtcggtgggccaaaaacaggggcaaaggggtcccctggtgggagccggccccttagcatcctggtgcctttccccaacatttaaatattcctttctcag

SEQ ID NO: 513256 - DNA, 807 bp, Homo sapiens
  misc_feature (294)..(294): n is a, c, g, or t
gtagacatggaatatctgtgcgtcacctagatattgtaccgcaagtggaagagatgtaactacattatacaccaatcataatatagcaaggactaacccctataccttctgcctaatgaattatctagaaataatttggccaggagaggctaagagcctaagacccaccgtaagaccatgcaacgcagactacgcgtagaggaagcaagctaacataggagcatcaacccggtcatatgtgatggcaaacaatcagtggtggacagatttataggtaagaggcgagaaacctanacggagtcctggggtagatagaactggataagttctcgtgatgagcatagtgcttaagtatcagactatgtgataacttatgcccatcgagtacagcgcatctaaatcctcctttgtaaaaattctagagcatggtgtagttgccagaaaaggagtgacagcgaggcctcctttgagagcatctgaggaaaaaactcttggtactagcagagtcagaaagatttaaacacccatagtcagggctacagaagcaggccagccaacgtagagataaagctgtcacaaaagctacaatacccatcgtacctaaaagaatcgcaaatatataactgaaactccttcaaaccaattggaccaggtctatcaccctatagaatgaactaatgtggagtataagtaacatgaaaacattctcctccgcataagcctgcgtcagattaaagacactgaactgacaattaacagccccaatatctacaaaaagatcacagaatgggaaaaccggctcagcgt

SEQ ID NO: 513257 - DNA, 307 bp, Homo sapiens
  misc_feature (108)..(108): n is a, c, g, or t
  misc_feature (155)..(155): n is a, c, g, or t
  misc_feature (204)..(204): n is a, c, g, or t
  misc_feature (207)..(207): n is a, c, g, or t
  misc_feature (215)..(215): n is a, c, g, or t
atgaactctgaaaacatgcttggtgagagaagccagacacaaaaggccacatactgtatgatttcacttatatgaaatgtccccaataggcaaacccatagaaacggnaagtacattagtagctgtttaggtctgggggagaggggaaatggggnacatggaatctccttctggggtaacggagatgctctgaaaccgattgtngcnacagttgnacgattctgtgaataacttaaaaccactgaattgtacactttaaatgggtgaattgaatggtacgtaaattatgtcaataaaacttattttt

SEQ ID NO: 513258 - DNA, 1719 bp, Homo sapiens
  misc_feature (938)..(938): n is a, c, g, or t
  misc_feature (1436)..(1436): n is a, c, g, or t
tcatcgatattcttcgttcttgtttgtttgtcgtatgtctttcttctctccgacacggtgtgttctatttaaaagtgctgtcctcttccaacaatttttgtcttctcttgaaggggtgacgttctctgctgggtgttctcctaaatctactatgggttgcctctacactgactactcgttgtgttagattctctttgtcactacctgattagtgttttttttttgggggcacccatttattgttggttagcatgggatatgtgaagatgtgttggatttctatgtccacccggtgtttcttctgcccccatattgtctcacctcccaaatgggtgtgggtgatacccttgtgtcgttataagaaatagttgtttcgtccccccgttgctacaaggagagctcacaaattgtcttcgttgccgttcggagtgttgtgatgaaaaaacccccggtgtattttgttgtcccctcacgcgcgcacatgaggtaaagtagattgccttccctcttgatagatgatgatgtggtggagttttgttcccatcacaacgctcgtgttgtggggtaataagtccacacttggtcgttaccccaccgccgactttctcttgatttgatgagaaagtgcgatccaccccagggtttgtaggtgtttcccccacggattctcccctggttaggtgaattttttctcgtggtgacgccctcctccctgtgtcttgtgggaaaaaagagggagaagggtttcctaaagtactggtaaagcgggtttaatttcctccaccacccacattgttgcgccaaggagtagaaaaatttggtgttagaaccatttatgaagaccgtgtgtaaatgtttcctcataggatgagtctctaaaataatggacatatcttctttgtggactgtatcccccacacctctctcgttgacttttntatatatttctcaagagagctctttctgaaagagggaaatgatatctcttaaatatattataatggttataatgactactcttggtataaataatggtgagacaactcccactcccccctcgtaagattggagcatctttattagagtcccccccacatatatattgtgttgatatatttccccacagatgatatatatagtctctcacaaatactgtatggttattctctcacacagtgtgtaaaagacaaataattttggtgagactctttaatggggtgacacacacagagtactcccactactatatttgatgagagagacactcttttgataagccgcccacacacacagcgagtataaagtgtgttattgttggagacacacattctgtgcgtctctcaagagtctctctctttgtgggagcaccccactctcagggtgacgacaacgacacaatgtttgtctcagagtctccagaggaatatctcccaggngaactttctctcataggatacaccgcgctctcacacaccacagactgtgtgtacaccacaaacttcacaaactctcacttgtaaagatccaagataggagaatcttgccagaagcaccattatctgtgaaaagagagcaccagtaacccaggaaatcttcccagggcacacagaactgggcgcaacatctccagatcttgaacatttctcacagacatttgtccagggatctttcaaaatagaacccccccggaggagcagctccgcccaccagataacttta

SEQ ID NO: 513259 - DNA, 132 bp, Homo sapiens
ggccggggaatggtaaattttaatgggggaagattttttattttttatacttagcctttaaaaaaaacccgccttccttgctttggttttttatgccaaggcttttttgtttattaaaaaaaggcccgaaga

SEQ ID NO: 513260 - DNA, 151 bp, Homo sapiens
acccaggctggagtgtagtggcgcaatctcagctggctggagcctttgacctccttgggctcaagctatcctcccacctcaagcctctcaagtagctgggactacaggcagcaaacgacctgcatctcgagtatgccatgggaagcacgta

SEQ ID NO: 513261 - DNA, 1189 bp, Homo sapiens
aagatgttaataggttttattggtacagactataatacaaaaactatagtgacagtaagatagtgatggtgtaatcgacctaagcatgtggtagggttcgtattgttgatggtatgtggctgcttttatgggagtgcgactttgtgtatgatgatggttgtctgtctgttggagtttttttcgtttcatgaagtggtgtcgtctaccaagaaataggggtggggtccctctcttagtagttgttgtctcccccgcgttggtttaacgcaggtgtttcccgcatagatgtagtatgatagcacggggttggtgaagcagtctcgcgctttttttctctgtgggcgcccatataaaaagttgttttgttggggacacccccgcgcttttcgcagttgttctccccgcgagtggcccgtagagttgtttgctggtgacgcgtaccgggtcgggtgtttctgtttgttttcgcgcgcctggttttcggcgcgtcgtttttctgccgcccgggtgggtttattggtctctctccgttgctctcgtggcgattttcttttgttgggccccccccgggttatgattaagaggggtgttctcggggaaacacccagttgttctctccccaataccagctgatgacacagaccgcgcaccatatttgtgggcccacgcggttcgcgcgcactcaatctggaagcgccccgatttgtgtggatatctcgccacgcgtggagaacttttttcttctgagagtctcccttccacacacgcaaagcatttcacccccgactcccgctcctgctagaagaataaagaaagtgacttctcccgggtgggtatacacgcggggtgggttccgccccaagatagtttcccccagtgtctccccgcccgtgggggctaaaaccctgtatacaaggtttctcccttgtcaaaatctaccctgtgtaaaggcgtctcccacctaggcgcaccgccgtttatcttctgtaaaactattaagtccaacctctttgggcgcgatttttgagaaagactcctgaacttgttcgtaaggtgacaaagggacccttgttcaacaaagaggtttggcgcttttgtgcctcgcggcggtaataagaatattaatgtcttcgccgcactattgcgcccgtttggcggtgagagacaatctacaacaatagtcagacaa

SEQ ID NO: 513262 - DNA, 183 bp, Homo sapiens
gtctcgcgtatcctttgccggcgtacgcctgatcttgttgcaaattcctcccccaagccctccccttgaacggggagggcttggtatgcggccacggattcgcgcggatcacgcggatcgcgatgcctctctcgcgacctgcgggcgaggggtcggggtgagggcaagcgccgcgcgcgtacg

SEQ ID NO: 513263 - DNA, 103 bp, Homo sapiens
  misc_feature (59)..(59): n is a, c, g, or t
taattttaatgaagtcaacgtgaagaatataatctggttgtaataccaatgcaatgtgntctaaaattatttttctattgagttaaatattcatctgtagatc

SEQ ID NO: 513264 - DNA, 141 bp, Homo sapiens
cgtatcattattgtgtataatcttcatatgcaataatcaataatcataacacaggatttctagttctcaaacgggcatggaatcattacaaaagtgttgttagttccctgcaagattgcttgggccctgaagatagcctgg

SEQ ID NO: 513265 - DNA, 459 bp, Homo sapiens
  misc_feature (89)..(89): n is a, c, g, or t
  misc_feature (188)..(188): n is a, c, g, or t
  misc_feature (196)..(196): n is a, c, g, or t
  misc_feature (218)..(218): n is a, c, g, or t
  misc_feature (288)..(288): n is a, c, g, or t
  misc_feature (296)..(296): n is a, c, g, or t
  misc_feature (298)..(298): n is a, c, g, or t
  misc_feature (305)..(305): n is a, c, g, or t
  misc_feature (326)..(326): n is a, c, g, or t
  misc_feature (374)..(374): n is a, c, g, or t
  misc_feature (393)..(393): n is a, c, g, or t
  misc_feature (412)..(412): n is a, c, g, or t
  misc_feature (431)..(431): n is a, c, g, or t
gctccagacccgcacgccgcggcacagagctctcagcgccgctcccagccacagctcccgcgcctcgtcaggtcaacatggcaaaaatntcagcctacagagactgagcggtgcatcgagtcctgattgctgtcttcagaagtatgctggaaaggatggttataactacactctctcaagacagagtnctaagctncatgaatcagaactagctgctncacaaagaacagaaggacctggtgtcttgaccgcatgatgaagaaactggacaccaacagtgatggtcanctagattngnagaattncttaatctgattggtggctanctatggcttgcatgactccttctcaaggctgtccttcccagaagcggnctgaggacccttggcctgncttcaaaccacccctttcnttcagctttctgtcatcanctcacagccaccatccctgagaactaac

SEQ ID NO: 513266 - DNA, 336 bp, Homo sapiens
ccagtctagtgatacttgcctcgtgctattatcacttggagtgggcagtgcatggccccatctcatttttatgtatttgccctgcatagtctataaggctcagaaattgtgggttaaaccagcttatgcatcacacctctttgcctaatgcaagttctcctctgattcaatattgcatacatctattgacatgttgcgaccatgccccctgtttctggattggccatcggtataacttcaagggtgaattctctttttccactgctcattctgcttctttggtgatcacaggtgtgttataacacctgtcaccgtctatcggtcatttctatttga

SEQ ID NO: 513267 - DNA, 359 bp, Homo sapiens
ataaggatcccttaggctcagaggccctggacgtcgggggacagtcctcgctttcatcaccttccttgagggtcaccgcagccagccctgtggccttctgcccctttcactccaagatctctgggctgaccttcatcagccccttccacccgcctcaggaggtagggacaaggctgggggcggcctttgcagaccctgagaatgaatattgtcctgcatacacagcccagtggccacgagaggccgacgaagatactgaaggtcacagagggccagaggcggggccagggcttgagccaccctctctccaggcccgtctataccattgggctgcccccttcagacctccgggcaggaaa

SEQ ID NO: 513268 - DNA, 849 bp, Homo sapiens
tcctaataccaccacctaacagagaacacaggtgaatgcagatgttcactttagcagacttaatgtttcctatgagatttcactgtacaaaacgtggttggattcaaggatatatttgtctactggccctcatgttgtatgtacttgaggagtaaaatgagtaaaatgatactgaatgaaatgttctgtggaaatattaaaaaaaaaaaaaacttaagccatccattcatccagaagaaaaatgggaatacacggatctactacggatgtcttctttcagcttggatctaaagatgttttttattaaaactataatttaaattgtcccattgaaaaattttgcggtaaaaattagtggttttctaagctagagtaggattggtcttacaattatgggggctaggtagtttggttttaaaaattccaatggggtggcggctttcttgacattttatttcaattctataagagggatagatgacatggttctagaaacacatatacatcattaagagtgaatctctaaaaccaggatataaattatgcttaattctctggaaaatcaaccaaatggaggtgttcacacctccccttctttaagcattatctaaattactttttactgctttagtcttaggaaaaaaaaacgaacctttagcggaaagggagaacaggtgctttaagggtttaccataatgatccgagggaaggagggtatttggaaaaaaagctgttatatggggagaaaagggtcatctgggaaccgagagtatgaaaaactcttttttccacaattggggtatcttagaggaaatagaaggaggagcaacatgtgggagggctaatgga

SEQ ID NO: 513269 - DNA, 683 bp, Homo sapiens
ccaggacgttacgtgaacacacatccatgaaacatcatcccgcgaggttgatgggtctgcaggaacaaatgcggcaggcagtgcagaatggggacatggagaccgtcccagggcatctgtcgcatcgctgtgggccagggcgagaaacaatcccgggacctagctggaccaagtagagcacatgtcagagttcctggacactcgtcaacatgattatgtatctgcacagggcgattccctgagtcactattcctgtcaaggagaccaccgagctccctaacccgtcaccttctggtacacactgcaggatgatattctatcctttgaggcagagaagcagggtgtataccagcaggtgtaccggccagtctacttccagctggtggatgtgctcctgcacaaggcccagttcccttctgatgaggaatatggattctggtcctcagacgagaaggagcagttccgaatttacagggtggacatctcagacacgctcatgtatgtctatgagatgttgggggccgagctgctcagcaacctctatggacaagctgggtcgtttgctcaccagctcagaggagccctactcctggcagcacacagaggccctcctctacggcttccaatccatcgcagagaccattgacgtcaactattctgatgtggtgctgggctcattggct

SEQ ID NO: 513270 - DNA, 120 bp, Homo sapiens
gttgggtgagcttttttgtgtccctgtggtggacgtggttggtgattggcaggatcctggtatcgcttaacaggtcaaatgcaagacttcgtcaaaaccgttaccggcaaggccataacc

SEQ ID NO: 513271 - DNA, 186 bp, Homo sapiens
ccccccctttttaaccccggggcttttgggggcttttccgggggttttaattttaccctttttttttttaactgtaaaagggaaattattttaccccccctcccaaattttaaagttggggaaggtttttaacataagggcctggcccaaagggggcccttttaataaaccaccccccccccttta

SEQ ID NO: 513272 - DNA, 417 bp, Homo sapiens
  misc_feature (330)..(330): n is a, c, g, or t
  misc_feature (396)..(396): n is a, c, g, or t
atttctgattccagaatctttgtatgtctctcctcaccctgtcctgcccctttggagctttgggagtttttctttactgttgtcttctgaaattttatttgttctttattccttcctgcatccctcaactaattctatatgagattattttccctttgcctgaagaactgcttgtaatatgtcctttagtgtggactctgctggtgacaaattcttttaatttttatctaaaaatgttttccaacttgcctttaacttaaaattctggatttggcaggttattttcttttcgccctttgagaaatattttctgggcttacattctttccntttttttttatttttattttttgatggaatctcgcttggttaccccagttggagtgcaagttgggnccgaattccaaccaaaacctt

SEQ ID NO: 513273 - DNA, 488 bp, Homo sapiens
  misc_feature (133)..(133): n is a, c, g, or t
gcatttattatatatcacatggtaaaagaatccctctaaataatacttctctcttggattatatgaatctttgtcatttaaatctcagcataagtaaaaaaaaaaaaatccaatgaagagattgcttcattcncaaataagtatcaaattttagtgcttaaaaattaacaaggtgggctgggcgtggtggctcacgcctgcggtcccagcactttggaaggccgaggtgggtggacccacgagatcaggagattgagaccatcctggctagcgcggtgaaacccgtctctactaaaaatacaaaattagctgggagtggtgccacatgtctgtgatcccagccactcgggaggctgaggcaggagagtcgctcgaacctgggaagcagaggttgcggtgagctgatattgccccattgcactccagcctgggcaacaagggagaaactgtctctaaataaataaataaataaataaataaataaataa

SEQ ID NO: 513274 - DNA, 1553 bp, Homo sapiens
  misc_feature (465)..(465): n is a, c, g, or t
tgtctaaaaagctatgtatcgcgtcctatggaagggaccagatccttagagaagtttggtgggtgataaaaagggaagtgggggacagattccgaagcccaggagtcgctgggcgatggtttcactccttgggttctctcaagccagcgggtttaacgcctggcgggcgccagcctacacggaggggccgggtggacacttcccgggggaatggtaactgggagacagatgggcacgccagtggaaagcaagaaagccaccagggggagtgggccattcgcggggttgggagaacagggagagcggtagtaccaggcggaggcgcactaaggaggtataaggtcatgtggaggggggccaaagtagaatgagaatggtataagagattatttcaattataccctggagtaactttacaacatctcgagagatacatgagcaggtgcgacatcttggtgcactctntattacctagggatgagatgaggtacacgagtccatcagggcgaacagaggcgagaccacgattctcacataaacagcgtaaaatgcgactcagaaccatctctatatcctgtatacttctcacccgggggggggataaaatcacgcactaaaacgaacacatctagacaaggcacgacaacagtagaaaatcgaggggacaaaagtgctaaacaatacgccaaaaaggacggcaaaatatttaataccccgggggagtaccctcaaggaaccccgggaaaccaccccaagagtgggcggaggaaccccacatatacccccaaggcgccccacatacaaaatcaccccacacgcgtattacccctgtatttacacactaaaccaggggggcccaccagggggggagacaacccgagggatggcactacacaacaaaaagcatgcaggtgtggtagagacaatacaccacaacaagcgccaccccggggggggaataccgcaggtaggaaacaatgagaagagcaagaccccaacacagacagagaaaaacggtgccagcaatgaatgagcaaacaagcgaggaaaacgcgaagaagagagaagtgaattagcacaagggcggacccccatcactagacaattgaataccaccagagaaggagcacgtcatacgagtggcaccacaacaacagagcgcggtgcgccacgggtgagcaaacaataagtgtgaacgggcagaaaaacctaaaaacacagaaggaggaagtaaaaaacaaccatgcacgggcaagaccagacttatactacacaccactaggcaggtgcgtgagaaaaggacaacacgcacaaccacccacgctggggggggagaaacatcaaaccacaacgaacagaaatgactgtgaggaacgccaacaatcttcacggcgcgcacggacgaccaagaaacaaggatggtgctatagccacatacgacaaaagagaactgagggcgagaggcgtctcgcccaactcaccagttagtattagcacaaacgacacgaactaactaaacacaacaaccagcaggacatagttgcgacgcacgc

SEQ ID NO: 513275 - DNA, 656 bp, Homo sapiens
aggatcagatttatagggcactattacaccaagaaatattcatattatgggtgttccagaggcagaagacatgggaaaaggtgagaaaaacacatttaataaaagaatagcagaaaacttcgcaagttttgagagaaaggtggacatccaggtctaggaagctcaaagaattccaaatagattcaacccaaacaggtcctctccaaggtacataacagtccaattgtcaacagtcaaagacaaagaattctaaaatcagcaagtgaaaagtgtcaagtcaaacttaagggaatccccattagactaagagcagatttctctacacaaacattacaggccacgagagaatggggcaagatattgaaagtactgggaaaaaacccctgtcaactaggaatattatactcagcaaagctatctccttcagaaatacaaggagaaataaagtcccagacaagcaaaacataagggaattcactatcactaacctgattttatacagaaatgctcacagggagccttgcatctgaaagtgacaacagataataatgtgaacccaaaatatctgagacaggtcgcagtccatttagaaagtctatttgccaaggttcaggatgcgcccatgacacagcctcaggtggtcctgaggcttggaa

SEQ ID NO: 513276 - DNA, 332 bp, Homo sapiens
ggcacgagatctccgaggaattctacggtgtaaaaagggttgatctcagttttttctgttgccactttaagattcagttttctgagatacattgagtcatttattacttcaccaatttcttttcggcttctaagttttgtgcagtctcctttcctagttccattgtctgtgggtttatgaattaaaaaaaaaaaactactttctgtgggattttaggagggagggaaaatacgtgcatgtattcagacttcttacctgaagtttgttgatgggcttctggattttaaaggataagtcaattctgggtgttatagggtctaggttttcattcc

SEQ ID NO: 513277 - DNA, 950 bp, Homo sapiens
aagcagctgtaacgctcgaattcgggataaaagagcacttcctctgggcagaggcaagcagagcctgtgcccatcactctctgcctgcttgagtcttggaatggacctccctgcctggaagctgcattgcccttggtctgggctgcctgcccctggggaacacaggcagtagcacattggcagtgaggccgtggcaggtcggcagcagagtgatgccccagtgcctttagcgtgcagattggcagctgggcctgggtggtgctgctggcaccatgtgacccagtgctcaccctgggttccccacgtgtatcggatcttcttcactgaactgcaatgggagttccaggccagcaacagcgagaactcttggttcccctccatcctcacggctgtgcttccagatggcagggcccctgtgcagcatcctgtgggacgcttcgggtgccgagtgaccgtgatgctggggggcgtctggcagcctgggcattgtgacagtccttcttacccacaacctcagcagatctacttcacagcaggatttcatcacatgcttggggcatgtgcttcagttccagtcaggcgtcagcgggtgctgggcttctaactttgtcccgcgggcgggtgtgtccaaggcgctgcctcgatgggcgtctccctgggaattcagcctctggccgtgttcctccgatagcttctgggataaacctcggcgtgaagggtacctccctggtcctacggcgggatctactcactgctggatctgcgggccatacaaatggcctgtggcaccaatttgcccgtacaaccacacaattggaccccggaccattcgaatacactgcattggtgctggctgatgagtgcggacatccagggcaactggactctagatctggggcaaacaccgtactgcgtgtcgatctcggagtcatcagcccgtagggaccact

SEQ ID NO: 513278 - DNA, 287 bp, Homo sapiens
  misc_feature (106)..(106): n is a, c, g, or t
  misc_feature (241)..(241): n is a, c, g, or t
  misc_feature (268)..(268): n is a, c, g, or t
  misc_feature (271)..(271): n is a, c, g, or t
cctttctgcggcggcactggtttggcaccgatgaagtgggacgcgatctgtttagccgcgtactggtcggcagtcagcaatcaattctcgccggattagtcgtggntgccattgcgggtatgattggttcgctactcggatgtctatccggtgtgcttggtggacgcgcagacgccatcatcatgcgcatcatggacattatgctgtcgattccttcgttggtactgacaatggcaactgntgccgctctcgggccgagtttgtttanacnatgctggctattgcta

SEQ ID NO: 513279 - DNA, 657 bp, Homo sapiens
  misc_feature (21)..(21): n is a, c, g, or t
tggtactggcccgagttcttngatggggtcatgacggctgctgattctggggctggtcaggaaaccaaggagacccccccccccaagcatggacccaccgtcaccgaagcctgtgaccgtccacaaacccagcccacagccacctctccgctgacttcctaccggtggcacacatggcggcggtggggagaaggctggctggtagggttccagcttgggtgccgctttgctggctggggcatgggcccttgagccactcatgtgagcccatggttcagcacccagccatgcccctcgctcgatattccgtcgggtcctatctgcgcctcccaaggagtcacggaccagtcgccttcgactctccaaggccctctgggggaggcataatgaacccaccgccggagccagacccggagccggagcaggaggcccagagctggagccggatgccagagcttggagccccctagcccaacagattccatacggccccccatacccaacgttgccttgtcttgggaccattcggagggctaccacgccgtgctagatgcgagaacgctaggtagcatcgcattggcaggaacgaggacagagaggtcctcgaataggcacccgaggttggaaaagtgatacgctccgacgaggcgcatccac

SEQ ID NO: 513280 - DNA, 752 bp, Homo sapiens
  misc_feature (371)..(371): n is a, c, g, or t
atatgaaggggacaaatttcagagtatctagtttaaatttatgtagtcgagtatccttttgacgttctcctcaggtcagtgtatactaggtgagaatattcctgttcgtcctcatgtgtataggcaagggtcatatctgtttatccattctaacagaagactggtcgcccagcgctactcagctcgcaacctcgatgttgtgcgttgaagctatatattagcattgcgttgtcacagtcgtgcaaacggaaaagtagactgaacatccgtgatacattactcatgttagtgtagcgacacctatgtaatcaaagaattccataagaacaaatacaacaaacatgagtggtagttcatgactgatatgctgntgttgacgtgctcatcttggtcatatctatcccatcccataaggcacggacacgtaatatgtgtcccatacacatggagggtaagactaggactgaatgggcacacctaattagaactcaactttgcaatgtcttaccttctctgcaacaccattatctaagaacgcctaatttgaaccgtgggaacacgatggatctcctaataaggcgacatcgatatgacctaacttccgtgtaatactgtgatctttcagctcgatgtgcgattctgggcgcatgttcgaacggcgtgttcagacccaggtcaaccgggacaatgctattattagctcatacagtattaatgccggtgtcacggtaaatgtcaagttataattcctc

SEQ ID NO: 513281 - DNA, 159 bp, Homo sapiens
cgacgcgatggaggtggtggtggtagctgctgtgggaggaagtgatggaggaggtggtggtagctgctgtgggaggaagtgatggaggaggtggtggtagcggctgtgcgaggaagtgatggaggaggtggtggtagcggctgcgggaggggtcgacgc

SEQ ID NO: 513282 - DNA, 323 bp, Homo sapiens
  misc_feature (205)..(205): n is a, c, g, or t
ttcctctcgacatctcctggggaacatagcagcagtggtgggagtggtgtccccttttctactctagcccctcctccacccctgttgaccactctggagttgtacccttcccatgcccacactggcaggcacggagtagcaggggctgtgcgagtatttcccaatgaccatagttccctccttcaagggaccctggctgagcatnttgtggtactcccaggacccagggaccacggggcccaacccaactggacctcaacggccttggcctaagcccgtgtacagagagagcctcacgcttaccctcccaattctcttggaac

SEQ ID NO: 513283 - DNA, 243 bp, Homo sapiens
gttttgccccccccccccagggttgttttccttaaattagggccccccccccctggggggcttcaaaggggggggggccccccccctgtttcccccctggttgggccatataaaaggggcccggttttccttccccttttaacaagattgggggttttctggggcccccccaaaagcaaaaaattttgggtttcctggcccctttttggggccgggggcccatttacccctttttttttttta

SEQ ID NO: 513284 - DNA, 182 bp, Homo sapiens
gctgcccagagtctaggtaagagtttgttcccgtggtgcggagggtcaaggcccacacccggaaacctagcgaggtaaagttgcgtttttggttgtagaaacgacaactttttccgctttcctgggcgatggcggcgtccggaagccgtatggcccaaaaaaccctgggaaactggccaaca

SEQ ID NO: 513285 - DNA, 972 bp, Homo sapiens
  misc_feature (1)..(1): n is a, c, g, or t
  misc_feature (206)..(206): n is a, c, g, or t
  misc_feature (211)..(211): n is a, c, g, or t
  misc_feature (246)..(246): n is a, c, g, or t
  misc_feature (250)..(250): n is a, c, g, or t
  misc_feature (260)..(260): n is a, c, g, or t
  misc_feature (264)..(265): n is a, c, g, or t
  misc_feature (276)..(277): n is a, c, g, or t
  misc_feature (282)..(282): n is a, c, g, or t
  misc_feature (286)..(286): n is a, c, g, or t
  misc_feature (288)..(288): n is a, c, g, or t
  misc_feature (294)..(294): n is a, c, g, or t
  misc_feature (321)..(322): n is a, c, g, or t
  misc_feature (324)..(325): n is a, c, g, or t
  misc_feature (330)..(330): n is a, c, g, or t
  misc_feature (332)..(333): n is a, c, g, or t
  misc_feature (338)..(339): n is a, c, g, or t
  misc_feature (343)..(343): n is a, c, g, or t
  misc_feature (345)..(346): n is a, c, g, or t
  misc_feature (358)..(360): n is a, c, g, or t
  misc_feature (362)..(366): n is a, c, g, or t
  misc_feature (374)..(377): n is a, c, g, or t
  misc_feature (380)..(383): n is a, c, g, or t
  misc_feature (387)..(388): n is a, c, g, or t
  misc_feature (390)..(390): n is a, c, g, or t
  misc_feature (397)..(397): n is a, c, g, or t
  misc_feature (414)..(414): n is a, c, g, or t
  misc_feature (418)..(419): n is a, c, g, or t
  misc_feature (422)..(423): n is a, c, g, or t
  misc_feature (427)..(428): n is a, c, g, or t
  misc_feature (431)..(431): n is a, c, g, or t
  misc_feature (441)..(441): n is a, c, g, or t
  misc_feature (444)..(444): n is a, c, g, or t
  misc_feature (446)..(446): n is a, c, g, or t
  misc_feature (451)..(451): n is a, c, g, or t
  misc_feature (461)..(461): n is a, c, g, or t
  misc_feature (477)..(477): n is a, c, g, or t
  misc_feature (488)..(488): n is a, c, g, or t
  misc_feature (496)..(497): n is a, c, g, or t
  misc_feature (500)..(500): n is a, c, g, or t
  misc_feature (512)..(512): n is a, c, g, or t
  misc_feature (537)..(538): n is a, c, g, or t
  misc_feature (553)..(553): n is a, c, g, or t
  misc_feature (569)..(569): n is a, c, g, or t
  misc_feature (579)..(579): n is a, c, g, or t
  misc_feature (581)..(581): n is a, c, g, or t
  misc_feature (590)..(590): n is a, c, g, or t
  misc_feature (596)..(596): n is a, c, g, or t
  misc_feature (601)..(601): n is a, c, g, or t
  misc_feature (606)..(606): n is a, c, g, or t
  misc_feature (609)..(610): n is a, c, g, or t
  misc_feature (612)..(612): n is a, c, g, or t
  misc_feature (615)..(615): n is a, c, g, or t
  misc_feature (618)..(618): n is a, c, g, or t
  misc_feature (627)..(627): n is a, c, g, or t
  misc_feature (631)..(631): n is a, c, g, or t
  misc_feature (643)..(643): n is a, c, g, or t
  misc_feature (652)..(653): n is a, c, g, or t
  misc_feature (659)..(659): n is a, c, g, or t
  misc_feature (662)..(662): n is a, c, g, or t
  misc_feature (684)..(684): n is a, c, g, or t
  misc_feature (696)..(696): n is a, c, g, or t
  misc_feature (723)..(723): n is a, c, g, or t
  misc_feature (736)..(736): n is a, c, g, or t
  misc_feature (757)..(757): n is a, c, g, or t
  misc_feature (759)..(759): n is a, c, g, or t
  misc_feature (761)..(761): n is a, c, g, or t
  misc_feature (764)..(764): n is a, c, g, or t
  misc_feature (771)..(771): n is a, c, g, or t
  misc_feature (773)..(773): n is a, c, g, or t
  misc_feature (778)..(778): n is a, c, g, or t
  misc_feature (789)..(789): n is a, c, g, or t
  misc_feature (796)..(796): n is a, c, g, or t
  misc_feature (800)..(800): n is a, c, g, or t
  misc_feature (802)..(802): n is a, c, g, or t
  misc_feature (805)..(805): n is a, c, g, or t
  misc_feature (808)..(808): n is a, c, g, or t
  misc_feature (815)..(815): n is a, c, g, or t
  misc_feature (823)..(823): n is a, c, g, or t
  misc_feature (834)..(834): n is a, c, g, or t
  misc_feature (836)..(836): n is a, c, g, or t
  misc_feature (847)..(847): n is a, c, g, or t
  misc_feature (853)..(854): n is a, c, g, or t
  misc_feature (863)..(863): n is a, c, g, or t
  misc_feature (868)..(869): n is a, c, g, or t
  misc_feature (894)..(894): n is a, c, g, or t
  misc_feature (898)..(898): n is a, c, g, or t
  misc_feature (905)..(905): n is a, c, g, or t
  misc_feature (909)..(909): n is a, c, g, or t
  misc_feature (945)..(945): n is a, c, g, or t
ntggaagctgttaataagccacatggcagccaagagccaggtgtgacctagatcagctggatgcaagtgcctgtcccttcatccacacaacctgctgctcggggaccctgctaggatgcgcttgctggcaaactggctaaaacccaacagggagaaatgatgctactgctcatcatttccacctccccacatcccatgtccaaganaatanaggaaaatgccacaagtacccctccaaaataaacncgcntgcgtctgtntgtnntactgaggagnnaggantgtncnaaggcnctgcagctaaccagcagcacccagcannanngaggnannagtannttgntnnctgttccagtgnnntnnnnngcagagtnnnnagnnnntaanntngaagaangaacataaaattgcatncttnncgnncttnnaanaagattcctncananctcgngagctggccncagcgtcggccgaaanccccaagccanctcaaaannatnagcgtctaagangattagaggagccttctataccgcnnccagggcccaatccngcgagcgagaagacgncaaggatatnanggcagcaancagagngccanaagcnganngnaangtngtccataancatngccaaaaacaangctcgccanngccgcnagngcgtaaataaaacgcacagccnagtatgcacttnaagggcctccagtggcttccaacttcnctgagattccganccagaatgtaacacggccttnancntcngccaccncncgtantagaattccancagtgcnatgnanagncanatccatnattggaanaaagccgaaantnctagtcgagtntcaganntaagaggangatcnnccagccccgtgcccacagagaaagnaaantagaaanccangaaatctacccagcccatgaaaagaaacctaagatngcttctatttccgtcagttgtttctta

SEQ ID NO: 513286 - DNA, 935 bp, Homo sapiens
gacacggctccacctcatgagttaagagaatacgtcccaacgcacttcatgaaatatgggttattgaagatcctatacgagtagagcgagtcaacattcgtcgtttgagacagaagacatggattactagcttctgatggcagccacgagctagtcatgtgtgacgagtaatcgctgtctaaccagtgtgtgcaacttgtactggtcgactctgggcatctagaagtgctcgcgtgacaggcgtaagagaggtagcttgcaaggtaggaattcccaccactgttcatcactggtgcctgatgcacaggagggatacagcaagaagatgctcatgcacaacaattactggtagcagccaagaagaaggtaatcgtctcctaactgtaaaagcactacaaggtggacacacatacctcttcctccgaaacccattgttcatgctcaggatccagcgatgtgaaggctgctagtgccaacagcatctccgttctagtaattgaacacaaacgagacatgtcaggaaaggcgaggtactggggattcgagagagtagatcctgccaagtgagcaacgagaggacaggcatctatcgaggcaggggttcacccacgtcatcccactgatgattggatcgacgttctgtaggaaagatgacccttggacttgcatggttgaatccctatgaaggaatcatgcccagctcctgatggaggagtcaagacgcagtactggatgctcagcagcttcgttggagtcagtaatcgtcgtaatcccttgtggaaagtaggcctggagatttggactggggaaagctgcttgtgaacttggggcgggatcgtgtatttctcaagggaaaagcatttttgtgaggcccacctagaaagggttgggcaccctgttgttggcagtgggaagaaactcccggcccatgttgg

SEQ ID NO: 513287 - DNA, 624 bp, Homo sapiens
aacaatgaaacggtcatcctggatctatccccatattagtctgtctggaactaccaatgtatcagtcttcatatatgtctcgagaagctacatatacaacaataaataatacaatttttttttttataaatcaatgtagcatgcatacagtttgacaccatgcttttctcaaataaacattattatgccttagagatcttttcatctcagtacctaaagcacttcttcattcctttttcccattgggcaaattagtttcaccaatcctctgtaatttattatctaaagtgagacattgagaatgaaagcactattaataattatccaagaacagcaggtataaactggtagtgttcaaaaagccaaagcatatggttatcctacctatggcagatatttaggttgcttccaattctttgacattaccaagttgcaaagaatatacttgtaaatacatacttttgcacatctatgcgctttgtttggtaggataaatttctagaagtggaattgcagggcaaaaggttatgtatatgaatttaaaaagttcacggactgccaattgctgtacataaagagtataacaagtcacacttccctagcaggatagagaatgctggccta

SEQ ID NO: 513288 - DNA, 223 bp, Homo sapiens
  misc_feature (5)..(5): n is a, c, g, or t
  misc_feature (12)..(12): n is a, c, g, or t
  misc_feature (111)..(111): n is a, c, g, or t
ctccnttccccntttcccaggatgcagcaagccaaaacagtaccactgcacgtcagcctgggtgacagagtgagaccctatcttaaaaaaaaaaaaaattggctggacatngatgtcacgcctgtaatcccagcacttagggaagccaaagtgggcggatcatttgaggtcaggagttcaagaccagcctggccaacagaggagactgtgtctcctaaaaaaa

SEQ ID NO: 513289 - DNA, 937 bp, Homo sapiens
ggtaggggtgggagggaatgcagatgggagtgggggaggggaggatacagctttcaggatatcccaggcgctggggatcagggccatggggcaggcattggctcgccacttgtatccagaagttcccaggggtgaatgtgatgcgtggtgtgggactggaggtgtgataaggtgttcttggaaggaaggggcaggaggtggaactgtagtcgggtccctactgggccccacactgaggggtcgtgaacaccgcgtcccgcgccaaccatttgcaatggttttcgtctacccagggcagtgtggggcttgttcttagaaagtcatgtaccagggcaaggagcaacttctttctgatcagatgtaaccaagtgagaaagtgcaataaaaaggagaaataacagaaaaggagaagagaggggggggcgcacgggttgtacggagtgatcttcgcgccccaagggtgggcacgcaggctatgaaaggggaagtaccccgagttctctcttgtgtgcaatcaccatcggtggcccagaggaaaggggcgcggtcggggacattataatagccaccggagagaggcaaccaggggcgtggcgggaaagaaaactcggaggtacgtgggaccggggcacaaactgaggcgacacctggggcacatcgctcccgcgttcccggagacccgtcttactaactggagtgggagcgagggcgcatctgtagtggagaccaagtaggcaccgctcagcacgagagaactctacacagccacgccctaggggcataagttcatacagaaagttgtgcaccgggtggccaacccgcgcgtggcaaaccataggcccagtacaaggcatggataggacgcaccgagatgcccgccaacgagaggaatgtagatcaacgaaagcacttttattgccctgcggggacgcggaaa

SEQ ID NO: 513290 - DNA, 297 bp, Homo sapiens
tacgaggtaggaccggcgggagacggctctggccagttccaacaccaagaggggggcaacttttcaaaggaaatacagtcacggcgggggtggggcaaaaaggcttcccactttctctcgtctccaccggatcagccagaccttccgctagcttagcctcttggtcccggtcactcaaagttggtctgcagctctcccggtctcttggtacctctctcagggtgggtcctccccggcctcttcccttcagggtctctctgggtcacttctcatgtgtcggcgtcccggtcggtcact

SEQ ID NO: 513291 - DNA, 717 bp, Homo sapiens
ctacttgggtgtcttcccatctctgtgactcctggcatattgacgagtctgagggtcctcaaacttttccactccccctcccagcccaaactgcaggcaccgccgtgacttcctgccccaccacattcccccggtcaaaccacacgccccgcgaccacactccacacccttcatgcctcacatcactgtcctccagtcacccactctccacacaagacccacgcgtacctcgtgtcgagttatataggaaagaatgtgaaacacagtggaaagagtatggatttaggagtcaagcctggggtgaaattccagctctgacatctaccagtcctgtgatcccagctactgtggagaggctaaggcaggcgagatcacttgaatccggcaggtggaggtgcagtgagctgagatcacgccactgtgctccagcctgggcaacagagtgagactccgtgtcaaaaaaaagagattgggaacacagaccgctgggcagacagcgggcggagggggctctccactggacacttttgccccacttcgcctatggagggagaaccagagggaggacgaggctccttatcccaccgcggggaatctgcacccttgggggcgacatgccagaggttttagttgaccgccgagttttggaacctggcgggccactaacggggtgcgcgtcctcaccatatcaccaaataccgagctgcacgaaaccgg

SEQ ID NO: 513292 - DNA, 274 bp, Homo sapiens
  misc_feature (126)..(126): n is a, c, g, or t
  misc_feature (231)..(231): n is a, c, g, or t
gcactttgtgaggccgagatgggaggatggctggagcccagttcatgaccagcccaggtgacatagcaagaccctgtccccacaaaaaaatacaaatataagccttgtgtggtggtggcacctgtnatcccagctgctccggagtctgaggcgggaggatcacttgagcccaggaggtcgaggctgcggtgagctgtgattgtaccaccgcactcagcctgggcgacaganaccctcttgctaaatctggcgaccttcagctaagcaagagcgg

SEQ ID NO: 513293 - DNA, 1265 bp, Homo sapiens
ggagaggctctggctcttgcttcttaggcggtccgaggacgccatggcctagtgcccgatgactcggggaaagcagtcatccagactcacctcggaccagcacttgtgtgtccttggtgagatgcgttcgttgtatttgtgacgagatcgcagcatcgccttggcttgcccgttaacccattcgacgcatgcgggacttggttgactgttgccgggtgctcattgcgtcgctggagagcacgtcgtccgtggggagggcctattgacctctctcgatgcggcatatggtggcgccatagtccatggcgttgctcgtatcattgctggacatgcttcataagctcgctgactggagcgagtagccgcatccgtcagtacctccaaggtttcttggacttgcttagttgtacctactatcatacgattcgcaccgtggcgtgggatggactattgcgttcttcagacgcttgcttgccagaagtgacgttgatgtcttctgagctgagcaccgttgatcgtccgttttcatccccgatgggtcctgatgccttcggccatcgccttacatagtaggcgcgagtgtatcgtcgtgttcttgtgtcacccttcgggctttacttacttgaccgtagatggtcgtttcctactcgaactcgagcgtcgttgtgagtgcttcttggagcatggcataatgggacctacgtaaccacgcagggggatcgaggcattcctaagccaccacgcgtgcgctcgaaagtgtaccgcctgacacgttgttaggccccaagctctggcgtcggccctttaagaaactttacccaagcgttcacctttgcgcaacccgcgcacggcactatccctaggtttaagggggcacgcagcatccggttttttttcccccagtagctttgccctccccggtatattaacgcgttggttgccccttctgggcctttttcctccttcgacggcgtgggacacttgactagcggtacgtatgcccacgtccctgcctttcacgttggtgtcactctttatgtggttccccctttccatcggaggggaccttcacggatcaattttacgcagttgttgtggcaaataaccccccagggatccaggatctacccggttggaacctatagggttgatgaaaaacaccaggccccggatttcccacccttgaagaccaagcggaaccgtctgtgataagcccctggggactcaaagtgggcactcgcgcagcaatggatgcattaaagctc

SEQ ID NO: 513294 - DNA, 290 bp, Homo sapiens
ccagaggcaccaaggagcggctgcctttattccaggctctgaaggagctgcctattcaatcctcagacctccacagcacacagagcggccatactcatctctgtattcttctctgtgcacctgttggggacaccaggccttcgtctctgttgggacctccacctgcagaggcttcttgcctttgttgtcaaaagtctactcatccttccccagagccccctcacaataacctgcactaaggcccctgggtttcccagctgcaaaccaccctccttggtgctctgggggta

SEQ ID NO: 513295 - DNA, 1522 bp, Homo sapiens
taaaaacgggaaatctatttaatcccatctaaaaatacaaatcaggaaagggggggaaccataggaaaattcttccacctctcttaacagagcgaagtttacgtggcttttcgtgcttggccccaagaaatctcccaagggctggagtgtttgtggaagggaatttactctgtggttctttcaactatactctcccgagaattacctcagaacatataaggttatacaccaccactctctgtggagagacagcgggctctctgttgccctgtgtctgtgagaggctataagatgtggagagcgctctcaagtgtgcgatgtggagagagacatacgggaggcatctcaatctctataagaacaaaaaatgtgatctcacacagagaaacacaggtctgtgagcgtgtgagacaggtgtgtgtgcggcgcacactatccacagggacacaggtgtggggctctctctgtggggtgcgctctgtggtgtgtgtctcgccagagaaacccccactataaccagcgctgtggggactgtggggccctctgagagaagagaccccacacccagagaccagaagcctgtgtgttgttttccgaagactaataacagagacatcatccgtggggcgtctcttataaattctcacccactactcgcactccgaggccaccaagagccccctgtgtgtggagagtcccaaagagcccctttagacagagccactctctctttattcaaaagagccccccccgttgggcgtggggggtgaggaggggtatacaccaccatcaacataatatatcctctcggcccctctctatctcacaacaatctctgttgcacatgtgtctaacaggcgcccttcgtgaacacgaggggtggtagaacatacaacatgcgtggggggacagaagcgacagtgtctcaaggactcacaccctgtgggaaaggggctccctgggttaaattctacaaaataacaacaattttgggccccagtgggtccccccaagatgttacatgaaaatgcccagcgggtgtgacactcccgggtactaggggaaccgccccccttcggaaagggggctcttgtcgcacccggatccatgtaccaccacaaactgtgtttgggggcaactctggaagcgggtccacataaggcgggagggacaacactaccctaggggctgacccaccccgcggcgttagtaaagccccttctccttgtcacaggaccccaagatgttctatatccatccctcacaagaaaattgccacaacaacttgtgccgctcacaacctccggcgacacaactcggcaccaacaaagacatggtgggcactccctctctctaaaaagcaacaaagagacaagcgtgtgcggtcacctctcaaggagggagaacttcctccgtgtggaatgcacacccacaggcgattcctgacacaacgttgcgccgcaggaccacacagttggttacaagactgtgaaaagacggctcttaacgaaagaaagtgtcc

SEQ ID NO: 513296 - DNA, 113 bp, Homo sapiens
catcttctcccatcagtaacgatgaggatgtgtacaacaaagtagagaggattggggtgatagtacaggtcaggaagaagtactctcatgtggacctgatgggagcatagatg

SEQ ID NO: 513297 - DNA, 475 bp, Homo sapiens
accagggaactggtgtctctcttaggagaaaatctctttttgtagtcccctaagcccagtgaagtagaaaattaagtttttgcccactaagtctctgaaataggtcagaacagacatccaccattaaaacacatttaatactagattacgttctctccctattctactttgactctccatttatgcccagctacatgattcaaaagagaggggtatagagtgagcaccacatgttagtcagactctttctgttataagtaacagaacaccatcccaaactaggtttatgcaaagaaaggaatttattgtttcacataaattaaaaaatccagatgtggcagcagcttcagacatctgcttcaaagtatgatatcaggagttggttgtgttccatctcttcgttctgctaccctttgtgttggcttaattctcaggcaggctttcccatgccattaaaaaaaaaatcctcgttaaa

SEQ ID NO: 513298 - DNA, 102 bp, Homo sapiens
ctgctccgcccctctctggagaccaccacctttactttattccatctttcaggattatccagccattggtgggcacaatggctcacacctgtaatcccacca

SEQ ID NO: 513299 - DNA, 116 bp, Homo sapiens
tgctcctcacaaagaacagagtgtgttggacatctacctctaaatacaggtttagtacggtactattctgtagctctgatggtactaataattaaacccagataattttgtggcga

SEQ ID NO: 513300 - DNA, 993 bp, Homo sapiens
  misc_feature (420)..(420): n is a, c, g, or t
aaacatgtgcctgaattcctcacaaccaagttaggaccattctatcagcctaatagaagaactactgttatgtatgatgagcatgacgacgtaagctcctgcgtcactcagtcctgtcgttctcgcatttctaaagcttgagcttgactaatctattccagaccccagtatctaacctattctgccaacagagttccattgtatgttaacacctcacatgggtcaaccccaaacacagggcatgcttcacttaggactggggtatcagagaagattacatagtgatgctcgagagacagtcctaccaccgtcctgtttgacacaggaacacctgtcaaccgtcatgaagctattcacttcaagttatcgaggagagctaaacgcctgcgagcatagtgaaaccatgatgattttcacatngagtcagaggctatcgccttacaccgatgacaaagagagatcagacataaatctagctctggttcctctgatgttaacggaagcatgattcatccaaatgggcatcccaaacataggagctttacaaggacatgcctatcatcgggtacctactattaaaccgagatgaaaaagaagaaccgtgtggcactgcagaatggcccgggcagaggcatttgaacggtcagatcgggagccgatcggaagtaggcggatccactcttatggcgatgcctttgaaagttttactttcaatggtagaaatccatgtctacctcaaatggtagtaccccctagcaaggggttctcgtaataaatctacacgctaggagcactgcatattgtatacaagattggtactggttcgtggggggccgaagcgtgcaggagacaattgaagcccagatccatactcgataagcaagatgctatgggttaatgaatcttgcgggcagctagatagccggaacataagtagatactctaagtggggatcccacttaagttggaccaagggggtaacaaagtgaatcc

SEQ ID NO: 513301 - DNA, 179 bp, Homo sapiens
caatcgccgatctactttccgtctcgtatgaattcagagaacactactctaggtccgttatatacgtggaatcatacagtgctttccttttgtgactggcttattttgctatcgcataatatccccaagggtcatccatgtcatagcatgtgccagaatttcctttttttttttttttt

SEQ ID NO: 513302 - DNA, 1088 bp, Homo sapiens
  misc_feature (388)..(388): n is a, c, g, or t
cgtgacgcgtgggcaccagcaacacagggtgtcgtgaatattgacccctaatagctcaaaatgggaactgaaaagactacatatcacatcattgtcagtcattggagcacagtacgatcttcgggtcaaggtccagccacatacgtgcgaccgaatcatgagtctactcaatgcagagtgtgcattcgatcaatatagaaccattgaagataatttgtagaaggaggctgtctgtacatcgggcacaagggctccttcaagatatgccatgggtcgttgacgattaaactgacaacgctgagcgtgaacagtaggataatcaccagttgatatctcctttgatgcgaacatttgacgacccagcgaagatagctatgtgaactaatcnattgaatggccccagtggactacagagagatactttgatccatgaatacatgaattcacagaggatcgatctcagggctgaactgatgtctgtgccttgactagttgcatggctggattgttggtcgagattcttgaaacgtcctgtgtgattcgtcccaagcacattggggacatgaatcacgcgtacgaagcaatggccgctcttcgtagggcttaacaaccatcgtgcgggtggttgcacaatcattgctatagtttgctcgagctgtatcaaccatatagatcgtgtacgtactcactggaggctcaacaccctatcgagtcccacgcatagcagcacttgttcgaggacacggtgggttccaaggggaaatgtccagcaacctttaccagtgtaacgaaagcattggcgcttacaaatccccgagcacaggaaagccatttggtgccctagttttcttgggctttatgaactgggtagcacctaaccattggcgttgcgaagcccaaaggtgggcgtaaaccattggccactttggagctctcaaggtgcaattcgcaaaatgttcaaccccggttacagggcattgtgcaaatgggccaagtgtgaacgcagacctcagagcctggagaggattctctgggcacttagattccttagcacgagcattatgttttgcccacactgggacagcgtc

SEQ ID NO: 513303 - DNA, 423 bp, Homo sapiens
ctttattctaatatcaccaatctaaagatattggaaatatgccatttaagagcacctaagttctacagttgattataaaccaccttttgaagaggatcaaaacaagactacgattgtctgtgaatcacaagatgtctttagacagtcacagtcaaaaacacaattgacaaagaaatttcgttatttctgtggtttacaataacttaacataataaccctaattataattgatatcatatactcagatattagaattttagaaatcttatacaattttggaacatatattaatatatatattaatgttattcactaaaatgtaacctgaataagattaaacattattcttattttggcaatcccatgtaattaaacatgtcaaataatccaggggccctctatggcatccaagaacagggttta

SEQ ID NO: 513304 - DNA, 615 bp, Homo sapiens
  misc_feature (18)..(18): n is a, c, g, or t
  misc_feature (100)..(100): n is a, c, g, or t
  misc_feature (128)..(128): n is a, c, g, or t
  misc_feature (133)..(133): n is a, c, g, or t
  misc_feature (143)..(143): n is a, c, g, or t
  misc_feature (163)..(163): n is a, c, g, or t
  misc_feature (303)..(303): n is a, c, g, or t
  misc_feature (315)..(315): n is a, c, g, or t
  misc_feature (337)..(340): n is a, c, g, or t
  misc_feature (390)..(390): n is a, c, g, or t
  misc_feature (410)..(410): n is a, c, g, or t
  misc_feature (425)..(425): n is a, c, g, or t
  misc_feature (427)..(427): n is a, c, g, or t
  misc_feature (463)..(463): n is a, c, g, or t
  misc_feature (486)..(486): n is a, c, g, or t
  misc_feature (489)..(489): n is a, c, g, or t
  misc_feature (493)..(493): n is a, c, g, or t
  misc_feature (523)..(523): n is a, c, g, or t
  misc_feature (531)..(531): n is a, c, g, or t
  misc_feature (542)..(542): n is a, c, g, or t
  misc_feature (549)..(549): n is a, c, g, or t
  misc_feature (555)..(555): n is a, c, g, or t
  misc_feature (592)..(592): n is a, c, g, or t
cccccccatccctccctncctccacatcaccctccacacccccctcctcattcacaccctcctcaccctccctcctcacctgcactcctccacctccaanatcttctccacccaccaccatccccccnctccnattcccaacnctcccattcccctctatccntccaacccccaaacccaccaccactacctctcctccattcaccacaccctctacttcaaccacccccccctcaacatcattctccaccaccccccccacctcaccaacctcatccacaccaactacccccaccttctgcnacccatcccacncatctctgaccagaaaccactnnnntccacaacctctacaacatgatgcccaatcccatcctcaacctccctccnatcaatctcaatcactcccncaccaacaccaactntnacaacctctatccctccccccactccctcatacatnccatcaacccccccacacatctnatnattncccccaacctacccctcctaccaccctatnctcatctncccaacccctntgcccancccctnccccctttcccaccccccctcatcatcacccacattnaccccatcaacccactccaccct

SEQ ID NO: 513305 - DNA, 92 bp, Homo sapiens
acggccgtgtattactgtgcgagagatcgaacccattatggttcggggaaaaactggttcgacccctggggccagggaaccctggtcaccgt

SEQ ID NO: 513306 - DNA, 286 bp, Homo sapiens
ttttatccatttaaattttgaatttttaacctttttggtcaaaaccccagccaacccccctaccctgggcctatgcgggggcgggatcaaaacccccccagcaggggccaggaatttttccccccccttataattgggggggccccccccaaaaatatattggcccttgccccaacccggggtccccgcctaaataattggggcccaaacggccccggggccccaatttaaatttccctgcctaaattgggaaattcttttccaaaaaaagtttttttgggggata

SEQ ID NO: 513307 - DNA, 154 bp, Homo sapiens
tcgcgtttagttcaacatgcgtctcagagattaatcccggaagttaacagcagcccctgggtctcagccccaaaacctcaggattgaatttgggaaaatggggtcttctgccgaccagcctacagacctacatggaaggaagcgaggcctgtgt

SEQ ID NO: 513308 - DNA, 344 bp, Homo sapiens
aattgtcaggtctaccaaaaattcatatttcagattatcacaatacatcccttacctagtgaaatcggctgtcataatctttcacaggggcacaggatggttcccttatgaagaagttgatatgccttttcccaactccagaaagtgacaagctcacagacctttgaactaaagtttagctggaacagtatgttagtgcaatatagtcacaggacagcccttctttccacagaagctccaggtagagggtgtgtaagttgcatcggccatgggatctgttgggtagacacacattaagtccaagcatttagatgtataggtagatggcggtaaaagcttgagta

SEQ ID NO: 513309 - DNA, 117 bp, Homo sapiens
agtttccaaagcagctcaccccctctgctattaccaaatccacccgtgattcccaaagccaccgggattaccaccaaatcttccacttctttctaactgtctgtgcagtgtgcttcg

SEQ ID NO: 513310 - DNA, 789 bp, Homo sapiens
cgccgagggttttttgcgggatgtccgctgttgtgttggattgtcttgaattgtggtttatgacttttgggtcgtttcactttcaaagcctcttgaatacctgtgaatgtacccccttgttatgaactgaatagttttagatcccagaatgtgttttaccaggagggatcaccatcgtcatgcttctatcagtttatttggaggttttgacaaaatctgttttttctttagcaacacttgcgtgaaacttccattattttcctcaaaccagataattctttctggtgtgacaaaccgttcttcctgtcttctttaaacgtgtaagggtgttagagaattcctttgtcccaaatcatgctgatttgtgctctcttgcgtattattccgattgtctgagacacatttcgcttctggccgtagacatattggcaattgcgtggtaagtgtttctagattgctgtcctgttgagcacaaagtgaggatgctcgccactgaagcagccctgtccaggggtgctgtttcaggctgggcatccgctcaggagcggccttccctgctaaacacaagggacttggggtgcaaaggggcatgatccagggtcccccagggtgggctcagctcacagggagaggccacccacgtggcagccccacctcttgtagagcccccagtgcgcggagcagataagagacctggacccagaggcagatctgccggggtggtagaaaaggtagattaggctgtggcaatgggattcaacacgatttaatacgttaagaattgcgtta

SEQ ID NO: 513311 - DNA, 135 bp, Homo sapiens
aacccataggaaacccctaaaggggactttaacccccgattttgccactgggggtttttagcagcttgctttagcctgctccccctctgtggaaaaaacttttgcttcaataaatctgtgctttttttgcttcca

SEQ ID NO: 513312 - DNA, 463 bp, Homo sapiens
gcaatgtggtgaagctgggggggtgggtttttttagaaaaaggagttgggggttttggggggggcaattttttggagggggaattttccgagtagggggggggtgggaaaaaattccagtttttttggtttgcccagaaaaatttttgggggccctaaatggtttttctttcccgggttgttggttgggccaataaaagaggttggggtggttttgtggggggggtttggtaacggaagccggggggtgtgggaggaaaaggtccccccccgggtgtttttaaatttgcgtggggggggaggggggagaaatattgccgtggttcctccgtggttttttgggggaaaaaggcggggagagaggaggggttggttttccccttgtcggggttcattgcatctgtgtgaagtaaggaagaggttttgaaaaaaaagattataggtagtaactcataatatccctt

SEQ ID NO: 513313 - DNA, 150 bp, Homo sapiens
ccttgaccgcgccggtgtccttgatcagcttgagcaaaggcttcacgtagatacgggtcggtgccatcagcaggtcggtcaaaggcttgccgtcgagctggatggtttcgatgtcagcaccggacacttcgatgatcttgcggatcagcg

SEQ ID NO: 513314 - DNA, 332 bp, Homo sapiens
gcgtttagctagaaggtgtacattctgatgagaaggtgactgtctctgggcaaggattggcaccggccctgcctgctgctgctgagcgctgcgggaagacactgacccgccgtgcgggcacgcggagcacgatgggcagcctctactgccacaagccctgctaatggaatcctcttcggacccaagggagtgaacacctgttgcggtgtgcagctacatctatgaccgggaccccgaaggcaagtgtccagcccctaggctacaggggctctcatgatgtgggctcacctgcgccccagaccctggaggggcccccctgtttgggtctgctg

SEQ ID NO: 513315 - DNA, 514 bp, Homo sapiens
tatgtctcgatcgttagagaaatgaatcagaaccataaggaggcaccaggcacagtgctcacatctgtaaccccagcacttggggaggccaaagcaggaggatcacttgagatcaggagttgaaaccagccggtccaacatgaagaaaccccatctctactaaaaaatacaaaattagcaagcaggctggcacagtggctcgtgcctgtaatcccagcacttggggaggctgaggtgggcagatcagttgaggtcaggagttggataccagcctggccaacgtggcggaactctgtctctatggaaaatacaaaaattagctgggcgtgatgttgcatacctgtaatcccagctactggggaggctgaggtgcgagaatggcttgaatctgggaggtggaggttgcagtgagctgagatggtgccactgcactctagccggggcaacagaatgagactctgtctcaaagaaaaaaaacaaaattttatagcaaatatcaggtttaggggagaaa

SEQ ID NO: 513316 - DNA, 803 bp, Homo sapiens
gcacagcccttcctgccgggccgggcccttcctggctgagctcgagaagtccaccagacatctgtggcacagggtgctcctcccacaggcggcacttcggggagctcagcggaccctgaagcctggtcgccctacggccccagtgccacgggcccccgacctgctacatctatgatgagttcctgcagcagcgccggaggctggtcagcaagctggacctggaggagcgcaggcggcgggaggcccaggagaaagggtactactacgacctcgatgactcttacgacgagagcgatgaggaggaggtcaggggcccacctccgttgcgtggccgagcagccgccctcaaaactggacacgtcctctgagaagctagacgtttttgcaacttttttggcttgaccacccaacagcagaaaggaggaatttggttgggcccagaagcggaggaagcggcggaggattgctggcgagagagaagcccgtcgcccccaacaattcaagagcaagcggcaggaccgccttcaccgaggactggcgctgtctaacccgctaacagcctgatgagatgaacaacagtcccaaactttcgaagaaaagaagaagttcctggagcatcttcaaacctgaccacatcagcgctgggaacgaggcaagaccacagcagagacttgttgacattggtccgtgcctggagcaggaagggcatgtcagcaggcaggggcgatccttgacaaatctccaagggagaggcttggcgcttccctgattgaaacagccacgcggagctctctgggtgtggg

SEQ ID NO: 513317 - DNA, 628 bp, Homo sapiens
aaaccactctagagaagtgctgtgccgctgcagagtcctcgatgaagtgcgtatgccaaagtgttcgatgaatttaaagcctcttgtggaagagcctcagaagactgtgtaatcaaaacaaaagttgtgaggcatatgttctgacgtcgagcgttggaagagatacaacacttccaggaatgcgctattaggttcgttacaccaaggaaagtatcccccaaagtggtcaagcgtccagaactcgttgtagagagtctcaagaaaagcctagggaaaagtgggcagactaatagtgatggtagaaactactccctggaatgcatgaaagagaatgctcctgtgcagaagactgatcgtatccgtggtccgtgaaccagtgtatgtgtgttgcactgagaaaacgccagtaaggtgacgagagtctacctcaaagtgctgtcacagaatcgcttggtgaacaggggagcatgcttgttcagctctggaagtcgatgaaactatacgttcccaaagagtttagtgctgaaactattcaaccttccatgcagatatatgcaccacttgctgagaaggagagacaaatcaagaaacaaactggacttgttgagcttgtgaaatgaaagccaag

SEQ ID NO: 513318 - DNA, 158 bp, Homo sapiens
ggctacagtgagctgtgaggatcacaccactgcacttcagcctgggcaaaagagtgaaaaaaaaaagatggtgccaccgcatctggccaaaacaggatctggtcccctcaacggcagggcactggaagaacctctatgttagtcatatccgtcatatc

SEQ ID NO: 513319 - DNA, 97 bp, Homo sapiens
ttttcccccgggggtttccccccggccccttttttggggggggccttgggggtttttccctttttaaaattttggggggtttttcccccccccccca

SEQ ID NO: 513320 - DNA, 1349 bp, Homo sapiens
agtgtcttttttccgatgttggtgtctccccctgttcgactcgcaatctgtgggggtttatccgcccgtgtaatctccgtggggcggctgtgtgcccgcggttgtcctggggatgcccctcaaggagcatctctcttgggacggggtccgcggcgcttgccgggtgacccccgtgttttgcctattcctgcaatgctgacaccacttgtgggtgcttctcgcgcggcttggtcctcttgcccatgcggcgggggcgtgggagttcccacccccgcggtgcccagtttttgcgccgcattccccatgggacacagaagggccccgttcctaaccccatccacacatataagcctgccttgggtgtttgcttcacaggtgggccccaaagaggttttcttagatccgccaggcccccgtgatttcccaataagttcccgcgttgggttttttctcgcgatagtggaccccccggagtgggaaacaccacatctgggggcatgattttggtggttccccccccgcccccccgtttattttagggagatccggtttggaactggggaacccctttcccacggagtgcctcgggtgaagattgcttgggaaaaaattgagtccttgcccccccggcgcttctgtgaaagaaaacgctgtgtacacacacccgtggcacaacacgcttgggaggtcacacccccacggccttcccacgagatcccccacttccctttctctgggagtgttggccgcgggcctccacgcttctgaaatttctggtgccccacgaggcccaagagatgtctcgagagttggccactctgtgaaggtcttttcctttcctcggggctctgattctttcctcgcggtctgggccctctaatgtattgccacttcccacggaggtacagagaaaggggctccctcgcacctgagactccctcgaggacactatttttataactggggagattgtgttaatcaaccttttttctgtgaaacgcctggcttgtcccctcgcccacgagagtttgcccacgctgcctcgggtccacagcctggtgcccccctcgagagattcacgaggttcctacacacggtggctgtgcacacgcacgccacccacggtgcatctcctttcatccccaccctcgaggctgatggctgtgagaccctgcttcctgcacacttacccacgaagcctctgcctgtgcaccggccacagctgcgtttactgagggccccaaggggtttctgtttctattctctcctcagactgctcaagagaagcaccatgagaaacccttacctgactttagagcttttttacaaaaattaaacctggtcctgag

SEQ ID NO: 513321 - DNA, 391 bp, Homo sapiens
  misc_feature (2)..(2): n is a, c, g, or t
tnacactggagctaaaagcaaatctgacattttaaactctgatgtggaggaggctttgtctgcaggaataagcctgacaaaggtagtggttattggataggtagaaacaggagctgtcgcatatgtgactagaagcaaatagataaggacagggtatagttgaccttaatcaaaaggcaaaggtgaagtatacctcctaaaggctaggcaagtctccgagtggctgacttctatctgacctacgttttaaagaatggagtagaggaatatgatatgggtaagacaaagcattgcagacacagcagactccaaagatgaagggaatttcttagtgaaatgagttccgcagggcacaatggaatggttttgagggaaggaagcagaaggaaaa

SEQ ID NO: 513322 - DNA, 345 bp, Homo sapiens
tgcctgagctgggtccagtggatcacgccttgtaattccagcactttgggaggccgaggcaggcggattacaaggttaggagttcgagaccagcctggccaacatagtgaaaccccatctctgctaattttttgtatttttagtagagacggggtttcaccgtgttagccaggatggtctcgatttcctgacttcctgatccgcacgcctaagcctccgacagtgctgggattacaggcgtgagccaccgcgcccggcctgttttgttggttttttttttgacactcgctctgtcgccgagaccacgccactgcactccagcttgggtgacagtgagactctctg

SEQ ID NO: 513323 - DNA, 916 bp, Homo sapiens
caacatgcctgtactatgaagaagtctaatcagtgtgctcttcatggaaaattaacagacaaaccatatgtattcactacttcagtattctcagataacatttattttattggctgggtgttatggctcatgcctgtagtcccagaactttgggaagccggggcaggaggaaacctgagcccaggagtttgagaccggcctgggcaatatggcaagagcccatttctatgaacaaatttcaaaaattagctgggcatgatggcgtggagcctgtggtacccaggctacttgggaggctgaggcgggaagattgctatgggtccgggaggtcgaggctgcagatgagctgtgttatgtggccactgcactccaggacgcggtgagagagcagacgacctgtctgaaaaaaacatattataatatcagattagagaccgggctcgggactctgtacaactgggactggaggtgccgcaatggcactgcactaccatagactccactgctaacgcaccaaaaaacaatgaagcctcaagattaatcccaacccagaactacaaaataacccgagaagcaggcatgcgacaatacacgggagaagaagacaaaacgaggacacgaggcacacaagaacacagcaaaaagtaacgcccacagaatgcacacaacaacgggaaaaaaccacagagcaaaaagagaaccacaaaagaaaacgagggaaaacacagggaagagaacacaccgaacacaggcaaaaaaaaccaatacatgcagacaagacaaaccgcactagaagaacaaaaaaagcaagcaaccgcaaacaacaaaacaggcaaaaagaaaaacaacacaacaacaagaacgcaaagacaacaaacagcacgacacaaaacaacaaaaaaacaaaacaaagcag

SEQ ID NO: 513324 - DNA, 469 bp, Homo sapiens
cagaaggatgaaaggagaatggtggattatagaagaatgggaggatgatggtctatggaaggatgatggaatggatgatggtcttggaggatgatggaatggatgatggtctatgggaagatgatggaatggatgatggtctgtgggaggatgatgaaatggatgatggaaggatggcagaatggatgctggtctatggaaggatgatggaatggatgatggtctatgggaagatgatggaatggatgatggtctatggaaggatgatggaatggatgatggaaggatggcagaatggatgctggtctatggaaggatgatggaatggatgctggtctatgaaaggatgatggaatggatgatggtctatggaaggatgatggaatggatgatggtctgtgggaggatgatggaatggatgatggtctgtgcctaaagcacagatgttcttgtgatgcaggtcgacacg

SEQ ID NO: 513325 - DNA, 649 bp, Homo sapiens
  misc_feature (273)..(273): n is a, c, g, or t
tgaagaggaagaagtcaagccgatcttgcagaaattgcaggaactcgtggatcagctctactcatttcgagactgctatttcgagacacatagtgttgaggatgctgggaggaagcaacaggatgtgcggaaggagatggagaaaaccctacagcagatggaagaagtagtgggttctgtccagggcaaggcacaagttctaatgctaactgggaaagcactaaatgtgactcctgactatagcccctaagggctggaggagccttctgttcnaaaggcttgtgaagctgggagcccgagctgggggaagcctgggaaccagctgggtgaggtgtactggaaaaaaggggatgttgcagcttgccacaactgcttctcaggagccctcaaccattggcaggaaccaagtctcctttgccaaaacttggccaatggtggctccggccggtgggggccggccctcggagaatgaccttctccccacctaggtctagtggcacggtgtcgcgacaggctaagtgggcgtgtccagatggatgtccatgatggccgctcctggtatattcttggggaatttcatatctttccctttacttctctactggccagaaccctaagatctcccagcaagccctcagtgctatgccca

SEQ ID NO: 513326 - DNA, 1114 bp, Homo sapiens
tacatgttgttagaagcacgcggtcagctacgcgactgcatggcagctaaaggatgtggcgagagatcattcatgctggagcgcgcatgagttgtgatgtgagatcccggtagggtcgaacacctaggggacaaattccacagccatcgtacgattaggtgggcttaagtcccttttgctctccatcctcagggttgtcattgtgaaaattgcccatatggcgatgtcgtgaccggggttgttcattgacgaccatccggactgctcttagtagaacacacgctgccagtcacaacaccgcagatgcatatttctcttggtagtgggggaatccatggattggaggcgacaaataccatgcacggagtctagggggtataactgcagactggaatgagttctctatgctgacgaatcctgcaaatggagtccagtacgtaggaccttctcaaaaactcctgttgtaaggtgtctagatgtgatctgtcagcattggatacaaggctctatgtgtgggagcttggggcacaaagctatgtcccgagcccgataagttatgtttcatgtgaacctgggtgtacaatctgattcactccagttcgatatacgctcccggtaccagactggataacgacatcattacccttcttttatactgtgatcaccgcagtggtaagggtatcactttcctgcgacctatttgaagatcatcagtgaaaatgagctaatatgtgcgtattgtcccacctgtattggcagccgtcagggtaactgcatgggctgaagctggagcaagctgaaaagtattctgacaatgcatggggccaaggttacgggctaatgtggattgccctcaggccttccatggagaaggggtaacatgcgaatagagttgtagacattttgagcctgccgggagcgaggggttattggaaaccggggaacatacaccctttcctgcggccaagtttcaggtgggccccatgtgggcctatgttgacacgttgttctttcgatatgtgccccacacggcgatataacacagaaaaccgggaaggcggtcgcaaaagggcaaatgattacctgcgggaaaagcccgcagctttcctctcag

SEQ ID NO: 513327 - DNA, 352 bp, Homo sapiens
gaggaccccttgggccttacctgttgctctgttagctatcgaggatctcgtcttcaatttctcctactcctgggccatgcgtgtatggctctgaagagagggattgacatcactgctgtgggaagcttcgagtaagtgagccacaaacccaagtttcagttctcccttgtgtgttctcctttctccttgccctctcccactttacatacatcttttccttcctaatacttttcccaaatgactataggtcccacactagatacaggaagcagcagcttcccagaaattgtctgtgaatccccctttgaataagccctatgttcgtatccatttcctaaagttctcctttatt

SEQ ID NO: 513328 - DNA, 1195 bp, Homo sapiens
  misc_feature (669)..(669): n is a, c, g, or t
aagtttcactcaacatttcaatactattggactccttgctttgtaaatcgaagtaaggagaaacgtgttcgcagattggactcagtattacatacaattgtaccaatgccaacacactcaggcagccgctatgcggtccttaacttcacactaagacagactagacccgcatcgaaacattcgaaactatttaggacaggaatagcgggaacggaggactatgcaagagaggccgcacataatccccgctaaaggcattgcggcagcatgacttatttttcacaagtattgcgtcaatccaaattataacgtatcagttcgtttcattttgctgttctagatataagagcaatggttttgcagattggctaagatatcctggtgctagtggctaagtaaagaataccccgttatatttatgtcacatatggctgtatgcaaggaaatcatgtatctacaagtggaccgcgggtattcatgaaggagaatctggggcacttttaatcagcttggccaagcggttaattacaatccttcattggcagatttggaaaggcccccataacatgtgttcggcacacagtggtgttagcctcgaaggaatgaatttggacgtgtccccgattacaccattgggggatacagttgccaagtgctcccacaagtgtnaacaatacgataaccctggtgcgtaaccccctttttgaccaatatcagttctaagggcccaacaacacttccactcccaaggtctctgtgaacgccactttgcgatcgaccggcagcggaaaacacaaggtgggcacagcttatcacgttgtacgacaacggggctatgtacatatcgttgtacaaacattcgactgttggcgctttgtctcagtcccacatcccaaggtggtaacccacgaggaagaaagcaagtgaactgcacccgttatgtgaagtgtttgtgtgctagtaccacaaagaaagtcgataaagcgcataagttgagtgtcgcgcatggcacattttggacatcatggggggaaacgcatagcgtcccttaccaacgtgtggaaaacctctacaggcacatattatggcgaactatacgcgtactggtggagtcccactttatcccacgatgcgatgatgtgtgtatttatcacccaacaatgaaagttctgaacaccatatgggatcagtcatc

SEQ ID NO: 513329 - DNA, 128 bp, Homo sapiens
tagggccgcgcccgcccgagcccgggccccgcccgcgccgcgggccccggccgcgccgcgcgccgaggccggccccgcccgcgccggcgaccgcgacgccgccggcggacgccccacggcggcagccg

SEQ ID NO: 513330 - DNA, 242 bp, Homo sapiens
agaagtcaatagcacctcttgattcataaatctcactctggccaggcacagtggctcatgcctgtaatcgcagcactttgggaggctgaatgtaccctaagatgaaagacaggaaaagcatcgatttaaaatgacggctatgttgcccaagccgatctccaactcctgttctcaagtgatcctcccacctcagcctcctgaatagctgggactatataattcgatttacttctttacctatc

SEQ ID NO: 513331 - DNA, 910 bp, Homo sapiens
  misc_feature (51)..(51): n is a, c, g, or t
  misc_feature (73)..(73): n is a, c, g, or t
  misc_feature (84)..(84): n is a, c, g, or t
  misc_feature (87)..(88): n is a, c, g, or t
  misc_feature (98)..(98): n is a, c, g, or t
  misc_feature (126)..(126): n is a, c, g, or t
  misc_feature (128)..(129): n is a, c, g, or t
  misc_feature (134)..(134): n is a, c, g, or t
  misc_feature (157)..(157): n is a, c, g, or t
  misc_feature (161)..(162): n is a, c, g, or t
  misc_feature (164)..(164): n is a, c, g, or t
  misc_feature (167)..(167): n is a, c, g, or t
  misc_feature (177)..(178): n is a, c, g, or t
  misc_feature (182)..(182): n is a, c, g, or t
  misc_feature (187)..(188): n is a, c, g, or t
  misc_feature (196)..(198): n is a, c, g, or t
  misc_feature (200)..(200): n is a, c, g, or t
  misc_feature (202)..(202): n is a, c, g, or t
  misc_feature (210)..(211): n is a, c, g, or t
  misc_feature (235)..(235): n is a, c, g, or t
  misc_feature (239)..(239): n is a, c, g, or t
  misc_feature (258)..(258): n is a, c, g, or t
  misc_feature (260)..(260): n is a, c, g, or t
  misc_feature (271)..(271): n is a, c, g, or t
  misc_feature (281)..(281): n is a, c, g, or t
  misc_feature (284)..(284): n is a, c, g, or t
  misc_feature (288)..(288): n is a, c, g, or t
  misc_feature (293)..(293): n is a, c, g, or t
  misc_feature (301)..(301): n is a, c, g, or t
  misc_feature (311)..(311): n is a, c, g, or t
  misc_feature (313)..(314): n is a, c, g, or t
  misc_feature (320)..(322): n is a, c, g, or t
  misc_feature (326)..(326): n is a, c, g, or t
  misc_feature (330)..(331): n is a, c, g, or t
  misc_feature (335)..(335): n is a, c, g, or t
  misc_feature (337)..(337): n is a, c, g, or t
  misc_feature (348)..(348): n is a, c, g, or t
  misc_feature (355)..(355): n is a, c, g, or t
  misc_feature (376)..(376): n is a, c, g, or t
  misc_feature (380)..(380): n is a, c, g, or t
  misc_feature (401)..(401): n is a, c, g, or t
  misc_feature (411)..(411): n is a, c, g, or t
  misc_feature (413)..(413): n is a, c, g, or t
  misc_feature (415)..(415): n is a, c, g, or t
  misc_feature (422)..(423): n is a, c, g, or t
  misc_feature (425)..(425): n is a, c, g, or t
  misc_feature (436)..(436): n is a, c, g, or t
  misc_feature (446)..(446): n is a, c, g, or t
  misc_feature (476)..(476): n is a, c, g, or t
  misc_feature (485)..(485): n is a, c, g, or t
  misc_feature (500)..(500): n is a, c, g, or t
  misc_feature (502)..(502): n is a, c, g, or t
  misc_feature (507)..(507): n is a, c, g, or t
  misc_feature (513)..(514): n is a, c, g, or t
  misc_feature (522)..(522): n is a, c, g, or t
  misc_feature (524)..(524): n is a, c, g, or t
  misc_feature (527)..(527): n is a, c, g, or t
  misc_feature (532)..(535): n is a, c, g, or t
  misc_feature (547)..(547): n is a, c, g, or t
  misc_feature (582)..(582): n is a, c, g, or t
  misc_feature (604)..(605): n is a, c, g, or t
  misc_feature (613)..(613): n is a, c, g, or t
  misc_feature (618)..(618): n is a, c, g, or t
  misc_feature (650)..(652): n is a, c, g, or t
  misc_feature (784)..(784): n is a, c, g, or t
  misc_feature (871)..(871): n is a, c, g, or t
gagtatgcaattatttagtatacactacaaaatcctcaattttagaaagtntccaactgtctaaatatcagangaatgcaatanttnngcacaaagangaaccatttcctatattatagcaaaatngnnatctncccgtattctaatattggggggngggnnanagnggaatattanngggnctacnngggggggnnngngngacctcannggctttactattttcatattttangacncatgatttatcctattttngnagcctggttcntacgttaaanganggtnagtgnggacggcngggggggttngnngggggnnnatcnaggnncaancnagaactatctnggtcacngacatttctattccttttgcnggtnggcacacagtgaatgcccggntggataaatngntngcattannangggtgtcttcntgtgtaaatngggggtaataccacctaccacacagaatgnggggggggngggaacaagtaggtncnggggngctttnnacgggtcngngtnatttnnnnaatctgtgttantaggtttgttattttacacaaaatatcaaatttcnaatgacctccagggcgggggtnngggggggnagttnattgggggggatgttttccttttaacaaagtnnncattaacacatttgttcagtgttcatttgggagggtgggaatgttgtcttatagctcattcaataaaacaccataattcaggtcaaatgccaatgtccttgtacctcctttgctaagtcaatataaggaggnatctgttttgtttcaagacaaaagcatttgattataaaaaggtctacagtttatagttcttactgtattccaattcaacagcatttnaccaaaggactttacagctatttcttttgtagcatatat

SEQ ID NO: 513332 - DNA, 408 bp, Homo sapiens
agacagacacgagtggtaagtgtgagggacagatcatgcatcgggagtacttacaaagtaacacaccccacccccaccctcaataaaaacagaagaaaaagccccatcactaaacaccaaacagcaacattatcaatacaacactatctttgctgcccaccagtgccttatcagaaagaggaggcctgtgagaagtggaaagagccagggtgagagggaagatttgcacttcagtctagtttccaatttccatttctcttacaggaagtcttcagtcatctgatgcctgacatcgagctctgagcagaaaccgagtatgtggtggccacgactggggtgccattgttggctgagtagccttgcctcaatgtttcaaaatatgatgcctgcacgggttagtgatactgc

SEQ ID NO: 513333 - DNA, 339 bp, Homo sapiens
cgccgcctcgaagcgctccggggcgccccccgacagggaaaaccgcctcggccccccacccgggcgctcggcaggtcagggcggcccgtcccgggccccggagccgcctccaattcgggcttagccctacaccggctggatcaccagcgctccgcagagatcctcaggggcaaggcgtgcccatgaagaaggctacacgttggagagcatgagagatccgccggcagccacggaggcatgggtaactggccatgagcaaggaggtgcagacctcatcgaaagcccagggcaaatgaccgactgagctgctggtgctgtacagtggagaggatgatgagc

SEQ ID NO: 513334 - DNA, 409 bp, Homo sapiens
ttttgagatgggaggcttgctcctttgcccaggctggagggcactggcgcagtctcggctcactgcattccagtctggtgacagagctagaatccatctcgaaaataaagaacgctttataggccaggcacagtggctcatgcctataatcccagaactttgggaggctgaggaatgaagattgcttgaggtcaggaatttgggaccagcctggccaacatggcaaaaccccatctctactaaaaatacaaaaattagccgggcaacgtggcgggcacctgtaatcccagctacttggaaggctgaggcaagagaatcgcttgaacccgcgaggcagaaattgcagtgagctgagattgtgccgctgcactccagcctgggccacagagcaagactccgtctcaaaaaa

SEQ ID NO: 513335 - DNA, 216 bp, Homo sapiens
  misc_feature (81)..(81): n is a, c, g, or t
tgtttcccagaataatggtatggaagtttctgttgtcttgtaataaaggcttttaatttcgattttattttaggaattagnatccgatagcaatcagcatgtcaaagcagctgagccttctgtaatcccagcgctttgagaggccaaggtaagaggattgcatgaacccaggagttcaagaccagccctggcaatgtagtaagaacctgtctctgc

SEQ ID NO: 513336 - DNA, 330 bp, Homo sapiens
cttttggggtctttgctcaggtatgtcaagggaacccaggaccagatgcataaagtgatttaacaatctaattgtatcacaaatgtataaaacaaccacagcgatggggtggatgaaattgttgtggacctaagtaattttggaaatagagtctataaaattaaaggcaaaagaaactgtatataagtactgcactctagttgaaaagttgtttcctgtgggatatgggttaacaattatgatactgctgtacaggtatgctgggactgaacaaataaatgcaaagatggtggatggtggaagccaggtttttttactcttagaggggag

SEQ ID NO: 513337 - DNA, 118 bp, Homo sapiens
  misc_feature (45)..(45): n is a, c, g, or t
  misc_feature (48)..(48): n is a, c, g, or t
  misc_feature (84)..(84): n is a, c, g, or t
tcatcaaggttgtggaggagctaactcggatccattagccaaggnagnggggccctttgctgaccctccccaaaggctttgccntgctgccctccccctcctctccaccatcgtcttc

SEQ ID NO: 513338 - DNA, 320 bp, Homo sapiens
taacacgagatgttgtatttaatcttatggccacgttcggtggcatcacgctctgtcatcccacgcactttgtggaggccgaggcaggttgatcacgatggtccggagatcgagaccatcctggctaacacggtgaaaccctgtctctactataaatacaaataacgatattagcctggtgatggtggagtgcgcctgtattcacatctatttcccgtgtttaagaaagagaatggcgtgaaccctggaggcggagcttgcggtgagctgagatcaggccactgcactctagcctgggcgacaaagggagactctgtctc

SEQ ID NO: 513339 - DNA, 850 bp, Homo sapiens
tggctgtggtgcctgagcggctggagcccaggtgccagcccgtggccgataagaaatggtggcggtggcggcggcggcgcagtctggacgggatcgtgggctggcggctcctcgccctgtaccctctgctcccccggccaggcccgggcgcgaatctggaggctgcggcgaagggaaggagtgagcatggctgatgaccccgccgaccgccaccgctggtgccgaaagttgcagcgaggagccggcgaggggcggggagtggcggccggaggagccgcgccgcgctcccgccgggggcacggacctgagagggctgaggcgtgggccgacgccgggcctcccccgccggggcagtcggaggcccgactcgcctggtggcctgccccttcttcctgctgtaccccggcgatggaggcgccggcttcggagtgcgcccggctgcctgcagcagcagcgctccttggaggaaccccggccgtcccccgggttcagcgggttgccccttcctggctgctgaggctacccgagcggcggcgggggcagcagcgggcagcgggaagcaccatcctaattatctccatggctaatgaacgcattgaagcctcatgaacatggccaagcttgagtatcaaggggctcgaattgactcaggttcttgaaaccttggaggagggaactcttggaacgtcgtgaccttatggcaacccttcttccagaggcaagatgcattatgaggtgggttgaactgggaagaagacttgatcctgaaaagcgatggggtttgaaaaagcttaagaaaaaagagttttaggggtcggggaagaagagagagttaagatcacttacctgg

SEQ ID NO: 513340 - DNA, 276 bp, Homo sapiens
gagaaggtcgctgtcaagatggagtttccaacccagtaaatccaagggccagaccgtgacctcataaaggcattttttttctttctgtccaagactgtggcaaaaggtattccaaggcggcatttcaaatttcttgccccttacttgttggaattcttttggcttgtagggggaagcattgagggggtccacgacccctttgtaaattcacatatttttaattctttcaagggctaaaagagaggggctgtacctcccggttttgaaaccctcttc

SEQ ID NO: 513341 - DNA, 127 bp, Homo sapiens
  misc_feature (17)..(17): n is a, c, g, or t
  misc_feature (39)..(39): n is a, c, g, or t
  misc_feature (48)..(48): n is a, c, g, or t
  misc_feature (83)..(83): n is a, c, g, or t
tggagtaaatacatttnttgatacccatttcatatatanttcatatgnccataatctataaatttaaaaagcatttttccttntggatgtcaccatggtccatgtaaatactcaagccagaattcat

SEQ ID NO: 513342 - DNA, 286 bp, Homo sapiens
  misc_feature (7)..(7): n is a, c, g, or t
  misc_feature (142)..(142): n is a, c, g, or t
tggtttngaactcatgacccccccctgccttggcctcccaaagttttgggattacaggggtgagcccccggttccggcccaaagcatgtctttattattggtttttccttccttgaaccaattccctgagccctaccttatnctgggttttggggaaataaaaatgaaacctttttcccctgttaaggggcccccaaaatttttttgttttttttttttgtttgtttttgagaaaaagtcccgctttgccccccagcctggggggcagagcaagacgcccttttta

SEQ ID NO: 513343 - DNA, 606 bp, Homo sapiens
accgcggcccttcccgatgcctccccggcatagccttcccccgggcccctaagcagccccccaatgggggccccaaattgctgcccccacatcacggggaaacaaaagccccggggaagaacccacctttggcccgaaaccccggagaaagacagggacacacacacaccgtgggcacaaataagcgactccgcaccccctcttggacaagaagcaatggacaggggaccatccaacattgtctcagaaggcagtgtattgatgaagccgcgccccacggaggcaggttgcaagggggcccccctcacacagaggcaagtcccaaccgcgactaatcagatgggaatttaatggagggaaaaacacaggacaagaaaaaacccggggggcccaaaaaccggggaaaacacaaggtgagagcgcacccaacagggggcttgacacggaaccccagggcaaaattggggcaaacaagggacagcgaggaaaaatgtcggtaagcagacctctgggcgcgacgaggacaagtgcccgcggcacggatacccgggtacaaaggggagcgtcattcgcgcaaaaaattctttcacccccgcaaacaataca

SEQ ID NO: 513344 - DNA, 316 bp, Homo sapiens
gcatccacaccatggaatattgctcagcaacaaacaggaatgaactatcaacacacagcaacttggatgactctccaaggaattatgctggttatttgttgttgttttgagacagggtctcactctgtggcccagactggcatgtagtggcgtgatcacagttcactgcagcctcacctctaacttccaatctcaagtgatcctcccacctcagctacttgggaggctgaggtaggaggatagcttgggcccaggaggttgaggctacagtgagctgtgatcatgccactgcactccagcctggatgaccctgtct

SEQ ID NO: 513345 - DNA, 256 bp, Homo sapiens
cacgggccatggtgactttctttgcataagttccaggatgttatgcactaccgaggagagatgatcctgctgtgggggattgccagatggtcgtgcagtgcctaaaacccagtcctccttttcctggaacagttatgtcccgtccaagaagaaagacagtgacatcggtttggtcttacacattttccaccatttaagcagggagactggcaaacagctgtatgacagcgagaccccgtccagccaggcgggcagt

SEQ ID NO: 513346 - DNA, 269 bp, Homo sapiens
cgtcgactatcagaagtttcacaggcttcatgtgtatccacaaacacccaccccattgagaaggcctagaaaacctggccctccccaaacctttattgaccgcttgtgaatgatcccagggtgtgtctgacccacagctcctcctggagggagagaaaagtctctcctaggtatttggttatcaacctcaaccacttgctgagccttcctcaagaccaggcaccttggcagagatttctgggttgtcaggcggaactcgagcgtcgacg

SEQ ID NO: 513347 - DNA, 138 bp, Homo sapiens
aagcgcggcccctgcttagggctacatcgggtctcatacctgccacgacactagtagtacctgccaagaactagtgtacctgcgcaagacactaagtagtcctgccaagcactaatagtacctgccaagcactaagta

SEQ ID NO: 513348 - DNA, 1144 bp, Homo sapiens
ggcgggccaccaggctggcggagctgcaggagcagctgaaggccgtgcacgagcagctggccgccctgtctcaggccccgagtaaacaaaccaacagcaagcaagcaaggcagcacagcacaggcagcacaggcagcacagcacagcacagcacaggcacacaggcagcacaggcagcaaggcagcaagctacgacaagtgcacaggccgcaggcaagcagcacagcacaggcccaaggtgtgctccgccatgaccaagcaggctcagcacgcaagacaggctctctgccacagaaggccaacagtcacgaccacaggaccggcagaccagctgaagcaaaggcggcacagcaggcatcatgccatcctacgacatcagaggcacgaggaggagggcctgccacatgagctacgatgaacagcgccagcttagcctggacatcaaccggctgccggggagcaagctgggccgggtagtgcacatcatccaatctcggagagccctcgctcagggactccaacccaggacgagatagcacacttgactttgcgactctgaaacccaccacttgcgggaactaggagagactatgtcaagtcatttgtttccagcacaagaaaagggcacaccggacatcacagcaagacgcgcaaggcacacacggcaccccgatcgccaagcagcgctcactcaggacaaccacccaggcagctgaacaaacacctgcggggagtccagcgccaagagcaccaccaccagcaccccgccggacagaaaaaagcgcaggacaccacaaccacaggaaggccagacccaggctcacgcacaagcaaaaccaccgaaattagagaaacgcacgacagaggaccaagacgaaacgcgaagacccgacagaccggcacggcacccaccaacagacagacacaaacgcaaactcagaacccccagaccacagaaaacagacccggagcccacagacacacgagcacgagaaccgccaagaaccgaagaccaacagtggcaacacaggcgcccccaacccccgacacccgcgcgacgcccgaacacccccgcaaccacacaccccacccacccgacaccacacacagcgcacaaggcggcacgacccacgaacggacaccc

SEQ ID NO: 513349 - DNA, 254 bp, Homo sapiens
  misc_feature (80)..(80): n is a, c, g, or t
  misc_feature (171)..(171): n is a, c, g, or t
ttctgcccctgcccttcctcacactgacactttgttcccacatggggtggggagcagagttcccgccccgtggagattanctgccagcgggggctgctacatccattgccaccatggggcatctggcggggcgggggtttgccggccttctgcaaggcccctggagcatcntccccaggctttttataccttacaatgtaacttttttattttattttactctatgattattcaggaatattatctctcagata

SEQ ID NO: 513350 - DNA, 357 bp, Homo sapiens
gatttagtctgagttactttcatatctacatcacattaagataaagggatccatccagtgagccgtctccactagaggctgaattccagagacttccttcatataggagctggaggacacagcacattggaaatcaagaagaaaataaaagtaaaaacaggaatttctaatgtcatcccatatgactattacagagtgccacttaaacatgagctggaaatgagtaaagagagtgagcatgattcagatgaatcctctgatgatgacagtgattcaaaggaaccaagcaaatacatcaatgcatcttttatgttgagctactggaaacctgaagtgatgattgctgctcagggacca

SEQ ID NO: 513351 - DNA, 194 bp, Homo sapiens
cagacatagactggctgaatgtataaacagcacgactcatttatctgtaccctataagaaacacacttcctattctaaagtaaacacatagctctaaacatagaatcaagatcttccatgcgtaatggaaaccaaaaaaagagcagtagtagctctactaatatcagacaaaatagacttcaagacacccactg

SEQ ID NO: 513352 - DNA, 758 bp, Homo sapiens
  misc_feature (28)..(28): n is a, c, g, or t
  misc_feature (70)..(70): n is a, c, g, or t
  misc_feature (73)..(73): n is a, c, g, or t
  misc_feature (75)..(75): n is a, c, g, or t
  misc_feature (87)..(87): n is a, c, g, or t
  misc_feature (104)..(105): n is a, c, g, or t
  misc_feature (114)..(114): n is a, c, g, or t
  misc_feature (131)..(131): n is a, c, g, or t
  misc_feature (166)..(166): n is a, c, g, or t
  misc_feature (170)..(170): n is a, c, g, or t
  misc_feature (318)..(320): n is a, c, g, or t
  misc_feature (333)..(333): n is a, c, g, or t
  misc_feature (344)..(344): n is a, c, g, or t
  misc_feature (348)..(348): n is a, c, g, or t
  misc_feature (388)..(388): n is a, c, g, or t
  misc_feature (390)..(390): n is a, c, g, or t
  misc_feature (520)..(520): n is a, c, g, or t
  misc_feature (527)..(527): n is a, c, g, or t
  misc_feature (556)..(560): n is a, c, g, or t
  misc_feature (566)..(566): n is a, c, g, or t
  misc_feature (646)..(646): n is a, c, g, or t
  misc_feature (683)..(683): n is a, c, g, or t
  misc_feature (713)..(713): n is a, c, g, or t
agggggcacagaacacaggccccctgcntggcaggacccgacttagttacaggcccctgggaggggcganctntnaggggtcgaggncaggggggaggggggcnngcacctgangcccctgggggcccgcngggtcatggaactgtgtgtgtggagggtggggggngggngcaccacgggccatttctccccaaggctaagggcgggggagcaagtaaagctgaggagagggcttcatgggacagggttcccatcccctgctgggagggtgttcctggataccccacaaggcactacagatgcagactgtaggcgagnnnccccatctttggnccccgattgcntggntctccccctgccccagctcccactgtggtttggcgggggngnagagaaggggctgggccccccactccctcagcagacaccagccaggaaccgacccggcgggccgaggctaggaaggaccctctcccgctgctctgggctcctggggtcctcttggctcggcctccccctnttttagngctggctgttgcgaataaataaataaatnnnnncgtggncgccccgcccctacagctgggtgtcctcctcctccagggagcggttgagtccggggatgacttgagcagcgcggcggaantgcggtacttggttttgcgcagccggggcgcataggnctgctcgcgagctcagtccagagcgcgccngcgccgcccgcctccgccccgccaggcccgcgcacgcacactggg

SEQ ID NO: 513353 - DNA, 276 bp, Homo sapiens
  misc_feature (68)..(69): n is a, c, g, or t
  misc_feature (74)..(74): n is a, c, g, or t
  misc_feature (191)..(191): n is a, c, g, or t
tcaggggcatccaatattcttcgatgcacattatgagtacggtcaaatactcataaattcccggggcnnccggngcgccggcggctcaggagcgcgaagggactgactgaccgaccgacggaccgcagcggcaggagcagaacagcctcagccgaagtaggcgggcggtggaggcgctgccgcggccccgntacgtcacaatgcggcccggccgcgggcgccgctccccgggccccccaacgggcgcgcgcgggcgggggcagcctgggcggccgc

SEQ ID NO: 513354 - DNA, 166 bp, Homo sapiens
ctaccggcttgccgctactactcccattgcccctgctcctgggctttccccttcagtcagcgtatgtcactccgtcagtattgattcatcacaggagtcaggagtcacagtctgtatgtccaccctgcgatgttggctagacatacgtttcaaaagttcctcagtc

SEQ ID NO: 513355 - DNA, 395 bp, Homo sapiens
  misc_feature (182)..(182): n is a, c, g, or t
  misc_feature (357)..(357): n is a, c, g, or t
  misc_feature (379)..(379): n is a, c, g, or t
tgagtcacctcgggtcccctttaatgattctcccctctgaaaacaattaaaatgcctagataaaatagccttgcccttgacctaaaaattcaaatagcctacacccagtatattcttcccccacatttctagactggaaggaaaactgcccagtgtgaacttggagctaagtagaaatgggnaaaaaaaaaaactactttgaaaatcttctcatgtaggtcgtgacctgaattcatatacctacatggtcaaaaaattctcaagccaagaatttaactaatattggtcccaagctagtaatatctccaggcacctgacaaaaacaaatgcaaattctttcaatccaggcttcaattnccacagataaatttattctagnaaatacaaacacaata

SEQ ID NO: 513356 - DNA, 989 bp, Homo sapiens
  misc_feature (987)..(987): n is a, c, g, or t
  misc_feature (989)..(989): n is a, c, g, or t
taaacccctattttgccaggaattcttagggaataggttccagcagttcaggctccttcccatgggttctcaaaaagggggtcttttcggggtggagcaggtgggcgctttatttgaccccaagggaacctattctactatagagttccttttactattatgtctggatcaatttctcctatccacacgtttcaggagaagctaatctccggctctaaagatgcggcttaactgctggctcaatacgcacattaatcctctggcgaaaagaatcttggccctaaaactggtgtggtgtcaaacaacatttggccaacagcggtggtgcggtaacattggccagcactcttccagtttggccattggtacccactggggggggcaatccccttttggaacaagaaccccatctcccttgagggtcgtacaaaaatacaccctttctaagagatcagcaataatattgtggccaagagaaacaccccatgtttccaaaagggctaaaaaccaatattatgggggacgcctcccctcattccccctgggatgttacgacaatgggagaacttacctgggacagatggcggaaaggctccgggctttggcccagatggtcaagcgaagggaaccaacactttgcagggatacaacagcgcgcggtcaaacacaatcacagcgtggaggaggcttgcccaacacactgtgtagcgtattgggcccatgtgcttgtaccacggtggttctcccccgtgtcggagtttctgtacacgctgcgcacattgggaaccaaagacagccggtgaaagtacgatgctccattgcagacgacatgggtgcacctgtggtatgggaatcggataacaaacttgacagctgatacaagcagtcgaaacgcagcagaactatggtgtgcaccagatgagctattcccgaagaagaaggcagcgatacgcaccaatgtctctctgtagattatacagatcatantn

SEQ ID NO: 513357 - DNA, 282 bp, Homo sapiens
  misc_feature (223)..(223): n is a, c, g, or t
ctcggaccgacgatatgctggtggcaggcatgaggacagcagtggtcgtatcaactatgagcgttgtagaggcatatcctgtcggggtgacgggcccatggggcggagctcgtccgcatggtgctgaatggctgaggaccttaccacagttctccccatgagtccgtgacctttaccctgatgtgaaattttagtatactacgcctaacagtttcacctaggnctttactttgtctcagacaactattccctatctcgttctctatctctggtggggtatcc

SEQ ID NO: 513358 - DNA, 501 bp, Homo sapiens
tgctaaaaacagaatcttacaaatgtgatagctatatatccaaatgaggtggtctagtacaagcatttctgaaaaaatttttgaatgacaaaattttatcctaagcgatatgttttccaagtgaatataattctagttaaacacaacattgcaagtcaggtgtgcacattttactaacaaacatatatcaatgtgatttcagggccttctccagaagcaaaaggagggtggaaagcagtctcctgcctttagctgaaaaaaaagaaaagagtttggggtcttcatttaaaaaggtagaaaaccaaacccctcacattgggtgggggtcttccaaataataaaaagggctcacttggctcaactgaatttctaaaatagcctagaattaacttaatttttttaaaagctcattaaaaacctggatacctaaggaagtaaaaaagccggcccttggcctattccaataaaacagaaacctctttttgaaaaaacttagtacta

SEQ ID NO: 513359 - DNA, 636 bp, Homo sapiens
aagagagacggtacgagcgaacgtatttgtgataattgctcaaaacacacccaaacagggggggaggggatgtgtttttaagagaacaacccccgcccacaccacatccaaatgggggatgagctttagaagcgatctgtaaattatatataccaaaagctcatatgatttcaacgtgcgacgtatatacgatgaccgcagatcgatgaagattagaaagggattctaataccataaatacgatgagaaggggggtaaagagataaatagctgcggtaaatgaaacagcaaatatggcatgacgggccatagggattatcctacgtgggatatatggtatgtgcgcgataagtaggtggttcattattacacatcagtgagtgaccgaagaatacaacaagatctattgcatctatataagtggcgagaggattggtagagaacaatatgcaaatttatagaactatgtggtgtgagtgagtattatatcgtgatgattttgttacgactatggtacgagtgcggaggatacaatgaattatggcgaaatggtttatatcggggtgttagtggtgaagtatgaagagctgccgagcgggaagtgtagatatggttgttgatgcgagcagagggcgg

SEQ ID NO: 513360 - DNA, 354 bp, Homo sapiens
  misc_feature (308)..(308): n is a, c, g, or t
  misc_feature (342)..(342): n is a, c, g, or t
ccccctgagggcccaatccattaattggcctctctctctcacacctcgcgcggtgatatataagagagagtgttctcacgcgcgaaataaactctctgggggttttttataagagggaagactcttgcccccaatttggggattctctttcccaagaaaattctggggataccacgaatgatggtggcctccttaattgggccaagggagttaaagggccggtttttaaacgcccattccccttatattctcggtcaccggtgggtgggttggacctgtttcctgaaaaaaaaaaaattatagtaaantaactcggcatatgtcgtcggagttatgcacccntcgatggtgcgt

SEQ ID NO: 513361 - DNA, 529 bp, Homo sapiens
taaggacccaggaaagtctaactgtagagtcctgctatgtcaagcactctgtaggactggagtgtggtagaaactgtgtcccagccctcatcatgattctcttcataactcaaacatctttcactccttaatatttcaattcacctcccactgtgaacacacagacaatgccctggcctcatggagttacattctagagggtgagggagttcaacacaaataagatgcttgaaattggcaagtgtgatgaagaacagaatagggcagtggggtagagtgtggttaggtagggtgtggtggacatcacataagtgtggtcagcaaaggcctctcaagagacagttgagacttgaatgacgaggatgagtcagatgaaagccaggggcagaggtgaggggagcatcttgggcagaggtgacagtgttaaagggagaggccacgttcagtacccagaacaaaaagctgcacacactgcttgctgagcaagagagcactgctcttgtagggcacggtctctcggataaagaaa

SEQ ID NO: 513362 - DNA, 114 bp, Homo sapiens
accaatcacaatttcaagaagaaaattacaacacactcatagagcacacatagaagtccagttcactttatggcaacaggtcagtatctgctgatcagtgacaggcagtgaact

SEQ ID NO: 513363 - DNA, 128 bp, Homo sapiens
cttgcggggtctattgatgatggtgacactccagtaagcagctgctctccgggagcttgaagaagaaactggctactaaggggacattgccgatatgttctccagcggtcgtgtattagacccgcgag

SEQ ID NO: 513364 - DNA, 352 bp, Homo sapiens
cctataatcccagcactttgggaggccgaggcaggcggatcacaaggtcaggaattcgagaccagcctgaccaacatggtgaaaccccatctctactaaaaatacaacaattagccaggcatggtggtgcatgcctgtaatcccagctactcagaggctgaggcaggagaattgcttgaacctgggaggcagagggtgcagtgagccgagatcgtgccattgcactccagcctgggcgacattctgtctcaaaaaaaaaaaagaagcttgtctaattgacttgcctaaaaaatgcagtgactccaaacaacatttgacctgtcttcctcaataaaagtcagtgttctcctga

SEQ ID NO: 513365 - DNA, 304 bp, Homo sapiens
gctcgaccccaggggcggcgctgtgcaatcagggcctgcgctacgggttcgaccagaaaggcgaccgcacattcgcctggcacaatgccgtcagcgtcctggccgaacgcctgcatccgggcccgggaggaaaaggcggtcaactgcgagaaccccaggaacagcgccggtggagcacggtgttcaatgccatgacaatcgcgttatccgcctgtccactgttgatcagggcttgagcatatcgattgcataggggaacgaactgcaggcggtatcgaccgatagcgccgggccgccgtcgacg

SEQ ID NO: 513366 - DNA, 910 bp, Homo sapiens
  misc_feature (2)..(2): n is a, c, g, or t
  misc_feature (108)..(108): n is a, c, g, or t
  misc_feature (110)..(110): n is a, c, g, or t
  misc_feature (117)..(117): n is a, c, g, or t
  misc_feature (120)..(120): n is a, c, g, or t
  misc_feature (151)..(151): n is a, c, g, or t
  misc_feature (175)..(175): n is a, c, g, or t
  misc_feature (182)..(183): n is a, c, g, or t
  misc_feature (185)..(185): n is a, c, g, or t
  misc_feature (190)..(191): n is a, c, g, or t
  misc_feature (195)..(195): n is a, c, g, or t
  misc_feature (200)..(200): n is a, c, g, or t
  misc_feature (206)..(206): n is a, c, g, or t
  misc_feature (210)..(210): n is a, c, g, or t
  misc_feature (212)..(212): n is a, c, g, or t
  misc_feature (219)..(219): n is a, c, g, or t
  misc_feature (229)..(229): n is a, c, g, or t
  misc_feature (234)..(234): n is a, c, g, or t
  misc_feature (236)..(236): n is a, c, g, or t
  misc_feature (242)..(243): n is a, c, g, or t
  misc_feature (253)..(253): n is a, c, g, or t
  misc_feature (333)..(333): n is a, c, g, or t
  misc_feature (353)..(353): n is a, c, g, or t
  misc_feature (358)..(358): n is a, c, g, or t
  misc_feature (361)..(362): n is a, c, g, or t
  misc_feature (365)..(365): n is a, c, g, or t
  misc_feature (367)..(368): n is a, c, g, or t
  misc_feature (371)..(371): n is a, c, g, or t
  misc_feature (381)..(382): n is a, c, g, or t
  misc_feature (386)..(387): n is a, c, g, or t
  misc_feature (412)..(412): n is a, c, g, or t
  misc_feature (564)..(564): n is a, c, g, or t
  misc_feature (856)..(856): n is a, c, g, or t
  misc_feature (862)..(862): n is a, c, g, or t
  misc_feature (895)..(895): n is a, c, g, or t
tnttgtcacatttcctgctacacagaggtgccgatcatctccacttcttcgcgttcggtgatgctgcattaccgctcagacctgctccagatgctggacacactgttntntctagcnccntgtatttgggttttgcagagcagaagcagtngttgggagtggaaatctcacacanatctaanngngaatnnttantgccnaaccangggngntatcatngatatccacnacagngncatccnnctgtatggancctacctccgcatccacgcgcaacttcactgggctcagatacctgctatacaacttccccgatgacctcgcgctttatangtgttgccagcaatttcacnttccncannttntnntgnttttcactanntgcnntgggtgtgggggggcatctggcccngacaccgcttctctttgcaggttaacatccgaaaaagagacaattcccggaaggaagtccaacgaaggatctttgctcatcagccagggcctgaaggccaggaggagtcaactccgcaatcagatgttacagaggatggtgagagccctgangatccctcagggacagagggtcagctgtccgaggaggagaaaccagatcagcagcccctgagcggagaagaggagctagagcctgaggccagtgatggttcaggctcctgggaagatgcagctttgctgacggaggccaacctgcctgctcctgctcctgcttctgcttctgcccctgtcctagagactctgggcagctctgaacctgcgtgggggtgctctccgacagcgccccacctgctctagttcctgaagaaaaggggcagactcctcacattccagcactttcccncctgantcctctcccctcgtttttccttcaataaactantttgtgtcagcttca

SEQ ID NO: 513367 - DNA, 570 bp, Homo sapiens
acaaatagattcagcaagatgattcttgtttattttgtattgttaaagttttcactcaaacaatgaatataatatacggggctgtggagaaaatatttgtaacattaattctatattgtttattccagccttttaattacaaattaaaacatgaacattaccatacacacagaactaaatataatgcaaaaaatctacttctttattttcccacattctgtattatatatatgaaccaaaaatgcacagagaggcctaagttccccagcctgtggcacattgtcagggggccaagcatggtcgggactgcagggcctttcttgggctaggattgcccacgtggttatgactgaggattcttatgctctcacccacgagagctgagcaaatatttttgcagtgctcactgtcttctggaagagacaagcactttcttgaaattcctaagcattgttgaacaaggattattattattttattattttgaacctgggaggtgaaggttgcagtgagccgagatcgcatcattacattccagcctgggtgacgagagtgaaactccgcctcaaa

SEQ ID NO: 513368 - DNA, 602 bp, Homo sapiens
  misc_feature (2)..(2): n is a, c, g, or t
  misc_feature (108)..(108): n is a, c, g, or t
  misc_feature (110)..(110): n is a, c, g, or t
  misc_feature (117)..(117): n is a, c, g, or t
  misc_feature (120)..(120): n is a, c, g, or t
  misc_feature (151)..(151): n is a, c, g, or t
  misc_feature (175)..(175): n is a, c, g, or t
  misc_feature (182)..(183): n is a, c, g, or t
  misc_feature (185)..(185): n is a, c, g, or t
  misc_feature (190)..(191): n is a, c, g, or t
  misc_feature (195)..(195): n is a, c, g, or t
  misc_feature (200)..(200): n is a, c, g, or t
  misc_feature (206)..(206): n is a, c, g, or t
  misc_feature (210)..(210): n is a, c, g, or t
  misc_feature (212)..(212): n is a, c, g, or t
  misc_feature (219)..(219): n is a, c, g, or t
  misc_feature (229)..(229): n is a, c, g, or t
  misc_feature (234)..(234): n is a, c, g, or t
  misc_feature (236)..(236): n is a, c, g, or t
  misc_feature (242)..(243): n is a, c, g, or t
  misc_feature (253)..(253): n is a, c, g, or t
  misc_feature (333)..(333): n is a, c, g, or t
  misc_feature (353)..(353): n is a, c, g, or t
  misc_feature (358)..(358): n is a, c, g, or t
  misc_feature (361)..(362): n is a, c, g, or t
  misc_feature (365)..(365): n is a, c, g, or t
  misc_feature (367)..(368): n is a, c, g, or t
  misc_feature (371)..(371): n is a, c, g, or t
  misc_feature (381)..(382): n is a, c, g, or t
  misc_feature (386)..(387): n is a, c, g, or t
  misc_feature (412)..(412): n is a, c, g, or t
  misc_feature (548)..(548): n is a, c, g, or t
  misc_feature (554)..(554): n is a, c, g, or t
  misc_feature (587)..(587): n is a, c, g, or t
tnttgtcacatttcctgctacacagaggtgccgatcatctccacttcttcgcgttcggtgatgctgcattaccgctcagacctgctccagatgctggacacactgttntntctagcnccntgtatttgggttttgcagagcagaagcagtngttgggagtggaaatctcacacanatctaanngngaatnnttantgccnaaccangggngntatcatngatatccacnacagngncatccnnctgtatggancctacctccgcatccacgcgcaacttcactgggctcagatacctgctatacaacttccccgatgacctcgcgctttatangtgttgccagcaatttcacnttccncannttntnntgnttttcactanntgcnntgggtgtgggggggcatctggcccngacaccgcttctctttgcaggttaacatccgaaaaagagacaattcccggaaggaagtccaacgaaggatctttgctcatcagccagggcctgaaggccaggaggagtcaactcctcacattccagcactttcccncctgantcctctcccctcgtttttccttcaataaactantttgtgtcagcttca

SEQ ID NO: 513369 - DNA, 437 bp, Homo sapiens
tttaggctactttacaggctctggaactgtaaggccaatgtgtgctgaatcgaggaaaaacaccaggttctgggggccaattggtgctgacttctcaaagctggatcaaaaggaggacacctgggtctgggggtagggaacctaaggccaattaacacgaacttcctagaactaaaccagaaggggaaatcccatctccccacgccgagcagcaaaggatcaaatctccctacagccctcccgcttccagcacatctcagatggaaagagagagtgccctgattggccaagcatgggccaccccttcctctgcatagggcaccaattcacctcagcctttaattagccaggaaccaaatccttcatccagacaagaggtaacttataggagcctcaaaaggggtacttaaaacccggaaaactggctccttcccccg

SEQ ID NO: 513370 - DNA, 328 bp, Homo sapiens
  misc_feature (1)..(1): n is a, c, g, or t
  misc_feature (300)..(300): n is a, c, g, or t
ngattccttaaaggaaagcacaacattccagtcaaaacttggtaaaataaccagtttctccagttgtgtcctgtgcaaaagaaaacagattcttacagaaatataagggattgatgggtaaagagtttaaaagctgtttatacatgcagtacattggatatgatataatttatggtttcttgtttgcagctgtttgtatctttttaatcccaaaccagacaaaattataaacattttatatacaatgttatcttggaaaaagttagatgtaaataattcatcttaatctatatttgaganatctgaggggtattaggaaactcatgag

SEQ ID NO: 513371 - DNA, 149 bp, Homo sapiens
  misc_feature (147)..(147): n is a, c, g, or t
gaactactttcccaaatgcagctgcttgagaatcttggactcattctttttcttacctcacagttaccagttcctatccaggttgggaaaaaatactgactgggatgcatgggcccttccctaagcctgcttggaattgcattccangt

SEQ ID NO: 513372 - DNA, 877 bp, Homo sapiens
gagaaagtgatgaatttccagagctgatgtgttcaccctgggcagatcccccaaatccagaagtcaaacgttactcatggttcagaagttcctcatggtgcacgagatcctcaacactctgccggcagatggaggtggagggcccatgcccgcaaggggagagaagagaggtgagacccaagacatgtactagagcatcatgatgggcaatagagcaggcagagatggaaaccatgacatccatgaccagactaatcatagagaagagcacaggcaaggcatggaccatcacaccagatgaggaggcaagacagacactgataagacaggaatgcaggacaagacacaaaacccagtagacagaagaggagagcgggcaaagaatgatgcaaggaaatgatggaagaaacaggaagaaagagaaacccacaagaacaaaacaaagacaagggaagaacaagacaacaaacacaagagacacaacaagagaaaaaaaaacaccaaaaagcaccgaaatacaaaataaagagaacaagaagagaaaccacaaacacaggaaacacgcaaaaagaagagagagcacgaaccaggaacacgacccatacacaacggagcacacaagtacgcaataaaaacccaagacaaaaaacaaaaaagcaaaaggacacacaacaaaacaaaagcatgggagcccacagaagacatgaccgagagagagagataacaaacacgaccccatgacacaaaaaaaacagaccaaagacaacaccgtaacatcggagcgacacgggaccacacaagagacacaagacgcaggggaaactcaaaagagagggacaagaccaccacacgacaaggaggacaacacgacaaacaa

SEQ ID NO: 513373 - DNA, 82 bp, Homo sapiens
gggggggggggggggccccccccccccccccccccccccttttttgggggttggggaaaaaattggggtttttttgggggga

SEQ ID NO: 513374 - DNA, 423 bp, Homo sapiens
  misc_feature (2)..(2): n is a, c, g, or t
  misc_feature (9)..(9): n is a, c, g, or t
  misc_feature (31)..(31): n is a, c, g, or t
  misc_feature (44)..(44): n is a, c, g, or t
  misc_feature (63)..(63): n is a, c, g, or t
anctgcctncccttggtaacctggaccaccnttggaaatccatnggggtaatattacccccanggctttggattcgggatggttatattaaaaaaccatagatagaatgaacccaatatgaaacctgccagggcaaagtctgaaagtcagcccttggtttggcttccctattcctcaagaggtttgtgaagatttaatcctcagattcccttataaaaacttagagaaaagaaaattttagaagacagccctacatggtcccattgctactcttgctgcacttatgtaaacaatcagaccacatttgaagaaactccacctattttgcaaacaaacttattctactgaaattatcattggtaaaagtagagatgcccatagagggaaaaattatgtggaaaataaaaactgtagtatacctgt

SEQ ID NO: 513375 - DNA, 172 bp, Homo sapiens
ccactaccatgcggaggccagccgtcacaggtgcagctcgtgagttttgatgtgctcaagctgcgctcggagctgtaggaatggagggcctgcattgctggcgtcccggtgccagcagttcttcattacttcatagactgcgggcgggcagccgtcgggcgctgtttggaat

SEQ ID NO: 513376 - DNA, 144 bp, Homo sapiens
tggccacccaagatgctgggattacaggtgtgagccaccatgcctggcctctcttagtaatttgcaagtatatgatacagtgttattaactatagtcaccaaattgtacaataagactgtacttaggcttcaaaagttgaaaag

SEQ ID NO: 513377 - DNA, 272 bp, Homo sapiens
ggtcctactttgattgagacagctctgcaggcctgtcttgctccagggcttttccaagcccagctcttgcctcatggcagctgccccaggcaaatttcttcctgcctgccagcagcctcaacaggcacagctcctccctcacagtggcccatttaggccccactcatgactgtcgggccatttccaggcctagtgcctgcctcctggctgactctttcttgaagcccaaaacttcctcaaatcagccttttgcctaacttctgtctactgtc

SEQ ID NO: 513378 - DNA, 98 bp, Homo sapiens
  misc_feature (48)..(48): n is a, c, g, or t
  misc_feature (59)..(59): n is a, c, g, or t
tagaaatgtattttgaaaacacttattttacagcgagcgaattttgtnatcgcatttanaacgtaaccttttatcaataaagcgactattgtttagat

SEQ ID NO: 513379 - DNA, 103 bp, Homo sapiens
ggcgccgtatcagacgggtgctggagacattgaatcaattgagcacacacacgcatagtagacatcactcgcaccagccctgctgccaagagcccgtcggccc

SEQ ID NO: 513380 - DNA, 181 bp, Homo sapiens
tacatcgagctcggtacctccttattaaaattatctaaaaagtcttctctgataaatatacatctttaatttacaaactctttttgattatacaaatgaaccaagtctttttttttttttttggaagacagagtctcgctctgctggtaaattttggtattttaaaataaggatcccctag

SEQ ID NO: 513381 - DNA, 336 bp, Homo sapiens
tatcagctcgccggtctctctagaggatagctctaatttcttttgacttgcggctccatcgggcgcttccactatggggaggatggcgacaagggctggctgctgtgggaggtggatacctcgtcagcggtctgcacgctgcagcggacacctgctcggcgaacggttgacattgtgtttgacggcaagccagacctcgacaccttgcgggatgcggtggcgcgacaggacgttgccggggcgttcgtgcgtgtccggtggacggtggcggacgaagatcgccatgaggtcaatcgccaggccattcaggaggcgttggggatcctctagagtcga

SEQ ID NO: 513382 - DNA, 403 bp, Homo sapiens
aaacatccgatctcatgagactaagatcactaccgagagaacagatatggagagaaccatccccatcatacagattctctgcacccggacccacccttgcaacgtgggaattattacaatgcaaggtgagattagggtggaagacccatccaaactatgtcagatatgtattgacttcttgcttgcttgctaggttgcataaaggacaaacatggcaattactgaagtaccttaatatctggcttcagatctaagacaggatcagcagggcagctcaaatttgcaaggaggggaggtagatcccaccatattatgggtgcatggcaaaatcaaacagaacttatgtgggatgggagatactgatgcagccatctttggaaacattctacggcttcgtcggtca

SEQ ID NO: 513383 - DNA, 114 bp, Homo sapiens
tacttacgggtatcaaacgtgccgacaaacccctggtcggttgattcctcgaccccaaaattgagccgggcgatgtcgtcacgctctatggcacggatcaggatttacagcgcg

SEQ ID NO: 513384 - DNA, 296 bp, Homo sapiens
atcgtgtgactgtgattgctggcacgaaattagaccaaccctagagttagaatagctagacttcaactatcgtgatatgctaaaggttaatcactgctgtttcccgtgggagtgtggctcggctaagcgtattgagctgcattgctgcgtgcttgatgcttgtaccttaaagatcgtggtgatttagagggtgaactccactggcaatggggatgcttgcatagtgtaatctatatcaagagctaaatagcaaaggctcaggcaccaaacctcatagtcgcaggcgagggatcctc

SEQ ID NO: 513385 - DNA, 861 bp, Homo sapiens
  misc_feature (27)..(27): n is a, c, g, or t
ctgcacgagcacaaagctatgactaangtcgaggcctgggtgttaatcggccgagggcagagagagagagagagaactagtctcgatggtttttttcattttttaccgcaacgggttttgccgccaaaacacaggtgtcgtgaaaactacccctaaaagccaaaatgggaaaggaaaagactcatatcaacattgtcgtcatgggcacacgttaaacttcgggcaagctccaccactacgtggccatcgtgattctataacctgcgggtggcattcgacaaaagaaccacttgaaaaatttgacaaaggaggctgcatgaaagtggaaaagggcctcctatcaagatatgccgtgggtctagcgaatacaactgaaacctgagcgtgaacggtggctatcaccatgtgatatctccgttggtggaaatttgagaccacgcaagtactagtgtgactatcatgagatgccccaggacacagaagactttatcaaaaaactgtgatttacggggacatctcaggctgacgtgtgctgaaccgtgatagggtggctgcgtaggatgatgggctaaaatttgacgctggtatctccaagaaagtgggcagaccccgagaagcatgccctttcgtggcttacacacggggttggtgacaacacactaaatcagctcggtgtttaaccaccatgtggtgtcccccactgaagccacctctaacggcccagaagagatgtgagcgacatttcgttcaaggaacgtccagactacactttaagaaaatgggttaacaccccgaacacagtcctttggtgcccattccggtcggaattggtacaacttctaggccagtgcaacttcccta

SEQ ID NO: 513386 - DNA, 957 bp, Homo sapiens
tcttgccgtcggtttgcgcacgggtcttggtgttcccgaaagtctttcagtggaacctgctcccgtgttaccaagcttcttctgctgttcccgtgcaacactttttgggcgatacttttttcgtgcgcgtgtccccgcccctcgtctgggtccctacggacgcccgttcgttggcaagaatggttcgctttacagcgggcagcatgggttctcccccacagcgcgcgggtcctggcgccaatgttcgccaccccggggttttaagaccactttccgcctcgattctgcagagtcttcctgggggttcccggacagttggtgggtgagccgctggtgcccttcccccccgcaatgttgtgtcgctctccccccccgccctccgtttaaggcgcctgcaggacaccccctgggtgaagggaaaacccaattttcctgctctttcagactttagggaaaccatttcttccggttatagaacaaatgggcctgataaacaagattctccccatatccaattttcatgtcatttagagcggttagatgccatggtgaggaaagacgcctctttggtcctccttctataagagatgtcggtctattggtaaaacccgcctacaatacggggtgagagctactctcttaatggcaattctacctttaataagccccgtgttgtaggacaagagtatgaaagtctggtgacgaaatgggttgggtcgcaaaagcgcgcccgctccgggcgcccttgtggtgataatattcttctattagcacccatggtgtgtctgccggccatcaagggctctagatcactgtggttctgagttttgtatataaaagaagccaacgatcgatgaatcgatgttggaagaccgtttgctactaaaagttgaagctagtgtcgtccgagattcaacaccagtaaggaaaaacaaaactttgtcccccaaaaaaaca

SEQ ID NO: 513387 - DNA, 351 bp, Homo sapiens
gggccggctcctgggcacccacccagctcattcgccgagcggctcccctcctggggttgagtgtcctgggcctgagtctgcagcctcagccatctgttccccaacttgatctcccactgctagttacaaacaaatcgcccggcttgtgcaaacctcctgggctcagtccccagtcccgcggggcatcatttcattctttcctagcctgtaaggtttctcctgaaaaatctattgttagtctaatatgaatttcctaatatgtgacttaaggcttttctcttgctgcttttaaaattttctcttttgtctttgactttgacaatttggctataatgtatgttggagaggacc

SEQ ID NO: 513388 - DNA, 226 bp, Homo sapiens
  misc_feature (53)..(53): n is a, c, g, or t
atatttgctccttcttgttgtttacttctaccgcccgcgaccaagattcctcnatgcccaccagcgtgtaagcttgcgtctacatcccagattccaggcctgggtagataaatggaccaaggagcatgtgccccgtgaaatggcagcagagaccagttagtggcttatgggtgaggggctggagggcctggcgccctgtaccaccacctgttatacagacaccctc

SEQ ID NO: 513389 - DNA, 1455 bp, Homo sapiens
ggggccccagatggccgccgcggagctgaggttgcctggagagatgcgcctgggcgcagaagggttaacgtggccaccgggggctcgcagagcaggagggtgctctcgagactggtgtgtcccaccactagcactccttgaacttggcaggacaggtgtcgaccgcggagggactgcagagagcacccgtccagcgcccacgatgcctgcgatagttatttgtgagccagtcctgctacctggactccaccctggtgtgcagtacgagggcggagcgcatggacgacactggtactgtgcagtgcccatgtgctgtatcgtgtctgtctgcattactgtccgcgtaccgcgtcagactctggctgtggactcacggcaggatgatagatccaggagcagcgtcatcttacagcacaacgcataacagaggtagtggcccagggacaccccgcacaggtggtcatgggagaccaattgaggatcacacgtgagcgcactcttatgcctcacaagtcccatgcagcggcgtggcggcgtgcacgacgcaaggacgcacgtgacactgctcagactcaccgtaacacggttggcaagagtgtcgcaagacgcagacgagtttctgtggcacacgcgacacacatacaacgcgacgaaggagcacgcaggacagagcggtacccgaagagcagcgagcggatacgtgtacacaccgagagcgcagctaacaaatagcgagcacacgcagagacaaacgaagagacattcaggggcaccgcaagacgcacgggagcgcacgacccaagggggagcagagacagacgcacgacacagcggcagagcgagcacagagcgagcagcagagcgcagcccgacacacgagaagcgagcagccagagccgccagcgccgaggcgagcggcccacagaaggcgcagagagcacacaccgaacaggacgcacagaaagcgcacccactatataccacctatccctctcctcctaaacatacaatctacaattccaaaccatcgtcattcacaactacaccactgactcacccatagtactcaccaacacaaccaaaatagctacacaataaaactcatcaagcacaacgcaacacccacagctccccagaagcgcgacaccacagcgacgagcgagccacggagaacggacgaacagcccgcaaatgaaagaagcataccgaacactacgcacccaacagcacacgacgcaacatccacagccgcagatggcggggaacacacaacgaacacacagcgagccagcgactgagccaaccacacccaagtacgctctgacatcacacagacacacgatcacctcacaacagacccagaacgcggaccgaccgcgcggagctcagctgacgacgccatcaaccgcctatcgagttgaacacgaggcgtgacgctaacagatcacccccgca

SEQ ID NO: 513390 - DNA, 279 bp, Homo sapiens
ttatctctcatcgagaaattcaacagagagaaacattatagcctctaaaaaggcataatagtagtaataaactatataatagactatgtacataaagagcaacgatctatatactcacataaagactagaatatatacctagagagaatagctagtatataaattcataatgtgcaacataatacagataacaaaggtaaatgactacatagtgaaatagtctaaaagagctataattaagtactgtatagaaagcaaatattctatgaatctatacaa

SEQ ID NO: 513391 - DNA, 1695 bp, Homo sapiens
ggcgtcgcccttcagcggggcgctgcagctgacggacctggatgacttcatcgggccgtctcaggagtgcatcaagcctgtcaaagtggaggaaaagggcgggaagtggcgtggacaatgaattcgcattgaagatgacgggagctagcttccaaattaaccaatgacggcgggacccggaggctggagaaggccaaggtctcgctaaacgactgcctggcgtgcagcggctgcatcacctccgcagagaccgtgcttatcacccagacagagccacgaggagctgaagaaggttctagatgctaacaagatggcggacacccatgtcacgcacgaggctggtcgtatgtttcggtctcgagcacagtctagagcatcgctggctgcaccggtttcagctgaatcctacagatactgcctggaatattagcctcattctttaccagaaatcggggtgcacattcgtcttcgtacacccgacgtatcatcaatgggcacttcagtcctccttgtgagagccacgcgagagttagtgcaggagattccgagggacaggccgactgcagacaaggcgctgcccctagtgggctctgactgcccaggttggatctgctatggcgagaagactccggggagctcatcattccccaatcagacggccggtcgcgcacaggtcatgggctcctggccaggaatcgtcgcccacagaatcattgaacctggacaagtctacacgtacagggaggcggtatagaaaaggggggacaaaccgagttcaaacggacacgacggagtggcagggcccacaggagcaggaggggagggagcacaagaaccctaggagatgctacggaccaaagggagagcgatcgcgcatgtactctggtgctgcgcgcatctctaaacaaacaacaaaaaagcaatagcggacaagacaaaaaaaacaaagaccaccacacacaaaaatgaacgacaaaacaaaacaacgaaaaaaataataagaagagaaacaaaaaaacgacaacaagcaaacaaaagacacgggagcacagagcgaggaggagagagaggagagataggaggagccaagaagcggacaggcgggcagaagagaaggaacgaaaaagcaacgaggagaaacggagaggtagcggaagcaaggcaagaagaagagacgaaaggagaagcagacgagggaaagaagacgaggaagaagagggcaaagaggaggacaggaacaagagagacgcaggcgggcaaagaaagagcagagaagaggaaggcagagggagagagaagacgaagagacgcgaggcaagaggagggagaagaagcagacggagagacgaagaagacgagcgaaggcaggacgaacaagcgcagagagaagaaccgagacaacagagacgacaaggacgagaatgaaaagaagaggaaggagaacgacgagaagcagagaacgaaaagagacgagagagagaagaagcagaagcgcaatagaacgcgcgaagagagagacaagagagaaagcacagggaacgagagacaaaacgaggagaccaacacagcacgccaacaacgagacaagacaacacagaagccagcacgaaagacaccacagcgacaagcacagcagatagacacgagcgcgacgacgagcacgcgaacgcgagaagcacgaagacacacagagga

SEQ ID NO: 513392 - DNA, 252 bp, Homo sapiens
tgcctcgtaacatctttggttgtggtagtcctgtttactaataacttgttcgtgtgctgtgaacgattacagatttgaacatgtagtgtacgtgctattgagttgtgaactggtgggccgtatgtaacagctgaccaacgtgaagatactggtacttgatagcctcttaaggaaaatttgcttccaaattttaagctggaccggtcactggaataactttaaaaaagcatcacaatactggctcagacaggt

SEQ ID NO: 513393 - DNA, 96 bp, Homo sapiens
gaaggaccaagaggaccacctggaccccggggtggtgccagggagaacagggtgccaccgccttgccttggttgtccagggcgcttccggttagga

SEQ ID NO: 513394 - DNA, 432 bp, Homo sapiens
aaatgttgaggagatcacagacttcctatcaaacttcgattaacttgatactctacgaagtggttaccgaaggccagatttatgttggaaattgagcgtgcgcgacgtgactaaaacattagcagctatgaaagaacaaaatggtgatgtgaaagaggcagcctccattgtacaggagttgcgggtgggaaacctacctctcaagggaaccgaaagagcgtactggcatgcactgtgggcgcaaatgaagatctgtcctagactgtgaaaggatcacgatgcgcagagcacaaatcgatcagctagacaacttatcaccgagaattggtccagagtcgaaaatacagagcaagttagagtcgacgtactatcattctagtgagttctgctggcatgacatgagggatcctatttgtctattgggacgcacta

SEQ ID NO: 513395 - DNA, 522 bp, Homo sapiens
  misc_feature (432)..(432): n is a, c, g, or t
tagtgtagtctctttataatttctttggctgtaaacagaatcagtggtatctgtgatatcctcagtagcttagagtgtggttgttactggaggctgttatgtagttttgctggagactgggatactagggaagccagtgtttgggccttattattgggatgattatgcctttctttgggcctcagaatggcctatgctagcatcacagttagtcagctaggttaggctgattcttgggcctccaagtggttttcttgggttctggaaatggcaacagtggcctgggggataggcgggttctctagcccctgagcagcaagcatggcatgggtaatagcagcagcattggtgggaaagccctctagaacccaagtaatccatgctggtgttggcattagcagcacagggctaagtgggccagtgtccaagctnataggtatcacatgtgggtaggtgctagctatggtagtagcaagaaaagagataatacagattagagcaaaaatgaatgcagttgatgca

SEQ ID NO: 513396 - DNA, 352 bp, Homo sapiens
ctgcacgaggaagctccctggcaggcttttacgaactgacctgcaaccactcagtgaatataatctaggacggagaattgagatctgcttagagccccttcagaaaggcgaaaacttgggcccccaggacgtactactgaggactcaggtgcgcatccctggtgagtggacctattccccttccttggaccttgtgtggaacgcgacccagggtgggactaccggctccctgaggcagagagtttccgatttatctcgtcttcccgtggagaagattgaaactgccaaatactttcccgaaaacttcgagtgacttccgatatctagctggaaccaacaaatacccaggtga

SEQ ID NO: 513397 - DNA, 834 bp, Homo sapiens
  misc_feature (286)..(286): n is a, c, g, or t
ggtccggttgaccgcgcgtctgctgccgagaccatgtctgccgagcggggcagatgctgatggtcagcacccagtgtgacagtggaagaaccggtacagcagctccagtgtggtgtgaccgtgtggccgagcactgcctctgatcagctccacctgcgacatggatgtccgcagtccgtatggcctccagccaatggtagaggctacccggcaccgtcaatgagctgtctgcgtacgtcactcagaggaagcggacgtgagtgacgcctcactggcgcgcttgctngtcatgctgtgcggctacagcctgattccgtctccaatgctatggagcctcacagatgtgcatcaagctcaagcgaatgacggcccgacatgtggtgagcttgtgacacacgtttggaagcgacgaatccgtcccgcagttccttgcagagcagccctacgagagtagaggtacctggcgggatgactcacacggaagcgttgtagtcgtctgtaacgcgctgtccggggagctccatagcacgactggttgatctaggacgtcctaacgagacaacgtagtggcgccaccacaactttgttcgggagcgccgcgtgtgtagcgcagaacccgacgggatgcgtcgctgcgagatacctggtcgttgagagcacatgacctagagggtcgcgctagttgaactctgagcgagcggtcacatttcgagctccattgtggcttcgcctgccttttggcgccgagactgtgttgcttgacgttgggggctcgacaccgtgtggctgggggtgacttcggttgggcttgggcctgtggcacgacctggccct

SEQ ID NO: 513398 - DNA, 188 bp, Homo sapiens
agatatctcgatcactacaacttcactcctggctcaagcatcctctcacctctggctccgagtagtgggatacaggttatgctacatgccagctaattttagtatttttttgtagagacggggttttgctgtgttgcccaggctggtcttgaactcctgagctcaagcgatctaccacctaggcaaca

SEQ ID NO: 513399 - DNA, 103 bp, Homo sapiens
  misc_feature (55)..(55): n is a, c, g, or t
  misc_feature (92)..(92): n is a, c, g, or t
gagtagaaagtacaagaggaatccatttctcaaacagtgcgatgacatcaatctnaaaaaaagagagagcagagcaatgatatcgctcgggngctttgagaga

SEQ ID NO: 513400 - DNA, 940 bp, Homo sapiens
  misc_feature (44)..(44): n is a, c, g, or t
  misc_feature (67)..(67): n is a, c, g, or t
  misc_feature (69)..(69): n is a, c, g, or t
  misc_feature (105)..(105): n is a, c, g, or t
  misc_feature (108)..(108): n is a, c, g, or t
  misc_feature (191)..(191): n is a, c, g, or t
  misc_feature (194)..(194): n is a, c, g, or t
  misc_feature (196)..(196): n is a, c, g, or t
  misc_feature (202)..(203): n is a, c, g, or t
  misc_feature (212)..(212): n is a, c, g, or t
  misc_feature (217)..(217): n is a, c, g, or t
  misc_feature (229)..(230): n is a, c, g, or t
  misc_feature (235)..(236): n is a, c, g, or t
  misc_feature (243)..(244): n is a, c, g, or t
  misc_feature (250)..(250): n is a, c, g, or t
  misc_feature (255)..(255): n is a, c, g, or t
  misc_feature (338)..(339): n is a, c, g, or t
  misc_feature (341)..(341): n is a, c, g, or t
  misc_feature (357)..(357): n is a, c, g, or t
  misc_feature (361)..(361): n is a, c, g, or t
  misc_feature (442)..(442): n is a, c, g, or t
  misc_feature (453)..(453): n is a, c, g, or t
  misc_feature (473)..(473): n is a, c, g, or t
  misc_feature (486)..(486): n is a, c, g, or t
  misc_feature (493)..(494): n is a, c, g, or t
  misc_feature (503)..(503): n is a, c, g, or t
  misc_feature (510)..(510): n is a, c, g, or t
  misc_feature (522)..(522): n is a, c, g, or t
  misc_feature (561)..(561): n is a, c, g, or t
  misc_feature (588)..(589): n is a, c, g, or t
  misc_feature (618)..(618): n is a, c, g, or t
  misc_feature (637)..(637): n is a, c, g, or t
  misc_feature (644)..(644): n is a, c, g, or t
  misc_feature (704)..(704): n is a, c, g, or t
  misc_feature (769)..(769): n is a, c, g, or t
  misc_feature (840)..(840): n is a, c, g, or t
atctttaagagatacgagcagagtcaggcacagtgcatcatgcntgttgtcccagcactttgggagncnaaggcaggaggatcacttgagctcagaagtttgagnccnccttgggcagcgtggcagacccccgtctctactgaaaattaaaaaaaaaaaaattggctgggcatggtggcgcatgcttgtcnatntnagttanncgggaggcnagggnaggaggagcgcnngagcnngggaganngaggcngcagngagccaccagcacgccaccacacgccaggcggggggacagcgagaccctgtctcaaaaaataaatatttatttgagctgtggnnantgaggtcttgaatggnaaantatatgcttccaagatgacaggtcccacgtggggaagggctccagggtaccttctcttccctcctccccactccaggcccnaggagaggccntgagggcagtgctgatcccnattcgagaggttntgacccnngaatcgganatctccnttgcacacgttntggctgcccgagccgacctgtcttgtctcgtccccgccnccagcgtggctgtccgcagagggaccnnctgtgccatcaacaaggtgcttatgggcnacgttccagaccggggggnccgcccnaatgagctggagcctcccatgcccacctggaggagccgaagagaggatggaggcccccantgttggggtcgcaagaagaagaagaagaagtaaagggggactggtggtcgggggcggggggtccnccatgagatgctaatgctatcggtaatctctggggagtccgtttaaggctttccttggtatttggcacccnagccccccatctcctattcctgagtcccccaatgccctgctcccattcacgtccatacccaggaccatgttttcccgagaataaatttaatttatgacca

SEQ ID NO: 513401 - DNA, 714 bp, Homo sapiens
  misc_feature (216)..(216): n is a, c, g, or t
  misc_feature (227)..(227): n is a, c, g, or t
  misc_feature (247)..(247): n is a, c, g, or t
  misc_feature (260)..(260): n is a, c, g, or t
  misc_feature (267)..(268): n is a, c, g, or t
  misc_feature (277)..(277): n is a, c, g, or t
  misc_feature (284)..(284): n is a, c, g, or t
  misc_feature (296)..(296): n is a, c, g, or t
  misc_feature (335)..(335): n is a, c, g, or t
  misc_feature (362)..(363): n is a, c, g, or t
  misc_feature (392)..(392): n is a, c, g, or t
  misc_feature (411)..(411): n is a, c, g, or t
  misc_feature (418)..(418): n is a, c, g, or t
  misc_feature (478)..(478): n is a, c, g, or t
  misc_feature (543)..(543): n is a, c, g, or t
  misc_feature (614)..(614): n is a, c, g, or t
cggttccatctaagttctcggacgcagccttctttgcccccagggtccttgcgaccccctcctcactgctcgctagatgcaccccgatggggagccttggaggtctctgtccccaagcctcagagatccgtatccgctgccgccgctgcctcctcctcaagcgccttgacctccgctacatctgctgttcccctggagtgaccgggcagaggcccnaggagaggccntgagggcagtgctgatcccnattcgagaggttntgacccnngaatcgganatctccnttgcacacgttntggctgcccgagccgacctgtcttgtctcgtccccgccnccagcgtggctgtccgcagagggaccnnctgtgccatcaacaaggtgcttatgggcnacgttccagaccggggggnccgcccnaatgagctggagcctcccatgcccacctggaggagccgaagagaggatggaggcccccantgttggggtcgcaagaagaagaagaagaagtaaagggggactggtggtcgggggcggggggtccnccatgagatgctaatgctatcggtaatctctggggagtccgtttaaggctttccttggtatttggcacccnagccccccatctcctattcctgagtcccccaatgccctgctcccattcacgtccatacccaggaccatgttttcccgagaataaatttaatttatgacca

SEQ ID NO: 513402 - DNA, 901 bp, Homo sapiens
gtcgatatagaattggaccattgatgataagaatacacatgtatgtatctgtgcacatcacacgtgtgtgtgtgtgcacgtacatactgtatagtctaaaaatagcattatactggccagcgttttaagataacgcctgtaatcccagcactttggaaggccgaggcgggatggatcaactgtggtcaggagtttgagatcagccaggccaactggtgacaccccgtctctactaaaaatacaaaaattagctgggcgtgatggtgggcgcctgtaaatcccagctacttgggaggctgaggcaggagaatcacttgaacccgggcagggcggaggttagcagtgagccgagatcgcaccattgcactccagtctgggcaacagagtgagattccgtctcaaaaaaaaaaaaagaaagcggaaaaagaataggataataccctcttccttgtctcaaccggccagtgaaactttcttgaacatttccaatttcaagttgaatactccaaaacacaactttataagtctcacaactcacttaactcctaataggaaactacgtatcacttaaaaaaagggcctcaggaaatataatcttaccaaacgcagcataacatacagtgcagctaattacacccaaatatgtgttccctagtaatgaaacaactcggcctatttcacgtgtgggttagccctaggagctaacatggttgcccacgtagtattcggaaataccgtgatttgtaaaaccactcgtttgtttcaccagtggcaaaaaatctaaagaccggaattggtcattctgcaccaaaacataatggaccagactgaatgagggtactaacaaatagtccagtgtaaaccccaatttcgtgtatccacaatctctttcggatatgca

SEQ ID NO: 513403 - DNA, 407 bp, Homo sapiens
ttgcttcagactgtgaaaggattggcattgcagcatggcttgcatcgcttgctctgggtccgtgaaagagggtgtagtgtgcactatctggggtgtgagtaggatttaggtgagtctgggtgtaagacgtgctctagagctgcacgagactctgcgctctggatcctctggctttagccaatgtactgatgctcacagataagtggtgatggtggtgatggtcccctccatcatctagtgcgtgtgacagtttgtaggtgatgacatacgaggctagctcctttgaaagcgttcagcgagcagcgcagctatacgcggcgcttttgccgtgaccgtcgtacagggctcccggcaggttctagatcacgtcggcgatgcttcgaatcaggtacggctggtcccgattc

SEQ ID NO: 513404 - DNA, 225 bp, Homo sapiens
tgacaggggagatgaagatgactgttacagcatgaattgcgtcccaacactatgtaaactatactgaaagatgttgctcaaagtgttactaacatacactttcatctgagtagcaaaacgaggcagaagtagccaagggcctactgattctttcatgtgagaagaacttagtctagacataatatgactcagactgcttctatgtaaaggcctgccaatcctctt

SEQ ID NO: 513405 - DNA, 185 bp, Homo sapiens
aagtacagaggcatgaccttagctcactgtagcctcaacctcccaggctcaagcccctcaagtggctgagactacaggcgcacaccaccgtgcccagctaatttttgcattttttttttttttttttttttgcctgtttggaaaatttttggccaggtttacttccatgaggacccgggggtacc

SEQ ID NO: 513406 - DNA, 331 bp, Homo sapiens
  misc_feature (18)..(18): n is a, c, g, or t
  misc_feature (51)..(51): n is a, c, g, or t
  misc_feature (98)..(98): n is a, c, g, or t
  misc_feature (148)..(148): n is a, c, g, or t
  misc_feature (162)..(162): n is a, c, g, or t
  misc_feature (327)..(327): n is a, c, g, or t
ctaaaaatattcatgtancaaatctgagaattgaaaactgcagataaccgnccgggtatggtgactcatgcctgtaatcctagcactttgggaggccnaggtgggtggaccacctgaggttaggacttcaagaccagcctggccaacntggtgaaaccccanctgtactaaaaatacaaaaatttgcctggtgtggtggtgcatgcctctagtcctagctactcgggaggctgaggcacgagaatcacttgaacctgggaggcggaggttgcagtgagtcgagataacactactgcattccagcctgggtgacagagtgagactccncctc

SEQ ID NO: 513407 - DNA, 99 bp, Homo sapiens
  misc_feature (99)..(99): n is a, c, g, or t
gtccgtgtcgctctgtaactctgtgaccagcgttcaatcaagtgatggatgtaacgtttctctgttgattaggagtgtctgtatatcacgcgtaacgan

SEQ ID NO: 513408 - DNA, 327 bp, Homo sapiens
tttatttgggtaaatggtttatcaaaggctgtcagcagtcactctatgcacaggcctggatttggcagtcactttgagtatgggactctctactgcccctcccacctacacaacattaccccgcctcctcaacccttcaggtggcctcactcatggacagggtggggaggattagcttctcttctgaagagggacgtcaaagcagtggaagtggggtggaataacctctgcttgcaaagtcctctggttggggaaaacaggcttagactgccttcctcccaactttttgtaagcagaagaggccccaccttggttggttttcttgtt

SEQ ID NO: 513409 - DNA, 986 bp, Homo sapiens
acatgtctcggcgctcgcaagggatgaccccagtcacattaacgtcgaaagcgggaattctcgacccggagcctcttgaagccattcttacagatgatgagccagaccacgggccgttgggagctccagaaggggatctagtggacctccgtcacgctgtgggctagtgtgcatgatgaacttcccatggtggtacattcttgatttgtattcgagcgaccatacggaaagcgaatgtccatagggacagtctctgtttagaatagagctgtggataaggccagcttccccttcacctaatctgagcatgaaaaatagcattcctgagtcgcgcggtgcggaggcttgtgctctcctagtgtcagggccgaggaggcatgagcgatgtgtgttatcaaacgttcaatcgtagcaggtaagtttgcctcgcagacaggtgaacactattagtcacgagtatacacttctctgctaccttggcatgggggcgctcattccattccgcctgcgtatctcgtcagcattgagaggcttctatatccaccaacgctcggggactgaagtgccgaagtatgccccgacagggtattttgtacacgatgaggcccagccagcgtacggcgatgtagcagagcttggcgaacacaggcgcattgtcgacccacggtgctaggtggtttcgtcgttttgcaaactagcgcgacgaggaagcacatccatgtgcattagaggaattcgtaccattaagagaaggcggaggcaatcggaatgctccaccgtgagccccgtgggggcttcgttgcatcaccaagcaccacattgcgggcgttagataagcccagggagaaggcctcaaagaagggttgtgggcgagatatctacggacttggaaaggcttccaagaagcgccgttaaagggtttcctggagaaatcatttggaaggccccccaggggttgggggctggaacggcgtgtcacggccctg

SEQ ID NO: 513410 - DNA, 159 bp, Homo sapiens
tcaggatcgataactgctgccggagctgacccaggagcagctgcaccagcttcacagtcgcctcatctcctaagcactcctcctctgtgcagtccacctcctctgtgctgtcacagaagctgaagccgggaggagtgggagccccctcctctgtgctgt

SEQ ID NO: 513411 - DNA, 568 bp, Homo sapiens
  misc_feature (8)..(8): n is a, c, g, or t
  misc_feature (16)..(16): n is a, c, g, or t
  misc_feature (24)..(24): n is a, c, g, or t
  misc_feature (68)..(68): n is a, c, g, or t
  misc_feature (362)..(363): n is a, c, g, or t
  misc_feature (375)..(375): n is a, c, g, or t
  misc_feature (377)..(380): n is a, c, g, or t
atttcttnacctaganaaatgtanatacacacacacacacacaaatatatatatatagagagagcacnaaacagaactggtgggagattgtggtgaggaatcatggtgttttaagtggcatccttgaacattctaccaaagccgaatgggaagatgaggagagtgttgggagtttccgaactgaagtacaactccgtaactggaagttttcaaggttggaaggcattattttgttagtccgttaaggggcacattattcaaagacttggctgggaatgagtgctaggtgatctgtaaataatctacgagtaacgtctaccaggagtcgaacattaacatcgtagaggccaggctttcgaagnntcattgccacangnnnngcattgcctccaccctttaactgtttctctacaactccaacgattgcattaaaaggacagaatggagcaggtagagggtgaattcaaatataaacaccctctgtggatgtggccagtgaggcagttagaaccattaagtgtctccgcagcaacaatacaactgttaggtcaagtgtacgaagggtgag

SEQ ID NO: 513412 - DNA, 301 bp, Homo sapiens
tcatgcgtggccaacctccttattatctgattccccaaccagggctgggatctggcctactcagggcgctgctatatttcaacacgcagccagggcctagtacatactaggagctaaattaaaaactgatggggccaggtgcggcgtctcatgcctgtaatcccggcactttgtgaggccaaggggggtgtgtcacctgaggtcgggagttcacgaccagcccggccaacatggcgaagccccatctctactacaaagacagagattagcctgtcgagaggctgagcacacattatggagc

SEQ ID NO: 513413 - DNA, 268 bp, Homo sapiens
acttcagtcacaagcatccaattcgcagttgtcagtgtacctgtcgcttgcagcaatgcagtgcaatggcaaccgtgtcgcagcccacgccagatcaggcagcacctccatctcagcagcaaatgttcagcccttgcagcagtgcagttcccaccacacccacgttcagctcgtcagatggttcgcacaggcaggcaacagcaatccgtcacgctacccaacatttaccacactattcacccagcacaaccagccagtcactcaacct

SEQ ID NO: 513414 - DNA, 300 bp, Homo sapiens
gtccaggctcctaaccatctttcatccttgggtgtatccatcggcctaggaacacctaacaccacgtgatgtttaatcctacagcaaaccatcgacactttcagcttgaatgatcatgtatcacttagttttcaagtttaattcaagtgcatctacctcttctccgctgttgacaccagaaaactcccttcaataggccccttgtgaaacctcattattactttgttcaaacaaggggtaaaggtgctccctgtgttagggtgtccagaaataaatttagggaatcccgtttaaagaaaa

SEQ ID NO: 513415 - DNA, 108 bp, Homo sapiens
agcgatcccccttgtttcaggtgcgagatagtactacggttgtggtgctggagtttaagttgagtagtatagacagtgcggtagctagttatggatcaatataaatag

SEQ ID NO: 513416 - DNA, 548 bp, Homo sapiens
cactccagcctaggcaacagagcaggactccatctctaaaagtaaataaataaataaaattttcaaaacttttaaaaatccaatgaaatatgtcaggtttgtacctaccacatttaaaatagggacttgaagaattaaacattttattacaaatgaagcacttcatgcacagactggcacatagtaagtagtcgataggtgttaacaatttgtgttattgttattttctggagtccaactaacaaatcccacagtgaatgacatcacagggatgcaaccaacaagatccagaatatggaaacttctactagataaacaactccatttcttcagcaacaattcaagagagagagagaagagaagctatacattttaaaaggctgaagaaatatatgaaccaaatttgtatgaggcaatcagaaaaactgacaccgactgtattaaggaattatctaattttagtgtggtaatgagattgctgttatgttttctaaaaagtcattatactttagattttcataataaaataattatgaatgaaaaaaaaa

SEQ ID NO: 513417 - DNA, 409 bp, Homo sapiens
  misc_feature (390)..(391): n is a, c, g, or t
  misc_feature (393)..(393): n is a, c, g, or t
  misc_feature (399)..(400): n is a, c, g, or t
aaggccgcacacattgtttgacgtagtagacatcctgcgtcatcgacacctgcgcgtgcccgagttggtccgctgcctgcctcgcggacagtccctcgtcgtcgaggatcgtcgccaccgacttccggaacgtgtgagtggtcacccactccaagtccagtgctgtgcggatctggcgccaccgccgctgcaccgtctcggggtccaggatcgtgccggcccgcgactcgaacacatacgtcgagtcttgacgccgccgcttgagcatgtcgacggcgaactgggggagcgggagcacacgtccgtcgccggcctcggacttggtgagatcctggcgcaccaaaccttgtccgcgatgcggacgatctgcccggtcacgatgcgtctagnntnagccanngtgtgtcac

SEQ ID NO: 513418 - DNA, 959 bp, Homo sapiens
acggcacgacatgggggctataagactctcaaatctacctggggatgaaggaagaaacccagccatccatcctgcatcgggcttaaaggtgggacacgagacagagagacatgtgataggcagtcagcggagccttctgctgtcgacagcacagatggagctccgggactcgttcgctacctgtgctgtttctggcagcatgacggcctgatgtggccctcagagccctgacgcagtgtcccgggcagtgacctgaggtccggttggatagcgtgtcactgatcaccttgtcgagatagctgaaaatgaaatgcgccggagtgtggctgccttcaccgcggaccctctgtctcttacatgcgcaacgtctgagcacaggagcccatccgtggctttaggagttccaccgctggaagccttcatgttcagacaccccggtatgctccaaggcctgatgtgagccagcgggtggtgtgaatagggaaactgcaccccactaacccacatcctccatcctgactgcagcatgtgggttacacccggacaggggtgggaggcagtcacggggtcatgcctggagcaggaacctctcccaactctgtccaggtgttcagacctacttggcccaacactgctcaaccccacacgggttacacatgtccctgtcgatggtggtctgagatgatgatgtgcgcatgaagatcagtgaatctatgggaggaccagccatccctttcagaggcgtgaggccctaggggactctgccggaaaaggagccgccatgctccgtcccaacaaacatcctagaacagtcagaaaacgggtgctgtagaaggagcactcagctcacggggagggagctcttggctgagcttctacagggcagagagctgcgctttgggacttcagccttccttccagtctgggctgagtgttactccagagtacctatgcccgct

SEQ ID NO: 513419 - DNA, 581 bp, Homo sapiens
agtgcggtgggaatgcccggactagagcaagctaccgatagtacacatgatataaatgtgactgctagagccatcagaataattcctatggttattaacgattgtggctgaacttattgagaaatgctaactatggtatcagagcgcaggaggagataaaggtgctaactgggggtggtgtgtatagtcctattgaaaccaagatgatccagtatctacatacccagagctgagtatgctgatgaacggtatattaccaagtatgacactctatacagaccatgagagatgcacaatgcacgtacagaatccctgattatttatgcagcgcattggatgaagcccgacttcatttcaggggtctatttgtggaggaatatgaggtcgctggtgttttgaggcacagatttcttaagagagctgccagaagaccttaaggaaatcaggctccacttacggcacatcccttgggtcagactttagaacctgtgcttgatctgtttggagaagtactccaaagcgaaagtccagggaagacagcgttttttacatagccgtatggagaggtctgactggctttg

SEQ ID NO: 513420 - DNA, 308 bp, Homo sapiens
tttccttttagcccttttattagtgtttaagactccacccaagtttactagcataccaagacagctaataaaacaccaactgacttaaagtctctgcaaatgcatgctacttaaaattccctaaagcacacattggttccgagtctgatttttacagggcagaggctactgtgcttctgtgcttaccatgggtgtctggtcatgctgcattgtggtttgatttcactgctgctgtgtcttctggctgctgtgtttctgtgtggggatcttctgcatttccagcatttttcttgcttttatctgctgca

SEQ ID NO: 513421 - DNA, 592 bp, Homo sapiens
gatacaaggccagactgcaagatatccgctgaattggagccgcccaatagaagtacaagaagagcaaagaagcacagcgggtggtaccaccagccgggggctggacactggccgacgccacgccccccaggcgatgaaaagttcgcggacgcccaccaatgcggtgaaaaaagcggaggtccccagccacgaaataggctggacgaacgagactatcttcgtcgaggcgccccccacgcttggtcccccaacagggaggcccaccaccacttgtcactgccccacagacatacctacatgtcacgtgccccacgagttgatcagcgaggtagacatttggggcccccaaattattgggtagtgacagtaacacaagcagccccacaaaaagtttggtgcggctgtacccaaatgaaccagacgcagcagttgaaaggcacggcaattcattcaatgcggccacaactgtgcagtctgaatacccccggctggggttaacagtcaggcgtctgaagtacaactctgatgcggtaatgtccggggttggtggccggcatacacacatccaataaggctacaaacacctcataca

SEQ ID NO: 513422 - DNA, 719 bp, Homo sapiens
cgattctgtgcgtggatcactaactctgtcggctaacatcgacatctgcacaaacaattcgtgcataatactagactggtagagcttggacagaaagaataatctgcctaacgagccactagtactagaacacaggatacttgcgcactacgcctggatctgccatctgcgaacactgtgccagcgtggacaagtttgtttatcatctatacaggcctgcattgctcgttagtaacagatggatggctccgcagatggctaaccctccttcacactgtgacatctgcctcatgactgaggcactcttgacatgaagatcgtgtgacagatctttcatagtggctagccagacgcaccgtttctagattgcctcgtatatgcatatggggatggctggttcccacgttaccttatagaatgatagatgctatgacagtgaattctctctggtagagatatgaaaagatatgaccgcgtggcatcttgtcttaatacataactgactagctcactgtgaaattcctactgtatctaccatgacatatccgcaggtagctggctgtagccacagctgagccatcaattatattcgttgagatgggcaagcacgaaccaatagcgagttgtgaagcctctccctagagcggagtgttctccaccgagaatggttcttcagatggtctccatgcatgattatgactgatattctaggttggtgc

SEQ ID NO: 513423 - DNA, 411 bp, Homo sapiens
ggaattatctgccttcaatttactatgaaccttcaaggcagataattccaaaggaaaataaaaaatggaaatttcttctaggggttatgctgttaatgcttcattacccagcaaaagactagaatggcactaaagacatatccttgttttattgtgtagggcagcattctagtttcattaaacatggcatagtaagaaatagcccaggcattgcagccaggcagactcaagcatttaagtccctggccatgcaacttcacagctgtgggacttccagtaagtcatttgcacttgtctgagtctaaatttttctcttctacaaattataggaagaatactaccaaccttgtagtgatttttgttattgttactgattatacaggcaacgggtagtatgacacctggcaccca

SEQ ID NO: 513424 - DNA, 847 bp, Homo sapiens
  misc_feature (1)..(1): n is a, c, g, or t
  misc_feature (177)..(177): n is a, c, g, or t
  misc_feature (198)..(198): n is a, c, g, or t
  misc_feature (234)..(234): n is a, c, g, or t
  misc_feature (256)..(256): n is a, c, g, or t
  misc_feature (267)..(267): n is a, c, g, or t
  misc_feature (294)..(294): n is a, c, g, or t
  misc_feature (521)..(521): n is a, c, g, or t
  misc_feature (525)..(525): n is a, c, g, or t
  misc_feature (567)..(567): n is a, c, g, or t
  misc_feature (584)..(584): n is a, c, g, or t
  misc_feature (599)..(599): n is a, c, g, or t
  misc_feature (601)..(601): n is a, c, g, or t
  misc_feature (615)..(615): n is a, c, g, or t
  misc_feature (625)..(625): n is a, c, g, or t
  misc_feature (638)..(638): n is a, c, g, or t
  misc_feature (664)..(664): n is a, c, g, or t
  misc_feature (671)..(671): n is a, c, g, or t
  misc_feature (715)..(715): n is a, c, g, or t
  misc_feature (733)..(733): n is a, c, g, or t
  misc_feature (773)..(773): n is a, c, g, or t
  misc_feature (785)..(785): n is a, c, g, or t
  misc_feature (830)..(830): n is a, c, g, or t
nctcaagaaaactggagccaccctgccctggaaggctcagctcccctgcttgaggacgccgcacacctgttccaggacgtgacataggctctggtccttgggcgtactgctggccaaggagaactaaagcttgttgaggtaggtgtgcacctggctccagggttcctggagcctcangaggtcaggggaacccttgtngaactccaccagcagcatcatctcgtgaaggatgtnattggtcaggaagctgttctgnacgtaggccanctccacatccatggggatgccatagtnactgggcctttgctcgggaggaggcatcacccagaaaggcgagaacttggactcggggcctgggttgccagattagtaaggggagctgagcagggcgaggcagggctggaagcatttctggagctctgcagccgcgctggtagtccatctgtgcgttgatgttctcctcttcgatggcagctgctgtttctgcgttcccgagccggctccgacaagggaaggctctnagcnccgtcagcttctggctgttgacgttccagcggccccccaggnaacccacgacctcactncgtgttaggggactntngaagttcagcaggnacagcacgtngctagaaacagcnacgttgaacggctgggacttgttganggctgcnaaggatgttacttccaccagggtgtgggggttcctggccaagtngcggctgcccagcatgcngttgcggaccggaacccggatcttgctgttcacccgcttncctggggttgtngcctccgggtgggcaggctctgaagggctcttccccagttgtctncgacttttgttctctgc

SEQ ID NO: 513425 - DNA, 313 bp, Homo sapiens
  misc_feature (175)..(175): n is a, c, g, or t
  misc_feature (267)..(267): n is a, c, g, or t
  misc_feature (293)..(293): n is a, c, g, or t
aaaacaaaacaaatttaaaagcactcaaaaataacctcaaaaagagactagtgagtgtcccttaaggaaagcccttcctgcagattcccacagaactcggcccaggcacttaacctccatctcagctctggtacagctcactgcgtacagtgtgtaccaaactcttatgcctggnctgctgataaattctatttatctctgaacctcaatttattcaaatctagttatgatatatcatagtgcttgtaattgttgtaaaatatagangtaacatacagcatgtgtctacacgnttaataaactggtgctaatt

SEQ ID NO: 513426 - DNA, 458 bp, Homo sapiens
tttggaactagcagcatatccacttctctgtcagcctcaagcagcatcattgcaacagataatgtgtcattcacacccagagatatgctaacagtagaacatctggcacaatttcaatccaagaaatttactctgggaaaagttccattgaagcctccacctctggaacttctaaatgtttaaaagggcaattttaaatacggaaaagaatgatgtttaaaattgctatgagtgattcatacagagatgtatatatgcatacatgtatatattcataaggaatataagcttccatcaatagtgattgtaaatgtgaatttattgttaactgtaaatatttaagtataaagtatcaaaatctctgcaagcaagggaatttttatgtactgtaattatgaatggaactgagagattatgctcgaatcaagtacttttctcatgccataccaaaaaaaaaa

SEQ ID NO: 513427 - DNA, 299 bp, Homo sapiens
  misc_feature (8)..(8): n is a, c, g, or t
cccccaanaccacggcttgggaatgcttgggcctctgggcagggcaggcaaactgtacccaaactgggtgggcagggggctggaaggcaccaggcctcaggaggaaccccatagtcccgccttcaacctgtaaccatcggctgggcccttcaaggcccacactcaccccctgtgggtgatggtcacggtgggtgggtgggggctgaccccaacttccaggggactttcactgtggacccccaaatggcataactgagataaggtgaataagtgaccaataaaaccagttttttaccaaa

SEQ ID NO: 513428 - DNA, 452 bp, Homo sapiens
tgctaatgaatgccaggacaacttcatctccatcaagggtcctgagctgctcaccatgtggattaggggagtcttgaggccaatgtcatgagaaatctttgacaatggccctgccaagcatgcccccatgtgttgctattacttttgactgagcatggattactgatttgccaatggcatcagtggagtgtacacatttgtgagcataggtaggtagagagtgcttgcttgcacctgcagtacatccacacccagcatccttgcaccagcaacattgtgattgtgccattgtcccacgacaaacaacaacatttggttgtatcattcacatattgtggctgctaacacaaacactgtggcacttgaaacatacactcttgaatctcttgtcacaatacactaccagaacccatgtgacctggttctttgaatccagggctacaatactaaac

SEQ ID NO: 513429 - DNA, 260 bp, Homo sapiens
acgaactgtcacgaatgttgacatctgggttgtgatccagaggtttagagtagaagtatgttatcttctcccctgccaattaatcacaagtggtctttatttaataatgaatttgatattttataatgctgtatgtcaaggactgacaaatttattctgataaagggctgagatgaaagtttgtaagacttggctggtcatggtggctcaacacctgtgatctcagcactttgggaggccgaggcaggcggatcatgagg

SEQ ID NO: 513430 - DNA, 1333 bp, Homo sapiens
  misc_feature (1144)..(1144): n is a, c, g, or t
tcctccaaaaaaaaaaaaaaaaaagggacccccccgtcggtttaaggggcctgtgggggggaagcccagaagagggggggcggtggcgggggggggaaaagtgttttgcgggtggcgcccataatctgtctggcacagagaggtcttgtgggagaggggcgcccaccccagtctacagttttgtgtgtgggtcttgtgcggccacaacacacatgtgggcgcccaggggggtgtggtgaacacactctccgcaagggggagacacaccgcgggggggagaatatctctttctctggggcaaagtgggggcaagtgtggcaagaagggggcgcgggagagccctctctctcacaaaagaggggggtgtggggcgcacacaccgcgcgggggggctctccgtggagagaaataagcgagggggcgcgcggggcggcgggaggcgagaggagacacgcggggggagaggagatatccgagaggggcctctctctctgtgcgcccggagagaaataaaaaggcgcggagaaagaaaagcaggcccgggggcccccacaagaggtcgcgcgggaagaaaaggggtggtgtccccgagaaaaaagagtggcttgggggctccacacagagagagaaaaatatacgagaggggggtctccgaggaggccacaaacggggggagccctccgggatgggcacggggagagacaggggggggggcacagatgagaagaaaagggacacactggtgagagaacccccggaagtttccacacgctctcggggagagcacacacccgggtgcggcggacaaaaaaatgctggggggccaaaaaaaagacgggtacccccggggagaaaataaacccccccaggggagaaaacacccggggggggcgggggacgccacaaagaaaaataatcccccgaggagggaggggccccaaaaggataatgcggaggctacccccgcggttgttctgtgtagcaacagagggggggcccccaataaggaggagagcacgcaaaaaaaaaaagagcaaagcgaaggagagggacggcttttataaaagcgggtgtagagttgggaaaaaagttgtcgagtcggtgggaatgctggtggggaagagaagacctctatatttggggngggaggagacaaaaaatgtgggtggcaacaactccctacgaggaatataaaaaaggctcggggggaggagtaaacaaaaatagggtgagatactgggtgtgtatacaaaggtgtattttgctgcgagtgaaaaatttgttagcgagagattaaaaataagagagaaagtatagtagaagaagaagagac

SEQ ID NO: 513431 - DNA, 387 bp, Homo sapiens
  misc_feature (1)..(1): n is a, c, g, or t
ngtgcaacatctgcctctggtactcagcatgtgccacctcgttgaccctcatttgaccctcacagccaagttctgttatgaccccttccttggtaagaacccgcccagctcttgtatccaaaatgtctggcttcaaaccccatgctctgaccgctcaatggcaccgcttccttgccagcctatctacagctcccagggcacccagggcacctcagcctctgaaaggggaatggtcagacccggaagcccttgaatgccaagtatacctctggtttaacactgtcgtctcgtgtattatatgtgtatttctcatctgctcgcaagtattctcgtggcacagaagagagagagaggggagagaagagcacatgtgatgtgtcctcgtgc

SEQ ID NO: 513432 - DNA, 552 bp, Homo sapiens
taggatcccaaattgagtcgggtgcatgggggaggcactatacccgtgctgtgagaggcagtctgtctgttggcaagcttaaccctgtgaatgtatcagcaccggacagtcatcgtctgaacaaattcacagtgtgcctgccgtcagggaagggcagacctgtgtaccaggcaagtacttgtccctgtgagcgcccaacgtgtcctcacgcagctgcgaactggcggcctgtgctgggtacttttgcgtttcctaccatgcccctctataccccgcagcctgtgactgtcgtatcagcgttcctggccaggaatgttcaccctctatcttgccgctcaggatcaacagccattcttgcccccatgactaccacggacagcagcctgcctgtaggagtcttcgtgtgggatgtggaaaatgaaggggacgaagctctagatgtgtgcatcatgttctccatgcggaatggactgcgtggtggagacgatgccccaggggctttgtgcgatgagccctttctgtcctgcagcgtagcgcgtaaactgtccgggg

SEQ ID NO: 513433 - DNA, 323 bp, Homo sapiens
ataaaagcgacccgctcataagggggctgcactggataggttatactagactacgttagggtggttggtgtaaatgagtagaggcaggagtccgaggaggtatagttgtggcaataaaaatgattaaggatactagtataagagatcaggtccgtcctttagtgttgtgtatggttatcatttgtattgaggttagttagactatacgtcatagtagggatggtgacttacgtcggatgtagataacgatacttgggacggtggggactcaatagacggggaaaactacgacacttgatcagtacctgcgtgcgggtacggcc

SEQ ID NO: 513434 - DNA, 520 bp, Homo sapiens
agtgtaaagggcagggcacagcttggagtccaagcattttgctgatgcattgctcattattcccaaggttcttgctcagaactcctggttagaccttccaggaaacatttacgttcaaacatttcacgcagaacactcagaaatcaggtccagctgtgggtgtgacctgaacacaggtgtaccactggtggcaccacaaataagcgtaggggacacaatgggggataagaaacagctacttacaatcgttgacgatgattgcaccaagcattcccgggtgagagacactgccacctgcatgtgtatctgaaggatgtatgtaggcacccgatgaattagacttgaatgcacagggactccgagacagcggtggaattgtgtacgacaaacaatattgaaaaaacactaaaaaggcacacggagtcgttaagaaaagtacaccaattcaccaggtgagcctcacgaggatatacacacgagagtcagacacactcaagatgttcaatctgaaggatagtca

SEQ ID NO: 513435 - DNA, 534 bp, Homo sapiens
tcatatattttttgcagggccctcataaaggggcaaatagggctaaatgtaaaccccaagccggccataaaaattgaaatatggggcttaaaaaaaatgggaccccaagaagtttattttccattttaggaaacaaagatcccaattactcctttgttatgggcccaaagaaaattttttttaagccaaaagccccttaaaaaagttccaagccttgaacttttttgggtttaatttaaaataaaaccctttttggaggttttatgggaaacaaaaaaactgcgggaaaagggaaaaaaacttggcccctaatccccaaaacttccaggatcattttccaattaaataacaagtctgttttgggaaaccctttggggcccttttttatccccccaatgtttcctaaaggcttggttgggaaaaattcaggaaatgttccccgaaaaaaaaaggaaaacccttttttaaaacccaatcgggaaaaatgggaaatttttttttggtttaggaaaaaacccttgggggttttccccc

SEQ ID NO: 513436 - DNA, 305 bp, Homo sapiens
tttgaaactcccttccccctttttgcagcctcccaaagatagttcaggctccagcctcatgtgatagcatgaaaagaaactggttcccacagctgtggggtttgctgccctcatccccaaccccagtttaaatgcccaattacgcttttttttaaggccccaaataggataggaaagatcgttttgctatccctgaatgcctgtcccccctgttttgtaaggtaagattgggaaggggttggcccttgcccctgcgggtgagaaaccaactttaggaataaagaccctctctccctgtttgccca

SEQ ID NO: 513437 - DNA, 837 bp, Homo sapiens
gggagctgcggaataacgtggctggcgctgccacgaggacaggctgagctgaatgtcaggaggtagggcggcgaggcgcggtggctcggacctcattcttctgagtgttataatatctggtgttagctgcagaaccaaaagaaaaataatgtaaaacctgaaatataaactgagaaggacaaagtacgcaggggagcgacaccagacaggctcaagagcggccaaaactcccctctccctgcccaagatgaatctggttgagcctcccgtggcatatgcctcccagagaggaggaagaagaggaagaggaagaggaggagagggagaaggacgaggtagagacaacaagaggaggaggaagaggaggagcgggtccctgtgaggtggatcccaacgaagaagccaagcctcaggtcccggactataaactacatcaccagcagcagccagaggccagggagccaccaaaagcaggcagtgaagactccggggaccaggcctcatcaggtgtggaggaggagatgcagcatggggccagggtttgataaagtggcttcagtcaacccaactacagtgactccgggggaccaggactcccaacagccaagaggcagaggccacaagagctgccagctgaagggcctggggtagagtacgaggtcctcagaaacaagcgaggaaagccctgaagaacagatggggtggaaggcaagagaagagtccggctgactcatcctcaaacacagcccaagggccggaccaaatgagaccttgacaaaaccaaactctaccaggccggaaaggaagacatacagaacggcaaaaaaccaggacaag

SEQ ID NO: 513438 - DNA, 879 bp, Homo sapiens
  misc_feature (223)..(224): n is a, c, g, or t
aagaatgcacagactttaacatagatactttcaaaaataggtttatgacagtctggttgacagtctgtgaaaaccatcaccatagttaagttgtgaacatattcatcgtcacccagaggtttcactagtgcacctttttagtacatttttctctacctctgtcctctgatctattttctgttactactgattagttaccataaatggaattatgcaacggatnntttttctttctagtttcacacagtttaatcattttggtattcacttattgttttgtgtatgaattgttcattccattttataattgaatagtattcttttgtatggataaacaacaactggtttatccattcacttgttgatggaaatttggattatttccagtttttggtgattacaaataaaattgttaggaacactcgtggacagctttttgtgtggatataacttttcttttccctcaggtaagtgtctagaagtgatatggctgggttgtatagctggtgtatacttaggagctgtcaactgtttgccaaaataggttgtactattttaccttcccatgagcagtgtacaagagtttgagttgctgcacatcattgttaacatttggtatggtcagtcttttctatttcagctattctgaggagtatgtagaagtactccatgatggtttcagttttcattcacctaataaataagttgtaagcatcttttcttttttaaaaaagttatttttaattggcaataatattatgtatatttatcatcttatatacttctttgtggtgccgacatttatattcactctttcagcattttgacttatgtatacattattattactgtagtcactatgctatacgatagatcaca

SEQ ID NO: 513439 - DNA, 278 bp, Homo sapiens
agtccccgctgctggacctcgacctcttcaacttcgactgccagaggcggagggggccgctacggctgaccgagccccgctcgctagagcctggcgcctgtgcgtcaagccggtggagctgctccacggccgtggccgacctggtgcgagaggctccgggcgctccatgcgggtcgcaacggcctgtaggaggcctacgaggcgggagcggcgcgccaagctgcagcaatgccgggccgagcgcgtacgcatcatgcgcgaggagaatgcgcgtcttt

SEQ ID NO: 513440 - DNA, 283 bp, Homo sapiens
aggaacagagactcatgcctgttatcgggggcacaactggcgaggctgcatatgtacccagaaagatgaaatgacaggaatagcatcgataaaaaatgacggctatttgcccaagccgatctccaactcctgttctcaagtgatcctcccacctcagcctcctgaatagctgggactataggcatgcgccaccacacccagctaattttaaaattaaaagtagagacaggctctcactgtatagcccaggctgggacatgctattgaaacttctaaaactagg

SEQ ID NO: 513441 - DNA, 206 bp, Homo sapiens
  misc_feature (23)..(23): n is a, c, g, or t
  misc_feature (163)..(163): n is a, c, g, or t
cgggcaccgagatttggtctgantttatttatatggcatgaaatctcctggtttattttgggatttttttttttaggtttcaaagtttgttttttctaaagttgtgtgattatatatttgaaattttaaatttcaaagaaaggtatgttgtttaaaagggganccaaaagaaggtagtattgaaaaatgttcttggttttaataaa

SEQ ID NO: 513442 - DNA, 294 bp, Homo sapiens
  misc_feature (62)..(62): n is a, c, g, or t
  misc_feature (206)..(206): n is a, c, g, or t
  misc_feature (236)..(236): n is a, c, g, or t
aaggttacgcactccagactcacggaggtgaagggggccgcgtggggctccttcagagaganggagatgcaagctcagctgccagagctggagagcaagatcctcacccatgtggcagagatgcaggcaagtcggcaggggaagccgcggctcctgagcctgaccgctgcagaaagaagcgtgagtctggagtgcgtaaccctgancggggagaggacttttctaagctctatttnaggtgttagatctaattacttatagattcgtgagtctggagtgcgtaacccttgagcg

SEQ ID NO: 513443 - DNA, 513 bp, Homo sapiens
  misc_feature (16)..(16): n is a, c, g, or t
  misc_feature (23)..(23): n is a, c, g, or t
  misc_feature (89)..(89): n is a, c, g, or t
  misc_feature (163)..(163): n is a, c, g, or t
  misc_feature (186)..(187): n is a, c, g, or t
  misc_feature (360)..(361): n is a, c, g, or t
  misc_feature (479)..(479): n is a, c, g, or t
aacatgataaaggccncgcctgnaaaatctacagttaacatcatactcaatggtgaaaaactagaagcttttccactaaggccggaaanaaaggtaggaggataacttgaggccataagtttgagaccagcttagacaacaaagtgagacccctatctctatnaaaaataagaaatcagaaacaanncaagtaccaacctgatggtacttttctctgtttatagaaatctacaggctgggcatggtggctcaagcctgtaatcccagcactttgggaggccgaggcgggcggatcacagggtcaggagatcgagaccatcctggctaacatggtgaaaccctgtctctactaaaaatacnnaaaattagctgggcttggtggcgggtgcctgtagtcccagctactcgggaggctgaggcaggagaatggcgtgaacccgggagggggagaatgcagtgagctgagatcacgccactgnactccagcctgggtgacaaagcaagactccgtct

SEQ ID NO: 513444 - DNA, 390 bp, Homo sapiens
cctttatgcacagaccaatatctggcaatggcactaggagacaaataagctttaccagtctcaaagccctggctactacagtgaatccacccttctcctggatcttatctacttcagcaaaagaaggccacccactaaaccaggcccttgtactttgggtggaaactcctaagtcctctagtctcctcaaacagacagccaggctgccaatttccacaataataatttctatagcactgagtctttggtagccttgtaactgtagctactgatgctacagtctggtccctgtatgataaaacaccagagcaacagaaacaaaaatattgactgaagccttctaaaatctctctaaatataccttcaataaatatggttttttttacaaaa

SEQ ID NO: 513445 - DNA, 901 bp, Homo sapiens
taatttccttagctggtatgaaaaggatctttaataattaacggtttttatagaccatcggtggaatgtatttttcatatggttatatgggccagaaaattagggtacaatttttggcgctccatcctttaatcactttgcactggtgcatggaagatcttctggacaagaaacccttggatttctcagagacttctgggcactatagaagcacgagaagagacaccactggggcaagggaagaatggtggatatctccagaatatggtgctataattaattctaaacagtgtgtgccgggtattttagaaagaacagagaagaacagatattatacgcaaagaccatgtccaacaagtacaaaaccgcggggaacaatattggggggtcacataattaatggggtgaggggggggaatgtacaatagacggcaataataagtggggctatgagggaaaggaaccccaaaaaaatatagagcgcactttagagctaagagacacagaggaggagtcttttatagacgaagccagagggtataaaacgtaagtattgggggagttattatgtccatacgagggagcaaacagagacgcgcgtgggtgtacctgtgaaaggagaaaagttgtaaaagcagggctgattatgttggcaacaccgaggtatattaactccacaaaaatttaagcaattttagagcggaagtacacagttttttagttggcacaagacaaaatgtttcaaacaagcgtgtggtctaacaacaggtttatcaacaaagaggttttagccacaaataaggcctcaacacgggtgatgagagaaccggtttattatacataacacagggggcgaacacacttgaggaccaacagatattttgtggaacaggctaaggac

SEQ ID NO: 513446 - DNA, 206 bp, Homo sapiens
cgcatcttctcccatcagcgtgtctggaagacaatctgcattcagttcagctaaaaaatattaggcaaaacatttggagatgaagtttccttgtccaggggtataaccttctttacaatattttccttgatgggtgtaatcctttttttttttttttttttttttggttttttttgggccccaatgggccaaaaatcgggggaccc

SEQ ID NO: 513447 - DNA, 351 bp, Homo sapiens
  misc_feature (225)..(225): n is a, c, g, or t
  misc_feature (254)..(254): n is a, c, g, or t
  misc_feature (295)..(295): n is a, c, g, or t
  misc_feature (301)..(301): n is a, c, g, or t
catgctctggaaaggggtgggtcggggctggctgcctcataaggctccagacaggagtgcagtgggcctggaaggtaggaataggccagaagaggcccagctgggcaaggaagagcagtccaggtggcgtctgccctctgcgggctggagtcggctgggggcggtccatcctcagccccacgggcctctgcttggtggcctctcttgttgctcccttgggaagcnagggccacaagccggggcaaaccccttanggcactttagttagcgtgtctgggagctgggctccgtggangccccngtgcaggaaggcaggccccgggagcacatcatcccccatcaacctgaggc

SEQ ID NO: 513448 - DNA, 108 bp, Homo sapiens
ctgaaaattagggggcacttcaagtagatagcttctatttcctatatttgtcttatatacaagtatttactttaaaatgctttgttggaattattttgataaaagtcg

SEQ ID NO: 513449 - DNA, 708 bp, Homo sapiens
  misc_feature (344)..(344): n is a, c, g, or t
  misc_feature (616)..(616): n is a, c, g, or t
  misc_feature (622)..(622): n is a, c, g, or t
gggattcaagcctcgtgaacgaagcggtggggagcaggcacaggactgggatgctctgccacccaagtcggccccgactaggggcaggaaacaagatcggaggccgtaggcttatggtggtgctggaaggggccagtctggtagacagatcaaggtagggaaacgacgagtatgagctactcaagctgtgacaagcacaagtctatattgtcgaagaatggacgggaccctggggaagcgcggtcggatatcaccgcacacagagtttgcctgatgctgatggatagtcccctgaaccgagctggcttgcctacaggtttatatccattacacagaagaatgtncctgaattgaaggtgaatccctcagtacccgatattcctcatgaaagctgttgaccggcctgttaggtggccatcaatggttcaatgcttttacatcatagctcagatgcttcgagcagctgattggcccccagaaggcttttgacggtaattaagaatccagtatcgagatcactttccagtgggactgtgatgaaagtaggcacttcttgtttccatcccggtgtgtcagtgatgtggcgtgagctgggtgcccagtcagtgatcctatngtgtcngtggtacgggcctttgtccatggccaaggtcagtgtggcagtatacgggagaagatggtgtccatcatgtacctgaccccttgctg

SEQ ID NO: 513450 - DNA, 138 bp, Homo sapiens
  misc_feature (21)..(21): n is a, c, g, or t
  misc_feature (40)..(40): n is a, c, g, or t
  misc_feature (47)..(47): n is a, c, g, or t
  misc_feature (53)..(53): n is a, c, g, or t
gatcgagctcgctccgctttngtatagcagaggtcttganacctgtnaaggcngcatgagttctccaagctgacgtcagactccacttagctcccctgtgtgctcttcgtggatctcaaagcgtgagcctggggagct

SEQ ID NO: 513451 - DNA, 101 bp, Homo sapiens
tgtcgcgacccccagaatatttccctgccggcatatccggcccgggcactggcgttccatctcgaaggccgtgtacaggtacagttcgatgtcgataatga

SEQ ID NO: 513452 - DNA, 352 bp, Homo sapiens
gcatcagtggcttgggtacagatcttccatgccgttagtcatggcccactttgacgtggataatccaattaccccaaaaggaaacacaccaacaccacgtatgtattagagaggacaggcagaaggccccaagcccatgtatcaggctcaacctcctccctttcaaaagacaccatatcttatccccaaaggacctgagactatggtgcttaccgactgaagatagtgccttttcatttcaaggcaaagaaatgaccacgcaccaagtgttgtgaccgtgtcccgctcctcttagatagccttcatcccgtgagactgggtaatatgggttgaatgcgtccgtcgacaatag

SEQ ID NO: 513453 - DNA, 262 bp, Homo sapiens
tgcgtccctatcaccctaaatttattatgttcagtggtatgaatgtgggactacatcctggaaaatgtggtatgtatataccatagaatactacacagccataaaaaggaacaagatcatgtcctttgcagcaacatggatgaagctggagaccattatcctaagcaaactaacacaggaacagaaaaccaaatactgtatgttctcacattgagtggacttcatgtcaacagacatagacttaataaatttagggttgatg

SEQ ID NO: 513454 - DNA, 454 bp, Homo sapiens
ggacggtaccaacaacatgaatcaatctcacaaatataattgatacccgtgggctgggagagatccccaaacaccaatgggacctcaaccccagctggtgtccaggctcttgacactgtcgtgagaaggaatttaaggataagtcagaaaatagtgaaagcacagtgatttattgcaaagggaaaagtacacactcaagggaatgtgggcggactcaaaagtcacgtgtaagggggttcgaggttgctacctctataggtttctttaaccaaggactgggatattcatgaacattcctgggaaaaggtggagatttcttggaactgtggtgccacccatttttacatcaaacctgggtgttcttggaactgtcgagacacgggtgggtgtgtgtttaggatattaatgagtgtatatcgaggtcctaggagaaacctgctcacatccagtgaca

SEQ ID NO: 513455 - DNA, 925 bp, Homo sapiens
agagagtggtgacgtccgggctccgtagagagagatgtccggtgttgccagtgactaagagagtagtaccctatgggtgatgtggagcaaggcaggaagatcgattaatgaagtgttcccagtgccacgaccgttgaacatatgggcggcaagccgactgaggactagggcgaaatagtctccatggtacttcttttgggggcgagcagaagagggtcagggcccctgaagtaggtctatacacagacccggcactaccgaacgaaagggcatcgatcttgcgtagagagatgccactgcatggaggtgtgaaggagacatcccaagcaagttcgtccctgtcaatcattaaaatgactctatgtcgccattggaggacggacgggaactaacagggcagcaacttacactagcttagtctcaaaatggcgctactacctggggtatctaatgagtgcactgcccctagatttatctatgaaacccggagttgtcttcttgactttagtaattgtggtaccatcctttaatagtatctcgtacaccagttttgcatgatcttgaatgaccgcatagacttattttgttgtcgccgggcctgatttccaacctaatgaactgctttgtggatccctgactatgtaccgtcgcgtgattaaaaatagttacctccagttccagttccctggtatcccttgttgaccccttctaattgcttttgttagacttcgaacgtatggttcacttttcacaagatggtgagtgcactttagacgtctggcactgggactttacagcaactagtggggcggccacattacaaaccggaatgtcctgctagaaccgacaacacccggggggtccagaaagcgcgggacgggggaaaacagcagttgtggcgaacacagaaacacgtagacggcgc

SEQ ID NO: 513456 - DNA, 325 bp, Homo sapiens
gccggcccgagttgcagtgcacccagcggggtgatgaagcgagactgtctcaaaataaataaataaataaataaataaaactggccagatgtggtgactcacacctataatcctagcactttgggaggacaagatgggcggatcacttgaggtcaggagttcgaaaccagcctgaccaaatggtgaaactctgtctctactaaaaatacaaaaattagccagatgatgtggtgcaagcctgtaatcccagctactcgggaggctgaggcaagagaattgcttgaacccacgagacggaagttgcagtgagccaagaccgcgccac

SEQ ID NO: 513457 - DNA, 105 bp, Homo sapiens
gtgcaatcagtacatggtaaaaagttgtggcagagatggcttccatatccgggatgcggctccacccctatccacgatcatccgacatcaacacagatgttgtcc

SEQ ID NO: 513458 - DNA, 201 bp, Homo sapiens
  misc_feature (67)..(67): n is a, c, g, or t
  misc_feature (72)..(72): n is a, c, g, or t
  misc_feature (116)..(116): n is a, c, g, or t
  misc_feature (140)..(140): n is a, c, g, or t
  misc_feature (182)..(182): n is a, c, g, or t
tgctggtgaccctggccgcccacctccccgccgagtttcaacccctgcggtgcacgcctccctgganaagtncctggcttctgtgagcaccgtgctgacctccaaataccgttaanctggagcctcggtagccgttcctncctccgctgggcctcccaacgggccctcctcccctccttgcnccggccctccctggtcttt

SEQ ID NO: 513459 - DNA, 913 bp, Homo sapiens
ggcggggggttgggtcggtgacttaatgaaaagggatggttcgtcgtcatgataggggggttctctctccttgtgagggcggagcggcgcgcctttggtgtgttggaggagagccgcgtggttgtgtcggggcgggcggtgtctgcgtgaggaaggacaggtggggggggtttgtcgcccgcgcggaccgcggtggggtgaaagtgaggggttgggtgaggggcctcgggcgtgtttgcgtgcagacgatagttgggcagcccggcgccggctgggggggggcgagcgacggttggtgcgcctgccgcgcgccccgggtgaagggggctgttgggtggttgcgccaggagagagtgtgtaggtgaggccgcgtctggtgggtgcacgggggccccagggggtgtaggggaccaccttggggaaaaataggggggagcgcccggggtcccaaggtgttattggggaagtccactggggggaattaaagaaagggcggtgggatgagtgcgcgcacgacggagtaccctaggtggggaagggtgacccacgagggggcgactgtccccgggcgccacttcggcgggtgacacccacgcttacgcacggcgttccattgctccgcttcagggcttggagccgccagaagggcgttgacggctgtgccaccgccgcccaagcactggcatgcaccggtgtaccggcccctggcccagcccctgccgtggttggagatagttttgccggggcactttatctgtgcccccgccccggtgggaccccctaaggtgccctaggacgaggtcagggtaacacctcacgtgggatgattagtaaagactggggtttggccttccctaatccccttgggggcgccccaaatcccccatcactatccgaaagaagccccaacatg

SEQ ID NO: 513460 - DNA, 790 bp, Homo sapiens
  misc_feature (145)..(146): n is a, c, g, or t
  misc_feature (182)..(182): n is a, c, g, or t
  misc_feature (676)..(676): n is a, c, g, or t
catcaaaagtaaaaggcgcccccatcatcttcattctaaccctactatcaccatgacaacatctcatcaactcacttcaatcactaaactacaatcttttaacactcctcattactcaaacagtcatacccctcctccctcattnncttaaatacaattttttctctagaggccacttacanacccaacccctcattacaacagcccaactaactatactatcaccattttccacacatatgcacctctaccccacatatcccataactacatcaatagccaaatccaggctacataaaattcgcaccctacaaaatacttgaaaattcccaatccctttgactgttattatacactatcagtcactccatacataatacaccccacctccctaaccacatttacccatttcaacaatattcttagtaccttttccctaaaacttggaattcgccccctaacaataacactgctaataacaaattgcatacctaataacccccacaacctttaatacccttaattccatctacctttctattttttaaaatcacataacaaaccttcttaatatacccatataaaatttaacttatacaaaaaaaacccctccaacaactcaatctttctaaaaaagccgtaaaccccaaaaattatcaaaattggctcttattcncctaaataccataaaccttacctctcttacctccctcatccttatacccaccaccttaccactttactcctacaaatttacttcttttctccccctcctcacctctttcaaaat

SEQ ID NO: 513461 - DNA, 405 bp, Homo sapiens
  misc_feature (64)..(64): n is a, c, g, or t
agcagtcaagtagtgaatggataccatatttattatggttgatgaaaaaaggcagagcttatcnttaattttttttagggaagagaaggaataaaataaaagtggttcaagctgggcatggtggctcacacctgtaattgcagcactttgggaggctgaggcaggcagatcacttgaggtcaggagttcaagaccagcttggccaacagggtgaaaccccatctctactaaaaatacaaaaattacccaggcgtgatggtgggcgcctgtaatcccagctacacaggaagctgaggcaggaaaattgcttgaaccggggaggcggagattgcagtgagccaagattgtgccacttcattccagcctgggcgacagagcgaaactctgtcaaaggaaaggaaagaa

SEQ ID NO: 513462 - DNA, 126 bp, Homo sapiens
tgctttaagaagaaagaaaaagaaagtgttctggagttgtttctattaaaagggaaagccttactgaggctccttaccctctctatctgccgtatataatttctgaataactcctctattaaaagt

SEQ ID NO: 513463 - DNA, 552 bp, Homo sapiens
gctgtcgaggaggtcgcaatagtcgccggcgcgaacatggcgggctgaaatccactccaggccgcagagcagacgtccggctgctgcttgagcaatgcatcgaggtggcaccaggacggccgtcacggactgcgctgctcatccccacaaggaggacggcgtgatcagctgtcagcgaggtacagaaaccatccggcgtactggctgaacaagagacagatggatcaagtactggtcccagcattttagccacacaaatggcctctccttggctctgcgtagtggcgttaccaatcatgacagcagacggatatttgtgggccaggataatggagctgtaatgggaagtttcagcgtttctgaagacttttagataaaatcgacctttatcaagacctacccagctcatcagaaccggttgtctgcgattatcttcagggttggcacagagtgcggtgactcacgtaccgtgccacgagcaacgtgtagtgagctcggatgtgcacgcggaagcgggaacatgctcgggaggcaacttcttcacgttctggg

SEQ ID NO: 513464 - DNA, 499 bp, Homo sapiens
  misc_feature (263)..(263): n is a, c, g, or t
gcagccctgttctgttgagaatctctcctacccgcattcaagtgctctctctaaagacctcgtcaccccgcctgctcctgcggagtgacttgccgcagcgagggccgtgaagacaggtgcgcccagcctcgcagtctggcctggctccggggaactcggcgcctccctcgtcaccgtcggtggcggtaaaactggcctctacgcttctgcttcaatctccaatttggcattcaaagcacacctttttgtggctttttggccanggttttgggcgcgaagatgataacagctaagccaggaaaacaccgattcaggtgaaggtacaagtaagaagctggcgaaacatagagctgcagaggctgccataaacattgtgaaagccaatgcaagtattatggtggaagcttaaattgtcttgtgctaatttcaagccagctcaaaaatatcatggtgagcttgcagttctgacccttaatgcctgaccttccaagcaacaaag

SEQ ID NO: 513465 - DNA, 981 bp, Homo sapiens
  misc_feature (304)..(304): n is a, c, g, or t
  misc_feature (643)..(643): n is a, c, g, or t
  misc_feature (672)..(673): n is a, c, g, or t
actaggtcttcaatcaccaccataagcacatagggtcagccattatggcacggggtcaccctagaatcaaccgagcatatgccagcacatggtgaagattatcacaagaatttacaataagaaagtctctgtcgcaaagagtatgtatacaaagtcacatatacctctagtaaaatatgccccatccaggatctcacgaagatatgcgtcgttccttacggaagtcattgtattgcttcgacacgactatggtcccagaccaaggtcattgcaactattttgcacatatacataacaatgaggnttcattgccatacttctacactggaactagttagtacatacgcagaaaacccatcgcacaatcattttaatcgtatggcttgaccaagaggcacattcccgtgcgactacgaatgtgacgtaaactatataacttggagattctttgtccaagtagaacggtttattggccattcacgagcctgctcttgaacatataattaaaagtccacgccaagacgtgttataacccccaaacgaggaaacgccatgcttggcacagtttcgaagccgctggataacgtaacttccaggctagaacaaaaagtggaatgaatggcaccatttcattaagcgtaantaatatttctaaagaactatcgtgcacanntacctctccacaagattatagcgtcttaatgacatccaactcttccatcttatctcattgcatcttcatttccataagacactgagccagatattaagggtgagactccaaaaaaaatagacaccacttgacgtattgtcggtggcatacatctatggatgacaactcctcacttgtaactttgggctttcccatgaatttcttcacaaattctttaacttgtccaattagaatacttattggactttcaatacccactattattttcttactttgactgggatgccaaatctggaacatgggttgat

SEQ ID NO: 513466 - DNA, 144 bp, Homo sapiens
tcccccaagagcccaaacggggccagagttgaggttggacgaacacactagggccagagctggtggaaccttgtaggctatgcaagaacctggggggtattctaggagcagcaggcattcattaaagcatgttccaccaagcac

SEQ ID NO: 513467 - DNA, 461 bp, Homo sapiens
  misc_feature (3)..(3): n is a, c, g, or t
  misc_feature (92)..(92): n is a, c, g, or t
  misc_feature (191)..(191): n is a, c, g, or t
  misc_feature (203)..(203): n is a, c, g, or t
ganaccctgccggccaccgcgtcgggccccgacgatgttctcttccacgccaccacatcctgagttctgagaacgggcaaaagcccggaaanatcttggcaattgtgaaatataaaattcactgtatcttagatacagctaaataagtccccgcagttcaagagtcagtgtaaagaaggccttggctgggncacagtggctcntgcctgtaatcccagccacgggaggctgaaggcgggtggatcatgaggtcaggagaccgagccctcctggctaacacgctgaaaccccgtctctactaaaagtacaaaaattcagccaggcatggtaacacatgcctgtaatcccagctactcaagaggctgaggcaggagaactgcttgaacccaggaggtggaagttgcagtgagctgagatcgcaccactgcactccagcctaggcgacagagtgagactccgct

SEQ ID NO: 513468 - DNA, 1093 bp, Homo sapiens
ggagagaactagtctcgaggtttttgagggatatgtttcccgactctgatcttattaattggttcctcaaaaaatcttatttctgactggattcaaacttaatcgtaaaaccctcgcagaagaggaaagctcgtgcgttcttctctcgcaatttggtcccgtggcgcttcctcctttagccctcctttacattcctcttgggcccaaaagtttatagcattattcgtgcgagccctcttctcttatattttatcttgggatacgcgtgcattctctcagagcaatacgcccgccgttgtggttgcctgcgaggacacgtgtggcagttaacagagacgccgtaaactctgtggggtgccttgggtcccataggtttctcttacccttcttattattacagagggcctttcttacaacatacgtggggcggacatctcattcttctctttataacacagaagatttgacaaaacgtttgtgcgggaatctcgtgcatacgcctcatatgtgggggcgccccatggcgtgcaaaagcgcactcgtgatagtatactcacgctcagctcccaaggaatatatctccttttcctctctcccttttttttaagcaataataaccccacaggtttagaaagaaaccggctctcaagatttgtgcaatctccaccaaagtgtgtcaaccacacgcagacaccagtgaattattctcctctagttctctttgtctctctccaagagattctctcctgtgtggggctctgtgtacaccagcgagaatgtgccccctttaacttcagaggataatagaccacgtgcggcagaacaccgtggccccaatggggggctcaaagagaacaaccccctttgatctttacattggtggagaaaacaccctgttgcttggggttcggattccccccaacccacggtgaattctcggggcacccaacaatataaccccttttccaattctcatttcacccccaagaaaggtgttcacgaaagaacacacttttcgtgttggcgcccaaatagggcctttcttaaagtaaaaacatgtaccaaaaagtatgggggttacaatgggtcccat

SEQ ID NO: 513469 - DNA, 192 bp, Homo sapiens
tagaggatctttggggggaagttgaacacggtggtagtggattgtgctcgtgtcgagcacagccatggggggctcccagcctctgccgaacagtgcggagccaagcacctgggactcaaactgcagcagttggcccatgaagctgacagttgggagagatgatgcttcgcctctgcttcacaaacttaaaga

SEQ ID NO: 513470 - DNA, 238 bp, Homo sapiens
gttcggaggacgatgatgtgaaggtgaaaagccgagtttggttgtcagtttgcggggattcctggtgctggattctagaggtcttggtgctgtgtagaccatcattttgtggcatgttcctttacctttctatgtgtgggtttcctcatcactaaaggggaaaaactaatcataatcatgatagctatgggggtggggatacgcccagggtttgacaaatagggactcaaacatacat

SEQ ID NO: 513471 - DNA, 156 bp, Homo sapiens
gatcccccttctgcgaggcagtctctattcctgagcatctttcctcccggcctacttatggctggctcactcccattattcaaagcttaattaaaaatgccccctctcttgctacctaagcctgtgcctctccctaaagagactgcctcgccaaat

SEQ ID NO: 513472 - DNA, 805 bp, Homo sapiens
tgatccagaggcgtcacaagggcaaacgaaaagggccgtggcgagatgcgagacagaaggttggcgtcgcccccccggtcgaggggagaaaccggggagggtgtgcccccgccaattgcgttggagatactgtgggtggaaccaccgccccacacgtggtggataaggcgagcccgcggcgcaaacacccacacggtctgggtggtggagctgttctcccgaagcgatagcgcccgccctgcgggcgccgacaatccgcggtcgggagcaactaagttcgaacacaacacacacatgccgctgcgggggttcctaccagagagcagaggggtgtcacacaacgaagagtccttccagtgggtgtccctcataggatccaccacaagttatcgtgccccgaagaaatcctctgagcggggatacagaaggattgttttctccctcatgtcggcgcggcccgcccccccctcctggtaaccagctgcggggcaaacacggtctctctgaaaactcatggttgtttcgaacaatgggcgacataaatggtagaagatcatgtaagacaacgggctttagtacaaagtagcaaacgagtttgggtgatacctcccgcaagtggcaagagcgatacaaattcttgtcgtggccccacatcctgtcgttttttaatctgggagcgggccacgatttgaatgcaattgatattcgaagcaaccccgagcagtttggctgcaagcacggtcgtcaccacaactgagccccaaggttcggaccccccttaaaagaggaaaagggcccacaaaca

SEQ ID NO: 513473 - DNA, 213 bp, Homo sapiens
gggaaatctccatactgttttccacaggggtagaactaatttacattctcaccaacaaggtataagtgttcccttttctccatatccttggcaagtttctgttaattttgggctttttaataatacccattctgactggtgtgagatggtacctcattgtggttttaatttgcagtaagtaagggtttttttcacttggccaaatcctgatag

SEQ ID NO: 513474 - DNA, 735 bp, Homo sapiens
ggacacccacccaaccaagcctgctccccgaacccacgcctgtctctgcagtggggggcttggttctgggagccttacccacaaatgcagcagcacgaaacaccgcatcatctctcccaaagtggagccccgagctttaaccctgacctctatcccccacctcaccccacaatgctcctccatgatagcctccggatcccagggctccccatcattcttcctcttcttcctcctcatcaggtcattgcagagcccctaggaagctcagaccctatgaccactcccgactctctcgaggcgaggtcctacaaacgaggagggccactgctatcctgcactcctgcacaggacctggagcagcagggcatggcggctttgacagcccaccaagcacatgaggctccacaggcctgatacttaggccatccatgaggttaaggcagtggttggcaaagccactgaggcctacgagaacccaggcaagcttcctcaccagggcctagccttaagacacctgatcagtaatcacttcaaggaagcccccagagggagccagaacagtacggacgggggggcaagcggaagtactgcccagactgtccccacgaagacagacggcagctcataacacctgttttggcctagaaggccgctgctagccctggaggccccggcatctgctcatgggtaccaccacaggcagaaaacgcggacacgaggaacaaattctcaacg

SEQ ID NO: 513475 - DNA, 120 bp, Homo sapiens
  misc_feature (35)..(35): n is a, c, g, or t
gtcgttctagaggatccctcactaattcattccantaaatattcatggaactttattaggtgtcagccccagtgctaggcctaggagattatgtgctagggagtgacatagatcaaatta

SEQ ID NO: 513476 - DNA, 542 bp, Homo sapiens
  misc_feature (36)..(36): n is a, c, g, or t
  misc_feature (76)..(76): n is a, c, g, or t
  misc_feature (104)..(104): n is a, c, g, or t
  misc_feature (158)..(158): n is a, c, g, or t
  misc_feature (184)..(184): n is a, c, g, or t
aaagggaaccccgtcaatgggaaaacccaacggggnacaaagcctggctactacggctggaagctccaataaaacncggaaacccccccgtcttaccttgtgcnccatggttttggatttggaatttggggtttgaaaaatttgtaaaaattaaatcnatttctcctttgttgtggaggaaaanaacttgtgttttcccccgtgacttgcccagggcgtaaagggtgggcatcttcgggtgcccacgtggggcagcacaaacctccacacaccctctcccactctcgacacgcacggggctggctgggccgtgatttggaaaggaactggtgggagccgggtggattgtttaatcttcggagctggagacctgtttctgtgttgggatgagcgatgccctcttgccccaacccactcgtccagaccagccctgtccacacaggcccccggcccccaacccccagccccactgtgccagcagactcgacaggtttttatacaaggttgttgagttttaaaatgtattaaaatattcttcgagg

SEQ ID NO: 513477 - DNA, 1077 bp, Homo sapiens
gttgggcctgtgactgtgtgatcctgtgaggcttctgagcctggagcagtgcagctgcctggaggccatgaggcctgttcgcccgcctcatgtggccgttctggcctgcctgctcccctcccctgcgcctgttccctggcagtggccagagagtgccgccgcctcctgcccggtggttctcgtggcgaagggaagcctgcgaagcaggtcctggggaagagctcgcctgctcctgagggaagcagcgataagatggcaggctttgaaaggggagcctggaggccgagttcactctgtacgtcgggacgccgcctttctaaccgccgccgtcggctcggcaccactctgggacctgctgcccacacttgactgcggggtccaggatcagcgggattgctggccgtgcgcgccttggtttcttgtaaaagagcaggaaggagcgccgagaattgcaggttccgcggcagaaaccctctgtagagggagcagggatgcaaccgaacaggcttgtggccggacagcttgctgacccagcacattgcaagccttgcaacgcacaacggatttggggcaaagaaggcccccatactcccggtgaataaatattggagtcttggctcttgttgcccaaggcttggagttaccaatcgactgttgtcacctcagaggcatcagcttgcaaggctatcgcctactacaccaggtgataccacaggtagagtcgtccatgcctcgaagacgctcttggatgtatggttgggggattcacatggaatttcgccagtaaagacttgattcgtgttaccaattaaaccaaacaaagtgtcttccatggcaagtaagagaatcgctcagcaaaatagccagtcgaaacgagctttaactgactcacatttacgatttggcggtccacaagatttttgagacacacgagcttacggggggcaagaacagattcgtagccagaaaggggactaattgagatacgttgccccattgaaagacaccaaccacttgataaaaccccactcggatgatccaagcgaatacattgcctctatttcacgacagatcaac

SEQ ID NO: 513478 - DNA, 225 bp, Homo sapiens
  misc_feature (84)..(84): n is a, c, g, or t
  misc_feature (133)..(133): n is a, c, g, or t
caaacaggtgcggcggtctcttcaggacatcagaagcagtgaagatgacgtgggtaaacccagagccatgaaagctggcatggncctggagaaaaagtgaaccaggccttttgatcttcatgccctgggttcntgccgcacggacccccatctctgtgacttcctggagactcacttcctagatgaggaagtgaagcttatcaagaagatgggtgcattggagga

SEQ ID NO: 513479 - DNA, 112 bp, Homo sapiens
gccttaggctccccagtagagctgggactacaggtatgcgccaccacacctggctaattttattaattttaatttttgtaagagatgggggggcaggtctacactactgtag

SEQ ID NO: 513480 - DNA, 274 bp, Homo sapiens
  misc_feature (25)..(25): n is a, c, g, or t
  misc_feature (33)..(33): n is a, c, g, or t
  misc_feature (50)..(50): n is a, c, g, or t
  misc_feature (64)..(64): n is a, c, g, or t
  misc_feature (121)..(121): n is a, c, g, or t
  misc_feature (123)..(123): n is a, c, g, or t
  misc_feature (132)..(132): n is a, c, g, or t
  misc_feature (171)..(171): n is a, c, g, or t
  misc_feature (179)..(179): n is a, c, g, or t
  misc_feature (213)..(213): n is a, c, g, or t
  misc_feature (229)..(229): n is a, c, g, or t
  misc_feature (255)..(255): n is a, c, g, or t
gtccccacctgctccgaagacaaanccaacctnccgtttcttttataaancagtcggctttttncttaataagccctcactgtacagaacagcccgttgatggtttatttggggtcccctntnccccccagnccctttttttctgttcggtttagcacaaatacttccctncctccggnacctcccaaacctaccccacagtcagtgtacttnttttatatatatttantcttattcaatggaaccatgcttttntcgttttatacttttctag

SEQ ID NO: 513481 - DNA, 401 bp, Homo sapiens
tcagttcgcggggggcgtggacggtgcacctatatcctggtgatggtggatccagatgcccctacgcagagcatacacccagactgagattctgtgcgacattggcttgtacccgatatcaagggcgccgaactgaatggtcagggaagattcagggcccggagttatcagcctaccaggctccctccccaccggcacacagtggcttccatcgctaccagttcgtttgtctatcttcaggaaggataagtcatctctctccttcccaaggagaacataactcgaggctcttggaaaatggacagatttctgaaccgtttccaactatggcgaacctgaagcaagtcacccagttcatgatccagaactcagcaggactcaccaacattccaggctcccag

SEQ ID NO: 513482 - DNA, 372 bp, Homo sapiens
gcactatttttattattatattattattattattattattattattattattattatttgagacagagtgtcagtctattgaccagactagagtgcagtggtgagatcatggctcacagcagccttgaccccttgggctcaagcgatcctcccgtcccggtctcccgagtagctaggactacaggtacaacaccattgtgtccagctaattttttaaatttcttgtagagacagggtatcaccctgttgcccagattggtcttgaactcctgagctcaagcattctgcccacctcagcctctcaaagtgctgggattataggcatgaaccactatgccctccctactttactttttcatttcacacgttgag

SEQ ID NO: 513483 - DNA, 207 bp, Homo sapiens
ctaattggttcttcgatgacgtctcctgagctgttccagggttgctggagggtgaggccctgctggccacgtgctccaggaatgtgtcttttctctgaccctgctgcctctggggaagctgtccctcttccccgggatagcggacgactgatgtgatgcacgcggtgcccctcactgggacgggcccgtcatcgaagaaccaattag

SEQ ID NO: 513484 - DNA, 304 bp, Homo sapiens
tatctccgccatatcctgtctgcgtggagtagatgcgtcaactaggctaaaaatgacgcaagactccctgcgtcatggatgtcaaggtctttcaatgcaccttcggtttacatcgtcgtttcacaagaagatcggccttcaacagggggtttaatcacctacaagcttttaacagctacaaccttgtaagtctgtgttaagatcaccttcatttttacatctacaaagcattgcccttctataggatattaaattcggggctctcgtagtgatgaaacaattgtagatatcagaagcagtgcag

SEQ ID NO: 513485 - DNA, 603 bp, Homo sapiens
agcggagtgtctcgagcgctcgccgacgtgctgccgcggcggccgcgcagagactgctgagcccgtgccgtccgccgcgcaccacccactccggacacagaagcatccagtcatggatgaccaatgagctggttcagataggccaatactgggcgagcaggctgaacgatatgatgacatggcagcctgcatgacgtctgtaactgagcaaggagctgacattctccaatgaggagaggaatcttctctcagttgcttatcaccaatgtgtaggagcccgtaggtcatcttggagggtcgtctcaagtattgaacaaaagacggaaggtgctgagaaaaaacagcagatggatcgagaatacagagagaaaatcgagacggagctagagatatctgcaatgatgtactgtctctctttggacaaagtccttgatccccaactgcttcacacagccagagagcaaagtcttctatttgcacactgaacaggagattacgtaccgtaacttggctgcaggttgccgctggtgatgaccagaacgggattgtcgatcagtcacaacaagcataccaagaagctttagaaatcagcaacaaaggaca

SEQ ID NO: 513486 - DNA, 1180 bp, Homo sapiens
tagatcgcgagcggcgcccttttttatttttttttcttctgaaaaactattctgttaaagtagtgtcacattcatttagtgctacaggatgtgagcagggatgtgggaaaacacaatgtggaaggctcactcccgtgtcggttgtgggaaaacttcggggcatgtgccagtccttcacccaggcaacgagcctcgtgttaccaggcttcaggcacagccttgcctttcatcgtgggactctcgatatatatagtaggttatattatgtggttatatatttttattcatcacctttatgggggcattaggaactaaagagaaaagagaaaataaaaaacaaaaaaaaaagaaaaaacaacatacgaaacgagagagagagacagcaaacagaccacggacaacagcgcgccaacacacagcacgacacccaaggacgacacacacacgacgagacgacagagcgaacaagaacagcacaacgggaacacagagcgccaagagcgccaccacagaacaagacagaaggacacaagcgacacagaagccgcaaacagagcacaccagcagcccaacaaccataagaagagagcgagcaacaaaaaggagacgcacaacgaagcaaaaggcaagacagagcaacaaagaaacagcgcgcagggaggagagccaccagtagaaaaggcaccagcccagccacgcaacaaagaagacccacacagacaacacacagacaagggcgccaagcgcgacgcaaccacggcgggcacagagggcccggcgcgaggagagagcaggcccgcgacggagcgacaccaagaagacagacaagcaaggaaagaaagaacagaaacgaaaccacacacacagaagcagagaacccaagcacaacgacggggcacggcaccacgcacacacggcacaacgaaagaacaacacggaaaaaacaaaccgagcacaggacaaggaaaacaggagaaagcacgcggagcgacggacacgagagacggcgggacggcggggagagacgaggacggaggacaacagaacgacgaggaagagagaaggagaacacaaggctagaagcaacagaaagcgcagcagcaaaggagggaagggcggaagcacgaacgcagagaacgacagagaccaacacagacacgagacagggagcgacaagaac

SEQ ID NO: 513487 - DNA, 1042 bp, Homo sapiens
gctatctcttctccctgcccattgagggaatcagagatcattgatttcttcctgggggcctctctcaaggatgaggatttatgaagattagtgccagctgcagaagcagacccgtgccggaccagacgaccaccgaagttcaaggacatttgcttgctatcaggaggtactacaatggccacgtaaggtctgggcgtgatttaaggtgctccaagggaggtggacctaccagctccgatccgtgtggtgctcatcaatccatggaccaaagctctctcatcgtccccgtgtcgcagaggctgactggtgggagaacaatgactcgagtagagtccccacagctgtcaccttgcagaaggtagacaagagcctgcgtagacagagttctggttgcattgggtaacgcactgcaattcccatggcaccacaagggggtcaactgggcaattcggttcttcccgccacccatgttgccttgaagggaaagctagctcgaatgatcggcgtgggcttatacagatggactagcataacaactctactagaccgctgggggcattgcatacttgagcaccctgggagacagacatttcgctcaatggtcccactctattgagactggcccggtatatcgtcaacgaacccttaacaaggcattaacccttagaacacgcacacggaatccctcattggggaaagggggatggaaccttgggtatttgccgacccaaaaggttcattcccccttatttccaaggggaaaggtttatcaaacctttgagagcacaacccctattcggcgtccaaaagtgtgaacccccaaagaaatcacctagaaaaggggtctctccgccgggttggtcccacgggtcggggggaaacccatccgaaggcgcccttcccccaaggacgattgagttgcggatctttaaccaagaaccaacttaaggggggtatttctcgtctaaattatccgaaagggtataaaacaaaagttgtgacacaagctcttgcgaaactttgtatcatgggccggcttggg

SEQ ID NO: 513488 - DNA, 186 bp, Homo sapiens
tcgcgaacgtgttatccccatgttgcccaggctggtcttggaattcctggactcaagcaatctgtcagacttggcctcccaaagtgcggggattataggcgtgagccaccacccccggccacctttgtcttagtgaatgctattaagtcgttaggttagtgatgtagtcatacaacttttttgttg

SEQ ID NO: 513489 - DNA, 127 bp, Homo sapiens
ccaggagtttgagaccagcctgccagacatggcaagaccctgtctctatggaaaacaaaacaaaacaagattagctgagcatggtgctgtgcgcctatagtccctgctactcaggaggctgaggtgg

SEQ ID NO: 513490 - DNA, 660 bp, Homo sapiens
tggaaacacagttctcgcttcgtgttcacccaggctagagttgcgtgtggccccattctcggctcactgtgcaacctgtggtgccttcgggggtccaagcgattctcccaccttcagttcacccaagttagctagaatttacaggtgcattgccaccacaccacttaagtgttttgggggtttaagtagagcacgggttttccacccggtgtttttgcaccagaccgggtctgtgacttttcaagcttcttttgagcctcaggggtgactcgtgacctcacccttccgccttctccaagagtttgtcgtgcgagaagtctacagggttgttggggccgcatgtgtctgctctgggccttggacacagtggtacgtgctcatcttataagagggacagtgtgtctccccacgaggttttatttcccgaaggttccaccgtggtgtcttccgtgggttgaagtggcgatctagcaggcgaggaattttacgaggcaacatagtttctttcaagaaggaaatttttccccaactaccattcatatgtgcacagtggttgtgcgtaggatacacccattacagcgccttggcgacgcctccaaaggcaagggacaacatttaatcttcttaaaaagggcgtttttggacggggggaaaactcgc

SEQ ID NO: 513491 - DNA, 709 bp, Homo sapiens
  misc_feature (7)..(7): n is a, c, g, or t
cattatnggccggttcgatgacgcagacctgattttagcgcggtccgcgttacgaagtgtatgacggccagcaagacggaccgcttgctcaaggccaagaggacccagatactcaaggctcatcaagctcaagtccatgccgatgaacgaaccaatgtgcattggtatcatcgaagtaacctccgtaaaggatgacgcgctgatgattatgccagagcaggagcagacccgcatcgacgagtggacaaggttccagtcatatgatgctatcagtcacaacaatctttcccgttattgcaggtacgggccacatggagctggacgtccgcatctctcaggacatgaccctggccaagagctacaaagatcatgtgcgcaaagaatactgagtctccagatcgacacgccccaacaagcacatgaacgcgacgggctacttccgatctaagctgtgacgcccaatcattcacaaatcgaaatagaaatgctcaccaactgggaccaaatgctatcggaccgttctactgagagcctcaaccgagcctgcatcgacagctcaacctggcacattcggcacactcccctcgaacattgctcctacattaacacgcctcgagctcttcaccacccgctctgacaacttgcactttaccactcaaccaacaccgctcaagtgccaatcgcgtcttcgccagaagactcacttccc

SEQ ID NO: 513492 - DNA, 255 bp, Homo sapiens
gagggttcagctgtctcttacttttaaccagtgaaattgaactgaccgtgaagaggcgggcataacacagcaggacgagagaacctatgcgctttaattattatacaacgtaactaacaaaccacaggtactaactaacaaactgcattaaaattcggttgggacgactcggagcagaaccaactacgagcagtacatacttagacttcacagtcaggcgactactatactcattgtaccatacttgacacggac

SEQ ID NO: 513493 - DNA, 125 bp, Homo sapiens
ctgaaagcttacttttaaatccactgttaggaatgggcactgtaaaagctatcagctatcaacgtgaacccttacatggtttcctttgatcacatgacatcattatgatttccttatcgcttgcg

SEQ ID NO: 513494 - DNA, 417 bp, Homo sapiens
gtagctcctgcctaagagaatttccagcttagtagaagagacaagcaaaataataaacatacatatgatatgtgctattatatatgtatgaatagggaaatgttggaaaagagaggagccatatataacaaagcctgggcaaggcaggagggttataatgattttcagatatttttgcaaaaagttgtaaggttaagaaaatttctttaggtcatatatacataaggggggtagactattttgggtttgatgtgtctttatgtatctataaaactataaggagctaaagtttagaatcaaatctatttgactggatgaatgttatacgtaaactttgttaatatattttctgaagcattgtagtttttttctatatgcgtgtttgagtgctaataaactcatatcatcctgtaaaaa

SEQ ID NO: 513495 - DNA, 365 bp, Homo sapiens
gggtaatactactgctccatgccaaaccaagcctgctggatactcaccatgtccattatccgcttacaggtgtgcctcaggtgctctctgcagaccttcgattgtacttgaaaacttcacataacaccagcttgttagggtccttacggaaggtgtcccgaaacatggcagcaggcacgagatacatgtcactgttggaaccctcagactgtaaagtactggagccatcaaaattccactcaggcaactcttccacacacttgggctcattgttcaggcctcccttgggatcataggcacccatgtcgcactggtgccgcttgcttagtttctcaatggcctcctcgatgtacttcagaccaccc

SEQ ID NO: 513496 - DNA, 405 bp, Homo sapiens
  misc_feature (127)..(127): n is a, c, g, or t
gtctagagatcgagtgtcatcccccttcgtggacattgatggtaccttctcggaaggcagagtcaattgtaccaccacagatcctggctgaacttaatattggagaggcccagaaaacccccttgtntataaatctgcaaaaattggctggacatggtggcgggcgcctgtaatcccagctgcttgggaggctgaggcaggagaattgcttgaacccggggggcggaggttgcagtgagctgagactgtgacattgcactccagcctgggcaacaagagcaaaactttgtctccaaaaaaaaaaaggactcatttcctaagggtcatgggcttagagcagggttggtgtacttggggaaaatccgggtaattttggacctgaccttacacaaagggggatggaca

SEQ ID NO: 513497 - DNA, 411 bp, Homo sapiens
cccacctggtgccgctatcgccgtttgtctggtgactccggtcttgagctctgcccttgtcctgcctccggtgagggtgagccagtcaaggaggtgggggttagtccccccttgtcagatctggaggggtgctcgccgtgtgcactgccccaggagtctgtaccgcagatctttcccgtggggctgtcttgcagtggaggggacctcccataagtagttttgagagggtggatgggcctctggcccaccagagcacgccctagtcccgactccttgcgttccggtggcccctcctccctccctagaatctgcctgaaagggctggagaggggcagtattgggggactgtgctagctttacccccgcaggacatacacaggagcctttgatttcattaaaaagatgtgaacc

SEQ ID NO: 513498 - DNA, 108 bp, Homo sapiens
ctgtatttttaatttcgaatgtttgtgctttttaaatgagccaagactacgaggggaaactatcacctacaatcagtttggaaaacaagacctacaaagggaagggga

SEQ ID NO: 513499 - DNA, 961 bp, Homo sapiens
acgaagtgctgctaatgtatcagagagtcacgcatggaagtcagacagtgacgaagccccctgatcctcctacaagtgcctggaaatgtccaagagagattgccgacccaggcagactgtgcatgggtctggatcccagggcaacaagacaaagatgaagagagcgaggttggtgcctaacctgaatatgtcttgcataactggtgttcctagccataccatatgaatatgctggtgaacgacagggacatcatgtcagggggccatgtggtccttagatccgtgatgcggtggcacgaagagtcagaccagtacgcagccgtttagactgcagaacatgcaaagacagtctgtgcccatgtggacatcgtgacaaggccagccctcggagtgcccatggaccaagctccaggaatgtgacctatggggcagatggagggccaaggacatcgacgtggactagagagcatgggcaacagcagtgatggcgatgccctccacctctttcctccagatggagtgggacttctctggctctgccctaggttggaaagagttgcattggaccctacttgccttcccgggcaaggataggacctttcaagcaaagtgccatgtttctctaaaattgtggaatcctaatgaagttgttgtctaggagatggcagttcgttcctagctcagagatgagtgaagtgaagtatggtgtgcacacaccgtgttgccatgttcctgtgcgctgatgattactgcccaacgcaatttcctgaacaaatgaacactcttctcaattacaaaagacggcactttactttggcatttgccatctggaaaacctatcctggggtttgagtatggaccgggggtgcctggttggttatgtccccctcttggttgcgtgctataaaccacctaccaaaagggctaccgcggactacaggaccaaaggaagcacaagaca

SEQ ID NO: 513500 - DNA, 300 bp, Homo sapiens
ccgcagtctggggcttggtcaccctagtgaacccacatgtaaatcctactccttgaagatccacaagtacagtagtgctgatatatacaccagatattagtctataacttgatgagactgtggatattaatatttcactcttttctcaggtcctcctctcaccaccccttgaactacatatgaatgatgctgggagaaaacacattgccattgcttggaagcctccagagaaaaatggtggaagtcctatcataggatcaccatgttgaaatgtgttcagtacgcactgtgaaatggatt

SEQ ID NO: 513501 - DNA, 913 bp, Homo sapiens
  misc_feature (605)..(605): n is a, c, g, or t
  misc_feature (662)..(662): n is a, c, g, or t
ggagagaactagtctcgagttttttttttatatttttggcgggtaaatcgggttattttttcaaaacaaaactaaaaatcgccactcaaggtttctgagcagagggcctgatcacggttaaaaggctttctggtgaatggcgcagcaggaacgtcatacgccgggtgggtcaagaaatggagtggcttctgggcgctgctgggactggtgggcccagaagccgggagcaccccttcttctcctccctctggctcatattggtgcttggtggctggccatccaggtcagcaggggaacagccaggcccaatggctgcgctcagggtctggtgggcatccaagagataacagggggtctcccggtccccgacaggtttctggctttggcccacctgggtgggggtacgcgcctgggccaccgaagaacggggaaggggagccaacttgccaggggcccggagctggggttggtgcgcaaaatctttatggggaccccggggagacccttgcgagaaaatctcgtttcgaccaagagcctgaagtctgatcggcgagtatggggctccggaacaaaggtgaggtcgggagggtcaaatttacccgggncaagatccgcaaggccgcccgggaactggctgacgcttgatgagagggacccacggngtcggtcagaaggcaaggccctgatgcaggcggtgggtccgcatgggggtgctggatgagggcacagatgacgcgggataacatcctgggcctgaaggatagagggattacttagagagaacagctggagaccccagggtcttcaaggcggggctgggcaaggtccatcacacaagcaccgcgtgctagatcccgacagggccatataaggggccgaaagcaggtggtgacacatccgggctacaatggcc

SEQ ID NO: 513502 - DNA, 198 bp, Homo sapiens
cctcgagaccaagaggtcgtcacgagggttggggcggccacaaatgtgtgattggttcggaaattgtgatgcctacagccattgaaaaatgaagcattcatgttggaacatcttccaaggatgtcagtttagaaaatagcatcccacatctgggtatctgagtggctatgaagatgcaaataaaataatctgttgtca

SEQ ID NO: 513503 - DNA, 846 bp, Homo sapiens
  misc_feature (129)..(129): n is a, c, g, or t
  misc_feature (580)..(580): n is a, c, g, or t
tgcaggggaaaataactttttttgaaaccccaccaatggcaaaatctgtcccggggctttaagcctcctttcttccttgtggccaatccgggctcttcttttcagggggctccccagtgaaggtgcttntccttctcctcctctccgtgttgctcgtggacatcgggccttgtggcgcaaagacttggtgggggtgggtgctcaagtgacctttagggcgtcaatcttctcgcagagcccgccgctcgacgtgcaccgagcagaggcactgtgcgggaaggggtggagcccaccgcggcttttgtggtggtctcccccgccaaacaacagccctttctcgagcttgtgcacaaaagctcctgtgggctcacttctccacctgttgatgtggcacagacagccccacgccgaagagggttgtgagtgctgtcgtggtctcgagaatgaggtctctatagctcgaggggtggaggccatttgtgtctcttgtgaactcgagcctgtagccggcgccccttgtaatatagaggggtagcccgcgtgggcgcatactcttatatgtaactctctttctcgtggnggtggacactctctcgagagtgggcggggaaagtggttcacgccttgtctctgtggccgcgagcgcggctgtgtgccccatcggagagagatcagggcggctcttaaccagccgagagcacgagggtttagtggccctatgtggcctcctcaatactatagacggagggggcccccacccgtttgttggcgccagagtgcacgcatcgtcgggggggaggcactcctgtggggcagggggggcccaagacaatcccctcttggggg

SEQ ID NO: 513504 - DNA, 667 bp, Homo sapiens
agggggatgtgtgtgtgcgtgtgtgtcagtctgctttgtgagtgtgttaaaggctacagaccacagttggtttaaaatgcttggaacttcccaaactggctttactttatgtttatacagtgctcagggattaacgcagctacatccatgccattgctgtgggaggtatccccggatgcatgtgttcttgagtctactaaactatagaaaatactatattggtttcatttattccaacttaactaggttctattaaacgcactgaaatgacaaggttgcactatcatgcattcaggttattttctaactcctcgcttctgacagtgcatgtctgccggaagcatgctgaaacaagattaacacaggagtcgagtaacagagagaaacatttgttagatgtacagccattggcttatggcatgtaatatagtgtttatacctgggtattgcattcaaaccctgcagacccctccttccccttctccctgcctgggatttactggatcaaggtaatgaatacataccattttgctagtgataaaaactcttaggacgtgaatattgagtgtattaagtagtatatcctagatgtgatgctgaaggaaagtgggctatgaggcctcattcacagttgacatagtgcaagtagagacggtagatattagag

SEQ ID NO: 513505 - DNA, 125 bp, Homo sapiens
gagctggtccgctatcaggcggcagcagctgctgcagctgtcggtttgctctaccaccttgtccttttcaatctccagaagccgctgcagttcggtaaccttgccttccagatcagcaatgcgct

SEQ ID NO: 513506 - DNA, 210 bp, Homo sapiens
tagccacgatcgacccgccgtgtaagcactacttctagctcacgccaaactcgtactccacctgccaagtcacactactccccgtatctaacaagcgtaaaaatcaaatgccagtttgaacatacaaaacccagccccattcctccccacactcatcgcccttaccaggctccacctacctatctcccttttattgctgaataactttgt

SEQ ID NO: 513507 - DNA, 250 bp, Homo sapiens
  misc_feature (18)..(18): n is a, c, g, or t
  misc_feature (24)..(24): n is a, c, g, or t
  misc_feature (49)..(49): n is a, c, g, or t
  misc_feature (74)..(74): n is a, c, g, or t
  misc_feature (105)..(105): n is a, c, g, or t
  misc_feature (110)..(110): n is a, c, g, or t
  misc_feature (121)..(121): n is a, c, g, or t
  misc_feature (132)..(133): n is a, c, g, or t
  misc_feature (136)..(136): n is a, c, g, or t
  misc_feature (150)..(150): n is a, c, g, or t
  misc_feature (175)..(175): n is a, c, g, or t
  misc_feature (189)..(189): n is a, c, g, or t
  misc_feature (207)..(207): n is a, c, g, or t
aggataagtaatataagnaatgcnaattttctcattaatttgaaggaancgttaatagaatcagtctaattgtnaaagacattacatttgaaaaatagaaatgtnaatgnttactgtaacntaatactatgnnagnttagaagctgagtnttcatatttcattataatccttaanagttaaggggattnaggttagtatttaaaaanaatgcttttctgttattttgattaaatataaaaccatactaac

SEQ ID NO: 513508 - DNA, 291 bp, Homo sapiens
  misc_feature (124)..(124): n is a, c, g, or t
ccccccgggggggggggggctttttttttgggtcccccccggcccccccccgccccctttttttttggcccccccttgggggggggggggccccccttgggggccggggggaaaagggcccccngggggggggggggccccccccccggggggggttctcggcccccccccccccccccttttaagggttttttcccccccccttttggggatttttttccgggggggttttttttttttttttttccaaaaggggggaaaaaggggccccccccaggggggtttttccca

SEQ ID NO: 513509 - DNA, 838 bp, Homo sapiens
gaagcttggcgtggttgggtgtgggtatacacgcgggttccacatgcgtatcgaaaagtgtatgtctgttcggggcccatctatcctggacacggcatgaggttcgtccgcaacgtttgccaagggtgtacagatttcgcaaaatctaaatgtcataaataactttagatcatagaagcgccaagtcctcggcaagattaggtggacccaaaacgtcgattccggaaacatgcagctggtatcagcagtcttaaccagatgtgagtaaatctcatatcgacctgttgagaaaaacgtcatgaaaatgaagggtagtcaagataccagcgagagctatggtacataaatacgtattggatgcgcatgaacgagagattgacggagagatcaaatcagaagcgccaagcgtaaatttcataattgaacagatggacagaaaaataaagagctacagaaagttcaggtatatcacagaagtcaaggcaagacatccatcttatccgagccctctgctggcaaagggaacgcagttggaaggacgatcatggtacagcagttcacaagaggcatgtggacagtgggagatcgctccgttaaagatctctgtaaccatattcattctgatgtaccgattgagaagtgcccttcggataccttggaaccgctacaactgtttggtattcctccattaggtcgacttaaattgccacgtgttcacagacatctgtgctggattgcacctactaatatcggagatcgggtgtccgcatgcgcttcagggtaaacgtcatgatcgcgtctcgtaaccagacagtccgagtgcccataacggtggggg

SEQ ID NO: 513510 - DNA, 405 bp, Homo sapiens
  misc_feature (18)..(18): n is a, c, g, or t
  misc_feature (24)..(24): n is a, c, g, or t
  misc_feature (44)..(44): n is a, c, g, or t
ttgcccaaaatggttttnatttangacctaatgtggtcctagtncctagaggattccatactggaatccatcggtttaatattaccgctatttgaaaggcagccatagtatagtacttttggaaaattggcctgagggtgatgtcttttggaatatttgtgaattcactatgaagcctaattccttaaaaatgacctccttcactcaattatcagtgttcttggtttgccctgggagtgaaaagagatcttaaaatctttttggttttagttacataattgactgatgtaatattatgtaatgatggctgtacacagtgtctcatgccctataatcctagcactcatttgagctcaggagttcaaggccagcctgggcaacatggtaaaaccctgtctgcaccaa

SEQ ID NO: 513511 - DNA, 318 bp, Homo sapiens
tcagaacaaggtcattttgcaagagctttgatgggaaatcactaggcatccaccctacagtcctggtttggcaccttctgactttttgtttcctaatcttaaaaaaatttttcagggcagtacatttttctcaagttaatgaataaagaaactgcattgttgtggtgaagaactctctggtctttctcggggatttttctgctgaagctttggctaagtttctcaaaacacccccatgataagcacgttaccattctttggccctacagaaagtcaacaagcaaaatgccttgagcattcaaaagctgttgccatgac

SEQ ID NO: 513512 - DNA, 515 bp, Homo sapiens
  misc_feature (208)..(208): n is a, c, g, or t
cagtcggcgccgcccggagccgggagcgccgctccagcgaggcgcgggctgtggggccgccgcgtgcctggccccgctcgcccgtgccggccgctcgcccgccatgcctggcttcgactacaagttcctggagaagcccaagcgacggctgctgtgcccactgtgcgggaagcccatgcgcgagcctgtgcaggtttccacctgcggncaccgtttctgcgatacctgcctgcaggagttcctcagtgaaggagtcttcaagtgccctgaggaccagcttcctctggactatgccaaagatctacccatgaccccgggaaggcgtgcgaacgatacaacggctacttttgggcgccctggccccttattcccgggcttttggcaattccacacatgtgtgccgtgaacgggtgccttggccggctttgggacggtcggtgccagcgtaacctggtcacattcataaccaagggggcccatcctttggaagttaacccttggcacggcttcaaact

SEQ ID NO: 513513 - DNA, 242 bp, Homo sapiens
tggcgctgtaatgaaccgacagctgcagctgttctctgtggctcacattaaatgctgtgcgctggtgtacgcataccaaaagtcaagcaaaaattgacccacactatatcataaactctttcaaaggagtgtaaacagatgagccccttcgtgtggagatggctctcacctgtcacttgatctgcctacatgtccgtggctcatttgtggatacttgtggatccatttcccagacaggattt

SEQ ID NO: 513514 - DNA, 138 bp, Homo sapiens
gtaccccccctccccgggtatgtatctagaataccagcttcagcatgtcttacagcaggacttcagcctcaatatctaatccaacgtttttatttccttcttgatgtactgcataaagtttagagattacttcattgg

SEQ ID NO: 513515 - DNA, 515 bp, Homo sapiens
aagtaggaccaagagaatttaatatatacgcctgtgacaaatatgggtatcatagatatattctaatttaacgtgagttaaaacttatgggctctatggacagattttggaacttcacaggaggggcaacattatagtagtaaaggaaactcttaacacctgagaacagaattaatagccttatttaaaggttaataattgatatgagtaataatgtctggaaaacaaaaatacaataataccctctggtataggctgaattgtgtctgttcaaaactcacctgttgaaatcctaaccccactacttcagaatgtgactatatttgaatggggcctttgaagaagtaattaagttaaaatgaggtcattaagttggaccgtaatccaatatcacaagtgtctttattaaagcggaaattgggacacagacatgtactaagggcagtccatgtgcagacacaggtaaagacaaccatctataagcctcagagaggcttcagaagacaccaggcctg

SEQ ID NO: 513516 - DNA, 198 bp, Homo sapiens
gcgactctagtggatctgcctgcttagatagcttggatcagaggtgcgcaccataacgccttgattgttaacatacttgagtagaatgggggtttcaccatgttggccaggctggtctcgaactcctgacctcaagtgatctgtctgcctcagcctcacaaagtgctggggtaacaggcatgagccattgcactccgg

SEQ ID NO: 513517 - DNA, 283 bp, Homo sapiens
ggtcactctagagatccccgtctgtgactacccagggtaatacctttcatttatgtgtgtatatatatttatatttatgtatatatatttatatttatgtatagattttgtgtacatattttatatatttatatacatatttatgtatatatatatttatatattatgtgtatatatatttatgaatatttatgtatattatgtatatatgtatatatatttatattcttccatctatattcacttaagtgggtagtcacagacggggatccttagatcgact

SEQ ID NO: 513518 - DNA, 247 bp, Homo sapiens
gtttcccttttttgtttttttggtttggtttggtttttaaccaaagataaagggaaaccgacttaagccagccgttagcccatgtggccaaagaagcttcttggggattaaggggccttggaaaatccttcttaaaaataaggttcttaagcccctcctcccggaaaccggtggaaaaaaaaaggtttaaggtttttaaaaaaaaccggttcctccctaaggaataaaaaattttttttacctgaaa

SEQ ID NO: 513519 - DNA, 256 bp, Homo sapiens
ggtcactctagagatccccgtctgtgactacccagggtaatacctttcatttatgtgtgtatatatatttatatttatgtatatatatttatatttatgtatagattttgtgtacatattttatatatttatatacatatttatgtatatatatatttatatattatgtgtatatatatttatgaatatttatgtatcaacgtagatctagatatgatccatgaattcgtaccttgagatactggaaccccctgca

SEQ ID NO: 513520 - DNA, 418 bp, Homo sapiens
  misc_feature (367)..(367): n is a, c, g, or t
  misc_feature (378)..(378): n is a, c, g, or t
  misc_feature (400)..(400): n is a, c, g, or t
  misc_feature (411)..(411): n is a, c, g, or t
gcaggaaatggccagctacctaggtggaagataggtcatggagttaccgtactcctacttacgtgcttaagcgcatcataaggttacaggcagggcttgagatcatcactaataaacatcaaatgcattagatttactgacccagcaagctacaaaaaatgaggaatgctatctatcagaacagattagctttagactatctcctagcccagggaaggaggagtatgtgggaaaattcaatctaactaattgttgcctggggaaattcaatgacaatgggaaagacatttatgggaaataacttgccaggattaaggaaatttaaccccacgttcccgtttcaaacgtaggaaagggtggtcttccnggttcttctcnttttggggggctgttttttccntttttccgggngggttcc

SEQ ID NO: 513521 - DNA, 185 bp, Homo sapiens
catcacttggcttcatattgcatatcttgactctgccctatgcctgtatatgtactatgcatgtaacaggcgtatatatatttatgaatatttatgtatattatgtatatatgtatatatatttatattcttccatctatattcacttaagtgggtagtcacagacggggatccttagatcgact

SEQ ID NO: 513522 - DNA, 1037 bp, Homo sapiens
ggtgtgcgggctcagtgatggggcgagcgtggtgaggaaccctggactctcagagatggagatttcaccgtgttgcctagtgctggtctggagctcttgatctcaagcgatcctccctgccttggcctcccaaagccctgggattgcaggtgtgatgccaccattgcctgggtctagagtgtgttgccttttttttttttcttttttttttgttggagagacgggatgtctcgcgttgtgagtctgcccaggcggcaagttgtgtggcggatttgggctgagggtggaaagtcctcggggtcccattgaggaagactcgcagtgtctcccggggtatcaaccgcctaattgtctccgtagcgctcgagccagcctcccgcgagagtatgagcgagtggggagcaactaagagaggagcgccgccagaaccgaaacacgggcggaccgcggggtataaaactacatgcgcaggacttgtaaacagataagattgacagaaaacagcggggggaagtgaaaagcatgtgagagtggacctaattaacgagagaggggaaccatttgtgagtcaaagagcagaccctactcggataggggaaccacaagcaacagtgtggtgagagaaacgggacaagcgcacccactacaatttggatacacaagacaatccgcagtagagggataggtgaaacaaaattataaattttattaaccccccgccaaagatcaaacatatcgatggagtggcggaggtacacccacagtagataaaaacaagccacatgaggcaagtataattagatattatcacagcccgccaataggatatcgcgccccaaaaagacaaacttactgtgcagaagtgagaaattgaacactctccaacaaagataaggcccacgttgtatcccaagaacaagagaaaccccacgtctacagtatagtaaagccccagagatatattacaccaaggtgggacgaccagtagagagaataccccaaccaaccgggatgaaagtagaaagaagatcggtgag

SEQ ID NO: 513523 - DNA, 1398 bp, Homo sapiens
gctccaccgttactactcaagacaagcttagctcaaagcatttactccatagataaagtatagtgcgcattagaacttgaaaccgtggcgctaaatatgcatataggtaccgcaagggcatacacgatagaatgaattagtagcttccagcattaaatatggcgaggagctaactctccctagtaccctttctgcactacatgatatttaacatagcatagataactttgcagagggagacgtcctaaagctagagagcacgccgcggataactcaggacgactgctaacctaagtgaaacgagcctatagagagacacatgcgcgtctatgttagccaaactttgagtgaggaacgacttgactacgggtatgacgcgtgcgagcttagaccgtactcggtagcacctgcgtcgactagcctgggttgacctaagactacgacatctttagatgcagacctttttaacacttttgccctcaggcaggaaaccgctcctaaagattcgcgccgtttgtgcttcagaatgtctcaaagcgtgcatatagggtctccaaccagtcaggggaaacaccaggcattcgctatctgggacactaacttagggcaacgaggaacacccggtttgggttagcacgtacgtaggcttacagactacccacttgattaaagcgaagtgcacaacttaagcctaaggggcgccttacaccacaggcccgagtggcctaccccaagattctacaacgtgaaaaagtccggttcacaaaaaggccttccaaagccacccaccaaccttcaacacgttcatgtgacgaaaaacttcccacgaaaacagccagttaatttacatccctagtaaaactgtacccttaccatcacacaccccaaaaattgggggacaccccaaatttcctaatatccacgacccttacttaagtaaaacccaaaatcataaaactggcatctcacggcttaattatagtggtaacaccacactttgaacaacgacacccaacgttgccatccacatacccggcacaattaaacaacccccttgtactgcttcacatgaaaactctcaaaacataccaacacttgaacaaccttggaaccaaaattgtaaaaataccatgcccccaaaatttacattcctataccaaatattccaatcgctaaccaacacagcttcaacttaactgcacccacccttacaaacatgcacactacccctcaaaacaacacgtcgccacttgccttccaatttcaccggacatccgccgctctacctcaaaactacacgtcgtacccaaacggtaatactttggcgcctaaacatcacatttcaacgcccccgcacccactaggttactaatcccatacgcatacacatacttcaac

SEQ ID NO: 513524 - DNA, 719 bp, Homo sapiens
cgagaataaattttaacacagttagtaaacatcttatatagaagtataaagtggggcctgttgatcataaatgtgtcagagttcacctataataaaatattcaacttgcccgtgagattaaggaatgttgcaataattgataaatgggctaatgtggtgtccgacttggagagtttcttgttttcattgtgctgttgatgctagttctgtaatgcaatggttccgctagcatatattgtagatagtggtgatacagtagtgcacatagtaccaggcaaaactcaagtgctatggcacagcttggtaaatctatcactgggcctcatccaccttatcagattcttgtcttcgtgtgtctgcacgggttctctttaaaaatctgtgatgtcgtactgggttgtcagatttattcgcatcactttccaagtcgaatgtgaataatgtctgaagagtaatgatttccctgagagaacttgtgatccatttgaatataattgaaggtgcatatgtctctggtgtaccatggttgttacatcaagacgggaggaaatctcacatttggacatcaaggacgtgagaccagaagatccaggtccacgacaccgggatttcacattacttgcttaaggattgtatttttaaaaaatgacttatttggctatgttgaataaagtcatggtgttgaacctctatcagggttatcttggtttgggaacgaa

SEQ ID NO: 513525 - DNA, 525 bp, Homo sapiens
aggcagtagtgatctgggtgatgcctgtttccgacttgatgcgatttgatgagatattcctaaagacgcgggtttacctgtatggctacgtgagccaccaggaggtgaaggagatcttcatgcactcgggcctcacccagaaccttctagcacacatatgggccctggccgatacgaggcaaacggggaagttaagcaaagaccaattcgcgttagctatgtatttcattcagcagaaggtcagtaaaggcatcgaccctcctcaagtcctctcgccggacatggtcccgccttcggagagaggcacgcccggcccggacagttcaggctctctcggctccggggagtttactggcgtgaaggagcttgatgacatcagtcaagagattgcccagttacaaagagagaaatattcactggaacaagacattcgagaaaaggaagaggcaatcagacagaaaaccagcgaggtgcaggaattacaaaatgacctagaccgggagacaagcagtttgcaggagctcg

SEQ ID NO: 513526 - DNA, 441 bp, Homo sapiens
ttagcggcgcccttttttttggagacggagtttgctttggtcacccaggctgagtgcaagggcacgatctcagctcatgcaacctccacctccggggttcaagcgattctcctgcctcagcctcctgagtagctgggatcacaggtgcctgccactatgtccagctaaatttttggtatttttagcagagacagggtttggccatgtgggccaggctgatttggaacttctgacatcaggtgattcgcccgtctcggcatcccaaagtgctgggattacagacgtgagccaccatgcccagctgagaatattttagaagagatgggtaaaatatgatggagctagcacacactcccccaaacccagaaaaggtttttagaccttttttctttttccagctccaatttatgacaattctaaatctgtctctcaaattgtttc

SEQ ID NO: 513527 - DNA, 351 bp, Homo sapiens
gggagtatgtacatatgtaaatgagaaatagagacgtgtcaccagatgcattcatttctctggaatgtgtattgtttttattttgcgaaacaaaacaagaacaaaaaaaaaagctgggaactccattcaccggtggaaaaactagatcctgtgggttatagcattggtgagttctcccacgtctgtctctcttcgctcatggtaattatacttcggacccttgagtgggaaagggggtttttggtcctggttttatattttaccttacattgtacatatttacgcttcagtggtacatagtccttggccacctggtggtatttttaaggggtggctaatgggaatataatg

SEQ ID NO: 513528 - DNA, 425 bp, Homo sapiens
ccgtgataaggggcacagaccgcaaagcgacacggccgatgaacaccgaacaacagcagacaagaaaaccaagcacaaacaagaatacaacaagcgcacaggaagacaaaagacaacaaaaggggacaaagagaatatacaagagcggtagcaaatgcgacaaaacaactgataaaaaatgaagctgacaaaaacgacaagaccaacacaagagacacagcataatcaagcagcaaccataacgactatcccaaaaccacatacaagcataccgtaagaggagcatgacccacacgaaagcatatcagaagagcacagacaatggagcgtagcactcacgagaagtcatcatagagtacgcacactactagtagacgacacagacaacacaacgtccacatgacacagaacgacctaacaagaca

SEQ ID NO: 513529 - DNA, 140 bp, Homo sapiens
ctcaggaaagccacatgacagcccaacagggaggcatccccctcctcctcaaggaaggccacaaggaccaccccaacagggaggccatccccgtcctcctcgagtaaggccacaaggatcaccaccagaaattttccgga

SEQ ID NO: 513530 - DNA, 162 bp, Homo sapiens
  misc_feature (87)..(87): n is a, c, g, or t
tctactgtctcctccctgggctaagcaggggagaagcgggctgggggtagcctggatgtgggccaagtccactgtcctccttggcgncaaaagcccattgaagaagaaccagcccagcctgccccgtatcttgtcatggaaaatatatgaggttggaaatca

SEQ ID NO: 513531 - DNA, 147 bp, Homo sapiens
ggtcaccaggactgcttttcactcatggtaaagtggatatagttgccactcaatgaccccattcatatgacatcaactacatggtttacatgttccaagtatgattccacccatggacaaattccatgtgcacctgtcaaggactga

SEQ ID NO: 513532 - DNA, 229 bp, Homo sapiens
aaaagtgctgggattacaggcatgagccaccacactcagctctcaatctccattcttaagtaatgacctggcttcttgtgtcactgagaacaaaagcaatcaaaagaggacttctggccaggagcaggtggctcatgcctgtaatcccagcactttgggaggctgaggcggtcccatcatgaggtcaggagtgcgagaccagcctggacaacatggtgaaacactgtct

SEQ ID NO: 513533 - DNA, 1159 bp, Homo sapiens
cacgactcaacatcctggataccctaagcaaattctctcatgatgctgatccagaagtttcctagtaactccattttctgccatgaggcctggctggcgcagatggataccaataatgcccgctctggctgcaatgctgcgccagtttagctcaactatcagtgccaaggacccaaacaacctcttcatggtgcgcttggccacaggtgcctgacacatttaacgtgaagggcacccttaccctctgcaccataccacagccgaccggacagcttatgagccaggtggccgtggctggactgatcactgtgctatgtctctatcacctggcatgttcgacaacattcattctacggccaatcacacctatgtatcgccatgggcctggtggcatgccatgcacgcccccgaatgctggcttacgtttgactgcagcgagactgcgtgtccaacttgccagctgctctgatccagcgctgaggccaattgcatatgtgaatgctgagtgcggccacggctggccaagccctcaagactaatcactagagtctcccagcacggcaataccaatccccccagaaggtgagctcaggcccaacggatgtacacacgggcacgcacctagggaccacaaggcagggaggctctcataccacgtgcccacccccgcattactgggcacacagcacagggcgaacccctcagccaaagtaaccccacccacctgattgaatcctccctcaaggtcgaacaaaccaatgtgggacacttgtaacccatggccgctttgaactcgttcctccaccgcacggagcagatgcaactccatggatagtacatcaggcgttggcacaatcaggttagagagacatacctttggtaacgacaatatgacgctccaggactagtccctctacaggctcccagacactgaccaaaaccagcggaacacacacacacacatgtgactgtacccaagaacaaaaccagtcacaggcgcccgcctaagatgagatacccagaaagggaaccgcgcaacaacgcaacacgcgcgcacccaccacaacgaggacacaacaccccgaccaagttcacagacacacgaagatcgagttgtaaaaacatcctaaggcgcaacctacaccgggaactgagaacc

SEQ ID NO: 513534 - DNA, 254 bp, Homo sapiens
ccgaaatcgcgcactgcactccagcctggcaatagagcgagactccatctcaaaaaaaaaaaaggccccagggggttattccttttcctctagggcagaacccaaaataaacctttctttatcaccaatgcttgatggtcccataaatgttccacctccctaaatcttcagaaactggcgaaaactggagtggggtacatggtaagcacgggagaaactcagaaccaagggcaggcggtggtaagttcccgtgg

SEQ ID NO: 513535 - DNA, 328 bp, Homo sapiens
  misc_feature (102)..(102): n is a, c, g, or t
  misc_feature (129)..(129): n is a, c, g, or t
tggtggttacgctgtaatccagtatttgggaggctgaggtggatggtacaacttagggtcagagagtcgagcgatgacccatttgacctcccaaagtgctgngattacaggtatgagccacaactcctnggctaaacatgactttttacaaacagttcaactgatctctactttatagagacatcctttaatagcgacaggacataaaacaagctacatgaagaacatgaatatctacagaagacagtactatggagattcattacggatgtgaaaaatgatactcttggtcaacgtccacctggtgtgcgaggagacagccaattac

SEQ ID NO: 513536 - DNA, 458 bp, Homo sapiens
gagatttttacagactagccctcttcctcctagacaattaacccattgatgaactatttcccagcttctccccaagaaaacgtttgtaaggcccgcgctgacccaccgacgcaattttctgctgaggaatgttgactccccacccccaacttggctagaaataaacacttactgatgccgaagccatcagcgatagctattcgagatctctccagcccatgatctcgggtgtcttacactgggaacttaaaagttaccaaaccaaaggcactttcaggttgaggcaaccaaacctttctactgctgttgacatcttcttattacagcaacaccattctaggagtttcctgagctctccactggagtcctctttctggcgcggttcagaaaatggccctagatgaatgagaaaattatttttttttaatttaaggcccaaatatagtttcaataaaatg

SEQ ID NO: 513537 - DNA, 120 bp, Homo sapiens
cgatgtctgcgaactgggaaacagagacggagcccaggagctgagcggcactctcatgtcatgctgtgtctgacgtgggtctgattcctaggtgtcgcagtactccttgcagggtacgga

SEQ ID NO: 513538 - DNA, 693 bp, Homo sapiens
  misc_feature (69)..(69): n is a, c, g, or t
cgcaaaatgcggctaaggagcctatcacacctgtccatgtactacgattggtgaggtgcagtcgctttngattgtttcagtcttgtcatggcagatctgtctcacataggatgaactgtgcagtcactcgatctcggcgtggctgccaagcatgccactgtgttcgcatccttcttagcaagatataggctatcagtctgtagtcagccactcacctagaggcggactacttccgagtgacagctatcagctcatcaatccatggttccagttgatgttaacagcttgttgaccggcacaagtcgttcagcatacactctgtagtgcctgcagaggcattagcctggaccgagggtcatctggtgcagtcagtgcctctgctggccagctatcgactgtggccatggtgacttgggcatgaccacctatagacagcgatgggccccatccctcagcatttcagagatgcgtgtgatgccaggcgttctcattattaccatgagccattgagaaattctagtaacagcctggacctgtgatcattccgttctcttcctcagccacaggtaagagtagcaatgttaagagtggtagcactatcaggtggttgaccttgtccgggatgcgaaagtcagactgcctgtccgaggggtcctctcgccctcagctagcctgtgtgtcgtccactccaca

SEQ ID NO: 513539 - DNA, 806 bp, Homo sapiens
  misc_feature (625)..(625): n is a, c, g, or t
gggcgtttgctgtggcggctaggacccgcgtgcgctgagagacctccgctgctggtgccccgcgacgcctcctgtccctggcccgggcgtctgcggctctgcctgcggcggtctcattgggtggcccccggtggcgcgggctgaggtaggcggcagggcctgctagttcggacgcggcgtgcctgctactggcatttacaggcctgaccccgggagctcgcgccgcgcgcgcggctgacctgccgatgcatcggagactagcgcgtcctttcgaacgctccgacatacagcaccttacacctcgagtcggtgtcagttttgactgacgtgcgttctatacattgcctggaacaaacctttcagaaacatctcccgtttacccttgcttggcacgtcacacgcgcgcgattcctggtaactttcctttgcaccccgacgcttggactctacctgtatgcagtaacccaactgacagtccgtttttccacctgtaaaccaaagacctacgttcattcccggatgccacacttcgcccgattgccataacttctccgcaaacgtactgtcaacgccaaaacccaaacatacacttccagacccccactcctcgccagacccagcaacngttacttctacagcgcaagcaaaacgccctttctacacaccttgccacaccttacacagcttacatcccctgcaagtctcgctgacacacattgtcctccaagacgcacactttccaacacccattttcccgacaccgaacctcacccaacccggcggtttgtcccacatggctattctag

SEQ ID NO: 513540 - DNA, 478 bp, Homo sapiens
  misc_feature (9)..(9): n is a, c, g, or t
  misc_feature (15)..(15): n is a, c, g, or t
  misc_feature (23)..(23): n is a, c, g, or t
  misc_feature (26)..(27): n is a, c, g, or t
  misc_feature (29)..(29): n is a, c, g, or t
  misc_feature (38)..(38): n is a, c, g, or t
  misc_feature (42)..(42): n is a, c, g, or t
  misc_feature (56)..(56): n is a, c, g, or t
  misc_feature (85)..(85): n is a, c, g, or t
  misc_feature (126)..(126): n is a, c, g, or t
tcgtcgacnccggtnctcttcancannanatacctgtncagnccctacttccatanacacttgcagacccagagccccttaccgntgccaggacccaccttctcagtctcatacttgtgcccaggnatgcttccttggacaatgaaagacccagcagctctctgctacacttggctaggtctcctcagatattaaaacccacagctacatttctgttccccagcccacctgcttgaacagtggcccagtgcctcatacttgtgccaggccccacatcctcagatactgacaaacccagatcctcacacctgtgccattctttgttgaacaatgaagactcatcactttgtacctgtgcccattcccaactcctcaggtggtactgacagatccagaaccttagacctgtgcctcaccccacctcctggacactgacaggcccagtgggtcatatctgggcttgaccgatcttctcggc

SEQ ID NO: 513541 - DNA, 347 bp, Homo sapiens
taggtaacatggcacatgtatacatgtgtaacaaacctgcacgttgtgcacatgtaccctagaacttaaagtataatttaaaaaaaaagaaaaaccaaataaatggagacatattccatgttcataaaaaaaaaaaagaaaatggagggtgggaggaaggtgaggatcaaaaacctacctattaggtactatgcttattacctaggcgacaaaataatctgtacaccaaatgcccaccacacacaatttgcctaaataagaaatctgcacatatactcctggacctaaaataaaagttaaaaaattaatgatatttccataaactaactacaaactatctgaaatgc

SEQ ID NO: 513542 - DNA, 896 bp, Homo sapiens
  misc_feature (3)..(4): n is a, c, g, or t
tcnncgctgacaatcaataagaaaagaggaacaagagaaatgaaaagaggcgcggctcggcggtacggttcgctgcaagacaccggcgtgttaggagacgatagaagctatcagcgcggcggggtgagttaaaaaccgcgtgaggttgagacagcaaagcaccataagggggtgagaaacctgctccttgtaagggggtaatgggtcccgccccccggacgagaggcggcccgtgtggggacccgccccgccgttgggaggagggccgcccgctccgtggacaaagtgcgggacaaattgtgcggaagcgtctggcacatatgtggcgagtacgccccaccggtttgccacccaaaatttgttgcctcaattatgtggggccaaaaacccttattaatggggcccctatgaattgccgaaaggaagtagcggcgcactcatgggcccgatgcaatggtgctgcgagacaacaaagaaaatttgtttgggaaacggtacataagccttggacacactggagcgcaatgttattggcgaaacaacaaaaggcgcctatgttagtattggagaactaacaatagaaaagggaagttttctactgagacatgaatagacttgctattccgcaccattttggaattctccattagggagacattgaaacaaactcagggagaaccctatgattcagcacagggaaatcgccctttgcgctggtcgttatttaacgcataaaacgggggctgacaaaaccacaggtggcagaggcccggtgcacaaacattgttttcgcatgatcctgctctggttcataatccctctcgacagctcccatggataagaattctattttgacaagcccagcttaaacaaaaaagtccccacgcccacataca

SEQ ID NO: 513543 - DNA, 198 bp, Homo sapiens
cttacggattcactaggtccgatgatatcaaacgcgggaaaccaggtagttcccctaatggagctcccagggaatattctgccaggggtgcaggatctcgagcaccccatgcaagaaaacttgtaggtgtcgcagtgatatggggcggattttgacggtcacatccaatacaaatgcttctcaaatctccacatcgga

SEQ ID NO: 513544 - DNA, 209 bp, Homo sapiens
cgatcatgcggccttactccaagatacgatgaccaccaagataagaatggtatggaagacacgacagaaggctaagaacaggaaggtaatctatgtgcacctgaccaaatacgcaagaataacaggatcaacaattgaacggcagtgctataagacgtatcaagtaaatacattaaaaaccaaacaagtgattatggaagcactaaaac

SEQ ID NO: 513545 - DNA, 101 bp, Homo sapiens
accctaatcattccaattacctgctatctgctctgccttgaccccgtcaaagcactcaccctgtcattctctttaaattagccaatcggaattagttttgg

SEQ ID NO: 513546 - DNA, 377 bp, Homo sapiens
tccagtagaatcttcagctccaatctcccagcgtcccatctggagatataaattaagaacacaatgatacagagatccctctgtgtcgttgttattaccaaataagtttacttgccgcagtggcactattattgctcacttcaccttactgtcacggtagacttagcacacattgcaactttggtattgatggtcgactcagaggggatttttacattcagggtaggaggataagccagatcactgctaaggctccaagttctgtatattttgcgccattgtagacctgtgataacttcatatcattacctcattcatcatgttgacaagaacagttgatccgactatttaagtaaagggctagcccatctacttct

SEQ ID NO: 513547 - DNA, 577 bp, Homo sapiens
  misc_feature (2)..(2): n is a, c, g, or t
  misc_feature (162)..(162): n is a, c, g, or t
  misc_feature (222)..(222): n is a, c, g, or t
  misc_feature (336)..(336): n is a, c, g, or t
  misc_feature (378)..(378): n is a, c, g, or t
  misc_feature (402)..(402): n is a, c, g, or t
  misc_feature (420)..(420): n is a, c, g, or t
  misc_feature (441)..(441): n is a, c, g, or t
  misc_feature (451)..(451): n is a, c, g, or t
  misc_feature (488)..(488): n is a, c, g, or t
  misc_feature (491)..(492): n is a, c, g, or t
  misc_feature (496)..(496): n is a, c, g, or t
  misc_feature (515)..(515): n is a, c, g, or t
  misc_feature (530)..(530): n is a, c, g, or t
  misc_feature (543)..(543): n is a, c, g, or t
  misc_feature (567)..(567): n is a, c, g, or t
gntcgcaggatagagtgtgaaatctctaagatgttctaacagactgtgaaagcacctctccagccacggctgtctacagggtccatgcttaagcttcactggaactctccatctgcctccgctatgtcacgctgaatgccaaatccttggacttagattctnctagggctgtcagtggtgtaggtacagcttctgtgtaaatcaaaggcccctttccccagnaggatacagacagtgtcaggccaccttgcttgggtaggaagcactggggctggatttcagcccactcggtccctcatctggacagtggctccctcggtgctgaacttgtccgtnggacttgttgtgagcttccccatcccctgtgcttttatgagnaggatgaaatgtcaatttacaagncggtcccagggaggaggntggcaactccccccaactttnggataacaanaaggggtttgaggattggtccaaaacaatctttcttnttnngggncccccctttccttttttcnaaaaagggaccaaangggtttcaaaaancccaaatgttttttgggggttttncccccaaccc

SEQ ID NO: 513548 - DNA, 240 bp, Homo sapiens
gggggggcaaaaaaccccccgggcccgtgtttccccccacagggtttttatttggggatttttgggggcccctggtttttgccctttttttgggtggggcccgcaccttttttttttggttacatttggaaggggggccccccgggccccccccccctttttgggggttgggttttttccccccccccccgggggggggggggtttgttttggggatttttttggggtttttccccccca

SEQ ID NO: 513549 - DNA, 839 bp, Homo sapiens
  misc_feature (34)..(34): n is a, c, g, or t
  misc_feature (68)..(68): n is a, c, g, or t
  misc_feature (98)..(98): n is a, c, g, or t
  misc_feature (120)..(120): n is a, c, g, or t
  misc_feature (126)..(126): n is a, c, g, or t
  misc_feature (160)..(160): n is a, c, g, or t
  misc_feature (199)..(199): n is a, c, g, or t
  misc_feature (203)..(203): n is a, c, g, or t
  misc_feature (211)..(211): n is a, c, g, or t
  misc_feature (223)..(223): n is a, c, g, or t
  misc_feature (262)..(262): n is a, c, g, or t
  misc_feature (364)..(364): n is a, c, g, or t
  misc_feature (495)..(495): n is a, c, g, or t
  misc_feature (513)..(513): n is a, c, g, or t
  misc_feature (525)..(526): n is a, c, g, or t
  misc_feature (556)..(556): n is a, c, g, or t
  misc_feature (599)..(599): n is a, c, g, or t
  misc_feature (613)..(613): n is a, c, g, or t
  misc_feature (617)..(617): n is a, c, g, or t
  misc_feature (622)..(622): n is a, c, g, or t
  misc_feature (628)..(628): n is a, c, g, or t
  misc_feature (633)..(633): n is a, c, g, or t
  misc_feature (708)..(708): n is a, c, g, or t
  misc_feature (712)..(712): n is a, c, g, or t
  misc_feature (821)..(821): n is a, c, g, or t
  misc_feature (835)..(835): n is a, c, g, or t
attaaaatgctaaatattgcaaatttaagctttntcagtatatggaaaagttgaagggaaaaaactgnaatgcttcttcaaaggttaaaaaataaccnagtcttttggtaatttgacccnacgtgntttttggccctaaagcatgtaacctcggggtttnaggcccagaacccacccccctgccaccctcccacccacncccngctcagtncctggcgttggnacacaggcaaggattggcacaacaaaattggctttttcnccctcttaatattgaagaaattcccacatttctcatttggtaatggtgttgtggcctcagatttcttctagtatttgcttctgatgaatgattatggtctanacataaaaaagtaagactaagtattgctgaatttgcagttatgttgtcgtgtataagagctacttccaagtgtggttacaaatgaacccatggaatgatgacttcatgttcttctcgtgggtttgtgccgngctgctttccacataggnattaaatttaannattagtctggtgatttcagttctgtgaaanattttgggatctataccaattaaacattttcatagttctgccnattgtccttccctnaggntccantgctgnttggnggccattctctgcctttttacagtcacctgaacaatgacccatcatctcttgcttgcttgaaatcttgctgaaangttntcatttcctgtttgctgtatgggctcgggtgggatgtttgttggctttgttgtgtttattccccaatttgtacattatttgttgtcctttactactgtaaacagtaaanatagtttggtattntgaa

SEQ ID NO: 513550 - DNA, 815 bp, Homo sapiens
  misc_feature (34)..(34): n is a, c, g, or t
  misc_feature (68)..(68): n is a, c, g, or t
  misc_feature (98)..(98): n is a, c, g, or t
  misc_feature (120)..(120): n is a, c, g, or t
  misc_feature (126)..(126): n is a, c, g, or t
  misc_feature (160)..(160): n is a, c, g, or t
  misc_feature (199)..(199): n is a, c, g, or t
  misc_feature (203)..(203): n is a, c, g, or t
  misc_feature (211)..(211): n is a, c, g, or t
  misc_feature (223)..(223): n is a, c, g, or t
  misc_feature (262)..(262): n is a, c, g, or t
  misc_feature (364)..(364): n is a, c, g, or t
  misc_feature (495)..(495): n is a, c, g, or t
  misc_feature (684)..(684): n is a, c, g, or t
  misc_feature (688)..(688): n is a, c, g, or t
  misc_feature (797)..(797): n is a, c, g, or t
  misc_feature (811)..(811): n is a, c, g, or t
attaaaatgctaaatattgcaaatttaagctttntcagtatatggaaaagttgaagggaaaaaactgnaatgcttcttcaaaggttaaaaaataaccnagtcttttggtaatttgacccnacgtgntttttggccctaaagcatgtaacctcggggtttnaggcccagaacccacccccctgccaccctcccacccacncccngctcagtncctggcgttggnacacaggcaaggattggcacaacaaaattggctttttcnccctcttaatattgaagaaattcccacatttctcatttggtaatggtgttgtggcctcagatttcttctagtatttgcttctgatgaatgattatggtctanacataaaaaagtaagactaagtattgctgaatttgcagttatgttgtcgtgtataagagctacttccaagtgtggttacaaatgaacccatggaatgatgacttcatgttcttctcgtgggtttgtgccgngctgctttccacaataagataattcgaactcttcatcgcgatttagctcctgcgtgcatcttccacgttctgctgaacatactcttcgggatcctataccaagttaaacacttttcatatgctctgcctttttacagtcacctgaacaatgacccatcatctcttgcttgcttgaaatcttgctgaaangttntcatttcctgtttgctgtatgggctcgggtgggatgtttgttggctttgttgtgtttattccccaatttgtacattatttgttgtcctttactactgtaaacagtaaanatagtttggtattntgaa

SEQ ID NO: 513551 - DNA, 1242 bp, Homo sapiens
gcatttctttatgcctggctttgcgccgtctcgaccagccgtggaagccgagcagatatcgagctctcacagtgccggaactcacccagtcaggtcttcgatgccgaggaacatgatggctgcctgtgacccccggccacggacgatacctcacgcgtggctgctgtcttccgtggtcggatgtccatgagaggaggtcgagtgagcgagactgcgttaaacgtggcagaacaagaacagcagctacttagttggaatggactccccagacaatgtcaacgacagccgtcgtgtgacactcacgcaccgtcggggccctcaagcatgggcgagtcaccttcagtaggccaaatagcacaggccagtgccagcgagcgtcattcagagcgccatctcggagaacaaggtctcactgaccaggataccgccgggaagagccagcgctccacatggtaacacagggcgagggcatggacgaagatgcgagtgcaccggagggctgaaagcaaccatgaagcgaactcgtcgtcttgagtatcagcaagagaccaggatgccaaccggcagaaagaggagagaggcgtttcgcgatggaggagagccgacagaggagggcccataaggccagaagccccacagtcacactcaggcatactcagggccccattagccggtattactacaactgcgccctttgcgctcatacccatacaggaaaatgcatgggaaacaggatgaacaatcgacgccaaagacgccccaaagcaccacatgggccactcggaaaaaacgaacgaaactaaacacctggagaagcacaaaaacacagaacaacgacacacaaaaagagcacgacaaacgggacaaaagtgcaccaaaaccgtagtaccgaactgtgcaccacaacacacggacacaacagcgagagaacaataggacgagacaccacaaaggaagacagccacaacaaataaccaacaaatgacagatggcaccacgacttagaataaaccgcccgagagaaaaaacggaacagaaaaaacaacaaacgaacgaccacacaaacaaaacaagagaagagcgggcaccaaacagcggcggagaagacacgaagaacacaagacgcaaaaacaaaagagaaacaccacacacgatagaaagcggaccaaacacagctcgagaaaagaacacgaaaccccacacatcacgacgaacgccgccaccgaagcagccgacaccaac

SEQ ID NO: 513552 - DNA, 101 bp, Homo sapiens
atgaaagaagaaagaaagaaagaaagaaagaaagaaagaaagaaggaaggaaggaaggaaggaaggaaggaaggaaggaaggaaggaagaaaaatagagaa

SEQ ID NO: 513553 - DNA, 277 bp, Homo sapiens
tgtgaggttgacggctggggtgtgctgagcaaggtgcagcatgagtaggagatccatagtgttggtgcaggtccagtgtcatgcagggacccagtgagccccgtatgaagagcttgggttttcattccaagtagcagtgggaagcccgctggaagctcaggcacagtgatgacggtgtgacccagacggtacaccttaagaaagatcactgcaacaggcagcatggacgcattgggtccccatggacgcttggacggggatagcagggatgggttgg

SEQ ID NO: 513554 - DNA, 390 bp, Homo sapiens
  misc_feature (29)..(29): n is a, c, g, or t
  misc_feature (32)..(32): n is a, c, g, or t
  misc_feature (46)..(46): n is a, c, g, or t
  misc_feature (64)..(64): n is a, c, g, or t
  misc_feature (82)..(82): n is a, c, g, or t
  misc_feature (163)..(163): n is a, c, g, or t
  misc_feature (167)..(167): n is a, c, g, or t
  misc_feature (175)..(175): n is a, c, g, or t
  misc_feature (178)..(178): n is a, c, g, or t
  misc_feature (181)..(182): n is a, c, g, or t
  misc_feature (184)..(184): n is a, c, g, or t
  misc_feature (259)..(259): n is a, c, g, or t
  misc_feature (310)..(310): n is a, c, g, or t
  misc_feature (338)..(338): n is a, c, g, or t
  misc_feature (356)..(356): n is a, c, g, or t
ggggccccgcaacccaccctggactccgnccntcctaccctgcgcncagtccttccacctcgangtttacaagccccccctnccacttttttcgctatgtttcttttctgctggaaccacactcgactcatatcgaatataaaatatttgtgtcttcaacagngagnggaagagnggncgnncncgcggagctggccccgccgcctggtactcaagccgcggggacattgggaagggacccccgccccctgccctcccntctctgcaccgtactgtggaaaagaaacacgcacttagtctctaaagagtntattttaagacgtgtttgtgtttgtgtntgtttgttctttttattnaatctatttaagtaaaaaaaaataggttcttaaa

SEQ ID NO: 513555 - DNA, 389 bp, Homo sapiens
  misc_feature (29)..(29): n is a, c, g, or t
  misc_feature (32)..(32): n is a, c, g, or t
  misc_feature (46)..(46): n is a, c, g, or t
  misc_feature (64)..(64): n is a, c, g, or t
  misc_feature (82)..(82): n is a, c, g, or t
  misc_feature (162)..(162): n is a, c, g, or t
  misc_feature (166)..(166): n is a, c, g, or t
  misc_feature (174)..(174): n is a, c, g, or t
  misc_feature (177)..(177): n is a, c, g, or t
  misc_feature (180)..(181): n is a, c, g, or t
  misc_feature (183)..(183): n is a, c, g, or t
  misc_feature (258)..(258): n is a, c, g, or t
  misc_feature (309)..(309): n is a, c, g, or t
  misc_feature (337)..(337): n is a, c, g, or t
  misc_feature (355)..(355): n is a, c, g, or t
ggggccccgcaacccaccctggactccgnccntcctaccctgcgcncagtccttccacctcgangtttacaagccccccctnccactccttctccatcccctccctctccccgcccagcactccacccatactcaccatacctcactccctcatttaacagngagnggaagagnggncgnncncgcggagctggccccgccgcctggtactcaagccgcggggacattgggaagggacccccgccccctgccctcccntctctgcaccgtactgtggaaaagaaacacgcacttagtctctaaagagtntattttaagacgtgtttgtgtttgtgtntgtttgttctttttattnaatctatttaagtaaaaaaaaataggttcttaaa

SEQ ID NO: 513556 - DNA, 133 bp, Homo sapiens
atgcgggaggtagggcggggcgagagagtacaagctccctggcagctgatctgatttgagcacaggtgtgctggagagcaggtgtgtggacgacacatcctccagccacctgtgctcaaatcagatcagctgg

SEQ ID NO: 513557 - DNA, 261 bp, Homo sapiens
ttaatcctggccactccacccctccttttagtttaagccccgcacctcgcacctagactaaagttagcttccacttataagtcagaacaaatgaattttggtttttcactcctatgttacttcacttagaataatgcctctaggccaggcacgatggctcatacctgtaaagccagcactttgggaggccaaagctggtggatcacttgaggttgggagttcgagaccagcctggccaacatggtgaaaccctgtctctac

SEQ ID NO: 513558 - DNA, 1301 bp, Homo sapiens
  misc_feature (1039)..(1039): n is a, c, g, or t
gctgagatgttaaccaggcagtcctggttgggctgttatgactacatatcgctgatacgtctagctggacaccgaatgagggaagctataccgtcggaatatggccctaaggatcgatactccatttccaacgatgagctccaaagggctatggtatgactggtaggggatacagagcgcaatttgcttaccaatatgtatgtcgcattcagaacgaggcgatagaatcgcagagggggcaatgtcgttcccgttcatgcatgaggtacgagagtaacctataactccacgactgtgcgcgattcgcgtggaagcgcatctcgtacgtgcagtagcacaatcgcccaggtggaatgtgagtacaacgtactgcatggaacgactactttttccgcgcgtgagcagtcgaatcgcgactccctgtcgactcaaagctacaggggaacggatccagccagctgcgtgaatatgacggtacaatgggtcatgtcccggcatgaacaaaatatttgacgctagacctaagttgtggcgccgaaggcctggaggagcgacctttgttgtacctcctctaaatgcaaagcccagagggggtgggccaagggcctggcggaatatcgaaccagaggtccatgcaggcagccctccagcagcaccaaatgcctacacgttacattaggccccccggtggaaagctaaggtagcaacaatcgcgtctttacaagtacatccatgtccttggcaatggaatccgaagtctaggaggcacgtggccgtgatatgcttgacttgttcgaccacgagaatcgtaggtctactaggaacaatcgcggccttaataaagccaacaggggggcaacttccccaacgtaggagaagaccggaacgggcagctgaactttgggcaggcgaagcgggggtaccatttccaagttacattcccccccaaggttggcctcccgtatgctagatgcgacccttcgtgctcagagttcctcgcaagcacaaggaagcgtttgatttgacatgacattcgagnaagcggggcctacacccgtgagctgccataaaccccataagatctcggcgctttgctcatagtgaattgggggtccccggacgtcacgctgggaccccatccgtacgcgaagaagacctacctttgcataagacactccttgaccggcgtaatttcacacttttgtgcatcggccatgtggcttctcacggggcgacatctgattatcgtgcccgaagagggtgattcacattagccacccttgagcagagcatgttaagtg

SEQ ID NO: 513559 - DNA, 158 bp, Homo sapiens
  misc_feature (13)..(13): n is a, c, g, or t
  misc_feature (21)..(21): n is a, c, g, or t
  misc_feature (157)..(158): n is a, c, g, or t
ggcagttcggcgntcccgcgngtctgtctcttggcttcaacagtgtttggtacggaacatatccggggggactctcttccagcctccgacctccctccgatttcctctccgcttggccctccggggaccatcttctcggccatctcctgcttctggnn

SEQ ID NO: 513560 - DNA, 818 bp, Homo sapiens
  misc_feature (539)..(539): n is a, c, g, or t
  misc_feature (551)..(551): n is a, c, g, or t
  misc_feature (615)..(615): n is a, c, g, or t
  misc_feature (620)..(620): n is a, c, g, or t
gtgaaaccttgcttagccccagtttatgaagatattctcttatgctttcttccacaagctttatggttttagttttcatttgaagtctctgaatctcaaatgaattttgtgtgtgttgtaaggtgacggtcaagttgtttgttttttcctgtacggatatttcgttgtttcagcaccatttcgtaaggagactttactttcctcatggattctttggtacctttgttgcaaatcaaagactaatacatctatttctgaattttctgttctgttatatgatctatctgtcagtccctatgccagtatcacggtcttcattatgtagttgtgttagtcttgaagtcaagtattaatagtataagtcctccaactttgttcttcttttcaagattgctttgactattccaggtcctttccacataaattatacaatcagcttctcaaattctactttttaaaaaaagacagatgagatttgaatggtatgtgtggagtctattgatcagtttaagaattgacaacactactgtacttttaantctacgaatatngtatatctctccatttatttagatctttaatttctttcaggcaggtttgtagtttcattggggnaattntgccatttattagcatttaattctgaagtagttaataattctgatactattataggatgggattatttaattcatttccaggtatggcaattgtagttacactgaatttattaggtatatttgggcatggtaacactaattttgggtgacccttgggagctaggattatgtgcactgtgtgaaaaattttttttaaac

SEQ ID NO: 513561 - DNA, 327 bp, Homo sapiens
tgggctacccagagaaggaaagagacttgcccagggacacacagccacctccgtcccgaggccaccagaagcccgaccgccaaattcgaattccggctccgtaacttagcggctacttgacctcggtggggtcaccaagtgtgagccctggagctgttacccagaaaagaggccggtggaaagacctcctttgggggtagtgaaagtcaaactggggcgccgcgcgccgggtcccgggtgggtggggcctgggcgtccgcgagaagccgcagcccacgtgcgctccctcgcaggccaaaacctggcgcgccacgcctcggattacac

SEQ ID NO: 513562 - DNA, 516 bp, Homo sapiens
  misc_feature (374)..(374): n is a, c, g, or t
cactggagtcaagatgggatttacttcctctcgtttcaggttatgcatgacatcctgggatgtaagatcacagaatccccctccagcccaccagtcacacgctaccccattcagtatttattaccctggccaggcctagtcctccactccctgcacaggactgagaaggcaatgaaaggtacaaacatgtaccatgaggtcttactaaccaaagtagggctgcccctcctgtcctgacagccccttggtctcccagcatggggaagcgtgaggagttgcccagcagctgagcgagccccccatcaactccgtggcccgcatgagcacgcgagccacaggcagcagaggagggctaaggacgaggacggaagccntacaagctccagttggtctaattaccgccgacgtctgtagcccagcacacagtaggcacgtggagaggactgattcccaggagtaaccacactacggtaccttttatgaagaaaaattagagcataagaatctactacatag

SEQ ID NO: 513563 - DNA, 1500 bp, Homo sapiens
  misc_feature (688)..(688): n is a, c, g, or t
tattccgcaaggggttggccgccaaaacccgggtgtcgggaaaactccccctaaaagccaaagggggaagggaaaagacctcattatctcaccatgtgtggtcgccatgtgggacccgcgtataaattcgcgggacaagtctcccccaccatagcgggcccactcgtgattcttaataaatgggcgggggctctcgacaaaaaacaccatttgaaaaattttgtggaagagagggaggtctgggcggaagagaggggaaagagggtctctcctttcaagttatattgccgcgggggctctggagaatataacgcgtgaaaaagccgtgagagcgcggtgaaagcggtggtattctcccccatgtgtgatatattctctctctgtgtgtgaagacacattgtgtgaacacacacacgacaaaggagatcccactaggtgtgtgacactatatctcacttgtgtgagtgtcgcccccacaggagagccacacagagagagactctttttctcacaaacacacacgtgtgtatctctacgcggggagacacactctctctcaagggcgcagtgaacagcgtgtgtggcgtgtctcgctgtgagaggtgtgtgagagcgagagcgtgagagtgtgtgggagccgagacacttgtgagacagcgcgctgtgggagtatctctctcacacaganaatatgttggggccgagacaccgcgctgggagagaggccgatgattgtctccctctgctcctgtgtggtgctatatacacccacgcgcgttgggggggtgttgttgtgcacaacacacaaaactaataatatgttgtggtgcgcggaggttgttgtttcaacacccaaaagaagtggtggggtgatctctcccccacgatgatgagagcgacaccaccaactcctgataatgaagtgtcgcgtagatggaaaagaagaaacagatcttctagttaggaggggacgacgacactgttgtggtttacacaacagaggcaggacaaactgtgcctcacaacaaccaacactatactaacaccaaattattataaagagcagaacaacacacgatgttggtgggtgtagtaaaaacaaagcacccccccacggaggagaacccagcaaagaaggagagaaagcccacattttatatgtgggtttgggccccccaacaaaaatatatctcacgagtgagggtactatgcagcacaacgtatgtatggtgcggcgacacccccaacaacttagtgatggccctggagtggtgagaacgcacccccacaagaagtgtgttgcgtccctaaaacacaaaatagattgccaccgtgttaggtggtgccacaaccaaaggggagaggaaactcgctagcgaaaaaaagatgatattcacccccccctcgtataaataagagcaggtcatgctgcttacaaaaattcgcgccccatagagtggaagaaacaacacacccagcatgctgctgatatatacagaa

SEQ ID NO: 513564 - DNA, 693 bp, Homo sapiens
tacctcagctatgctgtcttccagttgggtgatctgcaccgtgccctggagctcacccgccgctgctctcccttgacccaagccacgaacgagctggagggaatctgcggtacttatgagcagttgattggatggaagagtagagaagaacatcgttaacaaatcagacagaagctgagctagcaaccccagaaggcatctatgagtaggcctgtggagctacctgtcctgagcagggatgtttacgatgagcctctgtcgtggggagggtgtcaaactgacactcccgtagtacagaagtaggctttctctgtaggtagcaccgatggctaagctagggccccgatcgagctgctcattgtgccccttcaaagcagagacggacgaggtggagagcagcgccgtcatcgatcggtgcaggtagctacggatgtcatgtctgatgaggaaatcgagaggatcaaggagatcgcagaaaactaaagcttgcacgagccaccgttcgtgatcccaagagcaggagtcctcactgtcgccagtctagcgggtttccaaaagctcctggctagaggaagatgatgacgctgttgtggccggagtaaatcgtcggatgcaggatatgacagggttaacagtaaagactgtagaatggttacaggttgcaaattatggagtgggaggaaagtatgaacc

SEQ ID NO: 513565 - DNA, 151 bp, Homo sapiens
tgtgcagagtataaaagagcagagtcatcaatcagcgcggacttctgtgcacagcaagtatatcacaataccccaatgaagacagtccaattcaaagtggagtgaaatgacccttccggtacaggtttgtacactctggacgcaatgtgac

SEQ ID NO: 513566 - DNA, 244 bp, Homo sapiens
ccggcacgagatttttggcataaagatacctaaacccatcaacccagcggagggttgaactgaatttctgggaaataaatttgttttaaaaactaattattttaaaaccacttaattcttaaaaacaatgtcaccagtttcaaaagtttcactttgggaggatattccttaaaaggcatacatagatggtaaagtatcccccccccaaaaaagaattattcagtattataaaacatttactttc

SEQ ID NO: 513567 - DNA, 487 bp, Homo sapiens
gggtccctgcctgctgagctctggcttacacacacattgctagcttcaagttctctctgttaatgtactagttagcagaactaatacttagcgagctcagacatttgtgtgcatttcattgcaggttcttgtgctgcctgtgggctgtccccaggtggcctggaggtgggcaaagggaaagtatcagacacactatgttgtcaaggatggtctcggtactagaggctctccgtgtgggagagcatccctgcagaacccaccaagcatgaacgtggttagcctgaggctgttactgagacagagattctggggctgtgttatgcaacatatagacattctcacataagcccagctcatcaccatttcctcctttacctttcacgtgctgttgcttttcgcattaggctgtgggttcacgctttggggagcccggactgtctgttctctgcgtccgtggtcggcgcctcctgcggggtccccctcggtc

SEQ ID NO: 513568 - DNA, 188 bp, Homo sapiens
  misc_feature (21)..(21): n is a, c, g, or t
  misc_feature (172)..(172): n is a, c, g, or t
aggtgactctagagccgcttntatgaggaacgtcactgggatgaggaacgtcactgggatgaggaacgtcactgggatgaggaacgtcactgggatgaggaacgtcactgggatgaggaacgtcactgggatgaggaacgtcactgggatgaggaacgtcactggcaggcgngcctctaatacctgta

SEQ ID NO: 513569 - DNA, 245 bp, Homo sapiens
  misc_feature (21)..(21): n is a, c, g, or t
aggtgactctagagccgcttntatgaggaacgtcactgggatgaggaacgtcactgggatgaggaacgtcactgggatgaggaacgtcactgggatgaggaacgtcactgggatgaggaacgtcactgggatgaggaacgtcactgggatgaggaacgtcacttcattgtcatgctatggaagccaagctaatccttaacttcagtcggagtaagcctcctaaatccagcatcattgcagattcc

SEQ ID NO: 513570 - DNA, 103 bp, Homo sapiens
atctagaggatccatcaggcgaagatgtggcaccatgagctcatctttctatcacatgctggcgacctccctgcttgctttctggccaagctctcccttttga

SEQ ID NO: 513571 - DNA, 1151 bp, Homo sapiens
ctctaaaggccactagcacccatcccagagctgtcagcaccggcctcagcccaggcggctctctccctgagcttcctgtagccctgaccctctccagcctcagacctgagacagggctggacaaggaagcagagagcagaagaaaagcagaagcgaagctcagatctgctgggaggaagattacattttgtcccctcctggggtcttgcacagtggcaggtgacattcgtgttacaggaatgactgccagggcctgggcctcgtggcggtcttcagctctgctcctcctgcttgtcccaggctattttcctctgagccaccccatgaccgtggcgggccccgtggggggatccctgagtgtgcagtgtcgctatgagaaggaacacaggaccctcaacaaattctggtgcagaccaccacagattctccgatgtgacaagattgtggagaccaaagggtcagcagggaaaaggaatggccgagtgtccatcagggacagtcctgcaaacctcagcttcacagtgaccctggagaatctcacagaggaggacgcaggcacctactggtgtggggtggatacaccgtggctccgagactttcatgatcccattgtcgaggttgaggtgtccgtgttcccggccgggacgaccacagcctccagcccccagagctccatgggcacctcaggtcctcccacgaagctgcccgtgcacacctggcccagcgtgaccagaaaggacagccccgaacccagcccacaccctggctccctgttcagcaatgtccgcttcctgctcctggtcctcttggagctgcccctgctcctgagcatgctgggtgccgtcctctgggtgaacagacctcagagaagctctagaagcaggcagaattggcccaagggtgagaaccagtagcatctgctgtccatcaaggccctgtgctgcaacagagcccctctggggactggaatgacctcctgaccatcaaggcctgcaacagagcccctctgggggactggaatgacctcctgaccactccctcccgggctgctctctccaacatctcctggaatcctttgtgagcctccttcagccttttccctgtgcccgatccaacatgtgacacatgaggactttagagcacaatggatc

SEQ ID NO: 513572 - DNA, 238 bp, Homo sapiens
  misc_feature (21)..(21): n is a, c, g, or t
aggtgactctagagccgcttntatgaggaacgtcactgggatgaggaacgtcactgggatgaggaacgtcactgggatgaggaacgtcactgggatgaggaacgtcactgggatgaggaacgtcactgggatgaggaacgtcactgggatgaggaacgtcactaagctcctgatttcccaacctggttttatggtcctctctgtgtgaagttggacggtggttagtcaaatctctaag

SEQ ID NO: 513573 - DNA, 396 bp, Homo sapiens
  misc_feature (16)..(16): n is a, c, g, or t
gagcgtcgcgcccgtngtcggatacgagctgaagctcgcggtgccggccatcttgaacgacggcggcttcacctgctcggcgatgtacatgagataggcacgcccatacgtgtgatagccgttcaccttctcgtccgacttccaataggtgcccgccgcggggatgctgctcggcgcattcgcgggctctttgaaatcacccgcgggccacgtcgtgatgttggaaggcaagaaataatagagcgcgacggtcaccgcaccgggcatgcagaagttccaataattctgatcggtataagagttgttcgcgtcgtccttgccagagccttcgggttctacgatttgatcgacgacgctggtgtcgagcgttccaggcggcaagctcgcgtctgccgc

SEQ ID NO: 513574 - DNA, 238 bp, Homo sapiens
ggggttgaatgtgccggggacgcgctctcgggtcccctgagggcgctctgtctcctgggactgctgctgagccacgcagcagcgcgccgtacgaccatcatcacgttccccggcgatgttagcccccaaaacggacaaagagttggaagtgcaatacctgaacaccttctatggctgccccaaggagagctgcaacctgtatgtgctgaaggacacactaaagtagatgcagaaattc

SEQ ID NO: 513575 - DNA, 248 bp, Homo sapiens
  misc_feature (21)..(21): n is a, c, g, or t
aggtgactctagagccgcttntatgaggaacgtcactgggatgaggaacgtcactgggatgaggaacgtcactgggatgaggaacgtcactgggatgaggaacgtcactgggatgaggaacgtcactgggatgaggaacgtcactgggatgaggaacgtcactataactgaactcctcacacccaattggaccaatctatcaccctattagaagaactaatgttagtataagtaacatgaacattctt

SEQ ID NO: 513576 - DNA, 271 bp, Homo sapiens
  misc_feature (18)..(18): n is a, c, g, or t
  misc_feature (241)..(241): n is a, c, g, or t
gcagtcttctcccatcangggattttatacattgacctttgttggttatcaaaaagcagtaacgactgatgggacgaagatgcgtcttcgtcccatcagcatcctaccagcctctacagatattttagaaagaacaattagagcagctgtggaacagcacctttttgatcttcagagcagcatagatcatgatcttaagaatttacaacagcaaagtgtggtgtgtaataatgaagcaganagtattcattctcgatgggagcaagatgcg

SEQ ID NO: 513577 - DNA, 271 bp, Homo sapiens
tataggatccacatatgcgagctccattacatgaaactaaagacttcgtgcacttgctggctcttgaggggtgtgacctcggaatagcattgggatcttggagacactgaaaatgggacctatgtctttgggggagtccccgagctcctttctcagctgctgcaggtcccacagcctcatcttgagtctggcctgctcctcctgaagggcgtggagggcggcatccagtggggctgacatgggtctcgggtctgtttgtggaggtagcact

SEQ ID NO: 513578 - DNA, 286 bp, Homo sapiens
  misc_feature (21)..(21): n is a, c, g, or t
aggtgactctagagccgcttntatgaggaacgtcactgggatgaggaacgtcactgggatgaggaacgtcactgggatgaggaacgtcactgggatgaggaacgtcactgggatgaggaacgtcactgggatgaggaacgtcactgggatgaggaacgtcactgggatgaggggtgtaggcacgaaggctagagaaggaagagaagtataccgagggcgtctttgattgtgtagtaagggtggaaggtgattttatcggaatgggagtgacgttcctcatcccagg

SEQ ID NO: 513579 - DNA, 101 bp, Homo sapiens
cctttacctatagcaagtttgaacaaactcacaccaacatgacgcacgtgtcaagaactacgggctgctctcactgcttcaggaaggacatggacaaggtc

SEQ ID NO: 513580 - DNA, 892 bp, Homo sapiens
ctaaacctgtactgtaactaaatattgtaggcaattttaacacaaagtatttagctacaaagtattcatttagctaaacatatctaaacatggaaaaagaatttttcaattgcattataaactcaggatgaccgttgtatctgtggtccatcattgatctaaacattgttatacagtgcatgactgtacgagttaccatggggtttatggtttccaagcacaatcccagacagaatagaagacaattaactattacagtcaaaaacttcttacagctcacataaatctgaatccaccaaatcaaagaacaaaatcctcttcaatatgtgcctgatgcccaaatttcaaaactccaaagtaaatgaatattaaacaagtaacttgccaagacttgggctctccaaagtggagataattaatgctatagaggtccatgtcttcggtgtgccatgcaaacgtggtcttccacatgccaaaatagagatatggggtatttacaccctcaatagaaatgccacactcttcttcaaccacatccaagactgtattgaggcgagctatgttccattcatccacaccctggaatgagagagaaaaaaagagggagaaatcaaatcttactaaaccatgaaagatagcatttactaatcaaaccactatccaccaaaattattacattgtatattctaactaactgaaaactgaaaaataaaacaactcttattcaagagccacatacatatgtccattattattggtcaaagattactaccagcataatgctggttccatacaactatctggtagaaatttataccaaatagcttcctgatgccaaatggaaagtgaaagttacagacccactcccaacttggctgatcctatagatgtc

SEQ ID NO: 513581 - DNA, 855 bp, Homo sapiens
  misc_feature (148)..(148): n is a, c, g, or t
  misc_feature (151)..(151): n is a, c, g, or t
  misc_feature (191)..(191): n is a, c, g, or t
  misc_feature (220)..(220): n is a, c, g, or t
  misc_feature (227)..(227): n is a, c, g, or t
  misc_feature (229)..(229): n is a, c, g, or t
  misc_feature (236)..(237): n is a, c, g, or t
  misc_feature (280)..(280): n is a, c, g, or t
  misc_feature (290)..(290): n is a, c, g, or t
  misc_feature (298)..(299): n is a, c, g, or t
  misc_feature (325)..(325): n is a, c, g, or t
  misc_feature (348)..(349): n is a, c, g, or t
  misc_feature (470)..(470): n is a, c, g, or t
  misc_feature (486)..(486): n is a, c, g, or t
  misc_feature (529)..(529): n is a, c, g, or t
  misc_feature (594)..(594): n is a, c, g, or t
  misc_feature (721)..(721): n is a, c, g, or t
  misc_feature (784)..(784): n is a, c, g, or t
acacgtttgagagctcccagccggcaatcctggacttccagtgctcaaagggcggagagaatctcagcgtgggccaaaggcagctcgtgtgcctggcccgagccctgctccgcaagaaccgcatcctggttttagacgaggccacagntgncatcgacctggagactgacaacctcatccaggctaccatncgcacccagtttgatacctgcactgtccngaccatngnacaccgnnttaacactatcatggactacaccagggtcctggtcctggacanaggagtagtngctgaatnngattctccagccaacctcattgcagntagaggcatcttctacgggatgnncagagatgctggacttgcctaaaatatattcctgagatttcctcctggcctttcctggttttcatcaggaaggaaatgacaccaaatatgtccgcagaatggacttgatagcaaacactgngggcaccttaagattntgcacctgtaaagtgccttacagggtaactgtgctgaatgctntagatgaggaaatgatccccaagtggtgaatgacacgcctaaggtcacagctagtttgagccagntagactagtccccggtctccgattccaactgagtgtatttgacactggactgtttcaataacgatttatgaatgaccttgcctcctctgattttcatatttctaaagttcgttctgcttttaatacnaagcttttcctctggacaggagaagctgctggtcaggcaccctaggactcaggctgactctgnggctgccgaatcctaaaatggagtctgagaaaaaactcatggcacacgttaaaaaaacaatctaacaaaaa

SEQ ID NO: 513582 - DNA, 158 bp, Homo sapiens
agtcatgaaaatccagttacaccgtaaaaaccccggaaatccaaaaaccgcataaaaaaaaggggatcacaaagaaaaagaaaaaagatagaaaaaaaaacgaaagagaaacaatgtaaaaaggaaagagaaaacaacaagaaaaaaggaatatgcag

SEQ ID NO: 513583 - DNA, 465 bp, Homo sapiens
agcacggatacccgtataacgtagtagtagtaggtcgtatcatatagcagattgtcctccaaaatccatctctgactgtggccgagtcaggtacagagtccatcactcctacactatagaaccttttggcctgactgctgtactatgccccctgtgggctccatgcatcagccagaaagagctatactaaaacctcaatacacgtcgtgtctactctacagctcaaaagtaccccaaagccctcttatttactagcatgaaggataaaacccaaagggccccaatgctgcctctgcttacctatatccctccacttcatacacacttcagactgcactgacagtaatgtacatcaactctattcaaagctcatacctgcctacagggccttagcacatatgtaccctcaacctaaaatgtacttctactacatattctcctagtaaagatctaccacacatcata

SEQ ID NO: 513584 - DNA, 473 bp, Homo sapiens
tcagactaaataggctcttctgggtctctgagatccatatgaatttagaatttatctgttctatttctgcaaaagaataacactgctgatttcgatagcggcttatatttgacatctgttagagttgttcttgggtaagtagatgcatactttatcaaaatattatggattcctaaccatgaacacagaaggtctttccatttagttgtgttttctgcaattttttctgcaaagtttagtagttttcagtgttgaagtgtttcgcctcattggtaaagtttattcctaagtattttattctttttgatgctactgtaaatgtgattgtttcctcaattgccttttcagattggtcattgctgatgtatagaaatgtaactgacttttgtgtgttgattttgtgtcctgcaactttgctaaatttgtttattagttctagcagttttatgtgtgtgtgtggaatcattagggtt

SEQ ID NO: 513585 - DNA, 1406 bp, Homo sapiens
  misc_feature (386)..(386): n is a, c, g, or t
cctctttgttcgctgtttgccgttgctttcgcctacggtcgtggtgtttcgctgcgtctccctcatctctgttgtttctccctggtttcctgcttgcacgctcgtgcgcttcttcttcctattttccttatcgtcagtcggggtcccctgctattcgttgtcactttgtgagcgcctcttctatgttcgccggtttctcttgttggtcctccgattccccccaggcgtgtggtgtctctcggagggttttctcctttcttcctgttgttgttctcggctctcagtcgtcccttgcttcctttctccttgtttctgtgatccactggttttctcctccttgtcacagcggctgcttgcctacttgtccgcgaagcctcgtgtctatntcccgggtctgccctttgtgccttatggtatacggggtcgcggttctcttgtggtctgcttcacctttcgtcatccctaattgaaccccgcccaggttttcctacccccgtttaataccgtggtcgttcaatactgttctgtttccctctctctgcttacatgttcttaccccctcatggagaatctttgcagcttcccagcaagcaagtcacccttaggttccctgccccagcctcatctgttgatccccgtacgcctgggttcataaagtccacctgccggtgctccccactgggatagctgccatagtcccgttggcccttacgtagcaagctctatggatcgcattgcccgtgggtccctcttcaggccctgcctagacgtctacccgcccgtggaatgcgcactaggcataaccagcgttctgccacatcactccactgtaactctacctgcacattgtcccaatgtcctaccatggcaacctcacattgttcaacgtccctttctcgtgggtcgttacagtacgagtacaactagcacacaggcagtcacagcccgtggaccagaggctcgagagggctcaggaggctcaggcacccgtccatacactgagggccccgtgggtgggcctggccctgctgtctacgccaatgttatgtccagctccatgttctctccaaatataccgcttgatgtgaattatttgtataaggcataaaccgtgctctttatctgttagacaaacactgatatatcatcaactcgcggctaggtcattctgtttgccacatccctatagatccactcgggtttggcaaaactcaggcagaagtggagacccttctagacatcactgtcagccttgctacttgaaggtacacccccataggctccggaggtgtcatgtccccatcttgccccacgttgtccgtgagattaacccctccactgctgggggtgagctgtactcttcaagacctgccccctcacttataccgagtcaaaatactgtcaat

SEQ ID NO: 513586 - DNA, 353 bp, Homo sapiens
gtagctgttctcggctatgtggctatcaatttagagatgaggtagtcggatcatctgtatatagtagcatctattgatcaaaagggtgatattacaattacatcgagttcacacgcatcctgagtacatcgagccgaagatcggatatgcctgtagtgatctctaaattgcatatacacgttccttgtcgccacttcgggtatactgagattttctcttgcatgcccttaatttaactgctgttgtcttttcctagttgtatttgttgctcatgccattcttgggcatatgtctctttataatcagactggacacgggacttcctattgatatcatcttcagaatccaaatca

SEQ ID NO: 513587 - DNA, 1141 bp, Homo sapiens
cagtgtacctaggggttttctccccagccgtcgcaacacttcatggtgtaagcgtcataccaacctacataccctccctttggcgtcaagtttagcaatcccgtggtatatatgctggtgagttcatccgcccttggatctggagaaaacattaagggcgtccgtgggacaccccatgtctctgggcttttccaaggcacctattcgctgatacgcggacgggttgccccaaaccaatgggacgcctcgtatcggggcaatttcctgggttggttcgtttacaagccgttccacaggtgtgaatgcctggcgtggctgttctaacgactggcctgggggaaccgtgcttcctgctgggagcgcttgcccccgttttttgtatcctttactggctacctcctaagtctctcctcatggaacccatcttattccccctgttccccccgtagaccctcctaggttctagcccggcttctcgtgagattccaagattgttccctctctgttggacatcccaaccctcgcactgtggaacattgtggattacgctatacgtactggcccaaccgaagaactggaatggaacgacttcatggtttcgagcgaccttctgcgccggcattccggcctcgaatacgctgtatagaaactgaactcacggaacataaggaaaggatccatacctcctgtctcaggaaagacaggtgcttaaggtaagatacgggacgggccatggggggctttgcggagagctgttgatggcgccagtggtattgaagactccgccacctcgtcaatgcggggatctgttcccagcccctctgtccgcttgcccctcagcctgggaagccttctatgcaaccaatccgctgtcgacactctcatcccgccatccgccacgcaagactagcacactgggacctctctcttgctgaatagtagggcatgaatttttacgactgcaggctctgcttctccagccccggccgatgggtggcaagctgtgttcatacctaaattttcgggaaggggacagtgaaaagaggaagtgacaggagggaaagggggagacaaaactcctactctcaacctcacaacctaacacctcccattatcagctctctctgcccccattccttaa

SEQ ID NO: 513588 - DNA, 107 bp, Homo sapiens
actttgttctgagcccttctcaggcagaggaggtcggcaggtacacgtgcctttggaaagaaggtggtggaaaaatatggaataatgagcccttctgtcgtcttctc

SEQ ID NO: 513589 - DNA, 311 bp, Homo sapiens
tctagagccttatagtcccagagaacgaaactgaagcgcaggaatcagcagacaggaagatcacggtcatgatcgccaggccggtcatgacagaatcagtgcccatcatccttggatgtcccaactctactacattccccttctcctgagaccaccggatcaagacaaggctcctctcccctctctataccgggtgaggatgtcaggttaggagattgcataatccagggagaccagcgatatcgtagtagcccctcatcacgtgcttgtagagaacctactgccagtcctccagctgtacctcaaccagt

SEQ ID NO: 513590 - DNA, 110 bp, Homo sapiens
ttgtgcatgtgaggatccagcaaggaagcccttatcacaccagatgtgggcaccttctgcttggactttccagcctccagaactgtgagaaatacatttctgttctctgt

SEQ ID NO: 513591 - DNA, 120 bp, Homo sapiens
ataatctccaccctcacggagtcgtcatcaccctggagaggacgaagacagccaaaagagagaagtggtgtcttgtagcacttactagattcacatagtatcatccttctaccagatgtg

SEQ ID NO: 513592 - DNA, 103 bp, Homo sapiens
agatttcttaaaagcagctgtgccttggaaggggacatttctcacagtgtggccccaggcctgccacactacaacagcagagctgcttggtgaggtgaacaga

SEQ ID NO: 513593 - DNA, 600 bp, Homo sapiens
  misc_feature (303)..(303): n is a, c, g, or t
  misc_feature (312)..(312): n is a, c, g, or t
  misc_feature (314)..(314): n is a, c, g, or t
  misc_feature (319)..(319): n is a, c, g, or t
gcgagacctcagaaaaagaacatgcaaagaagcgattgaacgacattgagtgacagtgacaaaatgaccatagacagacttaatgaacaatgccagtgaggagtatttcgaaagtagaacagaaatataacaatactccgccaaccatttgttcaggacgaggtcaggacttgatcgcgcaaaatcccaacattcttgggagtaacaacattgtgtcaaccatccacgaagatgtctgcactgcttgcgggaggaagatgaagaggcactgcattatttgaccagagttgaagtgacagaatntgaagatantnaatcnggttacagaatagattttgagtttgatgtaaatccttactttgaatatatagttctctcctaagtatttcatctgtatgagtgtggtgatccatctgtcgtagtcctccgttatctaatggtaatctggaaaggactttgacgtatcgttcgagtcttatcgcagaattaagcacatctggaatgatgcagcatgaggaaccagagagcttctttacctggtttactgaccattctgacgcaggtgctgatgaggtaggcgagctcatcactgactcgatt

SEQ ID NO: 513594 - DNA, 150 bp, Homo sapiens
  misc_feature (129)..(129): n is a, c, g, or t
actccttccttcctcagaaccatctctattctacaaaacccctctaccatgccagggcacgcccattccagctgaataatgggctgggcacaggggaatttttcagagctaagcctgacgtctactctnaagaatcttagaaggttccca

SEQ ID NO: 513595 - DNA, 667 bp, Homo sapiens
cgttggtctgtccgctcgaagagatattctcagaaaagtacatgagttggaaaacctgagtcttgagttcataagtagcaggttaagagaattgagacccctagactggaaaaagctcattatgggagtgaagtgcatcctttacttgccatgtcttggcaataggttatatccttataccagaaaaaacgagaataagccatcatgctttgctgggagactgtgttttactaaatttacacgagtttatgggtctggttagccagatcttggcagcaatgaaccaaagttgatgttattaatcgacgtggggctggccaggcgcagggtggtagctgcagcgtccgcgtgatacttccaactcttgtaatccagcaggggctccttcatcctgtggcagactgctttgtcccattggggctttggccccagcaacttcacttgcatccttggcgcttgtctctgaactctgtgagaaataaagacagtggcctacactacaggttgagagtagatgcaggagttgaaaggggagtgtcctgtcttatcctactgtcattcaaagccgcttttccaactgtccaggccaaatgagatccctttggtttacgtcatggcttggaacttgccgattagtgtacggtggggccataatgtcctgtacccg

SEQ ID NO: 513596 - DNA, 198 bp, Homo sapiens
tgaggttggaggactagtggggaacagatggtacttgagtctgaagcttagtggcaggcacagggcggggaggggtgtcaggcctggaccatgccaggacagaaagcaggagcagaacactatcccaagaaagacctacggagggactctgcaggcgcagggtgcagcaggaaagtttacacccccggtcttccccag

SEQ ID NO: 513597 - DNA, 372 bp, Homo sapiens
tgtagatcaggggtctccaaccccagagccatggaccagtaccggcctgtagcctgttaggacctgggctgcacggcccgagaagatgagcagtgggcagcgagctttactgcctgagctccgcctcctgtcagatcagtggtggcattagattctcaggagcatgcaccctattgtgaactgcgcatgcgaggaatctatgttgcgtgctccttttgaggatctaatgcctcatgatctgaggtggaacagtttcatcccaaaacaatccccgtgccccagtccatggaaaaattgtcttctgcaaagccggtccctggtgccatgtcatgggttccttgatccttagaacacgtatctcttcatggacct

SEQ ID NO: 513598 - DNA, 1544 bp, Homo sapiens
  misc_feature (941)..(941): n is a, c, g, or t
  misc_feature (1544)..(1544): n is a, c, g, or t
gttgattctgtcgactcacgtcaggtggggcgcctgttctgcttgacgctagggttctacacggtgtgaccacgacctcactctcgaaggagtggtgagacccagcgaggacgcattgactacaagctctcaagtgcatatgtgagctttctctgcttgcgttgctaggagcgctacgtgtttccgtcacggaccgtgcgcgaacgcgctgcacttggctcgtgttcctcatgaaggtatccaatcacttcgcagaacgaggcggctaatatgtctcgttctatctccggtagagcgcatcttgtgtcaaattttgacggagcttacttgacttggtactcgttgtctgcgcacagaggctcacgtgcgcgcgagtcgtctaagaggatacttttgacaacgcaagttgcctttaactagggctcgccttaccttctggtggataccgttagcttgatgtgatgcgcgcgcatatcacaagggaggaattctattttgcggggccttcgagcatttccttttagcggcgttcaatggatgagttgggaaagagccggagagtatgttaatccggcctttgggtgaccgaataggaaaaattgggtcagtcatagggagttattgtccatcccttcgttgaggggaacaatacggacgttccgagttgcatttctgcataccattccccaagggctgtattgtcccgctaaaggtaatatgggggagagtccatcacaaggattgttgtagacaagagtttaaaagtataataccggcctttgggaaacgcccaaattaaaacacctttgttactcggaagcaccagaggtaaatgggttagtgaaacctatagcgcgtatcctttccggaaggagggcaaagccaatgtctacgcttggggaggcgcgacagagtgcggtaccggtacgcgccagaaaggnggggtaacctattggaggacgggtagggctaattgattaagcgaccaccggacggtggtctaggcttatagtgtggaaccgaaagttctatgggcatagaatagaggcgcccagccaaattggcaatttttggagtttcatacccgaaaggggtacacgtttggaagtacctttttgaaagggagaacgctttaaaacccgcgcgggtcagattatagcgcgttcgagacccggggtgggattgtaacggcatattggatatcggcaaatgtaacaacagtcaaatacggtacgcaaacattaagacgcgatttgggcacaacagcggatactttcctataagggcaaaagttccccttttagaggaagctacacatttcgtttggagatttgtgatgccacttcggcacggcgaataaccaaaggtaaaagaggctttgtggaagccgggtgcttcttcgcgacggttagggccaacatatcattagacgaaagaagatgtgacagccaccatatatcccattgtcgccaaggatttcctcatagacacagttattaacagcttatataatccacaggagcacgcctcaaagagagaagaan

SEQ ID NO: 513599 - DNA, 370 bp, Homo sapiens
ttgtcttatccaggagacctcgtccgatggaggatgaagccaaggacgaaaaggcagagcctcaagtagggtactaaatcatgttgggcctctcccccaggcggacccggaggttggcacggttgcccatcaaaccaacatactgaataaaatgcccccaggaccctggggaccccgtccagtacaactaggaccacagatgaggatgctgtcagatctgtacgatagagtgtctgtgacggcctcagaagtccagcaggcagagagcgaggtttcagacattgaatccaggattgcagccctgagggccgcagggctcacggtgaagccctcgggaaagccccggaggaagtcaaacctcccgatattt

SEQ ID NO: 513600 - DNA, 604 bp, Homo sapiens
  misc_feature (198)..(198): n is a, c, g, or t
aagggccgtgtgttttcccccccaaacaaaggggtttttttttttcccggccccccccccccgaaaatgccttctttttataccccaatagggcctttccggtcgccaaaccccaggtggtctctaaaacaaaggatacccggtcccttttttgggggtggggtcccccgcccgagcccttgccccctccccaatttnttaaaaaaaaaaaattcaacatccgggggttgggcccctttcccctcaaccccctgggaaaaaaattttttttttccagggtttggcccccccagggggggttccccccccggggggccccttttttttaagggggccttggtggggctttttcccctcccatattgggggacccggggttccctttcccccccccggccttttcccggggccccaaaaatgggaaccccccttagctttttaaaatttttggttttaccagggaaccccttcccccaactttgggggcccccttccccccgcccttggggggggtttaagtttggggggggggtttttcccttccctaatttttgggaaaggggccccaaaatttttttaaggggggggttaatattttttttta

SEQ ID NO: 513601 - DNA, 569 bp, Homo sapiens
ctggctgcacatggagaatatatcatcagcacatcaaaaagctatccaccatgatcaagtctgcttcatccctgggatgcaagggtggtttcaacaggatgcaaatcaataaacataatccatcacattaattagaaccaatgacaaaaaccacatgattatctcaatagatgcagaaaaggcctttgacaaaattcaatagcccctcatgctaaaaactcaacaaactaagtattgatggaacttatctcaaaatagtaaaagctgtttatgacaaacccacagccaatatcatactgaatgggcaaaagctagaagcattccctttgaaaaccagcacaaggcaaggatgtcctctctcactactcctattcaatatagtattggaagttctggccggggcaatcaggcaagagaaataaataagggttattcaaataggaagataggaagtcaaattgtctctgtttgcagatgacatggttgtatatttagaaaaccccatcgtctcagcccaaaatctccttaagctgataagcaacatcagcaaagtcttagcataacaaatc

SEQ ID NO: 513602 - DNA, 546 bp, Homo sapiens
ggccagcaggcccatcgccatgggtaggcagagttcaatagtggcctcacacaagatcagtcaacggcaaagcaacggcatccagaacaagcttaatgtcagtccataactcgttagacttcacttcatgcacggtatctcttaactaatgactgtgctgtacggaggactccattaataacatggaaatctccactctgaaagcgattcaccatttctgtcagcaagtcaggccatttctgtggaaaatcttctctgccaataatgctaattgcatcacttaactgcttctgaatttgctctgggctgctaagcatcaagtgcactatgttggctttgatggccactcgatcggcttcacaaattttgttgggttcatcttcaacaattctccagttccttttaatatagttttggaatgttactgaagcacatactttgataacattatcctgggacctctccagtaatgtcaaaagcaacagtggatacttctgatttccttcaacagattccagacatttctcagctggacgtcggatggca

SEQ ID NO: 513603 - DNA, 342 bp, Homo sapiens
  misc_feature (11)..(11): n is a, c, g, or t
  misc_feature (85)..(85): n is a, c, g, or t
ggccaccatgnctggccattttttcccttcttatacagaagacaagcttaggaggtaagggaggccaggtgtggtggctcatgcntgagttccagcactttgccgacgggggcgggcagatcacgaggtcaggagatcgagaccatcctggcccaacatggtgaaaccccgtctctactaagatacaaaaaattagctggacatggtggcgcaggcctgtggtcccggctgcttgggaggctgaggcaggggaatcatttgaacctgggaggcagaggttgcagggagccgggatcgcgccactgcactccagcctggcgacagagcgggactccatctcag

SEQ ID NO: 513604 - DNA, 106 bp, Homo sapiens
  misc_feature (50)..(50): n is a, c, g, or t
atggatatgttgccatcattgacccttcattgacctcacctccatgtgtncaatgttccattatgatccaccatggcacttccatggcacgtcaggctgagcacgg

SEQ ID NO: 513605 - DNA, 99 bp, Homo sapiens
cgactttccattgtaaagggcagcatcttatacaaagagcatagctgcctttcattgtggtcatgtaattaaactgacatcattgagcacagctttgca

SEQ ID NO: 513606 - DNA, 178 bp, Homo sapiens
acccagtgcagcatggcaacagggtttgtcaggtggcatgtgtcacatgtgtggccattttcgtggttctgcaccgcagcccacatcttggacaatgtctcacgtgatggcacacagccacaggcccacaggtcatcagcttatgcaacactagtcattcaagcaacagcaaccatca

SEQ ID NO: 513607 - DNA, 343 bp, Homo sapiens
  misc_feature (64)..(64): n is a, c, g, or t
  misc_feature (77)..(77): n is a, c, g, or t
  misc_feature (342)..(342): n is a, c, g, or t
cggaaaggctccagtggttcctacttgatccaaaaaatgtcaagaattaatctaggaggccggncctggtggctcanacctgtaatcccagctctttgggaggccgaggcgggtggatcactcaaggtcaggcatttgagaccagcctggccaacatagtgaaaccccgtctctattaaaaatacaaaaattagctgggtgtggtggtatgtgcctgtagtctcagctactcaggaggctgagacaggagaatcacttgaaccctggaggtagaagttgcagtgagccaagatcatactactgcactccagcctgggcgacaagagtgaaactccaccttgnt

SEQ ID NO: 513608 - DNA, 310 bp, Homo sapiens
  misc_feature (5)..(5): n is a, c, g, or t
  misc_feature (51)..(51): n is a, c, g, or t
caggngtggatttacaagggtgtgaatggcaggaggtgagggtgatcaggnccatttagaggctgcctaccagtgttgaagaaaattgttgacttctatgagctgtagcagcagacagtgctatgcaaggagaatggctgtctcagaagtccagctcctcacatgggtttaaacgtgttgccttttccccctgatacattttgtttaaatccatggtcatcttgccatttagtggtgtggtttaattgcatatttgggttagtctgtatgtaaacatttaacataggtgtctctgcctgcgaacctatga

SEQ ID NO: 513609 - DNA, 930 bp, Homo sapiens
ggactggcggcaggctcgccgcgggcggatcccggctgcgggatagaccgagggccatggcccgctctcccggacccgccggggttgggggcgccgggagcagtctacggctcgggctctagcggggctttcgccttcggacttggggacgtgaagatcaaaacttcgctggggtgggaagcagaggatactccccgtggttatcctcagaatcaccagtgccttatttattcataaagggataataaccaaaaaagtttttgtttaaaaatctctgcaaggcaattccggggtgtagggcaaaccgctggtcaatttgtgcccagtttggacaagatttgcgtcacaggtaaggaggaagctattagcaaatgaaaagggggattgtggaccaggacagaattacattatgccgtctggtatgggaaggctgaaacaagcggggaggaaaccatgtggcgggcattaacaggaatataaccaatttgggaacccatgtggaatctgggtggggcaggatcacatttttctacaggacaaacagggagtgggataaagggtggcaggattaccttctttcttcggtggacaaaagtggttgtggtggcagaccggagtagtctttaacacaggataattaaccttcaacgaaattaggggtcttcgcaactattggaaggacttagagaaaggtgaatacgttcaagagttgtgtcccaaatattcggtcatggggaatgaatggggggtcgcccatctgggtggggttggacaatggttccacacaagaaagacgaaaaaagaatttgggggcggccgaaaatttaacaatgtgggggggcccgagagaatgaatgtatgtgttcaagaagcgctgtatgggtttcacaaaacggggcgttgaaacgggtggtgggtaagaagaagcag

SEQ ID NO: 513610 - DNA, 414 bp, Homo sapiens
gcctcagcctcccaaagtgctgggattagaggtgtgagccactgcaccaggctgttgttggcatattttaaagctagatctagacattgacactgagtgtttaattaataagaacattcttatgttcttattaattacacgcctgtaatctcaacactttgggaggctgaggtgggtggatcacgaggtcaggagtttgagaccagcctgatcaacgtggtgaaaccccggtctctattaaatatacaaaggttggccaggcatggtggcgggcgcctgtgatgctggctgcttggaaggctgaggcaggagaatcgcttgaaaccagaaagtggaggttgcagtgagccgagattgcgccactgcacttcagcctgggtaacaagagggaaactccatctcaaaaaaaaaaaa

SEQ ID NO: 513611 - DNA, 297 bp, Homo sapiens
tgggcccaacagggctgcattgcggccacacacgtgaggttgctccccaatgagatgtggatctgtgtgtgtgcacgtagcgtgggagcatccccgccttgtgttggatctgtgtccccatggaggagggaggtggggtgtctcccccaagcacagcactcaagtcttcacaggacaattacatggcggacatggacgagctttcttctcaggtggatgagaagaggaaggttagtgtgtgtcgcttgctgacaatggctggcaggtactcgtgcagtgccccttttcgggtaccga

SEQ ID NO: 513612 - DNA, 428 bp, Homo sapiens
gctctgtgtgggaactcaacctccacacagctaccatgagtgcaatgtagctctgtgtaggaactcaatctccaaacagctaccatgagtgcaatgcagctctatgtggaaactcaacctccacacagccaccatgagtgcaatgtagctctgtgtaggaactcaatctccaaacagctaccatgagtgcaatgcagctctatgtggaaactcaacctctacacagctaccatgagtgcactgtagctctgtatgggaactcaacctccacacagctaacacgagagcaatgtagctctgtataggaactcagcctccagacagttaccatgagagcagcgcagctctgtgtgggaactcaacctccacacagctaccatgagtgcaatgcagctctgtatgggaactcaacctccacacagctaccc

SEQ ID NO: 513613 - DNA, 406 bp, Homo sapiens
agatcctcatacaggatcccacgcgttaaagttaactattaagagcatcacatttgtttgggtcctgctcacagcccagaatgacaacagccaagtgtttgtgttgcaggatatggacataaatatgtaggaagcgcacatctctgtatacattcattcttgtttgagtctgtcatgaacttcctctggacatccagctgaatgctcatataattcatgtagcatactcttacctgagtgtgctttctctgactcctgaccttacgctacacttgcttgtccctatggggtggggattaggatgtgagaggttcgatccgtttctgcctcatggccaagactttgaatcgtgtctccgtttcactttgacgcggggtacctatctcgtctacctgctcgtgttcat

SEQ ID NO: 513614 - DNA, 456 bp, Homo sapiens
ttgcccctaatgtgaaatgatggggcagacataaaataacaactccagtgattttagtttaaaatgagggaacatggaggggataaaaaagtccttaacccaaaaaagtttggaaaaggagttgggcaaaatccaccaggggttttttagttaggatccccagcctggggctgaccctttgtcctgggggtttttacctttggggtttttggtttgcattttttgaaaccattattatttttcattttcctcccccttttttggggaggggtcctattgccctcaaaaagtttttgagatttatccatgttgttttgggggtcaaaagtttgttcctttagcccttccatggaaagaaggtatcccagttttttgatccctttttgtattgaaaaaaatttgaatgtttccagtttttccttttatgaaaaaaaatgctatgaacatttttgttta

SEQ ID NO: 513615 - DNA, 101 bp, Homo sapiens
gacatatgacactgtctgttagatctgtctttcttccgtattctgtgcagagaagattgttcttctgaccttgtgaaaggcaattaccatgtgttatcatg

SEQ ID NO: 513616 - DNA, 1263 bp, Homo sapiens
ggcttgactcccagcattctcatctcaccttgccatactataagatgtctggtttgtctcatggctgcaagttctggcccgccacggactgggcaccagtcagcaggcatggcattaccagcaacatcacgcagcagcaggcattcacatcttttacattcaatccattccactttcatgcaacacacctggcatgcaagcaattcaaatgcaagcacattaagccagacaaacagtcggttccagcatgattttcatcgtggctagcagccaacagcaagtgccccaatattctctgtcagtcacttctcatgcacagcacatcattcaatcctattaacgtgccatgcagctcatctcacaggcacagctgcgatcactctctggcgtttatcaatcagcatccttcagtgcaccatgtgcacccacaggccagccagatggcttctgcacaacatgggcagcatcttgcaccatgccacagcaaatgcacaatgcacacacagcccattccagcagcatgcacagttggatcatgtaggacttccattcctggcaaccttcggcatgttcgcattccaaccagcagcaacagggcacagcattgttccgaaccagagcattgcaactccacttgcacaggaaactccagcctggcattgcttgtggcttcagtatctgggcttgcagaagaacaacgaacattggacattgacggaagcagattccttctttaaggtgcttcgtgcataggatgaagatacacaaccctcagctcatgggcacacctacgggaagccccagactcagagcgcaagatctcccagatggtggtcactccaggaccccttaacaaaacccacatcacacgaaactctggagaatggataaaacggacagacacactgacacaaacaatgccaaccacccggagcactccgatcaatgcccgcagaacatacaggccatacagagcccacgggatcacgctagcaaaataccggacaccacaaacggaacagactaccaaggacgcagccacaaacaggaacaaaatgagggccacacacagcaacccacaaaccgaaaggggccgtgagaaacccaggacgaaccagcacaacgcgaaaagcaaaagcgcaagcgacacagcgcaagcagccagcgccaacacgccacaagcgacaacacacgaccacacaacacaccccagacgcccaacatgcaccgccaaaccaccagaactcagaggcgcgcgcgaag

SEQ ID NO: 513617 - DNA, 843 bp, Homo sapiens
cttcctgaaccagatagaagttcaacgagaagtatgtctggaataagagagaatagcactgagtaaagggagtcctctgggagaagtggttgaacatgggaataactagcggtgtgaggaacgactcacagatgcaagttggaattgtgcttgaaagatgctaaagaggcaaagttctttgggtatgtttcagctcctagtggccgttggactggaatcacattgctctttggggaatgaaccactctgagataagagaagataaatagcccgatttgcccccgaggaattagcacttgttcacaacttgaggaaaatgatgagaacatgactaggcatggaggcgccatgtgtagtcggttttgagccagactgggtctctctttaagcccctggaaagcctagtctggccccaggagttgctgggaaagctcctaacagaagaaagggaactatgacgagctgctgttcctaagtaacagcgaaccccctcagctgctggagcggcagctgtgccttacctctaagccgaagatcactagcatgttgaggaagcacagtggacatctgctttatgcttggacccgagtaaagatgaggaagtcgggcagtacacaggaagaggagccaggccctttgtacctatgggatggaacaggactgcaggttggctctggaccgtgcattaaagctgggtttgcaagggtgaatgcgtgaaaataagatattcccttgttcgttagactttatatcaggtgattggatgtggctttcaacatttaagataattaagggccttttcgtaaagaatagaaaatcttctaaggggtgggttcgatcata

SEQ ID NO: 513618 - DNA, 351 bp, Homo sapiens
tgtttgagcctgttgagatcgcgccgcactccagcctgggagacagaacgagactccgtctcaaaaaaaaaaatttagctgggcattggtggcagacacctgtaatcccagctaatcaagaggctgaggcaagagaatcgattgaaactgggaggtggaggttgcggtaagccaagatcaggccattgcactccagcctgggtcctgctaccttgaaggacagcatagctaaactgcgtggcccaagggacagcatgaatgcagaatatagctttcttcacttgtggcctattggcatagctgcccaaggcctccagtggccgacttcatggcttggtggtctccatctgt

SEQ ID NO: 513619 - DNA, 383 bp, Homo sapiens
aaacctttgtgggaaaaaaaaatcccctttgaaactccgacttccgtggataccccataatttaaaattatgtgaaatgttttaaatttgggaactcggaaatactggtttaaagattccgtttcttcaaagtgggaattggataaaaatgctattgcagccttaccttccaaatgatgggcccgtaaacccaggagttttccccgtttgtaaaaaaaccttgtaaaaaattgaatgttttattttaaaaaggtccttagtttcctgttaccccttttgttagtctgggttttgttgcctaacggggttaaaattgttctttaaaaaagttgatgctatgttatggaaaacctttttaataaaaggtgtgttattagccgtta

SEQ ID NO: 513620 - DNA, 414 bp, Homo sapiens
gctcgacaacgtgctggacaagtgtcaacaggtcatctcgtggctggacgccaacacctaggccgagaaggacgagtttgagcacgtcaggaaggcgctggaccaggtgtgtaaccccatcatcagcggactgtaccatagtgccggtggtcactggcctccaggattcggagctcaggcgtccaagggagggtctgggtcaggccccaccatctgaggaggtagatgagatgcctctccaagattagctgcctctctagtggatcttcgagactgtgcacatcctagtagctcggaacggcagtcctccagtgcctgtgatggcaatgagggaatttagtcgtgaagtactggacctgcagcattgccggtatctacatgcagagatgaatttatactgccatcttacgacta

SEQ ID NO: 513621 - DNA, 1181 bp, Homo sapiens
  misc_feature (1181)..(1181): n is a, c, g, or t
gccaaggagcaggctccagacgctgcttaggaaccggggacccgggagtgcccgcaccctgagctctcagctccggaggcgtcatggcagagtacggaactctccttcaggacctgaccaacaacatcacccttgaagatctggaacagctcaagtcagcctgcaagggaggacatccccagtgagaagagtgaggagatcaccacaggcagtgcctggtttagcttcctggagagccacaacaagctggacaaagacaacctctcctacattgagcacatctttgagatatctcgccgtcctgacctcctcactatggtggttgactacagaacccgtgtgctgaagatctctgaggaggaggagctggacaccaagctaacccgtattcccagtgccaagaagtacaaagacattatccggcagccctctgaagaagaaatcatcaaattggctcccccaccaaagaaggcctgaacaagggggaggaagaggaggaaggttggatcttcatcagaccactcccttccccatcctcaatgggaggggctagggcaaccccctgctccgtacccatttactaacttggtcctaacccttactatgcgcgtgtgtgtgcgtgtgcgcacgctctggctgtctgtctgtctagctcatctagttcctcctcctcatgaggggctcggcggcagcgaggggggggcttaaattcccccgattattaggggcaggtggcaccgctttcctcttgtggaccgagaattgggcattctcctccttttccccttcgtcactcttcccacatctcttggagcgcacggcctggtgtgccaaacggggagcccggcggcacaagagcctcgcgcaaacgcgtgggttcttaccagacaccacgtggggagagcacagggaaaagaggcgcagcaacacccacccggggtgcgggcgctcaacaacaccggcagacgggggtgagcttcaacatcggacccgggtaaaaacccacggggtctctcgaaacaaacagtatagaagaggcacacaaccaagaatgagcgaggagcgacagccacttaaataaaagcacgcgcctcatcacctcgaacgaagtagacatgtgatgggacccacgcgaacacaattgctaccgcgcgtgcggacacaacagcgtacctagcggn

SEQ ID NO: 513622 - DNA, 263 bp, Homo sapiens
caaaagcgcatgaatcatcttaaaacatatctagatataagctatggatatgtacaatatataaataaataacataacatagcacacagttgatgcaaatagagttagagaaaagaaacatacaagcagaataggtaggctatttagtaagcaaaacagtgtctccctcacattcatcaaatccacagccatttagcatggagcttcattcatcatttacatttatgcaatcaatcacacacataaacgcatgtaaatcatag

SEQ ID NO: 513623 - DNA, 136 bp, Homo sapiens
  misc_feature (3)..(3): n is a, c, g, or t
tgntcgtcggatagcccacaggcagtctgggtttaaaagaagcagaaggctgcggggatagatggaaggagggctggtggagttaattgtggttacatagtttcaatggtattaactaaaattaagccccctccac

SEQ ID NO: 513624 - DNA, 96 bp, Homo sapiens
gccctgtatctctgtgccagcagccaagatgaaagggagggacagggctataatgaaaaactgttttttggcagcggaacccagctctctgtcttg

SEQ ID NO: 513625 - DNA, 293 bp, Homo sapiens
  misc_feature (172)..(172): n is a, c, g, or t
tgcgaaagtatatccccatctgaggaaggctgaggtctcagaagagcgatgagaggcagggtgtgtgcattgcgctaagtgagatcatgaagtccaccagccgggatggcgtgctgtatttctctgaatccctcgtgcccacggaaagggaaggctttgtgtgaccccactncaggaggtcagagaggcggcacgcaagactttcggagcaggtgaattccaccaatcggccaccaggttctggaggacattctcccatttttactaaagcagctggataaacacgttcgcaa

SEQ ID NO: 513626 - DNA, 566 bp, Homo sapiens
tgttctagaggatcccaatcagttaacaagttaactccttgaagaagggggtgggtaaggagtccttaatgtcttacaaatcaagggggccagatggagttcgtccggctttctcagctaagcgagagttttagtcatgtggaaacaaggctaggtgattaagagagcaaaagggagagtctaaaaacagggttagtaaaaacaatgttgggcattacattcaccacccatgttttcggggaatcaaatggttgattcctcagttattaacaagggtgtcatattgagtcttaagatacgtaagtttgacagaagctatgcgtggttttataaaattaagaaacgaatttaatatacaaggcccaaaaattaaacttaatagtaggatgaggagaggtccagctaacccagtgattaaagtagttagccatgggttccagttaaacatgctttgataccaggggatgttattttctcgttcttgttggtgcctatctcgattttctcgaacttttttttactgtaccttttatgactccagattggtgtaaacgggtaccgagctc

SEQ ID NO: 513627 - DNA, 174 bp, Homo sapiens
gtgtcatggaggcctacgagcagggtcaaaagggacccctgaagctgaaaggcgtcgcagagctggggagtgaccacgcggaagaagagaaagagggacaaagacaaagcgaaactcctggagcaatgggacgagcaaaagacgaggaggagagcggccggcctggcaagcgga

SEQ ID NO: 513628 - DNA, 1473 bp, Homo sapiens
  misc_feature (87)..(87): n is a, c, g, or t
  misc_feature (163)..(163): n is a, c, g, or t
aacacagcgatcgatcctcttctagggtcatccggcgagcgatggagggcgcggtccggccagcgcagggatggagtgagtggatantcgggcggagcgcggatcgactcagatgagaagaaccttctcgagcaagtggtcgaccaaggagctccgcgacttnacaggcagtgggcagaacacagtggccaccacgcgaggacgcgtgcttacacgccttgcgcgagtctgtcgtcgccgtgcacaggcgcagcacgacgaggcctgttgaagtggcgcttggcgacgaatagtggctcaaagacaaggtatctcccctattggtagtgcgacgaagcgatgcgacacgcaagtatgtcgacatggaggtaggagacaactaccatccaactcccgtgagacaagctaacgcccacgactacggcaaaggccatcgagccaataccgcgttcgaccacgaaatcgtggcgaggaccaggatcgaatcggagaattggagagacatttcttggggacgaactcacctaacctccctttccataacctaatattggcaagacttcggcagttgggtcgggggccttccacggcaggggcaaggccagctgcgcctggcttggcgttgcccatgcaacttggttaggcgccgccgcttcttagcgaatgcgcgccattcggtactccataactgtactgaagacagtgagtggagccacgggacaatccaaatgtctctgtgacaagagccctttctatgaccacccgctaatgtggcacctgactactgcaattagacaagtcatttctgaggaggcattggtggcctgaggcgccccttgcgctggactggcaccctcattggaaccccgcctacacccagagggtggcggtctagtcccgttggccagtggggcgacagtcatccggtgggaaggactcgcgccgcgggtcaaagcccctggcaacgtaggtgtgccgcccatctgtgacacgccagcgggagtgaaattagtgcccggtgctacgcaattaggacatttggcgcgagtgccgcttaaggcggatacctaattgtgaacacccgtgtggggcgcttggaagcgccaacgcgcgaaaggcttagggcaacatttaggagagtgacccgttgcccaccttaggaaaacacaatattccctatttaaacacagacaaggttggtcgggggctttagacagtggacagtaggtcgaacccgcgatgccgcaattgtggaacccgccatgccatgtgtggaaacagtctgagtgccctccttggatagcatcccacggggagaacacagtcgttggatgaactagaacgttcccctccaaggggaagcctgtttggtattcaaaagagacacatttggtgggcgcaagggagactcggacatttccacggagatcacacttcgtcgccatgaaaagacgcctatacaaagtggtgtcc

SEQ ID NO: 513629 - DNA, 394 bp, Homo sapiens
acatttagcatcaaagctgagctagctatgcacagcaccagctctggagggcctcatttaactagatcagggacctaatcttgggcttggaattgagcttcagagcacgcaagcctggctctccagagagtgttccatacggaaccaatatgctttgaacagattttgctcgctagactcgcttaagacatccaaagttggcttttggtgactgtcactcagaatcttgactgaaaattattgccataagataatgtgagatttaaccgcatttctagcaagtcggatgcgcttgatgcacagatgcacattagctaatagttttctctatgcgtgtttgtgtggaatgttgcgggcacaggataccagcaacaaccaccagttatggataccc

SEQ ID NO: 513630 - DNA, 226 bp, Homo sapiens
atggcgcgcaaagtgatcccatcgaggcgagccagagcctgatggccaagttcaaacaggagcgtgaggacaataagtacttcctggacacccggtcatggagccagctttcataattcagcacttcgcagggaaggtgaaagatgatatcaaggacttccgagagaggaatacggactacatgcggccagacatcgaggacctgctgcggagcagtgacagctac

SEQ ID NO: 513631 - DNA, 162 bp, Homo sapiens
gaacccggcttctcaacgcgctccgcgtcatggagatcccgggagcttttcaagaaagtcaagcttgagcaataacggcagaactggggaattcagagagcaaccaatgtcacctaccaagcccatcatgtcaacgaggacaagagaggtcaagtggttggg

SEQ ID NO: 513632 - DNA, 389 bp, Homo sapiens
  misc_feature (13)..(13): n is a, c, g, or t
  misc_feature (220)..(220): n is a, c, g, or t
gtttgctgtgcgntggtccccagtgcggcccttggtttttgcagctgcctttgggaaaggtgacgggcagctgtttgatttccagaaaagctcccagaaacccccagttttgatcaagcaaacccaggatgaaagccctgtttactgtttggagttcaacagccagcaaactcagtttttggttgcgggcgatgcccagggcccagtgaaggtgtggcancttagcacagagttttcgggaacaagggccccgggaagttgaggacctggactgcctggcaacaaaggtggcggcctgaggggtcccgggaggggggggcaagcctttgttgtgccgagccttgtgtttttgacgcaagccaaatgaaaaaaagcaaagctttggggga

SEQ ID NO: 513633 - DNA, 362 bp, Homo sapiens
  misc_feature (168)..(168): n is a, c, g, or t
  misc_feature (346)..(346): n is a, c, g, or t
gataaccaaatgtggtatgtccatacagtggaatattattcagccataaagaggaatgaagttctgacacatgctacagtgtagatgaaccttggtagcattatgctaagtgaaggaagccaaacacaaaaggacacatattgtattcttccatgtatagcaaatgtntagaatgggcaaatccatagagatggaaaggagattagtggttggcaggggtcgggtgcaggggaatggggagtgcagcttcagggtacgaggtctccttttggggatgatacaaatattctggaactgggccgggcacagcagctcacggctgtaaccacagcactttgggaggctnaggagggtgatcactt

SEQ ID NO: 513634 - DNA, 165 bp, Homo sapiens
acacacacgcgagcacagcacgcacgaacacagcacacaccaaacatatatcccacacaaagcacgccacgacaccatacaccacacacacacgacacactacacaaagcacataccaaatacacacatacacacacactacacaccacacgcacaccccacaca

SEQ ID NO: 513635 - DNA, 134 bp, Homo sapiens
  misc_feature (130)..(130): n is a, c, g, or t
  misc_feature (134)..(134): n is a, c, g, or t
ctcagacaagtggtataaaaaataatttatgtgttctgaatggaatgttttcgtctccatagtccaaaagaggaaccaatttctgtcattatcattggtccactgattaatgacgatggactgcgctcancaan

SEQ ID NO: 513636 - DNA, 120 bp, Homo sapiens
gacctccgccgtgcgcatttcctcagcgtcggtgctccacgaccgaatccgggacgactgggataggcccattctcttcctatccctcaacccagacatcattaccgggtttccctctta

SEQ ID NO: 513637 - DNA, 309 bp, Homo sapiens
ctacgagctacacgttcaaccaagtagaccctgaggcgtacgcctaaccgttaccattactgcaggcacacctactcatgcacctaattggaagcgccaccgctagcaatatcaaccattaacctatccctctacacttatacatacattcacaacttctaattctatctgactatcctagaaatcgcatgtcgccttattccaaagcctacggtttcacaccttcatagtacgcctctacctgcacgataacacataatgacccaccaatcacatgcccaatggccactcgcgaacgggaggataccg

SEQ ID NO: 513638 - DNA, 288 bp, Homo sapiens
gtcctactcttagcggggctttaaatcgctttagcctgggtaggcgggttgcagtgagccgtgactgagccactgcactccagcctggcaacagagtgagacagtgtctcaaaaaaaaaaaaaagtggccactttacaattttagcatctaaaatgattaaaaaaaaaaatggtagttgaaaaaaaccatcctgctggtttactcctttttttcattaattacccacattagttttttcagaacctcctatatggcaggatctcaggagttataaagcccccccaaaa

SEQ ID NO: 513639 - DNA, 202 bp, Homo sapiens
  misc_feature (66)..(66): n is a, c, g, or t
  misc_feature (118)..(118): n is a, c, g, or t
  misc_feature (132)..(132): n is a, c, g, or t
  misc_feature (146)..(146): n is a, c, g, or t
tatgtagcgtctgatctctccattaccacgttccatattctccctggactgactcccataattaanagcctcttaattattcccttctgcctgtacttcctaatgaagtccatatttnattctgttttaagntgtcaatctgatcntgttctacctttatttacttcaagggattcccactgatttagggtaaagaccgtcg

SEQ ID NO: 513640 - DNA, 181 bp, Homo sapiens
ctagaggaccccatcaacaataggtttacgaccgtcgatgtttgatcatggacatcccgcatagtgcagccgctattaaaggttcgtttgttcaactgataaaagtcctacgtgatctgagttcagaccggagtaatccaagtcggtttctatctacttcaaattcctccctgttcgacag

SEQ ID NO: 513641 - DNA, 344 bp, Homo sapiens
ctctagaggatactatgttatccccaacacttcgggaggctgaggcgggcggatcacttgaggccgggaggtttgagaccagcttggccgatgtggtgaaaccccatctctactaaaaatacaaaaaaaaaattggccgggcgtggtggtgcacgcctgtagtcccagatacttgggtggctgaggcaggagaattgcttgggctggggaggcagaggttgcagtgagccaagatcatgccactgaactccaacctgggcgacagagtgagactccatctcaaaacaaaaaaaacggagatggatgatgaatggtgttggcgatagtgttgggcgataacatca

SEQ ID NO: 513642 - DNA, 348 bp, Homo sapiens
acagggtctcgctctgtcagccaggctggagtgcagtggtgcaatctcggctcaccgtagcctcaaactcctgggctcaggcgatcctcccgcctcggcctcccgagtggctgggactgcgggtgcatgccaccacatttggctaattttttttttttttttttgcttttggtatagatgaggtcttactatgttgcccaggctggtcttaatcttccgtgactcaaaaaatccttctgacttggccccccacataccttcttttgcataattgcttgaacttctcctttagccaacaccctctgaattcatatgtttgggtaaccctgatggtctaaattgtggagt

SEQ ID NO: 513643 - DNA, 1401 bp, Homo sapiens
ggctcgtgccgaatcggacgaggccttggagtctcatgaaatgcctgatgtgtgacgccatgtccagcaatatctggggtgggcgacgatggtcggggtgaacccatcaggcatgcatggggcgtctgtcgtcccgttcccgacagagggcgagaaccgacatatggacgggtccgcggctcgagacgcgtcctgtactcatgagcgcacggattgtgctcggcgtgtgagatcctcgactgacgtgccgttccttgtgtcatgcacccctgacaccactctgggaagctccgcactagcgtcctgtcgcgttgggacatcgtgggcccatggtccttgacagcacgacagcagtgaatcgcagggcagggacctgccgcagggggcttgggaatttcgtggttcgggggctgtgagcatgggagagaagcgccaccccggggtgtaaggccctctaaatttccgactcgtggcatgggcacggcacacgacgcgaaatggttcagaaagacgtccccgagaagaacacacaaaggggcccccaaggaggaggagccaggcataccacaggggcacaagttagctcacggggaagccattggggtggccaacggggattgacggttccgctgtgggggcgcagaccattggttgcccgcgggaacggcccccaacgaatatcgctatggttggggcgagaggatccccagagaatggcacagcaaccacaaggggaacacggcgcgcaaaataccgattgggggggagccattttcccactagccgcggagcaaaatatcgccatttgtgtcgcacactgagagcccacaccgccatttccaggttgaggctacgtcgggatcgacaccattggggcattacgggaacatgggaaaaaacgccaaaaaggatgtgaatacgtacacgttaggtggagcaaagtgtggcagcaattaccattttggggtaggggttcaagagatttaggggagcaccaaaagatgtgtgaggagcaccatggtgggatggggggtgacaccagagatgtaggaggtatgagaattgatcacaagaggaacagtgattggagtcgagggagcccccatttgggttgttgaggagcaaaattatgtcggcacgttttgggaggggacgactaccaaacaaagagggcagtgagggtttatacaaagcgacccccattttgtagagaaacaacaatagctgtttctgggcagaacaagcaagtgcattcaagggaacaggtttgagtggtgtcatttggtaagaggattcaactgtattggtggtgaagacagcactgttatgaactatttgtgaaagacgacggagcgcactcaataggtgggaagcaatgatacgaaatgagattcttgaggg

SEQ ID NO: 513644 - DNA, 202 bp, Homo sapiens
tgctgggtgatctagaggatcccgtacgcaggtgaagaagcacagaccaacctggccggtgagcagcaggaggcaaggaggcgctgcccatgccgcgcctgagaaggtcaaggtggaggtgaagaagtttgtgaagatcgagcgccgggctacaaagtgaccaagcagagagactcggagatgtggcagcagagcctcctct

SEQ ID NO: 513645 - DNA, 265 bp, Homo sapiens
gaacggcagctcctgcctgtaatcccagcactttgggaggccgaagcaggaggatctcctgagcctaggagttcaagacctgcctgggcgatatagggagaccccatttctacaaaaaatttaaaaattagcagggtgtggtggtgcgtgcctctagtcccagctactcgggaggcttgggtgggaggattacctcaactgggaggtgaaggttcagttagctgagatcacaacactcactccatttaggtgagagaccttcttt

SEQ ID NO: 513646 - DNA, 425 bp, Homo sapiens
ggagcagctctgataaagatttacaaatctacccttctttgatttcctccttcccagttgctgagacaggcatgtctccccctgtgatgagcacctagtgttcctgaggacactctcaatgctaaaccacgccctgccaagagccagtacgtgacaactgggcagtctccacctcatccctgggtgtgattcttgcgaaactttttggttctgggaccactcagaaaactctccagggaaacgatcacaaaagctgactctgggcaggcagaacactgctcactcccagccagaaacccacgggctgatgtttcttttcacaaacatccccagcctacaagactggccaggggatccacctccatctgactgcccagggccgcacttggcaaaacacggaggcagagaaactcaggctagagttc

SEQ ID NO: 513647 - DNA, 207 bp, Homo sapiens
caacattttggaaggttgacgcatttgcttgagcccaggagctcaaggctgcattgatccatgatcacaccactgcattccagcctggacaacagagggagaccctgactttaaaaaaaaaaaattttttttttaatggaaaaaaaagagcctaggagccattggtagattttagggaaaagttacgtcctgccctactgccagcac

SEQ ID NO: 513648 - DNA, 1236 bp, Homo sapiens
ggccagccatctccaacagcatgtgccatgccgtccgacatgccctctccaccaatgcaatgatgtgtgaatgaatgtgcatgtgatgatgatgacacaatgctgtgcaaatgtgatgctggctgatgaatgatgctgtgtgccaatgtactctgtgcgtgccgaagaatggcatgtgttggcgttggatgaatgtgatgtgagaagtgccaatgggctgctgctgtggatgaatgcatgctccatgtgatgctgcctgtgctgcctgtgcttgggagtgatgcaacggtctttaaatgcctgatgcacacgcctgtgcaaggcccttgtgatggacactggcgaggctgtgcatgagatgctctgatgaaataacaatggattgcgcttattgaatgcagtgccagtccaattcgtgtccagttgaaaagaatgaactgttgggcctgaaattcctgtggatgcatgcggcttgggtccgttggtgcaggtggtgcccttggcaacccaacatgcgtcgtccatgggaacataatgaaccaagttgtgtgagcagtgttgctcctggtgtctgggcagggttaaaccttgcctccagagaccaactgtgggactcataataagagtcaacagaggcgggcgtcttcaagaggtcctactctgccacggcatcttggaacttcccccacagttaggagaagtcgcaatgccttgcaagcttgaggcgccatggcgagaaggcatgcaattccgtgggattcggtcttgagtggacggcccaggtactactccgttaccttttgactcgggagtcgccaagacgcggggtcacaattgaccccgcaaccgtgccggggaaccagggatagggtgggcttgatgaaccccctttgggagcaagtgccccaacggttgtgtgtcctgggccaagtgggtccaaggcatttgatgctgacgggtacgtggaaagccggaaacagcagctcattccttcatgcagtgctgttcccgtgtgttccctgcgtactgtgcctctggccagggcccataagcgcctgtgaaggagtaaccctgaaggcggttggaacggttgtgtccccagcgtgttaggtccggggagcgcggaagcgccaaagactggtgaaccacgaatagttgcacccgagagagagactcgggtaccaacgtgctaatgcagtgagcgggaagacgggtgaaaggctaccgggagaccaa

SEQ ID NO: 513649 - DNA, 281 bp, Homo sapiens
gagctcggtaccactgcatccaacgccgcgccacgtcctgctggtgacagacgagcgcggctgccatgtttgtgagtcgccaaaggtcgttcactgacgcagtaacattgtcaatgctcattacatgttatgagaatagggtctctcttcagctctgaagcgaatctgttctctactttacagatcacttcaatgtgaacgtgtaccaccacccctctggtgcgtcacattgtttaggacgcctgctgtgctctatcactgggtgtgctgtcagggtctga

SEQ ID NO: 513650 - DNA, 126 bp, Homo sapiens
gagcctcctctgtctcccccacctgaagcatcacctttttctccactggaggagacgcccttgtttccaccggatgagtcacccccatctcctgcacttgagacgcctatatcccgaccacctgaa

SEQ ID NO: 513651 - DNA, 437 bp, Homo sapiens
  misc_feature (62)..(62): n is a, c, g, or t
  misc_feature (229)..(229): n is a, c, g, or t
gttgccttgggcaaggaaggtgacaagaacgtgctccccacgctaagcttgggtgcccggcnccccgtgttccacgagaaggattatgacagcctggcgcaacccggttttttcgaccgcttcatccgttggatttgcaagcccccccgcccgggccccccagttgagggttgtgagcccaccccgtccatggtgttaagcgggcccgggtcccacacggccagcaccnttgttcactgggaagacgcctggggcttgcacttttccagctcctcccagggggtcccggaagccccggcccccgcccagccccaggtctccccaggccctccgaaggttggcgggcctccctccccctgaagccatcccaaggttcttgacctaccgggcccctgagctttggagcaagccctgacccaataaaggctttgacccca

SEQ ID NO: 513652 - DNA, 1215 bp, Homo sapiens
  misc_feature (294)..(294): n is a, c, g, or t
gcacaagcgttcccactcaccctcaggctctgagtcagaagaagaggagcgggccccacacatctcgtccgcgccccccgaaggcgtgaggaggcggaactcccatcgagatggtcatggcgtcgtgcaggcccgtcgtgtccgtcgacgtctggagttgccagttgacacaggtgggggctgcgtgcgcgcttgtgtaggtacgagggctcctcgctgtcctcccgatctatgcttggcagcgcagcatcactgagcctgtcgagaaagactcatggaaatccaaataagagnagaagagctaaggagggagaaagtacatgcaagatcgtacactagtgtcctgcaagagatggagaaccagcaccgctgtagcgcagagacacgctggagccaatgggaagacgccgagtgaagaagagaagcaaggaatcgaggagcacagggatcatggggacgtctcgcaagcaagggcaagagacgtgcccctgaagccggttaccccagcgccttggcgccacgtcacagagaggagaaagactaggcgtgtggactagcgtcgaggagaaggtgcagcgtgagtgtagggttgagctgggagaggcggagcgtgggacagtcctgacagtgagctggctgcatctaacactgatgcccaatgagctgtttctcctgtgctcgggctctgtggtgtaggccatggggtccctgggccatcgctcatgcgtgctgtcgctcggaactatcttcgctgtagatctggatcgtggggggtccacttattggctaaaaggttaaccgcaatccaccagtacaccatttgttgggggacctaatcaagggtatgctctagcgtgttccaatgggtcccctactccctggaactagtcgccagtccttggcctcagacccaggacagagaatgggggtatatggcaaggtgcgaggtgggctgatgccctttcgaatgacccttgtcatcaccaggggctcgcagggaatcagtccacgggctgttgtgacgccaaccgtggcttggacaaggggccggggtcacaaccggctagaataggtgccggtaccgcagtgaactgggcctatgagaccaccaatttttcctcccccaggacaagcggggatggacagctatgtcgttacatcacgagtatttcccgcacaaatagaaattaataaacaaaccaagacaatagtaaa

SEQ ID NO: 513653 - DNA, 214 bp, Homo sapiens
cgctagcggcattaagtgaacgcaacaacatgtagaatgaacaacaacaaaaatctgagaataaccacataaaaaagagaggaagaacagcttcactgtgcctgtatcacccttctcccgaggccaccgctgttctctgccaagaggaagcttctcagctacagagagttctcctccaggaaagggagagccgttcacttaatgccgctagcgc

SEQ ID NO: 513654 - DNA, 264 bp, Homo sapiens
  misc_feature (167)..(167): n is a, c, g, or t
gggtgatctcatatactctggatataacctttgtcagatatatagttgcaaatattttctcccattctgcaggctgtcttttcactccgtctcaaaaaaataataaataaacaaaagaatttgaattactctagccattatagaaaacagtatagaggtccctcaanaaaattaaaaacaaaactgccatatgatcccacaatcccacgcctggttatatatctgaaggaagtaaaatcagtatgttgcagagatatctgcact

SEQ ID NO: 513655 - DNA, 475 bp, Homo sapiens
gcgaggctgcccaaaaagcagtcagggcaatggcagcgctgactgatcacccctacgcctctctgaccctcccagatgatgcagctagtgactgtctctttctgcgtcctgggttgcctggtgccacacctttcctcctgcaccgcggaggtggggacctgcccaacagccaggaggctctgcagaagctctctgatgtcaccctggtacctgtgtcctgctcagaactggagaaggctggagctggcctcagctccctctgcctgtgctcagcacacgcccccactgctgagggcctggatttggggatcccactggttaggaatagagctgtatagtgggtagaatcagctaatagaggctgggtagttgtggggagatgccccaggatagggaaggacttagtgtggaaaagaatagaagccattgggtgagtcctctctgtcaaaaccaataaaataaaattgacctttta

SEQ ID NO: 513656 - DNA, 165 bp, Homo sapiens
  misc_feature (146)..(146): n is a, c, g, or t
ctgaggacccgttgtcatcccccttcgtcagagataagtctacttcttccatgcgtgatgtgtcgtcatctcctatcaaggggtggcatttcttcagttacagcagcactggtatcaatcaagcagtaggggtcatctttcatcanatacccaagaccaagtttt

SEQ ID NO: 513657 - DNA, 281 bp, Homo sapiens
tggtgtgtcagtagcttcatcacttgtgattccctggtcttctggcgagccgagtcaggcggttcacaaggtcaagagttcgagaccagactgatcaattatggtgaacccgtgtctctactagaaatacgaaattagcgggagctggttgtcacacggctgtagtcccagccacttggtaggctgagtcaggagaatcagttgaacccaggaggcggagagttgcggtgagccgagatttgcgccactgtattccagcctggtgacagagtgagacttcg

SEQ ID NO: 513658 - DNA, 593 bp, Homo sapiens
cagggtttcaccatgttggcccagctggtcctgagctgacctcaggtgatccaactgcctcggcctcccaggtgctgggattataggtgtgagctaccacaccgggacatcatcatattttcaagtttaaccaacattatagcatgtatcagtactttattcctttttatggctaaataatattccattgtatggatatcatattttgtttatccggtatctgttgatgatttgggttgtttccttcttttggctattgtgaataatgcttcagtgaacatttgtgtacaaatatttgtttgaatacctgttttcaatttttttgggtgtacacctaggaatggaattgctgcgtttgttgttgtgtagttgtatgttgtcgttgtatattgagatggagtttcactctgttgcccgggctggagtgcagtagggtgatctcggatcaccaaaagtatctgcttcccaggatacgggtgaatactacactgccatcaagaatcaccgaagtaggctgaggataaaggacatgcagccaccacacccggaataaaaacagagaaaaacagtagagatgggaaaccaccaagaag

SEQ ID NO: 513659 - DNA, 311 bp, Homo sapiens
cctcctcatgtgcttgcccacctcctctgtgctgtcggacagcacagatgaggtcctttaccttagctctcaggaaggagctggtggcatgtgatcttggtactggagtgggtgaaagaactccgggctcccgagctcttgaggagggtggtcctgagatggtttgggaccagagaagaccggaggttgaggttggggaatccacccctcctctgtgctgtccacctcctctgtgctgtccacctcctctgtgctgtccacccctgtgctgtccacctcctctgtgctgtccacctcctctgtgctgtcca

SEQ ID NO: 513660 - DNA, 517 bp, Homo sapiens
  misc_feature (11)..(11): n is a, c, g, or t
  misc_feature (31)..(31): n is a, c, g, or t
acgatgaaacntacaaaaaacaaacaaaaangaattcaacaacatcatgacagttagtgtaactttgcaccaaggagaaggggaagtcccagaactttcttccggcttcacaaagaagtcgcacacaggcctttcaggagagaggccacactggaaatgttcaggacaggacattccagtggcagagaccgctccgagtgccagagttagcacgtggcaggtcccacctcagaagtccagctgtgtagaaagctcctttcagcaaaggacaggcccaagcatagtttaacaacatcagaaaagacagcaagacgggctcctccgaattctctgctccaggtggagggggaccctgtgagtgcgcttggtgacccctgtggagatgcggacagcaggggccactcactgtcctccagcagctggtcactaagtaggctggaggctggaagttcctgttaaccttctagaaaggtgggcctccctgaacttgcaggttcctgaaaagaaaataatgttt

SEQ ID NO: 513661 - DNA, 478 bp, Homo sapiens
gagagatagatgagggacctacggtggcatgtttggtattggacccccgcagagtagctctatggactagatctcatcaactctgtgctgtgtacactgcctggccagagatagctgtattcaccctggactaccatgctaagacaaacagctcagcttctcagcctcttaagcctctgctggctagtttagttctgtaggctggatttgcagggcgcttggatgactctgcccagtgcttccggcactcacagacctgcgtcacaagcctggctttcctgccagtgtgactgcactgccatctcaagtcatctccaaatatgtgcatcttaactcgcgatccacattgcaagatgcttaggaaccagggcccatgctttgtttgtgtccagattcccccagggatacctagcttgtaagagggtacttattagtggttaatgccagtagcctggcttaagaaataaattctctctga

SEQ ID NO: 513662 - DNA, 214 bp, Homo sapiens
ttaactgcaggcttatacttgaagccaggattgtttaagatcatctccacctgcagatggctgatgctgcaggcgccaatagctttcaccagcccttcattcaccagctcttccatggccgcccacgtgtccagaaagctggcgccacatgggaaccacattgcccgactcatccaatgggaaaaattccttcccaggcttaaagccacgtcgc

SEQ ID NO: 513663 - DNA, 123 bp, Homo sapiens
ccctgggttgctgttatttgtgtttagctcggggagggccccctaagggggcgaactgacctcaggcattttttgtaactgtaaaggggcctgccattaaacgtgtcccctgttgtggcgcca

SEQ ID NO: 513664 - DNA, 240 bp, Homo sapiens
  misc_feature (162)..(162): n is a, c, g, or t
tgcgaatgtggcagacctcacttgggtcgggggtgtggagtggaccacaatgttgtgctgggggatgggggggtctctctttgtcgattgtgcagtgcacaagatttgtgacacatgtatatatcagactcctattgcggactgatcagtgggagaggaggncccattaccagcggaaactctgagatgtgtatttcgcctgctgtatttgtaatccactcgtggtggtggctttttttt

SEQ ID NO: 513665 - DNA, 171 bp, Homo sapiens
cacctcaaccagcatagttccatccttaaactgagttcatcaacatcatcaagaggacactatctcctgtgagtcacccccatggtccagagaatctagcccatgatagggtagtcctttacttattgctaacccgtaacctctcagtccaccttttctgtcctaagtcag

SEQ ID NO: 513666 - DNA, 457 bp, Homo sapiens
gtcaacgacgtgggtttgatactgatgaaaaacaccacttaaaggaggcattgctatatcagcgacaataagcaaaagcttgaagggtatgttattctctcaatactacttctccacttcgcaggcatatctattcaggagggcatcttgaaagaggagcagggtcacccacgacttcttatatctcctgcagtgcactggccaagtgtgtgtgtattgatatgcttgaagcccctagggttctcaacatgccaaatcacaaaggggttcaatttgtggactgcaacattgcccccaagcaagactgtcatccagtccctaaaagacttgaagcctggcattgctttggtctacctcatggatcaaagtcctttcaggcatctgtttccagaatagaaaggtttcatccatattgaaaatttgttctggcaagtgattttcctccagactcagctta

SEQ ID NO: 513667 - DNA, 631 bp, Homo sapiens
  misc_feature (125)..(125): n is a, c, g, or t
ggaccggtcagctaggacgcagctcatagcgcagtagtagggaacgacagcacgttatccagccgctcaatccgccctgaacgatcccggcaaaggcgcagccggttgtcatacgcatcgctganggttgtcagcacaccgtcgcgaaagtggtagaaacgcgaggcctgggccagcaccagttcgtcaggcgccgaacccaagtagatcgccgcctcggccaggctattggtgatcgccggtcgagcagaagtcggcaagggcagggtagtcgagcggttctcatggtcagtccacaccaccaaatcgcccgacaccaccagccgatgagccagcgcatgactccagccaaaccccaacccacactcgacttccaccgcactggtgcggtacagccgcgtccactcaaacggcaagattccatccagcgcaccatcggtgagggtcagcaattcctcgccggtgaccatcgacaccgggcagccgttggtaacggtcttgtccgctggcgccgccgcatcccccttcggattcgacgccaccgccggcacatcatccacacgctctttctgcgtcagcactacgttctgccgcgctcgccagcgcatcgcgtccgtagcggccggggatc

SEQ ID NO: 513668 - DNA, 786 bp, Homo sapiens
catggtggctcacgcctgtaatcccagcactttgggaggccaagacaagtggatcgcctgaggtcaggagttcgagaccagactggccaacatggcaaaaccccatgtctactaaaaatacaaaaattagctgggcttggtggtacatgcctgtaatcccagctattcgggaggctaaggtaggagaattgcttgaactcgggaggcagaggttgcagtgaaccgagatcgcgtcactgcactccagcttgagtgacagagcaaaactccgtctcaaaaaaaaaaaaaaaattttttttataagctacttaggaaccttgtggggtggtcagggagggaaaaatggcgcgacaagacagggctatctatatttggcaacaggccccaaataaaaaataccctcaaaacaccggacgtaactggtcacaatttcctctattctacttccatctcataaacaacttggacactcttctggacatttttcccggtttatggaacaacgctatctggtctaaagattccagacagatgtacttctagggtccatattgaccggaaaccacttcctggttaggaacacataccgggaaaacccctattatgtagcaaaaatccggtctcagcgcattgtgtgggagaccatcccaggggcgctgattactcaagcgtccaggtggcgcagaaagatgttccctcaaccaaggggcaccccaaaggaattctaaaattgtccctttagaagggaaacgaccgtggttccctccaagcacttgtcacctgttg

SEQ ID NO: 513669 - DNA, 259 bp, Homo sapiens
acacaggctcgagcgccgatccggttaaccagagaagacatcttgcttgttgggtacagctactgtgtcccagcaattgggccctggaagccttacagtttagtgatgagagacgtgtattctctaaggaatgtgttagaaggattgttagtgattaagccaaagtgagggccttggattcctcacagggtctgattctgtcctcttgcggaatagttagcccgcacaccaccaccttcctcttcagctgtcctccccg

SEQ ID NO: 513670 - DNA, 110 bp, Homo sapiens
ataatcgtgacactgcatcctattttcaaaaaaaaaaaagaataagatggaagggaggaaggaaaaaaaaaccggtttaaaaccttcctctggacctggttcctttcctc

SEQ ID NO: 513671 - DNA, 103 bp, Homo sapiens
tacagccggatgttcacgtctcatctacggtacacaatcatatactatttccctgtcttgacccctattcaagcaactagaggccagcacttgggcaccttat

SEQ ID NO: 513672 - DNA, 211 bp, Homo sapiens
ccaccagaaagggaaggtgctaagttccctattagtggacggctccagaagcaatcaactttggatgtttcactattaagtctgatgtgtggtcctttggaatcctcctatacgaaattgtcacctatgggaaaattccctacccagggagaactaatgccgacgtgatgaccgccctgtcccagggctacaggatgccctttctggtagg

SEQ ID NO: 513673 - DNA, 150 bp, Homo sapiens
gcaaccacgagacggccttccaaggcaatgcttcggaaactggacatcaaaaacgcagacgatgtgaaatcgtttgtctcgaggtgatggatccatggtttttcagccgacggcgtaaacaaaactgggggcaggattgtgactctccat

SEQ ID NO: 513674 - DNA, 645 bp, Homo sapiens
tagcggtccggatgggcatttcaaaacacaatcatgccttccaacagtccccaagtcttactcattccagcattacccaaaagtccaagtccaatgtctcatctgagacaagttatgttccttctgcctatgagcctgtaaaatcaaaagctagtcacttcctagatgcaatggggatacaggcatagggtaaatacacccatttcaaatgggaaaaatgggccaaaacaaagggactgcaggccccatacaagtctaaaatccaatagggcagtcattaaacctcagagttccgaaatgatctcctttgactccatgtctcatatccaagacatgctgatgcaagaggtgggtttccacaaccttgggcagctttgcccctgtggctttgcagggtgcagcctccctgctgatggctttcacaagtaggtgttgcgtgtttgtggcttttccaggtgcatggtgcaagccatcagtagatctgtcattctggggtctggaggatggtggccctcttctcacagctccactaggcaatgccccagtggggactctgtgtgggggctccaaccccacatttcccttctgcactgccctagcagagattctccataagggctcaaccctgaagcaacttctgctgta

SEQ ID NO: 513675 - DNA, 218 bp, Homo sapiens
ccaaaccgggactgatttagatgtaattttaaatttctattctatttttcgcagcagttggttagaggaggaggagcctttagcctctcataaactgacctctctacttctcgtgtatttttagatgattgatgatgtggaagggcttgcttgtctgctactgaaacctttacctgcggtttttggaactgctttggaagagaaagaatgacttactg

SEQ ID NO: 513676 - DNA, 111 bp, Homo sapiens
  misc_feature (69)..(70): n is a, c, g, or t
cttacaggagcttcgaggactggatgacataggacttgaaggtgacatgctgttccacagtcactcccnngccttccgtgtgcccccacttgcccacttccagagacttcc

SEQ ID NO: 513677 - DNA, 1699 bp, Homo sapiens
aagcagtggtatcaacgccagagtgcccaattacggccgggacttctagaggccgaggcggggccgacaatgttgatgtgaatgacgtggacactatgctggtgtcgcagagggacgaactcctgagacacacgagcaagcagcgcgaggacacagtgacgcacagcagaaagaagagcaccggaccgccccactcgaagcagcaaccgcgaaccaggatcgcccaccccggcagacgcccgagggcccaaccaacccgggcactcacatcaccccagggccgtacccaacaccggacaccccgacacactccaagagacaactgcaaccccgacacaccagcacacacaagcgcacaacagtttacagccacgaacggcacgcgaggcccacaaccagagggggaaccacgagaacaacagctaaacacagaaagcgacacgagggcgacggacgcgcagcccaacacccaatgagcgtacggcgacggagcagcgcgaacgcacaggcgccacagacccccgccgacgcagacaacaacaagacaagagaaagggcaaaaggcacgaccacgaaaaagcgaaggagagcgcggccacggaaagaggagcgacggacagagcaagaggaacagagaacgagaccgcgacgcagccctcggcgacggcagaagagcaaacgagcgcacgacgacggcagaacgagaagagggacacgacgcggaggacggcgagagggccgcagagcacaaaaccgaggacggagagaggcggggcaggcaagcccaacagcaggggagaacgacgcgccagcgacacgacagcagatcaacgcggcacccaggcgcacacgcgagatgcgcgtacagaagaagcgctacaaaaggaaacgacgcgtggcagcagcgaaccaagacacgagaagagcaggggcacaggacagaccgacacagcaaccagaaggacggcagggcggcacctgacgacccgcagcgccgcgctgagacgcagagcgacccgcacaccaccgagcacgaccagaggcaaaacgaggaagccgaagacgcacagacaacgagcggacgcactcgaagaggaacgcggagcgtccgaagcaagaggaaaggacagcggccgccgacaagacgaggctgcgaaacacacagcaagagggaagaggcgaagcgagacggtctgcgaaccgagcgacagcgacaggcggaaggaggccaagctcagaaacagataggcagacacagaagacatgaaagagaccacgaggcgacgccacaagaagagacgagagagcacacagccaagcagaggcgacgacgatgatacatctataaacaatacataatgcgtgaccagaccagacagagcagagagagcacagatacaccaggtggagcgcacaacatagagcgcgcacggagccgggcgtagcagcacgaacagcacgtatagccaccctccaagagatggcagcaccagctcaacacgcagaaaccgaccgaacacacaacagaggcacagacaagcagaagaacaccgaacgaaggcagcaacaagagcagccagagcagtgcgcagaaaagcacgagaacagaatagagaaacaatgagcccaacgtgacaagcagccggagacagagcagcaacgacggcgcagcagcacgcaccggggagctgcagcaaga

SEQ ID NO: 513678 - DNA, 301 bp, Homo sapiens
aggagccatagatgtagtctatctatcagtacagttacatatccatgaactgatatctgggataccctatccagtaaaatctgcgtgactctcgctcagctgagagagctggacagactccatcgtagcctcttcagttgcagtccccttatccccctcccttaagggaatacctagtgcaagctgactccaagcacatccagtaatgcacttacagataagatatagaggcaagctgtaccagcagctcctggggacgtgctcagtggatggatacccaagcccctgcatttatctctta

SEQ ID NO: 513679 - DNA, 264 bp, Homo sapiens
gcaccatggcggttggcaagacaagcgcccttacgaaaggcggcaaaagggagccaagaaggaagttggttgatccatttcttagaaagattggtattatttaagcacctctatgttcaatataggaatattggaagacgctcgtcaccaggaccaggaaccaaattgcatctgatgtctcagggtcgtgtgtttagtagtctgctgatttgcagattgatgagttgcatttagaaattcagcgtattactagatgttcagggt

SEQ ID NO: 513680 - DNA, 347 bp, Homo sapiens
cctgttgtgggccagctgccctcctagtttgtgcgggtatgggctatgctggagtggtaaataggctccgaaaaatcctgcgaagaagaaaatttctgaggtaataaataggattatcccgtatcgaaggccttttatcggacaggtagtgtgtggtggccttggtatgtgctttctcgtgttacattgcgtccctccttggtatatagttcgtgtgtttgttagtaagcctagtatgaggagcgctttttgagtgccagtgaaatcaccctggctaggccggaggtcattcggtaggctcatagggcccctgttaggggtcctgggctgggttttactctattatt

SEQ ID NO: 513681 - DNA, 104 bp, Homo sapiens
cgatcccgactttttactgtaatggcccagatggttgttacgtccctgctgaagtgtgcaggctcacaccgagttgataagagtgtttactagacttaggtgcc

SEQ ID NO: 513682 - DNA, 297 bp, Homo sapiens
aacctttattaagggcaggtgtcctagtccggggggcggtgagtcaagggtaaaactcaaccatattttttttttccccttatatatatgaatcttaaaacagaaatacacataaaacaagattacatatggatcagcggatgaaaatatcacgaccaaagctcacaggaacgcaacccggtatttctcctaaggagcaagggtccagtatggggctaagtcaggggctcacaggggattttacaggatcggggccactggcacctccagcctaaggcaacaggggtaccggagctc

SEQ ID NO: 513683 - DNA, 968 bp, Homo sapiens
cacgcgtcgaggctcctatgagtggtatcacgtccgggattcttgtgactgccgtgtgcccttttccaggctgcatgtctgccctgggtccacctgcagtggacactcaggcctctaagcccccagtgagcacataccataggcagcaagaagcctgagcatgcccccaggaccagccatcccccaaggccttgtcccctgcctcggcccaggcctggtctctgaaggagtctgagaagatggcgcgtcagagaagtggatgggtacacggcacagcctggcaccatctccctggagatggagcggcagaaaccagatgaccagagccggcaggagcacgagcgggtaggccgccgtcgagggaggcagcggagcaggagcgcctctctccaccgagcttatcaccagcaggctatccaacgcatcccatctggcggactcctcttctcctctctcttctcctacactgggtccgtctataccaggggtacctctgactggctgatctcccgtcagtgccacgcaactcctcacgccgcaacaagtaggtcttaccgtaggaacactggcaccttagactaagagaatgccgaaacgaaccgcacaaaggaccacaaaacagaaccacgataatctcaatcggaaccatcagtctgacgcatgacgaagatcgcgtcacacacgcgcactagtcattgacaacacaacacccaacaaggcggacggctactattgcctcatacacctcgccgcatcgacacgacccaacgtgcaggacaatctgcccgcaccgccccgatcgccaagaccaaataggacccagcgaacacaagggaacgccgaaaaagcggcggcccccgagcaatccgcccccctagcagcacgagagaacaggcaccaacaccaggcgcacaaaccacaggaagaacagcgccggccaccaaaatggagaaagagaaaaagtgaag

SEQ ID NO: 513684 - DNA, 1615 bp, Homo sapiens
agcggagtgcctgtgggctgcccagcacgaatgctgagtgccgtgcgtgctgtgttgtgccctgtgtgccatgggcatcctggtgtgctggctctgagtgcccctggtgctgatggccttcctgtgctgctggctgactggccttgagtgtgctggtgtgctgtgtgtcctgctgctggcctgctgttacatgccatgtttgtgctgtgagatctgggctagcagagcatgcgtagctgtgctgtagagtattattgaagtgcaagattggcctggagctgcatgctgtgtggcccctggtgttgatgctggatcaaagacatgatcctggctcgcagaacagccaccctgaagaaactgttgtgatgcttgtggcagcttgtgcgtagacattcgttgtagtgcccccatctaccaaggccttcaaagctgtgcgtgcgcaaccatgaaaccgtcagtgggcagatatttgatgtgactgattgctgttccttgacaaggacagcgaaagttgagtggtatacagccacccatggctgcatttgagggttcacagtgacagaacacaagatgcgtctgcgagcgatttaaccctagcagcccttggagattgggaagaaccctccgtctgacaatgggacgacaagggatcccttgggggattaattgcttgaagtgacgccactgcgtaatcatctagtgattattgttcatagtgaagttccttggtgacaacgtggtcgggaagaacgcgttggaaattcacggtaattgtccatggtcccctggaagggcgcacagacggccaaaggacgaccgaaagcaaaaaggtatttcaattggcttaacaaatatattgaaccggaaggctgggccaattttgaccttttccgttgacaccaaaataaacacgaataattattggtatgccaacacagggggaaacccgtggaacagacgcagagagcgaaagcaaagtaccgatccaaataccagcgaagaaagacgctgacctataggagagcccacccgagataacagatcagaacaagtcagagagccgacacattatgagggcacataacacgcaaaagaagacataaggatgacattcaggagagatgagcaaaccacactacgaatggcacacagaaagggggatacagcaaaaaacacaacaaccaacaagttgtatgagattggtggagacaaacgagacacaggggagtgtacaccaaaagcaaaggcgagagccacggaagcaccctaacgaaggggtcacgggagcaacacatggcaagagagccaaaacacaaagggccagaggcgggaaacaccaaggaccacggagaaaaaacaatacggggagaggacgaaaagagagagcaaaacgagacatcaacaaccgaagaaaccggggaagacaacagacaaagaagacacaaaacgacaaagaaagaaagcacaaaaaagcaagagagcaaacacccaacgagcaacgagaggaaggagaccgcgagacaacggctggcacagcaacgacaacgacaacgcacacaacagaagaggagatagaaacacagagggacgcagccagctgagtacagagacgaaa

SEQ ID NO: 513685 - DNA, 399 bp, Homo sapiens
gccggtccactatggttggacgacggtggagaagctcattagcgccacgaggtcatttggaaaagtctagcagtcaacctggcgatgataggttgctctgggccctggaacgggcggactacattggtgcagttactgggaagtgcgcagacagcaagaggaagaggagaggaagaggcggccgccttctcccgagccgagcacgaaggtttcagaggaagccgagtcccagcagcagtgggatacttcaaaaggagaacaagtttcccaaaacggtttgccagctgaacagggatctccacggatggcagaaacggtggacacaagcgaaatggtcaacggcgctacagaacaaaggacgagctctaaagagtccagccccatcccctccccgacctc

SEQ ID NO: 513686 - DNA, 201 bp, Homo sapiens
ttgtctggatactcggcgtgtgcagcaacaacttcgtccatcgcgcactgcaacaacttcgtccatcagacttgcaacaacttcgtccattctgacttttctgcgaatataggtactcggcgtgtgcagtatgggttttcggcgtgtgcatgcacacgccgaagatccaaacgccgcaagtcctgatggacgaagttgttg

SEQ ID NO: 513687 - DNA, 392 bp, Homo sapiens
aacttaaaaaagaaaaaactttgccagttttaaggacatattttgattctttcaggatttttaacccctttttaaacaaagtttttgataggaccccctattattggggttgttttaagccattattgatttttgaaattcaagcatttacaatggagcaaatttgatttttttttttttttctttttttggcatcattaacatttcatttgaaaagcatattgtttttgaaggactttgtttttagcataaatgttgggcattttattttagggtttggatgaaaacatttgggttgtttagctttcatttgctttggaaatttaaaaatggacctttattttccagtaagcctacattttgtattgcccaataaatttattttaagccga

SEQ ID NO: 513688 - DNA, 496 bp, Homo sapiens
catatccagcagcgtgacgtagtgtacggggttgctgcccgacaggttgatatggtcgctctcagcgatcctctgggcctccttgttggaatatgccaggatggcctcgcgctccctcatactggcgtccggcagggtggacttcaactgctcctgggctgagatcaggccctcaatctcctcgatggtatggacaatgaacatgtcctggaggtcctccatggcgctctccatccagttgttgaacggggccgcgcgccttagcgtattccaggtgctgctggtcgatggcctccagctgcttctctgtattctccagggcttccctgcgactatatgtcagagagccgagggagtcccactggtcacagatctcctcgcaccgggtgttgacattgtgggagtcgtaatactccagctcgttcagctcctggggcaatggcggcgatctgcctccacggcggtccctcgtgcgcagcctggtcgctctcgaagg

SEQ ID NO: 513689 - DNA, 897 bp, Homo sapiens
  misc_feature (1)..(1): n is a, c, g, or t
ncttacggagggaagagatgagcgctcggcgcaagaagaatggcagacagagtgtggtcacaaggtcgttttgtgtggcgccgctcttctcagggaaagagccccttatatcaccctcctttaagggcctgattttccccggtgcccgtggcacctggggattacagagagatgttgtaattgccggaccaaatttgggttggtccaaaccatgaaggttgctcaatagtgccccaaaggtcccctaccacgagtggcaaagttttgggcaaaaacggtatttgcccatgtgttgtgcgcaatcgatacgagaaggccttgtcccctcttgccaaacagcccccttattgtttacgcccttccccccagtgttgccccccagattcaccatcgtgttccgaacccctttttttaaaccatttgccacagtcaacacatcattgaccaatggctcctactcccggataatattatgccccccccctccaacaattcaaagcacatcagtgagggcttgctccaactataagggcaaccaccctttggtgtaaccccccattacaaacatggttttcttatgggacacacccacagaagtctttaaaccaggaccatcaacatctgcgtcaataatcacccccccccaatatgcttctaaaggtatccctttccccagaccgcggttcaatccccgagtccctcccccatatatgttgtgccattcaccgagttgccctgtcacagcaaagacaattttcttttatgaaatctctggcttcctgaataattcagtcagcccctcaaaacattccttctagccccaactttcccccaaaccccaccccaaggcaaaaagttctcccccaaccaaaaaccaactttcccccaaaaataaca

SEQ ID NO: 513690 - DNA, 228 bp, Homo sapiens
gatcacttgagcccaggagttcaaggctgcagagagccatgatcttgtcactatatttcagcctgggcaacaaagccaaaactggtcttaaaaaacaaaacaaaacaaaactttttttaaaggtttattgctgttttgtttttcagcaaaccaaagctagtcaggctgacgtagcattttacacctcttataacctacagcttatacttcttcctctgtcaacaattg

SEQ ID NO: 513691 - DNA, 476 bp, Homo sapiens
agaggaactcatgctatgaccaatcattacaatagatcaatgatagactggataaagaaaattggcacatgttcaccgtgaaatgctatgcggccatggaaagggatgagttcatatcctttgcagggacatggatgaagctggaaaccatcattctcggcaaactaacaagggaacagaaaagcaaacactgcatgttctcactcttaagtgggagctgaacaatgagaacacgtggacacagggaggggaacatcacacagtggggcctgctggtgggtaggggtctaggggagggatagcattgggagaaatacctaatgtagatgacgggtcgatgggtgcagcaaaccaccatgacacgtgtatacctatgtaacgaacctgcatgttctgcacatgtaggccagaacttaaagtgtaataagaaaattaagaaaaagttaagtatgtcatagatacgtaagatattgtag

SEQ ID NO: 513692 - DNA, 515 bp, Homo sapiens
cagtgaggaatacaccaacaaacccaacatgaggactattatattttatagtatacgataaatttttagagacaggatctcatttagctgcccagactgttaatgcagtggtacaatctatggctcactatagcttctcagctcctgggctcttagcaaccctcctaccttagcctcccaagtagctggggccagagatgtgcaccaccacatttggctaattttttctttttttctttttgatacagagtctcagtctgtcacccaagctgcagtgcaatggttcaatcatggctcactgcagcctcaaaccttcccaggttcaggtgatcttcccacctcagcctcctgagtagctgggactacagctgctcacaactcacccagttaacttctgtattttttgtagagatggggtctcaccatgttgcccaggctggtctcaaagtcctaggcaacatggtgagaccccatctctacaaaaaaatacagaagttagctgggattacaggcac

SEQ ID NO: 513693 - DNA, 1428 bp, Homo sapiens
  misc_feature (991)..(991): n is a, c, g, or t
  misc_feature (1004)..(1004): n is a, c, g, or t
  misc_feature (1014)..(1014): n is a, c, g, or t
  misc_feature (1194)..(1195): n is a, c, g, or t
  misc_feature (1227)..(1227): n is a, c, g, or t
  misc_feature (1373)..(1373): n is a, c, g, or t
tacctaccacctgttccctcccacaacatgtgggaatccaaaatgagatttggctggggacacagctaaaccctcttctcagctacccttttctctctcgatctgtgagtaataaacctacttctgtgatttcccatgctttgttctgtggcctccatgggtctgagctgacctacactggaacctcactctccacctggccagggtctctgagagtggctcttgtcagaaatacacaggacacaggtcaggcaacagtcaccaggcatctcctagtctcaacagatattctgtgagagggaggcctggtcgtggtatgcacacctggccactgctggggtaaggaagtgtcctgtgaaaggcacatgttaagcatccacaaccccctgaccagaaccccagaaaggcagggctccaattgacagtcactctccagagacaaacctcaagccctaactggaggaaaataaaacaatgtaaaaatttgaatttatcttactatttcaatgatccagtaaagacattctatgcctgtacaccacatattttcttcgattgtggatttattttagatagaattttaggtctggctttcactttagcctggtccctacctcaagcataaggtaaagattttccatgggttcttttctggtactactacctgccagtgtggggtcatgtcctagtctatcttgagggaatccccctgttcattattgtcagagtgagactgttaagtcttgatttccctggacaacttcactgcatgacttttaatatgattttttaatataccctttactggacaataaattatatagttatctgagtaagagatatggtcaggaagaagcattgcctcattcagcttttctctttggtgaactcgcatatgttctcctcacccgccagtcacctctaaaccgtattgttccaagacaacaaacagaactcgagtgtgtatctttcaccaccggatttctatttnctccataaagctncatgcttaanagggtttctgttagcattttctctgtttattttcccataaaatatcacaggcctttttcatatggaattatgggtgatttccttcaatttgcatcatatcaagttgaggttcatgttgatgaaaagtaaaacatacattgaaaatatcagtaatgatgttttcccctcctttttagcacnngtgcttgtgatacaagcacattttaatacaantgtagtctcatgctttgatcattcctatgatgaaaataacatttttagataaaatatctgagttttatgaggcctttagtatgtgatgtgatagaatatcagaagaccatacttttttctagttttctgtgcaattctatcattgnttcatctttactcctaccagagtaattttccaaaatagatatcttgacattcttc

SEQ ID NO: 513694 - DNA, 114 bp, Homo sapiens
agcgatacacgcactacacgatgcactacagcactaatactacagctagtggttacctgatgcttctggaagttcagtaattcattgggtccaatagcgtgatttccttggtga

SEQ ID NO: 513695 - DNA, 270 bp, Homo sapiens
ataagcatttcgtcactctgcattcatacattcaaaaacaaacacccactggccaggtgcggtgactcacacctgtaatcccagcactttgcagaggccgaaggtgggcggatcacttgaggtcaggagtgcaagaccagcctggacaacatggcgaaaccccatctctactaaaaatgcaaaaattagttgggtgtggtggcaggcccctgcactcccagctactcaggaggttgaggcaggagaatcacttaagccagggaggcagag

SEQ ID NO: 513696 - DNA, 544 bp, Homo sapiens
  misc_feature (335)..(335): n is a, c, g, or t
  misc_feature (403)..(403): n is a, c, g, or t
  misc_feature (416)..(416): n is a, c, g, or t
  misc_feature (423)..(423): n is a, c, g, or t
  misc_feature (425)..(425): n is a, c, g, or t
  misc_feature (431)..(431): n is a, c, g, or t
  misc_feature (511)..(511): n is a, c, g, or t
  misc_feature (540)..(540): n is a, c, g, or t
caggtttaaaagctgaaaataaacttgcatcaaaagcaaaaacctaactgaagctctgccatctgcccccagagacatctttgctttcatttccttgtcccaaggagaagacaatatagaacggaatttcagcaattctaattttaacttttctaagctcaaatatatccctttagaatcttgggggaaaggatggctgtatccttaagcactttaaatactacttttacaattgctcgattgcttcacatttctgccagactctggaaaagatgatggggttgtaaaaaatttttaaactttagataagtaaagtttcatggcttccttcaagnccaattcttcccagaggtaatcactctaatagttaataatttcctggcagattcactctatatttacntatatatgacacncccaatncnttttgncaatttatttacccagatgggacatgcttgccactaacttatttcacaacattaactatgtgcttacaggcctctatgtnggaatgattctatatattttctgtggganggtt

SEQ ID NO: 513697 - DNA, 872 bp, Homo sapiens
  misc_feature (24)..(24): n is a, c, g, or t
  misc_feature (87)..(87): n is a, c, g, or t
  misc_feature (89)..(89): n is a, c, g, or t
  misc_feature (91)..(91): n is a, c, g, or t
  misc_feature (93)..(93): n is a, c, g, or t
  misc_feature (98)..(98): n is a, c, g, or t
  misc_feature (100)..(100): n is a, c, g, or t
  misc_feature (103)..(103): n is a, c, g, or t
  misc_feature (109)..(109): n is a, c, g, or t
  misc_feature (119)..(119): n is a, c, g, or t
  misc_feature (130)..(130): n is a, c, g, or t
  misc_feature (142)..(142): n is a, c, g, or t
  misc_feature (172)..(172): n is a, c, g, or t
  misc_feature (174)..(174): n is a, c, g, or t
  misc_feature (201)..(201): n is a, c, g, or t
  misc_feature (211)..(211): n is a, c, g, or t
  misc_feature (222)..(222): n is a, c, g, or t
  misc_feature (226)..(226): n is a, c, g, or t
  misc_feature (246)..(246): n is a, c, g, or t
  misc_feature (249)..(250): n is a, c, g, or t
  misc_feature (256)..(258): n is a, c, g, or t
  misc_feature (262)..(262): n is a, c, g, or t
  misc_feature (270)..(270): n is a, c, g, or t
  misc_feature (280)..(280): n is a, c, g, or t
  misc_feature (298)..(298): n is a, c, g, or t
  misc_feature (303)..(303): n is a, c, g, or t
  misc_feature (308)..(310): n is a, c, g, or t
  misc_feature (315)..(316): n is a, c, g, or t
  misc_feature (318)..(318): n is a, c, g, or t
  misc_feature (358)..(361): n is a, c, g, or t
  misc_feature (367)..(367): n is a, c, g, or t
  misc_feature (371)..(372): n is a, c, g, or t
  misc_feature (377)..(377): n is a, c, g, or t
  misc_feature (382)..(382): n is a, c, g, or t
  misc_feature (392)..(392): n is a, c, g, or t
  misc_feature (401)..(402): n is a, c, g, or t
  misc_feature (412)..(412): n is a, c, g, or t
  misc_feature (414)..(414): n is a, c, g, or t
  misc_feature (443)..(443): n is a, c, g, or t
  misc_feature (455)..(455): n is a, c, g, or t
  misc_feature (543)..(543): n is a, c, g, or t
  misc_feature (663)..(663): n is a, c, g, or t
  misc_feature (677)..(677): n is a, c, g, or t
  misc_feature (753)..(753): n is a, c, g, or t
  misc_feature (857)..(857): n is a, c, g, or t
aatttttttcaaaaatcttatatngttattcttacccacccaaaaaaatggcattctctttggctcaaaccacaacaaaaacaattnantnanttctntntgntttttnaaaaaaaacnttttctcacangtctacattctntttaaaacaccactataaacacctggaaangnaaactaaacgtagacaaaacaaataanatttttttgntgctgcacgtnaatncactttgtgcatgctaattnagnngtatannntctntccctctntccctctatntttcaagctatataaaantaaanaaatnnnataanntnagcgctattttacagaatattgtttttttttttttttttnnnntgctanatgnngattnttttngggcaaaggnaccgttttnnttcccaatantntccatgggtgtcctgttgctgtgagcttnctgttctaactnctcggccctggccatttccaagacttcccggaggaggtggaaggtgagatccagggagatgggaggctcctcggaccgcctttctctntccggtgcctcctggtggccgccgagggcattcctagcgccgcgctccgcgaaaaccgcggggctgtgcgagcgagcgccgaggcagcagcagctgctgcagcaacacgcggaaaaagtnggcggtcgcctgtnccggcgaagggcggctgccgctgccgccggcgaggagcgaggaggcgggcgaaaggggagcggccgggctcttgtngaggttccccaggcggaggaagttctcctctcccatgcggagaggaccggccgagcctgcggctgctggggctgctcggactgcggcggcggctggaagaaatncaagggctgaaggtg

SEQ ID NO: 513698 - DNA, 1497 bp, Homo sapiens
  misc_feature (1143)..(1143): n is a, c, g, or t
  misc_feature (1497)..(1497): n is a, c, g, or t
cccgaggctgctgtcagaggtatacttcccattactgcttcacacagatccgcctgcttctaaacaggataaggtactagtatcgcttggcgtccttgaggagaccacactagcctaggtggcagattggacattcctcaactaacatcatggcttcttgataagtacgctattcggttcactgcatcccgatgcgtatacattcccgcaaatgcccttgagcgccacgtggccatgttggagttgacgtcgaatgattgaatggatgagaggactagagcctgcctctcatttctacgctctatgaataatgattacagttattgtccctgtgcgtttcctgtatacttgccagtggcaagcgaagccgagcgagtatacccgagtcatttcactaccatactgaactactgaatcccttattaagcggtggacttccatatagtttccgtcaatgggaacagctgacaaatacaccctgttgccaatcatactccgttgcgagttgacccccacctttgtcctcttaaatgtgggagtaaaggtgattaatagtccccgatcaggtctaaactttctttagccctagtccattgtcggcgtacgatgttaggttccaccaaaacgggccaccgcgaagacaccgcaattgtttatatcccgaccccaattgataagggaccttaccaaccgcagggcctctcaagaacggctgcggcacacttgtagggggccagaccattatttagcgccaataccacttcctatggagaccttgttggcttgggaatagtccgggacacaatgaggttacgcacttgggcaccatacagttgtttctctttctcgtttgccgcttaacttttggccgctgccatttaccacgccgaacattccacatatgaatgccctttaaaaagaaaggggggagacgcccaacatagcgagcattaggcaccgccgggacaccaaaaaacccaacggtcagggctatacacttggacgcactgtgttacactttggtggccctcgggaggccggagagacacacctcctttgtggcgcacgacggctttgaacttaaacagccgcttaactctcatctgtgccgttgtggcgagcacaaaggtgcaccagacatanacgaggctaccctttcaaaagttttcgacctcaaagggagccgtctgaaaaattctgcaacaaatcgcaaaactgtgcacgtatccccacgcccatttggcgggcagagttggcacccattctgacggagttatcccagagctagaaagggtcacatctgggatggttcgattgcccaacattaagggaactgttatgagccgttttaggaacgaaccctcttcctacaggcaaacaacacatgcggatgtcactcatcgtgcactcattcatgactgggcactatctcctcctgactcctggagcactcatctcacgacgacgacagggctacgccgtccaccacggcatccn

SEQ ID NO: 513699 - DNA, 446 bp, Homo sapiens
acccccatttccctttgttttgaataggggtttccctcccaatgtgttttttttgggttggggtttttacctccgggggttttttttgggataaatgggatttccttttttcttttaagccccttttttttttttttcccaagccgggtttttgggttttttgggtttttaccttttggaacttaatccggaatcccggccttgaaattcccctttttggattccttggggccggaaaccatttttgccttgttaatccccaatggttttttttttggggtttttaaattccgttctttttgccattttggggttttttgaggcccctttttttttttttcccccaaaaattattttattggccttttccaggatttttttttttttttcccctctttatccggggttttattttttttgggttaattaaaactttttttttttta

SEQ ID NO: 513700 - DNA, 118 bp, Homo sapiens
  misc_feature (13)..(13): n is a, c, g, or t
  misc_feature (19)..(19): n is a, c, g, or t
  misc_feature (41)..(41): n is a, c, g, or t
  misc_feature (72)..(72): n is a, c, g, or t
  misc_feature (82)..(82): n is a, c, g, or t
gaagctatagagnggttgnaggccctgggcttcccagagancctggtcatccaggcctatttcgcgtgtganaaaaatgagnacttggctgccaacttcctcctgagtcagaactttg

SEQ ID NO: 513701 - DNA, 103 bp, Homo sapiens
tgagctgctccaaacagcctacgttgaattatggattttctaacatatccaaaagttaactgtatgacaatagcaaaaagaacagaagataggaaaatggaga

SEQ ID NO: 513702 - DNA, 185 bp, Homo sapiens
catcctgatggctgactctagaggataaacgtttgccacgcagggtggagaggtcttcggccagggtattgaccgggcctaccaaagccttgcggtcgttttccttgaccttgtcgtaggtcatgaagccgccgtcaggggttttgtacttggccaggatcttgttcaccgtggcgaagttcttg

SEQ ID NO: 513703 - DNA, 398 bp, Homo sapiens
tgcagtggcgcgatctcagctcactgcaacttccgcctcctgggtccaagtgattctcgtgcctcagcctcccaagtacctgggaccacaggggtgcaccaacacacctggctaattttggtatatatatatatatatatttagtagagatggggtttcgccatgttggccaggctggtcttgaactcccgacctcaggtgatctgcctgtctcagcctcctaaagtgctgggattataggtgtgagccactgcgcctggcctaagtttttaaaaagttaaagaagaatggcatagtgcattattgaggctcgtttaacgagatcaagagcagaaagtgtttgcagacccatgcatagcccaaagtcctgaagagaaaggcatagttaagtggttcga

SEQ ID NO: 513704 - DNA, 1867 bp, Homo sapiens
  misc_feature (577)..(577): n is a, c, g, or t
  misc_feature (636)..(636): n is a, c, g, or t
  misc_feature (679)..(679): n is a, c, g, or t
  misc_feature (770)..(770): n is a, c, g, or t
  misc_feature (969)..(969): n is a, c, g, or t
  misc_feature (1230)..(1230): n is a, c, g, or t
  misc_feature (1500)..(1500): n is a, c, g, or t
  misc_feature (1621)..(1621): n is a, c, g, or t
gattgtgcctgttggctatgagttagcttgctgctttgtcatgtcatcttgattttagctgtcgtctttgacgtagtctgtcttagtctttgtctggctgcgtgctggagcatgttggagtgtgaccgttcggtgtgactacatgcgtccttagtatgaggtgtggtctggcggacttgcttgtgggtgtggctggtcggcttgttctgttgacttgtgtgacggctagcccatcaacacacctactgtggttgatgtctgctacatcgctgttgcgttgttgtgtgtgtgttttttacttgtgctgtgtgtgtaggctgacgtgctgtgtatgtgtctttgtgaagtgtgttgtgtaatcgttatggttgtacgattgtttaattgttattgtgtgttgtgttatattgggggtttagtgtatgagtagtatagttgaggattgtagagtgtgatgatagagtaggtcgatgcgtggctggtagtggtgtcggtgtgctgtagtcgctggtgtctgtgtgttagtgggtagtcgcgtctagcgctcgtggttcgtgtcgtgtttgtttgtgggccnccaggctcaaaattgtgtaatagcccacagtgtgcccccccgttgttatttgggtggtnttcgtagaagagcaacgcagcactaagtgtccgccggaagttnttttataggggggggcagaccacaccagcttatgttgtagggacacctccttcttctgatagagtggggggctcccccgacccaacaaggnggttttgggtcaccccccgagatatatagtgccacatcgggccgttttttggggtattaaaaacctcggtccctggcgccccacacggttgttacccgttattttttcacccgcggggtcctctttaataaaggggtttgtcgcctcgagtggggcctctcttgtggtggtggtgtcgcgaaattttttcttcggcgcnacacctcgtagagggggggagggcgcctgcttatcctcatcagtcgtcgctcgctcggcggctttttgtgggtcgctcgcacaacagcgcaccaaaaaggtctgttcttttaataggtgggagctctcctctccttgtgtataaaaggttgtcctcccacgacgcagaaatattgtttttcgcgcgcagtgatgatctctctcatcacacacgcgcatcacacatctctcgaattgtgcgcgcgcgcgcgcggagaaaatnatatagcgcgccttttttgcgccacagatctccgcgtcgcgccacacttataaagagggtgtttgtgcgcgccgagaaagaatatatgtcgctctacaatagtgtgtggtgtgttagagagagaaaaacccacgagccttttgtagctctctctctccacaacagagaggcgcgcgtggagtgagaatctctctcttgtagagagagatagagaggttggagacacgctgttgagatctaccgcacttatatgcacgagatttcgcaccngcccacgcgtataccacgatgagtcccacgcagactcgggtttttgtagacacacagcacacagaaagagagatttataaagagagatgtgagaaaatataccgcccacgcgtctctatancccacatggtcttgtgagcacacacacagcctccctgaaagaaccctggaggcggacctgaaagaaagaattctgggcccacataagaagggctgcgtcacacttttggggccctttgtgtcccagaggcccccaccccccaagaacccctggcccccctggcccccccgctgggggtgtcccagaaagaaaataagatctgttaggccttttcttgtttaataaaattagggttaaataccctta

SEQ ID NO: 513705 - DNA, 670 bp, Homo sapiens
cgacggagatactagtactactatgactatcaaccagtagattataggtacggacacagcataccggtggtactactacttaccatgcctaccagtaccgaccctaccgtatatatcctactacacgacatatgacatatcgctacctagggtaccaatacatatactactggcacatactacactagacaatacataggagcactctagcactagcaacacagtatattaaggtagcgtataagaattcacatatctttggcccaaactcaaagctcattagacaggcctactcgcaatggtatttgaccggtgtcaggcacgactttctatttaacgctatctctgtgacccgtttagagtaagctgaccatgtgccccgggctacacacacccatggctcataggggctaccaagagtatctagggtaagccccttggactatgtgtcctccttccagattagccgatccccttaagcccacagttccgtaccatcacctttggtggcagacctcatgatcgttcaactctcataccggcaaacactcgtgctgtcaccttggacacctttgtattggctcccgcttacacgtcgtcgtacagacagtcgggccctcgtcttggaagggcccaccaaccacgtttatacccattatcccccagctca

SEQ ID NO: 513706 - DNA, 799 bp, Homo sapiens
tttgacttgagccagctgcacaggggcctggacgctcgggctgaagtgactcgtaacgacgttgcaccaagcctcatgagtgtcccccggtatcttccccgacctgcgagtcccgatgaaatggaaatttgagtgatgaaaatctgaaagcggttgatactgaccccacagccccgccttatgattctctgctcgtgttggactatgaaggaagcggttccgaagctgcggtagtctgagctccctgaactcctcagagtcagacaaagaccaggacgtatgactacttgaacgaatggggcaatcgcttcaagaagctggctgacatgtacggaggcggttgaggacgacctagggggactcgagagaggcgggccccagatcccatgtgctgtggaacatggcatgaaatcacgttgctggtggtttcttcagactcccttcccttgaagatgacgtttcctggggaaacagagatagagactggtgagtgatgcagcttagtatagctttatactctctccactttagtagctctaactaagttcgggttagaaagagttttccgactgatgtatctttaaaggctgctcgttgtgttttcccaattcactccttttacatgggcggagattgtccaaaaggataccccagaattttgattatgcgcatgcaggaacatcttgtgggcttcagaaggttcccccagatacctggcaggattttcctcgagcggaacttgggttccactttacaaacagaaaggcgggaagcgtcccgctacctaaattcggggggg

SEQ ID NO: 513707 - DNA, 530 bp, Homo sapiens
ctccagatatgcagagacccgcacaagattatcagacatgattatctgatgaagattttaaagcaaccatcataaccatgcttcaataagtaatcataatttctcttgaaataaatggggaaaaaaacagaaaattgtatcaaagaagtgcaagttatagaaaagaataaaatggaactcatagaactgaaaaatatgataaccaaattttttaaatctcactagatgaactcaagaatacagcatagatgaaataatagaatcagtgaacttgatgacagattgctatggtctaaatgtttgtatgtcctccaaaatgtatatgttggatcctaatcaccaaggtgattatattagaaagtaggggctctgggagatgattaagtcatgagcagttcaccctcatgaatgagatttatgcccttacaaaagaggtcccagagacctgtcttgctccttccagtatgttagaacatagcaagaaggcaccatctatgaaccagaaagcaagacctcaacagaaacaaatc

SEQ ID NO: 513708 - DNA, 139 bp, Homo sapiens
acatcgggtgaggcctatcttacggatcctttctctactctgtggggctgcactctcggtattatcctccatgcttgcaactatacgcaccagccttcataggctatgtcctcccgtgcggccaactatcattctgagg

SEQ ID NO: 513709 - DNA, 224 bp, Homo sapiens
ttagcggcgcccttttttttattttttattctttgacatggggctagctctctcacacaagctggagggcagtggcttgatcgtggctcacagcagcctcaacctcctgggaccatgaagctgattctcctacctcagcctcccaagtagctgggtctacaggcaagcgccaccatgtccagctaattttctttttctctctggtagggaagaggtcagcgtgg

SEQ ID NO: 513710 - DNA, 118 bp, Homo sapiens
tgctattggctagcaaatacttttttatttttctatttataagtgaaagagataaaccaagatttatgtctgacgaatctccctgaactgccttatttataggggcctcatttagaaa

SEQ ID NO: 513711 - DNA, 921 bp, Homo sapiens
cggcgtcaagtggggcaatcgctggtggaggtggcggagagcaaggtggcagccgggagcccatcagaggaaaagtccgaggcgctggaaccctgcgtccaggcgtgacggtcatcccgaaaggccggacccagtttcatccttttatcctgtaatctgtcaccatgaccctgacaaaaggttccttcacctactccagtggggaggaatatcgtggcgagtggaaggagggccgcaggcatgcgccccgggtcaactgatgctctgcacgcactggtggcacctacctgggtcatatttgagaatgggctctttacatggcttacggggctattgaccttctcagcatggcttcaaggctatgaggggcgagctatgcccagggcaagcttcaactggcgtcggagatcttcatccgactatgacaaccatgacctttgagcggggaattcacacaaatggcacgagtagatggtcaggcctgctgacttttccctgatggttctcatggaaatcccccgaccattgacaggtctctacagacgaacaaacaagctgctgcgacgtgagcaagtgtcctggccattggtccagcaggggcccagaaggcgcctccgaaggtaaggccaagaaatttcacatggcctggacagacgcaattggagcaacaagcttggataaagaacaggagaaaaggccagtggcccagcaagcgaagcaacacaagagagggaccaccaggagactaaaaaacgaccaatgagctagcgcaccggaaactaggaaacagaaagaccatggacatagccacccgcacacctcggcaaaccaacacacggggccccccgaacaagcgcaagactagcgccaccagaaccaccggaagaacaccgagcggagtcacgctagcagacgtaccat

SEQ ID NO: 513712 - DNA, 234 bp, Homo sapiens
agtcatggaaattggcagctcgtttatatcaccattttctgatgaaatgaacccaaacaaaggtcttaacaataccctacctgcgacaaatatagcaaatagagctataatagccttaagcaaagctatccctagagctgatactaaagaaattttactatcgctagcaaatagcggtacaataactagcagtggcacaactgcgagatcttgtaataacaaaatggctaggga

SEQ ID NO: 513713 - DNA, 254 bp, Homo sapiens
cgtttatcgttgcaccaattatgtggattcacataactgagtggcaagatagtataggactcctttccgattggcctaaaaccattagtatctactaatgggacgctgaaattttatatttttgggtggagacaaggtttcaccagtgttggccaggctggtctgcacgctccgtgacttcaaggtgatccgtgcctcccacaagtgctgggtcttacacgccgtgaggccatgcaattttacactctagaaac

SEQ ID NO: 513714 - DNA, 259 bp, Homo sapiens
cggcacatgcttataccttgtttactatttcacatggaaccgaaatattcttccaggtagaaaacaatgcgacgaatatgtttatgacggttgatggtacaccaggagagttagtctccgcaggacagacaccaggcgaactggatatactaccgagaacttcctccgcgatcccccgagcgcctcgggagcaactgggagctgctgcaaactaggcgtttggcgtacttacttatctcctgcttcttcagagtgccta

SEQ ID NO: 513715 - DNA, 592 bp, Homo sapiens
acggtcggaatccgggtcgacccacgcgtcgccagatcatactgaaccaagctgccacttcacttcagcagaccacttgatcacgcacaggaagttcagatcagaaaatgcaggctggcgctaccgcctgttgggttctcgcgccgtgctgcccgccaaggcccggccggcggcgaggagcacggtggtggcccgtgtccctgccactaggaggagcgtccgtgcggctgccgccgccgtcgtcgtggcggagcctacgcaggtcgactacagctcaagattctcggtgttcccgatggaggcctgcgacctgctcggcggcgacgcgtgcatcggggagatgtacccggaggccaagctcgccgcggcggcgccggaggcgagcaggaggggtgcacggggtggagagggactacctgtcctacgacgatccaaaaacggtgttcccgggcgaggcgtgcgacgacctcggcggcgagttctgcgaggcgccgtacctggatggcgtcttccaggcagctggcgcaacgcctgaatcctggcagatccatccatgtctgtccagaaacgaattggtctcacagtgagccag

SEQ ID NO: 513716 - DNA, 706 bp, Homo sapiens
  misc_feature (473)..(473): n is a, c, g, or t
agctccaggcttctgggggtccggggcacccagtgtgtctgttggtgttgggaatggcgggatccgaggaaaaccagttttgtacagaggctcacaggacacctgcatgcccaaggcactccaccgatatgtgatcaactctggatccagcagtacatgaatgtgccctttcctgccaatatagatattcgtgatactgtaaagtataaagaagtaatgaaacaatatggacattggatccaatggcggctatagtgacctcaacgtctaatcatcatttgcatagcaagatttgatctaggtgatgaaatttattgagaaggccctagaacaatgttcaaattatgtgttgattgacacacctgtgacagagttgtaggtattcagctggttcagcattcatggagacagttcaatcactggaagcccattgcatcctcatttccaacaagttgtcatcatatgctagatgngaacactatgcgagaaaagtaccgaaccacaggtgacctttcatgtccaaccatgcgtctatgctctgacgagcagttctttatagcgaaaagcgaagactgtccttgtcagttgtggtcgatgaataaatagtgatcatcgattgtaccatgagtcttgtgctagttggcaatggcatgcgagggattttctggaggggtattccaaggatggcctgtggaaatcatggaga

SEQ ID NO: 513717 - DNA, 1589 bp, Homo sapiens
  misc_feature (358)..(358): n is a, c, g, or t
gtgttcttctcgtgcatactatgactaagagtgagttacatatggacgctatgttctgtgtcttccgcggttagttaactttaatacgggtacaatactctccacaaatcgctcccgcgtaacccatttgcatgtccatggcatattgactgagtacggcaggatcgtcctttaaggttacctttgcaatgaaacggaaccacactctagtgtggtcctcaaagtccattgtacttgctcgacgcattgtgagaccagtatactaatcttattaagacacggacatagacgtagatgagcagtctaggtatcaataacattttcatagatggcacctggtgaaaaaagcattactgcntgggacaacctcaggtgcaccatttgactcgtcccatctgtacaataccacatgtcttgatatgatctcagatgtgtttcatcaatcacttcactagagtaaacttacttgacgccaagtgagaggactgtgatgtcttgccaagctttaagcctgcaatgcactactgtgagaatgcaccaatttcacacaattcgcatggaggccgtatttccaactttcacgtggagtaaaactcttttctactttaacatcacatgaaattcccaacgcggccaaggctccttatccaggaggaaagccctactgtgcatgttccttgttgttcgggttataacttggaattccccccaatgggggattgcgaccctataccaagaagcgttcattccaacttgccgattaggagctacttctcatataatagatttttaaggagccttaaccctataaccccgatttggcagcctcggtgggtacaccacgaaggaatttcctccccttcttgtccgctaattgttgggaccatttgtgcccagtatcccaattggcatataaagcaaactgggaagccttcaacttcaacggcgggggtataaagactagctggagtgggaataggccatcgggctgtcgagggagaaacaggcttacagtgagcgcgccaaacttgccgagttgtgtcacgccaatattttttctcccgtttctgaaacacaccccccaactgttggagctcgcgcacaatatggccggtggaactactggaatcacctcctagagagggagagagtcccctgagcgcacagatataggacacataagaacacaacagcaatgtcttgccttttctctataaaggagacagcgccgaagccaacggggccgcccaatttcccacgcgcgggcaactcgtggcaggttacccacgacccacggaaagcacccaggggctcacccaacaccaggtgggtgtgcaacacggtctcgcaagccgcgaacaacagtagtgtcacactctgggcagcacaccagcaaaccacccctggacgacgacgcaggcccatccactcaccgcaaaaccagttgcgaaccgacccactccctgcaccgactagacgccgatctccccacgacagtaccagccaatcacgcaccagcgcgacacacagccgtccacacacacacaccgacaacatcaacatcgcgcgcagacgaaaccacaacgaca

SEQ ID NO: 513718 - DNA, 218 bp, Homo sapiens
ttcggagattcgatatcagcctggccaacatggagaggccccatctctactacaaatataaagaattaatggggcatgatggcatgcactctttcatcccagcttactctgcatagctgaggcaggaggcatcacttgaatcccggtaagtggaggttgccgtgcacctgagatcgcgccacatgtactccgagacgtggccgatatcagcgaagacc

SEQ ID NO: 513719 - DNA, 310 bp, Homo sapiens
tgcaggaaaggtcactggcctctatgtcacatgtggggcagggtgggaccgtcaacgtcggtcacgaccaaagcagtctctgtgtgatggacagtggcactcggtggcagtcaccataacacaacacatcctgtacctggactgggacacggacagtagctacacatgctggacagatccccttcccatctgccaggactcaagagccaatacacctttggcggggctccagccaatttgatgagactgaggatcccgtgtgtggaaatcattctttggttggctgaggaatattcatgtcattcacatc

SEQ ID NO: 513720 - DNA, 664 bp, Homo sapiens
ggatcactttccaagggagcgatactaaggcagactgagcttttgaaagatgggaggtcaggaggtggaagcgagaggagatcccatctcacagaactacacttccacgtaaatgcaggaccagcacttttccatgtgtcctgccctcttgagaggtcattctctcatcgtcctaagaagcctgtatcaggataagttgcggaagggttctgtgggaagataggcagcaggttgagagcagagacacttgccgacagggtggagcagatttgctcacggggtatcacatggtcttgcagtttggagctcttcgaccgagttggtgggagttctatgtaatgtgcggtgcaactgaacctgaaatagtgtagatagggacaaaagaccagtttatagggtggggttgatgatccaactgtgtgaagaagcagtttagctagcatctgtctccccaacagtccccatcccgggaggggcttatgttacaacggtgatcaagtgaaggaaaaacctgagcctatctggctgggatggtggaattaagcacaaggtcacattctctgtgatcacatgagagggaaggtgatgacttaaatggcagggggtggggatgatctggggagaggctgaaaagcaaaaaaagatagtcttccatgtaagtatg

SEQ ID NO: 513721 - DNA, 1837 bp, Homo sapiens
  misc_feature (180)..(180): n is a, c, g, or t
  misc_feature (746)..(746): n is a, c, g, or t
  misc_feature (1837)..(1837): n is a, c, g, or t
gaacgccaatgctgtacaggcactgcgatggttcaataatactacctcagcgtaccagtagaccgtgtgagactgatatctatcgcactgagagtttctcagaattcagctgtagcacgcagaggctgggaatactatctatggggacaactatgctccaaatggatacaagccgcagtntgatgtatgctcatactgtggtcttagttatccgagggacgcaatatacgcgtgagatgagtggactgtccaaatgatgatgtgccattatgatgtgtgtggtattcctggagctcacctttacatcattgtgagtctcagtgtgtgtcccgtgaagtcagtggggatgagatgacatgagcgtgagtacaacagagtgaggtttatggtggtgggggcagtctccgaacatattcaaaaaggtacggccttcatatcgtaccgtgaatttggaaggaaaacccgcatcatcacccactgaaagctgatccaggaaaatggcgtggggttacgatagatttgggacagaccgcataaatttgttcgcgtcttagtactatctcaaatgctatgtagagaaagagcaggtctattagtgttgccatatggtcgatcgttatttgtggcgcaatttcacgtgtctgtccacgtatgggccttagttgtgcatttggtaaatacttctccaattgacaccatctgggttgtggcaaggaccctgtccagtgttagagcgccttccgganaatccaaaacttatagaacgtgtgggtccagggacaattcaatataccagttggcggccacagagggacactttaggcggctctataggcaaatgcgcaggggggaaaaacccccgccattgggtccgtccattaacgttcaccttgggataattggcaccctttagaaaaaccaagcacagggaaaggaacatagggccattgcaaatcaatggacgttcaacgttgaacccttaactttagttccaggccacacaacgttggaaaagtggagagtaaaaaccaattaaaggtttaagccatagaaagtccttaagtggggtttgccaggcgaagggagacactttgggaggtttgggcagggcgtttggcccacatatggttccagaggaaccctaattttttcctaggagtttggggctgtttatatgaaaaacccaggggaagtggtttgtcactggtttaccaaagcccacaattaaattcttaattggggcaaagccattgcccttgtatatatggggcccgaaacttatttgagatcacaacgctcccggactggtgttcacccaacaagacgaaatgatccctccaagaaacacacgagacaagaaggaaagatccaacacaccgcgtgcctaaataaggtgggttcttagacacctatcacccggggtcagttatagttggaagaacacactcacggggggcgacacatggggagtcacccccacaaatacctttataaggggcaggagttaggggacaacccaggcggacatacaccgggtatttatggggagcagcgacgaggatagctactgtggaagacaacacagactggtgtgagtaatcaaaacaagaggtacataacggcgtgggaggaaacaacagcagatcgtggagagataccaaacaagagggggggtgcagcacaacaactcatgaaacagagaggattatcgctaggtagtcagaagagagctacgtacgtacacaacagcagagctgaagatgaggacacatacggtcgtgtccgtcttgctactcacacgcacgtcttgcagtcgcgccaagtagagtgggcaggn

SEQ ID NO: 513722 - DNA, 1429 bp, Homo sapiens
ggtgataacctccaggagtccctggtcggatagtaggagagctagtcgagggggaggatgaaagaggcttccggagcagtgttcaggaacagtgtctatacgagagactgatcgaaacatgatcatacgagatttcatgcattacgttcatccatcttgacgtttcactcatcactctaacagcgacacatctcgaagaagagcccatcgcgctaggaagaccgatgagaaatgacgaaaatcactctgaacgagtctcgggggaaaacatcggtgaatcctgagccagatcatcagaagacagtctcgcgaagctaggcagcagtccacttgtgccaacatgcgaacgatccaagtaagacgcttgggggcccacgactagagagagcttggcggagggaaggaggacctgagtgggacagccgcccgactccggaaggagcggggatagcaagaattattgtgccaggcgcacgatctaaacagtcagcacgtctacagctcggatgccaaggcctagacagcgcttggtagagacggcaggtgcgaaaagggccgacccggccggagaggagaccaaggacgaacgggttgacgaaggtaacaggaagctgcagaggcctgctaacggggctaggaaggccctgggccagagtttggacgacgacggaagtctgccgtggccgggctcgtgcccggaaggcttgcaggactgggtacgcgccctactttccaagtcagggaaggggcacaggccatccggccatgcacacaggcgaacacctcgagcggcgaaacgtcccccccaaacggccacgaaaaagggaccgagaggcaattaggggcagatcagcacagcacgggggggaggaggaaacagggtttgaggattttggtttgcactcgccatatggttggaactcgggaaacggtctcgcccttaccgcggggactacctcttcaaaaaggacggttcccctgtcactaaggcacaagggtaggaagggggcaggcgacctcgaagtacagactgaataacagacatgtggaaggtgcttcactacccgccggcatcacggcattagcaaccatccgagggattaactcacaagagactacggggcgtatatcgcgcaacaagtacaggcgacaaaacaagggggttccggcacggccgacgacccgggtggggcaacgacaaacgacatcttccgatgcgcggattgacagctgcgagacaacggtccgaccacgttgtcgctaagagcacagcccgaggacacgaccagcccaccacgaacgtagagcaaacggaacaacttcatctatctaatgacacgcccaaccgatattggcagcacacaagtggttgcgcaggcgggccgcgccacacgaggcagcagtgcggcagcaacacacagtggagcgg

SEQ ID NO: 513723 - DNA, 1542 bp, Homo sapiens
attcactcgtacgggtggcgccatgcctagtccttgtcgttctcgcttctctctcctcgcttcttgtctagtgttgtctccatgccgcttggtcggtatgttgttctgtgccgctctgtatgttctctcattcaggttcatttctcgtgtcgcttgctctttctgtttttgtttggtgtctctttttctctttgtgtgtttctcttgattcttgtgtttctatacttatggatgccctttgttttccttgtctgttgtccttgttttgtgtggcttatcgtttcgtctatgtgtttgtttgttgaatgcgcttttgtgtgtgttggttcctatgtattgttgatcatttgtgtagttcctctggtgtgtttactctattgtgttttttctgttgccgtttgttgtgtactagtcttcttttattaggtttctgtttcttccttttgtttatgtgttggttttgtgctccttttgccattgtgtgtgttatgataggaatgggtgttggtgatattttgtttcttgttgatgtgttgattatgatggtgtgttggatatctctgattgatattgttgttggttttcgttgattgatgtggggtgtgtgttcatggtgggttggtgtatgtaggtaatgttatgtgtagtgagtggtgtgggatgtttagtgctatttttgttagtgagtgtgatggatattgattatggttttcctctccgttttatattatgtgtccctaatcctggtcccgtttctcacataatcaggcatgcctcttttagattaccatcgcgggctactataggattgtgcattgataattctcgatatagtgtgctggtccccgtcgtgcgtaatgtggctgtcgctagttcattgttctcattctatggtgttctctcttggattttggggtatgttttgtgttcgtgttttccatgttgtccatgtccgttctggattgcttgttatgtggtggtgtctgtgtttgctctctttttgtttcgttatgtacctgtgttatgttttctctttgtttgttttctcttgtcttgtgtatagtgctcgctgtttgtccgtttccattgtgctttgtgtcgtgtctgttctctatcttatgtgcctatcttacatctagtcccttgttgttcctggttgtcctagtatttggtgtggtttattgtttatctaatgtactgctttgtgtcattcacctctgttctatgtttgttaatatcctagtgtggctattccttgcgtaggtgctatgtgtctgttggaccgatactgtatgctaggtagctacctcacgtgtgctattgtgacactctcttatagttctggcacctgtgtatagcccttgtaaacacccgtaagccaccaggttccccgtttacctctagagacgtctatttttgtgtctttttaatcggggtaggggggagggggtggttgtagctccattattcttttttattaaaaaataccacttaccaccatggaggctcaccttgtctcccagccacaatgtacaaagcgta

SEQ ID NO: 513724 - DNA, 428 bp, Homo sapiens
gacagaaagttccaagtgctctgcaagtcttgtgagggagattagtaaaagtgattcccaaggaaatgtaaaaaagggaatatagatatttgccttttcctagtgtctgctatgcaccagcagtggggtgtacagacctgtgtttgaacccaaagaggtagtgcctgcatcagaactcagcttagccactgtgggttttctctgaactgggaaggaaggacttaggatggactggtgctcctgggacaccggaatctgtcatctacaaggccagagcttgctagcaggtcctagagcctcaatattgcagtttccaaggggagagcctagagtccaagaaggaggcttactagaagagtccaatccagttggtgccccttggaaatctctttaagaaacagggaagaaaaggagatacaaagaggagg

SEQ ID NO: 513725 - DNA, 936 bp, Homo sapiens
attcggagtcatgctcaagccccgtgagtaaacatctatggctatcgccgttccttgtgctagtccctatgaggcataggtataagcaagctccatctgactacgataaacagagcctaaaatcgtcattgcatactcttcaatcagacaatagccctcggagtggcggccattgtcatccaaaccactgaagcttacaccggcgcggtcatgctcataatcgccacgggattaatcctcattatatttctgcctagcaaatctcaaaggtacgaatgccctgcacagtcgcgtcataatcctctctcaaggacgttcgaggtctatccacactaatagcattttggatgacgttctagcaggcctcgtgaacgctcgcctttacccccgactatgaaggctaactggagaacctctcggtgcatagtaaccaagctctcctgatcgaatatcacgtctcctacttacaggactcatcatactagtcacaagccctatactcgcctctaatattgaccagcaatcacaatggggcgcactcacgacgagataagcaaggataaagccctcattcagaggagagaagcctcgtgttcatacaccgtatccccccattggtcgtcgtaatcctaaatcccgacattagtaccgagtttgcctcttaccaaaacgtaggacacagatcagtagatactgttcggtccggccgccacagaaatgttttagcacacatttgtggggggcccagtggaagtggagtggccaggggcctaagaacggcacgaagggggctcccaaaaaagcggggaccgcctttgaacagcgggttgggatggactcacggaacagcatcccgcggagagaatgaggagcgggagctagacatcacgcgcgagtcgtggacacacaaggaggtattagcctgcttctctggcc

SEQ ID NO: 513726 - DNA, 105 bp, Homo sapiens
  misc_feature (40)..(40): n is a, c, g, or t
gggtacttcacaccttacctagtcagagtgcttatatatnagcttattttggtatgattgagactaaagactgatcatgcgtgtatgtaaggacaacattctttt

SEQ ID NO: 513727 - DNA, 132 bp, Homo sapiens
gagtgaggttgagggagatggccaatatattagtgcctagcacaatgctcaattgtgtttttccttgttttagatttgccagatttagcaaatacaaatacagaacacctaatttaatttgagtttcagact

SEQ ID NO: 513728 - DNA, 798 bp, Homo sapiens
agccctactcctgccctgtgtgtgggttgcggttcaagagaaaagaccgcatgtcctaccatgtgcggtcccatgatgggtccgtgggcaagccttacatctgccacagctgtggcaaaggcttctccagcgcctgatcagcttgtaagcggacatatcaacgcaggatgtcacacttctgcagtcggcctcacaaagatgatcagacctgacaattgcttcttttgccacccgagaccgtctgtcgctcccaccctggcctgtcactgaagacataggttgccctgaccatgctgctgtgggcaagtacttgcgggcatgacatacagtggtcagaccacctgtaagtaatgcacacgcgaggggcccacgcaacttctgcggtatctgtagaccgagaaaggccagaaatgctcacatcaggatccgatcgagagctctgactcctatggtgacctctcagatgccagcgacctgaagacgccagagaagcagagtagccaatggctcttactccagcgacatggcagtccccaaaaaaaaaaaaaacaaaaaaacccggggcctcaaaagccggagagcgagagaaaaggagggtctcgccaagggcgcaagtggtcaaaaggcgtgttcccgtgacccaacataccatgacaccaaaggggacagctagccaggcgccccaaaagaggagcacggaataacacgaaatgcccagtaaccggataggaacaccaagagacaaccagaaaaataccccaaaaagaaggaaaaaaacaaaaaacaaaacaaagcaac

SEQ ID NO: 513729 - DNA, 160 bp, Homo sapiens
agacagcgaagtcggtgaagatggtgagaaagacacaaaggctgaccagacagagacaggaacctaatatgcttcttgaatctgacgatgagctacttgtaaatgaagaagaagcagcagcactgctagacagtggcagttcagtaggcgctttagcctg

SEQ ID NO: 513730 - DNA, 193 bp, Homo sapiens
acctcgcttagtgctctttggcgcgaatcttattccttccagcggattttcaagggacgtcgggagcgcaccggacgctacagaggtgtagcgctctgccagccattaaaccctagctccggacaaaccgttttcagggtgagagactgttaagtagaaaagataactctacccagggcgcactaagcgaggt

SEQ ID NO: 513731 - DNA, 185 bp, Homo sapiens
gggattgtataaaagctgtttaatcagtgttcatggacaaagaaggagagaaaggagtcaacaatgtgatgtgagaaaaaagagctgacagtgtgagaagaagagaacaccaatgaatgtgagtgagagaaatggagctgatgtggagtgggtacctgatgctctgaattctgtaattcatgtgt

SEQ ID NO: 513732 - DNA, 102 bp, Homo sapiens
gtagccaggccgcgcactgggaaaaaaccacggccttgggcaccttgtacccggtgacgttggcacgcatgtgctccatcacctggtctttggtcagggtgg

SEQ ID NO: 513733 - DNA, 121 bp, Homo sapiens
atgcctgggagagtaattcgacacgaggagctgactggatcgccgagcgcgagtgagggagccgagccgcccgccgccgccgtcttcgcctaccctccacgaacaggagtccgggcaaaac

SEQ ID NO: 513734 - DNA, 102 bp, Homo sapiens
atgtccggtgatgtctgggaggcaggacagttaggtaagggaagcacaaaagttgaagatgaggcactgccatcaaagctgtgcccggtacatgcaaggggt

SEQ ID NO: 513735 - DNA, 379 bp, Homo sapiens
  misc_feature (104)..(104): n is a, c, g, or t
  misc_feature (239)..(239): n is a, c, g, or t
  misc_feature (244)..(244): n is a, c, g, or t
  misc_feature (310)..(310): n is a, c, g, or t
gacaacgagctcgggcctcacccggatggcggctgctacgcgcggctgccggccctggggctcgctcctaggactgaaaagaaaaaacgctgcgcggtcgccgnctgggacctggcttccctgcgctgttccttgggcgccttttgcgaatgcgacttccggcccgacttgccggaaggatctgaagagctgggtccaagggaacctcactgcctgtggccgctccctcttcctcttcnatganatggacaagatgcccccaggcctgatggaagtcctgcggcctttcctgggctcctcctgggtggtntacgggaccatttaccgcaaagccatcttcatcttcctcaaatggcttcctcaactcgggcctcatgga

SEQ ID NO: 513736 - DNA, 259 bp, Homo sapiens
gtagggcggatggtgtcgggtgatggtcgttctaggaggatccccggtgtacgcgcaaccggcaggtctagagtgagtgatcgatgaaggatggatggatgatgatgatgacgaggaagctgaagaaaaagcgccagtgaagaaatctatacgagagactccagccaaaaaggcacaaaaggtcaaagtcagaagtggaaaaggactcagaaaccagtcatcaagcgaccaaggatcaaagggacaaggaagtccgttc

SEQ ID NO: 513737 - DNA, 1709 bp, Homo sapiens
  misc_feature (811)..(811): n is a, c, g, or t
  misc_feature (963)..(963): n is a, c, g, or t
  misc_feature (1104)..(1104): n is a, c, g, or t
tttcttatacgacattagtgcagtaggagtgagtacgtactctctggtctctggtcatgtttagttgatgcgtgaaacgtgtgtacgctcggctgtcatattatatctagttggcgtgggttgtcgtgttctagtctctctctgcttgtcagtcgtgtatggtgtagatatatgatctagttgtcgatctctacatgtgcacggggtgtgtggattacctgttgttggtgttagtggtgctcggactcattgtgacggcatctgtggtcgtcgccgccgcttgtttttcacctgctgggcgcaatattatagtcactcgcgcgggtgctaaactctcgtgggtgttgttcctcgcgccgttgctgtttggcgtgtgtactctagcctgcccctttgttgtatgtggggtgtcttcattcgttcgggtcgcagaaatgtgtgcttttttttgtgtgtgttttactccactccaatttttgtagtgggagtgttgggtgagcaagagagcggggcgggcgtatatggtgttgtgtgtttatactctgctcgcctccttctgttgttatgtgtcgcgcggtaccaaagtgttaagtaacccaatggaagcgcccttgtgagtgggtgtaattcaagaagcagcaacagatggacccggaatttttaaagggggtgcaccacacattaattgatgggaaacctttctgggataagggggaatcccccacaagaagagtgtgttgggtaaaccccaaaaaaaatctccccagggccttttggttataaaaagcggcatcgcggccccacgttaaancctaatttatatccggggtgtctcttaataagggttattttcgcaggggcacctctgtgtgttggcgccgaaaaatttctggggcactcagaagggcgcacagtgaaaaggggctcatctctttttgttggataaaattttgggggtttttntttttctcgagatggagaaggtgattcacgctcacagcacggggcccacacgccgtgtttgccacaacacacacttctcgccacggctgtgtctctcgagaaagtctctctatacacaccaacgcccacatgggctctcgntggggacacacaaggactcgaggctcggggctctttctctcgggagacctttcaccacgaggcacacgcgagagtgtttcgcgggagtgtccacaggctctttcttggtgtctttcacagaacacacacacagagttgagaagagacaccctctcgtgtgtggggagaccacagccggttattctctcacgccccctcggaatggtgtaaatttcacgttcacgccctccacgaaggttagaaactttagtaacacatgtgaataaaggacacactgagttccaccacttcgccggagacacccaaggttcgcccacgggcgcttaatggggagttttttacaatccgctcaagagtccaccacaatttgaggagcttatatcgagaacccctgaagaaagaatgggacacacgagacccttgatgaataattcaccacaccacttcacggagaacctgttttgaatgtaattaataggcacggaaagtgtttttgctaaccgtgaaacctttacctagatcagccatcagcctgtcaactccagttaacaagttaaggaccgaagtgtttcaaatggatctccagtaaaggatctttggagccc

SEQ ID NO: 513738 - DNA, 376 bp, Homo sapiens
gacttaaacaggttgacaagtctccaggtgtgttatgggcctccaggtgtgtgacaagtctccaggttgtgatgggctcaggtttacagtctccaggtgtgtgatgggccctccaggtgtgtgacaagtcctccaggtgtgtgatgggccctccaggtgtgtgacaagtcctccaggtgtgtgatggatcctccaggtgtgacaagtcctccaggtgtgtgatgggccctccaggtgtgtgacaagtcctccaggtgtgtgatggatcctccaggtgtgacaagtcctccaggtgtgtgatgagtcctccaggtgtgtgacgggccctccaggtgtgtgacgggctctgcaggtgtgcgaaggaccctccaggtgt

SEQ ID NO: 513739 - DNA, 1290 bp, Homo sapiens
  misc_feature (271)..(271): n is a, c, g, or t
  misc_feature (399)..(399): n is a, c, g, or t
  misc_feature (1290)..(1290): n is a, c, g, or t
tgtggcagattccattaactatagtggtaagaaatagaagccagtgtgtctatcagacacggcaactctcattctaggcgctgtcgtatgcaatactgcaagatggctaccgaccacgatactcataccctctgagttttggcatcaatagtgacatggctgggctagcataggcggaaaacactcaagtccagagacctggccatatctatatacgaagtcacaccttatgaccttacagtgaaccttggccggattcattttaacgctntgaatcgacattctacactcacttgggtacactccagcttgaaggggtaccttttatcctttggttcaaaggtataaaccacgatagctggggggcttgtagaccccgagaaggcagattgtgcgctntctaagagacttataacgcacatggcgatagcttgtgaatgttgtgcggtggggagacgcaagattggtggtcgatgggagttcagttgttacgcgcatagtgagactttgaacgagagttcactcaaggcaaaggcacaaccttcagatgactatctcatttgacttagcaatgaatttggcttggtgtcctatgcgctaaaatccgaccctatggaaaatgggcaagcatgaaaaaccccgaattattggaggacctaagacttccagagagattagtgccaacgagccaagtaattgacaagaacggaagcttccccattttggtgttacaacattttccgcgtaagaacttcgttagaccaactctcattaaggagtttttccaatgggaatgggtcattccggtgtgccaactacaggggctggcactctgtagaatagacgtggaggaacggaaaaaaagtccattttaagagcggtactcgctgtggcggtatataattcgactggttatttctacaacataacgtgctcttatctccagttgttacccccttacaattgaggacacaaagggggtagttcccgggttcaactatttcatagacgtcttggggtataatactcgtctacaccccaacttcctgggatcattgtggtccaccctagtaggatctagtataaaatacttggggggggcgtcgagtaacattacttctaagtagttccatagttcccaccaggtgtctcgcaaagagcctccacgattatttgcaccctccaaccaggtgcaaacacccgatggagaagaaatagcgaagaccaagttgggttgcgcgacgacatgcactggccgcttacaagaaaagagttgcatagacgccagcn

SEQ ID NO: 513740 - DNA, 428 bp, Homo sapiens
atgtggctgtcttcgagttcccgctgttgctggttcagagtgtcatctactcccacaattggaccaggacctagcgcagtagcttagccatctgcgggtccagatccaacagtaattgactattgaaggcttgcgggcccacagtggtgtatgtggttagtgtctatgctcagaatccaatgcggagagagtctcgtcctctggttcagactgtagtaaccactattcctgctccaactgacctgaacgttcactcaggtcacgacccacgaagcctaagcgcccagtggacaccacccaatgttcagctcactggatatcgagtgcgggtgagccccaaggagaagaccgtaccaatgaaagaaatcaacgcttgctcctgacagctcatccgtggttgtatcaggacttatggtggccaccaaata

SEQ ID NO: 513741 - DNA, 106 bp, Homo sapiens
gtatgtggtaggagtgtatgcacgtcctcgggctaggattatggttcggctgagtactcgtacatagttcagtgttggctaggcagaatagtatggcaggatgtta

SEQ ID NO: 513742 - DNA, 153 bp, Homo sapiens
ggtgtttcctttgtcttttttccctttgttcacgaggcttcgagagcgactggctgcgcaccaggaccgcgtggagcagatcgccgccattgcccaggagctcaacgagctggattactacgactcccacaatgtcaacaccagacaaaggga

SEQ ID NO: 513743 - DNA, 211 bp, Homo sapiens
agcctcaggaggcctcattgaaaaggtgcttttgagacccggttttccgacccgggcccctgatttataccggattccggaagccgttaggcctcataaaccccgaagttggacttggagtggggaatggtgggagtaggggtcatccggcccgaggcctgccctggcacacgggtttcccccgggtatggaaaaacacatgttttgggca

SEQ ID NO: 513744 - DNA, 792 bp, Homo sapiens
  misc_feature (602)..(602): n is a, c, g, or t
caacaatctccagcaggaacgcgctgcgcaccacatattgagttcgccaccttgagcccccaggttaaatttgcctccgcctatttgtgggatttggcggtaaaatctccccagaaacccttgcctgtttccatttaacgaaccccttagggaattcccccgggcacaaactcgccagggtcgagcttggtagcctcttcccctacagtccttacgagcctgaagtgagactggtgaacttaacccagtgcaacaaggtgctgtgccacactcctctctagtttcctttcactacaccggcaaatctgaaagaaagcagcatccccagtcactgcttatagataaactcccatcttcctgtgacagagcacctggggaaagggatgctgtgggcacagtttcagcagacttaaactttccccttgccgcctctgaagagacagtagatccttgacaaggaggttcttccagcacagcactcgactctgctaagggacacattgcctcctcaagtggtccctcgcccccctgtctcttgcttgggaagacctctcaaaagggttgacataaccctcatacagggaagctctggctggcatcanggtgcccctctgggatgaagcttccagaggaaggagcaggcggcaatctttgctgttctgcagccttccctggtgatactcaggtaaacaaggtctggagtggacctccagcaaactgcagcaaacctgcagaagaggggcctgactgttagaagaaaaactaacaaacagaaagcaataacatcaaaaa

SEQ ID NO: 513745 - DNA, 103 bp, Homo sapiens
caccctatacaccgtactatacccctgactataccaccaattgcaaaggaagaaggagcttgatgccaggaacagattttgcagttggtggggtggtatagct

SEQ ID NO: 513746 - DNA, 706 bp, Homo sapiens
ccgtgagtggggctgggccctggcctcctagagcggggctgcgttgtctggggcggtagctgggggggcgctctccccggtgcccgggatgggagcagcccgaccgctccggtgccgggggcaggacaggagggggccgtggaaattgtcgggggtgcgcgggtgtgagggtccctgggccttgaggcagtgtgaggtcgcaattgaaggtgagagcttggtcgagggatgagggtgacgctcgttgcttgcactcttcctgaattggctcgcccgtggccacggccgtactcgcttggcaaggacttcgcacgttcctgtgcactgacgcggtgaacagaggcccaagccaattaagattgcccccttgagggatggccccattggaagggcccactggaatggccccgggtggggggcctccttggagaatgaggtgggggcccgggtggtgggccaagcagtgcttcaccccagcgattgaggatcggggagacaaccctcggtttggcaggggacaggccactttccgctttccggggagacgtgccatagcccggtgagcgctgccttcgggactatcggcgcattgccacactacatttggacgcagtggcggattgcccgtgataggacagcgggaagaacggtacttgcccctaacggggttaaccaacctggctccaaacagggccagcgacgggag

SEQ ID NO: 513747 - DNA, 283 bp, Homo sapiens
actaaggtttttaggtttgggggcaagaggatgaagttcccttcctcctccttttacaacatgaaattacaaatggttcttttgtaattttataagacctaaccttggaaaataaacacgtgaaaatattaagactatcactttgaccgatcgatagggatgatcttgttgtagatgatatacaaagcaaacgtatgacccagccccaattgagaaatcaatgagatggaattttgtcaataatgcccaggttggcgacagtgtgagatcttgtctccttaga

SEQ ID NO: 513748 - DNA, 837 bp, Homo sapiens
  misc_feature (36)..(36): n is a, c, g, or t
  misc_feature (58)..(58): n is a, c, g, or t
  misc_feature (72)..(72): n is a, c, g, or t
  misc_feature (88)..(88): n is a, c, g, or t
  misc_feature (92)..(92): n is a, c, g, or t
  misc_feature (102)..(102): n is a, c, g, or t
  misc_feature (142)..(142): n is a, c, g, or t
  misc_feature (178)..(178): n is a, c, g, or t
  misc_feature (227)..(227): n is a, c, g, or t
  misc_feature (231)..(231): n is a, c, g, or t
  misc_feature (264)..(264): n is a, c, g, or t
  misc_feature (374)..(374): n is a, c, g, or t
  misc_feature (390)..(390): n is a, c, g, or t
  misc_feature (392)..(392): n is a, c, g, or t
  misc_feature (476)..(476): n is a, c, g, or t
  misc_feature (588)..(588): n is a, c, g, or t
  misc_feature (738)..(738): n is a, c, g, or t
  misc_feature (814)..(814): n is a, c, g, or t
tctcatttaacttttttaatgggtctcaaaattctntgaaaaatttttggtcaagttntttccattaaaaantactgattttaaaaantaanaacttaaaantgccacacgcaaaaaaaaaaaccaaagtggtccacaaaanattctcctttccttctgaaggttttacgatgcattnttatcattaaccagttttttactactaaacttaaatggccaattgaaanaaanagttctgagaccgttcttccaccactgattaanagtgggggggcaggtattagggataatattcatttagccttctgagctttctgggcagacttggtgaccttgccagccccagcagccttcttgtccactgctttgatganacccaccgcaactgtntntttcatatcacgaacagcaaagcgacccaaaggtggatagtctgagaagctctcaacacacatgggcttgccaggaaccatatnaacaatggcagcctcaccagacttcaagaatttagggccatcttccagctttttaccagaacggcgatcaatcttttccttcagctcagcaaacttgcatgcaatgtgagcngtgtggcaatccaatacaggggcatagccggcgcttatttggcctggatggttcaggataatcacctgagcagtgaagccagccgcttccattggtgggtcatttttgctgttaccagcaacgttgccacgacgaacatccttgacaganacattcttgacattgaagcccacattgtccccaggaagagcttcactcaaagcttcattggtgcatttcgacagantttacttccgttgtaacgttgac

SEQ ID NO: 513749 - DNA, 107 bp, Homo sapiens
  misc_feature (92)..(92): n is a, c, g, or t
tgaggatcctgtggtcagtgatctccaaagtagctggggtcttgtgggacaaagttattgatgtaacactgaacctctgggttggcatggtngcaggcagtatattt

SEQ ID NO: 513750 - DNA, 359 bp, Homo sapiens
actacatacgtgcacgcacacacaggcacacacacacacacagatagtgcacccacacacaggcacacacacaggcacacatgcatacaaaagtacacacatacaaatgtacacatataacatacgtagcacacacacatatacccacacacgcgtgaacatacaaataataaacccacacttttaatgcacacacacgatgtaaacccacacaacgtgcacacacgtgcacccacaccacatgcgcacacacacaggcacacacaaatgcgcacccacccacacacgcacacacacacgcatcagctcaatgtgtgcccgagggctgcgagaggtaaaatatctctgaggcccaggga

SEQ ID NO: 513751 - DNA, 108 bp, Homo sapiens
  misc_feature (20)..(20): n is a, c, g, or t
  misc_feature (80)..(80): n is a, c, g, or t
ggcccagcagagtgatcagnaggttgaggcgaagaagaagatctgaatgagctggccttgcgaggcccaggacaaggatnccaggcaggttggtcatggccacacctg

SEQ ID NO: 513752 - DNA, 193 bp, Homo sapiens
ggtctcctggctgcctcctaactgcacttcctggtagcccctctgcacccctctctcctcacgtgtcctgttggtcagtgactccccagaaccggctgggtgtgttgtggcacaattctgaccgcccattgcgctagccctgcatcaggctgtctttttggttgcaggtgctgtgagcaggactattcgccaa

SEQ ID NO: 513753 - DNA, 1114 bp, Homo sapiens
  misc_feature (298)..(298): n is a, c, g, or t
gagcaggcgatggcgcctgcgacgcggaagactataagccccagcgggcgacgaccgaactgcccccggtgaacaccgtggcccctgagcctcttgtcccgcgccacgagtgtatcctccacggaggctaggatggtctgcgtcggggtgctgggagctggcgtgtgagcgggcagcgtatggtgcctgcgtagctccccgggcggccacttccgtcctgtcgcccgtgcgtggacccacgcaggaaatggcgcgtcgccatccgctagacccgcgaaaaacgagtatcgaatttttnctcgactgtgcgcagcggggaacgtcctggatagaatcctctgtttccaagtaggcaagctccggcgcttccctagccctgtacctggaagcctctgggagggctgcagagtaaagttgctcgcactctgcgactccgacggatggcatcgaggcctgtggagtaggtccctctgttccgatcaggtgcgcacgcttggcctctccagtgcttgccgggtgccgggaggcctggcctcccccagggtccgccagcttctgctggttgtctctgtgctttcaccttaacagctctggcaagcagaggctcccgtgcccggagagagaagctgtcagtcacatgcacctcaatatttgcccatgctggctggcggaagagttccgtggtagcagaagagtgctctcctatgctcgtaatgtccgggctaaatattccctgagtggtggtccctctcgtgattctgtctgagatccatcacggtgctgctcatctacgtagaaagtgaggttctggacgctgccggcttcagcttggattggcaacacgctgattttggaagtacgaaggcgggctgtcgtgtgttgttggccctgatcttcgcttggtcttggatcgctcaatttcgtccagtgacacgttgggaacacaaaagggctctgggaaacaacggtccggaaagcataattggagtccctaataagtacatttccaccctttgtttcccggggtctcagaaaaccttatttcccaacggtgaaagtcaacattggctgcattgaacacctggtctttcgaggcctgtgtggacacccgttc

SEQ ID NO: 513754 - DNA, 168 bp, Homo sapiens
ccagtagtcgccctcgggttccggttcctgcggcttgggctcgctggccatgcgggtcagcagcggcggcaccgcgttcatgcggatgtagagctcggtgtggtcttcggcctggccggggatgatcagcggcgtgcgcgcctcgtcgatcaggatcgagtccgcttc

SEQ ID NO: 513755 - DNA, 454 bp, Homo sapiens
  misc_feature (26)..(26): n is a, c, g, or t
  misc_feature (35)..(35): n is a, c, g, or t
  misc_feature (108)..(108): n is a, c, g, or t
  misc_feature (189)..(189): n is a, c, g, or t
  misc_feature (239)..(239): n is a, c, g, or t
aacaaaactttgtggggtttaattanaacccccangcttgccctcccaaaaaatacagttccttttaagtgaacccagaataactgcccaaattgcatgtgttcttgnctttcccaggtgaagcctttttgttccttaagattgaagaaacctatgaaggatctgcagccaggtcatggtggctcaggncctataatcctcagcactttgggaaatccgaggtgggtggatcgcttgancccaggagtttgagaccagcctgggcaacataatgaaaccctatctttacaaaaaaatacaaaaattagctgggcgtggtggtgcacacctgtagtcccagctactcgggaggctgaaatgggaggattgcttgagcctggcaggtcaaggctgcgatgggacatggtcatgccactggacgccagcctgggccacagagggagaccctgtctca

SEQ ID NO: 513756 - DNA, 970 bp, Homo sapiens
ggttcctctcaggagatccctgagcgatgggtgtgagggaggtctgttgaattctacttggcctctattgatctcaggcctgcatagaggtgagagcatttatgatcatgttgtccatagtcagaggattgcgatagacttctagtttatgtacctcaaatcgtctagggcgcatacggagatatagttgagaccatcacctaggtacatggcgacgcgggcgtccctgttattccaaggaaccggtggcctgtgctagttggccacgcacaggtgggatgatggccatcagagtaggggtgcacttcacgcgagctcgcgggagttgagatggcggccaggttgacttggtccttcaggcaatgatactttaggtaccgggtggcctctgccgtttttcaggcaatgaaactctagtgacgggtactctgatagggagctggctagcacgtaagtcacagacaccacactcaactctcctgcagatctagtattcttggaaacatgtcaaaagaatgggcctaatcttccgagtaacccactacccttcagacctcagaggcccactaaacttttaatgacacccagaattacctggatgtcagctggtggcccggccggggtgggtaccaatgctgctggtcctttcgggaatcactccaaggtgtggataagcgccatggctgtgggcctcggtattgtacacccacgaagatcgaccaggtggagacaggtacgacccaacagctcaatgcccatgttcacactctgaccccaaggcagcaaaagaccgagctggggccaagaacagcggatgagggagcgacacgacacccggacggcggcaaccctggcaggaccgccggagaaaccggcccacggacgcgcaaaccccaccgcgtgcacgactggccgcacccgcccgacgcgacgtcgactggacaaagcgacacacaaaccactgaacaca

SEQ ID NO: 513757 - DNA, 508 bp, Homo sapiens
tttataactaaagcagaagtagatccagtcaaatatctaacgtaacacaggagcgtggaagacaatggtatcaatcggaccatctctgccgaatttaagttcccacgcgacctatagatagccggttaactttctttttgcccccaggcaatgaggcctagaagaggtcaaggttagaaaggttaagcatttgatcactacaggtacttgtcgtacctagagaaggaacccatcctggggttggtggagttggtattgctactcgttttgatagttctcatttacagagaaagaaaaataagccaaagccagaaagcaatccaagccttacagttgtccaatacctcagggccagtgggctagaattttcttttccctcagcccataatcacttagagttagccatacaacaaacagcctgacaatctgaccagcatttccattgatataaaatgtaagcattccttcattctgtagttaggaactccaacttcagccttatctccaa

SEQ ID NO: 513758 - DNA, 1262 bp, Homo sapiens
agctgtaagctgtgacgcggtagggcaggccctgatgtggtgtagttcgctggggtttccatagcctcagtctccatgctactcctttgactctttaccaatcaggggttcatgcctaggggtcccctgttggatggtacggcatgcccaagatgctttgggcagagagatgcatcagaagaatcctagaaccgtccctccgaatgtgcgagatgacctgtctgaggtccgtgctgagaagaatgtggcggcggcagatctgtccctgcgtggtctgggtatcttcaactatgtttcaagagcaaagttcatgacctgatgcccacctacataggtccctaatctgggacggcactgtgttgccgactagatgccttacaatgcgtacaattatatgtagggtaattaatagccttccgggactttatggcacttctttcccttgtaaactaagtgagacttctaacggaccgcgctgtcccgcacaagatacagggcgcattatcgatcatttgtccctattgtccaaggacagagggtcacaccagggcatgaaggctccctacttttgttccataggcttccgattaagacaacaaatcattttcgaatgcattacgcgcagttccggtacgtctgtggtgccaacccttggtactaccgtgagattcctaggggcctggtacatgaaccaaggttggttgtaatcacaatccttttgggtcacataaacatcagcaatacccaaactttgccaactagttaaggcaacgagttaccttggcccttgaaatcctagaactaagtcaccgtccacatgggggcatgcaaagttccgtacactgagcagtgccacgtagaaaactctcacataatgccagcataagggtcacacagagaatccgtggaccaaattcttccaagatgtagtaatcaggcgataggactgggatataccactattacacacagttgtgtaggctccctaacagtgttacagacaagagcagcacaaccttttgggccagagtaccagttggccggacgacattattggcttaataagggcattggcacggtactcttgtgggacatttgcaccccttatttggtctctataaagaacgaacaaccaaacggcttagtgtataaagcggccccctctacccgtagttgtgagtactcgatcgacacacaggatatgtggcggaccacactaacgtgatctaaaacacgtattccactgcggaggacaagacatt

SEQ ID NO: 513759 - DNA, 102 bp, Homo sapiens
  misc_feature (47)..(47): n is a, c, g, or t
  misc_feature (51)..(52): n is a, c, g, or t
  misc_feature (57)..(57): n is a, c, g, or t
  misc_feature (62)..(63): n is a, c, g, or t
  misc_feature (65)..(65): n is a, c, g, or t
  misc_feature (102)..(102): n is a, c, g, or t
gtgctggggtgtttatggcaagtcactttgacagacattattgtggnaaannttgtntgacnnantgtttcaacaaaccagaagacaagtaactgtatgagn

SEQ ID NO: 513760 - DNA, 911 bp, Homo sapiens
ccacctcacacagcttctgataccttggaggactcttcccctttgctgtacctgtcatcatggctcaccgatttccagccctcaccccagagcagaagaaggagctctctgaaattgcccagcgcattgttgccaatgggaagggcatcctggctgcagatgaatctgtgggtaccatgggaaaccgcctgcaaaggataaaggtggagaacaccgaagagaaccgaacgcagttccgagaactcctctttagtgtggacaattccattagccagagcatcggcggagtgatccttttccacgagaccctctaccagaaggacagccagggaaatctgttcagaaacgttctcaaggagaagggaattgtggtgggcatcaagttgaacccaggaagctttcatgaagcgggctatggctaactgccaggcggcccaaggacagtacgttcacacaggctcttcaggtgctgctgccacccagtcgctcttcacagcctcctacacctattagatactgtcaccaccagccaggctccagttctcctaaatattttggagacctgaatggctcagtcaaccctggaaattagataacatttgattgaacttctgaaaacacaacacatgtgaatcataaacacaagagaaaagccaaatcagctttgaaacccaagaatgagcatgtcacccaatagtctctcaacacttccagttccctatgttccagaacattcatccaagaaaagaacaggccacgactgagaaaagcaactcagaagcagaggatggagaagggcattttaataaacatagttaccaggggttggttatagaagaggcacagcaacagaaaaagaaataaaacgtgtatgaaccttccgttggtacagtttcactttcctgctcttg

SEQ ID NO: 513761 - DNA, 307 bp, Homo sapiens
aatcacgcaccgacctgaccacacgaacagcaatgacacgcgagatggaaaagaactccttcaagtatgcctgagatcttggataaactgaaagctgagcgtgaacacagtatcaccatcgatatctcccggcggaaatccgagaccaacaatactatatgactatcattgacgccccaagacacaaagactttatcaaaaacattattacaggcacatctcaggctgactgcgctgccctgatcgccgtcgctgacgtcgacgaatatgaagctggtatctacaagcatgtacagacccgagagta

SEQ ID NO: 513762 - DNA, 1551 bp, Homo sapiens
ccacctcacacagcttctgataccttggaggactcttcccctttgctgtacctgtcatcatggctcaccgatttccagccctcaccccagagcagaagaaggagctctctgaaattgcccagcgcattgttgccaatgggaagggcatcctggctgcagatgaatctgtgggtaccatgggaaaccgcctgcaaaggataaaggtggagaacaccgaagagaaccgaacgcagttccgagaactcctctttagtgtggacaattccattagccagagcatcggcggagtgatccttttccacgagaccctctaccagaaggacagccagggaaatctgttcagaaacgttctcaaggagaagggaattgtggtgggcatcaagttggaccaaggaggtgccccgcttgcaggaacaaacaaggaaaccaccattcaagggcttgatggcctctctgaacgctgtgctcagtacaagaaagatggagttgactttgggaagtggcgtgctgtgttgaggattgctgaccagtgtccttccagccttgctatccaagaaaatgccaatgctctggctcgctatgccagcatctgtcagcagaatgggctggtccctattgttgagccagaggtgcttcctgacggagaccatgacctggagcactgccagtatgtttctgagaaggtcctggctgctgtctacaaggctctcaatgatcatcatgtttacctagaaggcaccttgctaaagccaaacatggtgactgctggacatgcctgcacgaagaagtatacaccagagcaggtggctatggcaatgtcacagctctccacagaactgttcctgcagctgttcctggtatctgctttttgtctggaggtatgagtgaggaggatgctacacttaacctcaatgctatcaaccgttgccctctaccaaggccctggaaactaagcttttcatatggaagagccctccaggccagtgcattggctgcctggggtggcaaggctgcaaacaagaaggcaacccaggaagctttcatgaagcgggctatggctaactgccaggcggcccaaggacagtacgttcacacaggctcttcaggtgctgctgccacccagtcgctcttcacagcctcctacacctattagatactgtcaccaccagccaggctccagttctcctaaatattttggagacctgaatggctcagtcaaccctggaaattagataacatttgattgaacttctgaaaacacaacacatgtgaatcataaacacaagagaaaagccaaatcagctttgaaacccaagaatgagcatgtcacccaatagtctctcaacacttccagttccctatgttccagaacattcatccaagaaaagaacaggccacgactgagaaaagcaactcagaagcagaggatggagaagggcattttaataaacatagttaccaggggttggttatagaagaggcacagcaacagaaaaagaaataaaacgtgtatgaaccttccgttggtacagtttcactttcctgctcttg

SEQ ID NO: 513763 - DNA, 279 bp, Homo sapiens
ggaagagcactgaaatgtaggtagcataacaggtgacctcttatctctcatgaaagtacatacctattagcaggctctgtaaatattgacatacttagcttttaatacattctataagtaaatttatagatttcagaataacttaaaaaatttaatgagtaagagcaggggtgcatgtgtcgaaccactcatactcaaaagtattaggtcactttacacacacaacgtgcataatgtcatgatttaatagaaatctataagcattcagttactacttta

SEQ ID NO: 513764 - DNA, 373 bp, Homo sapiens
  misc_feature (68)..(68): n is a, c, g, or t
gaaactacacccatgcagatatatgcactctttctgagaaggagagccaactcaagaaccaacctgcncttgttgagctcgtaacacacaagcgtagagaagtgctgcaagcctcactataagaagacttgctttgccgagaagggtaaaaaacttgttgttgcaagtcaagctgctttaggcttataccttcacatttaaaagcttctcagcctcccttgagaataagagaaagaaaatgaagtctcaaaagcttattcatctgtctttttcgtgggtgtaaagccaccaccctgtctaaaaaaccataaatttctttaatcatttcgcctcttttctctgtgcctcaattaataaaaaatggaaagtatct

SEQ ID NO: 513765 - DNA, 335 bp, Homo sapiens
tcgagctcggtcctcccttccacagctgctgggaggctgaggcaggagaatcgctgaaactgggaggtgagctgagatagagccactgcactccaacctgggtgacaaagcgatactctgtctcaaaaaaaaaagaaaaaaaaaagaaaaaaaagaatatcccattaaataataaaaatattaccttggtggattttaaagatttatccctgtgaaaggtttacaatttctgtaatttataattaaaccggaattcaaagattaccgtgttaataatttgtgtggtgagccttaagaaaagagactagttatacctccctttatatttggtattt

SEQ ID NO: 513766 - DNA, 199 bp, Homo sapiens
gcacgagaaaaatccaaaaattagccaggacatggtggctcgtgcctgtaatctgagctactcgggaggctgaggcatgggagtctaagacagaagaatagaagaattgcttaaacccgggaggcagaggctgcaatgagctgagatcgtgccactgcactccagcctgggcaacaggctttttctgtgagactgcgtt

SEQ ID NO: 513767 - DNA, 209 bp, Homo sapiens
gtatagtaataatgcactgagttctgcggcattttccgacgttcattctgcatttagagagagaaaaaacactgttgacagtccaagtaatggatgttccgctgcatgtaatggcgccatttcagtcagacccacaaccccgtatgggtgggtaggcatttcatacaatgttctctatctcgacgccaacagtccaggcagttgtgaca

SEQ ID NO: 513768 - DNA, 439 bp, Homo sapiens
ccgaaaaacaagaggaaaaaaaggctcacacctgtgatcccaacactttggggagctgaggcaggaggatggcttgagcccaggagttcaagaccagcctgggcaacacagcaagaccctgtctctactgaaaatgaagatacaaaaattagtcgggcatggtggcacacgcctgcagtcccacctacctaggagagacaggtggggaggattgcttgagcctcccgagtagctgggaccacaggcgcccaccaccatgcccggctaatttttttgtatttttagtagagatggggtttcactatgctcgccaggctggtctcgaactcctgacctcgtgatctgcccacctcggcctcctgaagtgctgagaccacagccgtgagccaccgcgccttgccagacatgaccctgtctctagaaaacaaaacaaaaccgg

SEQ ID NO: 513769 - DNA, 985 bp, Homo sapiens
accctcgaatgcagacgagctatctaagaacagctaaaagagcatacccgtctagtctagcactagatagatggggaagatttactacgtgtagagggcgacaatacctatcctgaggcctgggagatagcgtggttgtccaaggatagaatcttagtgcaacttgaagagtttgcccacagaagcctctaaatccccttgtgaagtttaagctgttagtccaaagaggaacagctctttggacactaggaacataaaccttgtagagagagtaaaaaatttaacacccatagtaggcctaaaagcaggcaccgaattagagaagagcgttcaagcgtcaagcaccgcactagcctagaaaaagtcccaaagcatataactgaactcctcacacccaattggaccaattctatcaccctatagaagaactaatgttagtataagtaacatgaaaacattctcctccggcataagcctgcgtcagattaaaacactgaactgacaagttaacagcccaatatctacaatcaaccaacaagtcattattaccctcactgtcaacccaacacaggcatgctcataaggaaaggttaaaaaaagtaaaaggaactcggcaaatcttaccccgcctgttagcaaaaacatcacctctagcatcaccagtattagaggcacggctgcccagtgacacatgtttaacggcgcggtacctaaacgtgcaaaggtagcataatcacttggtccttaattagggactgtattgattgggtcaccgagggtccaggtggctcttactttaaccagtgcaatgactggccgtgagaagggggctaaccagacggcagcgaagaccaaggggctacatacataaggcaccggcacctaaaaaccccagtgccaaaaccaacgtggtaaacacgggggggagacccggagaacaaccccgggcacataagagaaaccacagaggccatcctgcacaaca

SEQ ID NO: 513770 - DNA, 155 bp, Homo sapiens
gtcaccatgggcaacgcggcaccaagggcctgcggaaatgacggaaaatcgcttctgtatgttaatagcaatatatgacctctgctttcatgtattcgatttcaaccggcgagcggctgtaggtcaggtagtcgcgcttggtcatgcccacgccg

SEQ ID NO: 513771 - DNA, 860 bp, Homo sapiens
  misc_feature (52)..(52): n is a, c, g, or t
  misc_feature (88)..(88): n is a, c, g, or t
  misc_feature (102)..(102): n is a, c, g, or t
  misc_feature (124)..(124): n is a, c, g, or t
  misc_feature (147)..(149): n is a, c, g, or t
  misc_feature (153)..(153): n is a, c, g, or t
  misc_feature (190)..(190): n is a, c, g, or t
  misc_feature (199)..(199): n is a, c, g, or t
  misc_feature (215)..(215): n is a, c, g, or t
  misc_feature (239)..(239): n is a, c, g, or t
  misc_feature (242)..(242): n is a, c, g, or t
  misc_feature (254)..(254): n is a, c, g, or t
  misc_feature (350)..(350): n is a, c, g, or t
  misc_feature (360)..(360): n is a, c, g, or t
  misc_feature (380)..(380): n is a, c, g, or t
  misc_feature (424)..(424): n is a, c, g, or t
  misc_feature (445)..(445): n is a, c, g, or t
  misc_feature (487)..(487): n is a, c, g, or t
  misc_feature (499)..(499): n is a, c, g, or t
  misc_feature (501)..(501): n is a, c, g, or t
  misc_feature (508)..(511): n is a, c, g, or t
  misc_feature (515)..(515): n is a, c, g, or t
  misc_feature (528)..(528): n is a, c, g, or t
  misc_feature (540)..(540): n is a, c, g, or t
  misc_feature (569)..(569): n is a, c, g, or t
  misc_feature (571)..(571): n is a, c, g, or t
  misc_feature (688)..(688): n is a, c, g, or t
  misc_feature (860)..(860): n is a, c, g, or t
aggaaagcacccgttttaaccctcatatctttctcagggctcactgcgggcnggccatatctggagcaggtctgtcgagtggcttggnacataggcttttgnggtgaaacgtttaaaaacattncttgaattaggattacgcagagnnnactngattctgagtgggcgcaactatcgctgagaccctganatttcaggnaataaacatggttcanaactcaaactgttcatcaaaatanttncgcaggtcagcnaccactgcagagccatcactgctcagaggaattgggtcagcaatgactgatctcatcatctcttcattagcacataagcggttcaccttggggtangcgaggggtntctgcgggggtgcgggaganttgtctccaacacggaggggtgtgggagagttctctatcttggncttctcaacctctgtgaagantggtccaaggcgtgggagaggggcctttgggccaccagtgtntttgggcttatnancccgttnnnnagcntgttctttccgcnttggcaggtggntcactcttaagctttccacttgttggggnanctcattaaccaacacaagtttaaagaacctttcctgctgttagttgggtatgtggtggtagaagcagctttatgaacatgctgatcatgctgctctgagagagatgattctgttgantttcctccatttttccggaagattcctatctgggtacagtatccaacattctcagctccagctggtggttccccgacaccagtaaactccacagagtaatcatagcgatttgccacatataaagcccaggtctgaaactccattctggtccactcaaatttatgatctgaan

SEQ ID NO: 513772 - DNA, 674 bp, Homo sapiens
gtttaacgggcgcggtaccctaaccgtgcgaaggtagcataatcacttgttccttaaatagggacctgtatgaatggctccacgagggttcagctgtctcttactgtttagccagtgaagattgagctgcccgtgaacgaggcgggcatgacatcaggcaatgacgagaagaccctatggagctgtaatttattagatgcgaaaacaggacctaacaaaaccacaggtcctaaactaacaaacctgcattaaaaatgtcggtggggcgacctcggagcaggaatccagactccgagacagtatgatgctaagactttcaccagtcaagagcgaactactatactcgaatgtgatcctaagtaacttgactcaacggaactagagttaccctagggataacagcgcggatcctattctagagtccatatcaacaagagggttgacggacctcgattgtgggatcaggaacatcccgatggtgcagccgctatataagaggttcgttcgttcgacgattaatagtcctacgtgatctgagtgtcagaccggagtactccaggtcggttgtctatctacttcaaatgcctccctgtacgagaggaccccgagaaataaaggccgactgcacaaaggccctcccccgtcatgatttgatctgcatagtattataccaa

SEQ ID NO: 513773 - DNA, 284 bp, Homo sapiens
acttatctgttcagcttgtggctcagcctacatcagatactttcctttctggtttctgttaatgagtagaaccactacatatatgggtcaaggacaaaaaagctcatgcttctcctctctgtgggagaagcaaggtaaaccaggccaggcaattagtctccatgacgcgcggtctacttctggaggagtcctggaggcatttaagcatcagccaccagagtagtggggaaagacatagggccagtgtcagctgcaatatacaaaaaaaatgcaacccaacacta

SEQ ID NO: 513774 - DNA, 1191 bp, Homo sapiens
gttctgacacgaattagtattattgcccagaattttcccaatgtcttacaaaaacattctttggaggagcacccctgtgggatcctatcttcaagggtaatagataatttaaaatgccttatcaccaaccccaaaactcccccaatatccagagctcttttttgaagaaaaaaatccccagacatttttaaaagggagtccccagatttttgagaaatatccctgagaagggacacccattaatttattgcccccccgttcccaatttatgggaaaatttgtttaaaaggactttttacgcccaggtagccacccccgccacggttttattaccccccgtttggtatgcaacaagcggcgccaaagggtttcatcctggtatccgccccaagtaagcttccacgggtaccccccaaatggaagaaaaggttttccacgagaaaatggaccaccacattcttgggtcttctggcaccacaagttttccactggggagacccctcataatgtaataaagggacctcttaggaggcacagcactccctaaattggggcccaccgctgcaccgcttttggcccaatagtggcccaccgccctcgttctctggtttctttaaagcccacctgagagtttcactataaactcttctgtgccctaatacctcggcactacaaagggccacatgttaggcgcacataattaaaatgagaaaagtggagatattataagaatagcttttccccacattccccccctaatttcacacactttgaggttctgacacacacctcgtgtaggtttttctctggttgttgctcaagactacccactaatgaagtcttagagaaatagccccaaacgagttattcctcttatactcgtgaatatttaaataactcttaaatattcgccattgtcccagatatcttggatttaaactcggtttgttctctatatttctttctccatcctttaacgggaaaaaaaatcccgttattttctatactttggtaatatctaagatgttttggagggattttaaaactgaatattttattctggctataacccgtttatttggagaaagtatggatttttaatagtaaatccatttaaaaaggaccaaagtataaatttcccgtgattttcactgctgtccagtagaaaagtaataaacatttccaatttta

SEQ ID NO: 513775 - DNA, 525 bp, Homo sapiens
ggaccaaaagggggggccccccccggggggcgcccccttaaaaaaaaggggcccccccgggcgccgggaattggccccggggttattttaaaaattcccccccccctttttttttttaacccaaagcttaaaatttggtttttttcggtaaaaaaacccctttcccccctttaattggtcttaaggccccccccttgggttttgaaaggttggaaccgtttttaaaaaaaaagaagggcaaggggggtttcaaaaattcccccctttgaaggaaaccaaaaggtatccccttcccttttggaaaagctttggaatttaggaaaaatttttcccaaggaaaaatgggtatttttattaagtaaaaggggttaaaaaataaaataggcttatttcccccccctaaaaagacccccggttttggtttggcttcttaaaattaaggccaggctttaaaaggaaattaatcaggggttaaaaaaaggggattggaaaaaaagggggtaaaaaggaaaaggccaaaaagga

SEQ ID NO: 513776 - DNA, 338 bp, Homo sapiens
aaaccatctctaaataaaaatacaaaaattaggtgggtgtggtggtgggtgctgtaatcccagctacttgggaggctgaggcaggggaatcgttgaacctgggagatggaggttgtgcctggacaagagagcaagactgtctcaaaaaaatagtatagtatagtaaatacataagcagtaacacagtcatgtcttatcaatatcaagtattatgtactgtatataatggtatgggctagacttttatacaactggtagtgcagcaggcttgtttacaccagcaatcaccataaacacttgagtaattcatttcactaacacaccatgatgcagctcag

SEQ ID NO: 513777 - DNA, 156 bp, Homo sapiens
atgcttgttcagtttacagtaaaaatatttattgagtgcttgttgcatacaggcacaatcttaggcaccggcaaatacagacaatagaccaaagtccctgcccttgaggagctttcattttgatggagagaaaacataataaacaagcaaaatgca

SEQ ID NO: 513778 - DNA, 981 bp, Homo sapiens
ggcggcgccgggcgcggagtgccacctgattcactgcacttggaacagatgatgtgggctctttccagaagtcaaatccttcctggaggatgaagatctgccagtctgaggatctggtggacaaggaaaaagagcctcaagctttgaaggccattcccatgttagaaccagagctgatgtgacaatgtggccatcctgtggccccaggcaacaatgacctttctgaagtgaccaggctgacaggggaagcaatacttcggtgtgattcctcttcaccccgttcactcagggttggcgccaattcacgaactcattggcttcaacgtgacagcctaagaacctcccagttgggagagccaaaattcttccttgcctacagccctttctggagtaaggcttgggacctacaggggttcctaacaggatggtgtcgcgtccagaagaagacggtcagggcacgcaaggcgaatttgtgggccaagggccttcttgacctctagattttccaccttcgggagggtgtgccgagcccaccttttcttggagacaccctggtaccggtacgggcttctttcctgggagcgcaattcttccaagtcattctggtggtgctggcaataattcgaacccaattccaaaagttccacgaggcgggaggtggaaacagctctggagccaagaaaggtgaggtgacgaggacgcccaagggtgctgtccttctggggacaagcgggccagaaaggagaccaggagaagggaaagagacggcgaagcactgcgctgcagcgaggcttggacagcctcgggaccactgggccccgcatcagaacggactgggggggcagccaagaggaaataaaggacgacaggtagggagccacactctggtgagaaacggcaaccgggctaggtgggcacaggacaacattgaagcgtggacggaagggtggaaccactgtgcgggcagccagaagcacaatc

SEQ ID NO: 513779 - DNA, 1158 bp, Homo sapiens
  misc_feature (662)..(662): n is a, c, g, or t
gcttgtccataagggaatttgccgtgagaaacacaagtgtcatgaaaactacccctaaaagccatataatgggaaaggagaaatacgactctaactatcggaggaattgtctgctcgattgggacaacgatagatgtcggaggacacgtcgcatccacgtgactaggggcatgcgtgattctattctgtgtcgggggagtaacgtgctctatgtactcgatgagaacaaacttgtgaagaatggagcgctagcttgaagatactgggagataacggagtcattccctatgcaaagggtagtgctcatgtgcgttcctattggcgtatgatagatctgagaacgtcttcggaatgcgtggaagccgttagaggtaatacagccaatgtggagtaattcttctctatgattgcgaaatacttctgagaacccaagtcaaggctacctaatagtgacttaatcaatagatttggcgccctagtggcatcgcaagaagtacttataatcgaagagatagcatagaatgtacaaggggaacaattctcgaggtgcctgaccgtagtagcgtgtcctttgcattgtagttagactagtcgtggggtccgtggggggtgaaatattggagaccacctggtgctatcttcgcaaccacgaaaatggtgtngcttgtacccccggaagaaagctatgggccccgtatctggcttgttacacaactaggaggtgatgaaaaacaacgtaaatttgttcgtgaggttaactcaaaatatggcattgccacttggaggcccaccccttaacagccaggaagacaaatattgacggaacacacttcgtctgacagcgaaaggtccgggcaccttgaaccatttaaggaaccatctggggttaggaaccccccgagaacaagtatgccattttggtgcccaaagtttcctggtttggcgaagttggttgaacaaaaattgcctgtgggacgccaaaagtggcgtaaggaatttgcccttgggtcccaaaggggaatgggacaacaggtcgagcggcgctacacggatggtgatcattggccaggttggaaaacacagggctgcttgagaggggcctggaactggggttccttaccacgcaagtccggtccaagtgacacagccttgttgctg

SEQ ID NO: 513780 - DNA, 1682 bp, Homo sapiens
  misc_feature (1681)..(1681): n is a, c, g, or t
gagttgaccctccacagccgtccgtcatgactcgaccgtgtgatgcccctcgctgtcgcacgccgtgctgccgcctgcatcagatgcccgctgggcagataggatggctgtcactgtgcttgagcctgttgtggcagccggcgtgagggacgtgatctcacgttgccgggggcctcccatttgtcatgtgtggcgcctcgctggtaggtggacccgcatgtgacctgcatggagctggcgaaggacgacgacgttgtgggagcaacgctcgaccgagttcgtagtgcttggccctcgctatgtctgccaatcgtcatagcaactcctcatccgctgcagcgtccactttgcaactggggacagaagctcccaactgatttgtccctttagaaatttgcctatgtttttcatcatttattgcaattcatctatcacagttcgacgagtgcttggagatctcgaggctggtaaggaccaacactgattgaggtggcacatttgccagggattggaacttggccaaacccgagcctctaacatccacgagggaaagctttggcccttgggggaccttctcaggattgtttcctccgttggatgtccatcccaccggagaggatggaagtcaaaaggagaagcgcgccagccatggacagaagcccattccatttctgactttgtaactcctacattggttcacataacttggggggattccctttccattgattacaacaccaatggactcccccccatggttggttggctagtcaatggaaaactgaaaagtgtttttgggaatccccaaaggtgttcaaccaatggttatcaaggtagggaaccactttgtcggtaagcgaaaatatagcggcaaggaacgttttactgaattaaaaatgcaattcattcgcatttttgggggaccttattattcaattttccacctggcttaataatagagggcaatgacagggaggttagaaacgcagagacttttactcttttattaaaaagaacctttgcgcttaatttttaacataaattaaaagcgtttcgcacgaaataagcacatttcatagaccaagtcttaagaggagctcacggactgttgtccagtggttgaccaccacggttgcttacataaaactaagcccaggtcaccaggaacgttcaagttggcctccacattttatcaacgtgggaagcgtttacccttggacatcgataggctatagaaggaaagcaaccatgcaggtgggtgggataaacactcaattgcttttaccacgtgcaatccctcttggttaagatcaccataggttcggaccaccgccgaggtggacaacactatagggaccgtatctgtaagaaacagccgagcaaactagtgtagacccacaagcgcgagggagcctccttgtcgctactgcagtcatggacgacggataatactacttaccatgaataagacatatagacaggagcgagcaatcataactgcagatttccgaaaagagggagaacggaacgccgcaggaagctgtagttatcatgaacagcaggagaatacgacaataataacatcctacagaggatgaggcggatccaccagtctgaatgagatagagcggcgtgcatggacagacccacagagcgttgtctgccgctcaccacatcatcng

SEQ ID NO: 513781 - DNA, 251 bp, Homo sapiens
agtcatagaagagctagaggttttatgatatttttttaccgtcttttttttttggcctaggaggccagcctgccctaaaatatcaaccatttccctttttggctcctccccttaaaatttatttgtttccagcccatttaatggagaggcggaggtttttaattaggcggaatttccttttaatttttaaataatggtttatatttccaatccaaaaaggtccaaaataaagttacattttacggggggcc

SEQ ID NO: 513782 - DNA, 129 bp, Homo sapiens
atgtcggagttgtctttctgatgtcagcacgtgttggagtcttcttctggtggatttgtggtctcatggcttcaggagtgaagctgcagactttcacagtgagtttccacctcttaaggcagcgcgtct

SEQ ID NO: 513783 - DNA, 1047 bp, Homo sapiens
cagctcggctactggcacacaacgcaggcgacctgggtctacgactaacgcgcttctcgctcctcctgaagtgctcttcgcgtccaacgcttgttcccgacgctgtaccaatggcttccagtaacactgctgctcgactgcgcgtctggctagccctcctgcatattctacttgcttcaacacacggcaggaacctgactagctcacgaccgctgctctacttgcctgacacggacgcacccctggcgctactcgctgcgcacgcaagcacctgctgccaaccacgaccctgcacgcaccaaccgcctgacccgacttggccacagactgcagcaatatgctcacttcactccgggcccccggccaacactctccccccaaaacctccaacaaactcactacgcggcgcacaccaccgcatcctgcccctttctgcagccgaacgctggactcacccaagccctgacctccgccccgaccagcctcagctggcgcacgcaaaactacccggcccagccacaccccaatgccccccaatccgcgcagcttacccagccgccttactccaactacgcacagccaacagcaatctccgctgcgctctgtgggctgtgcatcccatactgcgaactggcccaccccaaaggccaataactaccccgaaaatcggatcctctcctttgcatccccgtggcttaaccacgctctccctcacctccggcgcactttcgcgctctattgcacccgcgacaacaacgcccaccagcccaagcgaaggtcaattctaaatccagacccaatcatttaccacaccctacttgagcggccacggaccccaccgactggcccagggcgaacacgaagccgagggaacaaatcctggcgagaacacaccaacggccacagcgccgcggccatacgccagcacaccaccctcggaaacaaaagcacccacggctctgacaccacaccacttcactccccaaccgatcacccgaaacccgccatagccccccacgcgccggcatacctggaccaggcgcacag

SEQ ID NO: 513784 - DNA, 665 bp, Homo sapiens
  misc_feature (174)..(174): n is a, c, g, or t
  misc_feature (189)..(189): n is a, c, g, or t
ccgggtgggccccagcgcttccaattaagccagtgaagggatattccgctttcccgtttttcccttttcttttgggccctggggggtttattttccaacatgtttaaaaggggccctcccagtaccccaaagggggggtggtcctggtttcttgttggggacatccgccccaangacaggcccatttangaaggtgccgacaaagccctgaaacccttccaggaggggtttaagccagtggagaccttttcagagttcctcgatgtggccggttttttatcaaaaatccccgatccaaagaggttcctgaagggcctgttgaattcagtcccctggcccccccccaacaattgggggggggaaaaaaaaggtgggttgccttcccccctttgttttccctccttggggattaagttccccccgggggaggggggattgttaccccccccccccctttttcattttttttggggggggtggggggttttagggttcctgtttttttttggggggggggggcccccgctatggggttgtttgtaacccaagccctcaaaggggcctggaaaaacctagaaggccatgaggttgtcccggccacgctttaaatttgaaggggggccttctttttgaaaaaaaccaggtggtctttacccaccctttga

SEQ ID NO: 513785 - DNA, 574 bp, Homo sapiens
  misc_feature (230)..(232): n is a, c, g, or t
  misc_feature (451)..(451): n is a, c, g, or t
  misc_feature (515)..(515): n is a, c, g, or t
  misc_feature (555)..(555): n is a, c, g, or t
tggggttatgggtggagcaggaccacttccaggaacggcttcactgccgccctcgtactacctgagctcccaggcatacagacagcaacgctggcagagcacaggcaaggacggtttctgtggcaggaacctcggcgggtggcaggaggagctagcgggcacccacctctctcccaagggccacggcgtccgaggctgggggctgcttcctgcctgaaggctccgctccnnngtgctgggctatcctgagatgcttccccagctcagccacctgcttccgcagctccaaaacctccaggtgtacctggtccacctcacggggaagctcacgctggagagcggccggctccaggggttcccgcagcaccttctgtctgagtcgtgtcaccagcaggtttaggagctgcactctgtccccgagcttcctgagtgccagtccagaggatactgngccagcttggacagatcctcctgcttgaccagcttggacagaccctccggcttgaccagcttgngcagaccctccagtcgtctctgtcgaggtgcggacgctgngctgagactcagcatgagg

SEQ ID NO: 513786 - DNA, 326 bp, Homo sapiens
  misc_feature (27)..(27): n is a, c, g, or t
aaaatctggcaatgttttcccggtganaaaaggtagggaattgagaaacatgaagggggccgggtgtggtggctcatgccctataaaccccagcactttgggaggccgaagcagggagatcatgaggtcaggagtttgagatcagtctggtcaatatggtgaaaccccgtttctactaaaaatataaaaattagctgggtgtggtggtgcgcgcccgtagtcccagttactccagaggctgaggcaggagaatcgcctgaacccaggaggcggaggtttcagtgagccaagatcccaccactgcactccagtctaagagacaaagc

SEQ ID NO: 513787 - DNA, 1610 bp, Homo sapiens
ggaagatatcaaatgctggaaaaggggaagaggtaggtcgggaacttctcaggaaaatggagagaaagagaaacgagcaagagcgtgtatcttgagtataataccacgaggacatagcgatacttctgaacaaagcccactagtctgtggcttctcaccaaggacctcctacatggtctgagtgccaggtcgaagcatcaggatcggaattcataccagtaatccaatggcatggacacgcatgtgatttactactggatatgtttcacaagacagaataggactttcatcacgtgttagacttcgacgacaggatgtacataggcgattgtgacatagaattgtttgcatagatgggcatgatggatgtatgtatggacgaaggatctgtacaactcacggacacacgacagaggcgcgcaacgctacattatgggctcaggactctcttatagagggatatactcgacacagtagaggtttggtggtgaacacgataactctaacatcgtttggagttagctcaggactaataagtgagaacttgcaccaactaaaaggacgcaatcgcccatcacagtgaaacgcatagaaaacgcatgtgatgattgtaggcggatagggtgatgtttggagacgagaaatcaagctactacaacgagcttgtttcaaatctaaaacggaggaacacttttgggacataaggtggacaaatctggcagggacctagcaagggtctaagcaaattcaggctaaggggaaaaggtgagtcttggtccttagaggtagaatgggggtaggaacacaaccaacatggcgttgagaaagtgtattgagcgcaagcaaatatattacttgtggccataggggggtttgataccgagacagtcagtagaagggcgcattttgcaggaacaaggggcatccgaaagaaacgtggtccaagaaggccaaacattctaacttaaacgtgcggcacaaagaggtaacaccttgtgtaattcgtacaagtaacgggtggaacccaggtcggaatatccggtggcctcaagcgtataaactactaaacaccgcctcctgttcgtcactcgagaagccccacgtgacactggggcattgaataccattatatggatagacattggcaccatgctgatgagaacggcacacacgctaccacggaacgcagtagtcagcggatgcccgatcccacggacatcggcccaacgacatagagcaacagcccctaccaccccaacacaaaacacggcgttacagtagcgtaggcccatggatgattagatccagcaacacgccacggggccaccttaaagagcctgacgaccccacacgggaacgggactcgcaccccggccacccaggtaacacacctgggcaacgggtacagcccaccacaccagcagagtgaccacgacaacgtgaccggcacaagacagtcacaccagagacgcacaagaagcgagaaggcaatctccacggcacaccacacacaaaaggtcgaaccgcacaccagccacacgacggcacaaccagcgcccgcagccacaacaccagaacaccacggaccgaccacacacaaaggcaaaaga

SEQ ID NO: 513788 - DNA, 254 bp, Homo sapiens
cttcacacaagctatatatttacaaaggcgagacagacacaggagcagtacatgctgcgagcacagaggccagcatctcctcttttccttatgccagtgtgtagcccggtgccaccgcgttggctggtccatctccctcctcagtcctctgccacagggctgctccactgctcccctcagtgaaactcctcagccaggcgctctgagaccaaccacagtccactgaaggcttgaccacgcctactcgagacagc

SEQ ID NO: 513789 - DNA, 456 bp, Homo sapiens
aaccttttaaaaaaggaatggccaaaaatggagggcctttttcccgtaatctcatcactacgaagggactttcaccttaactgagatccctactgaaaagaagattttcagaaaaatatagctcactagacaaagatgcaaatatactctcgaccctatttgtctcgttatggtacatcgtagttaattgaaatttcagcacttttaactccgattctccatttctcataacttcctttatagtatctaagagagtgcctagtcatacttcacctatttaggctgctaccccctatcttcgtttacctctcgctcgttttcactgtttgtggggccgagtcttgcagctgtgaccttggccgcagtgcaagtggtgcaatctcggctcactgcaacatccacctccaaggttcacatgattctcctgcctagacctcactacctcgggcctggttc

SEQ ID NO: 513790 - DNA, 1811 bp, Homo sapiens
aacgttctgtgggtaggggtcgtctcgctagcgtcgggtggataggtggagtgcgcttgtggtgtgtctgcccgccgcggcgcagttgttgttggttgtgcaccccgcgtgtggtgtgcgtatgtagaatttagaggtggttgttagacccacgtgttgggtgtgtcgttcactcgctgttggttggtgtgcgagaagagtttgttggtcagcatgcttggtagttgttcgggggagatttggtccccacaccgggggggtagttttttgttgcacccccacgagacacgttgtgtgtcgagtggtgtgtgccccgcaaggcggggctttttaaaggggggtgcagcacaccacaggagggagtggaaagtgggggggggaaacatagggtgtgtgtgggtgttgcacccaacgaacaccggggaggacgctcgctgccttttaggtcactccctcttgttgtgggtggctccttgcataaaaagtttgtttgtttgaaaaaagaaaacgtgtttctttctctgtgagaatgaagtcccgccgcgatgttattgtagaagcctgttgtgcccaccattttgtgggggggggggataataaatgtgatggaggtccctttctttggccttcggggaggagagccttcttttttttcaccgacggggggacggacgattgtttttgtgttgggtgttataaaaaaagagggggtgaaaaaacagattttttattaaagggacttcgccagctattttcaaccgcgtggtggtggtaggatgttgcaacacgtcgtgttgtgggggcgaccccccttgtggggaagcacccccgacaacgaagtggtggaagtataagatcctgccagaacatcgtcgttaatgatgatgttatacgacatttcgttgtggtgttgttgttggtaagcgtcgtcgtggttgctccggcgccgccgagcttctctgcgtaggtgggagtagccccacagcgtgttgtaggaaaatattgtcgtcggtgaggaacatcgtcgccccgctttgtcgtcgtgttttgtgttgttgtgggtcaccctcgcgctgtgtagaatatatgagcacttggtttcttattatttccgccccaccggaggagagaggtgcgccccaccaggggtagtcacccagctgtgagaaagagtggggagatatatacgctctctctctcgcacacttgcggggggtgatatactctctctccgcggagagagagtgttggttcacaccacgcagagcgcacggggagacacagcgctagagtgacacacaggcacacctttatcacacagcgctcgtctcacagccacgcgcgccccctctgaggacgcgctggagagctcacacatgtcacgcagtctttctcgcagcgagatacacacacacacatgtgtgtatacgcgctctctgcgcagaatgttcacacaccactctcacgcgggctctcgagagtgcttcgcgcccgcttcacacacacaagagagtcttttcacacaccagcgggagagagattgttaaggaaggggagagagaagttgccccacacacctcgcttcctccacgtgttccacgccctcgagcccacctctcccactccctctttggcctctctgagccctctttgttccacacccggggagacctcaacccctcattttgccggtcctccacagctcactttttcaccctcaccccccctcctcctcccttggctttataattataggctataattttgtgaaggaagaaatgtaaattaaattaagtgaagtcctttgccca

SEQ ID NO: 513791 - DNA, 501 bp, Homo sapiens
  misc_feature (501)..(501): n is a, c, g, or t
tttcatagtatcttcttctacccgttgcagacgataaattatttgtgccaattcgagaattgctgttaggctgttatcctcccttccttggggctaagaattacaagactcatggcactggcgtaaagttgttgtttatctaatcactgatgaaatattttcacacttgaaaatccccaaatgctttacaatgaatgaagtgttaatttggtgaccaggtggtagccattaaccatgttgcaaaaattctagacagtaaaaccctgtggtttttagaaacagaagggaaattaaaaaaatggagtcctggttagccctttcaaggattagggaattgggtttttttttttttcccctttttaaaaactaaaaaaatctcaatttttattaaaaggaaatttaaaaaaggttattgggccaataatttaaactggcatcttgaaaaaaacaaaaaggttcctccatgtaaaaactgaattcccacgaaaaatttccaacccn

SEQ ID NO: 513792 - DNA, 132 bp, Homo sapiens
cttatgtgctggcataaactggacaagtgagtaaccttattaagcagataactgaaaagagcactactgttgttatccaacgataacctactgggtacccaaatcttatgagcaactcctgtcaactaaatg

SEQ ID NO: 513793 - DNA, 343 bp, Homo sapiens
tcccaagtaactgaaaacatgctaaaatctggtcttttagcatctgaagtattttcgtggaaacaaattgagcctatctggaacctctgttaacatttttcaggccagcaagacactgcttcctttttttgtgtgtgcaatcaacaaaacctgatggaggatactttggcagaagggggttctggaaaaacaaataggctcatataaaaattagggatatcttgttgaagaataggtaaagagatatagcatgaaacatcacagagtagtcctggtaaagatgcagattgtacgtgtgatatgtgtggtgggggtggtgtgggaatgattggttgcgttgctc

SEQ ID NO: 513794 - DNA, 104 bp, Homo sapiens
aacaccattcccacatgtggtaatcaacgtggagacggtgacttacaaaagtgtcaagttcaacgtatgggatgtgggcggcaggacaagatccggccgctctg

SEQ ID NO: 513795 - DNA, 218 bp, Homo sapiens
acggagctgtgctgtggttttgaggatgagcttgccgtcggcgtccgaaggcttgtggacgtaccagagcacgggaagtgcgagttctggctggtctgggacttgacagagcagttcagctggatgggcctgttttctaccagggtgagggtcctcttggatttgctcacctgcaactttgtcactgccaaggaaaagagggagcgtcagcagcattg

SEQ ID NO: 513796 - DNA, 438 bp, Homo sapiens
aggcctggtgaaagtaagtcgtgcatccctgcacgtaaagaatcaactctgttctaaaggccgcaggtttctctttttctgtagcagctaaacaagcactagcctcaagataagcagcattgaaacaaccgcagctcctccccctgccgaccctggccccacacccctgctccaccagccgtaactagagctttccttggacaagagactcgtttcagtaacttttccctgataagagaccctgaccatagacgggttctggctggtttacagagattgcaccctcatgtgccttcatgtcctgaaagtactttttgaggtataccacctaattgtaatacgcttacatgctgccttcaccccaaggtgaacatgggtcatatgtaacatgcatgtttatccagcacacgtgtccgaataaacatgcatgtatattcg

SEQ ID NO: 513797 - DNA, 638 bp, Homo sapiens
taaattggtttggtttaaaataagttaaagacagtccagagctttcagccaattggtctcctactcggtgtaaatatttttccctccgggcaggggagccaggtagagcaaaggagacaagcaggagtggaaggtgaggcgtctccggctggtactaagccaggaggctttaagctccagctttaagggtggtgagcccctagggggtccagggaacggcttgcccagggttgcagctgctgagtgtcgagtgggccaccggggcaagagggaaggtgaccgcccagctctcccataatcccacgggatcgggcttacaggggggtcggaagcctgtcctcaccgctcgggggatagtggcccccgaccccctccctatatgcacccctggaaaccagcaagtcccagacaaaggagcagcgcgaggtaggcaaagtacaggggaaccgcaagcctccagatgtaacccaggttcacacatatgccaatgtcgggggttacaccctgagaggtactcactctaaacatgtctgacctctaaaatggggccccaggttacatccgtgggtcccctgcacctgtcacaagcgactgtgaggccacactgggaacatagagtgcagcttgtgatacctttc

SEQ ID NO: 513798 - DNA, 390 bp, Homo sapiens
ctccaaaactgtgagaaaataaatctctgttgtttaagccaccagtctgtttctgttacagcagcctgatatggtttggctctgtgtccccacccgaatctcatcttgaattgtagctcccacaattcccatgtgttgtgggagggacccagtgggaggtaattgaatgataggggtggttctttctcgtgctgttctcatgatagtgaataagtctcaggagatctgatggttttataaagaggagttcccctgtacaagctctctctgtttgcctgccgccttccatgtaagacgtgacttgtccgccttgccttccaccattgattgtgagccctccacagccatgtggaactgtacatttattaaacatctctttattcccaaaaa

SEQ ID NO: 513799 - DNA, 549 bp, Homo sapiens
ttgatattccattgcataaggtattggttcatgaaaatgaaaaattgtattagattgtataaccagatcttggttgatttgagtttctgcaaacacatacaagtaatgtaggcatacagttaaaaatgaaatgcttatgctgtagttctagctactagggaggctgaagcaagagaatggcatgagcctgggaggcggagcttgtcgtgagcccagatcaggccagtacactccagcgggggcaacagagcgcaactccgtctcataagaaacaaagaaaacagaacaaaaaaaaacttatagacaagtacaaaatgagaagaaaaagtccctttcccttcaggcctctacttcctgctgtattctcagaggtaagcacggattacagttgacttatggatctttccaggaaaatattgtatgcatttatcagaagatgtaagtatatgcatcctttaaaattgtggatagatcaaactctgcagggtactatcttcccatcctcattggatatagtgtagatcttttcctattgggtgtagagatcac

SEQ ID NO: 513800 - DNA, 898 bp, Homo sapiens
  misc_feature (469)..(469): n is a, c, g, or t
  misc_feature (475)..(476): n is a, c, g, or t
  misc_feature (589)..(589): n is a, c, g, or t
  misc_feature (599)..(599): n is a, c, g, or t
  misc_feature (607)..(607): n is a, c, g, or t
  misc_feature (647)..(647): n is a, c, g, or t
  misc_feature (698)..(698): n is a, c, g, or t
  misc_feature (891)..(891): n is a, c, g, or t
ctaagacgtatataccagtactaagcacagaaactaagccctcggaccacgagaagctgcacatctacatgctttatgcactgctacgccatgacaacacgcaatcctatataatccttctaatagactatcgctgcgttcacactaatatcaactctcacggcattaattggaaaacataaagcaattaactactcggaatttcaaatccacttgcactactactatagaatacactctgtgaactgtgacttaattgactatataattacatacctaagagcaaattagacgcacgcaccctctatacacgttattactcgcacgctttccgaaaacggtgtacgccagagggagctcccgttactgaacgatctcgagggcttgtttactattccttgcaacattggacaagaaagagctacgctctcccgcgatctataatttcataatagccaagatattactnccactnncatctataaactgatataagacactatctctctaccacatctaactacatacttcttcatacgccgtacaatacgactagtggccaggtctgatgcgtcgcgcacttgaaaanctccataaancacccaancattaatggctaagtactactctaaggcaatcactacctntcataatataactcccaccttagtagcgtatagtaagaatatatcagacancgtgtctaatacggtcacgaaatctcttgaagataattagacgccaatttccttataatttcactctcaatttgaataattatatttccttataataaacttacacggccattagcgcttatatatcgtactaatcgtataaataggcttcgtcaccgataatccacagtatacccattatcttacctaagtncattctg

SEQ ID NO: 513801 - DNA, 689 bp, Homo sapiens
  misc_feature (278)..(278): n is a, c, g, or t
agcggctctcgctgcagccggcgctccacgtctagtcttcactgctctgcgtcctgtgctgataaaggctcgccgctgtgaccctgttacctgcaagaacttggaggttcacagctaagacgccaggacccctggaagcctagaaatgggaccactgacatttagggatgatgaaaatagaatatatctatagaggaatggcaatgacatggacacatgcgcagaggaatttatatagagatgatgatgtagagacactacagacaacctggctctancctggcactgcagaactctaagaaagaaacaagaatcacaaggactggaaacaaggaaaaagacaaccagacgaaacagaaaaaaaaatgaaaatgaaaaaacaaaaaacacaagtaatgatgtaactcaataaagaacaaaaaaatgtaaggaaagaagaacaagaaataaaagaataactcacaaaaaagatgataactgaaccaactatggaaaaattggacactggaaataaaacagaataaaaaaagaaaataaaaagtgcgaaatagcatgataaggaagtaaaaaggaagataaataatggaataaaaaacgaagataagaaaaaatactgaaaaaaaagaataataaaaagaaatgacaaaatatgtaaaaagtaataaaataaaaataaacaaaatgtaaat

SEQ ID NO: 513802 - DNA, 172 bp, Homo sapiens
aagaggatcactcggtgtagtcttgagtgaatcaaagcattggagtcattctcggctggttccgtgaaccagaaagtattgcgagacgttaatcctgacaggttatccaggtgacatcccacatggtttcctgatgtcttgtactgtaataagggacaccggagaataaggg

SEQ ID NO: 513803 - DNA, 847 bp, Homo sapiens
ctcaactgtacgatcctgacaaattcaccgttgctactgcgagatcgacgagagagtagtgcgatttgtagctccgtgcaagagcatgctggactgaggtgtaatgtaataaggttgaaggaaacatgaaatgatgcgcaacgtagggatgtcaagatagcatagatccttacctaagcgccagactcgtttacctaggagcgtgaacatgaacctgcgcctagtacatggttatgtgggggtgtgattagagccgcggcatccaatcatggagagaacaatacttaaacatgaattattcctcggaggcccttagccatgagacacgaaacattaacttgacatggttcgcgcagtgggagtacacatagaaaccgaaccatggaagaagactggagggatctttgtgttagtcagcagtctactgactgaaaagccacggaaacctggatggtgcacgagatagctatgcataccagtcaacatcggcaacttgggcaaggtggtgaaatctatcgttggataatacctcaaacaactaggtcacttatcatgagccaagcaagcatggaaacaaagcggagactacgttggaaaacgctgcaaggagcatgcgatggaacgaaggctgcgtttaccgaacgagggtcggtggcacgagggtcctggggaccaaacacttggtagacccacaggcatgttaaataagatattctagcatgccatgggatactggaacttactcataggtgactttatggatgagtagatcagtggctataggtggacttatggggggcatattgatgattcgtggtctataactaatgggtaaccaaagacggta

SEQ ID NO: 513804 - DNA, 809 bp, Homo sapiens
  misc_feature (495)..(495): n is a, c, g, or t
ggtagtagccatggcggcatgagtttgtgcggcgggtttcggttactgcggtggcagtctgtctggccggccctggactcgcctcggatttgggggcttcctcactcgtggtttccgaaggctgtgagattctactattgcattgactggattccagtagcaattttcataactctggtgaatgtattcatgtgcatcccatatcaagatggatgtgcccgtaatttctatgatagtcctgaaaagatatatgaaagaacaatggcgtccttccagatgtgaagctgaaaaggtgaattacgggtaaaggagctgaagtgcgaaaatgtgatgcatgtgagaggagatggaaccctggtattactatgagacaatgtgacaaggaacttatgtgatcattctccgaaagcaatcctgacaattaagcatttttttctccaaatacaaagtatattctctttatgtgaaaatacattactaaatatattctgtatntggctctcggtgaaaaaaaaaagagctctgacataatgtctctcagtgtggggtcagatggaggttttgtggaggagtgggttccagtctcaaagaaggttaaaggtctactaaaactgggaatacggattggtgactctaaatgtgcacttgaagtaggttattactgacaatggagtttagagttatatgtaggccgtatttgttttggcaatgctgtgggattcggtttgggggaccgggagtagtctcaggttggaactaaggtgctttaaagtttgtgtaaaaaaaaaaaagtggggggaaaaaaatgg

SEQ ID NO: 513805 - DNA, 2069 bp, Homo sapiens
ggctagcttctgcgtgcttgttgttgtgctgtgctttgttctgctgcgtgtgcgtctcggtgctgtgctcttgtgtgttgcttgttgcgcgtctctgtcgctcccgtctcgccgtctcgtgtctggctcgctctttggtctcggcgcgcgtctgtctgtgttctgttcgctgtgtcgccttgccgtcttcttgcctgtccttgctctcgtgctgctgccgctcgtgtggtcggccctcgctgtcgcggtgtctggccgcgtgctcgtcgttgagttgtctgtcgctggtgcgctgctcctcttggcgtcgcttcaactctgtctcgtctgttgactctgtcgtgccgtggctgggtggtgtgcctcgcggggcgtggtggtcgtttgggttgggtgtttgtgtctttcgtgcagctggcgctgtctcgtggcgtttctttggtctggcgttctgtgttggttctctgcctcgtgttggtctcatgggtgtcggcccgcgcggcctcccttcttcgcgctgtgttgctcgtcggtctcttcttctgctgcgcgccctggctccgctcgtgtagtgtgttctgcgtttctgtcgttcgcgcttgttggtcgctgtcttcttgccgtgggctgcgcgtgcccgcgccgctggtgctcgattcctctgctccgccgtctgtctgtctgtggtcgtctgtcccttccctttctgctgtgtcgtgttgtgtggtgtgggttgctcgttccttccttcttttgtttcgttctgtgttgtgtcgtcttggttgttgtgcttgtggtgcttgtttggtggcttggtgtttgtgtgtcttggttgtgttttgtgttgtgtgtgggtggtgttgttgtcttgtgtgtcgttcgtggttgcttgtgctgtgttcgtcggtgtggatgtgtttgtttgtgtggtgtctgtgtttgtcgtgtttgtgtgtgttctttgtcgttgtggtgatgtgttgtctaggagtggagcctgtagctggtcttgtgcgctgtggtgtggtgcccgttgggttgcgtgtgtgtcgggtggttttgtgtagttttgttgtgtctgttgggtcgtgtcgggtgggtgtatcttgtgtttgtttgctgtgtttgctgtactgtggttcatctgttgttgtctggtctgtctcgtccgttcgggttactgttggtgttgtttgttgtttctccttgctgtccttgttctgctgggttgacgttgctcgccccctgctgtttgtggtaggtttggttgcgtattctggtgtcttgttgtgtcctctgtgcggtgctgtggttatgcttctcgtctgagtccgagtctttgctggtgagataaatcgggtgatttttgctatctcgtgtgtacctcattatttagtgcttctgttggcttctggtttgcagtgctagtgattgtggctctttccaacctttgacatgacgcgtggggatattgtagctgtgagcagcacgtggccctggggctcgccattggactctggtgtggtcagctaacccgtccctacagtctgtccatccaggacatggagcagcgtggctccctgagatccgtcagctatgatgaccctgctggccctgtatggtgtgtgacggagtgtcactggatctatcattacccacattcatggcctgtggcatcccactggctcactgaagagactctggtagttatcttcttagaatgtggacctcaaggcacccggagcttgtcagtcagctggcttcagatgctggcctgacctgtaccattaatcttagtaggctgtgcgtcatgggacttctgtgggaggccttccggttcctgcatatctcggaggtctgggcacatagcatggctgccctgtggatgcacttgtcagtgccgccagctctgaccagatgggaggtggatggcactttccagagcccaggttcttatggcatttcccagggttatgtcgatttccccatgctcgtgcatttctagtatatttcatagacatgcctggattggctccatcacatcagagtggcttaacccgccgtggtct

SEQ ID NO: 513806 - DNA, 113 bp, Homo sapiens
tacttttccacagatccatttggcaaaatatcaagcctttaaatgtggcagcaagagaaagcggactacgcaggaacggggagttgggagaagctctcctggtgttgacttag

SEQ ID NO: 513807 - DNA, 162 bp, Homo sapiens
cttgaactcgggatggaggttgagtgagcctgaaatcacaccactgcactacatgctgtgggcgacagagtgagactccatctcagaaaaaaaaaagaaaagaaaagaaaggctttgttcttgaggtcaacgtgctaatggggacatgcaggcaacaactca

SEQ ID NO: 513808 - DNA, 917 bp, Homo sapiens
ttcttgcggagtgattgcttctagtgttccttttcctacgctcttgtctagttttctgttacggttttcctctcgttgttcctgtcttctccttcctgtggtattttgtcttccgtcccattcctatggtgggctcttcttttgcgtgcactgtcctctccagttgtggtctgctcactgggcccttgctctctccatccgcgcctattctctcttcggtgcgcctctctgtggtgttctccttgcgtggttctgttctcccgtggtcctccctcgattttgtgtttcctgttgtagtcctcttgatgtctgacctgtgttcactacgtgtgcagatgcagactttgtgttccttcggacccagactagtcattttcctgtgcgtcatcttctctgtctccttgggtatattcttgtctttgtattgcccttcttctctccgccgagtatggatcgtctcgaaacggggaatcctaattcggtggtctcttatctcgttgaagttgacgctggtggatcccacaatctcatcgcacggagccatactactgggtcctcagacgccgagacgccttcgcgatcggccgacggctcgaacgacacgaacgcgcctcacttgttgcctacctagctgcggacccagcacaagccgctgctagctttgcgggcgcgtggggaacggggccaacgctgcagacacaccatcagtcattcactttcatgtccaaccacccctgtgggtggcagggtgtgacgtgtgtgtgccttgtgtgtgcgcacgtgtcggcgctcacacacacatgctagcccactgagtgcacccaagcccagggctggcaagtctttgcagcgtggggccgtcttcaacctggagcctggagaggatctatgcttaactgccttgggtaatccatata

SEQ ID NO: 513809 - DNA, 126 bp, Homo sapiens
gcatctattatgagtgataagcgctttaccacataatatacccatgtaaaatatacaattcatctttggtatcacattatggttattattcttttgagacagagtatcactctagtagcccaggat

SEQ ID NO: 513810 - DNA, 291 bp, Homo sapiens
gtaagcggagactccgcgcgccgaagaaaacttaaataggactcttgctctgtttgccaggctggagtgcagtggcgcgatctcggctcactgaaatctttgcctcctgaggggagggggtggctcccacctcaacctcccaagtaggctgggattacaggcacatcaccaccactcccgggtaattagcgtcaaattttttaattgcattaaactgcactgtaatttaaaggttcttattttatattaattccgtttttttttgagatggatggcgcggtgttggccagg

SEQ ID NO: 513811 - DNA, 112 bp, Homo sapiens
gaggttttagtgaactggatcagaagatgatgtaaaaatggccctgaaaaaggaccaggcaggccacggagcttgaccacaaagccttcacctccctcaggccccgagagta

SEQ ID NO: 513812 - DNA, 225 bp, Homo sapiens
agcacactcaggcctcagctggtggcacaggtagactcttgcgcagtccgcatcgcatgattgtgggttggaaacgtgaagctgatgtccacgtgcgttctgggaatcaccccgcgggaatgtgattgagcagtgaggctgcgttttgggcaagacactgagctctgaaataagacttttcttggaatctcaagccctcaacttacagtgggacacgaatgttca

SEQ ID NO: 513813 - DNA, 453 bp, Homo sapiens
cttggatttttactaaacttggttgataaaacagcagcagagtttgaggggttgacttcaattttgaagaatgttccactgtgggtaaagggctatccaacagcaacacatgctacagataaatctttcggaaaggaagagtcagttgatgttgcagccttccttgttgtctcatttaaagaaatctctagagccacactaaccttcggcaaccaccacaccgatctttcagcagccatcaacagtgaggcaagactgtcttccagcaacaaagactcactgaagacttagattatcgttagcatcttttagcaataaaatatttttaaattaaagtatgtacattgtcagatataatgctattgcaaacttaatagactataatatagattaaacataacttttataggtactggaaaataaaaataattgtgtgactcccaaaaaaaaaaa

SEQ ID NO: 513814 - DNA, 119 bp, Homo sapiens
gcggccgcctactactactactaaattcgcggccgcgtcgacgtgaaattaaatgaagcaatgctgatgagagtgaggagagaatggagtgagcagagtggagtgagtgggggatggag

SEQ ID NO: 513815 - DNA, 517 bp, Homo sapiens
tgtctagcagcaaccacgtctctcgacttcggaggcgacgctcagttcttcagcaaggagtcgaggcatacagcgcttcgagccaggccctgcagttcggtgatgccatccgccaggcttgctcaagcaggacctggacgctgtcgccaaccacttcacgcgtgaagttcggcgcttgcttgccggtatccaggacgaatcggcgcgtgctcaaacgcaacaccggctatccgcactgctgcagtagagccgaaatcattcggcgctgaatatccacctcaaacaccgcctgaccgcggtgcatttccttccctcggggccatgccccggtgggggttggctccttttcaacctcaccggagaatgtcaccatgatccagaagatcaatcccttggctcgcggctactacggcttcgagattcgacgcgtggcggtggtcagttatgacgatcgccatccgcaaacgttcgttccgctgcacccgtctcagcgcctcttaccagaacgacccaccga

SEQ ID NO: 513816 - DNA, 249 bp, Homo sapiens
agccggagcagaagcaatcctgccctcgccatcatgccgtagtcctcatcgccctcccatcccgtacgcatcctttacatcacagacgaggtcacgatccctcccttaccatcgaatcaatttgtccaccatttggtactgaacctaacgatgtacccctgacaacgggcgaacataaatcttcaactccataacatacgcccatggtatggcagggtactccctctagaagtcgaccttgcaaggcct

SEQ ID NO: 513817 - DNA, 709 bp, Homo sapiens
ttttggtcatggttatgatggggtgatgggggctgtgatatacggtaaggagattcgcgcgttagaaagggtctgagtcggtgcagagaacagcgcgactcgatgaaatgacttagaaaatggaggagaagaggaaagtactgtaacagcagaggagatgaagaataaggatgaactgatacggattgctagagactaggtaaaggataacggtagatgcattagatgccttgtagcactgattatttgtgccagagtaatggagtgacgcttaatgagatgcgtgcccacggttgggaagtgaaggagctgaaaacatgcagacacactgggtgaaattgtattatattaagagacgattattgctgcggacgcaagtccatgtgatttggtaaagattgtctatagggtggtacaaggcatttatttggtcgagggtttataaggtatcgatggtaaggtggttcattgggccaatttaatctgaatgagaggattacagttacccagctgtcgaataaggagttggtcctgacaatacctgtttgtaaacaatttataaccctgaaagctaatagggctatggaggcttctgaatgctgtatctgaccggtggagcttctcagtttattgctgacccaattggcataggtgttgtggtttaatattttttggagtataacggtgatgtttggacaagtgggcattt

SEQ ID NO: 513818 - DNA, 439 bp, Homo sapiens
gcgacatcctggccgttttgcgtatcagcaccacctggtattgcagcatggtgatttttggcgtcttcaccatctacgccattctgagttactccaccaactatctgaccgaaatgtatggcatgtcgctggtggcggcgagctacatggggattgtgatcaacagaatattccgcgcctgtgcggccgacttggcggcataatcaccacgtacagcaaagtgaaatcccgtacccgcgtgatccaaatcctgtccgtacgcggcctgctgacgttgactgccctgctcgtcacgaaggctaacgcgcaatcggtcgcgatggcgattggcctgatcagactggtgcgattcacctgttgcgcgtgacgcgggctgtactgggcctaccctggcgaagcgagaacgccgtgttgcattatgtgcaccgcgtgaggtagt

SEQ ID NO: 513819 - DNA, 803 bp, Homo sapiens
  misc_feature (13)..(13): n is a, c, g, or t
aagttccgcatgngaacaaccatgttctgcgggtgcttcttgcagagtagatgcatgaggctaccgctgggacacagtgttcctgctgtcgcgggcacgagacggtgctcacgcctgagttcctgaaccgctgccgcatgcatgccatctccggctggcaggtcttctttcccatgcatttccagagccttccacccagctgtggccccagccacatagggcctgggcccccaagagtctgggccgtgacgactggccgctttgatcgccaggctagccaggcgaggtccctgtcttctacaacgtccgacttacgtggcagcccggtgggcgcctggcggtagacctctagagagcaacgaagaggagctgctggagagcctggatgtgtccgaggctgttcctccgcgttctccaagtctgcatgtgctgcgggcggtgggagaccggtgctgctgagcgtctaccgggcccagacgtgcagcgcggaggctcacgttgagggagctgttacaagccgctggcctccaagagaccgtgcttgagggccgtcggtgcacagaatcccatggctgggccagtgctattcttttgacaccgaggaaggcagggagcatgtaaggactagcgttgaggcccaaccagtggagccacagtgggtaccaggggcgcttgtgttcaagggtcccccattaccgcggtctttttcttcacctggatattcgtaatacgcccagggttgccgtgtctcttttctttggttatggtgcctagacgcccgattgggcgcaacccgagagctg

SEQ ID NO: 513820 - DNA, 468 bp, Homo sapiens
cgtgccgacacagcttcgtctaagagtggctcaggactgaatccgtgtttcaaccttcggtagatggttacgaaattagattattacacgtgtgttggagggcttgacttataccatgcaccttgctcccagcatcacccttgtgtctgaccactttgcagaagagaagccaatcagggctgggcgcagtggctcatgtctgtaatcccagcacttcgggaggccgagatgggcagatcacttgaggtcaggagttcgagagcagcctggccaatatggtgaaaccccttctctactaaaaatacaaaagtcatccaggctttggggtgggcgcctatagtcccagctactccggaggctgaggcacaagaatcacttcgaagacgggaggcagagggtgcaatgagccgagatcgtaccactacactccagcctgggcgacaaagagagactctgtctcggaaaaca

SEQ ID NO: 513821 - DNA, 100 bp, Homo sapiens
tgtcacccaggctggattgcagtggtgcgatcccagttcactgcaactttcaactcctgggttcaaggcatacttccaactagaagtcgtttccacctag

SEQ ID NO: 513822 - DNA, 244 bp, Homo sapiens
gcgaatactacgtgtgtcagggatcgagttcagacgtctactggcctgggtgttccatctcatcttggagtaaatctatcataaagtaaagaatgagagagtgagagatagacacagagacgcagtatgaccgagagtacataaatgcagaaagacagagggagagaacccgagaaaccgaaaattgtttttttatggaagggtttaaacaaagtcctcaagatttcttttctccacatctcct

SEQ ID NO: 513823 - DNA, 391 bp, Homo sapiens
cagccggctgagaaaatggctctgtttatttccaagtgggtcgcgtttttcaagaccttgatatacccacgccaccgtggctccagcacccgccctggaacagcacgccccatttggctcatgctgactccgcaaaagcaatccttagaatccacaccccttggaaatactactccccttccccaggaaaagaagctgaaatggaaatgaaggttgtcatgaccaggaacacatgagtggaagctggtgcaggtgaaatgagaatgtttctatggcactgaaatgaaatgttccctccacccaggaatgactggttctggacagtgaatgctttgtgcccttgtggcgacagcgcctgtttactccaacctagctccagagctgagaattt

SEQ ID NO: 513824 - DNA, 197 bp, Homo sapiens
cggaaatggggcaggtcaaacctcccgtgctgatcagtggtgggatcgcgcctgtgaatagccactgcactccagcctgggcaacatagcgagaccccgtctctacaaaaatacaaaacattagctgggcgtggtgatacatgcctatagtcctagctacttgggaggccaagctgagatcattgaaccggaggtga

SEQ ID NO: 513825 - DNA, 321 bp, Homo sapiens
taagttgttgagtgtaatggtaatttatccattttctttgtctatataatcattctcaaacaaatggacatcaggacacctcttacattgttagcaattattgaggactagaaagagctttagtttatgttacatatatatcaatatttctgtattcaaaaatagaactagctggtcacagtggttcacagtggttcacccagcaacttgtgaggccaaggaaggaggaccagttgaggcctggagttgaagatcagcctgtgccacatagccagaccccatctccataaaaatcaaaaaattttttttgaacaccgaggt

SEQ ID NO: 513826 - DNA, 109 bp, Homo sapiens
cgactcataggatcccctgatcttccgtgccccatgaatacatagcgacagcagtcactttatactattgttcagaggggagaaaaaaggagcgcaggggcacggatca

SEQ ID NO: 513827 - DNA, 298 bp, Homo sapiens
ccatctaggtacttacaaatagaacttatccaataaccctggctctgtaacaatcttacaataatatctcttcataatgaatcattcttaattctcttatttcctccaaattctcccttgttctctagtgtcagtcaaaactctagaaattaaaagagggctttcaagtgtatatagatttaaataggagtaaattgccaacgtgcacttcatattttaaagttgtacgcttgttaccgtttacagactagaaaagtgctatgagaaaacagtactttgttattatagcgagatccag

SEQ ID NO: 513828 - DNA, 529 bp, Homo sapiens
  misc_feature (4)..(4): n is a, c, g, or t
  misc_feature (77)..(77): n is a, c, g, or t
  misc_feature (80)..(80): n is a, c, g, or t
  misc_feature (89)..(89): n is a, c, g, or t
  misc_feature (95)..(95): n is a, c, g, or t
  misc_feature (98)..(98): n is a, c, g, or t
  misc_feature (124)..(124): n is a, c, g, or t
  misc_feature (174)..(174): n is a, c, g, or t
  misc_feature (181)..(181): n is a, c, g, or t
  misc_feature (185)..(185): n is a, c, g, or t
  misc_feature (200)..(200): n is a, c, g, or t
  misc_feature (204)..(204): n is a, c, g, or t
  misc_feature (260)..(260): n is a, c, g, or t
  misc_feature (262)..(262): n is a, c, g, or t
  misc_feature (278)..(278): n is a, c, g, or t
  misc_feature (325)..(326): n is a, c, g, or t
  misc_feature (386)..(386): n is a, c, g, or t
  misc_feature (422)..(422): n is a, c, g, or t
  misc_feature (429)..(429): n is a, c, g, or t
  misc_feature (435)..(436): n is a, c, g, or t
  misc_feature (448)..(448): n is a, c, g, or t
  misc_feature (454)..(454): n is a, c, g, or t
  misc_feature (489)..(489): n is a, c, g, or t
  misc_feature (514)..(514): n is a, c, g, or t
tttntttggttttgggggttgtgggggggggggggagggagaggggggaaattggggggtaaggccatgggtggganggngtgctgagnacttgnggnggaagagctaaaagagtgcgacgganctgttgagggaggtggtgggggtgactctggtacaggggctgcaccaggngccccanagcncctgggtgcccagcntggngctcagcccaggagaagagcatgtgacggatctgctcatccagatcatcccggaantngtgcaggatgcgctgnaactcccggtaggacacccccaggtgcagggccacggctggccagtnnagacccagacgcccagccacactcagcaggttgctctagcgtcagaaagccggtctcggnatgtcccagattaaagggtgacaaggagaggcaagncccccgnggtggnncctcggaacctngaagtntctgttggaaggaaaaagtgcattaagccctgggntccacccccaactccaccatgtcancctggtaacccctgg

SEQ ID NO: 513829 - DNA, 687 bp, Homo sapiens
  misc_feature (181)..(181): n is a, c, g, or t
  misc_feature (185)..(185): n is a, c, g, or t
  misc_feature (187)..(188): n is a, c, g, or t
  misc_feature (191)..(193): n is a, c, g, or t
  misc_feature (195)..(195): n is a, c, g, or t
  misc_feature (229)..(229): n is a, c, g, or t
  misc_feature (292)..(292): n is a, c, g, or t
  misc_feature (372)..(372): n is a, c, g, or t
  misc_feature (374)..(374): n is a, c, g, or t
  misc_feature (400)..(400): n is a, c, g, or t
  misc_feature (413)..(413): n is a, c, g, or t
  misc_feature (425)..(425): n is a, c, g, or t
ggcggtcgtgctggtccaggtgttcgaacgtgatccgagtacataaggcatcttgctccctaaggcttgcatcagcattgaaatagcctacaagtagctggggggccggtccacaagagtgttcttgtcttccatcagacagcgagagatggcgtgtgctcttcatagggactatggttantagntnnctnnngnggtgctgccaactttataatggtggcccacctanctatcaatgttgccaaggcccgcaagaagtacaaagtggagtatcctatcatgtacagcacgnaccctgaaaatgggcacatcttcaactgcattcagcgagcaccaccagaacacgttggaagtgtatcctcccttcttatntnttctagctgttggaggtgtttaccanccgcgtatagctnctggcctgggcntggcctggattgttggacgagttctttatgcttatggctattacacgggagaacccagcaagcgtagtcgaggagccctggggtccatcgccctcctgggcttggtgggcacaactgtgtgctctgcttcccagcatcttggtgggttacaagtggcttgggcagtggaccaaatggctgcattacagaatcataggggtctaaaaatctcattcatttcaaatgacttacctttatttccagtcacatgttttctaaatat

SEQ ID NO: 513830 - DNA, 136 bp, Homo sapiens
ggcaatttctacattttgtacatctttggaagatttgcccagacccttcggcacaggcccaaagttgtttgtttgcttgtttgtttttgagacggagtctcactctgtcgcccaggctggagtacaatggcatgat

SEQ ID NO: 513831 - DNA, 371 bp, Homo sapiens
  misc_feature (181)..(181): n is a, c, g, or t
  misc_feature (185)..(185): n is a, c, g, or t
  misc_feature (187)..(188): n is a, c, g, or t
  misc_feature (191)..(193): n is a, c, g, or t
  misc_feature (195)..(195): n is a, c, g, or t
  misc_feature (229)..(229): n is a, c, g, or t
  misc_feature (292)..(292): n is a, c, g, or t
ggcggtcgtgctggtccaggtgttcgaacgtgatccgagtacataaggcatcttgctccctaaggcttgcatcagcattgaaatagcctacaagtagctggggggccggtccacaagagtgttcttgtcttccatcagacagcgagagatggcgtgtgctcttcatagggactatggttantagntnnctnnngnggtgctgccaactttataatggtggcccacctanctatcaatgttgccaaggcccgcaagaagtacaaagtggagtatcctatcatgtacagcacgnaccctgaaaatgggcacatcttcaactgcattcagcgagcaccacgaatacaggggatcatctagagtcgacgttgcga

SEQ ID NO: 513832 - DNA, 409 bp, Homo sapiens
acaaatttgttttagtccattcagactgctataataaaataccctagatggcatggcttataaacaatagaaatttatttttcacagttctggaggccggaaagtccaagatcaaggggccagcagattcagcatttggtaagggcccactgccgggttcacagaccaccacgttcttgttccatcctaacatggtggaagagataagaaagctctctggactctctttcgtaaggatacaaatcccacccatgagggctctaccctcatgaccaaatcacctcccgaaggccccacctccctgggttaggattttagcatgtgacttcttttgtgtgtgggtggggggccacaaacattcagtctattgcagtttccaaagcaacagccaaaaaaaaaaaagtcgagc

SEQ ID NO: 513833 - DNA, 229 bp, Homo sapiens
aagaccgccaagggagacgcccatgaggcctgtcccagtttctcgtatcttgtctgctacacctgcacaacagacagagacagcccatgctggcctccatgcctgagaccctgcccaaccctacaatgccaggatcttccgcgcttgatgccaaggagcgcaaatgtcaggactccagcatatgggagcaggccaaatctagacccctggctttccagtcagcagcatc

SEQ ID NO: 513834 - DNA, 377 bp, Homo sapiens
atcacactgactgggcacacacaaatacagtgcacgctcacacatgctgagtggcttgcactcacacacatagatgcatgcttgcacacatcaaggcacactcgttacacaatgtacacatacacttgcacacttgtggcatcagaggtgtgcactggcggcagagaactccacactcagtacacttgagagcacacccaagggggtatgggggcggttggctacaagcgaaattaaaagcctgacacacacagcaagtactctcacatgggcacacacacacacacaaacacatctgcacacacctggtcatgctctcacacgaatgcacactcatgtactctcacatatgcacactcatacacacatccctggtg

SEQ ID NO: 513835 - DNA, 842 bp, Homo sapiens
agtctactgtgtgctagtcacccccggggttcccggtccttctcgaggctgaggccgcggcagcgcggtaggacggcggaggcgggacatggtctgtcctgcgtgtgggagccggacctaagcaaggatagatgtgaactacaaaatgtcattatcctggatgatccaacgaagctagccaaggtggaagagaacgatcgaccattgacttcttctaaccgggccgctataaccatcaccctgctcagcttcaccatcgatcagcctcgatgtacttcgcctttgacctagggtatgtactctgttccagaaagacaacatctggagaggcatcctctctgttattttgcttcgtttcttatcgatcgagtgtgttagctttccccatttggtccgttcagctcgaccgtcatccagtccttcatggcgaatcgcgtttttggactcatgtgtgctctagcttcctgttcctggttttcctactcttcctgaatttcgagcaggttaaatctctatattgtattgtgctagatccaacatcttcgatacgccacaagggaagcagatgtcatggagtatgctgtgaactgccatgtgatcacctggggagaggattatccagccacttttgatattcttgcctttggacattcttggggctggggccatgaaggctttggtgaatccgaagttaagggctctgctggagcaaaccaggattacctggggactgcacgagctctcttctgggtttcctcccattttgccgcgagtcgcgggcacaagcatcttgggaccgtgtgcaagagagcgggagatagcgggaggacaccgcgccaaag

SEQ ID NO: 513836 - DNA, 213 bp, Homo sapiens
ggtaatctacaagcggccaaccataaggcatcataggaggatgggactttgacacaatttaacacacaaatcgatcagacgaatggcgtcgtcattaaattagtgccagatacgcaaacaggtggggtcttagatcccaaggcacgggctgaattagtggcggcccaaacgcaaactgtcgatcagcaagacatgacacccccagatatttct

SEQ ID NO: 513837 - DNA, 448 bp, Homo sapiens
  misc_feature (38)..(38): n is a, c, g, or t
  misc_feature (44)..(44): n is a, c, g, or t
  misc_feature (93)..(93): n is a, c, g, or t
tttggacaatttttaacattttaaaataaaactttttngtcatnaaaaaaccaaatgtattaaaacttagtttccagaacttgccccaaatgnctttttaaacatgacttaaatgtcgttttacaaattctatccaagaatacgtaattttccttttagaactttagtttataatttatatattaaagtgccctttaattgatattcatcgggataccttcctctgagccctaatggttttgggaggcctaggcggtggatcacctgaggtcaggagttcgagaccagcctggccaacgtggtgaaacccagtctctactaaaaatgcaaaaattagccgggcatggtgcgggcgcctgtaatctcagctactcgggaggctgaggcaggagaattgctggaacccgagaggcagaggttgcagtgagtcaagatcgcaccatcacac

SEQ ID NO: 513838 - DNA, 434 bp, Homo sapiens
tgctaggcagaattctaagcgcttcatattcacagcaaccctgtagatcccatattgcaatacatcccattactcagatcacattatatattggccttttgaaggagtcaattgaaagcaagataaccactgggtgcgatgactcacacctggaatcccagcactttgggatgccaaggcgggcggattgcttgagcccgggggttcaaaaccagactgggaaaaaaagtgaaacctgtctttaccaaaaataatgatgatgatgatgatgataataataataataataattagccatatgtggtgtcatgcatctgtagtcctagctacttgacaggatcatgattgcttgaccctgggagggcgaggcagcagtgatctgagatggtgccactgcactccagcctgggcaacagaatgagaccctgtctcct

SEQ ID NO: 513839 - DNA, 913 bp, Homo sapiens
cttcttttttattagcattccttactgaactgaatcgatttaaaatacaatgaattacatccaatttttacctttagtaacaccatcttaataacacaaattccaaagaacaagtcagtctggcttatcttctaaaataaagttatatttaagtagacttgggtggctttagtgacattatgaatgctttaaaccacatttatactatttttattctgttaacatttttaattagttgtcagcttttactcttgatctatcctatttttttctttcctcttaacactgtaacaaaaaatactcctgtttcttctgacatattgggcatttcaccttttctttgtttttagtatctctgaggtaagggaaaggtatttcactgaggaataaccaaggcaagttgatgtgaagactttctctgattatattatttttacatagtgtagtgtggttgttaaatgaaatggacctgtgactgatctacactgaaactaacagtgttaacttagagatagttttttcctactaccatgtaaatgattaaagtgttcatcagtctatgctcaaactggagaattggaaaatatgtatttacaatccctagagagcttggaagaagcatggtaaaatggagacaacatggattcgaagtcatctggattccagtccaagtccctattaggttagcgaataatatctctgagtggttcaatattctattgccttagtattgtaattactatgaagctggataatataaggacgagcgaggggaattgtgacagagagagtgatgacaagtagaggatgattgtgaaagagacgtaaaaaaaaaagggggaagacgaggaagcaattaagaagaaaggggaagggaaaaggaacgaaacaaattttttgttttatgttaaga

SEQ ID NO: 513840 - DNA, 524 bp, Homo sapiens
cattgctgacagggtcattggagaatgtaactggatctggcaggggctcatcctagatcacaaccttccagaaaactccaagataaaggggagagtttcctctcaaatggaagcacctgacgatgcggcatataaaccacaccaaccggacagagtcggtgggcccacttcccaaatctcgggaggatctgcagcttactcataacaggatcacaaagcggggctctttggagggatgggtaaacctgaccttcatccatctccagcacaatcggctgaaagaggatgcggttccagcggcttttaagggtcttaaatcactcgattacctggactggagcttcaatcagatagccagacggccttcgggtctcccggtctctctacaaactcctcctagaacgggaccagtatgccccagatgtggccgaactcatcgggagccttatggagattgcgtaacatccgtttgaaagtggcccggacctatctcttagatccttacaggatatggtctggagtgg

SEQ ID NO: 513841 - DNA, 262 bp, Homo sapiens
cccacgttcaagtgatattctcctgtctcaacctcctgtttagctgggactacaggctcgagtcattattttcagctaatttttttatttttagcagagacggggtttcaccatgttgaccaggctggtctctaactcctgacctcaagtgatctgcctacctcagcctaacaaagtgctaggattacaggcatgagccaccgcgcccggtcacagcccttaaaaatttgagtttaaatgcatatacatatttttgtaccag

SEQ ID NO: 513842 - DNA, 495 bp, Homo sapiens
gcgtttatctcacaacgaactggactgatagtggaataccgtgcgaaattctttcaatgtgtcatccctggttgagctggatctgtcctataacaagcttataaaacataccaactgtcaatgacacaaccttgaaagactattaccgtggaggttaactcaacttgagaagtttgactataaagagcttctgcaatgatcctggggccattatcctactccaagatcgaagcatttgcgttgggatggcaagtcgcagtctcagaaaccagtcgttccaccggatatgtactgacatgtcgtacgtgttgctgaacgaagtcactcgttaattaatatcgtggtatcctggaacaatattgtatggtaatgttgttctgtgtgtcagttttcatagtatccatattttattactgttgattacttccatgaattttagaatctgagggaaagtgttttgtaaagcattttattgtattttgaagaaaacgatga

SEQ ID NO: 513843 - DNA, 381 bp, Homo sapiens
cgtcgactgagattgtgcccctgtactccagcctgggtgacaaagcgagaccctgtctcaaaaaaaaaaaaagaaaagaaaagaaaacaagtgggggcgtcctcactttcccaggctccctctaattgtgtgtgggggttgggtgtttagcactcacaagcttccgcgaaatgctgcctcaaattatcttgtagccaccaggtggcagcagcaatccactttttggtctaacctggcagaggctgaactaggatggttctcctttaattagcgtactggccatagaatcgtggacgtttagacatgaaagaaccttcctcaaaagttctgacaactacaggtcgacgcggccgcgaatttagtagtagtagtaggcggccg

SEQ ID NO: 513844 - DNA, 138 bp, Homo sapiens
gagactgggccttacagagtaacatgtgtgaaagcagcaaagaggcactggcagaaaaaacctgaaccttccaaagatgccgtcgaggatgtaccgaatttgtttgtcaattcgttctgaagaggtgagtggctgtct

SEQ ID NO: 513845 - DNA, 915 bp, Homo sapiens
  misc_feature (89)..(89): n is a, c, g, or t
ttctctggacggaccttttctcttgcacacgaggagcctgaaatgatggaaaactaggtcaggggggttttggtccaggtttccccctnccctggtgaaacggcagaagacccactttcatgatttgcccatgtggtgcctcagtgattctcggtaacaacggcttcatctggatttaccctacacctgagcacaaagaagaggaagcagggggcttcattgcaaacctggagcctgtctctcttgctgatcgagaggtgatatcccggcttcggaactgcatcatctcgctggtaactcagaggatgatgctgtatgataccagcatcctgtactgctatgaagcatcccttccacatcagatcaaagacatcttaaagccagaaataatggaggagattgtgatggaaacacgccagaggcttttggaacaggagggataaggaggtgctccagatgcacgggactgtggaccttgcaggagtgatgactgtgatgtgtggtccccatatcgtggctcagcaatagactcgagagatcatccctttgtctgcattgacggccctgtgacggcctcactagccacacatggctctcgctttactccgtgtctctgaacatcataacgcctaggtgctcgcgcagcatgtaactacgtgcgttacccttggagttgacacgactgagtccgcggtatctagaggaatacgtttcagcttcttctctaatagtgcatcagtgttacagtcgaatgggctcccatcctggaataactatggagaatcctttgtcttccactcactgtcattcaacaaggcacagtgccccatgagattgccccaatagcacacatcggcatccctgacctccaaatgcgtctgttttggcctccatttacatctccggttaatgacc

SEQ ID NO: 513846 - DNA, 507 bp, Homo sapiens
  misc_feature (17)..(17): n is a, c, g, or t
  misc_feature (56)..(56): n is a, c, g, or t
  misc_feature (62)..(62): n is a, c, g, or t
  misc_feature (106)..(106): n is a, c, g, or t
cccttccacgggcgaanaatttttcttggcccgaaggcaaagggctttctagcgcntgaccntaaagccgcttctcagggaattcacggttgtttgcggcgcaatngtcggaacgcgccggaacgttgttgctggagccccttcccgctgcggttgtcatggagaaacttccagcttgggccagagactctactgcaggacaatccaaagctcatctatgccaggctgagcggatttggccaatcgggaattttctccaaagtagctggccatgacatcaactatttggctttatcaggcgttctgtcaaagattggcagaagcggtgagaacccctacccaccgctgaatctcctggctgactttggcggtggaggcctcatgtgcacactgggcattgtgctggctctctttgaacgcacacgctctgccgagggcaggtcatcgattcaagcatggtggaagggactgcatacttaagttctttcctgtggaaaacccagccca

SEQ ID NO: 513847 - DNA, 153 bp, Homo sapiens
tagctggtacctatacaaactgaactcttcattcctgctttcttagaatacatggccagaatccaagtggaaaaggtctctgtgggccagtccacctgcgcatcggtccccactgtcctgcacttcttccttgccctggtgctggatctgaga

SEQ ID NO: 513848 - DNA, 350 bp, Homo sapiens
tcagtggagccttgaagagagatcagttcagatgactctccttcggtagagtctcgagaggctcacagttccgctcgagagccgccttttcactctccctctctcctcgatcgcactttagccagctttccctcttgccttgtctcaagtactgccccctctgggtctgtccctggcctttcccggtgctgggacacgaagtaggctccttcctccacccatttgacgccttggctcctatgtctccattcacgccacagcacgactctgcctgactcacctctcctcgtggggcggccagcctcaagatcgtaccactcggtgccaggctcgtggatatcctcaccttc

SEQ ID NO: 513849 - DNA, 375 bp, Homo sapiens
gatgctcggggttactctatcagcctaggataaccacccagactgtgggactcatagcctgtagtccatttgtttggcgtatatactaatgttcaaggatgcacacataaggcgggtgatgttttttggatagcgtcttatcacttgtagaattgccatgataggcatgttttggagctacttgaagtacttgctggcctagtaattatgcaagtaagtaattaagtgttgattcatatgtgaaagcccaaggtaagcattatttatgtcttacagtgaagtgtggtgtgcctttcatttatctgagtggtctttatgtgatggaatattaaatggatcggtgaataaactcaagagggtagattataagaggaa

SEQ ID NO: 513850 - DNA, 434 bp, Homo sapiens
tcaaccacttcatgcgtcacatagagtaccctcctacttggcaaaggacccaaggtgcgtccttcctacgatttttgtcatgcagcattaaagaaatgtccactattaaaacaatagagacaaagccattattaccgaagtacggatatatgcaaactaaatgtctattaacatatttgacaggaggactatagtgtaaagaagatagatagtgtagtgtgtgtgtgcgtgacaatagtgtagtgtgtgtgtatgtgtgtgaataagtcgacataaagtctttaattattgagcaccttaccaaacataacaataatccattatcctatttggcaacaccacaaagatcgcatctgttaaacaggtacagttgacatgaggttagtttaattgtacaccatgatattggtgtattacgctcgtgagtccaaccc

SEQ ID NO: 513851 - DNA, 1395 bp, Homo sapiens
  misc_feature (632)..(632): n is a, c, g, or t
taggtaaaatctttttttttcagaaaaaaaaaaccccaaaaaaaaaagtttttccaaccaacatccggggaggggatttgggtgtagggggaagggtgtctggtgccatccaggcctgttgccccacagccaatggtggtgttttgggcagcaatataaggggtgtatgggctgtaattgggcccaaaaattaacaggggttcgtggtgttgtatgggagagagaacagggggggtcgcaaaggctgtgtgtgggagacgcggtgtagaaggggagaaagtgggaccagacgaggggtctcagattcctgtggagaagccgccagaagtggtggggagggccatttgttcatataaccatttttcttgttgtgtgatctcaaaacccaccgcgtggtgaccccgcccttctctttgtgccccatactcagagcgaggacatttaaagcggggtcgtgtgtgtcagagctctttgggggtgacacagaggtgacacatttttgagagagggtgggggggcgcccccccaccgcggtgtgctctcgtggggggacagccgaagagatatctcgagggcgtaaaatatctcgccgcaactctctgtgggcgagccaagtgggaattctcccccgngggggtttcccacccggacaagaacatttttcttgtgtggggcgccccccccaaaagtgtgtttttttttggccccctatatttcccaggcgtttgacacaacactcttttgtgagacgcggggggcgtcttttgttgtggcccaaacaccccatgagggggaggaaacacccccaaacacctctctaaaagaggtgtggcggcgagtcgtagcatgttgtttgtgatgcaagcgaaaagaagccggtggttttttcctccccgcgggcggggaggaagacgctgtggggggggggtccccactaaacatagatgggggaaggacgggcggcgaggaggttctcttctctgtgttgtgagcgcccaccagctgattagttgtggtccgcgggggttatcatccttggagagaaagaggggtggttcccccggtgattcgcggcgacgccatatggataggtgttttttgtgcccgacgatgtagcgtgtatagacaggcggggtgtgttaccaccacacccccgcgggtgggggccctattttgtgggcgggcgacgccgttgatgcgacaacaactgcatgggggagggggggcattgacgggacatctttcccgaggcggcggctctcatgtagcgttagatgcttgttagtgggtgggcgcccctgtggagaggagaacaacttgtggtgggtgggcatctcacagaaagagctgtatgggccacctatagcggagatatgttgtggtaaggcggatgag

SEQ ID NO: 513852 - DNA, 302 bp, Homo sapiens
  misc_feature (71)..(71): n is a, c, g, or t
  misc_feature (136)..(136): n is a, c, g, or t
  misc_feature (251)..(251): n is a, c, g, or t
  misc_feature (281)..(281): n is a, c, g, or t
gggatcgagactctgaccactgaaacccaaggccaagcacttttatttttcacacagggtcttgctctgtngcccaggctggagtgaagtggcgcaatcacagctcactgcagcctcaacctcctgcactcaagtnatcctcccatctcagcctcccgagtagctgggactacaggcaggcatcaccaccctcaactaattttttaatgttttggtagagatggggttttgccatgttgcccaggcaagtnttgaacttgggcctcaagggatccttccanttgagactcgcaagtagctgg

SEQ ID NO: 513853 - DNA, 108 bp, Homo sapiens
aagaagtgcttatcagacatcaccaggttcccacagttaggtacaatcaactcttgtgcacctgatttttcccactctcttatcgccttgtcattccgtgctgagatt

SEQ ID NO: 513854 - DNA, 552 bp, Homo sapiens
ggccctcgtacatggtggcgcctgtgtggtacttgtgtagctggctggctctgctagtctggctttatcctcttcctgactcgcagccggggcctgtgtgctggcatcacgccggccaatgagccactgcaccaatgagtgagcttgtgcagtgatgcatggcctggtgtgtgcccatgccattggtgcccctgtgacgcctgatgtgatgcctgagatgcttggacgtgcagtgacctctgtgctgcctggaggggaccctggtggacactgaccgcactaacatgtggcccatgctgttcgaagtcccactgcgagagctgtgccatggggcaccgacacgcatgaattgacgacaccggacgtgactgtgacacgctggtccaggtcccttactgccccccaggtgactgggactgtggcccctggggttggtcccggacgacaatgccccacggacctgtggaccacatccgttcaaccgcattggatcagcagcgtgcacacacacctttggggacggccttcccccgacaccgctttggggctggg

SEQ ID NO: 513855 - DNA, 383 bp, Homo sapiens
  misc_feature (35)..(35): n is a, c, g, or t
  misc_feature (382)..(382): n is a, c, g, or t
tgctcgtcaggctacggcggacattctgcgtgaangaatgtacccgtgaccgaactgcgggccggaattatcgttggcgcaggttccgcggcgttcgaagtcatgcgcgatatggtctacaacctgccagtcttaacgcctccgcgctgggttcgttcacgcaccacgcccattgcgctggaaaacttgctgcactatctggttgcgttgttagatcatccggccagcgaacaccgcatcttcgaagccgccggaccagaggtgctcagttatcagcaacagtttgaacattttatggcggtgagcggtaagcgcccgctggtttgatcccccatcccccctccccaccccgctggatttcggtgtggtttctcaaatgtgng

SEQ ID NO: 513856 - DNA, 957 bp, Homo sapiens
tatccccctccttagttttttgggcgcaaaacccaattataaccccccccccccttgttaacgggggggcggggaaaaaagccaaaaacccaaaaacccgctcgggtaaacccccatctgtctctggccccccgccttttaatcggccctgttggggttttgggtttttcacatcctggcccctggggggctggggcgtgagatgttgggggggtgggcaccccctcgcggggggcctctgtcgcctttggagcgcccctctgggagagaatgtcaagagggggatgtgggaagaagcgccactgtgccgcgggccgggagttctcggggggagaacgtggtggtgtggtgcccccacaaaaatgcccctataggcggccggaaggaggggggggatagggcgcaggggctcctcccctacggggcgtcagagagaggggagcgctccgagaggcgaccaccagggaggtggggccaccctgaaggttgaggccctaagagcgtctggcgccagaagagggagaacggggggtcaagcacctgtgtgttgttaaccccagcgggggtcccacccgagggcgggggccgaggggtggcgcgcgcctcgccgacactcctggtgtggaacccctctccctctctccccttgtggtgaaatcttttggcccgcccctaaagacccactgacgtgtggcccacaaggagggcgcagaaacccctgggtggaccccacttggggggcacaaggggggtgataatggcccgagcaaaagaggagtgctagggggggactagtcccccaagaaactagaaatagtggccagggttgtgccacattcaacaggtttgtgtgcccccgagacccccagggttctttgttgtcaatgacagccaccatggtgctcaggctgcggaggggaatgcctggtgagtgacatctcgcacaagtgcaagcac

SEQ ID NO: 513857 - DNA, 575 bp, Homo sapiens
ggctcacgcctgttatcccagcactttgacaggccgaggcggacggatcatgaggtcaggagatcgagaccatgctgggtaagaagggaggactgacggtatactaataagcgcaatggaattagacggacgtggcggggggcgcctgtagagcgtgattctagggaggctggggcagtcgaatgacatgcgcccactagtcgaagcttgcactgaggtgtcatcacgattgtgcaatatagactgttacgacagagtgagattacatcacttaacaaggggtcttgtgcgagttccatggtggtggactcaatgcaacaacttttactacttggcgacttcatgcatgctgtagaatggagcgagtctttctgcacgtgggctttaacggtaaagtctagtacttcaggggattatgccagttaccaatttcgcctagatcttcccatggggaactctgggtgcatacagccccagagtctatctacctatctatgcaccaagctttgctgatttcttcgctggccttctttccttaataggccatagatattggtcggctacctagggtctcc

SEQ ID NO: 513858 - DNA, 277 bp, Homo sapiens
aaggccaaaccgggttttttttgatggggcgaccccccctttgttttttgggggccccttggggtttttcccaaatttccccatcgttttaaaatgggtttggggggttccctttttggaaaaaaagggaatccctttgttttccctttaaaggaattttttttttagaaccaagtttcctgaatgggggggcccggggggggcccaaacccctttttttttttgaataaaaagccttttttttttttgttggttaaaaaattttttttttccttta

SEQ ID NO: 513859 - DNA, 333 bp, Homo sapiens
gccgctcctcccttcggctctctcctctcctctcaggattgccacctcgcctcctggccccaaaaggatcgcccccaaccaagggaccaaaccatcggggctcccccaaggaaaggccccgcagccccccaagcaagggaaggggccaggccccaaggcccccggcctcccccggctccccccggcgccccccgccccccctggccaaccagccccccctcgcccccccagcggccccggcagcgccttcccccacgggcacgccctcccccttttgcaccccccaggcggtcgttcaaagactcgatatctcccactgtcccccacccaccc

SEQ ID NO: 513860 - DNA, 189 bp, Homo sapiens
tagtcgtacgtggcacaggtcaaggccaaggcagatggctccacttggatatacccgccaattgccaggctgtgcaggaatagcttacaggctgaccctatctggggcctgccccagagttacacttaagtggcacttgtgggggtgctgggaagcagacatggggcccccacagcactgctgggcttc

SEQ ID NO: 513861 - DNA, 920 bp, Homo sapiens
ggcttggcacccgggtggggcacagatgccgcgggagtggggagtggggagtggctgcctcgaaccctgctgtgtggcttgtcaccctccatggcgtctctgcgcctccgtttgactccagctgcacggcacacggggcgaggttagcatcaggggccaaagcggacccccgccagaaaggaggaagaggcccccaggtaggtgcgtgcttctggacctggcgctcggcacactgtgaggatgggcggatggagttggtctgcaggttccagaatgaatggggccctgttgtgacaggagaaggagggcagcctgggttgaagaaacaccccctgctgtccaacagctgcactgcccgctcccctggcaacacctgccacgtggactggagaagacacattagcccttgggctggaagtcgtggaccggcgtccacctgagatgggactctgggagggaacagccgccggccctcctgcctcagctgctctcagcatcctacagtgccatcgggtgctctcaggacagatgcctacagaacaggcttttctaaagaaagggggtgggctccagggcccagagtcacggcacggacgagggggctttggatcactctgcacacacctcaggatggaagtcctggtcagcaaatgcattgagcatttctggttggaccaactgctcctggggcaggctggtctctatccccaattcccaatcccacgtgcctccttgcctctggtcacgttgatgttggagcagcaagccttttccaaagctcagaagtcagagggccacaggccactggtccccttgggcaggccggaatcccttggactcctgggagcactcgggaaaagccagtggccacacaccagtttggccgtgggcccggctaaagaattccccgaggggccaga

SEQ ID NO: 513862 - DNA, 115 bp, Homo sapiens
tgacatgattcgaatcgagccggtaccacagtgatagcaggattggtagtgattttcatgatgctgggcggcacttttctctactggcgtgggcgccggattcatgaagatgaga

SEQ ID NO: 513863 - DNA, 379 bp, Homo sapiens
ttctgtatgaatatgcaagacggcttcctgattactctgttgtgctgctgctgagacttgccaagacatatgaaaccactctagagaagtgctgcgccgttttagaccctcattatatgctacgccaaagtgttcgacgaatttaaacctcttgcggaagagcctcagaattcaatcaaacaaaatcgcgagcttcttgagcagcttggagagtacaaattccagaatgcgctactagctcgctacaccaagaaagtaccccaagtgtcaactacaactcttgtagaggtctcacgaaacctagggcgggcagcaaatgtcggaaacatcctgaagccgcgctgcacgagacaacgccagtgtgacacagtccctgccg

SEQ ID NO: 513864 - DNA, 237 bp, Homo sapiens
gacattaacctttatcgataaactgacagttagactaagactatactaaccccaggttggtcaactcctcgtgccctgcactcgtggtcactacgattaacccaatgtctgtaaaaaccggcgctaaacgagtggcaccacggtccgtatgatggggatcctgtacagtctacctattctcgttgcagcatgtgtacttgccgtgttcagagaagctatcattaatgccaaaacact

SEQ ID NO: 513865 - DNA, 606 bp, Homo sapiens
aaaacaggggtgcaccccccatgggggagaccccggcccccgccgcgttgcgccaccttctgggcgaaaaaaccccctggccgcccgggggaccattaaaacactctgggagccggtggactccccccatatcagtgcgcccgggtaggaccagatggccgccaccaactaaaggcgctgggcgctggccccggatgaaaacccacggccaaccgaggtacaccgcacgggttcttgccaacccaacccctttatggggcattttctaaccacaagttgcccctcgaggagtcggtgctcgaacccttgaggggggaacacacgaacccctctctgggggtccacaaaagacgaaacaggcacacacagtggcatgttgtgcacactgagcctgtcgagcgctcccaaccgttgggggattgccccccccatgtgccccaccgtgcgccccgagatattgctgttaggacccctctaggcgccacaggaggatatatttcccaccggtacacgaggagattttacacggcgtggcgcccccccctggcccccaaaatttttttttgaggggctttttccccataaggaccccccccccaaaaaaaa

SEQ ID NO: 513866 - DNA, 479 bp, Homo sapiens
  misc_feature (34)..(34): n is a, c, g, or t
tcccccgggatcccttaaacccttaaaacaaaanccctttataaatgtataataatttcttcaaaaaaaaaaatgggcatttgtttacttttaaaaaaatccaccagtccccaccacttaaatattctaaaatacaataatcttaataacattcatttctatcccaacaacacatttcctaaacataaccactttttaaatctttccaacccccaaacccttaaacacaatcaatactcttttcacttcatcaactactttataccatataaatatcttcacacagcaaatcttttaatcacacctcctaacccctcaccttctttagccaatttctcaataatcttcccacactacatctttctcatatcccacacttttattttcttaagcctttttttcctttaccacctctttcatcccaatttttttctattggacacttcaaccacccctacccttcccccaacacacttccc

SEQ ID NO: 513867 - DNA, 440 bp, Homo sapiens
ctcggtgtcacctgtctgtcccatcctgtctcgggtcattcttaactgatttgcacccgggacgcaggcactctgtgtcacctgtctgtcactgtctcgggtggttcttactgatttgcacccgggacgcaggcactcgctgtcacctgtctgtcactgtctcgggtggttcttactgatttgcacctgggacgcagcactcgctgtcacctgtctgtcactgtctcgggtggttcttactgatttgcatctgggacgcaggcactcgctgtcacctgtctgtcactgtctcgggtggttcttactgatttgcatctgggacgcaggactcgctgtcacctgtctgtcgctgtctcgggtggttcttactgatttgcatctgggatcaggcactccgtgtcacctgtctgtcgctgtctcgggtggttcttactgatttg

SEQ ID NO: 513868 - DNA, 96 bp, Homo sapiens
  misc_feature (25)..(25): n is a, c, g, or t
  misc_feature (62)..(62): n is a, c, g, or t
cagcgatgcgcctccctgtgggatntcatcaccctgggaaccgggagtggcccttggctcantgtgttctgcatggtttggatctgaattaattgt

SEQ ID NO: 513869 - DNA, 115 bp, Homo sapiens
tgtggagacgggggtctcactggtgccagccaagatgggtctcgatctcctgaccttgtggatccacccggtctggggcctcccaaagtcctggggattacagggcgtgagccac

SEQ ID NO: 513870 - DNA, 187 bp, Homo sapiens
  misc_feature (165)..(165): n is a, c, g, or t
accacaacctcagaaagccgcatcggggagggcggcgcagagtgcctcaaacaggtaagaaaagttttggaggcacacgcgcttggaaagatgcaacgcggcgcaaatagaccgtagacacgccttggcccgtttattcaatctttatcacagaacgaacaatanattttgcccaacacccagggta

SEQ ID NO: 513871 - DNA, 236 bp, Homo sapiens
ccccccccttttttgggggtttccggggcttttgtgattccccgtctggtccaaagttttggggatccattccgcgaaatgatgttttggcattggggggggggggattaattttttccagactttttaagatgacccctttggcccccccccacccttttgggggttgttaaagatggggatataaattttttttttccttttttcccttaaaattccgcttttttccgtcctta

SEQ ID NO: 513872 - DNA, 213 bp, Homo sapiens
  misc_feature (179)..(179): n is a, c, g, or t
  misc_feature (181)..(181): n is a, c, g, or t
  misc_feature (193)..(193): n is a, c, g, or t
  misc_feature (195)..(195): n is a, c, g, or t
  misc_feature (211)..(211): n is a, c, g, or t
ggggtccgtctgcttcttctctcagcattagatcagatgaggaagggaactgaactcttagacaggacgatgataaaatcactgctcccttacatgtctgctctccctcagtgtttcatctcaggcttcgggaactaaaatgtttgctgtgctttttaaaaagctggataaaaatgttntntaataaatgtcncncgttgaaactgatacnca

SEQ ID NO: 513873 - DNA, 225 bp, Homo sapiens
gaggatggggcaggtctctaggggaggctcgccttcacaggaagagagagtggtaccagtgagccttatagaagctcaaatataagaccttctcccttggaagatcggaaggccagaagagtctccatgcaaagccaagccaatcagactaacgcacttgggatcagccggggctgggacctttcagacgcagaacgatactggacactacgtaccacgcggaca

SEQ ID NO: 513874 - DNA, 481 bp, Homo sapiens
gctctggaagtggattaacacacgttcccaaaagtgttaatggttaaaccttccccttccatgcaaatatataggcaccttttctaagaggaagagccaatccaagaccaactgcgccttggttaggttgttaaaccccaggcccaggccaccaaaaaaccacttaaaactggtaaggattattttgcagcttttggaaaaaaattctgcaaggcttgccattaagaaaccttcttttcccaagaagggtaaaaacctggttgttccaagccaacctcctttaggttaataccttcccttttaaaagctttccaccttcccttaagattaaaaaaaaaaaattaaagtccaaaggttatttcttcggtttttttttttggtgggggaaaacccaccccccggtttaaaaaccataattttctttaaccatttgccctcttttctcgggcctccaattaataaaaaatggaaagaatctaaa

SEQ ID NO: 513875 - DNA, 461 bp, Homo sapiens
gaagcacaaaggaggggcccgagaccccacccaggccccgggatcagctgcccccccatcccctggtcccgccggtactccggggacgtgactcctcacctcctccgacccagagcggcccccttggtacccgcagtgatgacacaggcgacctggcccccggagggagcggaccaggccggctggtgacacaggcaaccccggcctctccgagacggactcctgccctgcgacagccagtccctgagacccggctggatcgcggcggccccggggggccccaggaggcaggggaaggaccagcatgttgggtccccagaccatgaccgtggggtccggagccagagccagcgaaggagcaggcatgtgcttgttgtgccgcagggatccgaagacgggacatgaactcatgggtgccaaggcggcagggggaagatgggggctcgggcaggagcaccccc

SEQ ID NO: 513876 - DNA, 245 bp, Homo sapiens
tgattcagtgcagatctcgtcaagacaaccaacggccgtgtgaacgcgagcattgccacgcgggctcctgtaggtggcgcagctggccggccaaccaggccagctgctcgacgtcgaggtggttaggtgggctcgtcaagaacaagtacgtcgtggtctccgcgcatgatttgaaaccagtgcagcccgccgtcgttccccacctggaaagatcggccatagcgcggtcgagagccaatgttggt

SEQ ID NO: 513877 - DNA, 906 bp, Homo sapiens
acaggcaagggagagacaggtggaaggtaattgaatcatgggggcagtttcccctgtgctgttcttgtgatagtgagttctcacgagatttgatggttttataagggattctttcccctttgctcggcacttcttcatgctgccttgcgaagaagctggcttgcttcctctttgtcttccgccatgattgtagatttcctgaggcctcccaagctgtgctgaactgtgagccaattaaacttctttcctttataagttacccagtcttgggcagttctttatagcagtatgaaaacagaaaaatacacctactatgtaaaacttaaaatacaaaaaaacaaaacattatctcactaacataggagctaatatttggtgtacttgtttagtattttatattaaaaatatgtacatatatatttatatataattaagaacatgtatgtacaatcgtgcatacatcatgtacatacatctacttaagaaaatagctatgtaatataccattactcaatagattataattttttctccatttctttattgtaatttatcattttctactttttgttttctcatttttattgcataatatttaattatgcaaaaatacttaatacttggaaatattggtgtgtattagataaggaagaggtcaacgagttataccattacgtactagatatgacatcttttctcatggaattcttaatatgaaatggtatcccttaacctgtaaattctcggtcccgtggactttcgaaattcttgggcgtggggcaagagtcatgttttttcgtctttcaaaaagtgggttctcggagggtttgagtatgatagagagaataatggggaggcgtaaagagttttccgttgtctgtgtgtaattattttaatatttgtatt

SEQ ID NO: 513878 - DNA, 592 bp, Homo sapiens
  misc_feature (336)..(336): n is a, c, g, or t
  misc_feature (490)..(490): n is a, c, g, or t
  misc_feature (500)..(500): n is a, c, g, or t
tcaagaggatcccttcagcacttagtggtaattactagccatcccaggaggcaagtaggaaataactagttcaggttttttaacaacgaactggattttataactccgggggacgatcctttcaagtcggggaattccaaaccaggtagggcttcggaagggaatcccctcgggcaagccttccacatacaagaactcggggttggattcaaacacaggatatggtacttttacggcctcggtgagtccaagagctggagcaaatttcaaattaaaaatctcttccactggcttccgtagctgggtaattctgacattccaatcttcttggacggnaaaacaaaaagaaacccaataaccaggtaatttatcagggcggtggcaaatcagaagggatttggctagaaagtactctggttggcagggatccttttgggtgggtttggtttaattttttggagacagagtctggctcggtcgcccaggctgnagcgcagggncgcgatctcggctcactgcaagcttcgcctcccgggttcacgccattctcctgcctcagcctcctgagtagctgggactacaggcacccgcc

SEQ ID NO: 513879 - DNA, 679 bp, Homo sapiens
gaaattttatttcatgacagcaccatcttttctttgcctgcgcctgggcctcctagtgtgctgcttacgtgaagcccacgtgccacagagttattgcccgaagctgccaaagggctgagcaggggataggctcttccttacaaaaggtctggagactctgggaccatgcaaacgcgatagcctttatttcttcttaacatgcaatatgaggatacaaaactgcattggagggcaaggactttaaatccacaaaagtgtaatgtgccatgctggagtggccacaggaagtatcgagaatctacattgactcgtgtctttggacacatctgggccgcgcctcccgtgtttacgaaaaggagctctggtttaccgtggagcacaccagaatcgtaaaactctgtgattgaaagaggaaaactttggcacagactattatcattcagccttttatgatgggcggcccgctgaaccaatacagggggaactgatataataagggggccttcccgaccacttttttggtttcaatagatgatgcttgtcagcagaacattttttgttggatgcctgggggtgtccccccttcattggagaacccccgattataagaaggacccccgttttttttttttttggccgcccctttctaaaatttgttggccaacaaaacaccctgtgt

SEQ ID NO: 513880 - DNA, 252 bp, Homo sapiens
gtggagcagtgggacgaggtactaaatgtacgtgcataatgaacgtttaaattatatgatgatgaaaggccattaagtatacgagctggggtgtggtcaggagacacacatggctttaccagctgcttagattttatagcagcatgatgcacacgatacagtatatataggaatgtcgccataatagattacaattgctcagctgggaccatgtctttttcgtttgaatgtctctggtacctgattttgcgc

SEQ ID NO: 513881 - DNA, 178 bp, Homo sapiens
caaagacccctttcatttttttatttttgtggtactgagggccccaatcccttagggatgtaattttataggataaaccttttggccagttttttttatagtttaataagtaaaaagggtccttccaattatgataattgcctatggacatggattaatttaaaccctgcccccggga

SEQ ID NO: 513882 - DNA, 1282 bp, Homo sapiens
cagagtgaaactccgtgtcaaaaaaaaaaaaaaaaattggttactcatcctctctgaaagcaaaaagggaaaccctaacagctctgaactcgggtttaattttcctggctgtattggggtgaacttggtatgattaggcattaatgtgtttaacaaaaaaatattttttttggggtaggaaagtgcaacctccaaccagttaaagcaggttacgaaaaaagcctagccttcttctcagaagaaccgggggaaggcagagtttactacttagagggaagtgaagtcctgagtggaaactcatgcctgtgtcaaagttgaggctctgaaagccggaattgcccaaattaaaagaagttattatttttattctaaattctataagtgtgggttaaccatttttaatgccagctttaaaagtgactgtggtaattattttcccctcttggtttaagtgtgtatcgtgtgggatatttttcccttggaagtgaaagtgattggggctcaagtgaggccctctttgccacactctcccagaaaaattacgttgttgacgggctgtgacttttaaaagaaaacttatgtggtggttctggggctccactttatatttctctctcttaaaaatttatctctctcattgggccctgtgggcaaaactcagcctcttctcctcggtgggatatatacctgtggtcccataagcacatttattgtctaccctgtgggggaaaatgtggtctaacaccaaatttgtttgacggggcagggagcccaagaaaaaaaaatgtgtaggctctacatatattcttaacagacacagcgtgcctatctggggtgcccatattggggggcttacccagttgttttttaaccctctcttctttaagggacaaaaaagcgtcgttggcatgtatgaggtgggcaacacacacaacagcaatctccggggcttactcaccacggctaacttcctgtggctaaacaaaacaccctagttcctttaactctgtggttcttcaccaaaaatctgccgcgttgggcgctctcataataaattccccccaattatttatttccgttagaacaaacctaaataataactggggggtggggtggggggcgcctcgaatatttttgttaaaagcacccccccgtggaaaggatagtctccaaacgacacggtctgtaggaacgaccactcttggagaattttgtggtagaagccaccccttcaaagtcccttttctttcacacaaatggtgggcgaaagcactctttaata

SEQ ID NO: 513883 - DNA, 183 bp, Homo sapiens
gaggatccgtcgattgtgtcgcactattctgattttacggtcaccatgaagttcatattcttatcctaccaggcttcggaatcatctcccatattgtaacttactactccggaaaaaaagaaccatttaggatcaaatcaggtcatggtctcgagcctcatgcatatccacattggccttcca

SEQ ID NO: 513884 - DNA, 155 bp, Homo sapiens
tgcacgcgtcaccatctctcacactcgctggcagtcatctgcctctgagcgggaggggccgcgtgctctgctccagctcagctgcaccctggactggtccttcctcctctcacaagtccgttgcttccgagtccactggtggcggctggagaggg

SEQ ID NO: 513885 - DNA, 287 bp, Homo sapiens
ctagaggatccccaacgatggtccttacagctactcggaggctgaggcaggagaatctcttgtacctggggaggcggaggttgcagtgagctgagatcgtgacactgcactccagcctgggcgacagagcgagactccatctcaaaaaaaaaacagaaacagaaacagaaaaaaaaaaaaacgggggggggcagagccaaacctcatttaaaaaaggcttgaagctccggctcgtgggggggtcacactaggaagacacggggccacaaaatcaatattacggctct

SEQ ID NO: 513886 - DNA, 867 bp, Homo sapiens
cgtccgtcgtgcagcagcggggctgctatcccggctgagggcccgccgagcagtgagagtggctggcttcgcattaagcgggggcctttcctgaggacggcgtacggagtgtggggaatgaaggatggcagcatgccgtgcattacaagctgtgtggtagatctcagtggcacgcttcacattgacagatgcagactggtgccaggctgcgcaggaagctcttacaaggttacgtggtgctcgctgtaatcattaggtttgtgagcaatacaaccaaggagagcaagcgagacctgttagaaaggttgagaaacttggaattcgatatctctgaagatgacatatgtcatcagtctcgtgactgcagtcagaagtttactagagcggaaacaagtcagacccatgctgctagtggatgatcgggcactagctgatttcgccggaatacaaacaagtgatcctaatgctgtggtcatgggattggcaccagaaccatttccattatcaaattctgaatcaagcattccggttactcctggatggagcacctctgatagcaatccacaaagccaggtattacacgaggaaagatggcttagccctggggcctggtaccatgtgtgactgcttaagagtatgccacagattccaaagccacagtcgtggggaaaccagagaagacgttcctccactggaagcattgcggggtcactggtgtgaacctgaggagtgctgtcatgatcggagatgattgccggatgatgtcggtggggctcaaagatggtcggcatggctgggcatctttacacacgagtggggaaatatcgagcatccaggaggacaaatcatccacctccctacttaatt

SEQ ID NO: 513887 - DNA, 776 bp, Homo sapiens
acccaagaagctggagaacagacagaaaaactgctgaagtcaagcctgtcattgccacaactctgcatgttagtgaagacagccaacaagtttggaggaacatggcctctgtctcacttccatcttctaactcttcaactggctcattgtgaagattaaatgaaagagtaaatgttaaaaagtgtgggacagttcctagcacatagctggagatcagcaaatgttcacatgttggagagtggtaatgaagtaagaggatacagaagcaccaagggacactggtggatcacttgaccgcatcgtggataaggagtcccacctcctgatgatcaggagcaatgaccctgccaggatagtggctcctttccttgcctgctggtctcttggcctgaggactctacagtggctatagtagaacccctgagtttcactggccacatgaccagccagcaatgactacatttcccagccttccttgcaaaagctgcttcaagaggcagtaaatgatgctgagcttgacctagtgtggtgcaaggattgcaggctgggctgagctcgtgttctgtatgatctgggaagaaatggttgttggactcatattgagactgtaagaggaatctttaagaggaaaaaaaatatatatgttaaatcttttggaaagaggcagggtaaagctttggggggatttcagcacctggaattataaataaagaagatgcggcccgcttcctttaaggaggggtaattcatgatccccgcttactgactcggtgcgt

SEQ ID NO: 513888 - DNA, 946 bp, Homo sapiens
cccaccagcagctgatattcccagcagcttgaggattgtgcaatgtccctgaagaggggctctgagcagagcatcacagtttttcaccatggtccaccttctgagttgctcagatccacttgccaccatgtttgggcatgcccttctccagcattctggtttgtctcatttcctgaggagcttacaagagaaatgttgctagaataaactacagctgttgttgctgtagttgatcttaaggctgaaatgattatgtatcatgcccctctttagctacccattccagtatctcctcactttcaagcagcatctctactggtctacatggcttgcctgaaggggtgacccagatcctcatccctgtggggtgtgagccctatttctcaggccatgactgcttttctttcccatttactactaaaacaggatacagaagcaccaagggacactggtggatcacttgaccgcatcgtggataaggagtcccacctcctgatgatcaggagcaatgaccctgccaggatagtggctcctttccttgcctgctggtctcttggcctgaggactctacagtggctatagtagaacccctgagtttcactggccacatgaccagccagcaatgactacatttcccagccttccttgcaaaagctgcttcaagaggcagtaaatgatgctgagcttgacctagtgtggtgcaaggattgcaggctgggctgagctcgtgttctgtatgatctgggaagaaatggttgttggactcatattgagactgtaagaggaatctttaagaggaaaaaaaatatatatgttaaatcttttggaaagaggcagggtaaagctttggggggatttcagcacctggaattataaataaagaagatgcggcccgcttcctttaaggaggggtaattcatgatccccgcttactgactcggtgcgt

SEQ ID NO: 513889 - DNA, 241 bp, Homo sapiens
actcaggcaccaggtgggggtgtcctaagaataacctgatgaaccagggagagggtgcaggagccacctgcgaagactgggctttgtatgtcgtgtaaaaatgctggttacctgctgaccacactctacttctgctctcagcatcctgcattaaagatcatgtgattctcgacatactacttgggtctcatgtgcggaagagctctgtgaagtgaaccagcgggatgactatgagttgtga

SEQ ID NO: 513890 - DNA, 214 bp, Homo sapiens
agggaggctgagcgcaaaatactgtagatccagagactctagacgcaagctaactatagtggatgaataggtcagagcctccctgtgactcacaggtagcagctgtccaaaaacaacaggaacctctatataataaaggtgtacacaaagtatatagcaggactctaatgaatgtaaaatacggagaccagtgagtgccagtacgcagtgaacc

SEQ ID NO: 513891 - DNA, 765 bp, Homo sapiens
acacatcagagctcgctcagctgctgcccagcctcggctgtgatgataggctggctgggcagcacgtctctcccctacagggctccctgagaccaccaggaagagcccccaaccaatcttgggattctcccttcgtgcggttgtctgggacctttttccaggtcaaagcagatcgtgatgaggaagctgagatgccctgtatccaagcccaatatgggacaccagcaccgagtccgggaccccgtgaccacctggctaagcgatcgccctgacctcctgtagattctatcaagctcctaccatggacctggtcagccccgaggcacgcccccgcgtggtcccactgcccgactttgggacggaagatgctggggatgtacaggcagttctatcgaaactgcatctccgtgttctctggagcgtcatccgcaaagtgggcggagaagatccctggctttgctgacgcttgtcgaccggctgacctaggaccatgttgctgtgagtcggccttcctggcagctcgttcatcctccgcctggcgtacgggtctctagccctggcgagggctagctcatcttctgctctgtgccgtggtgctactgcggttgcagtgttgcccgtggtttcggggactggattgacaggtatcctgggccttgctcatcggtccctgggcagtttgttgtgtcccatgtcccctggctttagctggcctcttctgcccttggtctcatccccgatcgggggtgggctgctggatccgca

SEQ ID NO: 513892 - DNA, 300 bp, Homo sapiens
ccatgtccctccataccactcccaaaaattttcaccagcctaacacttcaccactgtttgttttgttggacttattaatataaagaagacaggaatgtcaggcctctgagcccaagcctgcacctgtacatccagatggactgaggaaactgcagaaccacaaaagaagtgaaaatggccagttcctgacttaactgatgacattaccttgtgaaattccttctcctggacaatgagtctcagaagttccccactgagcaccttgtgacccccacccctgcccgcaagagaacaaccccc

SEQ ID NO: 513893 - DNA, 154 bp, Homo sapiens
tactggaactcctctctccttccacttatttcctcaacttgttgctttacactagacacagtgcaatgatatgttttaaacacatccaaaacagatcatgccagatgagttgcctgtcataggctggagatagctcttattgccctggctggat

SEQ ID NO: 513894 - DNA, 250 bp, Homo sapiens
  misc_feature (4)..(4): n is a, c, g, or t
  misc_feature (9)..(9): n is a, c, g, or t
  misc_feature (11)..(11): n is a, c, g, or t
  misc_feature (152)..(152): n is a, c, g, or t
  misc_feature (202)..(202): n is a, c, g, or t
tcgncttgnangagcagatccctaaccatgagcaccagccaaccaggggcctgccatgccagggagctgcaagcgccccgccattctctacgcacttctgagctccagcctcaaggtgtcccccgaccccgtagccgctgcctatgtaggcnaaccggcccgtccagctatgtgcacctcatcgcacctgccgggagctttnggatgttctggccaagacagtgggctttcctcagggaacctgccatcc

SEQ ID NO: 513895 - DNA, 205 bp, Homo sapiens
cccaggagggaccacagtcagcgtgaagcagttattttctacgctacctgtgcgccataaggaatttcaaaggaatattaagaagacgtgcctgcttccccttcgccttctgccgtgattgtcagtttcctgaggcctccccagccatgcttcctgtacagcctgcagaactgtgagtcaattaaacctcttttcttcataaatt

SEQ ID NO: 513896 - DNA, 137 bp, Homo sapiens
gagtataggcagacacgatgggtcgtcgcgcacgtagggtgcgatcggccgattatctagagtcacaaagcgcgggccgccccgtctggcgagagggctgaccgggtgttttgatctgataaatgcacgcatctccc

SEQ ID NO: 513897 - DNA, 1336 bp, Homo sapiens
  misc_feature (653)..(653): n is a, c, g, or t
tccccccggttagggtactggcggccgtaaaactttgtttcactgggcaggcggtgcctctaatactggtgatgctagaggtgatgttttgggtaaaccaggcggggtaacaattggccgagtccctttatactttttttaaaccctttccttatagagcatgcctgtgtggggttagacagtgagggtaataatgaccttgtcgggtcagatgtgtacaatattgggcgctggtaacaattggtcccagtccagtggtttcaaatctggcaccgcaggctttatcgctggagagaaaattggtttcccatgtgttcaacctttatcacctaaacctattaaagttctatctaataagcggtgatcaaattgggtcccaaattgggcattgtagaagagactgctatccaacgtcacactcaacctgcgtctcggagagacttctcctccacaaggctaaagcgagcggttagttcagacccccttttagaaccacgccatacttccttcaacaattggcgtggccgccacgtctcctaacaaaggcccctaaccatagtgcgcgttctgtaccaccactctgattatacaactacctcctctcatcaaaccaaaggggtaattaatcaccccaaagagttatgctcccacanagaagaccgccatgagtaaccccatcaccttcttggggcgaccatacaaccaaagtaccaccaatattttataaacaacagcggggcgcagattttcaacaaaacgcgcgcggtacacctgaggatagagcaccacaacaatattaacaacaagaacatgagtatcaacgaaaccctacacacacagaagatctaccaaatctccaatttgagggacaacacaaacaacacgcaaaacgaacatatatacacaacacacacccacagaaggaccacccaggaagcaaaaagacagtctcaagtagtcgaccagccacccatcaaataacccacagtaaacaacaacacaatttcattagtccgccccgacaaataaacattgtaagtggccacacaacaaattagacacaacaggacgcgtattgattaggacaccacatattctagatagcagcagttgattacacacataatacagagccatttcaccacgtcaccggacatcactgagcggtaaatcacacgaggcagaggagacggatctatccattacaacagccatgatctggcagggatctaccactcacctacgtttgcgactaacaaagagaacatacaacatataccaatcatcagatgatcaagaaacatccaccaagatctaaatagtcgtcagacagaaa

SEQ ID NO: 513898 - DNA, 229 bp, Homo sapiens
gctcgacgggttggccagtgcatatcgaatcctggcattgtcatgggtgttgctggtcagttgggtccacatcttgtcgacgacccggcccgacttcttcctgagcaaaggtaaacaactcgggtgtatcgagcagaagctggagcctgggcattggcgagataggccgatcggaagcaatgtcggctccatgcagtagcattggtcttgaagggcaaaagcagcggcg

SEQ ID NO: 513899 - DNA, 455 bp, Homo sapiens
tatcatgcagatgaaacatccaggtagcaagcttcagagagaatagactgtgaatgttaatgccagagaggtataatgaagcatgtcccacctcccactttccatcatggcctgaaccctggaggaagaggaagtccattcagatagttgtggggggccttcgaattttcattttcatttacgttcttccccttctggccaagatttgccagaggcaacatcaaaaaccagcaaattttaattttgtcccacagcgttgctagggtggcatggctccccatctcgggtccatcctatacttccatgggactccctatggctgaaggccttatgagtcaaaggacttatagccaattgattgttctaggccaggtaagaatggatatggacatgcatttattacctcttaaaattattattttaagtaaaagccaataaacaaaaacgaaaaggca

SEQ ID NO: 513900 - DNA, 465 bp, Homo sapiens
catgacttatggcaggatcatcatgtcgtcgactctcaccaactaagattaatgagacgtggcggagacttagccacacgcctgtatgagcacaagtatggtgcggcgccccgtgttcgcctcagtggtcatgtggctgcccggtgccccatcatcgctatgccactggactacatcctggcggatctgcgcacgaatgcaatgagagccacaatggacagtcacctagacgctccctacaatgtcccagatgtggtcatcacgcagtcgccgagcaatgatgtcgatctgatcatcaggatctccgagcgtgagtgtaggattcgctcatgaagatctggagcgggtctgtggactaccatttcactactgcgtgagggccagcacacaggacccccggctcagacccatctttgggcgtctggacatgcatagttggcgccccagtccgcgaccttgatgggg

SEQ ID NO: 513901 - DNA, 110 bp, Homo sapiens
ctagcgggaaggcgtggcttatggggcctgcagcacacagtgtaaagtgagcccacactagtgatagtgagtggcagacacacagtgatgtgttcttgtgtatacggtgg

SEQ ID NO: 513902 - DNA, 586 bp, Homo sapiens
ggaaaatttcgtctgttctagaaacatatgttttatttgcacagtcgtgatttgctattgagaatgcaatccatttaggcgatgggcgatagattactgtcgccgggaaattagtcacttttttgaaacctaaagtgactgccaatggcactcagtgtaatgacagggattggtaaatattgggaaaatactcatactcattgcgatgattataaacgcacttattaactcacggcattcttggatggtgtccaaagatgcaatcagagtttacatgatcaacatttatgggttatactagttgaagtatgtctctctccatctgtcattacaatgacacaggtatattgtagcatgagctcctgggccccaagttagtactgatgcagtaactttaggaaagatattctgggctaacgtgttagtgtcctatgaacccaataatctttccactagatttagaacatgcgtggactttacagcttgagcttttctaagagcatcaagttgctcacgtttcaagatttaatatacttggggacacaacatgcatttccgtacctacccttgggttctgctgttgtcg

SEQ ID NO: 513903 - DNA, 375 bp, Homo sapiens
agaggctgaggacagatgaatatggcacatgcccaggatagccaagtgaggctccaaatctttcccatgtaaacacagcctggagttgactggggatagccatgaatactatactttgggtggtgctagggcagggcctcacaccatagatactgaataccctgagccttagggacaggagaggtcacttaggatggcagtggatctccatctgatgagcacactgccaccttcattgccatcctaatattgatgcccagtccttcctacttaccttccacttgccactcagctgtgcaccagcgtgaagtgttccagaccaacctttgctgactaggaacctaaattagtgtaaggtacatggggaaagctctc

SEQ ID NO: 513904 - DNA, 567 bp, Homo sapiens
tagttgactctacaggatcttcacactggttcgagtactaccatatgttaaaacaaatatatacttttttaagacaggtctcactctgtcacacaggctgagtcaatggtgtgatctcgcccactgaactctgattccatgctcaaatgatcctcccaagtagctgggattacaggtatgcgctatgacatctggctactttttgtattttatgtagagacagggtttcactatgttgtccaggctggtctccaactcctggactcaagcaatctgcctgcatcagccttccaaagtgctcagattacaggcgtgacccatcgggcccagccaggattttgataaatacgatcaccatatatattattgtaagtgccagtgtctatcgatatctctcacaatttaaaatgattaagcattacgccaaggggtaaatacaatacacattttactttctacctgtttgaaatccagcactgcgtggttcaacggacagagtgagccgagagacagggctgaatcccttaatacctggaccccagtgagggagcttgtgtcacactgggc

SEQ ID NO: 513905 - DNA, 126 bp, Homo sapiens
gctataaggccactgactaggcagaggtagtatattagatgcgcacatgtgcccaaaggcattctagggcaaataggagctttcaaagggtacactaagggtctcagctctagtctctcacgacga

SEQ ID NO: 513906 - DNA, 129 bp, Homo sapiens
ccccgggaaaaaaaaatttggaaaaacctttttttttttcaaaattttttttggggggggggggggttttttttattaggccttttttggggtgtgggggggggaaaaaaaaccttggggcctttccca

SEQ ID NO: 513907 - DNA, 832 bp, Homo sapiens
  misc_feature (13)..(13): n is a, c, g, or t
  misc_feature (44)..(44): n is a, c, g, or t
  misc_feature (51)..(51): n is a, c, g, or t
  misc_feature (55)..(55): n is a, c, g, or t
  misc_feature (59)..(59): n is a, c, g, or t
  misc_feature (110)..(110): n is a, c, g, or t
  misc_feature (113)..(113): n is a, c, g, or t
  misc_feature (129)..(129): n is a, c, g, or t
  misc_feature (156)..(156): n is a, c, g, or t
  misc_feature (197)..(197): n is a, c, g, or t
  misc_feature (217)..(217): n is a, c, g, or t
  misc_feature (237)..(237): n is a, c, g, or t
  misc_feature (241)..(241): n is a, c, g, or t
  misc_feature (273)..(276): n is a, c, g, or t
  misc_feature (280)..(280): n is a, c, g, or t
  misc_feature (286)..(286): n is a, c, g, or t
  misc_feature (289)..(289): n is a, c, g, or t
  misc_feature (340)..(340): n is a, c, g, or t
  misc_feature (370)..(370): n is a, c, g, or t
  misc_feature (386)..(388): n is a, c, g, or t
  misc_feature (394)..(394): n is a, c, g, or t
  misc_feature (467)..(467): n is a, c, g, or t
  misc_feature (518)..(518): n is a, c, g, or t
  misc_feature (523)..(523): n is a, c, g, or t
  misc_feature (529)..(530): n is a, c, g, or t
  misc_feature (586)..(586): n is a, c, g, or t
  misc_feature (640)..(640): n is a, c, g, or t
  misc_feature (821)..(821): n is a, c, g, or t
taaaagcgaactnctgacacccttaaaacagaaaacattgttanttcacantaantaantgtggggctctgtctctgccgacaggggctgggttcgggattagctgtgcngtngacaattgccccattnatcccattcataaatgctgctgctacnggaagggaacagcggctctcccagagagggatccacctggnacacgagttacctccaaagngctgcgattgtttgagaatntgcnaagaggaaaaccactcaatgggacctggatannnnaggntcgggngtnatagctgggtgtggtacttcagggccctgggcaccctgttgatcacgagcntcccgtcatagctcagggtggcaaactgcnacgggttagctgaggnnnagttcncggcatagacgctgtcctcgtgctcctcgtaggtggcgatcacgttgtcctgcaggggctccttgctcttctnttcagaacggtggtcctcctggtcactgatgtcatcgtcgtctactaagtngtcgntggttnngttgagatggacaccatgttggaaaggatgattctgctgttactgttgttcgtgangttcagctggtcatgagagtggttgtagcggacgttccacacccagtgggagtnctcctccagggtcttcacgggttcggtgacatttcgggtgtcccagaacttcaccttacagtcgtctccgcagctggccaagtagtactgcttattgggattaaagtcaaggtcccgcaccagctgtccgtgggcattctctatgcagtagatctggctcatgctccgggtgtccagccangttgggggtgt

SEQ ID NO: 513908 - DNA, 375 bp, Homo sapiens
atgataaaatattttcttaaaatgtttaaaacaggccatgcgcagtggctcatgtttgtaatcccaacactttgggaggtcaaggcgggtggatcgcttgagcccaagtgtttgagaccttgtgatccacccaacttggcctcccaaaatgctaggattacaggtgtgagccaccacacccagctaattttgtatgtttatttttattttttgagatggagtcttgctctgtcgcccaggctggagtgcagtggcacgatctcggctcactgcaacctccatctcccaggttcaaacaattctcctgcctcagcctcccaaggtgttgggattgtagacgtgagccaccgtgcccggccagctatgggcgtcttt

SEQ ID NO: 513909 - DNA, 552 bp, Homo sapiens
  misc_feature (33)..(33): n is a, c, g, or t
  misc_feature (90)..(90): n is a, c, g, or t
  misc_feature (395)..(395): n is a, c, g, or t
  misc_feature (502)..(502): n is a, c, g, or t
  misc_feature (509)..(509): n is a, c, g, or t
gtgagtaaactcaaaaactgacactcgattcanctattggaaagtttttttaatgtggttggaacactgaggtatgtgaatctacttttncaactgtaaattttatgaaatctaaatactgatcaagtcccaggcatgggtggctcatgcctattatcccagcactttgggaggctgaggcaggaggattgcttgaggtgaggcgtctgagaccagcctggtcaacacagtgagaccccatctgtacaaaaaattaaaaaattagccagatgtggcctggcgcggtggcttacacctgtaatcccagcactttgggaggccgaggcaggtggatcacgaggtcaagagatcgagaccatcctggctaacacagtgaaccccgtctctactaagantacagagaattagctgggcgtggtggcagacacctgtggtcccagctacttgggaggctgaggcaggagaatgcatgaacccaagaggccgagcttgcagtgagttnaaatcgngccactgcacttcagcctgggcgacagagcaagactctgtttc

SEQ ID NO: 513910 - DNA, 155 bp, Homo sapiens
atgtctgcatgctattttgggagctggatggtgccccaggaacagggagaggagtccaagctgctctgtcctccaatgaggcccagcaccatgcccagtggctctgaactggtggagggcagagtaggagaggagagagaaagctagaagctatg

SEQ ID NO: 513911 - DNA, 159 bp, Homo sapiens
gtggtaacgccactgaactctagcggggtgacagagcaagaccctatctcaaaacaaacaaacaaacaaaaacaaattaattgcaatataaaatagtaaaataggtgtaaaagaagccaacagagttagagggtaaagagacagatcataggggagggg

SEQ ID NO: 513912 - DNA, 1054 bp, Homo sapiens
gtgtggtggcgcacgcccatagtcccagctactcaggaggctgaggcaggagaatcacttgaacccaggaggcggaggttgcagtgagccgagatggtcccattgcactccagcctgggcaacaagagcgaaattccatctaaaaaaaaaaagaaaaaaagaaagaaaatgcccaagtactaactaaatcccagatgctatgctaagtactttaagcagtccattcatttaatccaccctccgaggaagtcttataatcccctccgtcacgcgccccagtttaagagagccctcccacaatggccacaacggtggcctgggctgatatgctccccggttcccgggagttcaaatactcccgatcgaagtcgtcccggctttgcgttcaaatcacacgcataggcaatgaattagccgccacttcaggagctcccctaacggtctggggccttctgaactagcgggtggttaccgcctcagccgaagaaagcagctcggagcgacaagtgaagaagtcccccagtccctaagaatataaggaaaagagacaacatttattgaggaccccaagagtgcaaagtggcaacatttcacaacgcgacaagggttaatacccactagacccacttcatacaacacacaaatacatagtccctgcagacatccatatctgtacggcctaagcacgaaccacatgtcctagaactacaacagagctccattaagaaaagagaagagtgcagcaaacaaccatataccattagcaccaagctgacgataagcaccacccaaaaccacataacatagactcacagaataacaactccactacctccctaacaatatacacaagcacatgcctaatcagtaattacatattaacaagtatcatttccaatgtctaacagcacaatatctccgaattcacatgataagttaataacaacgaaccaatgaatatcactcataacaccacatcaacacacgccaacacccaggtgataccacagaataaacaattcacaccacaccagactcgtatcaaatctactcc

SEQ ID NO: 513913 - DNA, 593 bp, Homo sapiens
agcggaactggcaaatcaatgacttaagagtagctttctcccagcctccccgctggctctggagtatagagggaagccagccttttcctccccactgctcctctcttcatgcttcccctccactctcctcctgaaccctggcctggccactcctgcttttcacttctctccacgtcctcttcggaccccgccaccgacggaacatccatccactcactctatatggtgccaggacaccacatatccgcatgcgcgccggcggaagtaaacacagtagcagaagttgcaggcagatatctagggtcctgaccccaggcaaggaattccccctctgtcctgagcggcgagagcgaaatgcgagaggcggcaccaccgagtgaagtacaatccgtgagagtggaggcttaggtcgaaggaagcccgccaacgggaccacagtgggtcaggcgcctgtcattctactcaacaccggggtaaccgagaggagaaggcatcggcgggcactttgggggaagaccaaagaaatctctacctacgaaagccgaagcggtaagtgacaaaaagctagcacgaggccacagatgcataactgg

SEQ ID NO: 513914 - DNA, 815 bp, Homo sapiens
cgggtccttttgagggcccagggccgtaagctgggacagaggatgctgctgctacctcgcagtcggacaatgccacggagaagaacgcaggaccacagggggaatctcccagaggcccgaatcctacgaggagacacgtcaacggcagactgccaccgagactcctccgcgtcccacgacaactgccccagctggaggccacaaagcccgtagccagcagccaggcttcccccagatgaagaatgaggagaccgtgcgaactgacgggaaccagtgtccgcacagcatcacacgtctaagcggctacagcacttacgatgaccggcagctcggccagccagtcttacccagtcgcgacgtgaccagaccctcagggagtcagggcacgggaggcccgtatctcccatccggtggaacccgccccattggccaccccatgctgctgcagcctgggtctgcatgctcgtagcacaccagaggcatgaacaggaccacgtgctacagaaggtgcagagggtctggagcagaggaagggaccacagtcccctgcgcatgcccctgagcacattctaggagactgcgtcctgtcctatcgtgctcacacatcacccttcctgcccgatcggagctgcttctgctgcaatggggcatatggactgacccacctcctgggtgagaaccttgcccctagggctctgtgcagaagggctactgccccttaggcctcagctgggggaaaggcagttctggtgctgtagaggacctggtgcagaaagtgggactcttttttcctaagtacttcagcgcaggctgat

SEQ ID NO: 513915 - DNA, 320 bp, Homo sapiens
  misc_feature (216)..(216): n is a, c, g, or t
  misc_feature (261)..(261): n is a, c, g, or t
tcagaaggctggtagatggcagatgtgtgttggagagtctagagggatgaggtggtgggaaggtgagagacaagaagacagcgggataacccctgaaggatgtgatcatcgcagactgggcaagatcgaggtgaagaagccttttgccatcgccagggagtaggggacagggacatctttctttgagtgacggtctgtggcaggcctgtagtccgncacagggctctgagctgcactggcccgggtgctggcatctggtgnagcggaccactcgcctcacattccacagggccatggactcactttcgtaaaaaactcct

SEQ ID NO: 513916 - DNA, 908 bp, Homo sapiens
  misc_feature (30)..(30): n is a, c, g, or t
  misc_feature (62)..(62): n is a, c, g, or t
  misc_feature (92)..(92): n is a, c, g, or t
  misc_feature (102)..(102): n is a, c, g, or t
  misc_feature (114)..(114): n is a, c, g, or t
  misc_feature (134)..(134): n is a, c, g, or t
  misc_feature (138)..(138): n is a, c, g, or t
  misc_feature (159)..(159): n is a, c, g, or t
  misc_feature (162)..(162): n is a, c, g, or t
  misc_feature (177)..(177): n is a, c, g, or t
  misc_feature (190)..(190): n is a, c, g, or t
  misc_feature (193)..(193): n is a, c, g, or t
  misc_feature (202)..(202): n is a, c, g, or t
  misc_feature (207)..(207): n is a, c, g, or t
  misc_feature (222)..(223): n is a, c, g, or t
  misc_feature (254)..(254): n is a, c, g, or t
  misc_feature (268)..(269): n is a, c, g, or t
  misc_feature (271)..(271): n is a, c, g, or t
  misc_feature (278)..(278): n is a, c, g, or t
  misc_feature (280)..(280): n is a, c, g, or t
  misc_feature (289)..(289): n is a, c, g, or t
  misc_feature (294)..(294): n is a, c, g, or t
  misc_feature (297)..(298): n is a, c, g, or t
  misc_feature (311)..(311): n is a, c, g, or t
  misc_feature (318)..(318): n is a, c, g, or t
  misc_feature (320)..(320): n is a, c, g, or t
  misc_feature (322)..(322): n is a, c, g, or t
  misc_feature (326)..(326): n is a, c, g, or t
  misc_feature (328)..(328): n is a, c, g, or t
  misc_feature (330)..(332): n is a, c, g, or t
  misc_feature (357)..(357): n is a, c, g, or t
  misc_feature (372)..(373): n is a, c, g, or t
  misc_feature (387)..(387): n is a, c, g, or t
  misc_feature (390)..(390): n is a, c, g, or t
  misc_feature (405)..(405): n is a, c, g, or t
  misc_feature (414)..(414): n is a, c, g, or t
  misc_feature (431)..(431): n is a, c, g, or t
  misc_feature (443)..(443): n is a, c, g, or t
  misc_feature (530)..(530): n is a, c, g, or t
  misc_feature (558)..(558): n is a, c, g, or t
  misc_feature (891)..(891): n is a, c, g, or t
ttcacagattcataattgtattaaggggtncaatatctacatttagaaaacaaagtattgtnctcaatcactgaaatgcttaaatgcttgantcttcaaggnatcttctcggcngtaaagacttgagaagcttntctnctggcttgtttctcctctagnganagagcaccctctacngccaatatctggnatngcttatgtnttaantttcccatagatttnngagggggcttgggactgcgagcctctatgtnttgctttaataatnncngcgttgngnggggggggnatccnggnncaagtattagtgngcataangngngggntngnnnctcttcaattccaataacagtgcgnctgggaccttgaggnngaagatagataggnggnttagatgtacacacnacctttggnctcccttctccctctgnagaataatagtncaatatccattcaaataagcgagggtgtgtacccaaaggaccagttgatttgtgaaaatcaacaatatgacactttacccttagggnggtcaggagtatatatacttcacatgcnccaatccaggcctttgttccctgtaacctgttattaagttgagaggccccctgaggatcaaaaccttccttccatgcatcttcaatcatagattgaatttttggaatgcaaggaatcaacataccttttaagcaatcgttgtaagcatcattttgtaataatgatgaaagtagcatttggaaatttctgtaaccacaaccccaacctttgtcgcctaaagatgaatgaaagtgatccaccactgaagaaagccacacccgtctcacatctgtggcagcattctgataatacctatgaagtgcttcaataattccggaagtttttgtttttccncgtcaaaacaagagcta

SEQ ID NO: 513917 - DNA, 176 bp, Homo sapiens
tcttttcataaactttactcttttgtagaatttgcgtaaggcaggatacagtagccttggcccaggtatagtatggttttttctttgttcaagtgtaccaaccaaccaattctagccacacgaatagttaggaaaaattgccaaagtgggaattgttaacctctatcaataggaga

SEQ ID NO: 513918 - DNA, 169 bp, Homo sapiens
ggaattcatcaggtgatgttaaaagtcactggccggctgttgagaatcacgcctgtaatcctagcatttgggaggccgaggcgggcagatcacttgaggtcaggagttccagaccaacctggccaacatggtgaaaccccatctttactacaaatgcaaaaattagctg

SEQ ID NO: 513919 - DNA, 330 bp, Homo sapiens
ctctctgtcattccaatctgatcatttagcttcctcctcctagtccagtactcccatgcaacagcgccacttggcagactctcttctatccgttctttctttatttaattttagtttaatttaatttaatattttgtaaagatgagttttcactttgttgctcagtctggtctccaactcctggctccaagtgattctcctgtctcagactcccagagtgctgggattataggtgtgaggcaccacacccagtctctcccttctttttctattaacaataacattatattgaatttaattaggaacatatgaatatatatatttttttgg

SEQ ID NO: 513920 - DNA, 713 bp, Homo sapiens
catcccttgcctaaaatagaagtatctgagtctgtagaatatgaggcaggacatataccatcaccagtgattccccaagagagttctgttgagatcgataagtgaaacagaacaaaagtctgagagctttagttctatagagaaaccgatctattacctatgaagacaaagtaaagttaatgaggttcaatggcataatgattatcacaacagaagcatgtgaactccgatgcaacattttcaacaatagcgtgtcgtgaatacaatagtgcgcacgcaataatatacagacactgtacccgacaatgaagatggggaagccaaaatgaagtatacgctgacacagcaaagcaaactttgatttctgttgtggattcttcttcattaccgtgaagtcaaagaagaagaacacgtctccagaagatgcccttttgagaagggttacagaggacagctacagattgttatgctgcacattgcaacaattctacagcatctaggatatgctaatggaaatcttgtacatggatcaaagcaaaaggagtcagtgatctatgagacttaataatcgtattaaagccttagaagttaacatgtctctcagtggtcgctatctggaggagcttagccaagaggtaccgaaaacaaatggaagaacatgcaaaggcctttcaataaaacaatcgtgacacttcagaatacttcaagcaata

SEQ ID NO: 513921 - DNA, 916 bp, Homo sapiens
ccggctacagcgggtggggctcccccctctcttattactttctggtcgtcctcctttgcggggagtacacgaatgtagtgtgggtgggtctctctccgccccgccccctcctttgggggctagctcgtcgcccgcctcttgttttcgctcggcagaagtagtttgtgctcccctcctactttatgttgtgttccacaactcccactcctctctgtgtgtgttggtcggtgtgatgttctcgctctctctacaagatagagagatagagagatgaagtcagttctttctctcggcggggagagtattttttattcttttggggtgcgctgctcttgtttttgagagtgaaccttcccccccccccccgtgggggttaaagattcttcttgtcggttgatctctgtcgttggtcgcttggttggttattattcccccgcgcgcggggcggcacgccctccctcttccatcttctgttcgttgtcgtgcgtgccgagttgattatatttgcgtggcgatgacgtcgtcctcacccccccgcggcggcggtcttctcacctcgccccgtctttcgtcgtggaaactagtgggtcggcgcacgcccccctgcgctgcgtgaggctcccctctctcttctgcttgttctttctgttgagggcgggtggaggtatttctctccgcctccgtctatatcacctgcgccaccgcgcggcgggttgttcacaattgagttttccttcccctcccccgggcagctagtatttttctcttcctgcccccccgtggtcgtttgcgcgctctcgtccgttcccaattttttcccccaaagggcccccccctttttttttttgtggggggggccctctcttcttctctgtgtgtgtgtgtgcccccccaaatcgggggcccccccgttgta

SEQ ID NO: 513922 - DNA, 846 bp, Homo sapiens
ggggacaaccgtgctgggtgtcccaggctgaggaggaggtactccgtgacaccttccctttcggccttgaggttcccagcctggtgtccccaggacgtccggtcgcatggagagtgtacggacgacgcctatgaagcccttagtccttctagtttgcgcttagcatatggaccttcgtctgtgccggctttatccgagcataactgtgacacctgatgacagagcaaaacttgaatcattatatacaagtttagagaacctagtacgaagtgtccctcgtgggagagcccaggtcgtgagaaaaaaatctaactctacaaaaacatgtttatcatatagcatcaaatgggatcaaaatttacggagctaggttacacatggagaggcttaccaatgagaaatgcatgtttaagcaaatcctatcagtgaagaaactagaattttccctacaggaggtacacacaccggaaatagggaaagaaaaacacaagggaaagtacccatgctggtcgatcaaacaaaaaatggttccattgtttgatgcagagaacttattgaaatgaagagcagagcaagagcgggagaatgtgcaaaaagagtggggaccaagaatgttgccagtggttactgcatcattacaagtccattgtgtacctcatacaagtcacgtgtaacattagatacgaggagggggtgggatcctaagacagagattctagataagtgacggggtaaaccggagagtggagtccaggtggaagggcttgaaattagattatcagggagatttggcgcgcccttaaaatggttaaaaagagtgtagggagaaatgttgtgggaatgtgt

SEQ ID NO: 513923 - DNA, 240 bp, Homo sapiens
gctggtgatctctacaggatcccccagcaagaatggcattcagtagccattttaacggaatcagaacactttgggtacatgctgctatcagcccgtcagctcgtcttccttgttttttgtcaacattggctttccagataaagtaccaatgtcctctatttttgtccgtggaagaacttttgaatactttcaacgtgcttatttttattatcacctgctcgtaccctattgtactaattt

SEQ ID NO: 513924 - DNA, 142 bp, Homo sapiens
actttgagtatgggaaggcatcaacacacttgggcaccaatatacggtggaggtcaaggagatcatagacgagaaaatctacaaaagtgatcttgtctgctgccaaaccatggccgcttaaactcgccccgcttaaactaca

SEQ ID NO: 513925 - DNA, 401 bp, Homo sapiens
tcgacggtaccaacaaataatagctgacaagttgatagccagaaaacggcaaagctgggatgcaaacccaagcagtctgactcccaagcctcttaacattcttaagagaacaactaacttcaatcctccttcgaacacatgtttttcctgtttgccacctgaatacgtggaaccaccatccacccagctggttaaaccagaatcactcagaaatctacctctccttcatattattcataactgccagtgttaaaattctaattgctggccaggcacggtggctcatgccagtaatcctagaactttgggaggccgcggcaggtggatcacgaggtcaggagatcgagaccatcctggctaacatggtgaaaccctgtctctactaaaaatacaaaaaaaat

SEQ ID NO: 513926 - DNA, 252 bp, Homo sapiens
tttatattttgccattctgggtagaagttatgttagttattatattacatgtagtaatctaaggtaataattccctttaggtgttatgggcataaagaaaacatggaaatgggagtgcagtggcagacaggggccttttcctttctggtatccaattgccctttgcataacgaagttagataatactgataggcaaatctgatattagatcctgcattaagacaggcagcttagattagccataaaaaaacg

SEQ ID NO: 513927 - DNA, 776 bp, Homo sapiens
gggaaccaaaacggccatggcagcagcggaggaggaggacgggggccccgaaggggccaaatcgcgaagcggggcggggcagggcgcgaccttcgaatgtaactatatgttgggagaatgcttcgggaagcatgtggtcagtgtgtgtggcgcaccaagatacacttgtatggaccatggtcatttcatccagattggatgggaggaccacgggccacgacccggggccacgaagtgtccacagtattgtacaacgctggagaatcagcacgaggacgaacggtaggtcccagacatattatgcggcgaagggagaaggcccaggaagaccccaaagggaatccacagcaattaaaaaacgtccaaacacacggacccaacagggtaccaaggaggagcacactaccggagcagcaaagagagagaactaccacggcacattacggacgaataccggtggtgcaatacacagcgttcctacactagagaagatagcgaagcatatacaccaccttatgcacattatacacaaccaaccgggcatataaaaggtgacacaattgaaagccacattgacccggacagggggtaccagatagtgatgcgcatcctggaacaacaaggggtcaacacaaagagcatcccatggctgggccacgggaatgcacactccttacacatgtaaactgtcgccaaagaaatactcgcataacgaaagaggcacgtgcctcaagacataatgacgctaatagtctcgaacccatgccaatcttaca

SEQ ID NO: 513928 - DNA, 739 bp, Homo sapiens
tgggccgagccgccgtcgcccgcgtgcaccgtgtccccaaggcccagacagcggggcgggggtctatcaggcgcgggactggcttctctcaggccgacccttctagccgggctccggatcttcctcggcctcgggcccccttcacgttcaggacggaggccggagaacggtgatcatcacacaccccagccggcttcctggccagggcattttctctgcggccaagcagtgttgggattgtagctgctgggagccccctcctggcgcgacttttctggcagggagggactggcggcggcttccactcttttctatactctgcatctccacactctcttcccattcaagaacgagtttctcttccctctccattggaaatcctgctccggaggtccaaaacacgtattttaagcgtgcccttcctcacctcctggagcacccttagaagtattgcctacttatccgggctgagaatccttcatttttgacctggcttttttttcgccctttgggagatacaaggtccctctccaccctctactaacactctgcacccaaggtcttatcctttggggtcaccagctcctttgggcccaattttttcccttaaattggtttgaaattctccccccaaaccatctgagttccagttccctctgggctcccaatctccagtccctggcggatctggtcagtccaccctaggtggggagtgaccagggctctggcccaggatccg

SEQ ID NO: 513929 - DNA, 190 bp, Homo sapiens
aactcattgaattcttttcccgagaggctggacaatgtttaaaggacaaactttgccaggtaaggcgaaccagatcttttgttgaccatgcccctgccacatatcggatgttggagctatgacccactgagccaggcccacactggctttatggtatcaccccaggaggggaaaatggtggccaatcctt

SEQ ID NO: 513930 - DNA, 155 bp, Homo sapiens
gggggggggccccccccctttttggggggaaaaaaattctttttgggggtttttttaaaaattatggcccccttcccccgggggggggtttttttggggggcccccccccctttttttttttttttttttttttttggggggtttttttttttta

SEQ ID NO: 513931 - DNA, 126 bp, Homo sapiens
tcttggtgcatagctgtctccagagtataccaccgggtgggacgtacggaatgttatagaaaaaatagagctactgatagttacatctgacatatttatataggacataaattagggaggtgcact

SEQ ID NO: 513932 - DNA, 1339 bp, Homo sapiens
ataaaccgaaacttctctgccttcccgctgcaagagtgaatgagcgatccctctcaactgactcaaaatgtttgcctcacccaggagggctccctatgcctctccttttttcctttcatctgcattattcccgttgccaaaatctggagcctggtaaaggcccagtagcggtggcaacaatagagctgtgtgtcaccccagtgagctgaaagagcagacatcaagctctatgccagagaacagtggggcatccccaaggtcctgctggaaggcagctctgatctggaactgggaaggacaacacacagtcaagctctttctcgtctcagagaatccagcagaatcttcagggatccttccagaccaggaagactctcacactctgcagagaagttgcggcttgtttagcatttgacctacattcagaaacgaccagcctcccaactttcagctctaaggattacttaaaaaaacaaatggtgttcattctcagatatcttgcctttctcaggagagaaaaatgaagcttgcaattagccagcaaactagcacatacacaaacacacacacacgtacatacactccaacacagggagcaatgtggtatgttgttgaccagctggaagttaggatctcaaaggaaagaacaggataacttaagaggcacttctgggactgcagagctgagctggtggttctgaagagccatcggagtgtgggttcaggcagcttccctaattcagaagcagccccaagtgaatagatgacaaagaagtggatgtgaacatgacagaaaaagccagtcatggcttagaataaattttattattgttctttaaaaaaaaaaaaaaaaaaaaaaaaaaaaaaaaaaaaaaaaaaaaaaaaaaaaaaaaaaaaaaaaaaaagggggggggccggcccaaaaaaacccccgagaggggggcccaaattatcacagaaccaccaataattgcactaaacacagggggcccacaaaaggagggagcactataaacaacacaaaagaaacggggcagcatattaaaacaaacgcacaagagagagagaaaaacgagggccacaggtcaggacaacctgctgtgagagaaacaaccacacacgcggggggagcaaacaaacaaaagagaagcacaacaaacagcccccccacacaagagattgacaaccccctcgcagggacgaaacacaacaccccgcgcgaggcgactaacagggggcgaaaacaccagcacgcgacaaaataacagccgccgccacgaagaaaaatcgcagcccccatacaggagccatagatgacacacaacacacattacagcga

SEQ ID NO: 513933 - DNA, 952 bp, Homo sapiens
gaccgcgtccgccccgcgatgcacagagcctcgcctttgccgatctgccgcccgtccacacccgccgccagctcaccatgaaatgatgatatcgccgcgctcgtcgtcgcacaagcggctccgtgcgagtgctgcaaggccggcttcgtcggtgcgacgtatgctcccccagggccgatcttcccctcccatctgtggggctgctcccaggcacgcaagggcgtgatggtgggcttgggtccgacaggattcctatgtgggctacgaggcctagagcaaggagaggcatcctcaccctgaaggtaccccactctgacgtcacggcatctgtcgaccaacctggtgtaccgacagtggcacgaaagatctggactaccacatgcttctacatattgagcatgcgtgtggttcccgaggtgagcaccccgatgtcgtgctgaccgaggtcgccccatgaacgcccaaggtccaagccgtggagaagatgaactcatgatcatgtttgagaccttcaacaccctcagcctatgtacgttgctatccaggctgtgctatcccttgtacgcctctggcccgttaccactggctatcgtgatggaactccgtttgaacggggatcacccgcactgttgccctgtcttacgaggggttatgcccttgccccatgtccatgcctgcgtctggaccttggcgtggcccgggacccttgacttgatgtaccctcgtgaccggatcctcgaccgatgcgcgtggctacctgcttcgagcaccctatggccgatgccgggaaaaattcgttgcagttaccattaaacggtagaaagcttgtgcctaacgttcgaaccccttgttactttcgtaggcaacgacgatgtggccacggcttgctttccaggtccttcccttggagcacagaccttaggaagctagccttaagggcaaggtgatcacc

SEQ ID NO: 513934 - DNA, 143 bp, Homo sapiens
ataaaccgaaacttctctgccttcccgctgcaagagtgaatgagcgatccctctcaactgactcaaaatgtttgcctcacccaggagatggagctctcgaaggccttctttggccagaggaaccaaccttccgcctttaatta

SEQ ID NO: 513935 - DNA, 453 bp, Homo sapiens
  misc_feature (337)..(337): n is a, c, g, or t
  misc_feature (352)..(352): n is a, c, g, or t
  misc_feature (378)..(378): n is a, c, g, or t
tgcttgagttttgcacttggaagaaccctgcaccggttggcgtgtgcgacggcccagtcccatccagagcatggagcccgaccccagccagcgccttccactccatcatttcatttcacacccccgaagggaggggaggccaggaggggagctgctcctgccagaagctggtgggtgaccgttgggaatcggccacacctggtgtccatgggcagcctggtgcaattccattcatttgtacagaaacatttttgaaaaattcttttcaataagatgcaaaatcttccaacttttcaacccaagtgaagaaaaattgaatttgtttcaaaattcccgnaaacgggtaagttcnaaaagtttatatccagaaaaaaagtnaaacagtgctgttagtaatttcttgtggatttcattgttttgccttcaaataaagcaaattttaaaaaaaaaaaa

SEQ ID NO: 513936 - DNA, 209 bp, Homo sapiens
gagcgcgatgctgtgtttgcactccattcagagaattacatgggacacactcttttgtcgattcagcaaatagtaaaatttattattgcattcattatataagttttattagataatgaaaaaagaagaaaatgctccagtgtgatttataactctacacatggagtcgccctctgtcgtcgtgggatccctctatgagtcgcacctgc

SEQ ID NO: 513937 - DNA, 559 bp, Homo sapiens
  misc_feature (5)..(5): n is a, c, g, or t
  misc_feature (10)..(11): n is a, c, g, or t
  misc_feature (16)..(17): n is a, c, g, or t
  misc_feature (19)..(19): n is a, c, g, or t
  misc_feature (22)..(23): n is a, c, g, or t
  misc_feature (28)..(28): n is a, c, g, or t
  misc_feature (33)..(33): n is a, c, g, or t
  misc_feature (54)..(54): n is a, c, g, or t
  misc_feature (58)..(59): n is a, c, g, or t
  misc_feature (61)..(61): n is a, c, g, or t
  misc_feature (82)..(82): n is a, c, g, or t
  misc_feature (145)..(145): n is a, c, g, or t
  misc_feature (156)..(156): n is a, c, g, or t
  misc_feature (162)..(162): n is a, c, g, or t
  misc_feature (209)..(209): n is a, c, g, or t
  misc_feature (225)..(225): n is a, c, g, or t
gtacnacagnnggctnncntgnnatgangtcangaggcatgtggcacaagtgtngtcnnangggtacctcctgattcccaanttctctcaatgaacaatatgctgctactgactggacgtacctggaagggagctattcttgttngctttaaaagnggggancgcaaaccaaaacttgtggctgattttatggctaagaagttttcatnggatgcattaataacncatgttttaccttttgaaaaaataaatgaaggatttgacctgcttcactcttttttttgtatccgtaccattctgatgttttgagacaatacagagggggccccttgtggcagtcttcagcctcctctacaaaaaaagttctggagcaacagctgggaaatatcattaattctgctcatcacagattttatcaataaattacattggggggctttccaaagaaatggaaattgatgtaaaattatttttcaagcaaatgtttaaaatccaaatgagaactaaataaagtgttgaacatcagctggggaattgaagccaataaaccttccttctt

SEQ ID NO: 513938 - DNA, 1002 bp, Homo sapiens
atcctcccatggatttgttagtttcgttctttaaaggatttgagggatattcactaacatagtcagttaaaagtaatttgtaaacatcagacctgtgtctagatgtagtgggatacgcctataatcccagcactagggaggctgaggtaggaggaccttgagttgtagaccagtctgggcttacacagtaagaccctaactcaaataaaacaacctaaaagaagaatgagaaatctattaattggcccatatttgggacaaaggaaaaagaagtcactggtcaacctggggtgctgggcctcttttcctacagtgaccaggaaccaggtccagacttgtagatgatcagttgcagtctggtagcacacccctcctgcatgtagctctgtggccctttccctcacatcctaacgagctagatcctgaactgggacttgtggtgctgtcaggatgagaacatggaagttttgaacctagtgtcttttggaattcgtaaagctaaataaatgatgttgaacttgaaaccctccatatgtagatcagtttcaaagtgataatagtgattgccacggcagtaagtaccctgacctgtccctgtgcagactcccttgcagggttttactatgttgatctaaggtctccttgaattcatttgtcctaagctaaagaactggtgagtctcacagatcagtctggactgttcttgtcccaaatattactatttaagttgaagaaagacacaattcccctaatcctatactggcaggaagtaaaaatggtgctggctgggtgcccaaatgcgggattgggttgaaccatccgtgaagagaacctttggctaagaaaattggggaacctgcggaccgttaccagcagtgagatggtacatgccaaagataccgtactaagagtaagaacaacagatgggagtactcaccatagtaacaccggaacggtggtaatacaacaaacggcgtacacactaaaaacatcttttcgacg

SEQ ID NO: 513939 - DNA, 176 bp, Homo sapiens
gagctcatcacgagcgtatccgctggtctgaggctcgaatagaaattctctgtctggatctgctccatctgcatctccacgttcttcatgaacagcatcttcgggaatagctgtcgtctggacaccaggtgcatgaggtaacatgcgcacatgttcaaacaaaggctgtgttatct

SEQ ID NO: 513940 - DNA, 757 bp, Homo sapiens
cgtggtggcaggcgcctgtagtcccaactacttgggaggctgaggcaggagaatggtgtgaacctgggaggcagagcttgcagtgagccgagactacaccactgcactccagcctgggcaacagagtgagactctgtctccaaaaaaaaaaagaaacacaataatggaacatagaggcaggacagggattattttggaagaatgtatcaacagaaatcggacatttaaataacaaaagcccctccaggctaaatagttccttggtactcatttggttatagcccaaatgaacaatattttaaaggctttatgaaaattaccataaatttactttctctataacttctctggcatggttctaaacatgtccataatggctataattaagcttaatttcactactgaccgcactttaaaaaattaattactgccattgcatttcggctggacatttttaaaacacccacaaattaaattaaccttaaaagtgctgttatagagaacatggctcctacattactattagtggaaggattcaagcaacaagtctaagtgtgaatagcatcctcaaatggaaaaagcttcaaaagtaaccgaattgatatgatttaagaaatagagatggggtccgtgccatgttgcccagggtggactcgaaatctggggttcaagtgaattctccacttgggctcccaatgtgtggaattacaggcttgaacaggcacaaactgacaaaaaagcaattaaggcctaatga

SEQ ID NO: 513941 - DNA, 424 bp, Homo sapiens
  misc_feature (6)..(6): n is a, c, g, or t
  misc_feature (65)..(65): n is a, c, g, or t
  misc_feature (94)..(94): n is a, c, g, or t
  misc_feature (103)..(103): n is a, c, g, or t
  misc_feature (108)..(108): n is a, c, g, or t
  misc_feature (114)..(114): n is a, c, g, or t
ccaagnaattaaacaacgtattcctaaaccaaccattgggtcaatggaaggaaatttaagatggnaatccaaaaaatgccttttaaaaccgtgnccaatgggnaaatnaccatncccaaaaccctgtgggattacagcaaaggcagtgcttaagagaaaattatatagcaataaatgcctacatcaaaaaaaaagaaagatttcaaataataacctaatgatgcaccttaaggaactggaaaagcaagaacacaccaagcacaaaattagcagaaggaaattagatcatttaaataataaagatcagagaagaactaaatgaaatacagacttaaatataaagaatcaatgaatagctcgttctttaaaaaggaacaaaattgaaaaaccactcactagactaaccaagagaagagaaaatcca

SEQ ID NO: 513942 - DNA, 1058 bp, Homo sapiens
cgtccggaggaggggaagcgggcagaagccgcggagtagagagtgagggagacatggcgtgggggccaggtttcctccatgtagactagggggtgcatgacagcagggggggttcctggcctgcgagtgtggggatccatgtgtgtccctcggcagcccacatacagtcatgccccatctcatggatcccagatgatgatctgcattatcgtaaccccatactgcaggcattcatcatgatgaccacatcagtcacacacatccccatgatcacatatggaggacccacatgaacatgatggaacatcccacttcactgcactccgtgactcatgaggaccctcgtcatcccacaggttggacggcaccatgggagacggacaatgacctggacatcaggcacgtagaagggactatacacttcactggtccttcacaaccgcatgcaagacaacgtcttgcaacatgaccgaaccaagcaaggcagcaggagatccgtgaacggccccgatgactccacacagcatctcaacggcagtctcaatgccgcacgggatgctccagtagcatgggtcatgttcacccacagaacccatatgggcatcaccatgaagtccatatcacgtgccgatcaggacccatcaccatgagccagatcccaccagtatctggcacgtggcagagactgagagcatatccctacttatgccaaagggagcgacaaggagataacatgggctgacccatccagcacgggagaaacacgtcacaaccacatgggggcccttcgatgtctgggatggaacatgcaccgaacacacagcaagctcccctacatgactcctggtcaccgaatcaccgacacagggccaaccacggaaggcacggggaagggactgaacggcacacggttggacaaagataaagccaccataactcggtgcacccggcaggcataacccaatgccacagctaacggtaggtcagggacccaaaacaaccacccaaaacaacaccaggacacaaagagaaaacacaccgggccacaccacaggcaa

SEQ ID NO: 513943 - DNA, 122 bp, Homo sapiens
cctggcccatgcacttggaaacaagaacactttttacatggattaagaaaaccaagactttttggttagatgcacgtttgtttgtttgtttgttttgttttgttttgttttgagatggagtt

SEQ ID NO: 513944 - DNA, 691 bp, Homo sapiens
ccgtgggttgacagaaaaagccctactgattatacccccacccgagaatgtcttctcccttttcccttggggcttacacacttttatggggtttgtggggctgaagaaataccgcggtccaacagggccgaaaaagttcttccccgtttttttttccaagcccccttagccgggtttattattttttggggtttgggcccaataagcccccctttcccaagctcttaaaaccgatggggatgctcccatggaacgtggggggttaagcgcctttcttgccctaggatttcctttccgggcccaaggcccttttaaaggtaaccctttttaaggattccccgggctttagaggaattttttttccccggcgcccttttccgggccaaaaggcggctttcgccatatttgtgaaataggaattaaaaggaaccccccgtttgtttttttggccctgttttttgggccccccttgggccttgaggcccccagcttttcttttttgggccccgggtccttggggttttttaaaaaaaaaaaaaccccctttccttgtaagccctttttcggggggggggggggggggggtttttttggttttccattccccaaaatttccccaacccattttttccggggtgtttggcccaaacccttgcttttaccatgttccccttttcccctgtttttccta

SEQ ID NO: 513945 - DNA, 1672 bp, Homo sapiens
cctttcaggccttgcgaggtagaaggctgtcctgcgcctgcgcctgcgcccgcgcctgcgcctgcgcctgccatcattcctgttcctaaagctctgcacccagaacctaaacgagtaggtaggacccacctctgcgatgcatcggctgcaggtagtgctgggccacctggctggccggcccgagtcgagctccgcgctgcaagctgcgccctgctccgctaggttcccgcaggcctcggcctccgacgtggtggtggtgcacggacggcgcacccccatcggccgcgccagccgtggaggcttcaagaacaccacccccgacgagcttctgtcggccgtgttgaccgcggttctccaggacgtgaggctaaagcctgagcagctgggagacatctccgtgggcaatgttcttgagccaggagccggggctgtcatggcacgcatcgcccaatttctgagcggcatcccagagactgtacctttgtctacggtcaacagacagtgttcatcgggactgcaggcagtggccaacattgctggtggcatcagaaatgggtcttatgacattggcatggcctgtggggtggagtccatgtccctgtctgggatggggaaccctgggaatatctcttcccgcctgctggagagtgagaaagccagagactgcctgactcctatggggatgacctcggagaatgtggctgagcggtttggcatttcacggcagaagcaggatgactttgcgctggcctcccagcagaaggcagcaagcgcccagagcagaggatgcttccgtgctgagattgtgcctgtgacaaccactgtcctggatgacaagggtgacaagaaaaccatcaccgtgtctcaggatgagggtgtccgtcccagcaccaccatgcagggcctggccaagctgaagcctgccttcaaggatggaggctctaccacggctggaaactccagtcaggtgagtgatggagcagctgccgtcctgctggctcggaggtccaaggctgaagaactgggcctccccatccttggggtcctgaggtcctatgcagtggtcggggtccctcctgacgtcatgggcatcggacctgcctatgccatccctgcagccttgcagaaagcagggctgactgtgaatgacatagacatctttgagatcaatgaggcctttgcaagtcaggccgtctactgtgtggagaagctaggaattcctgcagagaaggtgaacccgctggggggtgcaatagccctgggccaccccctgggctgcacgggagcaaggcaggttgtcacgctactcaatgaactgaagcgtcgtggcagacgggcttacggcgtggtatccatgtgcatcgggactgggatgggagctgctgcggtctttgaataccctgggaactgaggcctggctgcaggcggcacaacccagagagtgccacagtggtgtccagagagggacgctacagaagccgtctgcgtgggacacttagcagtggaggggtgtgtcacagcactttactttagaaaacataattgatgttggaacagagggtgggactgccccgtcaggtaccctgaacagtgctgaagtgagcatgggacaccctggttgcaaagccatttgtacctttgagggagggatgcagtaaatgtgtactgtctc

SEQ ID NO: 513946 - DNA, 921 bp, Homo sapiens
cttgttatgtggtcctcttatgtacctgcctcacttgtcaaggtgtgggaatttggggtagagtcgcgctgtgtcaatagatgcgactctctctagaatgggggccttcctaacctgtctccctatatgtttgttagtatgcttgagggcccttaggttgccacatgggctcaagttgggactcctgctcagcataccgcaatgcctctaaccactttactccggggtttcggtggcctcgggaccgtacggtgctcgctagatgtggtcaaaggaagttgcacatgatgccatatatgactcgagcctctggagagcccccatgtgttgggctatggtggattcgctcgtctgtgctctggcaccattcagctctgttccagaacggaggattccgagcatcaggctaaagatccctgtgtcctcctaccattgcatctcactcctctaggcctctggttagctgacagttagtcttgtgcgggaatcacagcgtacaacgcctaccctggcagggactctgagagcatctgcaggaggggcagcgcactgtgtgcatgtgtctgtcgtgagttgagtcacatcctcgtgtgcacacgtcattacacatgttgcacacaaagcgcactctccgccgctcaaggggacctggaggtctaggcgtgagcccactggggaaagagtgagttctcttcatctccctccatccaggtcggagtgcctggagtacaggtgtcgaggccacattgctggctgccccatctttgtagctcctataaagggccacacctggtggatacctggttgagcgtgtggtctctgcctccagcctgtccatgtcacgatcacaggccttgcttatgtaacaatgatgaccgcggcctgtctcatcattctgaagaggaaaagtcaaagtgatga

SEQ ID NO: 513947 - DNA, 220 bp, Homo sapiens
attgtgctcctctcctattgcgcccacctccccctccacatctgagatgtctgccagctccccagtgggctcgttcagcatctggatgaactgctcctggtgcctggctgatttgcttgtaaacagctgagtggttctccgtggcccatgctgcttggagcagtggcgggcatgcagcgcagggttcttgctgaatcaccttgccgcgatgttctgcttg

SEQ ID NO: 513948 - DNA, 253 bp, Homo sapiens
gagagcttaccatcgagcaatagctgagaatgctcgaagttaaatattcagatatactcgggaacagcgaaaaatagataatctaagagaaaaagaatctgacggcctttttagctgattccgaacatatgcatcattgttgttgcagtgttgaaacaagagctagaaaactgacaatgtcgtctgcttacggaagctcctaaagactagtgtgtgatttattaacgcccaacttctattattgagtgtgaag

SEQ ID NO: 513949 - DNA, 190 bp, Homo sapiens
ggtctagaggatcccattggaagatgtgcagagacagcatatggactcagtgtgctagtccattctcgtgcggctaataaagacatacccaaaactgcctaatttattaaggaaagagtttcatggactcacagttccacatggctagggaggcctcatgatcatggcagaaggcaaaggaggagcaaag

SEQ ID NO: 513950 - DNA, 107 bp, Homo sapiens
caacttctttttgtacccttcatttcttcttcttggacttcataatctgaaagtggactaaactggtgaagttttctaatttcctccaataggttcctttaatttac

SEQ ID NO: 513951 - DNA, 761 bp, Homo sapiens
  misc_feature (331)..(331): n is a, c, g, or t
  misc_feature (563)..(563): n is a, c, g, or t
agcgggcctcgcgccgcgctggtcctccagtcctgcggccacattcaaggcacgagacgcagtctgggatggaaacccggcgtccggggcgcaggcagcccagatgggccccgcagtcaccccgacgagctgctcacgatctccaaagggaagaaagcgacgctcttgagaatcgtccgtagaggctcgtctggctcgaaagctgcctgactcggggaggcgtggtggatacggaatacctgacgtctccccttcgatcatcccgggaatacccttctccgtattactctccaattaccgtcgatccgcacaatataacgaaacagcaaancattggcttatgcagaatagtataatgaacttgcgcttctctagggctcttacctctggcatggtctatcgttccctgacatacaatgttttacttgatgcctgaccggagcgacgggggacggagcattatcgtaggtacggataaaggacacgagtgccttctccgtcgtcatcggcatctctcggacagccaagcgagttcaaagctgggcacgtgcctttgcactgcntgtgtgaacattcggtcgtacagaattgttattcatcctcgcgagttggaccaaggatggaggaagggacgaagtcgtagttgccctgttggagtgacagcagatccggccagtccgcgactcggcgagacggctggccggcgcccgggccctcgatcgcagccaggtcacagatgccgatgggaacgagcctccccg

SEQ ID NO: 513952 - DNA, 366 bp, Homo sapiens
  misc_feature (149)..(149): n is a, c, g, or t
  misc_feature (163)..(163): n is a, c, g, or t
  misc_feature (209)..(209): n is a, c, g, or t
  misc_feature (239)..(239): n is a, c, g, or t
  misc_feature (345)..(345): n is a, c, g, or t
tggcttgatagatctacctttagttttgtcattttccagtattcacaatcctttcaaagtttcctttaaaggggaaaaaaaagaggcttgtaagaaatatgcccaaaagaggttctaggacttacagacatcccattcccgtataaganacaaaaggcaaaangtttcctttacccctgatccaggctagctccaagaatcctaaaaangatgttttaatttgggaactggggtgcggngttttgtgggttaacatgtgttctgccccaggggctactctccttccttaaggaacatgagccaaaatgctttgctccccccccttgttttgtttgttcccctggnggtcttggtccttcctggtac

SEQ ID NO: 513953 - DNA, 723 bp, Homo sapiens
cagaatctactccttcatacggatgtgtcatataatatgtttctggaaatacgaacaatgagagtccacctcgaaagatatgggagaggatttggagtgcctctgtcagataatgaggacagtgggacctagattagaccatgaagcgagccaagtccttaatggatcagtactttggcccgaatgtgctccttgatgttaagtacggaattgccagcacaggattcagtactcctgcctgcagggatacctgtggagagttgcgacgaacgaccagttggtgttccgtcgcaaggcctcttcacttgacaagtggatccaaagacgatcaattcaaattcgctcaagatgcagtaaaagatctaggggtgctttatctccatgctcctatggctcaacgggactgatgatagtgaacttctttctggcagggaccgtttcatgtccagcccagtgatgcaatacattggatagggacccaacattggaggacgtatgctgatatgtcctggacaaatgccaggctagccggcaattaggtactggtccaggagttatccaggcatagagttttcaagcccaccatgggtacgatcatcgttcaaatcaagctcttcaatggccatgggggcacacatcatgcctcccacacaatcgcagattcggagcagatgcgagcgcaagtgtatgaacaagcccagcattaacctgaagagcctgcct

SEQ ID NO: 513954 - DNA, 845 bp, Homo sapiens
gaccccggctccatctcgcgtgagaccgatttggtctgtgacgctgctgctgggggtcagaatgtcgtacccaggctatgccccccaacatggcgtaccacctattcacctggtgatatacctctctgtcgagggtcaagagtaagttcaattctgtatatgcacccccattcattggtccggtaatccatatatcgcttagttgttgcttatcctccaatatgggaggtgcatgagtagctgtataccacaaagttgcgcaggtgtggtggctatcccaaggagagctggaggttgaccgtttgatgccattggagagcgtaaaatcgcatgacccacgtattgctatgagttaattccattgcgtttgcctccaaaacaatagcccagtgggtgttgagaggcttcgcgaagtaccgttagttcccctgagtcggtttcccccttccatagtgcccgaaaggggctttttcgacagaagattccccagcacaagggggttggacagcgtcgggctgtccggtccctggggagatattcgcacaaatgacccgacccacatacaagggcacgttgcgcttaattcgggaaagtgtcaggagtcggtaagccaacgatgaggtttacccaacataaatctctgaggagggggcttttttcccttgggactggtatcacaatggcgtgttctacaagttattcccttgggagggaataaggtcctaatttttacctttagttcgagtccttggccaatcatggtgactacaggtcctccttgcacacggggagtaattctgaaacgagtttgcgattttgtccggtggctatgaactgaaggtttg

SEQ ID NO: 513955 - DNA, 599 bp, Homo sapiens
  misc_feature (29)..(29): n is a, c, g, or t
  misc_feature (64)..(64): n is a, c, g, or t
  misc_feature (70)..(70): n is a, c, g, or t
  misc_feature (74)..(74): n is a, c, g, or t
  misc_feature (78)..(79): n is a, c, g, or t
  misc_feature (81)..(81): n is a, c, g, or t
  misc_feature (85)..(85): n is a, c, g, or t
  misc_feature (91)..(91): n is a, c, g, or t
  misc_feature (124)..(124): n is a, c, g, or t
  misc_feature (157)..(157): n is a, c, g, or t
  misc_feature (166)..(166): n is a, c, g, or t
  misc_feature (183)..(183): n is a, c, g, or t
  misc_feature (201)..(201): n is a, c, g, or t
  misc_feature (211)..(212): n is a, c, g, or t
  misc_feature (214)..(214): n is a, c, g, or t
  misc_feature (216)..(216): n is a, c, g, or t
  misc_feature (220)..(220): n is a, c, g, or t
  misc_feature (225)..(225): n is a, c, g, or t
  misc_feature (232)..(232): n is a, c, g, or t
  misc_feature (252)..(252): n is a, c, g, or t
  misc_feature (260)..(261): n is a, c, g, or t
  misc_feature (263)..(263): n is a, c, g, or t
  misc_feature (266)..(266): n is a, c, g, or t
  misc_feature (269)..(270): n is a, c, g, or t
  misc_feature (284)..(285): n is a, c, g, or t
  misc_feature (288)..(289): n is a, c, g, or t
  misc_feature (292)..(292): n is a, c, g, or t
  misc_feature (310)..(310): n is a, c, g, or t
  misc_feature (320)..(320): n is a, c, g, or t
  misc_feature (351)..(351): n is a, c, g, or t
  misc_feature (356)..(356): n is a, c, g, or t
  misc_feature (370)..(370): n is a, c, g, or t
  misc_feature (379)..(379): n is a, c, g, or t
  misc_feature (390)..(391): n is a, c, g, or t
  misc_feature (414)..(414): n is a, c, g, or t
  misc_feature (421)..(421): n is a, c, g, or t
  misc_feature (429)..(430): n is a, c, g, or t
  misc_feature (438)..(438): n is a, c, g, or t
  misc_feature (474)..(474): n is a, c, g, or t
  misc_feature (544)..(544): n is a, c, g, or t
attatagaatggacttcactcctggcttnagtcatcctcccacatcagcctccaagtcgctggnacttcnggcntttnnancacncccagncattctggttgttactttgttaacttttttttnttatacctctggtggtcttcaggtcctaatatntgcttaatntgctcatttatatcttnatttatttgtttatagtnttttttttanntncntagntgcanacagganggggttgtgatttctaattnttagtgtnntnggnggnntgggggggcgttgnncanntgngcgagcggagtattaacntcattcattnggggatagagtccatttgggggggggacatnagatnagttttgggggtgngagacaatngcttgcgaagnntgagagtgtggcatattgctgtncttttgnttattttnnaattcttncagcatagtatctactataaacaacagatcttcaantttgataccttcattttcatcctgcttcttcaaattaagccaaggtaccagttctgcagatagtgttttnaagggcttatacaaatcctttaaggcatgtcagttgatatgcccacatttctatt

SEQ ID NO: 513956 - DNA, 222 bp, Homo sapiens
  misc_feature (186)..(186): n is a, c, g, or t
caatatagacagagtctgggctgatgtcagcgtggactgcagcagtagcatggtctagaaaggctgattaggaataagggactgaagtactcccaggtccttataggtgagggatactttcagtgacagggttgggtcagccagtcagcaaagtagccttcctaaggagctttacatttggacagnctgctgcccccacctgatacatctatggcaacacaa

SEQ ID NO: 513957 - DNA, 199 bp, Homo sapiens
tccgagctcggtccctctgtcatcgctaaatctttgccgggggcatacgtattgcgccgctagaggtgaaatacttgtgaccggtgcactgatggaccagatgcgaacgcatattgccaatgaatgttacattaatcatgacacgaaagtcggagtgttcgaagacgatcagataccgtcgtagttcctgaccataaat

SEQ ID NO: 513958 - DNA, 395 bp, Homo sapiens
ctctaaggatcccctatgtgcagcgaataccgcggacatcctagtgattttccggcaaaaccgttcagtttggctggtaacttttccagtaactttgacactatatggaccgggtgttgtgtgtctcccctttctcaaagttgctgggattacaggctgtgagccactgcgcccaggctgagaagtgaccgtttagatgaaggtggtgagatgccggtggattggttatatatttcacttgttgaggccaaaacgttcttgttgaggtgacgagggaacgacgcatccaatcttaagtttttggggcagagtagctggttgaatggggggttcatttcctaaaatgggaagattgggagagtaaccggttctgggggcacaccggggtaccgagc

SEQ ID NO: 513959 - DNA, 230 bp, Homo sapiens
cagtgaatcgcggacatactgggtaacaggggtgataaccgatctctagtgaaatacaaacatagcctagcgtggtggcaggcgcatgtagtcccagctacttgggaggttgaggcaggagaatggcgtgaacccgggaggcggcagcttgcagtgagctgagattgtgccactgcactccatccggggtgagagagcgagactccgtctcaaacacacacaaaaaaaaa

SEQ ID NO: 513960 - DNA, 374 bp, Homo sapiens
  misc_feature (33)..(33): n is a, c, g, or t
  misc_feature (42)..(42): n is a, c, g, or t
  misc_feature (70)..(70): n is a, c, g, or t
  misc_feature (81)..(81): n is a, c, g, or t
  misc_feature (108)..(108): n is a, c, g, or t
  misc_feature (140)..(140): n is a, c, g, or t
tggccctgcaggcccctttggcaagccccccantgctgcaanggtcctagaggcccatgggcagtgtggnaccctgctctnggtgtgacaaaaacagtattaaggggnaagtttatagcactgaatgccctacattaagnaattagaaagatctcaaattagcaatcctagcattgcaccccaactgtactataaaaacaagaacaaactaatcccaaagctagcagaagaaaagaaataactaaaatcagagcagaactgaagaaaattgagagattgagacccaaaaatctatacaaaggatcaatgaaaccaaaagttggttttttgaaaggacaaacaagatcaatagaccactaggtagattaacaaaa

SEQ ID NO: 513961 - DNA, 234 bp, Homo sapiens
atttgaaagagaattcttctagatgaatgtttacttaaaaaagtgatccacctcaacaacggatacagcgatgctttattcattgggcatttagcctcaaaaagcatgtagtaccaagcacttggtatttccgtatatgcagtttccgacgggacgtgagggagaagaaactcgaatagagcgtgtcaggtcttgcaggggtcctgacactgacctgagactgctgagacacct

SEQ ID NO: 513962 - DNA, 1190 bp, Homo sapiens
  misc_feature (265)..(265): n is a, c, g, or t
gtgaggtgtgtctccccctcctttttctgcgggaggtgacacacttcttgcttgactctccgctatcctccacgattccggggtgccccccgatcacagcccgctctgaacgcgtgaaaagacttatgccacgctttaacgaacagggaggggtttcccctggggatttttccctgcgggctttcatgtgtgggggccttccccggggggccaaataggaagatgttcgtttcctgggggaaaacttgggggaatgtacaaggangctaacaatcccacgagggacccaaaaggtgaaatcgcgtaacgtggggaccccgaatggaccaaggggtcccctgccaccgtatccggacaaagccttcctagaagcactgggatccttgggaacccttggggagcccctggagtggagaggaaacctgcgcaaggacacaaccccccgaagcccaggaggtgagcccttgagtttggagcacggcaccccgagaaatgtctttttatgggaattgatcccaaccggccccgcgtacaatcccgttatccacaaccctgggcatttggcccacgaatgtttgggaaaaaggtagccacgcaagggagaccttttgggtgtacctcgggccttctcgctggtgtgaactggtgaagaacccacggccccaatggctttcccacattgggcctcttcagaacatttcccacggtgaaacccactgggtgaaagcttctaaactggcgcccaaaggggcactggaaagtgtgaacaccaccccacagtgcacttcaagagacacccacttcacacaccggatggcgccctaactttcgggacctcggttttcccctgcaacaagcttttcacatggggcaatcccgaggtatccggcccaaagaggagcctgccaaaccacgtttgtgcccacaggcctttaacggtttcaaagagatccacatccgaatggcctatccacagctgcagctccaaagccgccacgcaaacttcaagaggcccacgtcaagagcgagattcgctgagattccctcccccacacctgtcctgcacgtctttgaacttttcctttcttttttgccacaccctttcacagggaaccctgtatggtttttagtttaaattaaaggagtcgttattgtggtgggaatatgaaataaagtagaagaaaaggcca

SEQ ID NO: 513963 - DNA, 423 bp, Homo sapiens
tctcgatctcctgactgtgtggtcaccatctcggctcccaaagtgctgggattacatggcgtgagcagcgacccggcagagtccagatcctttttatatgacttttttttttcacccttctgtaatcagtgttccacattttcagaatgacgtattaatacctgccttggcgaaggtctgtttccatgccaggcccttttccgagtgacctctggtccttaatttcggggacactttcttgaatacatcctcagtgatatccttcctaaggtgtgcacggtggtactacttttctctcttttttctaagcgcttgatttacacgctttttgcccaaggttgaagtgaattgggtgccatctcggctcattgcaacttttgcctcggggtgtacaggcaattctcttgcttcagccctcccaag

SEQ ID NO: 513964 - DNA, 266 bp, Homo sapiens
gccatttacgctgcagtggatgatgatgatgatgatgcagcttaagatgatttacttgtaagttttcgtgttgttttgcttttttgagatggagtttcactcttgtcacctagactggagtgcaatggcgtgatctcggctcaccgaaactccgcctcccaggttcaagcaattctcctgcctcagcctcccaagtaggtgggactacaggtgcccgccaccaaacccggctaatttttgcatttttagtaatgacagggtttcac

SEQ ID NO: 513965 - DNA, 415 bp, Homo sapiens
gaaggtttgttgtgatgattcttaatgcaatatgtgtcttcttatctgtctgcttcgttctcttctatggtgccatcattgacagagcggcgtcacactgaggttgccagaatgccgtcatgagctcgcggtctgcaatcaacttctcaagcgggtcaggatacagttgaagccatcacccatgcgaggtgaggctggttctctccctccactgggggatcccaggagtctgctttcctgtcctgctgtccgcttgccttgcagaggtcttcactaggtgtacggcttgagccgccagtgacccttgctctgggctcttggggcaagaggctgccccagctccctggtgagctgtgtgcaagggtgaatctgtaccctctgggtgagttcacacccatcacctccgagggctgca

SEQ ID NO: 513966 - DNA, 997 bp, Homo sapiens
attgttttgttgtcttttttctgtttctacccctctcgtgagtttggtccttcgcgcgctcttgtatatagccgggtccccgagttttttgcgggagttctttcccggggccgtttcccctgcctttgcgccctagacgcgggttgacaaacgcgggggtcccgttcagtttcccggtttctcgccccccctccgaataaaatggttcctctgccagaacccttagaaaaccaagaatttccagaacttaagttcttccctgtgatagaagtttgcccacaagatgcttcgtaagccaaagaggaactttatctatggaaagctcacccctgtcccaggatatttgccgatgtacagaactggattcgaatgcgaggatgccagaaagctgccacttctatgtacctgccggacccccattggcctttgtcatccgaatccgaggtatccatggagtgagccccaaggttcgaaaggtgttccgcttcttcgccttcgtccaatcttccatgggacccttgtgaagctccaccaggcttcgattaacatgctgaggattgtagagccctatattgcactgggggtacccccattctgagagtccgtataatggacttattctacccagcgctggttatggccacaatccatatagaagcgagattgctttgaccgataacgcctttgattgctcgattcttcttggtaaatacggcactcattctgcactggaggatttgatttcactgagattctatactcgttgggaaacgccttccaagaggccaataactttcctgtggcccttcacaattgtcttctccaccgaggtggaatgaagaaaaagaccacccccttttgtagaaggtggagatgctggccaccacgggaggacccgatccaccacggcttattatgaagaatgaaactaaggtgtctaccctgattatttttttaagctggttggtttaataaaccctacctgctctccaattga

SEQ ID NO: 513967 - DNA, 428 bp, Homo sapiens
  misc_feature (27)..(27): n is a, c, g, or t
  misc_feature (70)..(70): n is a, c, g, or t
  misc_feature (145)..(145): n is a, c, g, or t
  misc_feature (149)..(149): n is a, c, g, or t
  misc_feature (171)..(171): n is a, c, g, or t
  misc_feature (205)..(205): n is a, c, g, or t
  misc_feature (229)..(229): n is a, c, g, or t
  misc_feature (243)..(243): n is a, c, g, or t
  misc_feature (246)..(246): n is a, c, g, or t
  misc_feature (253)..(253): n is a, c, g, or t
  misc_feature (264)..(264): n is a, c, g, or t
  misc_feature (270)..(270): n is a, c, g, or t
  misc_feature (297)..(297): n is a, c, g, or t
  misc_feature (331)..(332): n is a, c, g, or t
  misc_feature (353)..(353): n is a, c, g, or t
  misc_feature (409)..(409): n is a, c, g, or t
  misc_feature (411)..(411): n is a, c, g, or t
  misc_feature (426)..(426): n is a, c, g, or t
ttttcttttgtcttctactagtttatnggtaaatttattgtggtttatccttactagggtttattcatcnttttaatgtatgaattcatgcgtgcatcaagttggagacttatgattctcaaaatatttatgctttgtgtaagangccngacaaaaaaaaaagtcatactntttgattcctttcacattaaactacttaaatgcntaattgtgagccggttggtggttntctgggggggggtnttntggtggngcattgtgtcnctttgngggttgatggttttgttcactctcttntttgtagtatgcttgttctccacatggtgtgatnncttttcatattgttcactttnaatttgttctgttttttttttgcttaattatatctcaattaagctttttacaaaancntacatctcttgcctnca

SEQ ID NO: 513968 - DNA, 196 bp, Homo sapiens
ttttttttgggggggggggggggggggttttggggctttttatatccccccccccccccccccctttgggggggggggggggggccccttttttttgggggcccccccccccccccccccgttttttccccgggggggggggccccctttttttttttttttttttttaaaaaaagggggggggggggggggggga

SEQ ID NO: 513969 - DNA, 174 bp, Homo sapiens
gatccccaacaccgaaggaggcactccggtcggaggtggatgtggcgtactgacatagaagagcaagagaggcggactcaagagtgtcctccaggcagtggcagaacaagtgacagaggaatcccagctgcctggcaccggtgggccagaagatgtgcttcagactgtgcagag

SEQ ID NO: 513970 - DNA, 190 bp, Homo sapiens
ggttattataaccaaggcttgggaaacccttcaaagggaaggggaaaggttttggggcccccttgggttttttttttggggggggggggttttaggttttaggtttttaaaaccgggcttttttaagggaaccccctggcccaaaatttgggcccagaattttgggcccccttaaaaaggttaatgggga

SEQ ID NO: 513971 - DNA, 267 bp, Homo sapiens
  misc_feature (45)..(45): n is a, c, g, or t
cggaccgtcgtgttctaccatatagacgtatgatttccctacccnatagtttgtaactgagtattccttttgttttttgagacaggctcttgctctgttgcccaggctagagtgcgattgcacgatcatggctcactgcagcctctccctcctggactcaaataatcctctcacctcagcctcctgagtagttgggattacaggcatgtgccactagtctggctatttttttaacgttttgtagagatgacatctcactgttgccca

SEQ ID NO: 513972 - DNA, 129 bp, Homo sapiens
tttgtatttcaggggtggctttttcagtggaccaagctgcaatgcagtattgacttgacagagcctctacttttgtttcaaaatggctccaaatgatttttgtactgcaaaataaagcccaattttgga

SEQ ID NO: 513973 - DNA, 195 bp, Homo sapiens
attttctttataatttcttgaacaggcaaatgaaagcttattataaaaagcatgtatttttttttatctttggaacatcagccccagtatattgctggcagctattgtattaaaaaataaagtatattttccctatcataaaggattcttttttcccccctcatgaaaataaacaacaacttggggtaaaagtga

SEQ ID NO: 513974 - DNA, 196 bp, Homo sapiens
aatgatcacgattaagtaataattgccttaattgttcaagttgcgtttgaatggttggttcaggtaagttgccaattaaggcttgtagttgttcagtgtagtctgtgagtaacggattcagttttgccatcgggtggactttggggtaatgggttcgggtaaacggatcaggtcagcatcgttaatcaaatcgggc

SEQ ID NO: 513975 - DNA, 1195 bp, Homo sapiens
  misc_feature (208)..(208): n is a, c, g, or t
  misc_feature (270)..(270): n is a, c, g, or t
  misc_feature (282)..(282): n is a, c, g, or t
  misc_feature (303)..(303): n is a, c, g, or t
  misc_feature (331)..(331): n is a, c, g, or t
  misc_feature (877)..(877): n is a, c, g, or t
gctcaccgactagtgccgcgtcatagtaacaatgtagcttgggaggaaggatacagtagatcaggtgaagttcatgatttgatttacccagagcacaggtcaaagccccaacgtatcatcgatctcttcgcgagtgatgtgtcgaagtgggcgtcagttggcattgatcacatgaagtgcgccctcaacatgcggactggaagtcagngtggtgagaagcgaccagcaacgcgttattgcagagaggccgtacaatacgcacgcacgacnaaaagtgtactntactcaggccgctatgtcccnagacggcagtacggtgaatgacaaaccnagagtgcgtgtgagaggcgtgcgtacccgcaaatgtagtgaaagaatgccagtgctgcatgtcctcgacgtaacaaaatcctcacgtatgtgcgccatccgttagggggtcatgagaacgtgagagaccgtattctcggtgtacatagagagcacaagtgcgtagacaaatccccccctagtcagagaccgagctaggggaaatcgccgtgaatggggtaccaagaacgaaccaggatagagcctttgtatattggggttcgccacaaacctttggcgaccgctattaacatttagcagcaccacaagtgagacactagggttagagtagcttaccttgtgggccgtggtcagtgcgcgtcgcattggattagctaacatgtggtaccacctcctcgtggcttggatcggtaaaacacgaggtacagcctcttcaaaggcttatgaagaatggattagcccaaaccttgtatatgcacagcacccggaggtggctcgcacaaggtgccaataggcgggacctgtgaccataaggagccacacaccnttccgggctacccaagtttgtcatcatcggtatgtgcggcgtccacagaaaaacagtgtttcccctatatatacgtggggaggctaggatatctatcccattaacacacgctctccgaccgcaaatggagtcgatcggggggaaccattacgatctatggggctgtgtaacttactcttccgttaagttgtgtggacccatcagagggttagaactttacacaaaaggcgcttcctatagggagccacgtccttacagattattcaatccatctagtgatctacctacccaagagaagaggccttcttttcacgcaag

SEQ ID NO: 513976 - DNA, 426 bp, Homo sapiens
aggcacaatgtctcttgttcattgttgccaagcatagtatccgggtgtttaaagcaatataagaatggatgctaagcagtaacgagtgtggtaagttatgttcatcagtccctacagaaggtcttgaatgcatattgacaaatatgaactatattatgtaggcaattagaggttaaaaaggtaacatatcagctgttattaataggcataattttcttggtgcgcctccgtgcgttacgtttagtacgtgagtctctgagatggagtctcgatgtgtcacacagtactggagtgcaatcgcttgatcttgcatcactactccaggcatctttttggctccatcaaaactccccctatatcctcctgagtagttagaaatgcatgcgtgccaccccaagctcgacctcgtgcagaattcgtgcagcc

SEQ ID NO: 513977 - DNA, 188 bp, Homo sapiens
ccatgattgtaagtttcctgaggcctccccagccctgcagaactgtgagtcaattacacctctttcctttataaattacccgtcttaagtatgtccttacagcaacatgagaacagactaatacagaccctttccccaatcccaggcccagacagttttctactccaaagacctgcccccctccccac

SEQ ID NO: 513978 - DNA, 841 bp, Homo sapiens
atcatatggagattatctgggttctgggaagagataggaatgagtctttatctagtgtggcaggccagcaaatacagaggtggttgatcaaacagctctagtatgaagcaggagtaaagactaaggtttcgagagcattcctactcacataagtgaagaaatctgtcagataggaatctaaatatttatagtgagatggtgaaagcaaccttaaagttggaagaagactgatgagactaggtgcttggtttcctttcatcaggtatcttctgtggcatttgagaacagaaacaagaaacatggtaattactaaattatgaggcttggttagggtggcttttaagtagaaaaacttgtgtggcaacatttgagttgtgagtttgatggagataatatgacttaactagttgttgtcattccattgtgttaaagatacagtcaccaagaatgttgggagttttgtgaaagaccccaatttaagccttgttaattttaaaattatttccattcagtgtgatgtgggatgtatatccagttattaagtcacattaaatctccattaaatttgtgtgctgggggctttttatcacacacgacagcacccgtatgtcaaaagacagaacaccacattttgtgggcggctcccggcccccagggagtgttccaaaccacttgtgttgggggcggcggccccagagtgaatgggacaagtgggccacacggggtcacaagagaacaccgggcaagacaaagggggtggggttcccaccataaaaaaccgcgcgggcacagagggtgtgacaaaacacaggaggtcgggcatacgggcacacagggcccg

SEQ ID NO: 513979 - DNA, 228 bp, Homo sapiens
agagacaccacggaggggagagacaggcagcccagcagagtgtagaccctgccacagccataggagggcagagggagaatccaagggttgagagccagaggcgtatgatggccagcccgtgcagcccagccgatgtttacatgggtcttgcaagcgatagctgtgcagtctctgtacagacagcgaactttgacctcggtgaccactcttctataagccatagaccct

SEQ ID NO: 513980 - DNA, 419 bp, Homo sapiens
tagaggacccgcgtagccgtacaaatacgaatcagatacagagctgatcatggacaattatcaagtcattagtataaacattattaatcattaacttttaatgttactctgttgcattactaatataacctaggaataaccggcgggtatagggtcaggtgctgaagcgacattgtgagaagtgacctagaaggcaagaggtgagccctctgtcatgcccgcataagggccgcttgagggctccttggtcaagcggtaacgccagtgtctgggaaggcacctgttacttagcagactgtggaagggagtctcctttccttggaggagtcagggaacactctgctccaccagcttcctgtgggaggctggatattctcaaggcctgcccgcagtcatccggaggcctaaacccctccctg

SEQ ID NO: 513981 - DNA, 429 bp, Homo sapiens
ctagattcacatgtctcagtcactactgcctcaggacccatctcttatgcgttatgtgctgggggctggagtcaggtgcatgcctgcttggttcctctggctctctggattagtggcacggtcgccatcaggcagctgccggcggggatcagattaagccggagatgcctcgaaatgccacagatgggacatcacagagcatcttccctgtttagcctggacttgagattgctgtccccagcagtaagctgctcaacctcaaagcaacttgcacgggggtttacaaaaaaatgcacttggccgggcacggtggctcacgcctataatcccaacagtttgggaggccgaggtgggtggatcttttgaggccaggagtttgagagagaccgagccccaaggggtggccgtcctgagggggtttgtgggtga

SEQ ID NO: 513982 - DNA, 1007 bp, Homo sapiens
tgtctcgtggacgtccccttgtagcccgccgtgttttcacccagtggcttctccctccggtgctgccagattctggtgggatcccgcactgttgtcgcactataagatgtccgtcgcgggccgcactattcgcggggttctccctttatgccggccccggcgtgacttccatgggttgccgcccgcttctggcccgggtgagcttccttcctttttcccaagggcgcccgaattccggcttggtttacaccacacccgctaccgcttggggcgcctgtccatctccctcaccggctgtcttttgtggagggcctcgtccacgcttaggtcgcactctataggggtcgcgttcgtccctctcccagggtcatgcctactctcccttggagttgcccgcgctttttccgaggaaccccctgaggcccaacaaatgagcccaaaatgctccattcttcgcctttattaaattcctcgggacgtaaagatgataactttctgtggccacaaccccacacttttctcgcgtaatctcttgatgggcccccacacacgcttattatggtgacctccccctcgaattactgaactcacccgcaccttggaacactctccgcctaactctttagactctacactcacatttgtctttgtagacacctccccagtgttaaaattcctaattataaattgttcagatccatacttttatgaataggccccattattcttgcatacgctactcatagattatgcttccattagtgtgaaagtgaccccctctcccaccctacctcggcggggtctcattatttgaggacgctccccgccgcactcaagcacacaaacctttggtcgcgagaacccggtttcatacactcaacattctgtgatgcaacaaaaaggaatggataccctaagcccctccgcacggcaagctggctgtcagactccacacactccacacactggcctctcccatgaaactcgttccccacatgagaacgaaa

SEQ ID NO: 513983 - DNA, 156 bp, Homo sapiens
atgttatgcggtactggatgtgtcagaggcattcgccaggtttgttgacccactttatcagcctcgtgtacaaggtgtccctgtggcccgctgcctcagctttagaccactttatctcattgtccatgaggcccaacttacctcatgacgcggctc

SEQ ID NO: 513984 - DNA, 166 bp, Homo sapiens
tgggaatgatctaaggcaatggtgtcaaatgtgtcattgaggttgatttcaggaattagaacctgggagggtgcagttgccatggagactctctcggtatattcttatgcagtctgtaggaatacgcgcatttatcattctccttcagagtagtgttccggcttgg

SEQ ID NO: 513985 - DNA, 412 bp, Homo sapiens
gaaatgaaaacatctatacaaatcctgtacaccaatgtgcatatgtaacattattcataatagccagaaagttagaaacaactcagattccaacagctaatgaatatatacattaaattaggttatgtccacagaatgaaatattattctgcaataaaaatgaagtactgatatatgtacgacatggatgaatcttgaaaacattacattaaatgagaaaagccagtcaccaaagaccatatgttatatgactacatttatatgaaatgtcagaataggaaaatctatagtgacaaaaagtacattagtggttgcctcaggcagagggtggggtggtggagaaggcaatgactacaaatgggtactgcgttttttgaggatggtccgcacagggggtaaccgaggctcgaat

SEQ ID NO: 513986 - DNA, 355 bp, Homo sapiens
  misc_feature (273)..(273): n is a, c, g, or t
  misc_feature (325)..(325): n is a, c, g, or t
  misc_feature (345)..(345): n is a, c, g, or t
gcagaatcacaggccagaggtgagagctggagaaagggaaactctcccagtccctgggagtggtcattacagactgggaaatcgctctccagctgatggtaaaggactgcaaatcctattcatgtgactcagggcctggtgtgccttctgggaagaaagcagaagagggttcctaactgtagaagggaaaagtttccctttattcttccagccacgtggttcaataagcatgtacaagctctcaccagggccaggcactgtgcgggcaccagnaaacattaagatggaattgacacaggtctgccctgggaagaaacatttaagntgggaatgacacaggttttnccctgggaag

SEQ ID NO: 513987 - DNA, 215 bp, Homo sapiens
gcaaaagggagatgtgaagaattacctaaagcttgatatagacaaatctaaaacacttcttgaggataattaagacatgtctcatttgtggaaatttggagaagaatttgacatttactggtataggccctttctgtctagctgacttggtcactattacaggtcagtcatatcattattattatctcgttagagacctggttattattttgaga

SEQ ID NO: 513988 - DNA, 235 bp, Homo sapiens
ctttcaatatacggtttgccttatcctgattcgccgttgttcagtccctaggtcatgtggttacatagtggcgccgcagaacagggcttcaaggccgtaacgagaaggtcttctggagcagaggacctgaaattgagaaggtgaacgggcacccaggccgagtctcccgacagggatataaggggatggacaagccgtgtgggtgccctcaaggtgtgtgcaaccatgggatggg

SEQ ID NO: 513989 - DNA, 328 bp, Homo sapiens
ttttttttttaagacggagttatgctcttgtctccccagctgtgcactggcaagatctcagctcactgcaatctccaactcccaggttcaagcgattctcatgctacagcctcccaagtagctgggaccaccggcacccactaccacacccaactaatttttgtatttttagtaaagacagagtttcgccatgttggccaagctggtctcgaatttctgacctcaggtgatcctcccacttcggcctcccaaagtgctgggtttacaggtgtgagccactgcacctggtctcaataaacttttaaagaaacttgtgttttaataggtc

SEQ ID NO: 513990 - DNA, 403 bp, Homo sapiens
aagacttttagcaagtcaaagcttctatcaccttttcttgcccccttcaaccagagtcccctcctgctcctactccgctagtccggcccctgacccctttccccagtacccacttcctgcctctctcattaacccttccgtagctgctcaccatgaccccatcagaatccagttaaaagactcttccaaatttcccaacgttcctcaataccccatctctctaacccaccaaaagggcctacagcccatcgtaaacaagctctgctcatgcagtcttcttagaccaacacactctccatataacacccctatcctccctgttaaaaagtctgatggctcataccgactcgttcacaacctccgagccatcagtcaagctgtcctccctattcatcccatagtc

SEQ ID NO: 513991 - DNA, 269 bp, Homo sapiens
gtccaagcatcttgtcaatagcgctatttcaggcacatcattggaatacaggaatgtatgccctgcacctgctctgtgagctctccctccacaagattgtaagagatgacctgggcatcttgagacatcattgatgtgtcttcacggagaatgtgcagctgcttttgtaacacactaattattatgcaaattagaggctccatagtacatccgctttgttaatgaaaatgataaaacacaatattgaccagctacgacacgaatgttca

SEQ ID NO: 513992 - DNA, 273 bp, Homo sapiens
gatctgtctctgccctagactacggaccctgccggcctacttctccgttactactacgacaggtacaccgcagagctggcgcagttcctgtacgggggctgcgaaggcaacggcacacatttctacacctgggaggcttgcgacgatgcttgctggaggatagaaaaagttcccaaggtttggcggctgcaagtgagtgtggacgaccagtgtgaggggtccacagaaaagtatttctttaatctaagttccatgacatgtgaaaaattcttt

SEQ ID NO: 513993 - DNA, 102 bp, Homo sapiens
gaaaatggggcatcggcgtgagcctgccaacaggctggggttgggaggcctctctgggcctgcaccagagctgccaccctcttctttctcccagccttctca

SEQ ID NO: 513994 - DNA, 927 bp, Homo sapiens
aacttaaggaagttgtgcctataaaagttactgcaattcagtatttctttatttttttcgagacagagtctcaatctgtcgcccaggctggagtgcagtggcatgatataggctcactggaaggctctgcctcaggggttcatgccattctcctgcctcagcctcccgagtagctgggactacaggcgcccgccacatgcccagctaattttttttgtatttttagtagagacgggttttcaccgtgttagccaggatggtctcaatctcttgacctcgtgatacgcccgcttggctcccaaagtgctgggattacaggtgtgggccaccaacccagtccttttaggtgatcttattcatatgtgtatttcttgttggggaaaaacgaggattgttcacacttcttggtgacccagaaaccccgctggggtggtgtggtggggggccccaactaccccggagctgaggtggacatctcacaccttcagagggttcccgggagatgtcaaagtgacatagaacctctgagggaagtgtcggacaataagggtggtcccccaacattgcccatgaaaattgggtctttgcagagaacacagctttccaacgttgttgcacggtgtgtgtcataactactgagtaccattttattttggccggtttggccccccagggtgtgtatttccggcggcacctgtgccccagaggtgggtcttcaattcacgagtggaagacaccgcgtgatatatcacaactatatcccaaggcgcacagttatcatatacggttttgtgtctcttcccccacgcaaattttaagggccacttgttgtgtctcacaaaaaagcgtcggtatgtggtccgataacccctgtgggggacattgaccgggcaaggtctgtaaaggaaccaccattgttgctgaata

SEQ ID NO: 513995 - DNA, 1045 bp, Homo sapiens
gcgctatgatgtaacgcgcatgtgcggatggtgagccgctcgcgcgcgaccacctcggcgcgccgcctgcgcggagatcgcccggctcccgagagcgagccccggcgccgcgacaccagccgcgctaaccgccgacaaccgccaccgaggcgcctgagcgagagcagaggaggaggaggcatgagtgaggcgggcgaggccaccaccacacaccacacctcccgaggctccgaggaggcggcgccgggtccccaggacccggcgccaagagcccggtgggcagtggtgcgccccagggccgggccggtgccgcgcgcccacgtcgcaggaaacccgtggtggggacggcgggcccccgcgagccaacgggcactgggccgccgctttttaggcccaccggcgccgggaagagaagacggcggaaggaaaagagttctcgccagcaaaagtcgttggcacttgtcaatgggtcacgcgttcagaaagtggatattggaattaataagttcggagagagtgacaccgaaggagggatgtttttgtgtacattcgggagtggcatcaaggaagaaataccccggagggaatttttctgcgcgggtggtagggaggatgggaggaacgtggaggagggttggatgttgtttgaagggagagagggttgcagaagtgcacaattgtgattgcccgggatgagttcttgtgaagggaagtcgtacggtgcagaatcggcggcgtaacggacgtgatatatggaaggcgcgtggccttcaccggaatgtgctgaattgatagatgaagatggagtccagagggcacattttaggagggttagtgagatgaattacgccaggtagaaggggacttgcagatgccagagtgagagtgaaaaaaaattagcccggggtcagactgttgtcgagagggcccaaaagcgtgcgcgggagctttcggaggaaggagagagaagaggctcagcggtgtgtgagtgtgtcagggagagaattagagaacgagaggagatttatttatattttcgcgggcg

SEQ ID NO: 513996 - DNA, 170 bp, Homo sapiens
cttcctactaccggccaaggattagcctcctgggagcgcgcaccccgctgcctcgccacaacattttcctgggagcggcggccacggaggcaccatgaagaagtcttactcaggaggcacgcggacctccagtggccggctccggaggcttggtgactccagtggcccag

SEQ ID NO: 513997 - DNA, 1242 bp, Homo sapiens
caaaaattatgccaggcgtggtgcggaggtgcctgtaatcccagctactcgggatggctgaggcatgagaatcacttaaacctgagaggcagaggttccagtgagccaagatctgtgcctagcgtgcgattgccagccgtggagtcagagcgagagacaagtactctgctctcaaaataaaagagtaaaaaataatcagggcgacagtggctcatgcctgttaatcctcagcactctgggaggctgaggtgggtggatctatctgaggtcaggagttcaagactcagcctggtgaatcatggctgaaaacccgtcgtctatataacaaataccaaaattagccgggcctggtggtgcagtgcctgtaatcccagtctatctcgggaggtctgaggtcaggagaactagcttgaagccaggaggcatgcggttgcagtgatccaagatcatgcacactgctactccagacctgggacgagcaagaggcagaacctccgtctacaacacatacacacgatacggaacaagaatggacagcgctgagcatgagagttgctcatcgagatttccctctagatcctaaatgtcttcatgtctatcagtctagagcagaccggagagtagggcggggcacattctccgagggccttcgttcctaagctctgtggttggacctctcagcaaagagctgatacaagctgggccaccagttccctgcacatcatcggtgtgtgaattaacccaaaatggcattcctgggctggctcaaggtcaatgatgcaccgggacgcgtgcaccagaggcttcagatagattgtggggactgcgaggacaagctggaatagactggggtcatccacaggaagcatggacgggacccgcgtggcgcaacacagaggaccacgacggtaccgggatcgaaaacaatcggccgtggacaaagagcctcggcacaggacccccggaacacaaagcggaggcactgcagggaggagcaagaagagggtcggagcgccgaggacaaaccgacgagaaccacgaggagacagccggtgaggagcaacagcaagaagaaacagagaatgggagggacgagcacacagccaggcagcgagagcaacaagaccaccacaagagctggagaagaccactacagaccacccagagtcagcgaaacaccgaaacaaggaccgaacactaccaaagctgatacaccacacacaagacgacgcagcgaccaat

SEQ ID NO: 513998 - DNA, 736 bp, Homo sapiens
ggctgagcctagtggctcatgcctgtaatcccagcacactgggaggctgaggcgggcggatgccctgaggtcaggtggtcttgaactcctgaccttaggtgatcctgcccacctcagcctccccaaagtgctgggattacaggcgtgagccaccgccccccagtccaatatgtatacttctttcaagtgtggacatatgaaaaagtatcagtctttagaagatttgtaacagaatttcaactgtgtggcattctacaaggcacctaacattcataagtgctctaaataaaatttgtgtcaaaaagtcaatcattaatattcaacaaagtgtacgataacatacatacagtgtctagcaattttcaaaggcagtgctaaattcatcagtgcttcctctttcaaactagttttttgtaaagagccctctgcttattccagtccccccctttaaaatcttttacaaatttattaataacctattaaccttgtgagcaacttcatctacgacatccacaacaaaatgtgagggacgtacatgtccttgtgtcctttaccttttagaaaccctcaaacatagcttggtatgtgctgtcttacaaactcttctgcacgcatttcaggaatcactttagaaacacgccttgagggagcaacacctttatcctagccacactcaactctatttttgccgtgactactcctatttttccccttttatttccctggattttcatgg

SEQ ID NO: 513999 - DNA, 115 bp, Homo sapiens
cttgtgctctgcggacccttttgacgagacgacctggtgcgagtgtggctggtgacattggcacacgctagaagtttatggcagagctttaccaaatcaaaacaaaaactgggcc

SEQ ID NO: 514000 - DNA, 811 bp, Homo sapiens
atgagaccctcacataatgcccggcaccacttgagactgcagagtcttgaccagcaagaaggtcctcaccagatgcaactcctataccttggactccctgcctccagaactgtaagaaataaaattcttttctttataacttacccactctgtggtattcagtcatagcaacagaaaatgaattaagacagaaagaaagaccatgttcctggataagaaaactctcctaagcaagacaattctacaaaagtaaatttataaatgtaatgtaatccttataaaaacgccgcatgcttttccccagatctagaaaactaattataaagttcatgtgagagaggaagtgcacaagagtgtaaaaatagccaggaaaactctgcaaaagaaatggagaggtcctctgcccccgaaccatctcctggcctccgtaatggaaccacatgacaccaggacccatgtaggcaagcaggcccaggacatgaaaacccggggacagaccccagtgcctagaacattcagtctataaggtagcatatgataccggtgaggcaaggatggcttgttatacaagtggttaacgttaacactggagaagacggaaatgatttgattataccattattagataatcctacggcgcaaggatatgacaaggaatccttcaggggagggcaaattttaattaacttaacgagtgtagaaatgttgggacatataaaaataagaggagaggagaaagagaatgggtaaaagccaaataaaaatcatagtatagtgttttgttttaggatatgtttatttgagaatgggc

SEQ ID NO: 514001 - DNA, 1306 bp, Homo sapiens
cttgtgtgtttgtttgttgtgggtggcgcaacctctgtttttgttgacgcactaccggggggctccgcggtggattagtatgttttctcttggtgggggtgccgctcaatcgtctgtgcgctttgtcctcgcttttgcctcaatatttgtgggttgttggttgaggctgctcgctccttctgatgtaatggtgtgtaatttaaccgaccatcgtgtggtgattatagtacccgcgggcccccactcgttgtgtgcgactctccatgcgttgtggagaatccaccgcctgttggatgcttctcatatggggtgggccagaactcaccccaactagggagcgaccgcttgtgggccgataatgcttgcgcagctgtggcagacaagatttttcgatctcagctaaggtgatatgatgacacccaccacatggtggtcgtacattcgggaaggcgcgacaaatcactgcttgtgggggagaagagatgacgccgcctcaagtaagaatagatattgatgatcgccgactctccaccactgattgttggtcgctgtaggcacaacaatgtggggggcgatatctttgtggtgccaccccccacctgtagaacaattgtgagcgtttgtggcgccacaacacctccccccgtcttataaagatctaagacgacgcttttgtgtagtacacaggagtggtcgagaaagatgtctacatcttctcgagaggtgaacagcacccaccatctgtgggcgactaaaagtcacgtgatgattctcgttagggcaccacatttggttggccgaccactggggcgacaaggtgcgaacagaaagagtgtctcagagggcgccccccaagtgaggagggctcaccactgcgcgctcattctccagcatgtttgtcctcgatggtacagtttctgtatgtgtggggcacgctccccaccggtgtcgcatgtgtcgcgcttctcgccacgagaaaacgcgcaacaaaatctgtggggtacgcacaccacaactgctcacggaggctgcccccgaatctcccgttgtcgagcccccttagttatggcccgtctcccgtccccgtgtaatttggttttcgcgaccaccacggggtgtttagcgcccccaggatgggcccttcttttttcctgccaggataagagttgggtccatcccatcttgccagtttctcttttaaacacccccaaggagcaaaggccacagcaaaaccaacgggtttttgcaacaaatttgaggggcaaccagggcgggcccccaattaagccccttgtaataatttgta

SEQ ID NO: 514002 - DNA, 734 bp, Homo sapiens
aagacttgtgccggagccgactactggagatgacagtgatgctgccacctttaagccaactctccccgatctgtcccctgatgaaccttcagaagcactcggcttcccaatgttagagaaggaggaggaagcccatagacccccaagccccacatgaggcccctacatgaggccagcgccctgagccaagaccccagaacacagccccaggtggctgcaaggaggctgcccgcctcagctgtctgaaggagggggccagacagcgagaacgctggcagcagatgggtcatccaaggccaagatccaacggtccaagagagagacagaagaagttccgataacccgtacctgatctgaagaagagacaagaagaagagtagactacctgaaagccctggcgctaaacacgtgtcctgtccggagcgacacctgggcatctgccaggtgtacccgggcaacgatcgagggctgctagtcctaggatgtcagatggacatggcaaaagaaaggccaagaccactcacgccctagaaaggtaccacaacttcaacagatagaaaccaagaccaccagaagtaaagacccacggaagcagtgaacacacaaggggtggatgctacagaggaaaaggccacaaaacacagaaccatagagccactatggacctccagcagacggcctcaagaaagcaaggaggagaagaaaatgagcacacaccagaaacggagagcaag

SEQ ID NO: 514003 - DNA, 314 bp, Homo sapiens
  misc_feature (135)..(135): n is a, c, g, or t
agcggaagcgaagtagagacagaagcaaaggaaaaagtagcaaaagcccttgacgaacaggccaagtaggaggaaaggagagggcgacggaggcccccttcaaggaaggttcgaggattccaaggattttagganggccccctaccaggaaggttccttaatttcccgaccccaaatttttaacacattcccatttcccgggaaaagatattgggttttgccctatatgcatataaagatagagcacgagagcacgctttccccagagcacaaagtttcacatcacgagagagacacagagccccctatagaga

SEQ ID NO: 514004 - DNA, 156 bp, Homo sapiens
gagatcaaatctgaagtattaaacagaaaagacctgaagaatatcaacttgaatatatttcattccagaaaatatttatgtctatttcaacactgactcattttgctatgatggcagttttgtgtacctggtgacttactcttaatgttagagata

SEQ ID NO: 514005 - DNA, 1273 bp, Homo sapiens
  misc_feature (1)..(1): n is a, c, g, or t
  misc_feature (992)..(992): n is a, c, g, or t
ntgagtccctggtgcgcttcggctcgcttctggtggtggtccgtcgcgctatcgctggggttgttggccggggcgcccccggggggtttgtgggggtgcgcaccgtggtgccctcgtgtgacggtggcgctttgcgccccacgaggggggatgaccatgtgtgcgctggttccccccgtgtggtgcgtggggccacacagagcgggtggggggtgggccccgcgccccaagtggggggccagcgggggtccccccttgtcgggggcgcggagaggcgcgctgcgaagttggcccccccactgttggtgggagccccacggggcccttatgagtgcgcgtttgtaaaattaagcggacattggcgttttgggtattgtgggtcccctctcgccccagtgtgggagggcgtggcccaacaggggtgggaagttgtgccccacgccctttgcgggggagaaagttgagggcgccttggccgcgggttctggggggccgcttttcttggcgtgggccccctgtggagggaccacttgcccacgcgtgtttgtgcccacgcacacgtggacacacttgtttggcgcgacatcgtgtgaaggcgggtctgggcgcttggcgccctctagtcccccgcactggatggggcgtcggtgcacacaggcgtctctcgggcacaaccacacagcttggtggtctgcacgcccacagaatgactctctggggtgggctcttggggtgtatagagagtctataagtgttgtaaagtgggcgagagcccctctgacacaggtgtgaaggtgcttgaagggagaggggggctcgccacggtgtcacgcgtataagagttcttggagaagaccacgacacgtgacacacgcgctttgggaagcggcccacgcggggacactttctcaaaagggcccacagagaagagtttagcaccgcttcggggaaaggaaggcacgtgggcacagaaggcggttgagagggacacncggggccccctaaagttccacgccgagggaaaagctccggtttggggccccctgttacgcctcccgctttggggtgcgccctggaacgccttttctcccacgcgtccctccacgccactcacgcacgcctcttgtcaaagcttttgcctcgccccacagtttaatccccacaaccccacaaatcaaagccacccttttttcaccggtcactatttattttttgttctctttttttttttgtaagaaacaattccaccccacacccatgccaaaacccaata

SEQ ID NO: 514006 - DNA, 1059 bp, Homo sapiens
agacgttcttcgccgagagtcgtcggggtttcctgcattcaacaggtgcttggacggaacccggcgctcgttccccgagcccggccggccgccgcatagccagccctccgggcaccgtctatcagccgacaccctccggactggcccaaggtcccccgaccgtcgctcacagacgaccgcagcagccgaccgctcgaccagtccggccggcctctccattaagtacagccgccatgatggaccagaagttctaacgcttcgtcagggtgcagcacagaagttaccaaccagggacttcatcgagcgccggtctaatgaatacggccagactcaataccttgggagctctaacgctcatcactaaccggttagccgtgatcccaatggtgcttatacctaacctctggcacgcgtccggatggagtgctggccttttggtagagaaagtgtagcgagcgcatagagtatcctatacgtatcaaccaattgtacttccttggacgcgcaggagcgggaactctttgactcgacgtaaaaactgagtgaaaggctggctagaacatcactaggaccgaagtgttgcggcccggtataggtcctttccctataccatggcgagtgattccaatccaagaggcccaaggaaagctggctggatagcactggggcgaataaaggccgtgtgctagatattgacatgactgggacggtttgtgccactttcacatcatcctcgcgggacgccgacacacagttggtgcacttacacggacaccaaactattctgagcagagcttagccgccagaaaagggtgggtgcacgcttggatctgataaatgactggaacgccccccaatttgtggggtgattggaacttacccgttcggacgaaacacacagttcattctcttgggatattcgacgcccacgcggctgaaaaatgcccatttcatctgaacatttggcggttgacccaacttttggaatcatcactttggccggcatacgaatgtggaaagccgttcaggacattcttggcttggccggcgaagcaatcg

SEQ ID NO: 514007 - DNA, 1275 bp, Homo sapiens
cgacgctcctctgttttaagtgtggcacacccctccgctctcagggtgtttccgccgcctctgtggtggtggactctgccccccaattccgcacaaacccccttgtggtgttgtttgcgacccgcgccgcccctcatttgtgtgaaagggacctcccccccccgggggggtccgcgggatgttcctcctcagagctcctctcctcgggggacctgtctttaagaccccttttatgggtcccccgccggggggggcgcccggcgggattatcaccagagatggttgcgcacccaccacgggggtcaaccctagcctttattgtaccccccatttaagggccgctgtaatttttaaggggtggcacccacctttttttgatgtcaacccaagtgttgtggtgcaccacacacataatatacccagggccttggggtggacccccggtccccccgcggagattttcccccccgcgggaaatattcccgtctggacaccccccacaggctgttctcccccccggggggggaagaaatcctgggaagagagaagttcccccgctttctcattcttcgcctggcacacccctggcgtttttttgtgggcgctctgtttgcccacactgggcgccacgatagctctcaagaaccttgggtgccccccccttgtcgccgagtcttgtagccgcttttgtggccccaaaaggtatccacacacccagacgtctctctctcagaaaatttgtaaagagagagagactctggggcccaccccaaaggcgctcaagatgtttgcccgcggccagggaacattctcacggaaaccccctctgggccccacgtataagctctgtggggcacaggcaaagaccctctcgggtgcaccctcgttgggctaacaccacaggagacccctggcccctctcgtggtgcacagctctcacaggcacagtctctcgaggccccccgacccaccacgttgcaaaggggtctccctgcgtaattatgcgcgcccccacccgcccgtggaagttctgtgacccgcgttctccttatgaacttcttaccagaaagcccagcgtcccctggaagccctcgttggcacgctctagctttgcacgtcgtgtaattggccccagtcacttgtttttctcgcctcacctttccccccagtgtctaagaagtcacatgtgagcctcgtgtcatctccggggtggccacccggctagatccccggtggttttgtgctccaaataaaaacccccagtgacccctgaga

SEQ ID NO: 514008 - DNA, 1537 bp, Homo sapiens
  misc_feature (260)..(260): n is a, c, g, or t
  misc_feature (328)..(328): n is a, c, g, or t
gcctgcaacgccgcctttgtggccagtctatgcgtgatgcgtgctgatccatcacatggtgagcataggtatccagccatgatttgatcccagggtatcagaccacggttggatatcgcacagctcggacctgcagggcaccgcgtgtgtgccagacgcaagtacacagctatcgctgcagggagggcgctagaagactcatcacgcaagatagtctggtgcataagtttgacttgtggaacgttgcattgttgttcaanctcgtacaacatgatggcacttggaagatcggtcgtattgcacgtgcgacgctatcgttgagagctgnctatgcgttgatgtccgcatgtatagacttcacattgttgttggaccttaggccaccgttagagtgtgacgcgagtcctatcggacgtggctccatcaaactgtacgcctggtggaccactatgagtgtgcgtggggtctgagagccccgctgcttcttactcatgttcctaggccaattcacatggcgttgtcgtttggctattaggactaattgcgagtttaccgaggcctgctaggggcgtagaagtcggacttcgttgcgtacgcgtccggacttcaccttaatttgagttagatttgctcattgcgaaccgtgctctggattgaggcaagtgcgctctgacaagagcccaacttcgccattttttctattgagcccaggcgccgaaatagccgaaatttctaagtctttgagaaggcgagaaaccttccgggcgcagagttgcgcattagtttgacagaagaagagtgcctttgcaagaggagcggaccaagtgagttcctgaggaggaggttgatcaccccgttcagcgtgctcttgagaaggaacgtcttctggcgaacgagcgtgtcaattgaaccttaaatttggccccagttaaaggccattctgttgggcaccggttttccgttaggggaaatatgttgcaaacgtaacgccaatttagaggttatgaccgcacccctaacagaaatttccaaagggggaacgttaggtgcgacacacccccggataggttttatcggtcggcaggtttcgcgcagggaccaccgattgtgtgagcacaacgcaaagggccattcgcccaggggggtagcaagatttggttggaaacgaggcaagttcggttggggaagggggtggtcctttcatatcgttgagaaaagggaagcacgcgtttgatttcaacttggcgaacgcgccttgacaattccctttgtacgcgcacccactgtggtatagtttttccccccatgtttgaggttccttagtgatgcaaaccatttttggcggtgcacacaggagacacgtctactgtagaggggcccataaggttacagagtgtccccctcatgtggcagagggatactcctatgcggcgaggacacatattcacacaacagcaaacaggggtgtgtagtcgcaaccaggagccactagttgttgtgataaaagtctcttagtagcttgtgcgccaccagagtg

SEQ ID NO: 514009 - DNA, 293 bp, Homo sapiens
accaaaaaatgcaaaattagctgggcacgtgcctgtggtcccaaatacttgggaggctgaggtgggagtatcacctgagctctggcagttaaagctacagtgagctatgactgcaccactgcactccagcctggtcaacagagagagatcctgtaggaagaaagaaaaagaaaacagaagaagagaaagaaaagaagaggaaaaataaagaaaattaaacctaagcaaaccgacaataagtaacaagattgaagctgtaattatgtctcccatcaaagaaaagctcaggacct

SEQ ID NO: 514010 - DNA, 223 bp, Homo sapiens
tggatagggtcaactcctctgttacttaactgtttagtccatagaggaacatctctgaggacactatgcatcattatcttgttgagcagagttaaaaatttatcacccatagtaggcctaaaagcagccaccaattaagaaagcgttcaagctcaacacccactacctaaaaaatcccaaacatattactgaactcctcacacccaattggccccttatcgag

SEQ ID NO: 514011 - DNA, 132 bp, Homo sapiens
ccacccaaatgctgaggtccggggggtctgtctgcataagactcatagtcagtaatcttcttcatcgggggaccgggtggttgtcctcaggcttttgataggcagtagctaaagtcaccaggtgtcttccct

SEQ ID NO: 514012 - DNA, 505 bp, Homo sapiens
  misc_feature (274)..(274): n is a, c, g, or t
  misc_feature (330)..(330): n is a, c, g, or t
  misc_feature (400)..(400): n is a, c, g, or t
  misc_feature (415)..(415): n is a, c, g, or t
  misc_feature (433)..(433): n is a, c, g, or t
  misc_feature (437)..(437): n is a, c, g, or t
  misc_feature (488)..(488): n is a, c, g, or t
  misc_feature (505)..(505): n is a, c, g, or t
cctgttggtgcggatgatgtagttggccgggaagccgccacccatgttgatcagcttcagctcgatgccgtcttcttctttcaggcgctcgaagatcaccttgaccttggcgatggcggcagtcccacacgctgatgtcacgctgctgcgagcccacatggaaggaaatgccgtaaggtaccaggcccaggtcgcgggcgaggatcagcaggtccattgccatgtcggtctggcagccgaacttgcgggacagcggccagtcggcagtggtggngccttcggtcaggatacgcacgtacactttcgagcccggtgcggccttggcaatgntgcgcaggtcggcttcggagtcggtggcgtacagacgcacgcccttctcgtagaagtagcggatgtcctnggacttcttgatggngttgccgtagctgatgcngtcngcgctgacgccacggtccatcaccttgtcagttcgtagatcgaggcgatgncgaagctcgaacctttn

SEQ ID NO: 514013 - DNA, 580 bp, Homo sapiens
tggctcatctgtcaggctacactcatagtttcctcaagttcaagtttagaatctcctggcttacaaaaccgcttttctacttctaacccaacgaatcaagcattcggtcattcggtcatcctccattcatcggttcactcttttaatctattcaaccatccaggcacccattcaggggtgatggataggctccctagggattctatctgggggatctttaaacttccgggctggctatgaaacaaacagtccggactgatgtggcgagatatcaggatgacatggcgccatgtgcactctggaccgcaacactcacactgtctagtgactcccaaagcaggcgctcgctcacataagcggcatgggctcgctaatagcctcgaaacctggtctcagaggatttcatattattctgtacttaaatccgagacatttcatttagtatgatatgttacaaatcacaatttgtgttatatgttatcaatatgtaaaccgtacaatatgttacgaatttacaaaaaagtattaaaaggttaagaatttgccaaaggtacaatatgttacgaattctcattcgtaa

SEQ ID NO: 514014 - DNA, 451 bp, Homo sapiens
  misc_feature (6)..(6): n is a, c, g, or t
  misc_feature (33)..(33): n is a, c, g, or t
  misc_feature (124)..(124): n is a, c, g, or t
  misc_feature (177)..(177): n is a, c, g, or t
  misc_feature (338)..(338): n is a, c, g, or t
  misc_feature (368)..(368): n is a, c, g, or t
  misc_feature (392)..(392): n is a, c, g, or t
  misc_feature (423)..(423): n is a, c, g, or t
aaaggnaaataagatttctcgtaagaaaccgtncccacatctttaaaatgccccatttcgtggctcccaaaagatttacacctccacactgaggccggaagtggttttcccctataaaacatgncgaaaagctttcttgtctccaaggaaacgccacgtaatgagtcaaagctgttngacgcgcagaagtacaagctaccggaagtgatgcgcccctactaaagccttggggttagtaccgtcgcagcagtctcttccgacagttgtgttgtgccaatggtggagaagaaaacttcggttcgtcccaggaccccgggagcgcgggtgctggaccggtnccggcacgtcgcatcaaccggcagctgagncctggagaatgacaacttccaggnatgaccccacgcgggcttccctcagctcggnaagagactgcctcagtttgatgacgact

SEQ ID NO: 514015 - DNA, 835 bp, Homo sapiens
gtgacagagctagactctgtctcaaaaaaaaaaaaaaagatcaggcccaggcattgtagtgagacccctgtctctacgaaaaaatacagaagttattcattggtggtgtatgcctgtggccccaggtacctgggagactgaagcggagccattgcctgagcccgtggaggtcaaggctgccgtgaaccatgatcaagccacttgcactccagcctgggtgacagagaggaagacctgttgtccccccagaaagaagaaacatttagttgcagtcaaacccacgttctgtctccctaccattgtgtagctgtgggaccctacacaggtgaaattgccttttgagccagttgccctcatgttaagatctcgagatgaccattacttaaaattggtcactcgcatatatcttatgttgtggtgttacctgtgctcgtttaatgtaattggtgtaaagaaccgggttatatcccctactccaaaaggagcttgggccatggagagcctttcattcgtgaagtaaacaggacttatctccttctggtcacagttgacgcaatgtgactgcgatgcgctcgacagcttgcccgcagtctacccacacccccagactgagatttgaagaagaagcaagttgacgtattcttagaagaccagcgggagtaaacttgcaaggcttggagaattcgggccactcccgggacaaatcaaggccaatgccaggggcacctggtgctatatacaccgactctgagggaccgggtccaccgggccctggcttggaagtggtctggtcccaaagttggttggagaaggatggccggggtcaaactagggc

SEQ ID NO: 514016 - DNA, 375 bp, Homo sapiens
gtgactagttaacttcttgttcagtttgttttaatactagtgagagacaggacgagctggatttcctaggccgactaagaatccctaagcctagctgggaaggtgaccgcttctacctttaaacacagggcttgcaacttagctcacacccgatgaatcggatagtaaagagacctcactaaaatgctaatttggcaaaaacaggaggtaaagaaatagccaatcatctattgcctgagagcacagcgggagggacaatgattaggatataaacccaggcattcgagccagcaacactacccgctttgggtcccttccctttgtatgggagctctgttttcactctattttactctattaaatcttacaactgca

SEQ ID NO: 514017 - DNA, 1886 bp, Homo sapiens
  misc_feature (1886)..(1886): n is a, c, g, or t
ggaccgccatgcagctgacggtgaagggcgctgcacggccgcgagtgcagcctgcaggtgccagaggacgagctgtgtgtccacgctgaagcagcgtggatcatccgcagaaagcttgtagacgtcccagttgctgccgatgcagctggtatgcatgttctaaggggcaaggccctggcagatgggacacgacatctcggattatatcatcgtggctcctaactccatagcttctaatcttagtgtgtcgataaccccttggtagaaggtgctacttagaaatgaaggtcgaggcccagaggcgtgggcgactcgcccaggccccgagaggtctggacaggtgagtctccaaagtcattggcccgccatcttcagtgctggcagatgccaggtcagggtcctggaacagtgtacagacgggattacggagaggtccctgagttcgcctgactgctggacgacatcgaacggttggcgcagccgcgttcctgcaccctgaagatgactgagaacaatggtagaagggcttctccaaagtagcaattctcgagagcatggggaggtgcccaacgccaggctaccgctgcatgtcgcactaaggtgtgttctcctgttgcgagatgggctcatcatcgatcatagctgggcatgtacctgggcctctggcccaaggtgctagcgcacctccttcacagcattgactgggttatgttcccaacctcaggagaggagacccggacaccagaggcaccggggatgagtgggacagccaggcgaaagcacgggctttaaaggctggttagaaggagaaagggcctgaaactggactccaactaatgtatccccagtgaaatcacacgtacctcccgcctaacggaacagtacacaatgtggtcaaatcaaccaattagaagagatctcaccccttccgtaatttgtctatcccgcgatctcacgacacatcttcttactgacaacaacagaagagacgaaacacaaacaaacaacagcaacacacagacagacacacacagaaacgacaataaaaaaagcaacccagagcgaaaaccacacaacacacacacagggaacgacgcaagcccacgggagaaaagtgcgagcgagagaaggagcgaaagaggaaaagaaaaacgacaggaaaaggacaggagcaaaaacacggagagaagaggaaggagaggcagacaagcgacaccgccacagacagagagacgaacgaggccgcagacaggacggagacgggacggagagagaagaggaggaggggaggagggggaggaggagaggaacagaaggagggagaggacgaggaaacaggagagcgccaacacgcaagagcccaggcaaacaagaaagcagaagagaaaacaagaaaaccaacacgagcgacacacacggcgcgagccgagagagacaacggcagagacgagcgaggcaacagacaagaaagacggaagagacagagcgagcagagaagagagagagagaggagcagagaagagaacgaagaccacagagagacgaaaggaaagaagaagaggaaggcgcacaacgacggaacaacacagaggagcagcgagagcaggcaggacggagcggaagtggaaggagcggcgacagagaggagaagagcgaagaggagacagaagatgaagagagagaacgcgcagaaggcgagtgaacggaagcaaggacagagcgagacggaggagacgaagagaaggaagaacagggagagcaaggaggcgaggaaggacaagaccgagagagcagagaggacgagcgaacagacggggagagggagagcaggggagggagggagagcgagacaaagaacgagcaagacagacacaaacacacgcccn

SEQ ID NO: 514018 - DNA, 96 bp, Homo sapiens
  misc_feature (38)..(38): n is a, c, g, or t
  misc_feature (86)..(86): n is a, c, g, or t
acttctaggccgggagaccctcgggcctggggcgggtnctctggggagggtccactgtgttactggccaccgcaggtcgccaccanccctccctcc

SEQ ID NO: 514019 - DNA, 143 bp, Homo sapiens
tgccagcgaaccagcacgtcctttgggctgaatgcctgcgtgccagtgcacgtcagctgtcaccagctctgtacagtgaccagctcctccgacgtgcggcgtgcagcagtgtggacctcggtgcctggaatgtgtttcctgga

SEQ ID NO: 514020 - DNA, 1397 bp, Homo sapiens
gacagaacgtccacttcattcttggctggcgatggacttctcatcgtcgtgcatcctcctctgccttgctgtgctggtatttagttgtctgaggctgtgccctccgggcacctggtgatagtccgaatgtgtcctcgtgtctggtcgaaagtatctcgagtgctgtccggtcgcagtcctcgcccgtcgatgtggccgttgcttagttgtgccatcaagaggcttgttgatagacgtccttggagaatgccgatattcgtcgtacttcgggatagttgcctagtgcagtcatttgggcatgcgtggttattggcgtttgcaatagtgcattgtaggcgacgtgacatttcagtatgacatgtggcattagtctcccaacgttagggagtactagaacactcctggtaatccttttaggctcggggaaagtgtgccaccttttgcgtctttatccttactctccccactttttcgcaattttaacgatttgattgggcaggcaatgaggcttgtggccaattttgcttatccaggccaccacctcggactccttccccgggacctctcccgcggtgggcgggtttaagcgagtccaattttaggcgccggttacccgtggctctgttgtgttgccacctccctttatgttcccgtgtcattttccccctcttcgatattgggccctttgttccggtgctatcgccacacttgctcgccaaaggggcgacgattcgcaagggtgcaaccctttttcctttccgcgttctcagaggttggcggtctccctttgacatttgtggagccagatagttgggaacttagacggtgcagttccaccatgtgttgttttgatagtccctttacagcatggatagattggcccccgcattgtttgttttcccactttaacaccattggccgactggtggttttcatacccacccgcgtacaactaatttgcattacttggtcctagaaccagttgtctatccggcatttgcaaggattcaaacgtattataaacggattatcgcccttgtgttgacacaaggggccataacaggaactcttagaaactttttagggccaaataggtaccgttgacccgcctcttgcctatggtgagaggcgtcagcacacagcctcttggtagccgcggcttttagaacagctagaacgtcctcttgaacaagaaagctccaggttttacgctgtcgaggtcaccggcccgggccactaattcgagatttttggacagcggtagctggcatagtcaaggttaacttcagagcgacgctcttcggcatctggcacaacacgtatacctcgtgtaggcaacagacaactctacttgtgcaccgcaaggctattgttttccacaccccaataaatttctc

SEQ ID NO: 514021 - DNA, 205 bp, Homo sapiens
tccatgatggaatgtgtgaccttataacaagagaaccagaaagctgtgctctctccatcccctcaccgcatgagaacacagcaaggatggcagccacctataaagccagggaagagagccctcatgaggaaccaagatgggccagcacccagagtctgggcaattcccatgtctccaggagctgtgagaaaatacattttctggt

SEQ ID NO: 514022 - DNA, 1049 bp, Homo sapiens
  misc_feature (304)..(304): n is a, c, g, or t
  misc_feature (391)..(391): n is a, c, g, or t
  misc_feature (403)..(403): n is a, c, g, or t
  misc_feature (444)..(444): n is a, c, g, or t
  misc_feature (510)..(512): n is a, c, g, or t
agacaaccttagccaaaccatttacccaatagtaaagtataggctgatagcaaattgaaacctgagcgcaattatgatatagtatccgcaaggtgacaacgatgaagaaagttagtaggccaagtcgataatatagtcaacggacttaacctccgtatacctctcctggcataactgacatgtaacgtgagaatactagactttggcagagcgatgagactcgaaagtcttaagaacaccctcgtagaactcagcacgaagtcgtaccgtgaagaaggcagactaaaagtagtcacatcgccgntcatattgctagtccataatattaggtcgggcacatgcatgttactgaggctacgacgtgccgatcagaactcgttacctgtaggcnctgggctgtatnatgcttgggattgctcgcatagcatgaggacagtctctagncttcacacatgttcaagagttttagcgcccacacgaaactccgtactgagaatgcccgcttgctcnnnaatttgaactagttgagctcccagagcagcagtgcacacgacgctccttatgcgagcgacgtagcgacatacacatacctcttggtacgaagaagacgtcaatacacacaattctaagcaaccgcattcagtatggggcctaagaatatctggcccagctcaatctgtacagacaacggcgttgtcacagcgtcaatgcagcgcacttaccgtacaaagaactccgcaaatcgatataagctgcaactccatcatcactccaaatctggaccatatctagtcacccatatacgacagaactacatgttgacgtataaacttacacatgcaataacatactcctgcggcatcaagcctgcgctcacatttaaacacgactgaaactgaccaattaagcagcccaatatctacaatcaaccaacaagtcattattaccctcacttgtcagcccacatacccctccccccctacaccgacacacctttgcgccccccctaggcctcccgagacatctctacaacccatcgtcggcgcacc

SEQ ID NO: 514023 - DNA, 133 bp, Homo sapiens
gcttggttcctcccagctgtagagtggcttatacgccagatctcgctaccttcttataagaagaaggtgacatacgctatttggacaatgtgactatgtggcggttgaagggcggtcgactagggggattggg

SEQ ID NO: 514024 - DNA, 271 bp, Homo sapiens
gtactacagactcacagtgctgggcttcaaggcttgcattctgttggagtctgtcagccacacaggacacatcttgtgatgcggatgacgtggaagggtggagccgcaccggatatggaagccactttggcacaactttttaaccatgtacttattggaacaaattcgggcagctccagggcttcagaggacagctgctcatattcatctgacaccatgtggccacaaagcggaaatcatcactttgctttttccgcccaggtcaaaaatg

SEQ ID NO: 514025 - DNA, 1236 bp, Homo sapiens
atggagtctcactctgttgcccaggcctggagtgcaataggcgaaatctcggctaactgccacctccaccatcccaggttcaagcgactactccagacctatagcctcccaagtagactgggattacaggcactcgaccatacttgcctggctaatttttagtatatattgtagagggggttatcaccttgcttggacagacatggatcattgaaccccagaacctcaggtgatctgcccactatcagccatcccaaagtgctgggattacaggcgtcagccacatgcagcccaggacagatgtgatactctctggcattggactataacattctagacaaacagcagcactagtagtagccctgcaccacatgccacatttcacatttcatacatcgtcagccagtctctcttgctaagcaaacatactttctccaaggtgcacatcccaagatttggatctatagtgtttgagggaattccacaggcactcattgccatacctggattatataatcaccagttgtcaaagcaataatctatgggcgaaaggattaaatcaagaaaccagaagtttggaaaagtagagtaaggtggcagcaaaacctcttcgcgcaagacaatctctcaaggcgggtactaggactaggaaaaccatagaagctattacgcttctaataaacgccaggggatcactacattcttgggagcccttacaagggtaaaaccacagcacttacaagaccatgtatcacaatacctgccaatttcggccactacagacatacacaggtggccccaaggcgccccccgggcctgaagacacccaccccgcacgggccacacaccgtaccgccacacatcccaccaaaaagagaaagaaccaggacccccgacaaaaccgaacccgcgaaccgtaaaacccacagagcacaacatccactagtgaacccgcggaaatggcacaggcagggaaccaggaaagacccgcagcctccatgcagcagggcaacagaacagaggcagaagacgagaagagggcagaacgagagagacaacggaaagaacagacaacgcgacagcgacaacactacaagcgccggcagcgcaggctgaccagggcaacagaaaagcggccggcgcaacagcacaaaacacagagaaacgagaaaagagagagcaaaacacgagacagagaaacaagaagatagcgacacccgtaagacacaaaaaaga

SEQ ID NO: 514026 - DNA, 413 bp, Homo sapiens
aatagtcagcaataggggagacagatacagaaatagcagacactctataggaaatacacctatttcatgaaaaaaattctatagagataatttatctattcgacttttcttagcttctacaaatttctataatgagctagtgagtactttagtaataataaaagctttaaaaagtataacaagaaataggcaaggaaaccaagtctgggtacatctttcacatttaggtgctccctcaaatggtccaagatactgagaaaggactatgtacttagaattgcataaagagtttaataacatttaatcccatttaagcctctggataacacaacgaacaggtaatattactatgcagagaaactgaggaacttcacagctctagcaggcagcaggactcaacacttcaagccaaa

SEQ ID NO: 514027 - DNA, 204 bp, Homo sapiens
cggccgcatcttcttttatttaggatctataattcacccaatacattttaagaacaatttacaaactcaagttcatagctggtgggaatacagccacataataatcttttaaatgacaaatcttcataaccagttactaataaataatcatcatcacaatagcttcagtaaaaaaaccaatttaatttaaaggtgctttcttat

SEQ ID NO: 514028 - DNA, 496 bp, Homo sapiens
cccagcccatgacccctaacaggggccctcttctagccctcctaatgaccgtccggtccttagccatgtgatttcacgttcgcactccataacgctccgtcatactaggcctactataccaacacatctaaccatatactcaagtgtctggcgcgatgtaatcacgacgaaagcacagtagccaatggccaccagcagcaccaccgtgtccaaaaaggccttcgatacgggataagtcctatttattacctcatgaagattctctttatcttcgcgcaggtattctctgtctgatgccgtttctagccaacgtccatgaccgtaggcaccgctacccccgccaaaatctaggcagggcgtcactgggacccaccatagcaggtcgatcacgcccgagctgagtattcgccctaataaggtcccatctgcctacaagcactattccctggttcattttaaacctttacgggccatttcaaggggaagcttattcact

SEQ ID NO: 514029 - DNA, 515 bp, Homo sapiens
gcggatcccgcggctgaggaactcgcacgagtattttttttttctttgtagtcaaggtcttttattaacttaaaccggtacttgccttccggcttgttgcaacaagttctttttacaacatttgtcccactaatttctttctaagagactttgcggtaaccccccaacaccacaatttataagaggggccctttttaaaaagcgcctaattttgccattctcatccaccttataaaattttagggcagcccgattaacctcctttttttgggcctatccttctgggaagggggggaaaacttatttttccttttcttaccccccccccaaagttttaccccatcatgaagggttaccctctggccaaattctatatagtttataaaaatccggtaaccttggggggggccctggtccccattacccctaagggggggcggtacaactctcttggccgcgcgttaaaacccccggaatgggaaaaacccttgggtccccaaataaaagccttgaag

SEQ ID NO: 514030 - DNA, 102 bp, Homo sapiens
cccctcataaccgtggtttgggacgagttggctgagtcccttccaactcagttccatatctgtcaagtgagtatacccatgtgcgtcaaaggataacggttc

SEQ ID NO: 514031 - DNA, 796 bp, Homo sapiens
aaggcaagggaatcaataaatttattaatggttactttaacacgaatctacaaagagacctttcgttttgtctggaccccaaaaactaataactgaaaagtcattttcccaaacctgtgagctgtgtttcacctacctgtgctacccctcacagtgtgctaattaactggcaaatggccatttgctggggcttcacacacattccggggtcttcccctttttctggatgtgacttccctcccttaccccacacctccctgcactggtcccctgtctgtgccctgtggtggaaatgccctcgagcctgtttcagcccagacaaagtattcatcttaccagtccatgccctggactcctctggatgtggtcacccttcctctggtaatcacctcttacccggtggtatatggggggataaaggcttggataggaaggctcaggtaactggagtccctgtgggcactttggaaaaccagtggccaccccgatgataaggaaggacagacccggggacttcccattatcgatatgggatatgatcatctggactatgcaccctcactaactggatggggactcctggctggttacccccaaaagctcaaaagaacccctattgggccaggacacagggcttttccaaagtaaggtcaattctcggaaatgtcgagaagagcaaattaacgacctgggaacttttccagaacacaacacaacaaacaccaacacacgcaaaccacacaaacaccgcaacaacacaagagcgcaacaacagaacgcgacacagaagacaaga

SEQ ID NO: 514032 - DNA, 390 bp, Homo sapiens
tacgattggaacacggtgtccgctgcgtcaggacaaccggtcccgtcgcagacggagtgcacgtgccctgcgctacatcctcacgctcggtggagggacccgtgcggcgggacggtgcctacgggtacttgcagctgtgacccatgtggcaacccagagctgcgccctggtggtctctgtgagcgccacgctagctgtgctgaaaatgccggtttaaaaagggataccgagggacactacccgtctcttacataacgcaataattattagtatggggtaatgatagattctttcgaacaaacatatggggtatcaaccaaataagcggtccaggagtgagcagctccgttctagaagatgctactccaaatgttaccaaagacgagcact

SEQ ID NO: 514033 - DNA, 147 bp, Homo sapiens
acctcggacacacgggacccactgcgggcctctgcgcctctgtaccaccacctgctccgaccctctgggacccaccggtcggcggcctcctgtacccgacgctttggcgtccccgtcttcgtgccacgttgccggggtacccgacgc

SEQ ID NO: 514034 - DNA, 123 bp, Homo sapiens
caaagattggacattctttgaatgtctggtagaatgctagcgtgtgaatctgtctggtcttcagcggatgatttctccccttccatccccaactcctgggataacacatcaggtttttcgcca

SEQ ID NO: 514035 - DNA, 219 bp, Homo sapiens
  misc_feature (49)..(49): n is a, c, g, or t
tctctccacactggacagaaaccctacggagtgtgcgtattgtcagagnaagcttcaggaatcagagtagccttgctgttcacaggagagttcacagtggtgagaagccctatagatgtgatcagtgtggaaaagccttcagtcagaaaggaagcttaattgttcacatcagagtccacacaggcctgaagccctatgcctgtacccagtgtggagaga

SEQ ID NO: 514036 - DNA, 200 bp, Homo sapiens
ccctagacaagcatcctatctatgttccacagcagagacattgagtataccattggcataatgtcataagtgacttcaatctgagtgaacacctcgtgggttgcagttaggtgatgatggggttgcaaactttctccagctctttctgttgatgttcaaatccttcctgtacggcagtctgattcttatcaagccagttg

SEQ ID NO: 514037 - DNA, 98 bp, Homo sapiens
tcgctatatagtgagagagatatatctcgctacactgagtagagagagctctctctctctcgcctctctctagagatatatagatagagagtgaagag

SEQ ID NO: 514038 - DNA, 132 bp, Homo sapiens
actaggtgagaccttctctgatctctctcttatgcaaaactatcgttatctagttcctctttgacacctgaggaaatacaatcagtgaattatgggtcattatccctgtacactacatcattaggcctagct

SEQ ID NO: 514039 - DNA, 419 bp, Homo sapiens
ctctagtagtttgcagtatgatatgtcgccggaagctgcactggagacaagcttgtaaatatatacagaagacttgattgtagcgagtctgatcaaagcctaaactgctgacacagaaagatgtgctcaatatgtgccgacattagaagcttcaggacccaaaggataacgtatgcatctatagtctatacctgctccttagctagatcagtacccgctgctgcgctctaatgaagcctcaggatatgcacatgttgactacatctccactggactgtttcacggtgaactcccatcatctgactactatgggaactatgtgctgcttgactgggcttataatgagcgtcataatgtggaacaggccaatggtatacagtctcacaggcaagaccatcaagatacatttgtacctctgg

SEQ ID NO: 514040 - DNA, 844 bp, Homo sapiens
  misc_feature (9)..(9): n is a, c, g, or t
  misc_feature (21)..(22): n is a, c, g, or t
caaaaaaanaacaccaccaannccccaccgcaaaaacacaaaccacaaaacaaaaatattattttccaagagcacgcctaactgttttcaattgcattacgaagaacacagctggaagtctgggcttctttttgtaggaggttatgaagaatacaatggaaacaaaccttttttcatcaaatccatcgttgaaggaacaccaccctacaacgatggaagaatcaaatgtggcgatattcttcttgctgtccccggctcaaccacatccggaacgacacacgcctgctcggcaacactgccgaaagaacctaatggaacacctattactcccattcatcactgaacaccccctttttacccaaccaaatatccgccccgactaataatatattttcctctaatgtatacaagattcaataaagtatttaaacatctcagaacctaattattttcatctttttttcgcccggttcattggcctttatttttttttcctttcgttgtaacaaatttttctcaatacccgcattccattccccacattcttcttttttttccccctcctccttccccttatttcttctttttatttttccccccccccctcccttcatctcgcccataccccctattaccctccctttcacccttacttcccaccctcccctcttcttcccgccccactcacactatacgcccctgtcccacaaaacttcatagcacctcccccaatcgcctactagtttccccccacccatcccacactaacatttgtttaccgcacgatacccatctcatagataattttgccccagctccactaccacacttcttcaaatctccc

SEQ ID NO: 514041 - DNA, 949 bp, Homo sapiens
  misc_feature (1)..(1): n is a, c, g, or t
nacgcgatcgcgaagcggggagcctatctattcgtcatctgtgccctgtgggtcttctccggaattgtttcccccgcgtactacgttctgccaaggacactttgcccagtagcatattttggaggctctcgttctatttcagggggttgttctatttctgtcccgttgtcccccattgcgccaagcaatgtgtccgtctgtggtcgttggtctctcgcgttccattagtttttccgcggtcgagtattcttgtgattgagcctccgtggctacatcctcgggtatagtccccctccgtggacaaatccccgagccaccgaggtgcgtccccccccggcaaatgtttacagcgggacccccgcgcgaaacaaggaacagggaaaatgttatggcatgcgcccccgctgcaataggatttctgtgcggagaccacggaccgttgttaggaatcgggcgagaaattgggttcttgtggtggttcaaaaacgacccgcgttcaagccaccgaagattgctttttcccctcgccgccagttgtattatgagcccaccttggagtggcgagggcgcgacccccattcagtattagggtctccctcaactaaagataggtcccacgagtttgcctcacctggaccaatatgcactaccaaggtgcattcagggctagtcgacccctctgctcccatgttggaggaagaacagtcttgtagagtttctggtatcgtgatgaggacccgaagacccacgattctcccatgagcataacacattcggtgcaccgtgggcaaccggctcaaccaggggcggcttgcccataaaacaaggatgggacatggcgagacatatattcaacaagaactacgggtacaaactgttccctgtacccacaaaaaacgattttcccggggcccaaaaaaaaaaacattttttacaaccacacaaaaca

SEQ ID NO: 514042 - DNA, 124 bp, Homo sapiens
agagatgctgggactaccggtgtgtgcacgatgccaactaattggtaattggttgatagagacgaggtcttactgtgttagccctgcctggtcccaaactcctggcctcaagcgatcccttcac

SEQ ID NO: 514043 - DNA, 127 bp, Homo sapiens
gacagtatcacctatccattaatccttaagcagaaatacggatgcactctatattaccttgagcatgtgtcacacagatggtgccgtgcttatgttaatcaaataaccatgttccacaataacatag

SEQ ID NO: 514044 - DNA, 139 bp, Homo sapiens
gttgccaagatagtaccaaatggaaagagatacgttgtccaagtccatttacccatttgtacagctaaaaattaaagtgaagtagaaatagcataagataacagacaaagtatattattttaggtcacttaacattata

SEQ ID NO: 514045 - DNA, 993 bp, Homo sapiens
taacaggagcaaaacttatgttaggggcttaaaaaccaggggatttggccgggcgcgtggggcgctcatgcctgtaattcccaagggtgtctcgagattcgcacggcgtagacgccattgcacccgggcctgaagcacgtcttaaagataactttttcaagatctttattttatttttccttatagagtggtgcacagacatggttggggcgacatctccccaatctcttggggggtgaaattgggcccacaccacaaaccacagtgtggggccaagaggctatgtggcccacaatttcgtgagcaattctttctttcacaacagcgcgttacgacacatctcaaagccttcctccgagtggaagacgcctcgaagtgcactctgagacacacacccgcggggagccctctctttattacaccgcgtgggccattttccacctcctttgagcggggcgcgtttcaacaaacaccgcttccggtgggaactattttttaccaccactctcttgttaggcgagagaagcggcgagacacactctttacccacccgagaaacctcttctgatacacaccggggtggcggacctgtagacaccaacggtttaccggttgcggagaaatttaaatattttgcagctcacgcggaaggccttctggcgaacaatgtggcgcgctatttagcgcgggccccggtggaacaatctccacgatacaccccccacaagggtgtggctttgtcgtctcgttggatacccgccagttgttgggggggttcttcacaaacaccaccgcgggggagacgctcttaaaacgcaagaggtagaacgaagtgctctatcaccccagtggtggtggggagggcctagtgggtggggcgggcatattttacaagtatatttccccccacagcgtgtgcacgaaaatttgtggcgccacatttctcgagttcttgggggacagagcacaaccccattttacgctctatacaac

SEQ ID NO: 514046 - DNA, 171 bp, Homo sapiens
gcaccctccacctcctgggttcaggtggattctcctgcctcagcctcccgagtagatggattccagccgcctgccatacgccagctatgttgtactcttagtagagatgggatttcctcatatcgggcagtcctgacctcagtgatcaccactttgccttccaagtctggg

SEQ ID NO: 514047 - DNA, 1043 bp, Homo sapiens
  misc_feature (159)..(159): n is a, c, g, or t
  misc_feature (234)..(234): n is a, c, g, or t
  misc_feature (653)..(653): n is a, c, g, or t
  misc_feature (664)..(664): n is a, c, g, or t
  misc_feature (669)..(669): n is a, c, g, or t
  misc_feature (680)..(680): n is a, c, g, or t
  misc_feature (682)..(682): n is a, c, g, or t
  misc_feature (716)..(716): n is a, c, g, or t
atctcaggccatctgcagagaagaaaggtggtacataactttttcttgttagcatttggtaggggtgttttattgaccaaatatgttcccacaacctagttttttgtaactgactaaatatagtagatttttaaattttatcatcaaaatctatagacnatttttgattaaaatagactccacatctatgtcctgcttttcttcttattattaattacattgttgtataaaagnacaagacttcagaatcaagaatatcttgtctcttggcattgaatttatacaaggtgctctttctttaatgctgtctcaaaggacatattttttactcattaaaaaggaagatcagaatctagttgtatgcattgctccaacatattagtaattaaaattaggaggtaaatgtggtcaaagcgatagaaagacttgagatgtcatttatattgattatagcactctacaaacagaaattgttaaataatagtttatataaatattttgtatcatttcaaatatttgagtgcctgaagtttctcctcttgtatagttcagattatcaatttgaagacttactccgttagttaaaatgtttctagtctcgtttattatataaaagcaattttcagttaaatgtgttccgcttacataaaacnttacaaattantgagnatttaattacntnttcatgttcctgtaatgtctttagaagattttcntattattacctatcaatatatgtatgctttgtcaaagaaaaatcaaacatatatatcattgaaattgaaactttttaaaagtacttattaattctattgaaaaaccacatccataggaacaattacaatataatattgtgaacatgtaaacatataccctatgtctattttatgtataagcatgtatgattaaaaatatagtgaagaatttttaaacctagtattataaagtaaaaattagttaacttccgatgattatttgttaattaagataaaattattttgatttgggtgattttaaataaagaaaaatattaaattacatga

SEQ ID NO: 514048 - DNA, 191 bp, Homo sapiens
actctagagtatccccacaccaggctctagatgtctggttttcccagataaaaccttagttcacctttaaattttttactcctctctacaagattaattcctactttccacacagctatacctctttgtacaaacagttaaatttacaaggtgatttagagggttctgtgggcaaatttaccgttaactgc

SEQ ID NO: 514049 - DNA, 1393 bp, Homo sapiens
ccgatggcggcgtcactgacgctatacgatccggtcctcggatcccgagcgcggggagtgcagaccgactgtgagctagcttgtaccccatcctgcgtgaccgtacctggggacacagagccctccgatggtagcccggtggattaggattaggagccaggacctcacttacctcctacatgccccatgacacacctgtcccctacacagcacctggcccaacaaccactgcagcaccagacacccaatgagaacatggcaccatgaggtgagactgattaggagatccaaggttgggtgtccacacatcattcaggaccatgagaaataacaagaaagacaatgacatcatggccctcactgagggagccagtgcaaccccaatcctgacgtcgcgaccagacgactcactgccacaccgcgccgcccctggcagccgcaccaaccaccggataccacacacgatccgacgactgacgcgacagggtaaggcccagcacacgcgggaacgcgagaaaatcgaggaacccccaggcgccacccgaggacaacgcacccactgcacctcctgagtggcttggcaccccgcctgctgcggaagaaatgtagatccaggtgtacatctctttcctcacctccgccttttgtccctaattcaactcgcccatgtgtcactttgtcctccttcttctgcttcgcctgtacacgttttcactcactttggtcgcttgcgccccaccggcccgcacaagaccgggacccaccccgacgcaccgcccccgcacgcgccccccacagccccggcgaacggcacaacccacgccctggcgcccgacccccacggctagcccccaccggggccggtcccatagatgacaacccgctcggcacccccgtccccaccaacccccacccagcaccgcgggccggaccgcgacgccctagcggacgatgagcaactcaccagcgacccaacccgcccggaacccggacgacgccccaggccaggcggcacacgcccccagccgcgcgcgcccgcacaccactcgtacccacgccccgctacacccccccccccccctgaagtccccccagaccagacacggcaaccaggcgcgccaccgcccgcaccctcccagagcccggccggctacccacccgccaccccccaccaccgccaccccccccccccccccggcgccacccaggccagccaccaacccgccggcaccggcccgccccgcccagccaagggggccactccacgcgcaaggcacacccccgcgcctgcacaccaaccacaccacaggcaccgcgaaagacgcacgcgccagagcaccccacaagaggccaacacacagacaccgcgcgcgccacagcccataccaccccc

SEQ ID NO: 514050 - DNA, 797 bp, Homo sapiens
  misc_feature (167)..(167): n is a, c, g, or t
  misc_feature (258)..(258): n is a, c, g, or t
gagacccctatggattgtgaggccgcctgggcggagtcagcagagaagagggactccctgtgaactgcggtctacagcgcagctcattatcaaggatcttggagaaattcattcaatggtctttgggatcacagaccagtttatgcaaggctgaaaacatcgtaacngtgtgtaacaagatacttgaatgaagaaacgtggtctacgagaaatgcgagtacttgaaaattggaagaacatgatccattgaagacaaantgacacatacgtcttcccaaattgtagagacacaaagcgggacagcctcagccatggttctccagaggattgcaaggcatgctaatgacgtcagtctgttagactccaagcagcagtggaacaggaacgaagaaacgattcatagtgaccacttaggtagctagtgagaaacagcatatgctccagtgggacaacttcatgaaggatgcaacctcaagcagaaagtggctgacgtggcctgaagagcacagaaagagccatggaaaggcttaacagaacaatatgctgagatggagaaggacctagcgacattttcaaccttttaagaacttgaaccacaacaatcacaaactaatgagaagatgttcacctctctcctgaaaactattcccaccagaccgtttagcctctgcttcaagcttagcaactatattcacgtggcactcttatatcagaagaaagaagtttctactggcattctgattggatatttaaagaagggtgccacatttttccatgctttaaggtgcctatatatg

SEQ ID NO: 514051 - DNA, 230 bp, Homo sapiens
gagaggacactggcagcgtgctagtactgagggagtgcaccagcattgcagacaaccgtaggagccgacgtcggaacaaccatgggcatagcaaccttagacggatccgtaaggaagggagctacctttagcctgtagtttcaaggggggtctcagggtccacatgctagacaacgggcttcaggtctactaagcggaaacttctacaagatctaaaccacttccaagca

SEQ ID NO: 514052 - DNA, 906 bp, Homo sapiens
tgtggtggctcatgcctgtaatctcagcacttcgggaggctgaggcgggtggatcacctgaggtcaggagtttgagaccagcctgaccaatatggtgaaacctcatctctactaaaactataataattagctgggcatggtggcatgtgcctgtagtcccagctactcgggaggccgaggcaggagaatggcctgaacccgggaggtggaggttgtggtgagccaagatcgtaccattgcactccagcctgggcaacagagcgagactccatctgaaaaaaaaaaaaaaaggaggtgagccatttaacgggagagggaagtctacctagattagcttgggccctgtttggcaggtcccagggctacacattaaagggcgtcgcataattgcagggctcagggccccgtgggagacgtggcaacgggttccccaatggatttctccctcaagaattaccaaagattccattcaaattttatcatctagggggcgggtatgggtccttggtaagtccccggggggacttaaaaagagtggcctactggcttaaagtatcggggctatccaaacaggggcatgcacctcctttcccgtgccctgagggttacacacaaactctcagagtccctgaataagtaggactaacatataggggatcgagcgtaaaaacccccaaggattttaaaagggggaacaggtcccgggccccaaacggggggggagactttatgcccggtgttttccccaaaaaagttgtggggaaggccagggggagggtgaacccaccctgaaggccacggaaatttcgaaaccaggctccacaagcttgtgaaactggctctcttagtagactatacacaattttgtcacgcggcacatccaggaggggatgagggagaaaaacc

SEQ ID NO: 514053 - DNA, 243 bp, Homo sapiens
tgtgtggaacatctattcagatatgtttgagaattcatatatccacaataggataaaaactaaaagagtagaaatctcacacttttccttctacctccctcccctactgaccaaccaggttccaggacattatatcactgtacattaccatattctgctaaatgagagaccccataggcactacatcacactggacaactagcatagtagacataaccgcaccacaacattctaaggtataag

SEQ ID NO: 514054 - DNA, 1205 bp, Homo sapiens
gcgcgagtcataaggtggtctccttgcgtgcgtcgtgtctgtgacgtctgtgcaccagggagtccttgctcccttctcgtctctcttgactgctctctaacgtataccatgtggccttaagtggggcccatgtccaaagcggctttatcgcgcctttataccggtctagtgtcagaccctgggtgctatttcgctagggcgccccccgggaggtgacgttgttgtgcaacttttgcgccgtttcttaggcctgtgtctttgagcctgccgaagccggtgtccgggcacaccacggtggcgtttgacgtcggcccggcggcgtcggcatgccttctccccataaccgtgggcccgggggacagattatacggttagtgttcacttacgcctctcaaaggagggaccaacgagcaatggcagatgagtctcggggaccagcgaagaccaccagcacgtcacctgcaccatctggaggccccaggggaagtcctgatctgtacttcacacagttcaaggcaacgaggtgcggggcgcctgagattgagtacgccatggcctactctaaagccgcacgttgaaacgggaaagtgatgtccctcctgaaaactgaggaattcgaagtgaccaacaacagcagtggctcacaggcccggcggcattcaaagcatgagctgtccaacgctggtgacttgtgcgccaaaggcatcgcgcactgagcatgtgaccagcagccctgtatgcagcggtggcaccttcttcatgctccgcgcgaagctagtaaggggcctagtgtccccgtcgcacaagggccagcaacatctactcggttttctagcgaggcgactcttaaatttatctaccatgggctgtacgttgccattagtccggaggggccctcgcagggtgcatgaagccctggggcagagaaccagagggtccagggcccatcctggctcccaacagcttcttcagttcaccacattcctgatgagctacttctggacatcaggatcgcagatccggggcacaaagagggtggggaacatgcgggctactagctggggaaagcagaccatgcatcccccacgacctccagccgagcatccttcatgagcctgcagaactgctcttcctatcgttacctcagggacctcctttcagatgaactgggaagaagactgatacacttcggatattaaaagccc

SEQ ID NO: 514055 - DNA, 426 bp, Homo sapiens
  misc_feature (67)..(67): n is a, c, g, or t
gcagtcccttttttttgcaaagccaagcccattcagagctttcaaggcattttgggaacattcactncccatgtccgcggaaggccttccttcccctggttaccaaagggagggatggaccaaaaggagttcccccagggtgaaagcaacatgtaacgacccttgttttgagtatcaacagtaccaggaatgcccccccacaaaaggaggaggattttggttaggaggcccaaaaggaggcctaaggcaaagcccccatcccctcagggttttcagttcccttaaccgttttaatcaaatgcccctttcctttcccccaaaaattgggtttgctgcccctattttgttttttgtttttttttttggggggggtttaaaacaaggcctggcccaaaataggcgcccaaaaaaaacttttttgtttga

SEQ ID NO: 514056 - DNA, 2650 bp, Homo sapiens
aaagataaaatggagcaaaaggagaatgtgcccccaggtcctgaggtctgcatcacccatcaggaaggggaaaagatttctgcaaatgagaatagcctggcagtccgttccacccctgccgaagatgactcccgtgactcccaggttaagagtgaggttcaacagcctgtccatcccaagccactaagtccagattccagagcctccagtctttctgaaagttctcctcccaaagcaatgaagtttcaggcacctgcaagagagacctgcgtggaatgtcagaagacagtctatccaatggagcgtctcttggccaaccagcaggtgtttcacatcagctgcttccgttgctcctattgcaacaacaaactcagtctaggaacatatgcatctttacatggaagaatctattgtaagcctcacttcaatcaactctttaaatctaagggcaactatgatgaaggctttgggcacagaccacacaagggtctatgggcaagcaaaaatgaaaacgaagagattttggagagaccagcccagcttgcaaatgcaagggagacccctcacagcccaggggtagaagatgcccctattgctaaggtgggtgtcctggctgcaagtatggaagccaaggcctcctctcagcaggagaaggaagacaagccagctgaaaccaagaagctgaggatcgcctggccaccccccactgaacttggaagttcaggaagtgccttggaggaagggatcaaaatgtcaaagcccaaatggcctcctgaagacgaaatcagcaagcccgaagttcctgaggatgtcgatctagatctgaagaagctaagacgatcttcttcactgaaggaaagaagccgcccattcactgtagcagcttcatttcaaagcacctctgtcaagagcccaaaaactgtgtccccacctatcaggaaaggctggagcatgtcagagcagagtgaagagtctgtgggtggaagagttgcagaaaggaaacaagtggaaaatgccaaggcttctaagaagaatgggaatgtgggaaaaacaacctggcaaaacaaagaatctaaaggagagacagggaagagaagtaaggaaggtcatagtttggagatggagaatgagaatcttgtagaaaatggtgcagactccgatgaagatgataacagcttcctcaaacaacaatctccacaagaacccaagtctctgaattggtcgagttttgtagacaacacctttgctgaagaattcactactcagaatcagaaatcccaggatgtggaactctgggagggagaagtggtcaaagagctctctgtggaagaacagataaagagaaatcggtattatgatgaggatgaggatgaagagtgacaaattgcaatgatgctgggccttaaattcatgttagtgttagcgagccactgccctttgtcaaaatgtgatgcacataagcaggtatcccagcatgaaatgtaatttacttggaagtaactttggaaaagaattccttcttaaaatcaaaaacaaaacaaaaaaacacaaaaaacacattctaaatactagagataactttacttaaattcttcattttagcagtgatgatatgcataagtgctgtaaggcttgtaactggggaaatattccacctgataatagcccagattctactgtattcccaaaaggcaatattaaggtagatagatgattagtagtatattgttacacactattttggaattagagaacatacagaaggaatttaggggcttaaacattacgactgaatgcactttagtataaagggcacagtttgtatatttttaaatgaataccaatttaattttttagtatttacctgttaagagattatttagtctttaaattttttaggttaattttcttgctgtgatatatatgaggaatttactactttatgtcctgctctctaaactacatcctgaactcgacgtcctgaggtataatacaacagagcactttttgaggcaattgaaaaaccaacctacactcttcggtgcttagagagatctgctgtctcccaaataagcttttgtatctgccagtgaatttactgtactccaaatgattgctttcttttctggtgatatctgtgcttctcataattactgaaagctgcaatattttagtaataccttcgggatcactagagctgtcccccatcttccgtgttgaagagtttaaaggaggaagaagaaagaactgtcttacaccacttgagctcagacctctaaaccctgtatttcccttatgatgtcccctttttgagacactaatttttaaatacttactagctctgaaatatattgatttttatcacagtattctcagggtgaaattaaaccaactataggcctttttcttgggatgattttctagtcttaaggtttggggacattataaacttgagtacatttgttgtacacagttgatattccaaattgtatggatgggagggagaggtgtcttaagctgtaggcttttctttgtactgcatttatagagatttagctttaatattttttagagatgtaaaacattctgctttcttagtcttacctagtctgaaacatttttattcaataaagattttaattaaaatttg

SEQ ID NO: 514057 - DNA, 339 bp, Homo sapiens
  misc_feature (19)..(19): n is a, c, g, or t
tgggaagcagaggttgcantgaactgagatcgagccattgcactccagcctgggcgacagagcaagactctggtcaaaaaaaaaagaaacagaaccttgcaaattccattttctaacaaaattaagggatacttgatacttcataaccccaaataggaagaaaagtaggctatataagcggtaaagatcagagagaggttgggtaaaaatggaagagaggatgttggggtctgctgactgaaaaatacaaagccagtagagcccaattctctaaattagatggtgtaccttgacatacaacactcaaattctcatgagcagcaatgagaacgggatcac

SEQ ID NO: 514058 - DNA, 1144 bp, Homo sapiens
aaaggagttccttctcaaattcttatacacgtcactacttcgcagttccctcattctagctacttaaaatgacttggctgatatactctatcttaccggggatgatatgcataagtgctgtaaggcttgtaactggggaaatattccacctgataatagcccagattctactgtattcccaaaaggcaatattaaggtagatagatgattagtagtatattgttacacactattttggaattagagaacatacagaaggaatttaggggcttaaacattacgactgaatgcactttagtataaagggcacagtttgtatatttttaaatgaataccaatttaattttttagtatttacctgttaagagattatttagtctttaaattttttaggttaattttcttgctgtgatatatatgaggaatttactactttatgtcctgctctctaaactacatcctgaactcgacgtcctgaggtataatacaacagagcactttttgaggcaattgaaaaaccaacctacactcttcggtgcttagagagatctgctgtctcccaaataagcttttgtatctgccagtgaatttactgtactccaaatgattgctttcttttctggtgatatctgtgcttctcataattactgaaagctgcaatattttagtaataccttcgggatcactagagctgtcccccatcttccgtgttgaagagtttaaaggaggaagaagaaagaactgtcttacaccacttgagctcagacctctaaaccctgtatttcccttatgatgtcccctttttgagacactaatttttaaatacttactagctctgaaatatattgatttttatcacagtattctcagggtgaaattaaaccaactataggcctttttcttgggatgattttctagtcttaaggtttggggacattataaacttgagtacatttgttgtacacagttgatattccaaattgtatggatgggagggagaggtgtcttaagctgtaggcttttctttgtactgcatttatagagatttagctttaatattttttagagatgtaaaacattctgctttcttagtcttacctagtctgaaacatttttattcaataaagattttaattaaaatttg

SEQ ID NO: 514059 - DNA, 112 bp, Homo sapiens
ctagaggatctttcttcacaaggtcaggagataacggggagttgggaggcgtccagacactggacttcctgattctttaatccagaagggtttgctatgttaacaacctggc

SEQ ID NO: 514060 - DNA, 290 bp, Homo sapiens
gcgtcgactgtctccagagtcctcattttatctagccttggtgttataagcctagattcctgttcctcctttttaggaatctcagtttcatattgaaattgtattttaggttccatgttttatgggagctttgaaagagtgttatacatgtggtgagcggaggggaaaattgggtgaaagttggacaagttaagaagttggacaagaggatctaatttattaacacgccacacaggcaaaagtttaatgattcagagacatgtttatttcccccatatctcctcacaagt

SEQ ID NO: 514061 - DNA, 1901 bp, Homo sapiens
  misc_feature (1177)..(1177): n is a, c, g, or t
  misc_feature (1407)..(1407): n is a, c, g, or t
  misc_feature (1642)..(1642): n is a, c, g, or t
ctatggttgtgtgggtacagtgtacttcgagctgagtgtggtggtggaggattccttcctcttgaggtgtcacctctgtttttgcacgtcgttgtttttctttctgggggagctcactcgctcgttgtgtgttttcttttctcttcctagtgtcgtgtggttctcgttgggtgtcgcccttgcttgttatgtctcgtcgcccatctctgtggcacctgctcattttttgggcgcctgcagcataatactaatactttctgcccctgtgtgttgtttctgtatgctgctgtttattgtggggcctttttttttctaccacggtccctatgtctcccagaagttggttgttctcccgtgagtgtgttgaggttgtccgccgagtgcgggcccaccgtcgttgtgtttaatagggtggggtagtgttttatctagtgggtggtgtctttcctccttgtggtgtgggggccccactcctcctcgtggcggggtgttgtgtgtttatccacaaagggctcgccccacgagttgtccgctaaatttgctttgcgtcaacacacgcatgttgtgtgtctctcgtctgcctcagagtctcctccgggggttctccctcgggatgcagctgttttggggtgggtaatagcgctttgttttgtgtggtgtccccccccttttctttgtgtggtgttcgtatgactacttgtttccgtcctgtgtgttgttgggtctggtccccactcgtgttgttgtgttgtttttaattgaagattctcccgccgcgtgtccccctccagagtggggacatagtttgcctcatacacatctctgcggggttctctcttgctccctagtccaccaacaatacctgcggggggaagatagtagcctccatgttcttgtgtctgtcgccggggtgtcgctatcttctgttgtgtggttgggctgaagacatagcactacagtgcttccctctcgtttgggagaatatgctgctcggcttattatctccacagcgggggggaggtgttggtgttctgtgtggaagagaaaacaaccgccggtgtcgcttttgagaggttagtagtgtcctcccggcgccccccctttgttccacaacatagagaggtgtccctttgtttttttgtctcgcgcgttgtggagacaccacagcggtgtggtngagacacataatatttgtatactcttctcgggtccacgaccttgtgctctacacgacaccgcactagatgattagcacatctgaggtaagtgtattatagagtatagtagtaaatttagtgttttgtggggggtctcgcgctcgctgtataaaactctcgcaattatgtgagacaagcgcgctcacagaaggggtaatttgggccaccactcggcggcgcgctcgcgcgntctctctctttgagtacccggcgctctcacgcgcgcgctggagaccctcacaccgccccctcgggcacgagaggcacactctgggccctctggtcgagagagcttggaactttgtcctctcctctcctctcctctcctctcacttagtaccgcgcggtggagaattatgagacacgtgtgttttataaagaccacaccccctctgtccacaagtgttctcgtgaaacaccacttngtgaaattcggagagaaagaaaggaaaactgtctgcaaaggggtataaactcgtgcacttcaccacacacttggctaacacacactatgagcttctagtcacagtttgtgtgtctcccaccaacccctaaggcttttgtattttttaaattttaaattcactggtaatccctattgtcttttttaataagcaggttgggaaaccccggaggtaattgggcccctccaagtattgccaaaaagtgaccataaagttccct

SEQ ID NO: 514062 - DNA, 448 bp, Homo sapiens
  misc_feature (410)..(410): n is a, c, g, or t
  misc_feature (437)..(437): n is a, c, g, or t
ttttttttttaaattagactctgggatttaaatgggacttaactattttcccatttaaatgacgccagtattggggtcctgcagcctaaccctgctgcttagggagtgagtataaaccgcgactgtcagtcctcagatgccttcctttttaaagactagttctttctcaggtcttcttcttgacacctacaaatggtgcctgaccacaagacgacagtattcatcttcacttttattttttgattgcttgttttctagttaacccagaataatatagcttatgagaatctcccagtcaggaagaaagaaagaaagagaaagaaaagcaaatatgattttcctgatcattggattgggtgggatctccttcttagatgggagatatgttagatctttgtaaagggttaatntttataaagtgagagtagacatggtancccacacttag

SEQ ID NO: 514063 - DNA, 3358 bp, Homo sapiens
gcagccgcatctacggcagccgcacccccggctcggggctgtgagcggctcggggccgggggtgggcggcggtgcggcgggcggccgacgctcctcttcggcggcggcggcggcggcggcccatgcgtggggcggcgcggctggggcggccgggccggagttgcctcccggggcccgcgctgagggccgccgccgcgcccgccgctgctgcttgctcgcttgcgctgttgccgctgctgcccgcgcctggcgctgccgccgcccccgccccgcggcccccggagctgcagtcggcttccgcggggcccagcgtgagtctctacctgagcgaggacgaggtgcgccggctgatcggtcttgatgcagaactttattatgtgagaaatgaccttattagtcactacgctctatcctttagtctgttagtacccagtgagacaaatttcctgcacttcacctggcatgcgaagtccaaggttgaatataagctgggattccaagtggacaatgttttggcaatggatatgccccaggtcaacatttctgttcagggggaagttccacgcactttatcagtgtttcgggtagagctttcctgtactggcaaagtagattctgaagttatgatactaatgcagctcaacttgacagtaaattcttcaaaaaattttaccgtcttaaattttaaacgaaggaaaatgtgctacaaaaaacttgaagaagtaaaaacttcagccttggacaaaaacactagcagaactatttatgatcctgtacatgcagctccaaccacttctacgcgtgtgttttatattagtgtaggggtttgttgtgcagtaatatttctcgtagcaataatattagctgttttgcaccttcatagtatgaaaaggattgaactggatgacagcattagtgccagcagtagttcccaagggctgtctcagccatccacccagacgactcagtatctgagagcagacacgcccaacaatgcaactcctatcaccagctccttaggttatcctaccttgcggatagagaagaacgacttgagaagtgtcactcttttggaggccaaaggcaaggtgaaggatatagcaatatccagagagaggataactctaaaagatgtactccaagaaggtacttttgggcgtattttccatgggattttaatagatgaaaaagatccaaataaagaaaaacaagcatttgtcaaaacagttaaagatcaagcttctgaaattcaggtgacaatgatgctcactgaaagttgtaagctgcgaggtcttcatcacagaaatcttcttcctattactcatgtgtgtatagaagaaggagaaaagcccatggtgatattgccttacatgaattgggggaatcttaaattgtttttacgacagtgcaagttagtagaggccaataatccacaggcaatttctcagcaagacctggtacacatggctattcagattgcctgtggaatgagctacctggccagaagggaagtcatccacaaagacctggctgccaggaactgtgtcattgatgacacacttcaagttaagatcacagacaatgccctctccagagacttgttccccatggactatcactgtctgggggacaatgaaaacaggccagttcgttggatggctcttgaaagtctggttaataacgagttctctagcgctagtgatgtgtgggcctttggagtgacgctgtgggaactcatgactctgggccagactccctacgtggacattgaccccttcgagatggccgcatacctgaaagatggttaccgaatagcccagccaatcaactgtcctgatgaattatttgctgtgatggcctgttgctgggccttagatccagaggagaggcccaagtttcagcagctggtacagtgcctaacagagtttcatgcagccctgggggcctacgtctgactcctctccaatcccacaccatcaggaagaaggtgcctgtcggggctcacttgaagcctgtcagggatgctttgtatctaacacaacgccaacagaagcacatttgtcttccagaacaccgtgccttagaaatgctttagaatctgaactttttaagacagacttaataatgtggcatattttctagatatcacttttattaggttgaactgaaagggtttttgtaaattttttggccaaaattttttaaaacatacttactttggactaggggtacattcttacaaaataaataaacagtttttaaaattgtttagacacagatatttggaattagctatcttagggccaactgctttttatttttttacttcatcaaggtgatgtaagtgactttgtttagacacagatatttggaattagctatcttagtgccaactgctttttatttttttacttcatcaaggtgatgtaagtgactcacctttaaagtttttttagtgttattttttatcactactctgggaaatggtttgtcttcaagatgcaatacttttcttagtaaaggaaaaacagcataaaaagatacctggtctgccttgtacaagaaaaggcaatattagaggaagaaaatttaaagaaaagctagaggaaaaaaaaattttttaaaaaatacttattagaagcaaactgcccttgcatggaaaactgtttatttttttcagtgaaaaggaattctgctttcgtgtttttgggaaagcaggaactgagttcattacatctttaatttggcagaaattagcctttctgtgaaccagatgtggtttggggcagatctgtagtaaacaatggtgattttatttatttttactctctggaaaaggagataatacaattccagaaagtgaactcatatttctaaggttaagattcccttttattgcacctagaatagtgctatgcacagagcgggtgcttgagttgttgtcgttttttgtttgttttttaaatgtaaactggtaaattttgtgcttatcttcaaggctggcttaagtataaaattgttttttaaacacttgaaaaattaaaggatttgttttatattaaaaaaaaacaaacaaaaaaaaaacaaaaaaaaaagaaagaaatagaaccccaaaaaacaggcggggtgaaacaaaaatatacaagagggaggagcgatgactaacaggcgacaagccccgaaacggcggagcgatgagatagaaaaaatagagaaaagcgagcgaagcaaagaaagagagataagcatatcgcgtccacaacaactacaaactggagtaactacagacgcaaccaaagatagcagagaacaaagcaatagagcacacaagcgagaagaaatacaattaaaccaaggc

SEQ ID NO: 514064 - DNA, 376 bp, Homo sapiens
aagaattggaatgctacggaggaacggaagagagggaggggccgggaaaggaaacacccagctggctgggccagcccttgctctcctcccctcctaagccacagggtctttcatttttggaatttcctccctacctttaaacctttcttgatttaaacctttcttgatcagaccttaaaccaagtcaggttgcagctatttacagagtgaaaagtgagaactgaaagaattatataagcctttctcctggcctctggccaaatctagggatgcctcccactgtttctgtgagaggtgggaagttgttggcccatccttcatcctaagaagctccttcacagggctacaggtgtgagcatgcaaagaaggccttcat

SEQ ID NO: 514065 - DNA, 337 bp, Homo sapiens
cgctttctaacctaacaacatgtgggcatactgctatattcgtgacactgggagctctacttgtgacaggacctacataccaactgtcatatactgatatgagatttaaccatacatgaatttccatctgattataatacacacatcacaagactatagaagtatggtacaatattctaaatagcctggaacatacataatcatatgactgcttccttacctgttggctagactgaccttgaacatttcactgatgtgactgcttagcccatcaccaccccttgctttccctccttcgaaccttcccatactactcatatgccataaggggctgctc

SEQ ID NO: 514066 - DNA, 2105 bp, Homo sapiens
gcagccgcatctacggcagccgcacccccggctcggggctgtgagcggctcggggccgggggtgggcggcggtgcggcgggcccgccgctgctgcttgctcgcttgcgctgttgccgctgctgcccgcgcctggcgctgccgccgcccccgccccgcggcccccggagctgcagtcggcttccgcggggcccagcgtgagtctctacctgagcgaggacgaggtgcgccggctgatcggtcttgatgcagaactttattatgtgagaaatgaccttattagtcactacgctctatcctttagtctgttagtacccagtgagacaaatttcctgcacttcacctggcatgcgaagtccaaggttgaatataagctgggattccaagtggacaatgttttggcaatggatatgccccaggtcaacatttctgttcagggggaagttccacgcactttatcagtgtttcgggtagagctttcctgtactggcaaagtagattctgaagttatgatactaatgcagctcaacttgacagtaaattcttcaaaaaattttaccgtcttaaattttaaacgaaggaaaatgtgctacaaaaaacttgaagaagtaaaaacttcagccttggacaaaaacactagcagaactatttatgatcctgtacatgcagctccaaccacttctacgcgtgtgttttatattagtgtaggggtttgttgtgcagtaatatttctcgtagcaataatattagctgttttgcaccttcatagtatgaaaaggattgaactggatgacagcattagtgccagcagtagttcccaagggctgtctcagccatccacccagacgactcagtatctgagagcagacacgcccaacaatgcaactcctatcaccagctccttaggttatcctaccttgcggatagagaagaacgacttgagaagtgtcactcttttggaggccaaaggcaaggtgaaggatatagcaatatccagagagaggataactctaaaagatgtactccaagaaggtacttttgggcgtattttccatgggattttaatagatgaaaaagatccaaataaagaaaaacaagcatttgtcaaaacagttaaagatcaagcttctgaaattcaggtgacaatgatgctcactgaaagttgtaagctgcgaggtcttcatcacagaaatcttcttcctattactcatgtgtgtatagaagaaggagaaaagcccatggtgatattgccttacatgaattgggggaatcttaaattgtttttacgacagtgcaagttagtagaggccaataatccacaggcaatttctcagcaagacctggtacacatggctattcagattgcctgtggaatgagctacctggccagaagggaagtcatccacaaagacctggctgccaggaactgtgtcattgatgacacacttcaagttaagatcacagacaatgccctctccagagacttgttccccatggactatcactgtctgggggacaatgaaaacaggccagttcgttggatggctcttgaaagtctggttaataacgagttctctagcgctagtgatgtgtgggcctttggagtgacgctgtgggaactcatgactctgggccagactccctacgtggacattgaccccttcgagatggccgcatacctgaaagatggttaccgaatagcccagccaatcaactgtcctgatgaattatttgctgtgatggcctgttgctgggccttagatccagaggagaggcccaagtttcagcagctggtacagtgcctaacagagtttcatgcagccctgggggcctacgtctgactcctctccaatcccacaccatcaggaagaaggtgcctgtcggggctcacttgaagcctgtcagggatgctttgtatctaacacaacgccaacagaagcacatttgtcttccagaacaccgtgccttagaaatgctttagaatctgaactttttaagacagacttaataatgtggcatattttctagatatcacttttattaggttgaactgaaagggtttttgtaaagcatttctaaggcacggtgttctggaagacaaatgtgc

SEQ ID NO: 514067 - DNA, 215 bp, Homo sapiens
  misc_feature (33)..(33): n is a, c, g, or t
aaataaacccaataaaatttttaaattttaacnccaataaaaggggaaaataaaggttttcccttacccatcttccgggcccccttttttccctttaggggttggttgatttttgttttaaattgggaggggggccccccccttccccttttcgggagggggggttgggttttttgggaacccaaaaaaagggtggttttttcccctttagggga

SEQ ID NO: 514068 - DNA, 3272 bp, Homo sapiens
gcagccgcatctacggcagccgcacccccggctcggggctgtgagcggctcggggccgggggtgggcggcggtgcggcgggcggccgacgctcctcttcggcggcggcggcggcggcggcccatgcgtggggcggcgcggctggggcggccgggccggagttgcctcccggggcccgcgctgagggccgccgccgcgcccgccgctgctgcttgctcgcttgcgctgttgccgctgctgcccgcgcctggcgctgccgccgcccccgccccgcggcccccggagctgcagtcggcttccgcggggcccagcgtgagtctctacctgagcgaggacgaggtgcgccggctgatcggtcttgatgcagaactttattatgtgagaaatgaccttattagtcactacgctctatcctttagtctgttagtacccagtgagacaaatttcctgcacttcacctggcatgcgaagtccaaggttgaatataagctgggattccaagtggacaatgttttggcaatggatatgccccaggtcaacatttctgttcagggggaagttccacgcactttatcagtgtttcgggtagagctttcctgtactggcaaagtagattctgaagttatgatactaatgcagctcaacttgacagtaaattcttcaaaaaattttaccgtcttaaattttaaacgaaggaaaatgtgctacaaaaaacttgaagaagtaaaaacttcagccttggacaaaaacactagcagaactatttatgatcctgtacatgcagctccaaccacttctacgcgtgtgttttatattagtgtaggggtttgttgtgcagtaatatttctcgtagcaataatattagctgttttgcaccttcatagtatgaaaaggattgaactggatgacagcattagtgccagcagtagttcccaagggctgtctcagccatccacccagacgactcagtatctgagagcagacacgcccaacaatgcaactcctatcaccagctccttaggttatcctaccttgcggatagagaagaacgacttgagaagtgtcactcttttggaggccaaaggcaaggtgaaggatatagcaatatccagagagaggataactctaaaagatgtactccaagaaggtacttttgggcgtattttccatgggattttaatagatgaaaaagatccaaataaagaaaaacaagcatttgtcaaaacagttaaagatcaagcttctgaaattcaggtgacaatgatgctcactgaaagttgtaagctgcgaggtcttcatcacagaaatcttcttcctattactcatgtgtgtatagaagaaggagaaaagcccatggtgatattgccttacatgaattgggggaatcttaaattgtttttacgacagtgcaagttagtagaggccaataatccacaggcaatttctcagcaagacctggtacacatggctattcagattgcctgtggaatgagctacctggccagaagggaagtcatccacaaagacctggctgccaggaactgtgtcattgatgacacacttcaagttaagatcacagacaatgccctctccagagacttgttccccatggactatcactgtctgggggacaatgaaaacaggccagttcgttggatggctcttgaaagtctggttaataacgagttctctagcgctagtgatgtgtgggcctttggagtgacgctgtgggaactcatgactctgggccagactccctacgtggacattgaccccttcgagatggccgcatacctgaaagatggttaccgaatagcccagccaatcaactgtcctgatgaattatttgctgtgatggcctgttgctgggccttagatccagaggagaggcccaagtttcagcagctggtacagtgcctaacagagtttcatgcagccctgggggcctacgtctgactcctctccaatcccacaccatcaggaagaaggtgcctgtcggggctcacttgaagcctgtcagggatgctttgtatctaacacaacgccaacagaagcacatttgtcttccagaacaccgtgccttagaaatgctttagaatctgaactttttaagacagacttaataatgtggcatattttctagatatcacttttattaggttgaactgaaagggtttttgtaaattttttggccaaaattttttaaaacatacttactttggactaggggtacattcttacaaaataaataaacagtttttaaaattgtttagacacagatatttggaattagctatcttagtgccaactgctttttatttttttacttcatcaaggtgatgtaagtgactcacctttaaagtttttttagtgttattttttatcactactctgggaaatggtttgtcttcaagatgcaatacttttcttagtaaaggaaaaacagcataaaaagatacctggtctgccttgtacaagaaaaggcaatattagaggaagaaaatttaaagaaaagctagaggaaaaaaaaattttttaaaaaatacttattagaagcaaactgcccttgcatggaaaactgtttatttttttcagtgaaaaggaattctgctttcgtgtttttgggaaagcaggaactgagttcattacatctttaatttggcagaaattagcctttctgtgaaccagatgtggtttggggcagatctgtagtaaacaatggtgattttatttatttttactctctggaaaaggagataatacaattccagaaagtgaactcatatttctaaggttaagattcccttttattgcacctagaatagtgctatgcacagagcgggtgcttgagttgttgtcgttttttgtttgttttttaaatgtaaactggtaaattttgtgcttatcttcaaggctggcttaagtataaaattgttttttaaacacttgaaaaattaaaggatttgttttatattaaaaaaaaacaaacaaaaaaaaaacaaaaaaaaaagaaagaaatagaaccccaaaaaacaggcggggtgaaacaaaaatatacaagagggaggagcgatgactaacaggcgacaagccccgaaacggcggagcgatgagatagaaaaaatagagaaaagcgagcgaagcaaagaaagagagataagcatatcgcgtccacaacaactacaaactggagtaactacagacgcaaccaaagatagcagagaacaaagcaatagagcacacaagcgagaagaaatacaattaaaccaaggc

SEQ ID NO: 514069 - DNA, 419 bp, Homo sapiens
acactttatgccggggtggaagagaatggctgcgtggctgatgcgtcccggtgatgggaagggtactaggttgccggggcagctttccactcttctctggctgattgtcccttccctcccttcctctcccaccatgcgacgcagcatccttccaggccccgcgtctgccgagcctcagctcaccaggtttggtttctgagtgcctatctgctgctcttccctccctctgcgggcttctcttgctctgcagcctccctctccccattcccatccagctccctttccccctgggcttcccttgcgcttcctgcagcacacttgggccgctctctgccccttgcctaaaagcctgtacctctggattggcggaagtaaatctggaaggattctcactcgtatttcccacccctagtggccag

SEQ ID NO: 514070 - DNA, 3139 bp, Homo sapiens
gcagccgcatctacggcagccgcacccccggctcggggctgtgagcggctcggggccgggggtgggcggcggtgcggcgggcggccgacgctcctcttcggcggcggcggcggcggcggcccatgcgtggggcggcgcggctggggcggccgggccggagttgcctcccggggcccgcgctgagggccgccgccgcgcccgccgctgctgcttgctcgcttgcgctgttgccgctgctgcccgcgcctggcgctgccgccgcccccgccccgcggcccccggagctgcagtcggcttccgcggggcccagcgtgagtctctacctgagcgaggacgaggtgcgccggctgatcggtcttgatgcagaactttattatgtgagaaatgaccttattagtcactacgctctatcctttagtctgttagtacccagtgagacaaatttcctgcacttcacctggcatgcgaagtccaaggttgaatataagctgggattccaagtggacaatgttttggcaatggatatgccccaggtcaacatttctgttcagggggaagttccacgcactttatcagtgtttcgggtagagctttcctgtactggcaaagtagattctgaagttatgatactaatgcagctcaacttgacagtaaattcttcaaaaaattttaccgtcttaaattttaaacgaaggaaaatgtgctacaaaaaacttgaagaagtaaaaacttcagccttggacaaaaacactagcagaactatttatgatcctgtacatgcagctccaaccacttctacgcgtgtgttttatattagtgtaggggtttgttgtgcagtaatatttctcgtagcaataatattagctgttttgcaccttcatagtatgaaaaggattgaactggatgacagcattagtgccagcagtagttcccaagggctgtctcagccatccacccagacgactcagtatctgagagcagacacgcccaacaatgcaactcctatcaccagctccttaggttatcctaccttgcggatagagaagaacgacttgagaagtgtcactcttttggaggccaaaggcaaggtgaaggatatagcaatatccagagagaggataactctaaaagatgtactccaagaaggtacttttgggcgtattttccatgggattttaatagatgaaaaagatccaaataaagaaaaacaagcatttgtcaaaacagttaaagatcaagcttctgaaattcaggtgacaatgatgctcactgaaagttgtaagctgcgaggtcttcatcacaggcaatttctcagcaagacctggtacacatggctattcagattgcctgtggaatgagctacctggccagaagggaagtcatccacaaagacctggctgccaggaactgtgtcattgatgacacacttcaagttaagatcacagacaatgccctctccagagacttgttccccatggactatcactgtctgggggacaatgaaaacaggccagttcgttggatggctcttgaaagtctggttaataacgagttctctagcgctagtgatgtgtgggcctttggagtgacgctgtgggaactcatgactctgggccagactccctacgtggacattgaccccttcgagatggccgcatacctgaaagatggttaccgaatagcccagccaatcaactgtcctgatgaattatttgctgtgatggcctgttgctgggccttagatccagaggagaggcccaagtttcagcagctggtacagtgcctaacagagtttcatgcagccctgggggcctacgtctgactcctctccaatcccacaccatcaggaagaaggtgcctgtcggggctcacttgaagcctgtcagggatgctttgtatctaacacaacgccaacagaagcacatttgtcttccagaacaccgtgccttagaaatgctttagaatctgaactttttaagacagacttaataatgtggcatattttctagatatcacttttattaggttgaactgaaagggtttttgtaaattttttggccaaaattttttaaaacatacttactttggactaggggtacattcttacaaaataaataaacagtttttaaaattgtttagacacagatatttggaattagctatcttagtgccaactgctttttatttttttacttcatcaaggtgatgtaagtgactcacctttaaagtttttttagtgttattttttatcactactctgggaaatggtttgtcttcaagatgcaatacttttcttagtaaaggaaaaacagcataaaaagatacctggtctgccttgtacaagaaaaggcaatattagaggaagaaaatttaaagaaaagctagaggaaaaaaaaattttttaaaaaatacttattagaagcaaactgcccttgcatggaaaactgtttatttttttcagtgaaaaggaattctgctttcgtgtttttgggaaagcaggaactgagttcattacatctttaatttggcagaaattagcctttctgtgaaccagatgtggtttggggcagatctgtagtaaacaatggtgattttatttatttttactctctggaaaaggagataatacaattccagaaagtgaactcatatttctaaggttaagattcccttttattgcacctagaatagtgctatgcacagagcgggtgcttgagttgttgtcgttttttgtttgttttttaaatgtaaactggtaaattttgtgcttatcttcaaggctggcttaagtataaaattgttttttaaacacttgaaaaattaaaggatttgttttatattaaaaaaaaacaaacaaaaaaaaaacaaaaaaaaaagaaagaaatagaaccccaaaaaacaggcggggtgaaacaaaaatatacaagagggaggagcgatgactaacaggcgacaagccccgaaacggcggagcgatgagatagaaaaaatagagaaaagcgagcgaagcaaagaaagagagataagcatatcgcgtccacaacaactacaaactggagtaactacagacgcaaccaaagatagcagagaacaaagcaatagagcacacaagcgagaagaaatacaattaaaccaaggc

SEQ ID NO: 514071 - DNA, 1700 bp, Homo sapiens
tgctgaaacttgggcctctcctctggatctaaggcccagcaacaggccatcacagcaaataattcatcaggccagttcgttggatggctcttgaaagtctggttaataacgagttctctagcgctagtgatgtgtgggcctttggagtgacgctgtgggaactcatgactctgggccagactccctacgtggacattgaccccttcgagatggccgcatacctgaaagatggttaccgaatagcccagccaatcaactgtcctgatgaattatttgctgtgatggcctgttgctgggccttagatccagaggagaggcccaagtttcagcagctggtacagtgcctaacagagtttcatgcagccctgggggcctacgtctgactcctctccaatcccacaccatcaggaagaaggtgcctgtcggggctcacttgaagcctgtcagggatgctttgtatctaacacaacgccaacagaagcacatttgtcttccagaacaccgtgccttagaaatgctttagaatctgaactttttaagacagacttaataatgtggcatattttctagatatcacttttattaggttgaactgaaagggtttttgtaaattttttggccaaaattttttaaaacatacttactttggactaggggtacattcttacaaaataaataaacagtttttaaaattgtttagacacagatatttggaattagctatcttagtgccaactgctttttatttttttacttcatcaaggtgatgtaagtgactcacctttaaagtttttttagtgttattttttatcactactctgggaaatggtttgtcttcaagatgcaatacttttcttagtaaaggaaaaacagcataaaaagatacctggtctgccttgtacaagaaaaggcaatattagaggaagaaaatttaaagaaaagctagaggaaaaaaaaattttttaaaaaatacttattagaagcaaactgcccttgcatggaaaactgtttatttttttcagtgaaaaggaattctgctttcgtgtttttgggaaagcaggaactgagttcattacatctttaatttggcagaaattagcctttctgtgaaccagatgtggtttggggcagatctgtagtaaacaatggtgattttatttatttttactctctggaaaaggagataatacaattccagaaagtgaactcatatttctaaggttaagattcccttttattgcacctagaatagtgctatgcacagagcgggtgcttgagttgttgtcgttttttgtttgttttttaaatgtaaactggtaaattttgtgcttatcttcaaggctggcttaagtataaaattgttttttaaacacttgaaaaattaaaggatttgttttatattaaaaaaaaacaaacaaaaaaaaaacaaaaaaaaaagaaagaaatagaaccccaaaaaacaggcggggtgaaacaaaaatatacaagagggaggagcgatgactaacaggcgacaagccccgaaacggcggagcgatgagatagaaaaaatagagaaaagcgagcgaagcaaagaaagagagataagcatatcgcgtccacaacaactacaaactggagtaactacagacgcaaccaaagatagcagagaacaaagcaatagagcacacaagcgagaagaaatacaattaaaccaaggc

SEQ ID NO: 514072 - DNA, 1059 bp, Homo sapiens
gcagccgcatctacggcagccgcacccccggctcggggctgtgagcggctcggggccgggggtgggcggcggtgcggcgggcggccgacgctcctcttcggcggcggcggcggcggcggcccatgcgtggggcggcgcggctggggcggccgggccggagttgcctcccggggcccgcgctgagggccgccgccgcgcccgccgctgctgcttgctcgcttgcgctgttgccgctgctgcccgcgcctggcgctgccgccgcccccgccccgcggcccccggagctgcagtcggcttccgcggggcccagcgtgagtctctacctgagcgaggacgaggtgcgccggctgatcggtcttgatgcagaactttattatgtgagaaatgaccttattagtcactacgctctatcctttagtctgttagtacccagtgagacaaatttcctgcacttcacctggcatgcgaagtccaaggttgaatataagctgggattccaagtggacaatgttttggcaatggatatgccccaggtcaacatttctgttcagggggaagttccacgcactttatcagtgtttcgggtagagctttcctgtactggcaaagtagattctgaagttatgatactaatgcagctcaacttgacagtaaattcttcaaaaaattttaccgtcttaaattttaaacgaaggaaaatgtgctacaaaaaacttgaagaagtaaaaacttcagccttggacaaaaacactagcagaactatttatgatcctgtacatgcagctccaaccacttctacgcgtgtgttttatattagtgtaggggtttgttgtgcagtaatatttctcgtagcaataatattagctgttttgcaccttcatagtatgaaaaggattgaactggatgacagcattagtgccagcagtagttcccaagggctgtctcagccatccacccagacgactcagtatctgagagcagacacgccccactatcactctcttcacctattatctgtttcctcgtatagagcagcgcaccgtgagagctgcatgcccg

SEQ ID NO: 514073 - DNA, 172 bp, Homo sapiens
tggcacgagagaccaaaaaattttacaatattttttttttacaatatgttttgtagtatgtttaccctctttaagaagtgaattaccaatgctttgaaaaaagttcacttaaacattcctggacagaaattacgattttgtgatttcagtaataaaatgatattccttggga

SEQ ID NO: 514074 - DNA, 351 bp, Homo sapiens
agatatatagaccaatggaacagaacagaggcctcagaagtagcaccacacatttacaacaacaaacctgcacattctgcacatatatcccagaacttaaagtataattttaaaaaagtcaaaacagtcaaaaataataatagctacaggttttcaagaaatatataatataaaaaatgtaaatagtgaaataagtgaaaaaattgtgtggggggcaggtacaagtctaatgtttctgtatgcaacagaatttatgttatcagtgtaaaatagtctattatacttatgagatgttttatttcagtcctaagtaaacacaaagcaaaaaaccatagcagatacacaaacaat

SEQ ID NO: 514075 - DNA, 263 bp, Homo sapiens
aagatttgcggtgccgaccatctgtcgcagactggtcggtcatttttgttttgtgcgaaaaactcctgttgacccattttaaaacggctgtttaagggcgtactctagcccggccatccctattgagtcgtcgaggacctgctggtcatgaaatgccgtgaaggctgtggcgcctgctgcattgccccctccattagttcgccactacccggaatgccccagggcaaacccgctggcgtccgttgcgtgcacctgtcggtgga

SEQ ID NO: 514076 - DNA, 367 bp, Homo sapiens
  misc_feature (1)..(2): n is a, c, g, or t
  misc_feature (22)..(22): n is a, c, g, or t
nncgactttagaggaccccccncacaaaatgattatttatattaaattttttttagatctctaaagttattaaaatccaatctttcttaaaaagactttcttggaatgaggcaacatgtgctttacctctttaactctacctaaaacctaaagttatttctatagtataaatttcaaactccctggcacggaatgtaaatgctaaccagctaggtatttatagtcatgcgccgcattacaacttttcaaagacagaccgcgtatttgacagtggtcccgtaagattataataccatattcttactgtatgttttctatgtctagatacacaaataccattgcgctacaactgcctacagtattcagt

SEQ ID NO: 514077 - DNA, 884 bp, Homo sapiens
attctcggatgtctggggagctgatgtgtatcacaatgaatgttctcctgggcagcgtatgggatctttgccaccttcgtgacttttgtgcgaagtgcgctcgagtgctatattcatacctcaatgaggggagttccaggacgcgtgcaaccacggaaatgctatgggatctcgaaaggacaacaaacacccaggtaaactcggagtggcagactgaccactgtgagacatggcacttgctgacggaaacagaaatttcatgtttgcgaccctctggtgttctacacctgtgggttatgacgaaagacaactgccaaagaatcttcaagaaggaggactgcaagtatatcgtcggctggagaccgaaggacccaaaaaggacctgttctgtcagtgaatgggtatctaatgtgcttctagataggcatcagggctcccaggccaggctcattctcctctgggcctctaatagtcactgaatgtgtacgccatgcctatcagtaacaacgacttttcggagacaaataaacagaggtttatcaactaaatacaggcgcgacttttttcgaccccccgggcacctgtggagaagcgtttcggaatcaccacaccccgtgtgtgaacttggggcgacaccattatgtaataggaacaccgggtactgtttcgcggccaccgaaaaatcgcgcggacagcacactctgggggcggctacctcccccatggaaaacggccggtatgataacccccgggttatcgaaaagagctagtgttcgatcccccccgttgtgtgctacactgcgggagatgcagcccggctaatatagttcctgcgtgaggcgagtttcttacagacgatttctatatgcggcaaacacatatgt

SEQ ID NO: 514078 - DNA, 368 bp, Homo sapiens
tgtctcagttcgggacgggcagagggaatgcacatcagtgttggaaggacagaggagctgcagaaatggacgggcagagtggaatgcacatcagtgtgggagggacagagggaatgtacatcagtgtgggagggagagaggagctgcagatatggatggacagagggaatgcacattagtgtgggagggacacagatgctggcagaaatggagagcagagggaatgcacattagtgtgggagggacacgagatgctgcataaatggaggggcagagggaatgcccatcagtgtggcagggacagaggagctgcagagtgtgggtagcctgagggatggcccttccgggtgggaggtccatcaggtgct

SEQ ID NO: 514079 - DNA, 316 bp, Homo sapiens
gaatttaggcaggaaagacgcatcctattcctctattggttcacaacctgctgtggagacagcaggtatcataaatggtgtggtagaggtggaagttgcattaggtagtgtgggagcagagaaaaggagcatttgtttgagagtgggtcagacatgactctgtagaacatggggcatgaggtgaagcttgaagggatagaagtaagtagttgaagatgggactggaatagaagattggaactaagtcagatattttaatgtgatttcaactaatggactttatattgtaggaactgagaattcattcatggaatag

SEQ ID NO: 514080 - DNA, 315 bp, Homo sapiens
gtacgccttctggccgctgcgcacggcctggttctgtggctgctgtaccccaatcatgccttgcgtagagccgccttgctgctggttaggcatcatgggctgtaaaccaggctgctgggatggctgacggcaagctgctgaccacgattgggggctatatggccaccggcgtgcagagagaggtcgatcattgctgagttgcagttaggatattgtccaggggtgatagtaagaaacctggatctgttgagggggctgcatgtacccctggggtggcagaacttgctgagtaggtcgtgcatggctagaggtgga

SEQ ID NO: 514081 - DNA, 535 bp, Homo sapiens
  misc_feature (1)..(1): n is a, c, g, or t
nacactgggtgcacgactagcatggcaccgatctggtgcagtatgaaagactgtcagtggtcagggcctccatgacgggctcagtatcagtatcaggccctctttccccaggcgatggtccgcaacacgcagatttgtgctcctctgaacgccccatgttgtttggacacaatgaaataggagttttctttcatcctatagatacctctaaatctctcaaacagtcgtgagtggagctttttaggaagagtatagaataaattgctttaaaatagcacaggtcttgattatgagagcttcagtcctcctgctcaccgataagcaacaaaagtatagtctagcaccagttggtgcacataattacggtgccagttgcaggcaattatttgccaataagtgaaaggggccttttacccgcggcgtagcccatccatgacggaaaggggcatctgaggtttagaaggccgctttcaaaactccctccattcagggaggtcctgtccaagacaacaaacaataaatgtcattcctaaaa

SEQ ID NO: 514082 - DNA, 2348 bp, Homo sapiens
agctaaggctgaagaaaaagatgaattactacactttttccaaatgtgactgattctctcttctggctttgggaggccatgtgaacttattcagaatgtactacaaagtgatcatttcttacatttactgcaagctgacaatgtccaaataggatctgcagtcatgatgatgctacagaatatattacagatcaacagggtgatctactcagaataggaagaaaagccctgtattcaattttagatgaagttattttcaagcttttttcaactcctagtccagttataagaagtactgctacaaaactcctactgttgatggctgaatcccatcaggaaattttgattttactgagacaaagtacctgctacaaaggactcagacgtctactaagtaaacaggaaactgggactgaattcagtcaagaacttagacagcttgttggccttttaagcccaatggtctatcaggaagtagaagagcagaaactacatcaagcagcatgcttgattcaagcctattggaagggttttcagacaagaaagagattaaagaagcttccatctgctgtgattgctttgcagaggagtttcagatccaaacgatcaaagatgttgctggagataaataggcagaaggaagaagaggacctcaaattacaattgcaacttcaaagacagagagccatgagactttcccgagaattgcagctgagtatgctcgaaatagttcatccaggtcaggtggagaaacactatcgggaaatggaagagaaatcagcactgaatatccagaaacattggagagggtacagggaaaggaaaaattttcaccaacagaggcagtctctcatagagtataaagcagctgtcacacttcaaagagcagcgcttaaattcctagcgaagtgccgtaagaaaaagaaactatttgctccttggcgaggactccaagaactcactgatgcacgccgagttgaactgaagaaacgagtggatgactatgtcagaagacatttgggctctccaatgtcagatgtggtcagtagggagctccatgcccaagctcaagaacgactgcaacactactttatgggcagggccctagaagagcgagcccagcagcacagagaagctctgatagcacagatcagcaccaacgttgaacagctaatgaaggcaccaagtctgaaggaggcagaagggaaagaacctgagctcttcctaagtagatccaggcctgtggcagccaaggccaagcaggcccatctcacaaccctgaagcacatacaagcaccctggtggaagaagcttggagaagaatctggagatgagattgatgttccaaaggatgagcttagtatagaattagaaaatttattcattggtggaaccaaaccaccttagtgagtaaccctaagaattgacacaaatctcatattttaggagattatattggttctgcctctggcatgctggtagactagggccatcctaacttattattttccagaggttctcctccagacaagacctgcagtaagcaaagagttatattctacctctctctcaattttctttttcttttctctgtatcctcatccttagccacacacagatttgtgtggcttttattgtagaactaaacttagcatagtgttctgttgtttacatgaagtgtgtttttctttggtttcttctgttttccaactaaatatttttttctaaataaatattttcaacaattgatttgaaaaatttgtcaggattatttcaacttttcacatttgttatctgaaattcctatttcctgttaacataggaggtgtgtgcagactttattaatgtgaggaaaagaaatgctcaattgaaggacatttccctgttttctataaagcaatggttgaactcattttctattttgttatttctaaaaggaactgcataccaaaaaaatgcattctttctattaaactgtgagaactacaaaaactactgtttccctttttgtcttttctcctaggaatctcaaagctaaatataatgtttaatttttgttacaatcctaggtacctttatgattatttggttccaacctaatacttttcagtttccctgtttactttaaatatgttttaataccataacattgaagccacttcaatttgtgtttgtaacaatatggaatttaagttaaaatcaattaacaaatcatgactccatatcataaagaatctggaagatgttctttgtaaaatgagtgaaaataccagtatttctggatgtaaagaccaaattgtataatattgcgcaatctctaatgttaactttagtaaaattctaatcaa

SEQ ID NO: 514083 - DNA, 771 bp, Homo sapiens
cccggcgctctcctggctacccttctgccccagactcccgtctcggcggcggcgtggcagttgcagcggtgcagaatggctgacctcagtcttgcagatagcattaagcagaaccatctccagacccttgacgggagacgactaaacgcgggacttcacttgaccaccactagacggcagacgggcctttgactgactgtcgtgggatgacacactctgttggacacaacactcagaccctacctactatcctactacctggactgtccgacctgactgaacacacccgggacaccctcacgacggtacaacacgacacgaacactccgatgacatcacgacacaccgtacgacccacgcacttcgacacgcactaccatcacatgtacctcctctacccgacgcacacacgcaaccgtaccctacggcgccaacctgggacggggctacaacctcgggacacgctcaacgacaacgcgggaccgcccgaccttacaccgtaaccccaacgggggagtaacatcccaacacacgccgagacaccttatcccccacttgggcacaacgccacggacacacaccacgtggggcccccattacaccccgacggcggcaccaacattacaccccacacagcacgcataccggcccaacggcaaaacacgatgggggccccaccgtgaccacggcaacatacccacaccaccgccctccgcccgcggtacgcagccacccacacaccacacaaggaacaccacccaccggcccgag

SEQ ID NO: 514084 - DNA, 2230 bp, Homo sapiens
attaaagagattgtctagacagattttttttttatcagataccacaattgagcacgtaagaattctcaggagggaggaatatcttaaagatttcaacctggaattctctgagaaaaggaaaaagaaaaatcatatgattaatcttgttttcatttgtttttaagccagactttttagcttcaaattaatactgattagataacaaaatcatattttattattataataatagttgtaccttttgctattccatttcaggactcagacgtctactaagtaaacaggaaactgggactgaattcagtcaagaacttagacagcttgttggccttttaagcccaatggtctatcaggaagtagaagagcagaaactacatcaagcagcatgcttgattcaagcctattggaagggttttcagacaagaaagagattaaagaagcttccatctgctgtgattgctttgcagaggagtttcagatccaaacgatcaaagatgttgctggagataaataggcagaaggaagaagaggacctcaaattacaattgcaacttcaaagacagagagccatgagactttcccgagaattgcagctgagtatgctcgaaatagttcatccaggtcaggtggagaaacactatcgggaaatggaagagaaatcagcactgaatatccagaaacattggagagggtacagggaaaggaaaaattttcaccaacagaggcagtctctcatagagtataaagcagctgtcacacttcaaagagcagcgcttaaattcctagcgaagtgccgtaagaaaaagaaactatttgctccttggcgaggactccaagaactcactgatgcacgccgagttgaactgaagaaacgagtggatgactatgtcagaagacatttgggctctccaatgtcagatgtggtcagtagggagctccatgcccaagctcaagaacgactgcaacactactttatgggcagggccctagaagagcgagcccagcagcacagagaagctctgatagcacagatcagcaccaacgttgaacagctaatgaaggcaccaagtctgaaggaggcagaagggaaagaacctgagctcttcctaagtagatccaggcctgtggcagccaaggccaagcaggcccatctcacaaccctgaagcacatacaagcaccctggtggaagaagcttggagaagaatctggagatgagattgatgttccaaaggatgagcttagtatagaattagaaaatttattcattggtggaaccaaaccaccttagtgagtaaccctaagaattgacacaaatctcatattttaggagattatattggttctgcctctggcatgctggtagactagggccatcctaacttattattttccagaggttctcctccagacaagacctgcagtaagcaaagagttatattctacctctctctcaattttctttttcttttctctgtatcctcatccttagccacacacagatttgtgtggcttttattgtagaactaaacttagcatagtgttctgttgtttacatgaagtgtgtttttctttggtttcttctgttttccaactaaatatttttttctaaataaatattttcaacaattgatttgaaaaatttgtcaggattatttcaacttttcacatttgttatctgaaattcctatttcctgttaacataggaggtgtgtgcagactttattaatgtgaggaaaagaaatgctcaattgaaggacatttccctgttttctataaagcaatggttgaactcattttctattttgttatttctaaaaggaactgcataccaaaaaaatgcattctttctattaaactgtgagaactacaaaaactactgtttccctttttgtcttttctcctaggaatctcaaagctaaatataatgtttaatttttgttacaatcctaggtacctttatgattatttggttccaacctaatacttttcagtttccctgtttactttaaatatgttttaataccataacattgaagccacttcaatttgtgtttgtaacaatatggaatttaagttaaaatcaattaacaaatcatgactccatatcataaagaatctggaagatgttctttgtaaaatgagtgaaaataccagtatttctggatgtaaagaccaaattgtataatattgcgcaatctctaatgttaactttagtaaaattctaatcaa

SEQ ID NO: 514085 - DNA, 291 bp, Homo sapiens
tactactactaaattcgcggccgcgtcgacctcattcggaatggacacacacaggcggctccagtacagagaggggctctaggccctgaaatgctgtgctcctcgcaggacacacaactccacgtgacggggataacacgcgacacagctcctgcatcgatgctccccagttcctgcctggctgctcccccagctcctgcctaggttctcccctatctcctggccttatgctccccagttcctgcctttgtgctcccccagcaccccgtcgacgcggccgcgaatttagta

SEQ ID NO: 514086 - DNA, 2206 bp, Homo sapiens
catcctagagtcctttccctctttgacctccgtatccagttgatcattaaattatatcagtttcttatacttcgcccaaatacgcccccctttttgattaacaattctgactgccttatttctgtcacatatgtagcatgtgaaccctgggctgtactcgctgagcaactccaagaaagcaaaaagaaagtcatctgtataactgactgagtgacttaagagaaatttggaagcatgtgagtagagaacacatacacacatttgccctttccctctggtggtactgaatgacttcttaatcatgtacttaggaatttttttttttttttttttagtgttctttgtattggattttcagccattttcttattactctaccacaaaaatattatatgagttctttctgtgaagaagctgcataatctgggaaagctttgtttctaaaatcttagaaccatggtaaaataatagaattgggaaaattagtgaacaatattgacaaaaagaatgcaagattattattatcattgtcctgattccagaacttaagaaagcatggcagtgagtatgttgtaatagtgtctatcatctttttaggtcaggtggagaaacactatcgggaaatggaagagaaatcagcactgaatatccagaaacattggagagggtacagggaaaggaaaaattttcaccaacagaggcagtctctcatagagtataaagcagctgtcacacttcaaagagcagcgcttaaattcctagcgaagtgccgtaagaaaaagaaactatttgctccttggcgaggactccaagaactcactgatgcacgccgagttgaactgaagaaacgagtggatgactatgtcagaagacatttgggctctccaatgtcagatgtggtcagtagggagctccatgcccaagctcaagaacgactgcaacactactttatgggcagggccctagaagagcgagcccagcagcacagagaagctctgatagcacagatcagcaccaacgttgaacagctaatgaaggcaccaagtctgaaggaggcagaagggaaagaacctgagctcttcctaagtagatccaggcctgtggcagccaaggccaagcaggcccatctcacaaccctgaagcacatacaagcaccctggtggaagaagcttggagaagaatctggagatgagattgatgttccaaaggatgagcttagtatagaattagaaaatttattcattggtggaaccaaaccaccttagtgagtaaccctaagaattgacacaaatctcatattttaggagattatattggttctgcctctggcatgctggtagactagggccatcctaacttattattttccagaggttctcctccagacaagacctgcagtaagcaaagagttatattctacctctctctcaattttctttttcttttctctgtatcctcatccttagccacacacagatttgtgtggcttttattgtagaactaaacttagcatagtgttctgttgtttacatgaagtgtgtttttctttggtttcttctgttttccaactaaatatttttttctaaataaatattttcaacaattgatttgaaaaatttgtcaggattatttcaacttttcacatttgttatctgaaattcctatttcctgttaacataggaggtgtgtgcagactttattaatgtgaggaaaagaaatgctcaattgaaggacatttccctgttttctataaagcaatggttgaactcattttctattttgttatttctaaaaggaactgcataccaaaaaaatgcattctttctattaaactgtgagaactacaaaaactactgtttccctttttgtcttttctcctaggaatctcaaagctaaatataatgtttaatttttgttacaatcctaggtacctttatgattatttggttccaacctaatacttttcagtttccctgtttactttaaatatgttttaataccataacattgaagccacttcaatttgtgtttgtaacaatatggaatttaagttaaaatcaattaacaaatcatgactccatatcataaagaatctggaagatgttctttgtaaaatgagtgaaaataccagtatttctggatgtaaagaccaaattgtataatattgcgcaatctctaatgttaactttagtaaaattctaatcaa

SEQ ID NO: 514087 - DNA, 2081 bp, Homo sapiens
attaaagagattgtctagacagattttttttttatcagataccacaattgagcacgtaagaattctcaggagggaggaatatcttaaagatttcaacctggaattctctgagaaaaggaaaaagaaaaatcatatgattaatcttgttttcatttgtttttaagccagactttttagcttcaaattaatactgattagataacaaaatcatattttattattataataatagttgtaccttttgctattccatttcaggactcagacgtctactaagtaaacaggaaactgggactgaattcagtcaagaacttagacagcttgttggccttttaagcccaatggtctatcaggaagtagaagagcagaaactacatcaagcagcatgcttgattcaagcctattggaagggttttcagacaagaaagagattaaagaagcttccatctgctgtgattgctttgcagaggagtttcagatccaaacgatcaaagatgttgctggagataaataggcagaaggaagaagaggacctcaaattacaattgcaacttcaaagacagagagccatgagactttcccgagaattgcagctgagtatgctcgaaatagttcatccaggcgcttaaattcctagcgaagtgccgtaagaaaaagaaactatttgctccttggcgaggactccaagaactcactgatgcacgccgagttgaactgaagaaacgagtggatgactatgtcagaagacatttgggctctccaatgtcagatgtggtcagtagggagctccatgcccaagctcaagaacgactgcaacactactttatgggcagggccctagaagagcgagcccagcagcacagagaagctctgatagcacagatcagcaccaacgttgaacagctaatgaaggcaccaagtctgaaggaggcagaagggaaagaacctgagctcttcctaagtagatccaggcctgtggcagccaaggccaagcaggcccatctcacaaccctgaagcacatacaagcaccctggtggaagaagcttggagaagaatctggagatgagattgatgttccaaaggatgagcttagtatagaattagaaaatttattcattggtggaaccaaaccaccttagtgagtaaccctaagaattgacacaaatctcatattttaggagattatattggttctgcctctggcatgctggtagactagggccatcctaacttattattttccagaggttctcctccagacaagacctgcagtaagcaaagagttatattctacctctctctcaattttctttttcttttctctgtatcctcatccttagccacacacagatttgtgtggcttttattgtagaactaaacttagcatagtgttctgttgtttacatgaagtgtgtttttctttggtttcttctgttttccaactaaatatttttttctaaataaatattttcaacaattgatttgaaaaatttgtcaggattatttcaacttttcacatttgttatctgaaattcctatttcctgttaacataggaggtgtgtgcagactttattaatgtgaggaaaagaaatgctcaattgaaggacatttccctgttttctataaagcaatggttgaactcattttctattttgttatttctaaaaggaactgcataccaaaaaaatgcattctttctattaaactgtgagaactacaaaaactactgtttccctttttgtcttttctcctaggaatctcaaagctaaatataatgtttaatttttgttacaatcctaggtacctttatgattatttggttccaacctaatacttttcagtttccctgtttactttaaatatgttttaataccataacattgaagccacttcaatttgtgtttgtaacaatatggaatttaagttaaaatcaattaacaaatcatgactccatatcataaagaatctggaagatgttctttgtaaaatgagtgaaaataccagtatttctggatgtaaagaccaaattgtataatattgcgcaatctctaatgttaactttagtaaaattctaatcaa

SEQ ID NO: 514088 - DNA, 845 bp, Homo sapiens
ccttctagatattcccaaaaagaggctgagacaggaggttattttcaattttattttgggaattaaatacttttttccctttattactgttgtagtccctcacttggatatacctctgttttcacagatagaacataagggcaaggtctatagcttctattccttggccattgtcaacggagagctggccaagtcttcacaaagccttgcaacattgcctgaagttgatggaataagatgtattctcactcccttgatctcaagggcgtgaactctggaagcaacagcttgactaccaggtctatttttaccaatgattttcaggtggacctgggccgttaagtcatttaaactgggtcttttataaatagtaagaaggccgaacatttaagttattttgcgaaagcaacctacagagctaaagatgtaatgtttcttgcaatgtcacatcttttgtgtctcctgaagacttccctgtagaattgagctctgcagtgaaaaatcagagagaccaaagacatcttcgaatccatatttcagcctggtagaattggcttttctagtcagaacctttccaaggttctattattgggattcattaccatcccagaatcggttttgtggccaggcttccttcaatactggtctatcagaggggctcggcgacggggaacattgactttcggggcacgccatgtcttgcgactacgataccctggccgttgccttttgtgtgctttccgggggcgccctggtcgggttgcgggatgcctgtcttttggggtgcgcccggctggtttgtttgggcccccggtgtttttggcgcttgggcgctttggcgggcg

SEQ ID NO: 514089 - DNA, 1801 bp, Homo sapiens
agctaaggctgaagaaaaagatgaattactacactttttccaaatgtgactgattctctcttctggctttgggaggccatgtgaacttattcagaatgtactacaaagtgatcatttcttacatttactgcaagctgacaatgtccaaataggatctgcagtcatgatgatgctacagaatatattacagatcaacagatccaaacgatcaaagatgttgctggagataaataggcagaaggaagaagaggacctcaaattacaattgcaacttcaaagacagagagccatgagactttcccgagaattgcagctgagtatgctcgaaatagttcatccaggcgcttaaattcctagcgaagtgccgtaagaaaaagaaactatttgctccttggcgaggactccaagaactcactgatgcacgccgagttgaactgaagaaacgagtggatgactatgtcagaagacatttgggctctccaatgtcagatgtggtcagtagggagctccatgcccaagctcaagaacgactgcaacactactttatgggcagggccctagaagagcgagcccagcagcacagagaagctctgatagcacagatcagcaccaacgttgaacagctaatgaaggcaccaagtctgaaggaggcagaagggaaagaacctgagctcttcctaagtagatccaggcctgtggcagccaaggccaagcaggcccatctcacaaccctgaagcacatacaagcaccctggtggaagaagcttggagaagaatctggagatgagattgatgttccaaaggatgagcttagtatagaattagaaaatttattcattggtggaaccaaaccaccttagtgagtaaccctaagaattgacacaaatctcatattttaggagattatattggttctgcctctggcatgctggtagactagggccatcctaacttattattttccagaggttctcctccagacaagacctgcagtaagcaaagagttatattctacctctctctcaattttctttttcttttctctgtatcctcatccttagccacacacagatttgtgtggcttttattgtagaactaaacttagcatagtgttctgttgtttacatgaagtgtgtttttctttggtttcttctgttttccaactaaatatttttttctaaataaatattttcaacaattgatttgaaaaatttgtcaggattatttcaacttttcacatttgttatctgaaattcctatttcctgttaacataggaggtgtgtgcagactttattaatgtgaggaaaagaaatgctcaattgaaggacatttccctgttttctataaagcaatggttgaactcattttctattttgttatttctaaaaggaactgcataccaaaaaaatgcattctttctattaaactgtgagaactacaaaaactactgtttccctttttgtcttttctcctaggaatctcaaagctaaatataatgtttaatttttgttacaatcctaggtacctttatgattatttggttccaacctaatacttttcagtttccctgtttactttaaatatgttttaataccataacattgaagccacttcaatttgtgtttgtaacaatatggaatttaagttaaaatcaattaacaaatcatgactccatatcataaagaatctggaagatgttctttgtaaaatgagtgaaaataccagtatttctggatgtaaagaccaaattgtataatattgcgcaatctctaatgttaactttagtaaaattctaatcaa

SEQ ID NO: 514090 - DNA, 653 bp, Homo sapiens
atcaggggcgggcctcggccaggggggaaaaaccaccccacattgccccgcccccagagggcgcgcgacgacgccacataaaagaggcgccgcaccgccctcagaagacagcccccctgttgatatctgggagggcgaggagcatttggggcgcgcacgtggcctgtgtctgtgagaggagagaacacgtctgtctcgtcgacccgagcaggggggagcgcgagacaaaacaggaggcgccctctctctcttctggccccacgtggcaggtgtgtgacaaatacactcgtctctgtttcctggcccgctcttgtctcttcacaggcaggtggcaccttcttcatcctggtgtggccatgtatctacaccttttggcacacgcaagcttttttataataggacgccgttcgtgtttctccctcccgcgcatccgactcacctccagggaaaacaaaggacacaacaataataatagtaacccagagatggtattttagccctcgatctctgttgttgtacgagttggcggaatcaacaactcctccccccgccgtgttttaaatagacgattgacatgtgttctattaatccctttgtacctccttatgtattcattagcggcatcaccaacagaaaagatcaagagacaaaga

SEQ ID NO: 514091 - DNA, 168 bp, Homo sapiens
agtgtggagtgagtgaacccagtgaagaagagtcaggatcacaggaagcgagcctccctgtcggagaagaagagccccttcctgtccatcgcggagggcgctgtccccaaactggtcaaggaggggaaagttctcaaaaaccaaaaaaaacaaaaacacttgcggccg

SEQ ID NO: 514092 - DNA, 2294 bp, Homo sapiens
agctaaggctgaagaaaaagatgaattactacactttttccaaatgtgactgattctctcttctggctttgggaggccatgtgaacttattcagaatgtactacaaagtgatcatttcttacatttactgcaagctgacaatgtccaaataggatctgcagtcatgatgatgctacagaatatattacagatcaacagggtgatctactcagaataggaagaaaagccctgtattcaattttagatgaagttattttcaagcttttttcaactcctagtccagttataagaagtactgctacaaaactcctactgttgatggctgaatcccatcaggaaattttgattttactgagacaaagtacctgctacaaaggactcagacgtctactaagtaaacaggaaactgggactgaattcagtcaagaacttagacagcttgttggccttttaagcccaatggtctatcaggaagtagaagagcagaaactacatcaagcagcatgcttgattcaagcctattggaagggttttcagacaagaaagagattaaagaagcttccatctgctgtgattgctttgcagaggagtttcagatccaaacgatcaaagatgttgctggagataaataggcagaaggaagaagaggacctcaaattacaattgcaacttcaaagacagagagccatgagactttcccgagaattgcagctgagtatgctcgaaatagttcatccaggtcaggtggagaaacactatcgggaaatggaagagaaatcagcactgaatatccagaaacattggagagggtacagggaaaggaaaaattttcaccaacagaggcagtctctcatagagtataaagcagctgtcacacttcaaagagcagcgcttaaattcctagcgaagtgccgtaagagagttgaactgaagaaacgagtggatgactatgtcagaagacatttgggctctccaatgtcagatgtggtcagtagggagctccatgcccaagctcaagaacgactgcaacactactttatgggcagggccctagaagagcgagcccagcagcacagagaagctctgatagcacagatcagcaccaacgttgaacagctaatgaaggcaccaagtctgaaggaggcagaagggaaagaacctgagctcttcctaagtagatccaggcctgtggcagccaaggccaagcaggcccatctcacaaccctgaagcacatacaagcaccctggtggaagaagcttggagaagaatctggagatgagattgatgttccaaaggatgagcttagtatagaattagaaaatttattcattggtggaaccaaaccaccttagtgagtaaccctaagaattgacacaaatctcatattttaggagattatattggttctgcctctggcatgctggtagactagggccatcctaacttattattttccagaggttctcctccagacaagacctgcagtaagcaaagagttatattctacctctctctcaattttctttttcttttctctgtatcctcatccttagccacacacagatttgtgtggcttttattgtagaactaaacttagcatagtgttctgttgtttacatgaagtgtgtttttctttggtttcttctgttttccaactaaatatttttttctaaataaatattttcaacaattgatttgaaaaatttgtcaggattatttcaacttttcacatttgttatctgaaattcctatttcctgttaacataggaggtgtgtgcagactttattaatgtgaggaaaagaaatgctcaattgaaggacatttccctgttttctataaagcaatggttgaactcattttctattttgttatttctaaaaggaactgcataccaaaaaaatgcattctttctattaaactgtgagaactacaaaaactactgtttccctttttgtcttttctcctaggaatctcaaagctaaatataatgtttaatttttgttacaatcctaggtacctttatgattatttggttccaacctaatacttttcagtttccctgtttactttaaatatgttttaataccataacattgaagccacttcaatttgtgtttgtaacaatatggaatttaagttaaaatcaattaacaaatcatgactccatatcataaagaatctggaagatgttctttgtaaaatgagtgaaaataccagtatttctggatgtaaagaccaaattgtataatattgcgcaatctctaatgttaactttagtaaaattctaatcaa

SEQ ID NO: 514093 - DNA, 1209 bp, Homo sapiens
ggtcgattctagagcactgcacatcgcatccgcttatacagcgccgaacctaaagagaacacatgctcatgaacctgagctcttcctaagtagatccaggcctgtggcagccaaggccaagcaggcccatctcacaaccctgaagcacatacaagcaccctggtggaagaagcttggagaagaatctggagatgagattgatgttccaaaggatgagcttagtatagaattagaaaatttattcattggtggaaccaaaccaccttagtgagtaaccctaagaattgacacaaatctcatattttaggagattatattggttctgcctctggcatgctggtagactagggccatcctaacttattattttccagaggttctcctccagacaagacctgcagtaagcaaagagttatattctacctctctctcaattttctttttcttttctctgtatcctcatccttagccacacacagatttgtgtggcttttattgtagaactaaacttagcatagtgttctgttgtttacatgaagtgtgtttttctttggtttcttctgttttccaactaaatatttttttctaaataaatattttcaacaattgatttgaaaaatttgtcaggattatttcaacttttcacatttgttatctgaaattcctatttcctgttaacataggaggtgtgtgcagactttattaatgtgaggaaaagaaatgctcaattgaaggacatttccctgttttctataaagcaatggttgaactcattttctattttgttatttctaaaaggaactgcataccaaaaaaatgcattctttctattaaactgtgagaactacaaaaactactgtttccctttttgtcttttctcctaggaatctcaaagctaaatataatgtttaatttttgttacaatcctaggtacctttatgattatttggttccaacctaatacttttcagtttccctgtttactttaaatatgttttaataccataacattgaagccacttcaatttgtgtttgtaacaatatggaatttaagttaaaatcaattaacaaatcatgactccatatcataaagaatctggaagatgttctttgtaaaatgagtgaaaataccagtatttctggatgtaaagaccaaattgtataatattgcgcaatctctaatgttaactttagtaaaattctaatcaa

SEQ ID NO: 514094 - DNA, 409 bp, Homo sapiens
  misc_feature (41)..(41): n is a, c, g, or t
  misc_feature (95)..(95): n is a, c, g, or t
  misc_feature (123)..(123): n is a, c, g, or t
  misc_feature (144)..(144): n is a, c, g, or t
actttttagtcatgggctgcgcatatttatagatcaaatantcaaagcacagccaaacccagtaaaaataaacaagtgggctgtatcaaactaanaagcctcgcacagcaaagaaaacaattncacagagtgaaaggcaacctnccagaatggaaaaagtatttggaaatcatatatttgataaggagttaatttccaaaatatataaggaactcttacaactcaatggcaaccccctccaataacctgattgtaaaatgggctaaggacctgaatagacatgttcccagaaaagacacaaatatccaacaggtatatgaaaagatgctcaacatcactaatcattagggaaatgcaaattaaaaccacaatgtgttattacctcacctctgttagagtggatattatc

SEQ ID NO: 514095 - DNA, 2121 bp, Homo sapiens
agctaaggctgaagaaaaagatgaattactacactttttccaaatgtgactgattctctcttctggctttgggaggccatgtgaacttattcagaatgtactacaaagtgatcatttcttacatttactgcaagctgacaatgtccaaataggatctgcagtcatgatgatgctacagaatatattacagatcaacagggtgatctactcagaataggaagaaaagccctgtattcaattttagatgaagttattttcaagcttttttcaactcctagtccagttataagaagtactgctacaaaactcctactgttgatggctgaatcccatcaggaaattttgattttactgagacaaagtacctgctacaaaggactcagacgtctactaagtaaacaggaaactgggactgaattcagtcaagaacttagacagcttgttggccttttaagcccaatggtctatcaggaagtagaagagcagaaactacatcaagcagcatgcttgattcaagcctattggaagggttttcagacaagaaagagattaaagaagcttccatctgctgtgattgctttgcagaggagtttcagatccaaacgatcaaagatgttgctggagataaataggcagaaggaagaagaggacctcaaattacaattgcaacttcaaagacagagagccatgagactttcccgagaattgcagctgagtatgctcgaaatagttcatccaggtcaggtggagaaacactatcgggaaatggaagagaaatcagcactgaatatccagaaacattggagagggtacagggaaaggaaaaattttcaccaacagaggcagtctctcatagagtataaagcagctgtcacacttcaaagagcagcgcttaaattcctagcgaagtgccgtaagaaaaagaaactatttgctccttggcgaggactccaagaactcactgatgcacgccgagttgaactgaagaaacgagtggatgactatgtcagaagacatttgggctctccaatgtcagatgtggtcagtagggagctccatgcccaagctcaagaacgactgcaacactactttatgggcagggccctagaagagcgagcccagcagcacagagaagctctgatagcacagatcagcaccaacgttgaacagctaatgaaggcaccaagtctgaaggaggcagaagggaaagaacctgagctcttcctaagtagatccaggcctgtggcagccaaggccaagcaggcccatctcacaaccctgaagcacatacaagcaccctggtggaagaagcttggagaagaatctggagatgagattgatgttccaaaggatgagcttagtatagaattagaaaatttattcattggtggaaccaaaccaccttagtgagtaaccctaagaattgacacaaatctcatattttaggagattatattggttctgcctctggcatgctggtagactagggccatcctaacttattattttccagaggttctcctccagacaagacctgcagtaagcaaagagttatattctacctctctctcaattttctttttcttttctctgtatcctcatccttagccacacacagatttgtgtggcttttattgtagaactaaacttagcatagtgttctgttgtttcaatggttgaactcattttctattttgttatttctaaaaggaactgcataccaaaaaaatgcattctttctattaaactgtgagaactacaaaaactactgtttccctttttgtcttttctcctaggaatctcaaagctaaatataatgtttaatttttgttacaatcctaggtacctttatgattatttggttccaacctaatacttttcagtttccctgtttactttaaatatgttttaataccataacattgaagccacttcaatttgtgtttgtaacaatatggaatttaagttaaaatcaattaacaaatcatgactccatatcataaagaatctggaagatgttctttgtaaaatgagtgaaaataccagtatttctggatgtaaagaccaaattgtataatattgcgcaatctctaatgttaactttagtaaaattctaatcaa

SEQ ID NO: 514096 - DNA, 876 bp, Homo sapiens
tgtgcccgttccaagcacttttttggcccccctccataaggactggggccattgtagagtagcattgtggttctcccgtgcggaggaagacccctccttttttcgtgggtacagacgcgcgcacctccttgttttttaacaccagggcctcctctcacagcgtacttcttcgcctgtggccaatgagatggcgccccccccacgagattgcattgtgcggaataccatttcgctcgcgctgtctcgatctgctaggttgaccccacgctccgcgcgcacgctctcctctatagttgcatgtattctttatacacgcctgcgcgtgccccccgcatttttctccggtttgccctggcgcacgaccttcactcacttcggtgtaagcccccccccgcggtgggcacacttactgtaccccactcgctctgcttatacatacgttatggcgcgcgaagctcccttaacgcgccccgcattttttgtctagatataaccctcaaacaacgctttgcgcccagcgtgtgatggacatcacacgcagccactccatacgcaaaacaacgctctgcggcgtgtagcccctctctattatctcggcggtgtcagccaccaagaatcatgggagccgcactcccgcggggcggtaacaacttatttggtcgcgctcctttttgtgagatggtagataacaatggtgatcgtcacaaagaaatgatgacagtgccattaacagattctggtttagcacacacacattctttcgtgcgggccgcacattttctgggacacccgctaatctttgtgcgagcaaaacaaaaacagcaacgtagaaggcagtgtttgcggaataaaaacccttttgttgcgacaaaacac

SEQ ID NO: 514097 - DNA, 310 bp, Homo sapiens
  misc_feature (15)..(15): n is a, c, g, or t
  misc_feature (25)..(25): n is a, c, g, or t
  misc_feature (37)..(37): n is a, c, g, or t
  misc_feature (82)..(82): n is a, c, g, or t
  misc_feature (175)..(175): n is a, c, g, or t
  misc_feature (304)..(304): n is a, c, g, or t
tcaatggctatgctnttgcgggcgngctgtgagcttnccatgatgtgtgatatcatctatgccggtgagaaggcccagtttncacaggcggagatcttaataggaaccatcccaggtacgggcggcaccaagtagactcacccgtgctgttgggaagtcgctggcgatggagatngtcctcaccggtgaccggatctcagcccagggacgccaagcaagcaggtcttgtcagcaagattttgtcctttttgagacactggttggaaggaagccatccagttttgcagaaaaaatttgccagcanttttaa

SEQ ID NO: 514098 - DNA, 1822 bp, Homo sapiens
catcctagagtcctttccctctttgacctccgtatccagttgatcattaaattatatcagtttcttatacttcgcccaaatacgcccccctttttgattaacaattctgactgccttatttctgtcacatatgtagcatgtgaaccctgggctgtactcgctgagcaactccaagaaagcaaaaagaaagtcatctgtataactgactgagtgacttaagagaaatttggaagcatgtgagtagagaacacatacacacatttgccctttccctctggtggtactgaatgacttcttaatcatgtacttaggaatttttttttttttttttttagtgttctttgtattggattttcagccattttcttattactctaccacaaaaatattatatgagttctttctgtgaagaagctgcataatctgggaaagctttgtttctaaaatcttagaaccatggtaaaataatagaattgggaaaattagtgaacaatattgacaaaaagaatgcaagattattattatcattgtcctgattccagaacttaagaaagcatggcagtgagtatgttgtaatagtgtctatcatctttttaggtcaggtggagaaacactatcgggaaatggaagagaaatcagcactgaatatccagaaacattggagagggtacagggaaaggaaaaattttcaccaacagaggcagtctctcatagagtataaagcagctgtcacacttcaaagagcagcgcttaaattcctagcgaagtgccgtaagaaaaagaaactatttgctccttggcgaggactccaagaactcactgatgcacgccgagttgaactgaagaaacgagtggatgactatgtcagaagacatttgaggcaccaagtctgaaggaggcagaagggaaagaacctgagctcttcctaagtagatccaggcctgtggcagccaaggccaagcaggcccatctcacaaccctgaagcacatacaagcaccctggtggaagaagcttggagaagaatctggagatgagattgatgttccaaaggatgagcttagtatagaattagaaaatttattcattggtggaaccaaaccaccttagtgagtaaccctaagaattgacacaaatctcatattttaggagattatattggttctgcctctggcatgctggtagactagggccatcctaacttattattttccagaggttctcctccagacaagacctgcagtaagcaaagagttatattctacctctctctcaattttctttttcttttctctgtatcctcatccttagccacacacagatttgtgtggcttttattgtagaactaaacttagcatagtgttctgttgtttcaatggttgaactcattttctattttgttatttctaaaaggaactgcataccaaaaaaatgcattctttctattaaactgtgagaactacaaaaactactgtttccctttttgtcttttctcctaggaatctcaaagctaaatataatgtttaatttttgttacaatcctaggtacctttatgattatttggttccaacctaatacttttcagtttccctgtttactttaaatatgttttaataccataacattgaagccacttcaatttgtgtttgtaacaatatggaatttaagttaaaatcaattaacaaatcatgactccatatcataaagaatctggaagatgttctttgtaaaatgagtgaaaataccagtatttctggatgtaaagaccaaattgtataatattgcgcaatctctaatgttaactttagtaaaattctaatcaa

SEQ ID NO: 514099 - DNA, 215 bp, Homo sapiens
gtctctccctggctacagatgctaggtgttcaaggagcatgcaaagttattcctggggaaaatcccgccagcttgcccgattttttgtttggacccgtattgcttggggatttttcaattttggcagcattgccaccaggcaatttgtccaaaggtcacatgttccacaccaggcggaggtccattttcacaggccttcaagggagtttccccca

SEQ ID NO: 514100 - DNA, 1014 bp, Homo sapiens
attaaagagattgtctagacagattttttttttatcagataccacaattgagcacgtaagaattctcaggagggaggaatatcttaaagatttcaacctggaattctctgagaaaaggaaaaagaaaaatcatatgattaatcttgttttcatttgtttttaagccagactttttagcttcaaattaatactgattagataacaaaatcatattttattattataataatagttgtaccttttgctattccatttcaggactcagacgtctactaagtaaacaggaaactgggactgaattcagtcaagaacttagacagcttgttggccttttaagcccaatggtctatcaggaagtagaagagcagaaactacatcaagcagcatgcttgattcaagcctattggaagggttttcagacaagaaagagattaaagaagcttccatctgctgtgattgctttgcagaggagtttcaggtaaaaaaatttggtgaggggattgatgatcatagaatcttactagagtacagttgaattgaaatttaggtgatttttttttaatttcctagtatgtttcttgttatcttttcattttttttccatacgtttctgggtaccagcactccagtaaccagatgcactttcaaagcaaaggatgtaagacaggaatctgatgtgtcaaatatgcaatcctatccacttaataagatatttggggaggggccaagcctacaaagggagccaatgatagttatattattaaaccctctaaaccaacagttatcataatttcgtgtgtataattataacaataacatgtatgcgtataagagtttaagtctgttaacctgattttcctgaataaatatggcatggatggatatcttcattgaattatgatatagttcggcatttatttcaagtagactgaaaaggaaatactgaagacatagcccactttctgcaatgacttaaccaatccagatcctccaaggtcacagaacaaaaaaaaa

SEQ ID NO: 514101 - DNA, 754 bp, Homo sapiens
  misc_feature (114)..(114): n is a, c, g, or t
  misc_feature (118)..(118): n is a, c, g, or t
  misc_feature (136)..(136): n is a, c, g, or t
  misc_feature (142)..(142): n is a, c, g, or t
gccggagggcgggcgcgggtcttggcgaacggtcttcggaagcggcggggcgcgatgaccacgctacgggcctttacctgcgacgacctgttccgcttcaacaacattaacttngatncacttacagaaacttatnggattnctttctacctacaatacctcgccactgccagagtatttcattgttgcagaggcacctggtggagactcaatgggtatataatgggtaaagcagaaggctccagtagctagggaagaatgcacgggcacgtcaccagctctgtctgtggcccccagaatttcgacgcctttgttgtggctgctaaaacttatggagtcactagaggagattccagacaagaacggggtgcatttttggtgggatctcttgtgtaaagagtatctaacccaagtttgcagttaccatgtacaaggcagtgtgggctcacagtgttatataaggacggtcatagagtacctatccggccaaggcaacgggggagcgccttgatgagggacggcttattgatatgagcgaaacgcactttcccaggactactggagaagcaatccatcataccattacctcatcctgtgaggcctgaagacttgaattaaccctgggcagtggtccttaggcaggtacctctagatgctttatggaccatattattttccatggatgctcctggagctctattaggagaaacgtcactccattcaggtctcacagccttccacgaaatacggtcca

SEQ ID NO: 514102 - DNA, 159 bp, Homo sapiens
cggttggctgcatagatctcttcttttagagaagtgctgttcatatcctttgcccactttttgatggggttatggtttttttttcttttctggaaaattggtgggattccttggaaaatccggaatataaccccttggggggaactcctctaaaattca

SEQ ID NO: 514103 - DNA, 429 bp, Homo sapiens
gaacaaggccgctatccatttgtgttgttcgccagttatgtgtgtcctcgtaccgcttcgttcggacgagctcgcgcgtacgcatagccttgatagagggttagcgctagccttaagagtgcgaatcccaggagcagcgacagactcgagaccacgctccttgctcgtgaaggaggcggctcctcgcgtttgaggcccgcctgcggttgaggcccgactgcgcttgcggaccgactgcgcttgactgagcagtaaccaacatgtcatggagggagtcatattacagaaccgagggcgatgatgctgaggaggaacaagaagagaaccttgacacgagcggagactatcgatattcacgaagagatagttcgattcttttggatgaagccttcgacgctctgttgagtctcactagtgatagatggctgg

SEQ ID NO: 514104 - DNA, 103 bp, Homo sapiens
caaaaaaaataaggccttcttcccaaagcgccttcccccgtaaatgatatcatctcaacttagtattatacccccccccccccaaaaacagggtttgttaaga

SEQ ID NO: 514105 - DNA, 391 bp, Homo sapiens
  misc_feature (264)..(264): n is a, c, g, or t
  misc_feature (266)..(267): n is a, c, g, or t
  misc_feature (374)..(374): n is a, c, g, or t
  misc_feature (391)..(391): n is a, c, g, or t
ctgattagcaggctcaaaaatgatacatacaaataggagaactgatctctatactagtatcttatcatttatgcaaataactctcggatctgctcatcaatttaacaacaccaaatatataaactagcatggcatccccttgtgagcggcgcagtgattataggctttcggtctaagattaaaaatggcctaagccacttcttacacacaaggcacatctacaccccttatccccatactagttattattcgaaacccatcagncnnctactcattcaaccaatagccctggccgtacgcctaaccgctaacattactgcaggccacctactcatgcacctaattggaagcgccacccctagcacatatcaacncattaacctttccctcn

SEQ ID NO: 514106 - DNA, 432 bp, Homo sapiens
ttcgagggaacattgaatactgagtagtaggaactagacagtcagacctccaggactaacatgaagtgagccgagaggacatcgtatcatatgaatgcttctgtcgttagccggatgcagtgctgtgtgtatctagttccacctaattgagaggctgaggcaggaggattgcttgagtccagaaagtggcagttgcactgagcggagatcgcgccactgctctccaccctgcgtggcagagcgagaccctgcgtcaaacataaacaaaaacagaaggcttctgtcagttaacaatctttattagagggtgtctagtctttttttctcagctgtatgccatatctggctgaaccctgccaactacccccctttattatcccctcaaaaaaaaaaccacacaactgcccctcttctgctctcacgcgctggcac

SEQ ID NO: 514107 - DNA, 151 bp, Homo sapiens
tgaccgctaccacacaagccgcatcaggtgagccgacacctgccgaggactcttcacacagggatacgggggtctcagagagagacgacacctctcttagccggtttccattcgtcagcctatcctgccgaatggtctacggaggtccttt

SEQ ID NO: 514108 - DNA, 262 bp, Homo sapiens
tacaaatttctaacaccgaatcctattaaagaaaatgcctttcaaggacaggtatgctcagaataagtgtattctagagagtagcaacaaggaacactcttggcaatgagccagtgcccccgtagagtcaacatttgaacaatagtagcggagttcacccccttctctgtgggacttatgtgcattagtacaggtatgacatcactactttcaaaggaatgataaaactattagtgaaaaactagagtcacaaacagaaatg

SEQ ID NO: 514109 - DNA, 716 bp, Homo sapiens
  misc_feature (535)..(535): n is a, c, g, or t
gggaacataaaaatattaatttattaatcgtggccttaggcattaaagatatatccttgtgtcatgtgaagtagcataagcatttagttggaaacaaagtatcatagtgcttgagaaaagtattgtaagatgtttaagtctgagctgaaccatcacttttttatggatcattatttttatctagaataatctctgaaagcaacttgtggccatacagactagtctatttagcattctctagatattattcaagaggcttagtcactttaaagaatcaagctattggctgggcacagtggctcactgctgtaatctcagcactttggaagtccaggcaagtcagatcacctgaggtcagaagtgcaagacaggcctggccacattggtgaaaacctgtctctattaaaaatagagaatttagctgggcgtgcaagcaggtgcctgtaatcccagctacttgggaggctgaggcaggagaattgcttgaatccaggcagcagaggttgcagtgagccaagaccatgccattgcaccncagcctgggcatcaaagagtgaaactccacctcaaagcaaaaaaacaaaaaaacaaaatccagctatatcagtatttgttgccagtgattcaattcaagctttcaagcaaaaattcatcctgtgtaagacttcagtttgccatcatgagcacaatagtttcccaacacttcaagacctttc

SEQ ID NO: 514110 - DNA, 1586 bp, Homo sapiens
tattaaaagcccctggatccggttaatttgggcagagaaaatagaaacatcccacaagcccaggagggacggggtggacttaaatctcctctcctctcctctcgttcgctctctccggccccaggccccaccctgtgcgccctttttgtggctttttctccttcttctcacgcgtgccggggtgggccacccccgcgatggggactgagtgcgcgcaagacgaagaagagtctcagacgtgcgtgacctcttcgcgtggagaaatcctcacagcgcggcggcaacacaagagacagagagacgcgagagcatcgtgtctcacacacacacaccctgtggctgtgtgggcgagacccgcgctgaaacaagcgcgccgctgccgtgccgcgcgcactcacccacccctcctacgaccgcgagtgcgcgcgcgcagagtgagcacctctgtgcgcctctaccatgccacaacagtcactgcgaaaccaacaccccgtcgcgcgcctgcgcgcaaccgcgagcccctcctccccatctcatagagacacacatctcccctcccatatctctcacccaagcgcaccaacgcgcacgtgcgcacactcacccgacgcaccatttccacatatgtgtgggcaacccaaacaagttccccaacgaacccccccccacacgcgagcgccgcgaaccacaatgcgagaagcgcgccgcccaccccagcccggcgcggtccccggccaccaactgccgaccacccacgaccaccccccccgccggcgcacacactcaccccccacctcccactgactcccctaccctgcgccgcaccgctcccccccgcgctgctgcgtgcgccccccctgcggtcgcggagctccttgtccgccgcggccccttcgcccctcccccccctctccgttgcggccccactcgccctccctcccctccccgccccccccgtccggctctgctgcgctctcatcgcgacggtgtaacctccccctccatctcatacctttcccctgcgtggtctctcccatccggccgccccaccgcgacggcgctgcccgccggctgcgcccctccagtaccaccgcccgcgggacacaagacctccacacccgcgcgacgaccacgggggcggactacccagcaggccccgtcgcacccgcacccacaccccaaccatcctacatccactcacaccgcatctcctacacacccaacccaccacacccacacgcccccaccctcccgcacagcccacacccatccacacagccccaccatctcttactcacacatcgccaacttccacacacgttcactactcccacacccacctcatcacctgtctccgcccctatacacgtcgcgcaacctcagggacccctcctcaccaactaacggcacctcttttacaccacacaacactccacgcctcaccaccaccatctcccaccacaacacatcctgctaacacacccacctactgacccacagcagacactcttcctatccctcacacccacccttcatcaccactaccctgacgccacccactctacctctctcccaccacactctcc

SEQ ID NO: 514111 - DNA, 237 bp, Homo sapiens
tagatagtgcatggtgtgcaatctgtgagggtggacggcgcagtggatgtgctcaatgggcttgtgattcacctgtgtagcatgctcacgctgtgtgagtcttttcacactctctggcaggctgagttataatgttcagtatttccccagtcactttgtggtgtccccatgttcccactgccgttggacaccagtgtgatcttattggttgaagtcaagggatcattgatctcctct

SEQ ID NO: 514112 - DNA, 124 bp, Homo sapiens
agatggcgactgcgcgtgctcgagctgtaagggggtcatcgactacgccgtgaagatccgagtaagcctgacagaaccgctgtggtcacagatggtgttagcactccatgaacccttttgagat

SEQ ID NO: 514113 - DNA, 167 bp, Homo sapiens
ggaaatgcctccgctgaaggccccgaggcgaaggtacccaaagcacagtaatcactggtgtcgatattgtcatgaccatcaccttcaggaaacaagtttcacaaaagagcctacaagagtcatcaaggtttcatgaatcattcaaggggactttgaggcaagaccga

SEQ ID NO: 514114 - DNA, 268 bp, Homo sapiens
cttcaagacacaatgctgcatctccaaacaagaacaacggttcaactctcattgcgcccacatagtgtgtgctataaacttaagatttagaaataggtcctcgaatcccaatgaactaggggaaaaaggaaattatagcctagaatgtggaaggtggggcacactggcacggatggaggctggtgagtaagccaacacaaaaagacggacaaacccgagggcatctgtccagtctaggcgcaaacatgtatcggtctcagaatatctc

SEQ ID NO: 514115 - DNA, 338 bp, Homo sapiens
ggtggtgggcgcatgtaatgtcagttagtcaggaagctgacgcaggagaatcgcttaacctgggaggcggaggctgcagtgagccgagatcgtgccactgcactccagcctggcacgagagactccgtttacaaaaaaacaaagataagggggccacttgaaacacccttgggttgaaaatttaattcctaaaggcccatctcattcctattcacactgcccctcattataaaatgtgacccataaaaatggaattcttactttttgacccctgatagaccaatttcgggtacatttctctcatttcactgataatttcagagttcaactacttgcag

SEQ ID NO: 514116 - DNA, 692 bp, Homo sapiens
  misc_feature (184)..(184): n is a, c, g, or t
gctctgcgggtgtatgtggaccgctgtgtggcaactccagtacctgatccgaaagctctgccaagatattccttcattgagaatcatggatgcctggtggatgccaaggctacaggttccagctccacttcttgcccataaccaagaagacaagctccgttttcagttggaggccttcatgttncaggatacacccagtcctttaatctacattacatgcattgttaaggccactgttgctgctagacatagtgaccatctgcacaagtcctgctcctttgccaatggatggtttgccaatgatggacaccatggagcctgtaactgctgcgactctacatgtggtgttgaaggccaacttactggggatggctttaaaggcattcagtgggaaggcaaggctttggttggtcctgtagtggtcaaagacacgcaaaggaatcttgtttgataatgagtaaactatagtaggtgttattaaaaagctttttaaattgctcgtgtttttctacttaagcatgaatgtcagtatacttgggtacaaaactcccatcaataacattgtgaatccccattacttctagtaatgcacaaaccccccacttttgcaagctcggagccctacttgcattgtcttggatgactgtcaaatttttgattacttgaataaaccctcataaaagtaaagaaga

SEQ ID NO: 514117 - DNA, 782 bp, Homo sapiens
tgtactccagcctgggtgacagagtgagtgagactctgtctccaaaaaaaaaaaaaaaaaagaaacggtcgattatccgggggggtccatccgaggtgctggcctctgggcaaggaggactatgtgctgggagctctcttccaagctggtggcgtagttcggttccatttttatttctggagtggttttccctaagggtggtggagccaacggtctctttggcccgatctggcccaatttggtgttggggctggaatctatggtccccccaaacaaatggtccacaaggctggaagccaatcaatccccaagggcacttgggatatggtaacctggtggttgtggtgagagatacagatgggttcacaaaccgttggattaaggttaacaatgggggtcatatggggaggggccctaattttaatctctggattggtggtcctggataaaaagagaaagaaattcgggacacacaaaaaagacccccaaggggtgcaccacgggggagttaacgggccaaggtgagggccacggggagaaaggcaggggcttgccaagcttgcggaagaaaaggccctcggaagggaaccagttctggccccttgatctcgggactcctggcctccagggaactggggggaaaatcagtggtcgctgggtgggcccaaagccggtcagaggcagctttggaagaccccgtggttcggtttggcacttggttcgtggttaacccttaaaatggcccataaaaatattcggggtcaagaaacaacacacacttt

SEQ ID NO: 514118 - DNA, 114 bp, Homo sapiens
tctacaggatccctatgcgtgtacaacattaatcaggaataagatcactgtgaacactgtagctgaaatggcataatgaggagggccgaagattgtcttcagtccttaatcctg

SEQ ID NO: 514119 - DNA, 407 bp, Homo sapiens
  misc_feature (1)..(1): n is a, c, g, or t
  misc_feature (130)..(130): n is a, c, g, or t
  misc_feature (141)..(141): n is a, c, g, or t
  misc_feature (149)..(149): n is a, c, g, or t
  misc_feature (261)..(261): n is a, c, g, or t
  misc_feature (369)..(369): n is a, c, g, or t
  misc_feature (373)..(373): n is a, c, g, or t
  misc_feature (375)..(376): n is a, c, g, or t
nggcactgtgtccttcaccgcaacccgccgcgcaggcgacaatcggcagcccgctgagccaagggttccgcgaacaccatgcccataagccctcgtggcgcgacggcagtacgaacacatcggcgggttncgtaagccgcngttcaaangcatcgctgcccatctcaccggcaatggtgacacgatcctgcaggcggtgttgcgcgatcaaatcctgcacccgccgcacgacagcgggatcacgctctaaactccccaccnagtacgtacgccatgccaggtcggtggagttcgccagcgcttcgatcagcacgtcatggaccttgcggtaggtcagtgtcgccacggtcagcaggcaaggtggtgttnttgntnngacgcgcgctcggatccgtcgcccgccgcca

SEQ ID NO: 514120 - DNA, 1130 bp, Homo sapiens
  misc_feature (370)..(370): n is a, c, g, or t
tctcgagttcctgcgcgggactgcaatgcactgaccacggtgccggaaggctgcaggcccagtgggcaagcgaagaaatgaagccacctgcaacgcgggcgcttcggggcggggccgagtgcgaacctgagccccaaatcccgacccaggcatgggtgctggtggccctggagcggggcctttgtgaggccctagcccagctgcggagactgtctccgcgtggcgtcacgggcaccgacttacgtgcacccaaccacatggccgcagaccagcgcccgaaggccgacacgctggccctgaggcaacgggtcatcagctcttcctgcagactcttttttcccgaggatcctgtcaaggatttgtccgtggncccaagggcgcaggtaccattgttaccgatgaacaggggggcaagaataccattcgatttgccaatcagcaattgtggccgcaacggttgggcgcaacttggcaaccccttctcggtggttccaaggccaggcactatgacgccagaaccagcgtgctcaaacaaccaaaacagccgggtaccttgcattgacaaaccattcgtggccacttattgcgccagaaggcctgtccagcagaaccttgccggagccagcttcttgtggttgttacctattttcccttgaaatttctggggtccaagaacgcccaattgaccgttggcccttgtaggccttggcttcgccacttaacgccggggaccaccaggaccgggtgggtgggtatcaagatcaatgccgtatcacgggcccacctttgagctgcccttgatttggacccttcgggtccgcttaccagtttcccgcaaacctgtggattgggcccagacaggacggtggggtccaaggttgggacccttcttcccagagagcttacggggggccccttaagcggggaggaaccaacccaagcacaaggataatgggcttatgccaaacggagggtgaaacggttgtggtcaggaagttgcccaggacacagggcagtgaagtatggcagcgattttcggataagttcttctggccatgttggaaagggaggatataatccccgctgttggaaattctccaaggggacgagaattcggaagggcggagggg

SEQ ID NO: 514121 - DNA, 206 bp, Homo sapiens
ggcggcggctgctgctgcggtcgactctgcagcatcccctgtcatcgatcaacccgatccagctcccactctcttgctcgcctatataccgccatcttcagcaaaccctgcatgcaaggctaccacagtaagcgccagtaccccgtaaagacgttaggtccaggtgtagcccatgcaggtggcatcgatcacaccgggtaccgagc

SEQ ID NO: 514122 - DNA, 411 bp, Homo sapiens
tcagcacccaggtcactgatgagccaggtacgccaggcaacgaaggcgatatcgttaaggtcaccattacggctgaccaggtatcggtcgccgagaacgtgaagccgaccttcaccgtacacgtcaatcagccgctggatcacgacctggtcgtgaccctgagcaacaatgccacggtcaccatcaaggctggggagaccagtgcgccgtacgagcacgctgcacaaggtgacgacgtctaccaagacgctggcgaaatcagcctgggcatcaagtcggcggtggacgccacgggcgctaccttcgagaatctgcagttgggtggtgatgcttcggtcaaagtgaccgacaccatcgacgaagtggtagccaaactgaccgccacgccttcggtcacacgaggcggcgaga

SEQ ID NO: 514123 - DNA, 261 bp, Homo sapiens
taggatccccacaaatgttgactcagtcattacactcctagaccagaccccccagtgaaaaagtttacacactagttgaacaaaagagaaacaacaagaccgaaccctgtcagtctgtatttgctagcaatactactattgggatatatgaaaatacccgagtcttgctctagtcgcccaggcatggagtgctgcatgtggaaccatctctagctcactgcaaggctccacctccccaggttcacagccatatcttctgcc

SEQ ID NO: 514124 - DNA, 167 bp, Homo sapiens
gagtgaagctaggagaccggattctcatgcgaaagaggagcggtggtcagtgcaaagtgaacaacacagactacaagcgacagtacctgtaaaatgtataagcaatcacgccgaatagcgatttatgtcaaaccgacagacatatggtacggactgcaatcgcagtc

SEQ ID NO: 514125 - DNA, 146 bp, Homo sapiens
ccagcactgtttattttaatattttttcgtgagatatgtaatatccataacttcaaagcacatccgcccaagcctctttacagccagctccttcagaatcaggagccataagcattcaatgtctacttcccttctgtcgtcttctc

SEQ ID NO: 514126 - DNA, 1320 bp, Homo sapiens
taaattaagtaaactccatggtttttcttttttccaagaatggccgagtgttttgtggtttttcttacgaaagctcaggtgctttactttagcctcacttaacgagcgcgtgcgtgtggggggctgtgcggcgtgcgtgcgtgtgtggcaggatttttcaagtggtgggtggtgtttttcaacgcctctcacctctcaccctcatctctcctctctcatatctcacacaaaaaacattctcaagcatctcctgtgtgcaacaactctcctctacactttcacaggggttttctcaaaaaagatgtggagagagattttctccagggtggagggctccctcagagggtgttactcatatccccccggagtggtgtcacacgagatactccaagccttgtgggtctcttttcaaagtttctcctctcaagatccttttgtggtgtgtgcccacattgtttagcccagagggggtgtttgtcggcctctgtggtcaagctcttctcgaaaatcctccgcggccccttttacaggttataaacaaattcacagtggggatttccagtgtgggcacataaaactatatcttaaaagataaattttctcaaggataacatttccttttcccccaaaagtggcgtgtataacatataagtgtcccccctatatttttaggttccccaagacagagaccacacaaagccattaatataactctcccatctccgtgtgtgtgtgaaatcccctcaaagatttctcccaagcccaaagttggctggtctccaaatgtgcacagaagaccgagcaacactaaacacttttcataacactcagtggggggtgtgcttcaccccaaggtcaattccaaactttcgcgggggggtgtatcacagttatactatccctatgaaatcccccccttataaaaattccccttggtgaaaacaagaattccccacataaataagaggatttccacaaagcagaagtttttaccccttttaaaacattcaactttcacagaacaaatttccaccccagtttgtttccataaaagctctcggaagctttggtgccccctccttgccgggctcctgtgaaaaagagcccctgtttataaacaaagcttttctcatataacaaacaccctctataacataatctttcttaaaaacgttctccctccaaaaatatacacagggggcgaaaatatcccccaaaaccattgtacgggaaactctgggggactacaacaaacacctgtgtgaggagcatgtcattattcccccaaaattttcccaaaaaagttcgttgtttttatcc

SEQ ID NO: 514127 - DNA, 140 bp, Homo sapiens
aaacatataacctaccaagactgaatcactaagaaataaaaataggccagtcacggtggctcacacctgtaatcccagcaccttgggaggccaatacaggaggattgcttgagtccaggagtttgagatcagcctgggca

SEQ ID NO: 514128 - DNA, 1285 bp, Homo sapiens
  misc_feature (319)..(319): n is a, c, g, or t
  misc_feature (356)..(356): n is a, c, g, or t
  misc_feature (482)..(482): n is a, c, g, or t
  misc_feature (1285)..(1285): n is a, c, g, or t
acccatcggatccgtgtaacaacccagcggtttgataaaccagcggatcgatccatctccggttccatccggtcgagcggctgggtggagccttcggacagcggctagcaccgatcacctggcggttggaccgaccaaccgcgcctatcagacactcggcggaaccacaccggagtcgccaccgacacgacacacgtggttgactccacttttctacacgacacacgacttggtactgactgtgacacacgcaccctgctactgttccactactacacgacacactacttggacacacgaccgctcgtcaccacggacnccacacggacacccacacacacttgcactctgactgngtctcaccgggatccgtgtgtttgacacgtgacgtcttgactgactttgaacgacactgactgaccgtttgactttacgacacacacttcacacgctgacttacctgacacgactgtatcacgggntaccacacacctgggccctgaccctacacgcttcccactgggacactggaactactatacccccagtgacacacacactggtgattcacccggattcaccacacacacactggggcacgacgcaccttgactttgatcacgctcacccggtttgactcgtcacacgacctacaccagtcctgggtatcccttgtgacctatcgtactgggattctggtggattcgggtcttatcccatacacacacaccccgagctctcaacacctaccatcatcgcggagacccatcgcctactatccttgctaccgagcccacaccacaccgagttccgacaccacacactcccggggacaccgacacggactggacgtgggcacacccttaacttgacacccggacgaacggggtggaacgacccacacatctgaacacttggacaccccgacacggtggggttcccccttacacaccttgtgactttgccccgatccaccgggaccttggagtaccaaaacggaccacctacgaacacaaacgggactggggcccaccttgactacttgttacttgccgttcctacaacttgaactggttcttcaccgcgttaacgaccaaccgggtaccctccctggttgagaacgaaaccggccccaacggttagggaccctggggggaccaccgcctacctgggacgcttcacctgcggtagaccgggacagtacgttttctgggacacccggccactgtggggaacgcacgaccacggggtggataaccggttaggccctagccatatgactggn

SEQ ID NO: 514129 - DNA, 618 bp, Homo sapiens
catgctgctgcagtgatggcgccaacccgtggcagtcccagagctggagtgcatggaggatgtgatcctcatctccatgggaatgtgtcatgctgatgtgtgctgccatgtggaaatgctgtggcatggctgccttggctatggtgtccatctacatagttgctgtgtttcaacaatgtccatttatccttcacccctgaggctgtgttctaatgtggtggctgcaaacacctccccggtagaggcttggacctgagtgaccacttcgccacctgtgccactgtcccttaccatgaagtcctagccaccagtccatacactccatgagtacccggacagcctctgggtacatgcccttccctggtcacccatctgccctcatctacgtcatccagggacccagaccctgcaccttccatgtgggcccacagatccttgggaagtgtacctgagtgtgcaccatatgacattgtcggatatggggttagcatccagaaagaagaactgcgcttacgctctgtgaaggctgaactcagtcttcagggaagaaaggagactggattgcaccttgcttcctctgagacgggctccctctgagtgagtaccggcccctatcaa

SEQ ID NO: 514130 - DNA, 185 bp, Homo sapiens
  misc_feature (22)..(22): n is a, c, g, or t
  misc_feature (25)..(25): n is a, c, g, or t
  misc_feature (53)..(53): n is a, c, g, or t
  misc_feature (87)..(87): n is a, c, g, or t
  misc_feature (119)..(119): n is a, c, g, or t
  misc_feature (150)..(150): n is a, c, g, or t
ggccacttgattctcggtcaanacncctgccttctagtcccacttagttacanctttggtggcgcaggacgcccagcctctctctancttggtgttctctgtctgtaagatggagagcncctcacaagatgtggggtgtgtgggaacaanccaacatctggggtatttttaagaggctgggattt

SEQ ID NO: 514131 - DNA, 832 bp, Homo sapiens
  misc_feature (44)..(44): n is a, c, g, or t
  misc_feature (63)..(63): n is a, c, g, or t
  misc_feature (65)..(66): n is a, c, g, or t
  misc_feature (68)..(68): n is a, c, g, or t
  misc_feature (84)..(84): n is a, c, g, or t
  misc_feature (86)..(86): n is a, c, g, or t
  misc_feature (94)..(94): n is a, c, g, or t
  misc_feature (98)..(98): n is a, c, g, or t
  misc_feature (102)..(102): n is a, c, g, or t
  misc_feature (119)..(119): n is a, c, g, or t
  misc_feature (126)..(126): n is a, c, g, or t
  misc_feature (128)..(128): n is a, c, g, or t
  misc_feature (151)..(151): n is a, c, g, or t
  misc_feature (160)..(160): n is a, c, g, or t
  misc_feature (162)..(162): n is a, c, g, or t
  misc_feature (181)..(181): n is a, c, g, or t
  misc_feature (203)..(203): n is a, c, g, or t
  misc_feature (208)..(208): n is a, c, g, or t
  misc_feature (210)..(210): n is a, c, g, or t
  misc_feature (226)..(226): n is a, c, g, or t
  misc_feature (228)..(228): n is a, c, g, or t
  misc_feature (236)..(236): n is a, c, g, or t
  misc_feature (241)..(241): n is a, c, g, or t
  misc_feature (249)..(250): n is a, c, g, or t
  misc_feature (375)..(375): n is a, c, g, or t
  misc_feature (380)..(380): n is a, c, g, or t
  misc_feature (545)..(545): n is a, c, g, or t
  misc_feature (551)..(551): n is a, c, g, or t
  misc_feature (565)..(565): n is a, c, g, or t
  misc_feature (579)..(579): n is a, c, g, or t
  misc_feature (632)..(632): n is a, c, g, or t
  misc_feature (634)..(634): n is a, c, g, or t
  misc_feature (662)..(662): n is a, c, g, or t
  misc_feature (700)..(700): n is a, c, g, or t
  misc_feature (722)..(722): n is a, c, g, or t
  misc_feature (759)..(759): n is a, c, g, or t
  misc_feature (762)..(762): n is a, c, g, or t
  misc_feature (766)..(766): n is a, c, g, or t
  misc_feature (770)..(770): n is a, c, g, or t
  misc_feature (819)..(819): n is a, c, g, or t
gcaaagcggccaaaaaacaccccccacccccccccgcccccccncccccccccccccccgccncnncngccccccggggccggncncgggggtnaacngggntgggcgaccaactggcngggccgngnccacagctgccgggggggtgggncggccgggngnaggggggtggaagggtggncaacagagggggtgaaagcgcnggggncnccggggccaccagggncngggggcanggggntcgggggnngggggcgggggggggtggggggggaggggggggatggaggttagagaaggacactgatcaaagtgtgtgtagacccagcccaagcctcagctctgccttttctcatggtgtggccttaaacaagncactncccttcccgggctccagttttctcatctgggaaatgagtgagtccagagattctccaaagtctctttcacctgtgagaatctatgaccctctaaataagaggcataatttcaatttggacattccatactaagcgatatatgtacataacgtgattagacaagcngatgtntttcaaaggccagncatagccatcagcntgggagtgtagtgtttagtcacataaaaatataaaccaaatgaaaggggaaantncaccctccccctcgtgtcagcccccccngggctgccataacaaaatactacagattggatggcttnaacaacaggaacttatttctcnagttctggagctggggaagtccaagatcaaggtgtcngcngatncagnttctggtgagggctctcttctaggcttgcagacagccaccttctctgtntcctcacatggac

SEQ ID NO: 514132 - DNA, 314 bp, Homo sapiens
tcagctgagaaataagcattatgaaaatacgcttaatatcatagtcattagaaagttacaaatagaacaatgagataccactacacaatcatttagaatggccaaaatccaaaacactgacaacactaaatgctggtgaggatgctgagcagcagagactcttattggttgctggtgggaatgcaaaacagtagagccactttgggacagttcggcagtttcttacaaaaactacagcatactcttgcccatcctaatccagtcaatctgctgctccattggccatttacatcaaactacgcaggaaaatctta

SEQ ID NO: 514133 - DNA, 377 bp, Homo sapiens
gacatctgcacctgccatgctcgttccagcactattcacagtacccaagattggaatcaacctgtgtctatcagcaaatgaacagataaaatgtggtatatataccccgtggaatactatttggccattaaaaaaacaaaattctgttattctcagcaacatgtatgatcttagaagacattatgttaagtaagccaggcacagaaagataaatactccatgtactgtacttatgtggaaggtaaaaaagatctcatagaagtagagagtggctcatgcctctaatctcggtgctttgggagtctaaggtgggaggatcacttgaggcctggagtttgagaccagcctgagcaacatctctcaaaattaaaaaaaaa

SEQ ID NO: 514134 - DNA, 301 bp, Homo sapiens
acgaccttcgggttatgagcccgacgagctaccagactgctccatcccgcgtctgtgtgtcggcattctacagaggaacgcgagtgtgtcaacctgtgaatcgaagaaaagcgcttttgcttcaatcggttagcgcttgatgaggggcttcttgagggcttgaagctaggcagggcaaggctttcagctctattgggatgctggattcgattgagaaaatatattcgtctacgaaatttcctaccgctcagacagaagattcaaactactggtgctatatacaggggtgagtgcgatactt

SEQ ID NO: 514135 - DNA, 1008 bp, Homo sapiens
cgcagcgctgccgctcgctcggcgctgtagccgccgctgccgccgctgctcttggctcggtggacgcggtgcgggcgctccgagaggctctggtgcctgcggctgctgctctcctccgtgcgccctggggctgcggcgctccgggtcccggcccctgtcccggcatctctctggtgtccactgagcccctgtgcccctggtgtccctgctgtcctggcctggtagagaacctgctactcagcgtgctcgtagccagcccctgtggctcgctgccccctggtgccattgacagagtggtgccctgtgtaggctgctgctgctgtgagttcggtgagcgacagaggcaggcgaggacgtggaggcctgagcgaggcagggtgctgctgtggagtgcgcgcaggcattgcctgccgctgtgctggcatgccctgccggactgccaaccacgctgggggttcccccgggggacccttgaattccagaacccgaggttggagcccggcgctgggcgctgcagtctgtccggcgccgtcccgaccaggtagctggtgtcacttcggtgtggttggaacgaagactttctccccagctgcattcccggaggcgccctttcgacctggaggccgggtctgctggccacaggggctgccgcactggctgggactgccagctgggccttggagacgctggtggctgtggactccccagctttggagcagtccctcttatgaactcaccccttggagaagcagcccatggaaggtgcccaggcatgcaatgttcctggaaggccggtcctccatccttgcccttggacctccattgccatccaagtacacggccatccgacaaccttcaaccggcaaagtacgttcacacctggacccgggctggcagaaggccgggcctgaccgagcgacttgtccgaggagaagcccaacttcgcactaaaagcttttcggaaaaaccaagatcatcatcctgcccaacagacgcagcggatactca

SEQ ID NO: 514136 - DNA, 591 bp, Homo sapiens
aaggcctgagatcagacacaactcacttgtgttgggtaaataatcagaactcccggtcagcccaggctagcagctgtccaatgacaacaggaccctccatctactcagtgtcccaaggaatgagtgaggaccctatgagtgaggaatccagaccaaattaggtgttgaccaaggcgacccaatcatcctgaatgtcctatatacccagacaaccccaccatttacccctcatacacctattaacgtccagggatgaacctcagcctctcctgccatacagcctctaaaccacctgcagaatatactaggctgattgatggcaacatacagcaacacacacaagagctctttatctccaacatcactgagaagaacagcggactctataactgccaggccaataactcagccagtggccacagcaggactacagtcaagacaatcacagtttctacggaacttcccaagcccttcatctttcacaagaacttcaaacccgtgtagtacaaggatgctgtggccttcacctgtgaacctgagcctcagaaacaaagctttctgtggtgggtaaatggtcagaacctcccaata

SEQ ID NO: 514137 - DNA, 121 bp, Homo sapiens
cgtctctctgtggggtggtgatgcagtgctgcggaaaagctgagaagcggaaattggaccctgcagagctggccattgtggctgcagcacagaaaaaggactttccccacagagagagcgt

SEQ ID NO: 514138 - DNA, 291 bp, Homo sapiens
agcagcagcctgaacttctatctatcaatctcttcaggatctcatgtagaagtacagatcaggcatgacctcccatgggtgtacacgggacatggtgccacgcttgcgcagaacttcccgagaccagcatccaccacatcaaacccactgagtgagctccctacgttgtagcatgggatggcaatgtccacaatagcgcagaggcgaatctgtgtaacacagcgcaatggtaaggtaggtttttatataagatgcctaccgataattaaacatagaagaacagcacctagg

SEQ ID NO: 514139 - DNA, 916 bp, Homo sapiens
gttcttccgccgctccgccgtcgcgtttctctgccggctgagcgccccgacccggggcctgagctggactgtcgtcaggccctgcgccctcgccgcaccccgcgctgtgcccccgcttccacgcgtgcccgacggcctcgtcgcgccttcacccggcgaacaaaaaggcgtgggtggggcccggcggtcaggtcgcaagtggaacgagagagatcgccgcgactggtcatttgacaactggctccgagcaatgtgcgataggcgtggttgatgctgggtggatcggacagctccccagatgcacgtgttttcctcttccattcagatccggggcgccccctaggagcaactcaagtggctgttccataggttgcggcattgaggcccaagaatggacttcctaacagtaggcgctgaacgaaggtaccacgagacaattctgtagtgcaattccttgaaaccttgaatgtatccccagttggacgcattggcactcgtcaacgcagaccttggttgacgaccatggtaggaaaggcatcatgagcacacgatcagccctttcatagcaagcggagcatgcgggacaggtgagacccccgttggagagagcaaccaccaggttgcattgcgtggaccctgcagtgcctcctctctgaaatcccccacatgggccaatacgaggaggaaggacaggaatgcactcaaagaattcactgttctgaggaacactttctaaaaaacccacaggtgccatgtaacggtggtccatgccaaggtcccgatgcatagtgccctacttacgggcctcttggggcggcaacccacgtggacgattgtcatggaactctgggagagcgggggtacaacccaaaccgggtggccccatctaacggaggggctaacgccccatccccac

SEQ ID NO: 514140 - DNA, 978 bp, Homo sapiens
gatgatcgaacggttgcaggcgtagcgagagtggtcgtcgtcgtctcctagtgtctcagccggtcgtcgtgatgttcgaccgcctcgctcggatgctcactggagccagaaagcaggtagagtttcttccttcccagctttggatgtagcgagagttgttgcacacatccgttcaacatgttcgaggcgcgccgtggtccagggatcaatccctcataagaagggtgttgagatggcacctcaaggaatgtctatcaagcagtagtgccctgcttggtgaatggttagcctgcgagcgctgtaaaaccttgtcatggagacactggaatcggtccgacgtcgtccttgggcgctcgagtcaccctgcggtctttggggggcatcgagatgcttaccggctgcggaccgcaagcctggacgatgggcggctgaatctcgtcacacagtttactggtcacaattatttacataaatatgcgccgtgtatacgaataaatactcatttacacataggggtccggaagggattaatagcgaaatgtccattggtgggcgtcgttatttgagagcaccattgaccaggaagaagaggtttcagactatgaaatgagagttggaaggattacgattgtttgaacaactgtggaaattccggaagagtgaggacatgcgtgtgttcgtgaaagatgccttctcgggtgaattggaggtatatgtcgtgatgtgagccagtattggagattgggttgaaattttcgttggtggaagacgggtgaaatttgtctgagggggaactggggagtgactttaattgtgcacgcagtaaggcgctgagggggagtgtcctaagcagatggcccgtaaaactttcggaggtttggattttgaagaaaccccttagggggccagtggaggtcctcggggggtaaaaaggggcgtgaaaaactgtcccaaaggcaggggggttttttaaaaagg

SEQ ID NO: 514141 - DNA, 195 bp, Homo sapiens
ttttttgttttttttccctattattacaaagatttattattattttttattcaggatgacaaggccatcaggaggtcaacaacacaagcacagaacagaagggaaaagaaggccaaacgtgcgtgaagtgctcaggcggccgtgttcgtggagaggggcgtgaggctttcggtccctcgggaagtgctaaagcca

SEQ ID NO: 514142 - DNA, 372 bp, Homo sapiens
tctagaggatctccttccatggcatcagctgctgccagagctttctgtgcatttcagtgcggccgatggcgggctgcgggcagcgtcaccctctggtgccgggctgtgctgagcctgctgcgggcctgttgcggtttggcccctgtacgcccagaccctgtccccccgatcccccagctcaggaaggaaagcccagccctttctggatcccacagtgtattggagcccctgactcctcacgtgcctgatctgtgcccttggtcccaggtcaggcccaccccctggaactccaactgccccagccattgcactccggccagccattgcactccgggcagccattgcactccaggcagccaattgcactccgga

SEQ ID NO: 514143 - DNA, 917 bp, Homo sapiens
atcagaaaactttttactcactgttccttcctttacacagagagttaaacgacttcaaaccactttcgttattatccaaccttagttcattctttaagacaacgaaagaagtccctcttttatcactcctttgacagtctgtttacgtgtttcagcaaactttttacgctctttattctccgtttaaagcaatgttgttctcttctttgattaagacagctgctgttgctgcttccttgatcggctcagttactgctttgccagctcaccaacacaaccaacacaagcgtggtgttgttgtcgtcactgagaccgaagttgtctacgttaccgcgggtgctcctcaagaagtcagtggtgagtccaccaccgttctttggagtctgtcgtttctaacgccgcagctaccactgctactgagtctgcctacacactccaggctccagttgctgatgcttctactcacaccactgcttcaactgtggccacctcctccacctctcaagccactgcttcttccaccggagatggttctcttccagatgatgactcttccagcttcgctgcggtgccaagggtattacttactctccatacacctcttctggtgcttgtaagtcactttctgaagtcaagtctgaccttgctgagctctctttctacagtcttattagatgtcgggggttgactgtgtacccagtgtgaacgttttgcgcgctaagggtctggtcaagcgtttctgggggtctcctccgggcccaatgggccgggtcccacaagggctgcgtcagccccacgggtgggcaggttacccggtctctcgtacaactggcccggggtcttcggtgcccggcccttcccggaaatttggcgggcaggccgttggccgcctaccccgggtggttccgtctacccgc

SEQ ID NO: 514144 - DNA, 694 bp, Homo sapiens
  misc_feature (115)..(115): n is a, c, g, or t
ggggaagcggctccggggggtttttaccccaaaattttatataatagggggggaggggtgttggggtgttaactactggatgggctgttgagtagacaagtgggtacaaggaccnctgagacattgtaagctcacggtcatcttagggcctcaatcctcgggggtatgggaaaagttgtcagaaaaaatggggtgtgtggtcctatcgaggccctcaccccttaagttcataatacaggctggcactggcaagggcctctcatgtgtcacacacatgtgtcgttgtgagctcgccccatggtgggtctgtggtgagagtcagctaggatccctgctctagcagcacaaaggaaggggccatacgtggcctgtaggcattgtttcagactcataggaagaaagtagagccgggagcctgagcctgggctggagccttctcccctccccagttggactagggacagtgttaattttgacaaggtgtgggccccagtgtcctcttccaggggtccaaggttacaggagaggtctctgggcctgttttatccatcctagtcctgcatctcccaccccgtgtatcatagggaactttcaccttacaatcttgctaagcaaagtgcgaatagaactcttcctccctatgagctgtagtctcatgtcgcaaataaaagggcaacatgtttctgttaaaaat

SEQ ID NO: 514145 - DNA, 847 bp, Homo sapiens
  misc_feature (364)..(364): n is a, c, g, or t
  misc_feature (679)..(679): n is a, c, g, or t
ttacatgggagaaatcaagtttttctctgctgttttacaagttacacattctaattttgtcctgtggtaacatctgccagctcacaccgggctcacagaaccttatgcctcgcagccgcctcgtaggcccctcgcaggcatgcgctccacacgccccgctctgcgccaccccagccctggagtctgagctctcctgcggggcgctggggccacttggtttcctgtccatgtcttgctctcttatggcttcttctgagctctttctcctccttccttcagtgactcccccaacactttctgtgtgggcctgggatagaacgaggctgcatatcccgcctgtttaggaagccctgtgcttgtatcnctgtaggtattggaggtttatgtttaacatgttttgatatgaagatgtagaaggatttgtgtaggtttggccttatccatattctgtcttcatcggcctcctcgaagaacttcattctgtcctaaaggaagcagtcgcagcttaaagagtgtgagcacgcgcccactccccacagacacacccggcctgccccgcccagctgccctgcctgagaaagcgaggtccttcctttcctggagacgccggccacagttcttcagtgaaacgcttcactctctggtcatagaggtaggaactatagtgtccaataaatgncaggacgaattagcccagctggtcacgctcacagtcaacggttcacaagaaatgttgcggacccggaccgagggttgcccgtgaactgggaaggcaagaaaggtttcggaagcctcgggcgcactttggaaaacaatgcggctgggaccgaagaaccggtttccaaaa

SEQ ID NO: 514146 - DNA, 677 bp, Homo sapiens
  misc_feature (28)..(28): n is a, c, g, or t
  misc_feature (478)..(478): n is a, c, g, or t
  misc_feature (482)..(482): n is a, c, g, or t
  misc_feature (558)..(558): n is a, c, g, or t
  misc_feature (570)..(570): n is a, c, g, or t
  misc_feature (598)..(598): n is a, c, g, or t
  misc_feature (600)..(600): n is a, c, g, or t
  misc_feature (607)..(607): n is a, c, g, or t
  misc_feature (614)..(614): n is a, c, g, or t
  misc_feature (623)..(623): n is a, c, g, or t
  misc_feature (635)..(635): n is a, c, g, or t
  misc_feature (673)..(673): n is a, c, g, or t
actcgcaccaggctgtccgtgtagccanccaacagagtctggccatcaccagaccaggccagggaggtgcactggggtggttctgccttgctgctggtactgaaaacttcttgcttcagtccaactacaatgatctttccctctaaatcccagaccttgaagctggggcctgtggcagcacaaagccagtagcggtaagggctgaagcacagggcgtggatgaagtccccaccacctagcgtgtaaaggtgtttgcctccgttgagaacccataacaaggcctggccatccttgcctccagaagcacaaagggatccatctggagaaaaagtaaccgtgttcagaaagcctgtttggccaatgtggttggtctccagcttgcagtaagccaggttccataccttgaccagcttgtcccagcaacaggagaggatgaaagggttgctgccgtggggcgagaagcggacacaagaaaacnactntgagttgcttttatcctggacagtttatttgcacacacccagggtattccatagcttgatggttttatcttgaganccagaaaaaatntgccggttgttagaggagaaggccacantnagcacanccttggnatggcccanaaatcgcctcgnggtggtgcccgttgttagaacccagaagcgcagggttncatc

SEQ ID NO: 514147 - DNA, 234 bp, Homo sapiens
cacacacactagtagacataacacacacacagatcatagaaacacacacagacatatacacccagcacacagacacacacacacacacagacacacacacagcaacacaggcacacacacacacacacacataacacacagacacacatatacataaacacaacacacacaaaatactgacacacacacacacacagatatatacatctaacacaaaaacacatatatacatac

SEQ ID NO: 514148 - DNA, 303 bp, Homo sapiens
  misc_feature (9)..(9): n is a, c, g, or t
  misc_feature (11)..(11): n is a, c, g, or t
cctcgcggngngcttgtttctgtttgttacttacaggactgagacatcttctggaaactggtaaccctgggggcttttggaacccggggttagggcttctggcttgcttgtggccttttccaagcccaagttctgtgcaaggaactggttgggtgacagcaaggtcttaattcagccgggggttgcaacggaatcaggcaagccaagcctgtgaaagatggagctgacttgctgcaggggaactgatttatagggcaagagaagtcacactccggcctctcagaattcacttgaggttcaatt

SEQ ID NO: 514149 - DNA, 204 bp, Homo sapiens
tatatattgtttatttttattacattatttaatgattgaggtattcttagtgagctacctgcacctgtagccttcttctgcaaatgcaaagagtacaaatgcacctcctgcaagaagaactgctgctcctgctgccccatgggccgtgccaaatgtgcccaggactgcacctgaaaaggggcattgtataagtgcatctgacgt

SEQ ID NO: 514150 - DNA, 735 bp, Homo sapiens
agcggagctgaagctggcgaattgggacgactggcggatgcaggccttgcggcagcgtcgtgtgcgccctgctccggcggtgtggacagccgccgtggccgcgctgatgctgaggcggagagagttcaccaagtgacagggtgatgctttagtgaagaagatgggaactgacatgggatgaaataatgggtgtctgtatatgaacgacgagaagtagtgatgtaagagtgctttacggaagtttgctcagagtgcattatatatctctattgcagacaagtgtgtcctgagcgtaagaggagtattggaatcgatgtgttcagggagcagatggaatgtgtcaaaggtcaaatatgtcaaagaacttcagctggatgattgtaacaaagtcttttgaagtcaggaatgcagcggattaaagaatgcccgacacgggtctctcttctacgatatactcgggttttagacatgcttatgaaaactgcgcagtgtgtgaccctaggatgctcctgagtgattgaaccatctattgctactggggggattagagcgagagagtttgtaagggaaagatcgctgctgagaatagacttcatcattgtgcttgatgaagatagagagaggatggtgcatgtgtggtcatcggggaaggaggagttggagaaccatctacctgtacttacagtaatgtggatgcctcgatcctggaacaatttatttccatagaatgactat

SEQ ID NO: 514151 - DNA, 541 bp, Homo sapiens
agcggagtgggaactgaagaagatggcgtgcctgggcttcctcctccccgtgggcttcctcctcctcatcagcaccgtggccgggggaaagtacggcgtggcccacgtggtgtcggagaattggagcaaggactactgtatcctgttcagctccgactacatcaccctcccccgggacctgccaccacgccccactcctgcccctgtatgatggcaccaaggcaccctggtgcccgggtgaggattccccgccagcagtgcccagctccgctcctccctagtcagcggcaactcccgtcagatcactgccatggtcatgaaggggtaaacattgcacgcttccagcaacgaataaggctgggctggcgtcagggccaagggtgcccagctgggctgctcactcgtgagccgggtcatgtgagacaacagtgtctcaagacatgcaccctggaaccccaggatccaccgccaggacccctggacaagacctcgctcatccctgtgggtaatggtccactatgactgacattgctggacatgc

SEQ ID NO: 514152 - DNA, 137 bp, Homo sapiens
gagcatcaggtcttacaacgcggaacgtgcccacatgtgccactggaagcctgcagtgagacgtgactgctatactggaacgcaggctgatccttgaaatcacactggttccctgaccactacccatcgatgtgtga

SEQ ID NO: 514153 - DNA, 198 bp, Homo sapiens
tagtcatcatattgacagcttgtttcacaaagggaaacaagtacagagacggattaactgggtgagaaaggcaagtgacaagtatagttgaaaaccgtgctggcccaagggtcagttgattcattccgttattccagacatagttgagttcctgaagagtccttaaccactctgactcccgttacgtgttcatcagta

SEQ ID NO: 514154 - DNA, 134 bp, Homo sapiens
ataacctccaaagaccggttccgtataggaaaagctagaccaatgccttgggtagaaacacccaagtccgaagtcaacaacaagcaatgatggcgatggcgattctagttaataaaaagggaggttattggcat

SEQ ID NO: 514155 - DNA, 456 bp, Homo sapiens
acggaaccggccatacaagatgacactagtgtccaaccgtaaagatctaccagtcgtgatcggaagtcgtgggttgaagctattgtatgggggaatcaccagcatatcagcagcaattgaggacatcaggatgaatgactccataatgggagtaaatagaaaggaaagagaagtgaatcaaagatggaccgatggaagcactgatactgacaggcatgagcaatcgtcgagaaattctcaagagagtcggacaagacagagtcagagagagaagtaaatgaaacagccctgtagtggtggctaagaagccatggactgggttgggaacaaatactagagctcccagaaggcaggcacagattgagtcacaattcacaagaaagccctctgaacaaccaaaaccccaggaagtatagtatagcctatgtaagtaagcttttgagacagaatctaact

SEQ ID NO: 514156 - DNA, 369 bp, Homo sapiens
gccaaacggacccaggccctttctttttccccagcaccaattctttcccacacttgttcacttcccgccaacttccatttcaactttctttttacactgtgatgtttctatcacaacctgtaggaccactatcccaccagcaagtcttccctgtacacacatttacgggggcacatatcctttagagtctatagggttattgtgaagccacctcatgctttgtgatggtgcccagcccaaatccttctttgtaatatggtacagagtgaattgtcaagacctctaatcttgtattacttgtgtcaagaggacagtctttgtacaggtaactgtgtgtggaaattactcgtgaggcttagtgcacactag

SEQ ID NO: 514157 - DNA, 1107 bp, Homo sapiens
gcaaacccactccaccttactaccagacaaccttagccaaaccatttacccaacataacagtcatcaggcgcatagacacattgacaaccatggacgccaatcagcatcatagtacctgcaagggcaacagcatgcacaacacattcataaccacagcatcaatatagccaaggcactaacccctataccttctgcatcaatgaattaactagaaataactttgcaaggcagagccaaagctaagacccccgaaaccagacgagctacctaagaacagctcaaaagagcacacccgtctatgtagcaaaatagtgggaagatttataggtagaggcgcaccaaacctaccgagcctggtgatagctggttgtcccaagatagacatcttagttccaactttaaatttgcccacagaaccctctacatccccttgtacaatttaactgttcagtccaacagaggaacagctctttggacactaggaaaaaaccttgtagcagagagtaaaaaatttaacacccatagtaggcctaaaagcagcaccaattacagacacgcgttcaagctcaacacccactacctaaaaaatcccaaacatatcactgaactcctcacaccaattggaccaatctatcaccctatagaagaactaactgttagtatacgtaccatgaaacatactcctccgcataagcctgcgtccgcattcctaccacttgcactgaacattaacagcacaatatctacactcaaccaacaagtcattataacctcacaggtcaaccaacacagcgcattgcctcattacgcacagggttcccaacaacgtacagggacttcggcaattatacccgtctgcttttccacacacatcactatttacattaaccacatttgacgcaccgacattccaaatacacactgtttaacggaccagcgacccctacaccgccaaggatgcatatcatttacaaacaaactacaataacatagaccactattcggcgccaccacgtcaaatctgacgtactacactacctcaccaactgttatagataacgccacataacagatcatataacactaacacaatacatagactaaca

SEQ ID NO: 514158 - DNA, 114 bp, Homo sapiens
ggatcgctccacagacaaggtgaggatataagtagagtctaccaatgcgacttgtgtctcggagatcaccacattcatgtcatgcgagagtcactacgccaattaaagagatgt

SEQ ID NO: 514159 - DNA, 327 bp, Homo sapiens
ctttgtgtctctttggagtgttttagggtgggcaggcggtgtgtgtgtgcgagaacgcactgatcacacgtgtttctttttggggcaggaaggtttgccactaccagcaaagttggaactgctgatgctggttgtcaaggcagctcactctcagctgtgcgtgctggtgtgcgcctgtggtcccagttactcaggaggctcaggtggaaggatcacttgagcccaggaggtcgaggctgcggtgagttatgattgtgccactgcattccagcctgagtgacagaagagactctgtttgtttttttttctccgtccccgcccaaaaaa

SEQ ID NO: 514160 - DNA, 178 bp, Homo sapiens
  misc_feature (65)..(65): n is a, c, g, or t
taaaggggcggtgaacagctacccatactctttataaggtcttaatcctatttatgaggcagggnacttttgaattaatcaactcccccaaaagttcaatttctaataccattaccttgagtgatcaggtttcagcatgaatttggagggacacatacactcaaatcatagcagttcc

SEQ ID NO: 514161 - DNA, 400 bp, Homo sapiens
ggggcgggatgtaaccggctgctgagctggcagttctgtgtcgctaggcttctgccggccgccgccgcacataagccacgaggaggagctttacgacttcccggtcttcggcgccgggcggcaagggccagactctgcgctagagcgctgcgcgaaccggccggcacctgtcgagaaggtgaacgatcgactgtccgcagaagctctaatggcacgcagctgcagcccggcgccactcgctcattgagctgggaaatctggattgggaaagttgacattatcaactattattctcacagatttgtattctccagagtatccaggtccttctcagagaattaaaaagcctgtacaggtctagatattggtatttttaattgatgataagctggaataatat

SEQ ID NO: 514162 - DNA, 120 bp, Homo sapiens
gactctgaggatcccaacgtcagcactacttgggcagaaagttctcctcctgggcgtcaccttgttcattgtctctcttgtgtagcagcttgcctctctcctaccaagaaggagtcccgc

SEQ ID NO: 514163 - DNA, 498 bp, Homo sapiens
ccagcgtccgattcccgacacagaacccaagatggaagaattcaaggcccaattccctgctgatgagtgcaccaagctgaaagaagagatttcccaaatgagggggctcctggctagaaaagccagcgaaacaggagaaaatattagacaggcagcatcctcttttcagcaggcatcattgaagctgttcgaaatggcatccaaaaagatggcatttgagcgaaaaggctttggaagttctggccctggggaccaaaaggaagttccaaaggggggaaccccgtaataatagccgaaatttttgacgcccgaaggcccccatatgaagcttaggagtgaaaagacttcctgagcaaaaatgggcgaacttcagtctttttactgggtttttgcagtattctaaaaaaaatttccttaatttgtaaatttagggccccttagctagtgatcatttaatggccagtgattttaccagtataaagttcccaatatttttta

SEQ ID NO: 514164 - DNA, 358 bp, Homo sapiens
  misc_feature (12)..(12): n is a, c, g, or t
ccctcccaactnaaactccccaaaaaaccttcctttggtaacattttggatactttcccacccctaatggcagctcctcccaaaaatagctgcctttaaaactctgaatttaaattttcaaatatttggtttcatttttcaaacaagccaagaggcctctggtaatgaagtgctatatatatatatatatgacggagtctcactgtgctgcccaggctacagtgcagtggctcgatcttggctctctccaatctccgccttgcaggttttcaagcagttctcctgcctcagcctccttagtagctgggaccacagacatctgtcaccacacccagctaactttttgtatttttggtgg

SEQ ID NO: 514165 - DNA, 300 bp, Homo sapiens
cacgatccccggttttcgagttaagcgattatctactccatacccaagatcataccatctatgcgctatatatattgtggcccatagcttctatcctacggataagatagtgaaatgctgttcccccacaacctttctctctggaacttttaatttcatcccgagttgacgaatgcgggaatagcatgctttaagacccttgcatccaataagctaagaacttttggcccattttttttgggccggtaggttggagtgtgtgctgttgttctgcctttatcctcgcttctctctaaaccc

SEQ ID NO: 514166 - DNA, 622 bp, Homo sapiens
aggagagatatcccacgagtgagacattgtacgtgttggcacatgagatatgcgcgtataaggccataatgagagactcaagtatgagaaccagcttggcatgtgatggaacaagggacacattgtacctcgaggcaactggaatagagcacaggagagctctgatacctggagcaaatggcatggagcggtgatagtgtgaggtataaacctgatgagcccagggttaagagcacagacaagtcaaacgtatgcgaggtgctcacagacagttctggagatcttagtgctggtcttggctatgctggaaccacagggctccaaggacgtcacaagtgtcaagccatcatgtactttgacccagatcacgtgcctgacgtgcaaccacgtcacctgtggtatatgacatgcaaaactcggagccattgtgtgagggtgcacaatatgccatgtgcaagatatgcacgatccgaatgctttaggatgaaggagaacgtgcacagttatcccatagatggactttgcaccaagccgttatgtgtgagaagctccacactgagacataacccctgtagttgtgcaagccggacctctgttgctcggttctgttctggtatagccg

SEQ ID NO: 514167 - DNA, 818 bp, Homo sapiens
  misc_feature (161)..(161): n is a, c, g, or t
  misc_feature (226)..(226): n is a, c, g, or t
  misc_feature (238)..(238): n is a, c, g, or t
  misc_feature (242)..(242): n is a, c, g, or t
  misc_feature (245)..(246): n is a, c, g, or t
  misc_feature (281)..(281): n is a, c, g, or t
  misc_feature (327)..(327): n is a, c, g, or t
  misc_feature (329)..(329): n is a, c, g, or t
  misc_feature (343)..(344): n is a, c, g, or t
gagctgtttccgttcctctgcccgccatgccgttcctggagctggacacgaatttgcccgccaaccgagtgcccgcggctggagaaacgactctgcgccgccgtgcctccatcctgggcaaacctgcggaccggtgaacgtgacggtacggccgggcctgncatggcgctgacgggtccaccgagccctgcgcgcattgtccatctcctccatcggcgtagtgggnaccgcgaagganaacnganncacagcgcccacttctttgagtttctcaccaaggnagctagccctggccaaggaccggatacttatccggttttccccttngnagtcctggcagatnngcaagatagggacggtcatgacttttttatgatgtgggcaccggggggaatccaggccatctgtgaactgctgttctcccagagagatctctgtgcaagagtgaggcctggagataaccagttgtggattatcccggatgcaacattcctggtgatcacattaatcctcttcttcatcctcatatgaaattaaatgaagagagttcctcattcttaaaaaaaaaaaaaaaaaaaaaaaatggtggggcgccgcgaccagagaaatgttttaaaccactcggggccgcgggcccatgagtaatggaccctggcaacgttgacaaggaacgggcggcagggggtccccaaaaacgcggcgccgggttcgacaccaggtcgggcacgtcaaggcagctatccccccccgcggcggggaaaccacagcgaaaacaacgcactccacaacgaacagccccacagcagccaagcaaccga

SEQ ID NO: 514168 - DNA, 489 bp, Homo sapiens
  misc_feature (122)..(122): n is a, c, g, or t
  misc_feature (136)..(136): n is a, c, g, or t
  misc_feature (259)..(259): n is a, c, g, or t
  misc_feature (282)..(282): n is a, c, g, or t
cagcaagggacaccagaatcaaattgctgaaaaccagtgacaaagtgtgaacccttcaagcagccagagaaaaagcaggtagagagatgaggatgaggatgacgacagacaaaccataaagncggcgcagtccagncatcggtgaagatgcatccttaaggagcaaggtgggcagttagactggaattctttatccagggaaaaggccattcagaactggaagtggaataaataaacactgacagaacccagcacaccngcaatatgagaacacagaagggnactcttcaggcagaaggagtgtgatgtcagatgaaaactaatctacacaaataaagaaggccagacatagtacatatgtagtaaataagaaaaatgtttctcttccttttaatcttttaagaagataattgatgttaatatggttctggtcactctatctgtaatagtgtcaatgaaaataaaattaaattgagattttaaaaggta

SEQ ID NO: 514169 - DNA, 138 bp, Homo sapiens
aagtagcgtgcatgagaaccaatctaacacagaagcttgtgctcagtgttggcaaactcttgagtcacctgagcttgtggtttgacctttcaataacggtgaatatatcactttgggctgtacttgatcatgggataa

SEQ ID NO: 514170 - DNA, 1203 bp, Homo sapiens
  misc_feature (868)..(868): n is a, c, g, or t
gctgcgacgctggtcgttcttcggtggctcggtgtgttgtgtggcgggttgtgggctcgtggccctgttgttggtgggtgtccacgccgtgttctctctcccttcgatgggtcttcgggtgtggggcgcctgtttgtcctggggtgccgagggctccgtgaccgatggggcgtgtggcgcacgtgcggcaccgcgcggccggatatgctccgtttttgccctcgggtgttggcctatccgtgtcagaccttgccccgaagtgggacaacccggtgttttttgaccctctgcttttgcccttccgcgcagaacccacttcgtggaggggtgaactttaccgcgccttttggtggaactttgtacgtgtccgccgcacttggcggatccattgaggtccctccgcaagcgcctccccgcttggtatggggccctacctccgcactccacgcgccacttcactgggctcagagaccggtctatacacacttcccgatgacctgcccccttcataggttttcccagccactgtcaccttcctcagcgtcatcggtgctcttcagctacacaacacatgggttttgggggggcaattctggccccgaaccccgccttcttctttgcacggttaaacctcccggaaaagaggccgcagtttccccggacacgtgagagttcctcccgcgaggattcttctgtctcactcacatcccgggtctctgaaggccccggagggagtcccactcccgcccatccaggatgtctcaccagaaggattggtcgaagacgccctcgagagatccccccacgggaccagaagggtcaagctcgtccggagcgagggaggaccaccctgagtcccgccaggccncctgaggtcggaggacacgatggaaggcctatgatgcctgagggccccgctgatggcttccggctcctcgggaagactcccgctttgctgactcgcgagggcccaccctgcctgctcctgctcctcgcgttttgccttctgcccctgtcctagagatcttctgggcacactctgaacctgctcgacggggtccttctccgacagccccccaccctgctttagttcctgtaatgaaaaaggggcacgactacctcaccacttccagacacactttcccaccctgactcctctcccctcgtttttccttccataaactattttgtgtcccgccttta

SEQ ID NO: 514171 - DNA, 399 bp, Homo sapiens
ctgattaatctccactatgaacttttttttgctcctctctcaaaaatcacttgaacatactctgttcatctcgtttttgcattttctactctatttcattgatctgttgtatttcccccagtcttataatatattgtcttgattactatagctatatgataagctttgaaatcaggtacactgatgattgcccctttattctctttttcaaaattgtttctggttattcctagttccttcgtcttttcagataaatctgagcatacacttttctgtatctagaaaaaaatcttgctgtgattttgataggaattgcatcaaatctttggaagaattgacatctttactgtgttgagtcttccaatctatgaacatggtatgtctcaccatttgtttacc

SEQ ID NO: 514172 - DNA, 352 bp, Homo sapiens
cacctacggattacctcaacgatattacaaatagatattactcattattgatccagacaaccctatcttctagtgtatcattatgcaaacagaactgaaagcagggtcttgaagctggtatctgcacacccatgttcatggcagcattatttactataaccaaaaggtgaaagtaacccaaatgtcctgaatggataaagaaaatgtggtttacacaaataacagaatattattcagcctttaaaaggtaggaaattctgacatatgctgcaatgtggattaaccttgaagacattacactaacggaaacaagccagttataaaaagacaaatactgtatgacgccacttat

SEQ ID NO: 514173 - DNA, 191 bp, Homo sapiens
  misc_feature (70)..(70): n is a, c, g, or t
  misc_feature (77)..(77): n is a, c, g, or t
tctagaggatccctgtgctcctcttatccaaacactttcctttgcctgagactcagaatcttcctttaanccaagancctgtctcttccactccaccctttcttcagggagccttagatcacatccactctcaccctggcaggcccaggttaggaatacgtggtgcggacggcaaggggaaagggctgggc

SEQ ID NO: 514174 - DNA, 875 bp, Homo sapiens
cctgcggtaccgcaagtcgagcgcctggagcatggagcttccagcccgtgtgaacctctcagctgccccagtccccgagtctctgcgtgtgcccaccggcgctacactccaagatggaccaggctggagggtgcaggtgctggcccaggtgctggcactggagaaggagcgtgtggccctcagtcacagcagccgaacggcagagcgcaggaagtggaaaaggagttggaccgtcctgacagggctcgtgtggctgagctggagcacgggtcctcagtcctacagtcctccacgatgccttcaatgatcagcatccccatccgtaacaactacattgtacgcccgcgtgcggaagggctctgcccgatctctatgcattcaccgactgcatgtggctgcggtccaggtccagcggcaccgggcaggcagccccttctcctactcagtgcccgggctgggccaacgagattgtactgctatacgtgctgggccatgagcccatggacgctgtctgatcaacgacaatgtggcccaggtgcccctgagcctgaaaggacactgtgctgctcatcacatctgcatcggctggaccacaagggatggcctatggtcttgcctatgcatggacggggagctgcatgggcttccgggtgacgaacctggctgacttggcagccgcatcaatgcctctatggtgatcccttatcttgggccggagcgtgataccctgggttggccggttttggtgccagccaggccctttgtcggtgaattgcccggtttagcctgggggaacgcggccttaccggccaggttctgggttgccactgatgcgccatgtggggtctcccgggagccctgggggggcctggggg

SEQ ID NO: 514175 - DNA, 120 bp, Homo sapiens
tatggaatactctgctgctcgagactgtattgaggctctcatggaggagctgctctaatgaagaagaaccacgaagaggaagtaaaaggctacaagcccagattgcagctctgggttgac

SEQ ID NO: 514176 - DNA, 395 bp, Homo sapiens
  misc_feature (65)..(65): n is a, c, g, or t
  misc_feature (219)..(219): n is a, c, g, or t
  misc_feature (304)..(304): n is a, c, g, or t
  misc_feature (361)..(361): n is a, c, g, or t
tggtggccaggggacaaatcacattcatatgatatggatcagaacggggaaattcccgaataggngcttaagttgaaagtatcacgttcgggaacggaaatgcaccatcgccaggatgcgcgaacaatatatgcatccgagcggggtaatccattgaggaacgcgccgcgggaggtacgacatgccgcaagtacagcggcggccaagagaattggtggngtggcgcaggtaaatgcgtggtgggaagtgattgaccggcaacaagtagcggatcgatagcggcgttagaacggtcgtcatcggngcgacagcaacacggtcgtcggcaccggtcacggggggtggagttattgttcgtcgngccggaaacagcagtaaccaagcccgtcatcgca

SEQ ID NO: 514177 - DNA, 179 bp, Homo sapiens
gtgggtagaccgtggcttgtggggtgaccgtggcttgtgggttgaccgtggctagtgggttgaccgtggcttgtgggtagaccgtggcttgttggttgaccgtggcttgtgggttgaccgaggcttgtgggttgaccgaggacttgtaggttgaccgagacttgtatgttgaccggaga

SEQ ID NO: 514178 - DNA, 259 bp, Homo sapiens
aggtgatccccaacctacccacccactcctgccttctcaccctggcattcccctacactggggcatcaagcctccacagatctaaggcccttcccttccattgatgccagacttcaatactaccctttaccatagctctctcttacttttcttctatcgtttgtcattaaactcaccctaagcaatccattttccccagcataaaatatagttatatcacagattccacaaaagagagaaaacatacactagtcgacgc

SEQ ID NO: 514179 - DNA, 1360 bp, Homo sapiens
  misc_feature (289)..(289): n is a, c, g, or t
gcagagactgtagtatcagggagcagggaggacgggggcgatggcctgcgtcggggccagtgcccagtggactcccgggtgtcgggaggacccgatggttcccggggatctccgtggatgcggggactcgcgcggtgccaaggagcggtgggaggaagcgcgttggacaacggaagactggagggacgcgacgatggagcctgattgtgagacagagtaaagtgtacttgggagtgctccgatctacccatggtaagtcgccagacttgcgtgctgacgcgtgcagtgntgccactaccatgtcccctagcggaggtcacgcactactagttatgatatgctgatgtgacggtctccaaagggagacttcacgtgttgtatctcgactctaccttatctgcggaggcaatcatcattaccgagactggaggtgccagggccgagaagcattcttagtgacgcggcgccggaagccaaaggctggcatgccaggtgcaacgaggttaaggtttcccatcccacgagtgtgcctgggggggtgagtccccgtcacgtttatttgctgagggggcacccttaggtaaggggcgttcaagggctccgtgtgcatggagtcctgggtatgaatccgatcgccttgcgaaaagggaacgcgattgaggcgcgattcggaagcaaaattgccgattggtttccccttggtcgggtcgcgtggcacgcaaagggccctggtgtccccactcgggtccctctacgtgtggacggccatagcaggggccttaccctgggagggggaaaagccaaaggaattcgggggcgaaaggccccgcatacaagctcgtttcgcgctttggccaaatgggttgaaccacggggccaggatttgctgggccttcctggatgagcgtgggtagcgagccctccaatcgcgcctggccaacgcccaagggggggcccactggggcgcatcggggtcttcacgggcaccccttggttgcgccttaaagaaaagcttggcttccaatggactgggacatagggttagtcgacttgaaccgttggcttagcgagccttcgaggccccgggtgggcattggcaacttggccaaaccccttgggggacaaaccttttccgggcccagagggacgcaaactctttatagaagtggcccaatttttcgtaaaggaacctttaaccagaggtaccgttggagccccccgaagcctcctggggaaagggcagaactggtatttcaccacaaaggttctccccttaattaagaggaggttccaactggagccaaccttcggttctaagaaccccaaaagcccaagaaggtcttccggtgcccagggggac

SEQ ID NO: 514180 - DNA, 234 bp, Homo sapiens
tggaaccggggggccccccagtaagtcccctttgttaggcatcctgtccctggatttgacccccccctttttatggggggcatttttttacaaatttgcatttgattgtgatacccaaccctgctttgcaagtgaatacaagggtttccccccttaatttgggccgttgctagttttatttatttatttatttatttatttatttttccgaggccgggtcttgctttgtttcca

SEQ ID NO: 514181 - DNA, 208 bp, Homo sapiens
gttgggtgagcttgtttgtgtccctctggtggacgttgttagtgatttgcaggatacttgtatccgctaacaggtcaaatgcagatcttcgtgaaacccttaccggcaagatcatcacccttgaggtggagcccagtgacaccatcgaaaatgttaggtcaagatccaggataaggaggcattcccccgaccagcagagctcatcttt

SEQ ID NO: 514182 - DNA, 548 bp, Homo sapiens
gaacatgggtatatcagtgtgcccatatggagtggtgtcaacgttgctggcgtaactctctagtcactgaacccagcaatagcaactgactcagataaggaacactggaaaaatgttcacaagcaggtggtggaaggcggctatgaggtccttaacatgaagggctatacctcttgggctatcgggctgtctgtgactgatctggcgcgatccatcttgaagaatcttaagagagtgcatcctgttaccacgctggttaagggcttccatgggataaaggaagaggtcttcctcagtatcccttgtgtcttgggacaaagtggtatcacagactttgtgaaagtcaacatgaccgctgaggaggagggtctcctcaagaagagtgcggacacactctggaatatgcagaaggatctgcagttataaactcgccaccttcgaccgtgtgacagatgcctgatcacatcactgatcacggcagtcccactgaaagtgtttccacatcataacaaagttcaataaaattttggaaacctgttaagatcaaa

SEQ ID NO: 514183 - DNA, 860 bp, Homo sapiens
tccccccttattatcaaggggttggttttcctcataaggcttctgggccttttctcccttagtggtaagctttctctgattggacatcttgggaatagctccttcttcacttttccctctgtgacggggttgtgggttctcatggaggtgctccatttggcgtgatttttagaggtgaggctttctcgtgggggctaccaggatgatttttctttcactcctctctgagagagaagagtgagtgttttagatatgtgctcagctctctgggagctcctccctcgttggggctttttaaatgggaggttccagactcgagagagactctccctcgacgatctcctccactcataactttttatctcgtgggggggctcctttaaacagaggttttcacacaaatattctctccttttgtgtgggcacacgagacgaggaatccactcatatctcccggtgggggttattatcaaccccttgtggccttggggggttatactccctttctcatcgtggatccttttgttcgagaacgacggcattccacagacggggctggacttctctccaccttactaccagaacaaccttagccaaagccatttccccaaataatgtatggcggcgatagaactttgaactggcggcgccaatagaatatatgtcccgcgagggtaagtctgtaaattttttcccaggcctattttggcgtggataaccccctattcctccgtcttaggatacctggaatactctggcggggagccaaagcatgacccgaaacggaggtctctgaacgggtaaacccctctgtcaacggcggttgtgctgtggagtacccgcgctgatgggtgcaaatc

SEQ ID NO: 514184 - DNA, 157 bp, Homo sapiens
aaaaatactgaaacaaccaaacccaaaaaaaaaacaacaaaaagaaaaaaaaagagctggcctgccactcaggaagtctattattctaaaatattttgtattatcgaaaaattttttactttacagcctttcccggtcctcccaccacaaacgtggg

SEQ ID NO: 514185 - DNA, 149 bp, Homo sapiens
  misc_feature (135)..(135): n is a, c, g, or t
tacatctgttatagagggtagtgtatgtgagaatggtgccacagaaaacatgctaaaactgtgtcacccatcagaaggggtagagcatcagctctcagccctgtgctgcaaggtttgaattgtggttgccttcanacaaaatgcttgac

SEQ ID NO: 514186 - DNA, 1013 bp, Homo sapiens
tagcgttgtaccgtccgtaattccggaaggcataccccgctcaattttaatttcaagaatcgagtctagatcccctaggctggtcgtctcacctttcgtcctcaacacatatttgggaaatgtcacagaccccggtggtctcttaagcatgtgatctctgaacgtcgatccagtaaggagtaaggctttgctggacttttcccatgaagaatctgtagagatgcgaacagggaagccatcagcacctggcattctatacgctgctagccccagagttctacctggtacacttacatcagacactaatccagctgactggacacaattgggataacctggcttatgataccaaggctttaactggaatggtgctgccttccttgtaacggagatcaagatttgacttattggaggcccaggaagcccttggaaagctggcctcagatttcatgtacagtccctgtacagggtttccgatcatgtgacaactaccccataatatctacagacggcactgctcctaccaacccgataccagagaactctctgtcccctcgtctagcaggaagtagccagaaagaacatgccagcccctcgtccgtttttataactatgtaggtcatggtacttgaacagagtcagaagcatcaccattgtggataagcgcctcattttgaaattcaccttagatcaaaaatctgcctaagatccaaagggcatcagcctatatggctaaggtcagcagtgatcacaagaccacaaataacatctccgacctctaacattccagacacctcccagacgagaaatgcttagcctcgggataacccctgctcctgccggaagagatgtcaccctccaagataagccacccctccgcccagaacattccaagcctgccacaaacttctcccccacacagaaacattccaagcttgtaataagctccctcaccctaaaaccaacgtacattcttagtctgcaagaaaaccagtgctgcgtgactgaccagc

SEQ ID NO: 514187 - DNA, 159 bp, Homo sapiens
tgctctgtctatgatgcaggatagaagaggtaggtaaaagatgtgaaaccgtagggtatgattaaggggacaggatatcgtaggataatcagtaggaattagaatagttaaaatgattagtgttgagagtgagagtgggaaagtgtgatattgttatgt

SEQ ID NO: 514188 - DNA, 838 bp, Homo sapiens
gtcttatctgcgtctctctagacgatgagtatcaggttcgacttttacccttgttatcatctgatgatgaacttcatgttcccattttgtgttaatggaatattaagtccatctgtgatttctgaaccagagcatatatccataggcgtgacatcttgagtatggctggacagatgacagttaagtttggaacggccaagcggtgggctggcattgatgctcgtgtaagcgccatagttgcctgcaggaacggaggagactgtggcttgagccgccagggagggtaccacggggcttcgcaggaaacgccatcggaattggcggcgcatcgtgcatcttccaaggccttggcgtgaacaggaagtaaatggacgcgcctgggggtcacaaataacaccacccatgaaatggggcaacaagataagggacaccacaaaccgaagaagccaaccgaagggtccggctcagggaggccgcgacaaaccccgaaccaatctcacgaagacaacaccaagataataaaaccaagggcacaacagaggtggacccaggctgcgcctcaaaaacgatcacggcctcaagaacaaagtggccccacaacaagagatgatacaccacggagagaggaaacgccccggggacgatcaccattgcaacagcctggcagaaaggacaacacacaggaagacataaaccaagaacagcacggaagagaacacagagccagcggccaaagagagacgaaccacaatagaacgcaccagcggccgaaaaacaacgcgcgggacaaacacccaagcgagacccgcaagggaggcgcgcaggtatacacaaagac

SEQ ID NO: 514189 - DNA, 418 bp, Homo sapiens
gccagagactggaaaatcacttgagtcagatcaaggccagcctgggcagcatagtgggacctcctctctaaaaacaaacaaaacaaaacaaaacaaaacatccacaaagggtaggaaagttcagttaaacaggatgaataagttctggggatcttatatacagcaatgtgactatagttaacaatacactactgtatacttgaaatttgctaagagagttgatctaaagtgttatcaccacacacacaaaatggaaacggtaggaagcgagggatgtgttaattaacttgactgtagccatcgtttcacaatgtaaatgtatgttgagtcatcacattctataccttaaatatatatgatttccaattgtcaagtatactttaataaagatgaggaaataaattaggggtcaaaaaaa

SEQ ID NO: 514190 - DNA, 159 bp, Homo sapiens
tggaacccacaaccttcatggtgaggcgcgagggtcacccagaaaccctgcagagctggcatataaaagtcaagcgcgtggtctctaccctcagtcccatgaggaaccagtaaaacatacacctttacccaaagcaatggttgtagccaatggctacct

SEQ ID NO: 514191 - DNA, 925 bp, Homo sapiens
ggccggccgccgcccgccggttttgtcgccagaaggaagatggcggatctggaggagcagtttgtctgatgaagagacggtgccgtatagcagcaaaattcatcattcatgcccctcctgagaataatgacggttaaaccatgaatgtcggtaaactgctataataaatttgacaattctttctcaggggaaagggcagcagccccaagtgcatttgtgccccaagtatacatcttgtgcgacccaggtttactttccagtaacaaaacctggccgggtttatgaacgactcagcgtatggatacccaggaacaatgcgcgactttggggagaaatgcaccagttttgggcatccaaaagaaacagaatctgtttaaaacattgtgatccacttaacggacggggcgcgcacactagataccaaagaccccctgtgaagtagcaaacatgccgtgggacctcatggagaccttcagtagaaccttggctctgaagagtttagggtaaaagaacattacccgaatggaggtctgcacctgttgtattggcaaacaaaaattagatgggcccagcaaacccattattgcattgcatagaaagccatcagttcccaggcaaaaaattggtgccaatgccccgtgggggtcagcaaggcagttttacaatccactccttcaaaccatcagtgctggcatcttgaaaattcaggttcattattatgagcatggcactggatccgccagggagtcaaaagatatacagatccctaacgggctaatgagtgcaccgccagcatttaaccgttggacgggcaaaaggaatcgcgtgcccgggaaattcgacacgtggccatttaaccacgtgcaggggtacccaatgtgggacacctttcacatgcgagagaagacagcgcctatctgcaaaa

SEQ ID NO: 514192 - DNA, 362 bp, Homo sapiens
gacaagtatcagagtagtagaaacacataccgataatcactcgccacaatcatggcataggacttagaaaccggagtatgaaaagtctgcccttagcatactacaggtttcagcatcacgtgactgctgtatttatgatccgagtactgtattttttaatctagagtttgattgaacaaaaatccaaatataaatggacccatgcagctaacacctgggttggtcaaggcacccaactataatacacttttataagctaggacatacatattgaacaacatccatgatacttacctattacaactacaagtagtacatactgaataggtaggatgcctaagtacctagataaaaggtataac

SEQ ID NO: 514193 - DNA, 417 bp, Homo sapiens
ggccgtcccactgcgttgtccggtcaggtgggcagaagtgagcgcaccagtcactgctcagtcgattgctaccacagagttttcagcggaatcttccgggtaatcccctggaagtatctcccgagaatgtcgtggtacggcaactccccgtcgatccgcttatactctgatctgatgtccaggaggtcggtctcgctgcgagacaccatgatgcgaatcagggtccggtcctttgttcctgcccccctcatggccttgttgagcctctccgcaaagaaggctggggtattcttgagacacttcaccacggccagcatgccctcctccaggtccccggacatctcccggcagatgctcttctcaatgtcccggcctgtcattctctggtactcattgaaaactgcaaccaagtgggag

SEQ ID NO: 514194 - DNA, 1286 bp, Homo sapiens
  misc_feature (1286)..(1286): n is a, c, g, or t
aaactgggcgagtgtgcgaggacgcccggccagcctgcgggagccgcagtcggcggaggagaaaggaggcggctcccggtatcccgaccccctccccctcctctccttcccccacattccaggccgcccgagggaccgcagcttcactcgaaggccccagacaccggactcagtcggccgagaggcgaagggaaggagccccccgacccaggtacgacgttacatccaagaggaaagtaatccagagcaaaggaagcacaagactgatcaagatggtatagatacatgatggcgtgaccaagttgatggatattaatgacagaatcggtcgcatcagggaagactatccatcaaaaagagattttacggagcatatgaaggccaaatgtggatgaggaggaactggacgtttagggcgtgtgagtgatggatgaggtgagtgactgaccaattcggagcgcgaagcgaaaacgctggggatcctcgcgcgaatcgaacgtgggagacagcttaatcaagatggaccataaggcggagcaaaacgtgggacgagcaaggaacaggaggaaggacaagacaacaacatggatcgacaaacagagactagctggagacatacagccgcacatgcagaccaccgagcataagagagacaagagacccgcggaattgacaccgcggcgaagagcggcaggcgggagccaatcgacagggaccagagtagcagtgacacccgtagcacgttaaagacgcagagggatgtaacacaggggaagacgattgcagacgaagaaaggaccaggagcatcggcaccaagatcgggtagcaccaccatcggtgcacaagcagagcagagagctagcagtccgacaagcaggagagacgagcgccacacggaggaggaggtgaggcacaaacacaagcagacagtagaatcagacagggcgaaggcgcagggaacatcaggaaggggtagcccgcaaatagggagtaaaggaaagagaggaacgcagcacaagccggaggaggaccaccgagagaagcgggaaacacgggagtaatataccagtagaggagtcagagcaggacgtaagaaagacaacacaagagcaatagcgagagcagcctacgcaacggcccgagcagaggacataccgggagaaggagcaaagacaggcagaagacagccggagcagagagagcagccaggatcaagcaagaagggcataaacatggaaccaggcagagtaaacgaggagagcaacacatgggagagaaggcaagn

SEQ ID NO: 514195 - DNA, 902 bp, Homo sapiens
gtagaagagtcgagtgaggccaaggaagggttacggtgttcgaagttactggttgtaggagttttatgcaccatgagtgatcagtactagtaaatcagataaataatcatgttataatgacgacaggacgactgactgtgttatgaatttatgttaatgtgcatatatgctgtattgaaaattatattatagattcacaatttaccgaacagtatatcattattactatattctaagcgaatagtagaaattggaagcgcaattcataataatttaagaatcgacttgtggtgtggcttaagaattgagtggtggtgactgggtaatggtggttcaatgctatgtttccgtaaaggtttagagtatcagaaatggtgcctagtggaattgcagatatgaatgggaaaaatgccctggatttttatctccttgttgcactgtgcatgatttgctatgataatatccttggggattatccctatagtatgtcgatttaaaacgtaacagtatgggggttataggtttcatctctagaagagaagtgtgggattgtaaaacttggaaaggatttgggaatgctaggactattctggggctatagctgggggtgaccgggattaagcgcgggtcaagagatgtgtggggcgtactaatttgacgcgggcaggtctcacgagacggggaccaaaccggtatgccgaaagaagatatccaggaggttcaagacccactaaagctgttcccggaatagtgggacgcgtccgttggatccaaagggtggcgggtgtccccaaaattgggggtgaggggacccctttatgggaggcctttcgcaaccgagccacgccccctggggcttaaagaatctcgggtaccattggccatgtgtctcccccagtgga

SEQ ID NO: 514196 - DNA, 1093 bp, Homo sapiens
ggcgtcgggctgcagtgagaaagatgagtcgagtactccatagggagttaaagttcctctgtaatttactgctatgttggaagaacttgaatgaagtgacaaaaaggagtaaggctgacgtggtacagtaaagacatgagtggctctttgcaagagtagatgacagatattgacaactatacgaatgggttggacagtgcatagattatttggtggcactcaaggtaccaaactttatgatatagacgagagatactatagacctgacatatgtaggcaatgttggaatctctgaaataccgctagcaacgctcctaccgttcaaggtttagcattttgtacacgaaaatattagatatgcaacgggagatacaataatttccacagtggggattggttggcatgccgctggagcatatccagtgttcatcacatagatggcgaagatattcactattaacgctattatagacgttgtactatcaaggaagctaaagacgctctaagtagatgtaccaacagcaaacatcatgaagctatccaccatgcctaccagacaggacaatacataccatacaacttaaattctctagtcggcatctcaaaacgttgtctctagactcacacaacccttactaactcactgttcaactggtcttgacttcacactactcacaactgccaaacataccacacttcacatgttaaatacatggacacttcccacggcttggatagacaccattgactctgtgcaccaatatatggtaggaaatactaattccaacgttatagtgtaacaccccatttattgtatcctcaaggctcaccagggagggcacacacatgcagcaccacactcatattataccttctttggcacagcgggccaccgtgggtctaatcttgaacaaccattcagacacctgtgagaggtaccctccgtcacaattatcgcacttccaggggtttcacaaagaattgaaaagccgattgtgtgacgcaagtgtgccacgagtgggcgagtgcgtcacaccacttggtgggtccccaaccatcagtacgaccatcttcaggcaacaccgcgcaactg

SEQ ID NO: 514197 - DNA, 400 bp, Homo sapiens
  misc_feature (53)..(53): n is a, c, g, or t
  misc_feature (68)..(68): n is a, c, g, or t
  misc_feature (151)..(151): n is a, c, g, or t
  misc_feature (173)..(173): n is a, c, g, or t
  misc_feature (176)..(176): n is a, c, g, or t
  misc_feature (195)..(195): n is a, c, g, or t
  misc_feature (202)..(202): n is a, c, g, or t
  misc_feature (220)..(220): n is a, c, g, or t
  misc_feature (226)..(226): n is a, c, g, or t
  misc_feature (235)..(235): n is a, c, g, or t
  misc_feature (239)..(240): n is a, c, g, or t
  misc_feature (246)..(246): n is a, c, g, or t
  misc_feature (253)..(253): n is a, c, g, or t
  misc_feature (283)..(283): n is a, c, g, or t
  misc_feature (285)..(285): n is a, c, g, or t
  misc_feature (288)..(288): n is a, c, g, or t
  misc_feature (300)..(300): n is a, c, g, or t
  misc_feature (302)..(302): n is a, c, g, or t
  misc_feature (306)..(306): n is a, c, g, or t
  misc_feature (316)..(316): n is a, c, g, or t
  misc_feature (324)..(324): n is a, c, g, or t
  misc_feature (327)..(327): n is a, c, g, or t
  misc_feature (378)..(378): n is a, c, g, or t
catcttttaaatcttcaaatcaataaatctcagtaagttattcttaaaagatntgtacaagcatgatnttggctcttaatagtaaaaccatattttaagatggaaaaagaatcattatgaagcatagagagctttcaaccatttctttganaatatatcttgatataatagcnacngttcatcataatacaaaanagaaggnagattaatttactgtggnacaganagtgctgcnaatnnctaagngccctangtagtttctctcagactttttacatttttngnggnctcaggccaaancnaggngccacctccnggcttggnagnaaacaaactttgcttctccggtgctaagcttccatgactcctctggtaatnagctttgtgcacatttggtagg

SEQ ID NO: 514198 - DNA, 113 bp, Homo sapiens
ccaatatagaaccagcaccaagagtcactaccccccgcggcctcttgactactacctacctgcccccgcctcgcgaaggctcacgctctacccccactcgtgcgagctaacaa

SEQ ID NO: 514199 - DNA, 127 bp, Homo sapiens
cagctctcagtgtatggactacaggtgcatgcaccacattcagctaatgttgtatgttagtagagatgagtgcactatttgacacgctgaagtcaagtatgcgagacatcggggtggtggagagcgg

SEQ ID NO: 514200 - DNA, 729 bp, Homo sapiens
agtctccgtttcaaaaaaaaaaaaaaaaaaccttaggaaagtcggaaaaacagagaagcagggggagaaatagaggggaattcagcccagggaaaaattgtgatctatggcagcatctagttagctgctgagttaaattctggcgtatggataacctgcctgaggtgcaaagagcccaagggcagaaaagaggggctgaaggataaacagggtgtggtacgcagggggctagggttaccgggggagggggctaagtaaaatggctggtgggaatggataggcatgatttcccagaagggacccagattgggttgagacagagaatggcaaaatggggctacctggggaagggagactccacctgacacagcaggagagggataagcaaaatgtggaatagtgctggggcagggccatggcaagggggagattggctcaaaacaattgtgcacatgacctgattgcccaaactgctggggagcgcaagggtaaccttgaaagagccacgagcagtatgaacacaaacaaactaacaaaagaccagaattggggaaatacaactggggcccaggcacggggggctcacgcctgtgtaatcccaccactggggggaggcctaggcgggcgcgaacccgtgagaggccagggagctccaataccacaagcgtgccacgagggcgaaacccccattttctcataaaatacaaaaatttagccgcgcggtgtggg

SEQ ID NO: 514201 - DNA, 863 bp, Homo sapiens
gaagatttaattatttctgagttgcgagagaggtatccttcagacaggttcattgcagaagaggccgcggttctggcggccaagtgtgtgctcacccacaggccgatgtggatcatctgagtcccatctgcaggggatacctgcacttttgtgcactagatacccgacttgtgggctgagttcagcgattgtgcggattcggcggttacggacacagagctggacttcggagtgattttaccactgctaccagaaggcaggcgggcagttgttaacaacgggggccaggcaggggggtcagggagggcagcctttccttgcaacttgtgcgcaagcgtgggcatccgggggggtctctcgggtgcgaggaaccaatgggacattcattccactttctggtgcaaccacatgtgtcttgggatgtttgcgggttgtgtgacacgatcatgtggggtgttcaccctttggcaaggcatgtcatcaataatacacataaggggtactccagaaggccacactttctttccctttggccctttcgaagttcatcgtacccgtggaagattaaggctattgggcgacccttcacctatgtggccattttggtgttcccagagccgaaagaaagtcctgtgggcctaacatatttgtctgaggtaacgtgaatactatcacggttaaccggacggcaaacccggggggatattgttcaataacacaaggattgtattgtgggggcacacaacggtgcatgtgggggttctctttcgctagaagacacattttggaccgtttggaaacgcccaatttcatcaacaaaggtgtttgtgaaactaccccccaattttatttttgggagccct

SEQ ID NO: 514202 - DNA, 271 bp, Homo sapiens
taccaactcgacggacgcatcagtaatttctgattactcaccctcctcccagcctcccaaccttctgagtctccagtgtcgttattccacactgtgcccacatgtacacattattttgcttcaacttataagtgagaacatggcctccaggtccttccatccttccacgttgctacaaaagacatgatttcattcttcctttatggctgaatagtattcgtgtgtgtgtgtgtgtgtgtgtgcgtgtgtgtgtgtgtgtgtgtgaatgcgt

SEQ ID NO: 514203 - DNA, 276 bp, Homo sapiens
ggcccccccccaggatttccccaaatttacctttctttccctttgggcacagagattttttttttataaaatctttaaattttgtttttcttggggggggggggggcaccaacccccccccccgggggcctttttttttttttttaaaaaaaactcctcgggtgccctccccccttggtggggaaattccccccccccttttcccccccttttttttccttggcagggggaagggggggccccgtcccttttatttttaaacatgaatttcattta

SEQ ID NO: 514204 - DNA, 161 bp, Homo sapiens
tgaggatccaactcaggtgcagctgtaactcaggtgcgagctgtaactcagggccgagctgctaactcagtgccgagctgctaactcagggcctgagctgctaactcaggtgcgagctgcaactcagtgtgctgcgctgcaactcatggtgcgagctgtaa

SEQ ID NO: 514205 - DNA, 386 bp, Homo sapiens
taatcgatatcttatccttggccagggaaagaccttgctgtacctgcagctaaaagccctgaacatcttaacagaggcactcgggtacttaaacagaactgaaagaaaggagagacccgagctttgtaacaaagcaggcctctctatgaaagggtggaccaatggcagccgtcagggagagtgaagccaggccgggacagggtcagaggccctgcgcgactaggacctgcccctatgaaccccacgagcatctgaagaaccaaggcggcggtgatgcctagtgaccaggctgcaaggggagactcacaggccagacccatggaaccgctggtctcctcccatctttaggggcagagagtgaaggtaagacagagccacccccggtg

SEQ ID NO: 514206 - DNA, 2004 bp, Homo sapiens
catccggttctcccaccgcccccgctgtgggtctcagcagctcgggcggcgggaggagtggcagcggcaaggcagcccagtttcgcgaaggctgtcggcgcgccgcggcccgcaggcacccggcacgcgccttccccgcaggcacccggcacgcgccttccccgccgccacgatgcccaagaggaaggtcagctccgccgaaggcgccgccaaggaagagcccaagaggagatcggcgcggttgtcagctaaacctcctgcaaaagtggaagcgaagccgaaaaaaggcagcagcgaaggataaatcttcagacaaaaaagtgcaaacaaaagggacacaggggagcaaagggaaaacaggccgaagtggctaaccaagaaactaaagaagacttacctgcggaaaacggggaaacgaagactgaggagagtccagcctctgatgaagcaggagagaaagaagccaagtctgattaataaccatataccatgtcttatcagtggtccctgtctcccttcttgtacaatccagaggaatatttttatcaactattttgtaaatgcaagttttttagtagctctagaaacatttttaagaaggagggaatcccacctcatcccattttttaagtgtaaatgcttttttttaagaggtgaaatcatttgctggttgtttattttttggtacaaccagaaaatagtgtgggatattgaattatgggaggctctgactgtctcgggtgtcagcttaacattccacagatggggggttagtttttatatcctataatacaaagcatattaaatggcaatatggagtcagtcctgcatttaatgtcttgaacattttaaattacttctattaccatgttgttttttagtagaattgtttcctaaagaaaaccactctttgatcatggctctctctgccagaattgtgtgcactctgtaacatctttggttgtggtagtcctgttttcctaataactttgttactgtgctgtgaaagattacagatttgaacatgtagtgtacgtgctattgagttgtgaactggtgggccgtatgtaacagctgaccaacgtgaagatactggtacttgatagcctcttaaggaaaatttgcttccaaattttaagctggaaagtcactggaataactttaaaaaagaattacaatacatggctttttagaatttcgttacgtatgttaagatttgtgtacaaattgaaatgtctgtactgatcctcaaccaataaaatctcagttatgaaaataaaaaaaaaaaaaaaagaaaaaaaaaaaaaaaagggggggcgccccccaaaaacttcccccggggggccccatttcccgccacccccgttttttgtgcccggggggcccccaatgggggcgctgcataacaagaacacacaggcaccggcgcgcgctttataacaacaccctggatagaccgtgcggaacaaaccgcggccagcgcgagaaccacactactgtggcgcaagagaaacccccacacacctgccggggggggcaacacacacgcggggaccacacatacccccacaagagactctattaacagcgcccccggggcacaactataacaaacctcgcgccgggcgtactaagggcggtcacaaccaccagcacctaaaagcaccccgcgcaccagaaaaaaactcgcgcccacacgagacacatggtgcccccacgaacaatttctacacccgcgggacacgcctcattactccccgccccgcagccccaccacgcacacccaccaggacctgtacgccagccgccgacggcgctgactacgccgctaccacgcggcgtaccaacccccaccacctacacacttccatggctacgcgcgacgcgccgtaactaagctggttcacggtcgaggttccccgcagagccgccccgcacacaccccacaccccccccacgccacccaccaccacgcccgcgacccacccccacccccacccccca

SEQ ID NO: 514207 - DNA, 129 bp, Homo sapiens
tatgaagacgacggacagactcacgtcgatgtggcctgctgatcggacactgacacacctgtgtcactgctgcaccgtcatccccagacgctgagcacctcagcgcagcgtgtaatctcaatacgggta

SEQ ID NO: 514208 - DNA, 714 bp, Homo sapiens
  misc_feature (416)..(416): n is a, c, g, or t
ccggtgggtttattcagttccccgagggccagggggggggttcccgtggtgccccccctttttcggggcgggcgctcccccggaagcccccttattggtgtattttcagtttttttattcctctccccccgggcggtgggggggagggtttttttttttcttttctgtcggtttttgttgtcccaagcggggtaaaaaaaacccttctttgtgggggaagggttcccttttttttccggatccccaccttggggggggaaacatccccctttttatgtgtttggcttggggggcgctttccccccaattcctttttttttttccccaaggaagggggggaaaggccccccctgggggccccccccccttttggggggggtggggtggccccgggcgggggttttaaaaaccagggnttcccttttttttttaaccccccgggggggccgggttttgggcccggaaaaaaaaaaaccgggcctttgggggggggggtttttccccctggggtttttatttccccccccccttttggggtttccccccctttggcccggccaaagggtggggtttccccaggggcccaaaaagggggggccccgggatttggggttgggggggcccccccccccccccccccgggggcccccccccggtccccccccccggggggttttttttttttgggggggggtttttaaaaacccaatttga

SEQ ID NO: 514209 - DNA, 1775 bp, Homo sapiens
  misc_feature (1586)..(1586): n is a, c, g, or t
catccggttctcccaccgcccccgctgtgggtctcagcagctcgggcggcgggaggagtggcagcggcaaggcagcccagtttcgcgaaggctgtcggcgcgccgcggcccgcaggcacccggcacgcgccttccccgcaggcacccggcacgcgccttccccgccgccacgatgcccaagaggaaggtcagctccgccgaaggcgccgccaaggaagagcccaagaggagatcggcgcggttgtcagctaaacctcctgcaaaagtggaagcgaagccgaaaaaaggcagcagcgaaggataaatcttcagacaaaaaagtgcaaacaaaagggacacaggggagcaaagggaaaacaggccgaagtggctaaccaagaaactaaagaagacttacctgcggaaaacggggaaacgaagactgaggagagtccagcctctgatgaagcaggagagaaagaagccaagtctgattaataaccatataccatgtcttatcagtggtccctgtctcccttcttgtacaatccagaggaatatttttatcaactattttgtaaatgcaagttttttagtagctctagaaacatttttaagaaggagggaatcccacctcatcccattttttaagtgtaaatgcttttttttaagaggtgaaatcatttgctggttgtttattttttggtacaaccagaaaatagtgtgggatattgaattatgggaggctctgactgtctcgggtgtcagcttaacattccacagatggggggttagtttttatatcctataatacaaagcatattaaatggcaatatggagtcagtcctgcatttaatgtcttgaacattttaaattacttctattaccatgttgttttttagtagaattgtttcctaaagaaaaccactctttgatcatggctctctctgccagaattgtgtgcactctgtaacatctttggttgtggtagtcctgttttcctaataactttgttactgtgctgtgaaagattacagatttgaacatgtagtgtacgtgctattgagttgtgaactggtgggccgtatgtaacagctgaccaacgtgaagatactggtacttgatagcctcttaaggaaaatttgcttccaaattttaagctggaaagtcactggaataactttaaaaaagaattacaatacatggctttttagaatttcgttacgtatgttaagatttgtgtacaaattgaaatgtctgtactgatcctcaaccaataaaatctcagttatgaaaataaaaaaaaaaaaaaaagaaaaaaaaaaaaaaaaaaaaaaaaaaaaaaaaaaaagaaacaaaaaaaaatgtggtgggggggcggcggcccccaaaagaatttcaaaaaccaaacaggggaaggggggggggggcgcgggagaggcaaagagcggtcaaaaaccagggggggcgcggggacaaagggggggggctccccccaaaaaacataacccgcggggagaaacgagagtgctgtgtgggaatacacccagaagaacaagagggagccgggagatgctagcggagcacccaggaggtgttaatatccngcgaccgtcttagtacacgcaagacggattaattcgcagccctggggtgcgcaaccgaacatcagccgagacaacagctgctccacaccaacgatgaagcgcagacagtacgcggaagagaagaaaccagagacacagcgacacgcatcacaccagcttatgaacaacacatctaatcacagagaatct

SEQ ID NO: 514210 - DNA, 295 bp, Homo sapiens
aggagtagttacgcatgaggctgtacactgtgaaacccagtgtatgaactcctctagagatataacacctacgaaacctgttgatacaccgagatttctttctctcgtgtgacaaaacatctttgaaaacttaccttgtgaagacaaaatttgacttactatcctgtgtcaccattacaatttcctggcaaggaaggatacctgttggcaattatggatacgccctaccaggtgattttgagatgtgttgagctcttattgacacttattggtccactttacaggttacctgagg

SEQ ID NO: 514211 - DNA, 1579 bp, Homo sapiens
catccggttctcccaccgcccccgctgtgggtctcagcagctcgggcggcgggaggagtggcagcggcaaggcagcccagtttcgcgaaggctgtcggcgcgccgcggcccgcaggcacccggcacgcgccttccccgcaggcacccggcacgcgccttccccgccgccacgatgcccaagaggaaggtcagctccgccgaaggcgccgccaaggaagagcccaagaggagatcggcgcggttgtcagctaaacctcctgcaaaagtggaagcgaagccgaaaaaaggcagcagcgaaggataaatcttcagacaaaaaagtgcaaacaaaagggacacaggggagcaaagggaaaacaggccgaagtggctaaccaagaaactaaagaagacttacctgcggaaaacggggaaacgaagactgaggagagtccagcctctgatgaagcaggagagaaagaagccaagtctgattaataaccatataccatgtcttatcagtggtccctgtctcccttcttgtacaatccagaggaatatttttatcaactattttgtaaatgcaagttttttagtagctctagaaacatttttaagaaggagggaatcccacctcatcccattttttaagtgtaaatgcttttttttaagaggtgaaatcatttgctggttgtttattttttggtacaaccagaaaatagtgtgggatattgaattatgggaggctctgactgtctcgggtgtcagcttaacattccacagatggggggttagtttttatatcctataatacaaagcatattaaatggcaatatggagtcagtcctgcatttaatgtcttgaacattttaaattacttctattaccatgttgttttttagtagaattgtttcctaaagaaaaccactctttgatcatggctctctctgccagaattgtgtgcactctgtaacatctttggttgtggtagtcctgttttcctaataactttgttactgtgctgtgaaagattacagatttgaacatgtagtgtacgtgctattgagttgtgaactggtgggccgtatgtaacagctgaccaacgtgaagatactggtacttgatagcctcttaaggaaaatttgcttccaaattttaagctggaaagtcactggaataactttaaaaaagaattacaatacatggctttttagaatttcgttacgtatgttaagatttgtgtacaaattgaaatgtctgtactgatcctcaaccaataaaatctcagttatgaaaataaaaaaaaaaaaaaaagaaaaaaaaaaaagggggggggggaaaaattccccgggggggcccaaggtttacccgcgaaccccggctttctgttgcacaaggggggccataagggggaggggaataatgagatagagcaagggccgcgtttaacaagggcggcgagggggacaccccgtactgggacttgggaagagaccatactgtggggggggaacattggacaactccctaaagatttacgccaggggaaattaccccagctgatcgggggcacaaccgaatgctgggctacacttgccag

SEQ ID NO: 514212 - DNA, 1910 bp, Homo sapiens
ggaaacaggggagcaaagggaaaacagtgcctgaagtggctaaccaagaaactaaagaagacttaccacgccgccacgatgcccaagaggaaggtcagctccgccgaaggcgccgccaaggaagagcccaagaggagatcggcgcggttgtcagctaaacctcctgcaaaagtggaagcgaagccgaaaaaaggcagcagcgaaggataaatcttcagacaaaaaagtgcaaacaaaagggacacaggggagcaaagggaaaacaggccgaagtggctaaccaagaaactaaagaagacttacctgcggaaaacggggaaacgaagactgaggagagtccagcctctgatgaagcaggagagaaagaagccaagtctgattaataaccatataccatgtcttatcagtggtccctgtctcccttcttgtacaatccagaggaatatttttatcaactattttgtaaatgcaagttttttagtagctctagaaacatttttaagaaggagggaatcccacctcatcccattttttaagtgtaaatgcttttttttaagaggtgaaatcatttgctggttgtttattttttggtacaaccagaaaatagtgtgggatattgaattatgggaggctctgactgtctcgggtgtcagcttaacattccacagatggggggttagtttttatatcctataatacaaagcatattaaatggcaatatggagtcagtcctgcatttaatgtcttgaacattttaaattacttctattaccatgttgttttttagtagaattgtttcctaaagaaaaccactctttgatcatggctctctctgccagaattgtgtgcactctgtaacatctttggttgtggtagtcctgttttcctaataactttgttactgtgctgtgaaagattacagatttgaacatgtagtgtacgtgctattgagttgtgaactggtgggccgtatgtaacagctgaccaacgtgaagatactggtacttgatagcctcttaaggaaaatttgcttccaaattttaagctggaaagtcactggaataactttaaaaaagaattacaatacatggctttttagaatttcgttacgtatgttaagatttgtgtacaaattgaaatgtctgtactgatcctcaaccaataaaatctcagttatgaaaataaaaaaaaaaaaaaaagaaaaaaaaaaaaaaaagggggggcgccccccaaaaacttcccccggggggccccatttcccgccacccccgttttttgtgcccggggggcccccaatgggggcgctgcataacaagaacacacaggcaccggcgcgcgctttataacaacaccctggatagaccgtgcggaacaaaccgcggccagcgcgagaaccacactactgtggcgcaagagaaacccccacacacctgccggggggggcaacacacacgcggggaccacacatacccccacaagagactctattaacagcgcccccggggcacaactataacaaacctcgcgccgggcgtactaagggcggtcacaaccaccagcacctaaaagcaccccgcgcaccagaaaaaaactcgcgcccacacgagacacatggtgcccccacgaacaatttctacacccgcgggacacgcctcattactccccgccccgcagccccaccacgcacacccaccaggacctgtacgccagccgccgacggcgctgactacgccgctaccacgcggcgtaccaacccccaccacctacacacttccatggctacgcgcgacgcgccgtaactaagctggttcacggtcgaggttccccgcagagccgccccgcacacaccccacaccccccccacgccacccaccaccacgcccgcgacccacccccacccccacccccca

SEQ ID NO: 514213 - DNA, 1435 bp, Homo sapiens
  misc_feature (1407)..(1408): n is a, c, g, or t
catccggttctcccaccgcccccgctgtgggtctcagcagctcgggcggcgggaggagtggcagcggcaaggcagcccagtttcgcgaaggctgtcggcgcgccgcggcccgcaggcacccggcacgcgccttccccgcaggcacccggcacgcgccttccccgccgccacgatgcccaagaggaaggtcagctccgccgaaggcgccgccaaggaagagcccaagaggagatcggcgcggttgtcagctaaacctcctgcaaaagtggaagcgaagccgaaaaaaggcagcagcgaaggataaatcttcagacaaaaaagtgcaaacaaaagggacacaggggagcaaagggaaaacaggccgaagtggctaaccaagaaactaaagaagacttacctgcggaaaacggggaaacgaagactgaggagagtccagcctctgatgaagcaggagagaaagaagccaagtctgattaataaccatataccatgtcttatcagtggtccctgtctcccttcttgtacaatccagaggaatatttttatcaactattttgtaaatgcaagttttttagtagctctagaaacatttttaagaaggagggaatcccacctcatcccattttttaagtgtaaatgcttttttttaagaggtgaaatcatttgctggttgtttattttttggtacaaccagaaaatagtgtgggatattgaattatgggaggctctgactgtctcgggtgtcagcttaacattccacagatggggggttagtttttatatcctataatacaaagcatattaaatggcaatatggagtcagtcctgcatttaatgtcttgaacattttaaattacttctattaccatgttgttttttagtagaattgtttcctaaagaaaaccactctttgatcatggctctctctgccagaattgtgtgcactctgtaacatctttggttgtggtagtcctgttttcctaataactttgttactgtgctgtgaaagattacagatttgaacatgtagtgtacgtgctattgagttgtgaactggtgggccgtatgtaacagctgaccaacgtgaagatactggtacttgatagcctcttaaggaaaatttgcttccaaattttaagctggaaagtcactggaataactttaaaaaagaattacaatacatggctttttagaatttcgttacgtatgttaagatttgtgtacaaattgaaatgtctgtactgatcctcaaccaataaaatctcagttttggaaacaatccccatataatagaaaaagcggcatccctgtgcaaagtgtggtttaaacgggccttattatacgaccccacttgtttattatagagggggcccctggttatttgcgccttttcgcctaagaaataanncgggttttttctgtggggtggccaaca

SEQ ID NO: 514214 - DNA, 248 bp, Homo sapiens
ctctaagaagtgaaacaaggtttcaccttttaacattctttttcaaaattattaagccacattcagctattttccacattcatttctgagtttttttgagaagaatttttgaaccagatctcattagttgattaacatttatttctcattacaaaattactcgttgattaaattttgtggatctccagtttgattaaccgcgtttgatgatctctcctttctaagaagcacggttagggggattcctt

SEQ ID NO: 514215 - DNA, 371 bp, Homo sapiens
atgcagatcgggctgctgctggatcattttcagcacgatggctattgagccgctcaaggcttgaagtagcgtcaaggtatgctgagctgtggcagtgacttcaacttccacttctgggtgtcggtagctgaaaccaatgcctccatcaatatctaggaactctccaggggctttcactgcacttgctacttcgcgtgcgagttgagcaatgtgctgacgcagagtggtggaattatcaatttcgcgttcgatgtaccagaggtccgaaataggattcaggccaccggcttgaacgggtatagccaccaaggcattggctgcaaagtctggcaaaacttcgccgtcgagcgccgcgagctcccgtctctttt

SEQ ID NO: 514216 - DNA, 331 bp, Homo sapiens
cagcaatttactcgcacatctccggtgtcgacctggtgcgcgacggcgaggtacctactacgtgctggaagacaacctgcgcacccccagcggcgtgagctacatgctcgaagaccgcaagatgatgatgcggctgttcccggaagtcttcgccaagcagcgcattgcacccgtggaccactaccccaacctgttgctcaagaccctcaagagcgcccagccgcctcgataacccgaatgtggtggtgttgacgcctgggcgcttcaacagcgccttcttcgaacacgcgttccttgcccgggaaatgggcgtggagctggtggaagggag

SEQ ID NO: 514217 - DNA, 1559 bp, Homo sapiens
  misc_feature (961)..(961): n is a, c, g, or t
  misc_feature (963)..(963): n is a, c, g, or t
  misc_feature (968)..(968): n is a, c, g, or t
  misc_feature (984)..(984): n is a, c, g, or t
  misc_feature (995)..(995): n is a, c, g, or t
  misc_feature (1011)..(1011): n is a, c, g, or t
  misc_feature (1017)..(1017): n is a, c, g, or t
  misc_feature (1033)..(1033): n is a, c, g, or t
  misc_feature (1036)..(1036): n is a, c, g, or t
catccggttctcccaccgcccccgctgtgggtctcagcagctcgggcggcgggaggagtggcagcggcaaggcagcccagtttcgcgaaggctgtcggcgcgccgcggcccgcaggcacccggcacgcgccttccccgcaggcacccggcacgcgccttccccgccgccacgatgcccaagaggaaggtcagctccgccgaaggcgccgccaaggaagagcccaagaggagatcggcgcggttgtcagctaaacctcctgcaaaagtggaagcgaagccgaaaaaaggcagcagcgaaggataaatcttcagacaaaaaagtgcaaacaaaagggacacaggggagcaaagggaaaacaggccgaagtggctaaccaagaaactaaagaagacttacctgcggaaaacggggaaacgaagactgaggagagtccagcctctgatgaagcaggagagaaagaagccaagtctgattaataaccatataccatgtcttatcagtggtccctgtctcccttcttgtacaatccagaggaatatttttatcaactattttgtaaatgcaagttttttagtagctctagaaacatttttaagaaggagggaatcccacctcatcccattttttaagtgtaaatgcttttttttaagaggtgaaatcatttgctggttgtttattttttggtacaaccagaaaatagtgtgggatattgaattatgggaggctctgactgtctcgggtgtcagcttaacattccacagatggggggttagtttttatatcctataatacaaagcatattaaatggcaatatggagtcagtcctgcatttaatgtcttgaacattttaaattacttctattaccatgttgttttttagtagaattgtttcctaaagaaaaccactctttgatcatggctctctctgccagaattgtgtgcactctgtaacattttgtngnagccngtttcctataacttgntactggctggnaagatcagatttgacngtatgnacgtgctttgagtggnacnggtggccgtatgtaacagctgaccaacgtgaagatactggtacttgatagcctcttaaggaaaatttgcttccaaattttaagctggaaagtcactggaataactttaaaaaagaattacaatacatggctttttagaatttcgttacgtatgttaagatttgtgtacaaattgaaatgtctgtactgatcctcaaccaataaaatctcagttatgaaaataaaaaaaaaaaaaaaagaaaaaaaaaaaagggggggggggaaaaattccccgggggggcccaaggtttacccgcgaaccccggctttctgttgcacaaggggggccataagggggaggggaataatgagatagagcaagggccgcgtttaacaagggcggcgagggggacaccccgtactgggacttgggaagagaccatactgtggggggggaacattggacaactccctaaagatttacgccaggggaaattaccccagctgatcgggggcacaaccgaatgctgggctacacttgccag

SEQ ID NO: 514218 - DNA, 1088 bp, Homo sapiens
gaattcgtagcgtcggtaccctccgtaatatgtaaccatctttggttgtggtagtcctgttttcctaataactttgttactgtgctgtgaaagattacagatttgaacatgtagtgtacgtgctattgagttgtgaactggtgggccgtatgtaacagctgaccaacgtgaagatactggtacttgatagcctcttaaggaaaatttgcttccaaattttaagctggaaagtcactggaataactttaaaaaagaattacaatacatggctttttagaatttcgttacgtatgttaagatttgtgtacaaattgaaatgtctgtactgatcctcaaccaataaaatctcagttatgaaaataaaaaaaaaaaaaaaagaaaaaaaaaaaaaaaagggggggcgccccccaaaaacttcccccggggggccccatttcccgccacccccgttttttgtgcccggggggcccccaatgggggcgctgcataacaagaacacacaggcaccggcgcgcgctttataacaacaccctggatagaccgtgcggaacaaaccgcggccagcgcgagaaccacactactgtggcgcaagagaaacccccacacacctgccggggggggcaacacacacgcggggaccacacatacccccacaagagactctattaacagcgcccccggggcacaactataacaaacctcgcgccgggcgtactaagggcggtcacaaccaccagcacctaaaagcaccccgcgcaccagaaaaaaactcgcgcccacacgagacacatggtgcccccacgaacaatttctacacccgcgggacacgcctcattactccccgccccgcagccccaccacgcacacccaccaggacctgtacgccagccgccgacggcgctgactacgccgctaccacgcggcgtaccaacccccaccacctacacacttccatggctacgcgcgacgcgccgtaactaagctggttcacggtcgaggttccccgcagagccgccccgcacacaccccacaccccccccacgccacccaccaccacgcccgcgacccacccccacccccacccccca

SEQ ID NO: 514219 - DNA, 308 bp, Homo sapiens
ggcaccgccatgttcccaagtgtgtatgtctcctgagctcaagtattacaagtatggcattataggcgtgtgcactgccctggtgatctactctttagaacatgatatacatcagggttcagatgtaggtaagatggaaagatacattaattacacaaaatgaacagtgatgtgcattcgaatacaccaggtcagtagattgcgagaatatatttgccacaagttatacaaatggacccagaatgacgaaattcaagactaaatttaaactaaatggtctcacagtattaatttttgacaagaatatg

SEQ ID NO: 514220 - DNA, 826 bp, Homo sapiens
  misc_feature (823)..(823): n is a, c, g, or t
catccggttctcccaccgcccccgctgtgggtctcagcagctcgggcggcgggaggagtggcagcggcaaggcagcccagtttcgcgaaggctgtcggcgcgccgcggcccgcaggcacccggcacgcgccttccccgcaggcacccggcacgcgccttccccgccgccacgatgcccaagaggaaggtcagctccgccgaaggcgccgccaaggaagagcccaagaggagatcggcgcggttgtcagctaaacctcctgcaaaagtggaagcgaagccgaaaaaaggcagcagcgaaggataaatcttcagacaaaaaagtgcaaacaaaagggacacaggggagcaaagggaaaacaggccgaagtggctaaccaagaaactaaagaagacttacctgcggaaaacggggaaacgaagactgaggagagtccagcctctgatgaagcaggagagaaagaagccaagtctgattaataaccatataccatgtcttatcagtggtccctgtctcccttcttgtacaatccagaggaatatttttatcaactattttgtaaatgcaagttttttagtagctctagaaacatttttaagaaggagggaatcccacctcatcccattttttaagtgtaaatgcttttttttaagaggtgaaatcatttgctggttgtttattttttggtacaaccagaaaatagtgtgggatattgaattatgggaggctctgactgtctcgggtgtcagcttaacattccacagatgggggagcttttatatcctataatacaagcatactaaatggccatttgagctgtgtaantgg

SEQ ID NO: 514221 - DNA, 1510 bp, Homo sapiens
  misc_feature (912)..(912): n is a, c, g, or t
  misc_feature (914)..(914): n is a, c, g, or t
  misc_feature (919)..(919): n is a, c, g, or t
  misc_feature (935)..(935): n is a, c, g, or t
  misc_feature (946)..(946): n is a, c, g, or t
  misc_feature (962)..(962): n is a, c, g, or t
  misc_feature (968)..(968): n is a, c, g, or t
  misc_feature (984)..(984): n is a, c, g, or t
  misc_feature (987)..(987): n is a, c, g, or t
catccggttctcccaccgcccccgctgtgggtctcagcagctcgggcggcgggaggagtggcagcggcaaggcagcccagtttcgcgaaggctgtcggcgcgccgcggcccgcaggcacccggcacgcgccttccccgcaggcacccggcacgcgccttccccgccgccacgatgcccaagaggaaggtcagctccgccgaaggcgccgccaaggaagagcccaagaggagatcggcgcggttgtcagctaaacctcctgcaaaagtggaagcgaagccgaaaaaaggcagcagcgaaggataaatcttcagacaaaaaagtgcaaacaaaagggacacaggggagcaaagggaaaacaggccgaagtggctaaccaagaaactaaagaagacttacctgcggaaaacggggaaacgaagactgaggagagccatataccatgtcttatcagtggtccctgtctcccttcttgtacaatccagaggaatatttttatcaactattttgtaaatgcaagttttttagtagctctagaaacatttttaagaaggagggaatcccacctcatcccattttttaagtgtaaatgcttttttttaagaggtgaaatcatttgctggttgtttattttttggtacaaccagaaaatagtgtgggatattgaattatgggaggctctgactgtctcgggtgtcagcttaacattccacagatggggggttagtttttatatcctataatacaaagcatattaaatggcaatatggagtcagtcctgcatttaatgtcttgaacattttaaattacttctattaccatgttgttttttagtagaattgtttcctaaagaaaaccactctttgatcatggctctctctgccagaattgtgtgcactctgtaacattttgtngnagccngtttcctataacttgntactggctggnaagatcagatttgacngtatgnacgtgctttgagtggnacnggtggccgtatgtaacagctgaccaacgtgaagatactggtacttgatagcctcttaaggaaaatttgcttccaaattttaagctggaaagtcactggaataactttaaaaaagaattacaatacatggctttttagaatttcgttacgtatgttaagatttgtgtacaaattgaaatgtctgtactgatcctcaaccaataaaatctcagttatgaaaataaaaaaaaaaaaaaaagaaaaaaaaaaaagggggggggggaaaaattccccgggggggcccaaggtttacccgcgaaccccggctttctgttgcacaaggggggccataagggggaggggaataatgagatagagcaagggccgcgtttaacaagggcggcgagggggacaccccgtactgggacttgggaagagaccatactgtggggggggaacattggacaactccctaaagatttacgccaggggaaattaccccagctgatcgggggcacaaccgaatgctgggctacacttgccag

SEQ ID NO: 514222 - DNA, 437 bp, Homo sapiens
gccggggccgaggttatcaagcgcttttagtccactatatacatacggagtctacattcaacacctagcagctacgcctgatcaagacctcgaattactacccccactcgacagatgacaacctgacacttactcgtaacgactcagatctacacactctatatgaaacgccctagatcaacactgccactagcctggacaacccgccaaaggaaccgccagtgagaaacaactcaatcacttactgcacagcatttagccccgtatatccttccgagatccctctctaatctcccagctctcacaccccagacaactcccccagaccctgcgacccgccctcctcccagctgacatatgatctcccaccccaccctccctatccctctccactcccactcatccctacttcttccacccccctcccttccccttct

SEQ ID NO: 514223 - DNA, 385 bp, Homo sapiens
  misc_feature (5)..(5): n is a, c, g, or t
  misc_feature (39)..(39): n is a, c, g, or t
  misc_feature (322)..(322): n is a, c, g, or t
ataanaaaaggataggttatcatggacttggaaaatggnagtttttttactgatcccatgtgtgggtaaagacccaagttgtggccgggtgcagtggctcacacctgtaatcccagcatgtcagaaggctgaagcaggcagatggcttgagtcccaggagtttaagaccagcctgaccaacatggtgaaacctcatctctaccaaaaatacaaaaacttagctgaccgtggtggcgcgtccctgtagtcccagctacttgggagtctgaggcaagaggatggcttgaaccccggaggtggaggttgcagtgagccgagattngccactgcactccaccctgggcaacagagtgagaccctgtctcaaaaataaagtagttgaaaa

SEQ ID NO: 514224 - DNA, 542 bp, Homo sapiens
  misc_feature (22)..(22): n is a, c, g, or t
gcggtgactctagagatccctncgtaatatgtaacagctgaccaacgtgaagatactggtacttgatagcctcttaaggaaaatttgcttccaaattttaagctggaaagtcactggaataactttaaaaaagaattacaatacatggctttttagaatttcgttacgtatgttaagatttgtgtacaaattgaaatgtctgtactgatcctcaaccaataaaatctcagttatgaaaataaaaaaaaaaaaaaaagaaaaaaaaaaaagggggggggggaaaaattccccgggggggcccaaggtttacccgcgaaccccggctttctgttgcacaaggggggccataagggggaggggaataatgagatagagcaagggccgcgtttaacaagggcggcgagggggacaccccgtactgggacttgggaagagaccatactgtggggggggaacattggacaactccctaaagatttacgccaggggaaattaccccagctgatcgggggcacaaccgaatgctgggctacacttgccag

SEQ ID NO: 514225 - DNA, 988 bp, Homo sapiens
tggaaaaaaattttggctttttggccccggggggggggcgggggggggccccccccctttcgggtcccccgggcccccgccggggtaaaagatattcttcgcgcggcccaagcccccccaggatggttggtgggatttcgagcggcgacccgcgccgaataccagaggctgcagagctaatttgtcggggtttattatagccataaaacacagcggagtttcccctcgatgttggtcaccgagggtggtgttccacacactctctgccaccgagggttgatctggccccactgcttggcggctctctcaacaaagtgggtggggtcatatcgaagggcttcagaccccttgtgtcccccggagcgtgtgttattgatatctaaagcgcggggggaatgtcgaattctttttaccacaaaagattgctcattggtgtgcaagagtaaaagaaacattttctactttctgtttttcaagacgtgtgatcagatgttcatgccccccacgacaacttttctgttgggtggaacatctaccgacatgacgactattttttgtcgcgcccctgtgtcgtttattccgatgattaccccaacattttcccacgcaacaagcgtgctgccgtgccggatcaacctagtggttatccactgtggacgaagggttgtgacccccatgggtggagcgaccgacccactggtgctgggcagctgtgccatccaaacgggcggggtcacacgtagcccaatggccctacgggggctcccccggaccggaacttcccgcctgggggcgcaacctctacgagagaaggggtgccacggggggcgtgctctcctcgtatgaggtggtacacgccaccaacagcactattacagggtgtggcacccaaccggtcccggagaacaacgttcaggactagactgggtacacctcgacagatacgacatatcccccagagatctactgaacgtccttgcgacacggt

SEQ ID NO: 514226 - DNA, 109 bp, Homo sapiens
ttctgattagaatggtctaacgtgatgaagggtacatacaatgaggctcccccaaaggttatttacctgcttcgttccattagcaaagcagttgctgctactgacaacg

SEQ ID NO: 514227 - DNA, 240 bp, Homo sapiens
taagatccactgtgtcgtgtgtctgtaagtttctcagaagatcaagttcgccacatcctttgagctccgtagatctgcgccgttgatatgccactcttcaggaagagtagctgcctcttctttattcatagtctttgtaagggctcggcaagcgtggcccgtggatggagaatccttttggggaggctggttctgcagctgaaaatgtgtggaatagggggcatagaccacgacacagtg

SEQ ID NO: 514228 - DNA, 152 bp, Homo sapiens
cacccactagtgctattcccatgcattattaacactcaagctcatctgcaggtacagccatttccaactaggaaacttaataccacacacttttgaatttccataatttataaaataacatttttctttttttttcttttttttttattttt

SEQ ID NO: 514229 - DNA, 132 bp, Homo sapiens
tttattatagtgataactctgtttatctgtatttgaattattcctttcatggattattcaaggaataattcaaatacagataaacagagttggcagtatattatagtgataattttgtattttacaaaaaaa

SEQ ID NO: 514230 - DNA, 131 bp, Homo sapiens
ctgagtctgtcctttctctctccccgggacagcgatgagctgtcaccgactcgcttccaccttctccaccaactaccggtccctgggactctgtctcaggcgcccagctacgggtgcccggacggtcagta

SEQ ID NO: 514231 - DNA, 305 bp, Homo sapiens
ttttttttttttcccccccccccctttttttgtttccccttccccccccctttttttttgaaaggggccctttttttcaaaaaaaaaccattttttttcccctttgtttttccccttttgggaaaaaaaaaattgagtttttttttttttttcccccaccctttttttttaaaaaaaaaaggtttcccccccccccggtggttcccccccttttttccccccctttttggggccccagggggccctttttttggtcccggatttttaccccccccccttccccttgtttatttttttttttttta

SEQ ID NO: 514232 - DNA, 983 bp, Homo sapiens
ggtgtttcttgacgggtttgtgtgccgaaggatcccgtgtgatgtcggctgagcccactagtaccgcgtagtgtgcctgacatgggcaacgcacgcatatcaagtcttgacagtatcgagcgggtccttgtcggagaatgaccaggattgattcgcgtctgtctgggtgtattattgcatggcaggtcgcgcgcctaacgactttcgtaggatttctgcagctgtgtggtttgccttgaatattgtgctcttgtggatttcggtctaggactcttggccatgatgttctagtcaattaactcctgaaattctgaagatgctgtagggatgtacattccattcaaagagtcattctttctatttatttctcactttgtagtcctgtcatgtggtactgtgttgtctggtttgtcctgatctgcgtatttacaccgaggggagtccgtttttcttttagctgaaatttctccagcgggaatttgcgtgcttctgtgctgatgcatgccgcctgctggtggatctcgtttatgcacttgcccgtgggaatagcctgtgtgacagtgaagagactcatgtatacttttacgctgtaatgcatgcatgatgctcgtaatgttgtgtctgtattcttgaagatactagattacccttactaacttggtgtggagcccaagtctgtcctcctttttcacctggtaaccttgtgtgtatcgcattggttgatgggcagttaccctaaatagagcgatcataattgtgaagaattgaggccaacgctcttaccctacgtgaaagttgtactaaatcccttatcacgtagggtaaatctcttggtactgccgtgcgcgaacggaaagttgggcggtgttttcgcctgagatttgatgattcttgcttaggttgggaacattgttgctggtcgtgacgtcgttactattcattttgttccatgtggttcccgtcaatggtgttttcgactaggc

SEQ ID NO: 514233 - DNA, 199 bp, Homo sapiens
cgggagactgctcaaccatgttctgagctggttgaagcaaggtcaagcgggccagagctcaacagtagtacaacctgaccggtggagtacaagcttggcgatggaatacaacctgccgtgtgtgagtacaacctgccgtgtgtgagtacaaccttgccggtggggtacaaccgtgccaggtggagtacaaccagtgtgg

SEQ ID NO: 514234 - DNA, 160 bp, Homo sapiens
tttccccccccccccccccccccccccccttttttttttccccctttgttttaaatgggggggggggttttttgggccgcccttttttttccccctttttcggttttttccccccccttgggaaaaaaaaaatgcccccggggggggggtggggccccca

SEQ ID NO: 514235 - DNA, 228 bp, Homo sapiens
tgctgggattataggtgtgagctactactgcacctgaaccttttttttggatagaaaatgtgaaaagtgcgttaccatttgaagcatgtattggcccccaatttcaaggtgtatatatactcataaaattaaaagacagttttactttacgaaatgaaaatttacacaattcaaccagtttttggtccattagtttatgggtgtggtcctcaaagcggtctccctggg

SEQ ID NO: 514236 - DNA, 157 bp, Homo sapiens
ttagtgtacgtgtacagcacgtgaatcagttacacctatacatataaccattctttctcagattctttgtttatctctttagggccgcacctgcagcatatggaggttcccaagctagggatcaaattggagctgtagccactggcctacaccacag

SEQ ID NO: 514237 - DNA, 347 bp, Homo sapiens
agtaatgttaccaatgttcatccatgtgatggcagaaattgtgtggatttttttttaatggagttgcactccagcctgggcgacagagtgagattccatctccaaaaacaaaaaaaaaaaaaaaaaaaaaaaattttctggtttggttttacagttccccctaaaaaaaagcgaggtgttgaattttcggaaaccatttttggaattcgaattaaccccagtgccctattggactttttaccattctgctcggttcagtttggattattaaagaaaaattagaaggctctagtttttccctattagaccttttaactatgtctcaaaagcctattatgggtcataaa

SEQ ID NO: 514238 - DNA, 180 bp, Homo sapiens
  misc_feature (168)..(168): n is a, c, g, or t
cccagccaggaggaggtgaagctgccttaatctaagcagttctaggagccaaatggaaacatggaggatggagtgaagctggcagtcccaggtgccagatggagacaatgaaggagggggtgacataattcccttcaaagggtcagctggatcttcagggtgagagtnactggtcgacgc

SEQ ID NO: 514239 - DNA, 412 bp, Homo sapiens
tcctttccacacaaagacaccttccggctggagctctcggtgaagatatgctgtctacactgtggtttagcagtcacgaacaattctaccaaataccttctaccttctcagagtctgaggagaaggaaagccattttgtcatggcacagataccaggtcaatatccgtgggatagagggacctgccttgtcatcatcaacgttctggtgtgcctgtgtgagctgaaccaggaagctgtgtggatggatgtggatgtctctcacccccagtaatccatcccttcggtgctcctcagagaatatcgcaccccctgcatctgacttcctggcgcacattcatgaagaatcccgtgctgtactgctccattgctgtctgcctgcggttccgctgtgacgtcccctccttcagcgtc

SEQ ID NO: 514240 - DNA, 249 bp, Homo sapiens
cgagattgtcccactgcaactccagccttggtgacagactccatctcagaaaaaagggaaaaaaaaaaatttcgggaaccacccgatgctgaaaaaaatgtaaaaaaaaccgaccccttttacactgtgggggggagggaaaataagttcaaccattggggaagacagggtgccgattcttcagggatctaaaataaaaaataccattggactcagcactcccattacggggaataaccccaaaggata

SEQ ID NO: 514241 - DNA, 260 bp, Homo sapiens
  misc_feature (114)..(114): n is a, c, g, or t
  misc_feature (145)..(145): n is a, c, g, or t
  misc_feature (157)..(157): n is a, c, g, or t
  misc_feature (177)..(177): n is a, c, g, or t
  misc_feature (184)..(184): n is a, c, g, or t
  misc_feature (212)..(212): n is a, c, g, or t
  misc_feature (230)..(230): n is a, c, g, or t
atgaattcggaagaagaaggacagaggtcacaggagagacaggactgagctggcattcccatctggtgtgagggaggcaggggaatggcccagaaggctggatctgcaaacagnagtcgtatcagagacagagaagagagcacanttcaaggctganataagaccaggagaactggngctgctntttcctctatctattcctgagatccatngttcctgaaaatcatctnaacatctaagcatctcggaaacaactccca

SEQ ID NO: 514242 - DNA, 1218 bp, Homo sapiens
ggaaagaggggaaggtagtcaatagaggaaggtagtcaatagaggaaggtagtcaatagaggaagggtaatcaatagaggaaggtaatcaatagaggaaggtagtcaatagaggaaggtagtcaatagaaggaaggtatcaatagaggaaggtagtcaataaaggaaggtagtcaatagaggaaggtaatcacctagacggcagggtaactcaactacgcaggaacggtacatccaaatagacgagaccgggtcatcaactcagacggcgaacggtcaatcacctacgaacgccacgacagtccggggaaggcgaaagaagaagaatagagacagaatcgggcccacttcagaaagataaccacaccattaccctgcgagcaaaaggaaaaaaaaaggcataaacctataaaaaccctggacacaaggtacgcgaaagacaaggaagaaccaaacagaccagagcctaggacaacacaaaaccgcctagaggggccacgaacggtaccaaaccttacgcaagcaacaacggggcacgcaacagcaaacaagaataccgaaccaaacaagacagcaagcagaagaacgaacacagacaaagaagagaggaacagacagagaacgatacgaagacaaacacccaaaaaaagcaatcgaacgaggaacaccggcgaaccaagccaagagagaggagaacacagcggagacaaccaaggacgaacgaagagaggaaacgaaggaacacaaaaaaagaggggagcgagaagaacagccacaaaaagaacaacaacggccaccggagagggcacacagtaacgcgtacaagaaaaacagatactgcagaagaggaagagaaaaacgaagacaaacaaaagggaacgagccacagacacgagagctaacaagcgagacaatcacagcagacacagaagtgacacggcgcgccgcgggcaccacagcgcaaggccccggggaccgaccacgggaagaagagagcagacgcgagaggggagcgggcgaccacgagaagggaggaagcggcgagcgagagagaaaccggagagacggctagaggagacgggacggacggaagcagatagggaagaaggaggcaggcgagggagagacgggcgggcaggggcgcggcagagggacgcaggagagagacaagaggcaggggaggaggaggcagagaaggaagggaagagaaggagcggcg

SEQ ID NO: 514243 - DNA, 827 bp, Homo sapiens
ccttttcctccctgtcgccaccgagtcgcacgcgtgagattctccgccgagacgccgcggatgcgctagtcgctcctacctgtgctgccctaggggggcaactcctcccccagcgccaggacatcaagaagatctgtggacagcgtgggtatcgaggcggaacgacgacccggtcaaccacgtttatcagtgaagctgaattggacaaaaacctttgaagacggtcatttgcccaggttatggcaagcttggccagtgtaccctgcttggtgtggggctgtagccggtctctgttgcccaaggtttctgaagccccttgtttggctggtttctggccccttgtttgcagcagagcgagacggaacgattgagaagaggggaggagtcctgacagagtccagactgcttgaccttgggaatgggacctttttgattaaattccttgctccccgtgaaaattaaaggcctttttaacagcaccaaaaaaaaagcaaagaaccacgaaaaaaacatttttgggcgcgccctctcgccctgagaagaaagatttccaaaaaacccactcttctgtggtgggggcgcggggcccgcaggagagcatctcgcacaacgtgcgcgacaacggcggagtcacaaagaaaacccgggagtcaaagacaacgtggcgcggtgctgccaccccagaaaaaaaaccgccggggggaccccacggcgttcttgacacaccccaggagtagggtcctagagcccacccgtggatagcaccaaggcgggccaaagaggcgaacaacgcgcccccgcggaggaggcagcacgacgaccccact

SEQ ID NO: 514244 - DNA, 424 bp, Homo sapiens
ctggggaatggagccaaccagctttgaatatcgccccccaaaggctgtgagctcccctattgtagattttgccccctaacaccttggtggtcctgatccagaatttggtgtggccgttggccctgtttgctttttataaaccaaactctattttgaaatccccacaaaaaaaatttaactccatatgtgttcctcttgttttaatcttgtccaccagggcaagtgcccgccaaaattccagttttttttttccaaaatgtttggaaccagtataatttgccaaaaaaaaatgatacttttctttttttgctgttcccccaaatccaattcaaatgctttttgttttttttttttcccaattcccatttcaaaatgtttcaatggtgctataataaataaacttcccccctttttttttttccca

SEQ ID NO: 514245 - DNA, 423 bp, Homo sapiens
  misc_feature (42)..(42): n is a, c, g, or t
gttatatttgctctgccaggaaatcctgggaaagagccaggnaggtgacgttttatccacgagcctgctatggcttagcctagccctcccctaactgtgaccaagctctggatgagacacagacaactactgaggacctgcaaagtaaggagactgcagggcggaggcggaacttggaggagtgacctgccgtggagtttctggtttcctccttgtggctttgtctggagggcaagccccactctcagatccacatggcaacacaagcagctaaaacgcagatagaaaccccaacctgggaaaaggagtcctacagcaacttttcagaagcttcagaagaaggacgccggagaatgcccgcccgggactccgaggtgccctgtgctcatggattggtcctcctggctccatgagtgtgagtgt

SEQ ID NO: 514246 - DNA, 884 bp, Homo sapiens
  misc_feature (195)..(195): n is a, c, g, or t
  misc_feature (232)..(233): n is a, c, g, or t
ccagtgcctcttgtgagcaactggcgactccacagcctatcaataacagggtggtgagagcttccttcaaatgaggctgctggatcttgcctcttcaggaaaggaaacctaccatggagagcttggttccttgcctccttctggtgctcttactccaagtctatttcatttttccacactgagcaatgaatgtgngagatgtggtcaccaagatctaagttacttgttgaanngaaagttactttcgacaagatctaatatgaaagcatagatttcacatttgatctctgtaataatcatctttcctatacaagtcagcattttggtaaagtttccaagaaggcaagaaccaagagcatggaagcagtcaacagcatcaatttttcaaaatggctagctatttgggcaccagtttttctgttatctaaaatttcacacaattcatggttttattttcatcattatgagtggtccatcttaaagcaaatatgcagtaattctacatgtagtagaggtgtctgaagatcatataacaattaaacataagccagaattaaaatgatataggacgaagaattgagctaataatatgttttaactcttaacacccagcaagaagtcagtcatttatgaagttttagctactaagattactgtggttttgattaccagtgaaaagaaaccacatacatcaggaggtttcaaatcttggtccagtatttgattgttctcataatggggttgaattatcctagaattttttactgaaggggcattattaattcacaacttctggtgtataaataaaggcttgtggtctcgggggggagtgcacaaacaaagggggtgttggttacggttgttcgcaatagttttcaacctac

SEQ ID NO: 514247 - DNA, 419 bp, Homo sapiens
cgcttccggggttcaagcaattgtcctgcctcagcctcctgaatagctcagaaaacatggtccctaggctgaaagtctaccattgactgtagaaaaggaggaaaacaggtggctcatgcctgtaatcccagcactctgggaggctgaagcaggtggatcacttgaagccaagagttcgagaccagcctggccaacatggcaaaaccccatctcaactaaagatacgaaattagctgggtatagtggcacatgcctgtagtcccagctactcaggaggcagaggcacgagaatcacttgaacccaggaggcggaggctgcagtgagccaagatcgcacccaaacagggattaactgattaactctatcctaagacaaaacataatcaaatggtagtctgcccagttcaaaccaaaaaaaa

SEQ ID NO: 514248 - DNA, 614 bp, Homo sapiens
  misc_feature (195)..(195): n is a, c, g, or t
  misc_feature (232)..(233): n is a, c, g, or t
ccagtgcctcttgtgagcaactggcgactccacagcctatcaataacagggtggtgagagcttccttcaaatgaggctgctggatcttgcctcttcaggaaaggaaacctaccatggagagcttggttccttgcctccttctggtgctcttactccaagtctatttcatttttccacactgagcaatgaatgtgngagatgtggtcaccaagatctaagttacttgttgaanngaaagttactttcgacaagatctaatatgaaagcatagatttcacatttgatctctgtaataatcatctttcctatacaacagctagcactccttcggctaaacgccttctcaacacgaacgaagacaacagacgatggacagagtaccagatattttctaacatggctagctctcggcgcaccagcttcttactgtcatcgtaaaactttcacacaacttcatcgttctccattctcatacttatgcagcttgtcccctccttcacccgaacatatgcagtaacttctacatgtcactccgagcgccgtctgacagcatccatatacacaattacaccatatgcccacgaaattaacacttgcacctatagacagccccg

SEQ ID NO: 514249 - DNA, 459 bp, Homo sapiens
cggttactgaggtcgatctagagcgatccccctgggaggctgcagtgcagatttcagggacagctttcagttctgtattgtaaatagagtttccccaagcgcaggtttgtatttggctaggtatgatggagatgtattatcacttcttgcctgtgctctagtatgggctcccttagtccttgaatgaatgaaggaaacttatgaaaatgtagcacaggccaggcgcggtggctcacacctgtaatcccagcactttggggggccaaggtgggtggatcatctgtggtcaggagtttgagaccagcctgaccaacatggagaaatcctgtctctactaaaaatacaaaattagatgggcatggtggcacatgcctgtaatcccagctactcaggaagctgaggcaggaaaatcacttgaacctgggaggcggaggttgcggtgagccgagagtgcactat

SEQ ID NO: 514250 - DNA, 279 bp, Homo sapiens
tcggatgcaagtgtctgcaaacatttctggaatctgatccaataagctggtgataactgcccgagactcattgacgttgaccaggaagccatccagcagtggtaacaaacatgtcaggcacagtcagacacaaccatcatctgccggctgggccaagtgagctcttcacattatagcaagtggagcacctaaattgtagcatgacaaagaccaacgcgagattgctagactctatctgccccaccctcccataggtacgaaagtctaacagatgacttg

SEQ ID NO: 514251 - DNA, 110 bp, Homo sapiens
agagagctagcaccatgagcttcaataccctggggtcgggggcggaggcggaggttgcagtgggccgagatcacgccattttctgggcgagagagcgagactccgtctca

SEQ ID NO: 514252 - DNA, 956 bp, Homo sapiens
cgcgcctgaggaggaggaggaggcgggggcggcatggctgctgtggtggtggcggctgcgggtggcgcgggaccggcggtcctgcaggtggccggtctctaccggggcctgtgctgcggtgcgcagccgctgccctggggcctggtggctcgtgtcaccctgctgcagctgcgcgtcttcccatgtgctgccccgtgctcgggcctggccctgagtgtgggctgcctgatggcagctggggtcgggggccgagtgcccgatgctccatgtgccaaccgctttctacgacgcgctacctgcgacaagatccagcttgctgcgcaggtcagacccagctgcttttgagtcccgcctggagaaacgcagtgaatttcggaagcaagccagtggggcattccaggcaaggtgattttatcaaatgtgtggaacaggaagacatgatgccttggggaaaacaggtcttgtgaacaggaggattcacgtaagggacaagactctcagtttcaagtcttttaacattgcagattggtcaacaagaacaaaactgcagaagcacataacacagatttggcagcaatattttgcagcaaaagatacagtctacgcagttattccttgcagaaacagttcggattggatctggaaccgggctcagtcctgtccaacaatttctattgtgctctgccaagaaggggacagggttatgacgttaaaggtgggacaatggaccgggtacctgaactccacttcactgcacttaattagtattcagacccgatggggaagctgacggaccagcccagctgactttcatattcaactattcctgaagcttgagggaaggcaacgggccatagtgcttgatgacttgccgaaaactggattcccacatttctgaagtggtggacgaaggccagagagcatcgaccgagccaggtccagtcttctacgatacg

SEQ ID NO: 514253 - DNA, 1058 bp, Homo sapiens
ataatacaggatatcagcatatttgtgcaccttattaagccccatcttaagaaaacacaaagtctaagtctgctgttacaacttgtcaatggtatacgaatattagtctctaaattccagctttactgtgaagttctatagagtgttaaatacaaattttcctgtcctgcttcacacagttccttaaaatcagtttggaccttgggtcatagagtcttcatatttcagtatctgggtggtcccttatgacttatacataacttggtaaaacagacaaaccaaactttcttctgatgcttggacatatagtttggaaaggagttcggacttttattcccctcattcatctcagtcatcgagtgcgctaatttcacaatacgatttcggtcattacaattaccatatctttatcatatacaccgtaccctattgcgtcgactctgttacccatataccctctcacggtcaattacacactacgcttttcacaactgtactactattataacaaatatactgtacctagcctaccgacattgctacttcacaagaaaaaccacacgcccccacccaaacacacttggtacgcaagctgggcccctccacaccgcctctaaaccaccaaccgctatggccacccggcccaactatgtctcaccgcaccacggccccaagcgtggcccccaaaggacaccctgggcgcccacacacgggcggcgggcgctcccccccaacacacaaaccccccggcggccacccacagctgtagaacacccacccgggaccccagcgccaccaacgccgaccacacagcggagcaccagccttgaatatgcccccccccgccgggaaagcaccctcaccacgcgaccctagcacacgccgacatctccgcagcccacgccaggctatacaccgccccagcgaccaccaccacagcaccagcgcactcgtcaacgcccagactccacgcgcctcccccgccaaatcagcactcgccccacctaccccccccaccgcctcagcactcccatctaagcgcccacccgaagccaccg

SEQ ID NO: 514254 - DNA, 137 bp, Homo sapiens
ttatagccatacatgacaacatgggacccactactactaaaaatgcctcgaattccaatgagacaggcggaggtggaccggctaagtggtaccccagactgtgcccaaacatgggatgtgagcagggggatccatct

SEQ ID NO: 514255 - DNA, 366 bp, Homo sapiens
atctagcatctcctgggacatcatgtatagacacagcccactcccagcatctgagtaatcgtctgctgctcttgcactgtccgctcccaaatgaggaactcatcggtaaggccagaaaggaaagggagaaaaaacaaacaaacaaacaaacaaaaaataggaaaaacagaaagagcgtattcatcagatggtagcagacattctgggcatgcagcaaacccagccacacaagtggacatgtgtgcatcaggtgggactgctgcatcttgttttatgaaagaaataaaggcacgtcacacagatcctttcgcaaggcatcccccatgtgtgtatgtctaaccccaggtgacaggtaaagcagccagg

SEQ ID NO: 514256 - DNA, 370 bp, Homo sapiens
ctattattatctatattgtttccatacaaaacttaggctatttatcttatatctagctctccttgagattcgactctacatatgtatatacttcatttcttccacttctctcatctcacttccccttgctagtcaaaatggtttcttcacagctctcaaacctgcatattctactcctcgtcacttagcttgcactgttccccatccttttttcctcatccccacccatcctttggcagctgggttatgcttgttataaagccatgttatcgtttgggggcgttacatgcagcacgcattttggcatagagcatcactgtccaatttttatcccacactagttgtcgtgttgccagattggtttaaagtc

SEQ ID NO: 514257 - DNA, 160 bp, Homo sapiens
aaagctgtacctagtacaccttcccagcctctatcactggtgacacaccagatttctgtggataaatggggctgacggatgttgcaaagctcccaggaaccacaaagagcacgcctgagtcagcagatgctcgcaggggctgtccccacaagagagacgt

SEQ ID NO: 514258 - DNA, 1502 bp, Homo sapiens
  misc_feature (207)..(207): n is a, c, g, or t
tgacttctccaaacaaacacataattatgaatcaacacaagccgacccacagttctaattattagacatacatcccgtcgtactattatctcttaagccaacatctaatcaacaagcctaatttagttctggttgccccaaagcctattacctcacgaacctcgcctaaacaaaagcactgctctacacttaaataaacttaagctnatcgctgtactacctatcgccctcaggaatacagtggacatgacccaacggccttctttaatcacaagctagaaaccaacataatacaacagagagagagagagactgctacccatacatgctattacctacatcgtgcgcgctaacagaactctaccatgtaactctctaatcattatcagcgaagacacacaggagactcaatcaatagttgatgataagtctatacttagcgaaaaacgcagcaactgtgatgcgccacacacttgagctgatacaatgcaccgcggataagaaggcagaaccacgcccaggaaacgcctggaaaacgcagggcaacataactatccctgattctacaacccataatgagagcatacccatatacacacacataactcaatacagacacgtgacttatagcacatacaacaaacacacctcagagctcacataacaaccagttgcttaacatacatacacgtcctcaactagacacaaagaactatacaaactccctgagcccaaaccaaactactagatcatgaactaagacgttaacaacacagtagacactctatagaatagaataaaacacgataacacgtacttttaacagcgaaccttccacctatacatgaacttcccactcaacacgacccaatgatcgcaaagaccacccatccacactgagagtcaaactacgttacatatggcccggcaacggcacctccattaacaaaccctaagagcagggagttcatagggatataacttacacagccgtttacaacaaccgaccaagtttctatcaaacaccccacgctagaaacacaagcacacaataaagcacagaaccacacaattacagatcagcgaacaacaatccacactaatagaagaggcagattaaacctcaattcaaccaaaagagcgcaccagagcatagccatacagcaacacaaaaaaggaacgattaaagaacaggacagcccgtatggcgaataacgacagacaaaggaggagccaccgagtatggaccgcacgacagacaggaaagcaggccaagtacgccaaacccagaaaacacgcaacggaaagacgctacacaccagaggagcacgacaatagaagaaacaagaacggcaccgaggaacgtacatcacagagaacaagtacatggacagagcagaaaacgacacgcacgaaagacgcacacaaggagaagaaaaacacaacccagcagagacatacgacagaacgaccaacagagataaagagcccagatgagagcg

SEQ ID NO: 514259 - DNA, 273 bp, Homo sapiens
  misc_feature (230)..(230): n is a, c, g, or t
ggggtactagacatccccttatacagcagctatccaagcacgcagctatgtcaagtatccaaggaaatgtcagaaaggcaaaatggccagcattatccatttgcttttttgggtatactagagtgaatagcactttccttacatagtgcatgtgatttcagcgttatttcgtacttgagaaacattgcagatttccagttgggaagacacccttgaaatctttatgagtnagcataccccaatccaccctttggaatagcttggctgtagttg

SEQ ID NO: 514260 - DNA, 216 bp, Homo sapiens
atcgtcaaccaacgcatcgccgaagccttcatgacggaaggcgccgatgcatggtacatggacggcgcgcgcgagcgtttccttagggagcgcgcgagcgaagactggaagaaggtcgacgacatctgcgacgtctggttcgattccggctctacgcacgccttcgtgctggaggatcgtcagaacttcccgcagctcggcaacatcgtccgcaag

SEQ ID NO: 514261 - DNA, 1685 bp, Homo sapiens
  misc_feature (685)..(685): n is a, c, g, or t
  misc_feature (689)..(689): n is a, c, g, or t
  misc_feature (943)..(943): n is a, c, g, or t
ttgatcgccacacaaaaagaatcgaccgcacggggcgttgttggttgtagtaacaccacgtgtgcgtgcgctccctccgggtctctctttattattcaccacggtggttcgctccttttaatatggggtgttgactccgcagagaggccccccttctggcgctggtggccgcggaaaattttttcctcggccgactcatcccgactagggcgtccaacgagatagtagatccgtcgacgggcgccttctctcttcttcacacaacgggaagtggagagataactcttgtacgttgtcgatatgtccagacacgtcgtgagaagagagagggtgctgttctcccctccctcgtgagtaatggtagagtggtgataagcgtgtatgtaaaaaatggagccgtcggtctacacacaaaaggccggcccatcaagagaggtttgtccccaagacgctttctttgtggggtgtttgtaaccgacctttgtgggaacagggttaatagtatgtcgctcgccctccctccccttagagtttcttttcttatggacgaacccctcttcttcgcgtcctctataggagtttcttactattggccgcctcaatggaacagactagttcatcctacgggggggccgccccccacagaaaatgtaattagtggtgcagccgtgaggaagagaatcangctntgtgggtccgcttctccccgccgatagatgagatattatcctctccctgcaagtctgaataggtgatagtgcctccctctatgtagtgagaaccaccacagctgatgatcttggggtgtggttcttcaccaccgcaccaccgcattttgttgatgtagcgaagaggatgtgcaccaccccaccacacaccagcttggggggtgtcacaacacagcacaacacaacaggtttcttctcatcttcggagtagggcntttttgggagagccctctctctcgagagaacccgacacgcggctctcaccacagagagtctcgagagatacgcgacacacagctcccacacagctctcctcctgagagagatatttcgcagcattctcggaggactctcacactagaggagagacatatgctctcgagagaggcccacacgcgctttgtgagagagacacacgccctctctgagaggagagagtgtttggagagggcccacgctctatacgccccttatcacacagatatgtgagacacacgcgctctcaaacgcgagagattctctcggctgcacacccctctgaggtctcacagagagttgtggcacacacagagacccccgggccacagagagggacacacagcggccacagggcccacaggaggtaatgagagggccctctgtctggaaacactccacaaggtctcacacagctcggagaggctcgaagaattccgccaccctgatccccccgcctctgtctggaaagaatggcgaggacctttaaattcttggtagaatgccttggaacacgcacgcacaactccacatgcacaaccactcccaaagagccacccacccccccggagtatagtggagatggccaaagtggtgttctgaggacccatgaccacccaagattttgagcgccttaagcccgccagaagcccgggtaccccttggggacccggaggcccaattaaaagttcaagagttcca

SEQ ID NO: 514262 - DNA, 340 bp, Homo sapiens
  misc_feature (64)..(64): n is a, c, g, or t
  misc_feature (198)..(198): n is a, c, g, or t
atgatcagagagtctacagcccctctaatactaactacctgactcctacccctcacaatcatgngcagcaacgccacttatccagtgaaccactatcacgaaaaaaactctaactctctatataatcttccttacaatcttctttattataacattcacaggcacagaactaatcatattttatatcttcttcgaaancacacttaatcccaacttgggtatacatcaccgatgaaggcaccaggcagaacgcctgaacgccaggcacattactttctaatacaacactctagtagggctcccttcccctactcatcggactaatttacactcacaaaaa

SEQ ID NO: 514263 - DNA, 287 bp, Homo sapiens
atccccaagaccgagggtcttcctagtgcagcgtgcacatcataatccaaagcacgactatctcactgcccagctgtaacaccttccttagctgatgcctttctctatcgaatccaggttccacagtgtcaattctaccctctctaccatctctacaagcatactggctcgccatcttgacattacctggctcgagttcactgctccttccaaatgccctcaaatcgactttgtgtcagagtttactgtctgggtgtcccgaatacatgtggatctgaagggaagga

SEQ ID NO: 514264 - DNA, 637 bp, Homo sapiens
gtgaagctgttagaatggacagtacagatgttgcagattattccaagaactccttcagcaggtgatgttcaccattcgtaaaccgcattttaagacggtcactttgctcgtctctttgggtacatacgttttaataactgggatggtgaagtagtgtctaaaaaggtcgagtctttattcaccgtacattaaaattgggaaaaggaccggacttacctttggttctcaatcattgtacaaaacccaagaccttatttgggctcattagctgaaagaaggcacattcggccaaaccgggccttgtttagggccattgggaccctgataacccttccgaatggagggacccaggcccttactgggcaatgtacaggaaccccttttggacaatgggaatcacttggagttatttatatacacggggctttttccctaccggagtgtattgctactcacaggctacccacacattgtgagactgtgttaaatattttttaagcgtgattgtgtaactgtagcactctggattgtggcaaaatgtttttcagcagagcacgcttttataacactggtttttgacagcgctggaactcaccctttccaatggacgggcccggggactctgccatgcttgtgg

SEQ ID NO: 514265 - DNA, 334 bp, Homo sapiens
agggacgaggacacgttcataactttctacctatgagtagtacataacgacaaagactatgtaatatatggaccatctaccttcagcattccaccacgatcaacgcaataatgacttaactgagatggcgtattaatgaacctcaatctagtcaatgattccaccacactaccactcagtaacagcaattctcaaagggccaaaactctacgatgaatgaggatagaatataaaagaaaacggtctactccctagcgagaatgaacggaataaatatacctcagaaatattatgcaaatattatcatagagaacgtattgagctgtagtaactg

SEQ ID NO: 514266 - DNA, 320 bp, Homo sapiens
atcctgtgatgtattattgggctagagtggaagtggtttgggtaggctggcttcagtgcatttgcagaaggaggagtgggtggagggaaaggtgggagagagggaaggagtgaaagcaggagaaagtgaagaaaggagaagtcatgtatggattacctccacaggattatgttccttgattcctgagaagttttttctcttgattttaccccctcagtctatcactgcaagagaaaggggtagaaaagacaaacagaccacaaaagacaagaacccagacatatagacagacgcacctgttgcacatgcatgcacccagg

SEQ ID NO: 514267 - DNA, 902 bp, Homo sapiens
acttggaggttggtacattctttgttgtttagtcagtgagccaatcttggagctctgagattctttactcagctggtctatctgctggtaatactcgtgattgcatatgaactcttgtagtgtctttttcagctctatcagatcagttgggttctttcttataatgcccatttcatctatcagcttcgtgtatcatttatggtaatccttagatttcttggatgggtttgactatttctcctgaatctcgagtgatttggtcctatccatattctgaattctacttctgtcatttcagccatttcagcctggttaagaacccttgctggggcactacggggtggtatgtggggaggaagagactctggcttttacacatgtaggctatatagcaatgttccactcctcagataccaagttttctgtggcaggccatccttatatggcaaaaaatacctgaggctgggtaatactatacaggaagcttactggctaatggtactataggctgtacaagccggcccagtccccaggcctctgtcagctttctgggtgagggcctcggaaaagctaccaatcatggtgggacgggaaaggaacccgtcgttccaccttaggggagtcagaagttagagagagggacaggaagaaagcatgatacttgtaaaccggaaaactcctgagcagcacacaacaaaacggacgatacaggtggggagcaatcatctggaacgtgccaggtgcggcactccaacaggacctcagcggaataacacaagacgtggggcagcaaattactgcccggagtacaggtggcaggacgaccaggggcaagtagaaagcgtgaagagcaaataagaaagtgggtggcaagacggatggagagcaaacatagtggaagg

SEQ ID NO: 514268 - DNA, 196 bp, Homo sapiens
acagtaggctgaactggtagcccaagacaagtgcaccagccagaaggacccaggacatccaacccagctgatcctatgatgggaccgaggtgccaatgaagactacaacagccctgctctggctcacttcagtaagctgatccagtctacacacggttggaagcttgagagaaacaacgagccctgttctatgtca

SEQ ID NO: 514269 - DNA, 931 bp, Homo sapiens
  misc_feature (13)..(13): n is a, c, g, or t
ctggcgtcttgcncttggagatatataagcattaattgaaaagcacagcgaagcatcgagcggttggtgtagaggtgtgagcgctgctctgcacatagctatacgcgcttctctacgaagcaagtctcgttaggcaatcttgaaatgagggaaccccaatatgttgtgtggtcgccggatattagtcgggggtaaatagacgcctggctggccgctgatccggccccccatattgggtcgccccagggtagaccagattttgcgttataccacaggagcgcaaaaaacaagcggtttgcgcatgcacacccaaacgtgggcggcccaaaaaacagggctgggtgggaccgtggcaaaccacgcagacagcgtgcccgggaaggaagagacacttccggggaacatacaactccgcgggccgccccccgggagaacacctcctgtccttagagaaatcactatacggcgccgccacaccatatggggtcacacagctgtagctgccaggagaccacctcagtatgcccgccgcaaagggttgtcctcaccgggtctatcacggggaatcggggagacgcaaaaaaaagctgggtgacgaagcccagagccgaataagcccggtctgcgggcgaagacggcccgtggtgtcgacaaacaggaacctgcccccccggcagcgagaccggcggtccgcctgcgtgcggcccaacgccccaagcccggtcgcccacatatggcccgggctcttattaaagctcgtacatacgccatgagagcgtgcacaccacaccgcccgccggcccacgacgggcaatgaagcttcgccggcatgcacaattacaccgaggaaggcgccactatggccgaaccggcaacccaaccgggcaagaaatctcaaccaacctatttttaaaacccccccaacataaca

SEQ ID NO: 514270 - DNA, 877 bp, Homo sapiens
ggcgcgaggagccgcgaaagttgcacaagacagaagtgggcccacccaaaaggcgagtgtcacgaactccctccatgttggagcgtaaagacccggcgccgcgggggtcacacacggggtaacgccccttccagggcccaactgcctgggtgagcaaaaacagtgtggagggagcccacaacgggttagtacacaatgggggccctgcaccgtttatagggaccttgtggaactttcatattaggggtacctcccccggtcagacaacccgaactttgaagccccggcaccccagtttgctttttaaaaaaatgtccccgttcaaaggagaaagtttaaaaacctggggggttatcaccccgcgtgccgtacaaggcagagataagcccctcttcagcatctttccactggtgcgcatttctttgtaagaatatcaaaacgcgtgcttaatcacaaaaatgtagcaagacgcagcgcttttcccacagggggatcccaaaaagcctgtaaactctttacgagggataattctgcctcaccaggcagtcgccacagatttgtgatgggccagaacgaaatgtccccacggttcccttcttcccgagcccctagtggtacaatctccccgggttgttcgcaaacaaagggaagcgccccgcttgggggaggagaagcaagaaaattcccgcgagacaagtgttgttttcccccgctcgatccctcgcctagaagcaacacacacacgggagatacaaaagggggaaccaacacaaaaacctccctctggtgactgggcatgggcaccctggcgtttttttaaaggggtttttttataaagaaaaatgcccgtaagccaaaatttctgccaaccataaaa

SEQ ID NO: 514271 - DNA, 1017 bp, Homo sapiens
  misc_feature (228)..(228): n is a, c, g, or t
  misc_feature (472)..(473): n is a, c, g, or t
atctgggatgcagaagacttagaagttattttgttgcttgttatgttgggtatatggggatttttaaaaaataatcaaagtggaatttgctaggtaactgctttaagatgaattattgtggtctttcagtcactattacacgtttcatatgttttcgttgtgccttattggaacgttcttcgctgttctgcctcgagtctcttctcatggaaaggatacatcctgaanaattatgatagaaacgtacaaataatgaacgcgatcagagttactgaacaaacatacactaactaattatattggaatgaatttaagctagaacgaagagttactaatagctatagagaagaaccattaaacatcttaagattacatctgaaattttaaaggactcaccatgagcaacgaataagctcattaaccaatatttcgaagaaagagaaatatctgacgcagatagaacagcctaacnncaaggatactctagggatcatcaatgaatgaagatgacaaaacaaaaatcctgagaaaatgcatagatcgaatggaagactccatgatacaaacagatcaataatcgaaattgaatcaagccgagaaatgactattaatagatatgcaacagaatataagctgatgataccatgggtggctattatattaatgaataataagaccacaaatggaatcacaatatagaacaaacagacagggaaactaagggacgaatataaatcaactcacgagcgaaatcccacagacgaataccggactcctcgagataaaaaatacctagcaagacttgtcgggaataacatcgggcgcattatccagtcacaaacgcacgggaggccaagagttcgcgcatcacaaaggccgcaaaagcgttcaccacacatagcgatccaggcaccatcataacaacaaccctcaaccaataatcccggacaagtaaatcaacaatacgtggccagcccggatcaccaagaccccggtaatgacagaggacccagatgt

SEQ ID NO: 514272 - DNA, 185 bp, Homo sapiens
tcaggcaggagagggtggttgtaggcagggttctgggctcgtcacatccagtccagcgagctgcaatcttaccactggccaaggccgtggtacaggtcgtcctggtttacgacgtcgcccctgctgatgttgaatgaacacagactgtttccttcatcttctggaagaagtccttgttgcagagt

SEQ ID NO: 514273 - DNA, 177 bp, Homo sapiens
ttgctgagacacatttgagtcactgcttcaatctgggcggaacggtccgacattcccgatatactcaagttaacatcaaactctgctcttcaagcaccctccaaaactagactccaaatttaccctcccgcgagccagacatgtagactctgtaagtcccaaaactaactttagctt

SEQ ID NO: 514274 - DNA, 218 bp, Homo sapiens
  misc_feature (51)..(52): n is a, c, g, or t
  misc_feature (58)..(59): n is a, c, g, or t
  misc_feature (63)..(64): n is a, c, g, or t
  misc_feature (78)..(78): n is a, c, g, or t
  misc_feature (81)..(81): n is a, c, g, or t
  misc_feature (92)..(92): n is a, c, g, or t
  misc_feature (125)..(125): n is a, c, g, or t
attgggcctgatcattcgcagacagtatgatggcttcatcccggttcatannggcagnncganntgcgctcaggtctncangtcatctccancttcttccgggcggcactgccatcgagcgctgnttctctcgtcctccagctctgcctccatctcccgcacctgtctgaccagctgcttcttcttctcctcgctctgctcgtcccggccctgcaggt

SEQ ID NO: 514275 - DNA, 182 bp, Homo sapiens
gtctggttactgttgccgcgggtgtctttttctttgagtaactagctctctgagttttgcacatcacgttgccctcatctgctggagatcgatcaggatggcactagacgttctcctctgcccgtgatgagcttcccgcagccgcctggcccagcctgggcacgttctccgaggcatttgtc

SEQ ID NO: 514276 - DNA, 738 bp, Homo sapiens
  misc_feature (535)..(535): n is a, c, g, or t
gggggaggaaacatatattttagtggctacgacatgtgattcattttctgataaaatatttgtctaataaaacagaggcacgataatctaatcaaatgaacttatgagaattttccaaaaatgtgagttcactagtaattgttctaagtctacttattaaacaactcaagggaaactgtgaatatattttgcaaattgttgttcaaaagataatcggaaaaaattgaatatattgtaggatttgaatatacagcctacttttatgtcacctctaccttcaaaactacatataatgtattttaggagctggatttgttatgtctgttgcagcgaggacttgttattcactggtatgaagaattctttgatgtttatattagtaacaaaattatgcaaggatagaatctcatctagaaaatgcaaactattgttgaaaagcagttggcctttccacacaaccgctgtccccagagataactgctgatttcattttaatggtatccttttagaccttttctctatttacaaaaatgtnacgtgtttctatgggtacatacgtttgatggatttttttgattttacggaagtggcagacacttttttgacatgaaaattggaatttttctatcaaagtgcacattggaaataacccctgcttttggggttttacttaaatggcgcgccggtgctttttaattaaaagggacctaaaattttttgacttttgggggagataaa

SEQ ID NO: 514277 - DNA, 149 bp, Homo sapiens
ttcagacgggctcgttcatccccaccattccgtcgttccccacatgtatttcacgctgcgagcccttcaatggccatgccctggccccgtccactgcttctctccccatccacaatggagaaggtgaaaagaggagggaaaggccttgt

SEQ ID NO: 514278 - DNA, 106 bp, Homo sapiens
taagagatggggatcttgctatgttgcccaggctggtctcaaactcctagcctcaatgaaatggagaaacgcacacctacgcaggaattccccccaagtcagtacg

SEQ ID NO: 514279 - DNA, 531 bp, Homo sapiens
caaggggtgcccctctaaattaaaagggggggaaaaaaaaaacccagggattcttaaaaccttagttggaaaaaaggaggtaaaaatcccatccacttttcaaatggatccaagggggaaattatatggggttaaaaaaaaaacaagggattgggttaaaaattaaaagcaacttgttaatttttccctttttttaaagggggaaactaaaaaaattaacaaatggggcttagcccatatttttgttctacagcattgttttagattatgggaccaatataaaatgccgggcaaaggcaaattcaaaaaagtttttgattttaaggactttatgactttacccaggctttttttcggagaggtttctattttcaaagggtgggtgcgcattatatctaaaaacctaaaagctgcctgataaacaaactgcatctggtcccttggaaaaaatttaccaaggcaacagcggctgctggggggttctaaaattagccacgcctgtttattcttcatttgggttcgagcaaatgg

SEQ ID NO: 514280 - DNA, 308 bp, Homo sapiens
tggagcggggcagaagggcggaagacatctccgtcgcggggtcttcttgtcgagcgacccaggaatggccagctgctcccatttgggaagtcatgacaaatacgagaaacacacccttgtgtctaactaagttctccttctccaaggtagagcagaaatatcagaaatatcatactagaacttctcctcttttttttttttttttttttttttctgaaagggagttctggcgtgtccccgggggggaagagcagggtggcaggatctgggttcactacaacctcggcctcggggcctcggctctccag

SEQ ID NO: 514281 - DNA, 525 bp, Homo sapiens
caatgagtcatttccacgctcttatgtgtctcagtttctctcttcagaggtctatcacctctgagagggctaaaaatgccaagtgaacagctctatatgcatttcttgaatgagtcttttaaaactaattttgttgagggttccctgtagggccactgcatgtcaaaaggggttaaccacccagacattcccactcagtccccagtcacccaaggggcagcttgcagcttgcagtaacaaaatgtcctttctcttcagagctgaggaggtaagtctctcatttatctctaaaaatgacagtttaagtttctcacaaaaatgcacagacaagccaactgagattaatttggggagaaaacgtaatggagaagacactttagaatacacctccaaagtggaaaccaaatagggtacccaaaaggcggggggttctccttggctttagaaaatggcagtggagaagatcctttagaatgtacctctaaactagaattaggatcctaaacaacaacttcctaggaaaaa

SEQ ID NO: 514282 - DNA, 1340 bp, Homo sapiens
  misc_feature (1340)..(1340): n is a, c, g, or t
gcggaagctgctgccagtgctgtctggagctggagcttccagggtctctgtggtctgccagctgcgcgggcgcgcggctggagccggcgccgggcacggccatcgggggcctggactgcacggcccggcagcaggccggccatggagccaggcatgcgtggatgaacctgtccatcgtgtacctggagccgctgacttcctggtggtcaacaatgcactgggacgttctgcagttgacagacaaaggcgtggctgggagactctgaccctgcagaacgcaagctgcaggtacccgcttacccgagctggccgaccctgacacctgctacgggttcaggttctgccaccagctggatttctcacaacagcagggagcgctgtagcgttgggcctaaacaagggcaagccgcctggcaagctgctgtacaagtgttgcttcacagggaagcagagagcgctgttgacacaaagggctttaacccttggcaattttgcttgaaagggtgcacacaatccaatggacagacgccgcgaggtaacgcaagtcatgcccattgccatcttggccagggaacacagccaccggactgtgcctgaggcaccaaaacaaaattgttgcaattcagaagtgtgccttcgagcaaagggatatggtggagaaaaccccaaaaaagcccagaggccttcaacagagaatcgtcagtaggtatctttgggaacaccttggggaatgtaccggcaatatgcataattaccatggattattaccagaaaaggagttgcaattcgacatgaagaagcgccgggagtacaaaacaggtaggaccagggtgacaaaacataaccccagagcgcattaggaacgacaggattgccagacgtctgggaaaagagttgaggaactcactagtgggagtgagacctaaaccaccaccacgggattgaattatgggtgagagtcagagacccacttatgggacgacactttagcggcggcgaatgacaaacaaagggaactctatcagtagggagggacaccacaagcgagggcaaccggcgaacccaagtgggagcgcaaggattaccacggacaagattgagactttcgcgtattacgcaacgcaggcataaattacatataagccatttggcagtgacaaattcactccgccaagtgagggaaacaacgacaggaagagattgtttaattaagcgacagggatactgtaggcagaggagcacaataggaacccaccagaattccatatagcacacccataagataccattgaggagatatgaacattgaaatgatgagtaaaggcacacacacgacagan

SEQ ID NO: 514283 - DNA, 973 bp, Homo sapiens
ttctctctccccggacagcatgagcttcaccactcgctaccaccattctccaccaactaccggtccacatgggctctgtccaggctgcccagcatacaggagcccggaccggtcagcagcgcggcacagcgatcatatgcaggcgcatgggtggctctggattacccggatctcacgatgatacacgatccccacccagcttccagggcgccggccattgagggtccaggaggagccaaggcccaccagggcatcagccagcggtgtgtccttggccaaggcacattgggcaggccatccccaagcacacgcagcacacggcagcaccccaatgacagacaccagccccctggcacaacaggcaacccgcacctcgtgcaccttcctcttcaccgttggcgccacccagcagctcgcaagtgcaagcccctcgcgcagcaaccctgccagcaaaccttggcagggcatgggcagccagcccacccaatccccgggccacgcacaaatatgggccagcaccacacaacgggcaacccccaaggcacccaaccaccatcgggcaagccccacatacacctaacccacgcatcccatccgccggaccaccatgcaagggtgcctatccaaaagcaatcgttgccaggcgcaacataacttgagtaaggcaccaaaatagcccccccgccatcccggtagccttaggccagccatctagcaccacatagggcccccggtacccatctgggtcgggctccaatagccactattcagccagctccaaaagttccccagacagccaccccacaggcccggggccaacacggacgcaacaagacaaaccggctggggcagacccacggccacgaatcccacatgcgaggccccccacgggcccacacggacgcacgactggcccagaacaccacaccaccacataaggtaccagacaccggcccccaggccacagacacag

SEQ ID NO: 514284 - DNA, 264 bp, Homo sapiens
gtaggtgatctagaggatcccagcggccgcctttttttgggggggccaggatcgtggctacatctgcaatcccagcaactttgggaggtcgaggcaggcggatcatgaggtcaagcaatcgagaccatcctggccaacatggtgaaacctcatctctattaaaaatacaaaaattagctgagtgtggtagcacgcgcctgtagtcccagctacttgggaggctgaggaaggagaatcacttgaacccaggaggcagaggttgga

SEQ ID NO: 514285 - DNA, 520 bp, Homo sapiens
  misc_feature (429)..(429): n is a, c, g, or t
aaaactccttccgctctgtttctgtggtacagattttatccttcatcctaatagagaaatcatccctggatatgcccgtccagttcacaattcaatgtttggcattgtgtttcggataaaatttcattcagagcgtattcagtttgccagttatcacatatggcatggcagttggacaagatagggatatctatggttctgatagcatggaaagcgtatgctctatatcattgtcagcagtttcatatttgtttgtgtggcacatgaaatttctcagatcactaatgatcttgcacagattattattcctaaagataactcatctctcttgaaaaggttggcatgtatagctgcatttttttgtggactcctcatcttatcatccattcaagataaatcaaaacattaggttccaaaaattctaaaaanactaaactcttcaggctacctttgtgtgtctctagaagagaaaagcatctatctggagatataaatgtgtatgtaaatataaacgtttgtg

SEQ ID NO: 514286 - DNA, 696 bp, Homo sapiens
  misc_feature (453)..(453): n is a, c, g, or t
  misc_feature (518)..(518): n is a, c, g, or t
  misc_feature (549)..(549): n is a, c, g, or t
  misc_feature (596)..(596): n is a, c, g, or t
  misc_feature (643)..(643): n is a, c, g, or t
  misc_feature (654)..(654): n is a, c, g, or t
gccttggacacttgctgcccctttccagcccggattctgggatcctttcctctgagccaacaatctggggtcctgcctttcgacaccaccccaaaggcttccctacctttgcgtgccctggagtctgcccccaggggcccttgtctggccatggccaaaagggtcctgggcctggcagctggggctgtggccattctgctctatcttggattactccggtcggggacaggagcgaaagggcagaagctccctgcggtgtggccccccaagcacgcatcacaggtggcagcagtgcagtcgccggtcagtggccctggcaggtcagcatcacctatgaaggcgtacatgtgtgtggtggctctctcgtgtctgagcagtgggtgctgtcagctgctcactgcttcccagcgagcaccacaaggaagcctatgaggtcaagctgggggccaccanctagactcctactccgaggacgcaaggtcagcacctgaaggacatcatccccaccccagctactncaggagggctccagggcgacattgcactctncaactcagcagaccataccttctccgctacatcggccatctgctccntgcagcaacgctcttcccaacggctcactgactgtactggctggggnatgtggccctnagtgagctctgacgccaagcactgagactcgaggtgctctga

SEQ ID NO: 514287 - DNA, 1331 bp, Homo sapiens
gatgagttcgataatggggggtggatttgagcattggtgtgatgactcgcggctcgcgatggaatgcgtaagaatgggacatgtgatgtgtggaatgcggctggcttgaaaggtcgagtggatagtatgagccggcactagtttgaaatgtgcggcgccgtcctgatcgcggtgagagataggttcggttgaacacgtagtacgtagtggtatcgatggtttcgctacatggcacggcgttaggagacaacacacgcctgagagactacagttagtactgagtgagtgtgcgtgcagtgtcttccgtcgtagtctctggtacattttgtcacaaatggaaggcgatatgcgaatatgtcactggtttaacatctgttacgatctatactacgcaatggggaacgcaatcatgttgtaaaatgtcctgctcaggctatagatttccacataggggtatcttgggagttcttcggtaacactcctagacgcttgaatcgttaacccttgagaactatctgaaaagatgagtatacagggtctcattcattgacacgtatctagagcaggttcatgtaacactggttgtcgggggccgtccaccggtgctacgttcatcgttttgtctggcctatccaatgattgtttagaaatcctatattgcgtatgccctgaatggtggataatagacgagagcagaactctgacatctgtactctgtgtctgctagtccattaccgatctcgataccaccgctggtgtaatcagtggggtcccacctgctgaatggactcggtctggggaacgcacgagaggaatttcagactgggaattcaccatacttaggtgaaccacttcgttggttttcagctgccttggtgaaatttggagtactaggttccggatttgaaccccccttcccgtttcacactaaggacccggactactagccttaatggaaatagacttgaggacgggtaccgagtcatatttgtagtagccaatatgtcgaaaacggatggggaacaaaaatttcaatatcacaatcccacaaaacagaaccggagagaataaagaaagggggattcaccgccaaataacgaaatggaggatagaaaaggaccccggaaatccaatggagatcatatacccaggaaaacatagaggtacacgagggcaaaacaaataaagaggagggtaacagagatgagaaactacccatgggacagatggagccgaattatgaaccatgtccaaggcacccctgggagcaggccaaagacaccagacgtggatggaaatagactagaaatactttgaggaaggagaacacg

SEQ ID NO: 514288 - DNA, 307 bp, Homo sapiens
cgactggggagtacgtccgtgcacttcgtgacgtttggtggtgttgtcgtgggtgctggcactgagtccgctggactctagagacgtttcgcgagtagctgaaagagccacaagagtccctgtgggctgagggcacagacctgagagcgaccagggaggacctccgtgacgtctgtgagtcagtaggtaattccggaatgtgggaggctgaatccctctgaaatctgggcgtgatgagagaagagcagagacagacaggaagaatcccaagggacagggggtgaaaacattagaaagaatggggaag

SEQ ID NO: 514289 - DNA, 402 bp, Homo sapiens
ccagcttcccctcccccgaactctcaggccttcctacatctccccctactcctagtcaggttgacctgattgggagcgggcgcggggttccaaactttcctgggcagaataagccagggaaggaggctcgagtgcggagaggagccgacagcaccacagcgagcagaaagagagccccggcaaaactgaagggaaggaggtgcagggacgcatgaacgatgtggccagcgccgcgacgtcccgacggagggaaccgccccgggagaagcttagggtccgcgcccaaagaacaggagccccgggaggcgggcgcgctacggtcgcaaccgggctgactcctgcctctccccccggctcttctcgcttgaggagggttgggggggagatcgggtggccacccgc

SEQ ID NO: 514290 - DNA, 288 bp, Homo sapiens
ccaaggggagcttcaggcaccagggtgagaccctaattgtagagcccctccatctccagacaagaagtaatagtaggatgtgatctgtgcaagaggacattaccagcgggcgtctggttttggctgcacaaaggcgaggcccagcgatgcccccgctgtggagcccattacatgctggtgccccagcagctggcacactgagtaccggcactaaattactcaaaatgtgctgtaaagtttcttctggccagtaaagactagccattgaatggggtcggtctcccatga

SEQ ID NO: 514291 - DNA, 1264 bp, Homo sapiens
  misc_feature (73)..(73): n is a, c, g, or t
caaagtgctgggattacagacatgagccactgcaccaggcaatttttatatttttagtagagaaggggctttncttgttggccaggctgacctctggtgatcctccctcctcgccctcccaaagtgctgggattagaggtttgagccaccgcacctggcaaaactaactattttttttctattctgtaatatgtgtaaagtagcattaaatataatcaaaaactgtcctagttactattattgagaatgtaatgccttgaatatggtttttcagatatgttcttcttttcatccatcagagtctttgtttgtttttaaggtgatcacgaacaaaggtattggcagaagattttggttgatagacaggcaaaacttaatcagcctcgggaaaagaaaagaggcactgaaaagttaattgattcatttttgtttttttagactaaactttccttgaacgtttaatgccaaagtcagtactaggtagtcataaaatgatcgtagttttgctattacctaacaaaaatttactgagtatatactatgttttaggttgggagggaaaagtcatttctctagatttcaaaatgtatgaaattgaattatttttctcacaaggatacataattttaatttagattttttctttttaaccagtgatatactttaacagtcttgatatctggctgctatgtcttgtagtttggtgataaatgattatagaaagattatcttcatggtaaaaacacaatgtattcagaatgtagtttataaagataggaggctccatagataagatggagagactttatgcatagtgtttcctatagcaacgataagctttattcctctttctctaagatagtaggtaatacaaacaagcttaaataatttaaagcaagcccctctttcagtaattttatttttctgtcacttaaaatgatactggtctgatcagtagtggaatcacacctgggaatagccactgctttccagcttaggcaacatagcaagaccctgtctcttaaagttttaaaacaaattattatacatgtaaaggttagtacattttaaaagtgcctggaacaaagtagggtacataatacctaatattaactacagtcatcaaaatttagaaatgcatattataaaagtgtaagaaaaatgaaaaagatgaacttccttttttgttaggtgagcaagttaaaagtcctatttcctgtaatctaagcttgttgatttggggtcatatttatacaaaaaaaaa

SEQ ID NO: 514292 - DNA, 353 bp, Homo sapiens
ggtgttcagctaccgcgacgagctcgcgttcggcatcgtggtcgaccgcgagcagctcgacgccccgtggcccctgctcgacgcggtacgcagctccctggcggagctgacggcggcggtcagtaaaccaccagcggcgtgacgccgagttcgtccaacgtcagccggacatgttcccggagaacagctttggtgttctccgcgccgacctggtagcccacgacgccgatggtgaccttgccgttgtggcgcagggccgtcaccaccagcaggccgccgggctgctcgatgtcacgcttcatgacgttgtgctcgacaccccaacagatcacgtaatcagcctggtggacgcc

SEQ ID NO: 514293 - DNA, 502 bp, Homo sapiens
atatagacatggcttaggtgatagagcacatgcatagagatgagaattatctgtctcataccactgtggcccgttgtgataggaaaacagaatacttatcatgttcttatgagaaagtattatcggctgtcccctttatattttctggctcatctccccctcttgacatgaattcttggagagcatggatctgtacctttctgtatacatcacacattacttatgtgctcagagaatgtttcctaatgaatgttcaataggtatggagagattatgttcatgtaatcctgcatctcaaccctaaactcaattgctctataaagagcaatttctcctagaggcaattttcattactcacatttgataaaatctctatcattcattaggggatataatctacatagctttacttatggttaaaatggacccctatctggaactggatgaacacaggaaagaaacgtgttgcccaggcaacagagctgatttgttttgcctgtgg

SEQ ID NO: 514294 - DNA, 108 bp, Homo sapiens
  misc_feature (69)..(69): n is a, c, g, or t
  misc_feature (77)..(77): n is a, c, g, or t
gagactcatctatgatcacatttagaggggctatacattacaagctactattaggagctcttaatatcntgatattnataaaataaatgtgataaagacaaatggcag

SEQ ID NO: 514295 - DNA, 124 bp, Homo sapiens
agatagagatatcaaaagcggaagaaaaatgaagattaaagcatgccagtcacaggatcaagcacttgtatacagcaccctgatatgagtaactccatcttagaaaaagactccatcttacatt

SEQ ID NO: 514296 - DNA, 429 bp, Homo sapiens
ctagtcatagttttgtgtgtgtgtgtgtgtgtgtgtgtgtgtgttttgagtatccaatacattttaatttttgatttatttctctttagttaatcaccaaagctgaaaagattagactggcaaagactcaacaagcgagtaaacatataagattttctgaatatgattgaaaaaaaaaacagttcacctcttaatacttcacaagatacttgagctgttcttgggagattcacttttattatggtagcactgcataattaatgtgtttttaattaaaagaaatatctttgttcctcaacttgtaaataagacttttttctagagacaaatatgatgtataccacaatttttcttaaacattttatttgttgaaattatcttagatgtcagtgtcaggtgatttagtaaataaatgtgttttgaacatta

SEQ ID NO: 514297 - DNA, 770 bp, Homo sapiens
  misc_feature (599)..(599): n is a, c, g, or t
  misc_feature (610)..(610): n is a, c, g, or t
  misc_feature (699)..(699): n is a, c, g, or t
  misc_feature (710)..(710): n is a, c, g, or t
  misc_feature (760)..(760): n is a, c, g, or t
gaggcactgaaaagagctcatctttgactaggaagttcttaaattgagttggaacacaactcagttatgacgtcaggattgtcgttaacgcaatttgttaagtagctatggaagtagccagttgactcttgtcgtgaaatgaaacggaggttaacacagaaattaatcaccaaagctgaaaagattagactggcaaagactcaacaagcgagtaaacatataagattttctgaatatgattgaaaaaaaaaacagttcacctcttaatacttcacaagatacttgagctgttcttgggagattcacttttattatggtagcactgcataattaatgtgtttttaattaaaagaaatatctttgttcctcaacttgtaaataagacttttttctagagacaaatatgatgtataccacaatttttcttaaacattttatttgttgaaattatcttagatgtcagtgtcaggtgatttagtaaataaatgtgttttgaacattatttggaaatgtgttgattttgtttttatactgtaaaacaaaacataattgcaaaaatactacatgaatatatataaagtttagagaaatgtttaacnctaaactctcnctgtacttagtttgtaacttgcaataccttcaataccttttcatgttgatttatacagacatgtttaatagttcattctattcattccnctttgcctatntgagcttccattgaacaatagaccatagggattggttctaattaaaatgntaaattttta

SEQ ID NO: 514298 - DNA, 431 bp, Homo sapiens
ggccgtattgagaggcacacgtgtgtgcgtgtgcatgagtgcatgtgtgtgcaagtgtgaacaagtgcattgtgtgcatgaatgtgtgcaagtgtgtgagcaagtgcatgtgagtgcacgaatgagttcgtgtgtgagcaagtgcgtgtgtgcaccagtgtgagtgcatgactgagtgtgcaagtgtaagtgtgcgtgagtgcgtgcgtgtgcttgagtgtgtgtgccagtgagtgtgaactagtgtgtgcgtgtgcatgagtgcatgtgtgtgcaagtgtgaacaagtgcattgtgtgcatgagtgtgtgcaagtgtgtgagcaagtgcatgtgagtgcacgaatgagttcgtgtgtgagcaagtgcgtgtgtgcaccagtgtgagtgcatgactgagtgtgcaagtagtggcgtggtgcgtgtgcactg

SEQ ID NO: 514299 - DNA, 183 bp, Homo sapiens
taatacctttctgtcttagagacagggtttcaccatgttggccaggctggtctcaaactcccgaacccaggggatccgcccgcctcggacccccaaagcgccgggaccacagatgtgagccatcacgcccagcccggaaaagaaattgtttaacctaagtatagttcatgcaatactaaatta

SEQ ID NO: 514300 - DNA, 901 bp, Homo sapiens
  misc_feature (80)..(80): n is a, c, g, or t
aaggatactggagatctaaaagatagctctctcttgaaaccatataggtaacataagaaacaacataaagagagacatanaatgggagaagaagttatccattaagagtgctatcaaagagcgaatggatggatttgaaaaaagagtatttagcgctacaaaaagctagcatggcttctttaaaaaaaacaatatcccaaataaaatcagagtcagaaatggaaacagacagtggagtacctcaaaacactggaatgaaaaatgaaaaaagtaaagatcactgatagtttgacaacattataatgtacttatatatgtaaatgctatctctgagtggttataagataaattttaattttaaaaaactgtgattattctatttcattattagaacaattcttgattgttaagttatccagatgtgttacttactctgtgatataagaatatttaaaaggctcatttaaagcaattttttaaataacctgagttttctctacagttttcatcaagcacatgagtgcagagttgggagactgagcaagttgtaggaatgaagattgtagtttctcacctgttaatttcactctgtagtatgcaccaaagcaggaacagttaaagcagaattcctatgaattcaaaattaggatacattttaaattctcatttctgtaaaaataaatgtcacgtttgatatatgttttaaacacagtatcttaacttttttaacttatgagtaaaattatggtctgtcagggagggaattaaggtagaaggcttagcgaaatggtgatataaatttgggtataggttgaaagaggaaaaacttggtttaaacggtttttaaaaaaaaaaatgggggggcaaaaaaaaggggagaaaggtgagaaagggtaaagag

SEQ ID NO: 514301 - DNA, 984 bp, Homo sapiens
  misc_feature (80)..(80): n is a, c, g, or t
aaggatactggagatctaaaagatagctctctcttgaaaccatataggtaacataagaaacaacataaagagagacatanaatgggagaagaagttatccattaagagtgctatcaaagagcgaatggatggatttgaaaaaagagtatttagcgctacaaaaagctagcatggcttctttaaaaaaaacaatatcccaaataaaatcagagtcagaaatggaaacagacagtggagtacctcaaaacactggaatgaaaaatgaaaaaacagccaacagggaagagtgtcgcacccaggagaaagttaatgcaacaggaccacagttcgtgagtggagtgattgtgaagatcattagcacagagcctctacctggcaggaaacaagtccgggatactttggcagcaatctcagaagttctttatgttgatttgctagaaggggatacagaatgccatgctagatttaaaactcctgaggatgctcaagcagtaataaatgcctatacagaaattaacaagaaacactgctggaaactcgagatcctttctggtgatcacgaacaaaggtattggcagaagattttggttgatagacaggcaaaacttaatcagcctcgggaaaagaaaagaggcactgaaaagttaatcaccaaagctgaaaagattagactggcaaagactcaacaagcgagtaaacatataagattttctgaatatgattgaaaaaaaaaacagttcacctcttaatacttcacaagatacttgagctgttcttgggagattcacttttattatggtagcactgcataattaatgtgtttttaattaaaagaaatatctttgttcctcaacttgtaaataagacttttttctagagacaaatatgatgtataccacaatttttcttaaacattttatttgttgaaattatcttagatgtcagtgtcaggtgatttagtaaataaatgtgttttgaacatta

SEQ ID NO: 514302 - DNA, 507 bp, Homo sapiens
  misc_feature (57)..(57): n is a, c, g, or t
ttttcaagagaatatcactttaccctcagctcaaaagactagttaaaacatggggtncacttttaataggcagtccatactgccaattaaagttgcacttgttatttcaaacccactgcttcccaaaatctttcagaagcttagctgaaatactatgtagtattgcctggaggatgtccagcttgtttctttctctaaatgttctaaagtaggttaacctagaggagcaaaagctgtcaatgtatctagtctaaatggtattcactccctgtagggtagcttttactgaatggctctttgtttcgtgatgcctgccatctgtactaaggaaggaacaataagaaacagccctctgaaacatatttctcttgaaaggatgttgttgatgacactgttaattgcctttgcattttctttatgaaatctttgaagaaatttcattgtaatcttgttaataattcagtaacaataaatgataattatgcttcctttgaggaattaattaaa

SEQ ID NO: 514303 - DNA, 373 bp, Homo sapiens
ggaaaagtcaacatctaactagtggaggaaaagtgccctgaatacatttaggaatctccctcactctataggttggcccaggttggaaagggtaaagggagggagggggtcggctttttatgggactttccattgagaagaaagggaaaggaaattattttcagggtaaggcttctcagggccttggccctttttttgggattttggatgagaaatttggaaggtactaacctactttctagcatatctttaagaaaattgattgttatttactccagatcctcttccagaccagagttatcaggacatagctctgtgattcatgagtgtcccatactgatgaattggagcatccatatggaaagcaaaggca

SEQ ID NO: 514304 - DNA, 751 bp, Homo sapiens
  misc_feature (73)..(73): n is a, c, g, or t
caaagtgctgggattacagacatgagccactgcaccaggcaatttttatatttttagtagagaaggggctttncttgttggccaggctgacctctggtgatcctccctcctcgccctcccaaagtgctgggattagaggtttgagccaccgcacctggcaaaactaactattttttttctattctgtaatatgtgtaaagtagcattaaatataatcaaaaactgtcctagttactattattgagaatgtaatgccttgaatatggtttttcagatatgttcttcttttcatccatcagagtctttgtttgtttttaaggtgatcacgaacaaaggtattggcagaagattttggttgatagacaggcaaaacttaatcagcctcgggaaaagaaaagaggcactgaaaagttaatcaccaaagctgaaaagattagactggcaaagactcaacaagcgagtaaacatataagattttctgaatatgattgaaaaaaaaaacagttcacctcttaatacttcacaagatacttgagctgttcttgggagattcacttttattatggtagcactgcataattaatgtgtttttaattaaaagaaatatctttgttcctcaacttgtaaataagacttttttctagagacaaatatgatgtataccacaatttttcttaaacattttatttgttgaaattatcttagatgtcagtgtcaggtgatttagtaaataaatgtgttttgaacatta

SEQ ID NO: 514305 - DNA, 1252 bp, Homo sapiens
  misc_feature (80)..(80): n is a, c, g, or t
  misc_feature (1081)..(1081): n is a, c, g, or t
  misc_feature (1092)..(1092): n is a, c, g, or t
  misc_feature (1181)..(1181): n is a, c, g, or t
  misc_feature (1192)..(1192): n is a, c, g, or t
  misc_feature (1242)..(1242): n is a, c, g, or t
aaggatactggagatctaaaagatagctctctcttgaaaccatataggtaacataagaaacaacataaagagagacatanaatgggagaagaagttatccattaagagtgctatcaaagagcgaatggatggatttgaaaaaagagtatttagcgctacaaaaagctagcatggcttctttaaaaaaaacaatatcccaaataaaatcagagtcagaaatggaaacagacagtggagtacctcaaaacactggaatgaaaaatgaaaaaacagccaacagggaagagtgtcgcacccaggagaaagttaatgcaacaggaccacagttcgtgagtggagtgattgtgaagatcattagcacagagcctctacctggcaggaaacaagtccgggatactttggcagcaatctcagaagttctttatgttgatttgctagaaggggatacagaatgccatgctagatttaaaactcctgaggatgctcaagcagtaataaatgcctatacagaaattaacaagaaacactgctggaaactcgagatcctttctggtgatcacgaacaaaggtattggcagaagattttggttgatagacaggcaaaacttaatcagcctcgggaaaagaaaagaggcactgaaaagttaatcaccaaagctgaaaagattagactggcaaagactcaacaagcgagtaaacatataagattttctgaatatgattgaaaaaaaaaacagttcacctcttaatacttcacaagatacttgagctgttcttgggagattcacttttattatggtagcactgcataattaatgtgtttttaattaaaagaaatatctttgttcctcaacttgtaaataagacttttttctagagacaaatatgatgtataccacaatttttcttaaacattttatttgttgaaattatcttagatgtcagtgtcaggtgatttagtaaataaatgtgttttgaacattatttggaaatgtgttgattttgtttttatactgtaaaacaaaacataattgcaaaaatactacatgaatatatataaagtttagagaaatgtttaacnctaaactctcnctgtacttagtttgtaacttgcaataccttcaataccttttcatgttgatttatacagacatgtttaatagttcattctattcattccnctttgcctatntgagcttccattgaacaatagaccatagggattggttctaattaaaatgntaaattttta

SEQ ID NO: 514306 - DNA, 204 bp, Homo sapiens
agcggagaagccttcaggcagtctcaagtcagccccaagccactgtctctccacatcgcgcaggtcccgtggaagatccaccacgagcttgggcccaggctcacgcccaaactccagagcgcgcagcggggaccgcgagtcatccacggggccgtgaccttgtgtgcgcggatagcgcacctccctgtacgtggagcgagaatg

SEQ ID NO: 514307 - DNA, 211 bp, Homo sapiens
ctaatcatggtgggacacccctggaagagggaccatgggcatgccccctccgtgaatgcggctcctccccctgtgtatgctgagggcccctcccccgggaatgcgcccaccaatggccctagactcatcttggcctcctcagctccctgcctgtttcccgtaaggctgtacatagtccttttatctccttgtggcctattagaactggctt

SEQ ID NO: 514308 - DNA, 1497 bp, Homo sapiens
  misc_feature (80)..(80): n is a, c, g, or t
aaggatactggagatctaaaagatagctctctcttgaaaccatataggtaacataagaaacaacataaagagagacatanaatgggagaagaagttatccattaagagtgctatcaaagagcgaatggatggatttgaaaaaagagtatttagcgctacaaaaagctagcatggcttctttaaaaaaaacaatatcccaaataaaatcagagtcagaaatggaaacagacagtggagtacctcaaaacactggaatgaaaaatgaaaaaacagccaacagggaagagtgtcgcacccaggagaaagttaatgcaacaggaccacagttcgtgagtggagtgattgtgaagatcattagcacagagcctctacctggcaggaaacaagtccgggatactttggcagcaatctcagaagttctttatgttgatttgctagaaggggatacagaatgccatgctagatttaaaactcctgaggatgctcaagcagtaataaatgcctatacagaaattaacaagaaacactgctggaaactcgagatcctttctggtgatcacgaacaaaggtattggcagaagattttggttgatagacaggcaaaacttaatcagcctcgggaaaagaaaagaggcactgaaaagttaattgattcatttttgtttttttagactaaactttccttgaacgtttaatgccaaagtcagtactaggtagtcataaaatgatcgtagttttgctattacctaacaaaaatttactgagtatatactatgttttaggttgggagggaaaagtcatttctctagatttcaaaatgtatgaaattgaattatttttctcacaaggatacataattttaatttagattttttctttttaaccagtgatatactttaacagtcttgatatctggctgctatgtcttgtagtttggtgataaatgattatagaaagattatcttcatggtaaaaacacaatgtattcagaatgtagtttataaagataggaggctccatagataagatggagagactttatgcatagtgtttcctatagcaacgataagctttattcctctttctctaagatagtaggtaatacaaacaagcttaaataatttaaagcaagcccctctttcagtaattttatttttctgtcacttaaaatgatactggtctgatcagtagtggaatcacacctgggaatagccactgctttccagcttaggcaacatagcaagaccctgtctcttaaagttttaaaacaaattattatacatgtaaaggttagtacattttaaaagtgcctggaacaaagtagggtacataatacctaatattaactacagtcatcaaaatttagaaatgcatattataaaagtgtaagaaaaatgaaaaagatgaacttccttttttgttaggtgagcaagttaaaagtcctatttcctgtaatctaagcttgttgatttggggtcatatttatacaaaaaaaaa

SEQ ID NO: 514309 - DNA, 346 bp, Homo sapiens
gtacagacgtaagttctaaagtccttaggaccaagaatgccctcctaggttacagacccaacagaaatgcacatttgtggctgggtgcggtggctcatgcctgtaatcccagcactttgggaggccaaggtgggcggatcacgaggtcaggagatcgagaccatggtgaaaccccgtctctactaaaaatacaaaaaattagccaggtgcggtggcgggcgcatgtggtcccagctacttgggaggctgaggcgggaaaatggcgtgggccgggaggtggagcttgcagtgagctgagatcacgccactacactccagcctgggcaacagagcgagactccatctc

SEQ ID NO: 514310 - DNA, 502 bp, Homo sapiens
gaggcactgaaaagagctcatctttgactaggaagttcttaaattgagttggaacacaactcagttatgacgtcaggattgtcgttaacgcaatttgttaagtagctatggaagtagccagttgactcttgtcgtgaaatgaaacggaggttaacacagaaattaatcaccaaagctgaaaagattagactggcaaagactcaacaagcgagtaaacatataagattttctgaatatgattgaaaaaaaaaacagttcacctcttaatacttcacaagatacttgagctgttcttgggagattcacttttattatggtagcactgcataattaatgtgtttttaattaaaagaaatatctttgttcctcaacttgtaaataagacttttttctagagacaaatatgatgtataccacaatttttcttaaacattttatttgttgaaattatcttagatgtcagtgtcaggtgatttagtaaataaatgtgttttgaacatta

SEQ ID NO: 514311 - DNA, 146 bp, Homo sapiens
tgactctagaagatcctgaccctgtgaatcccaccaggctgctggagaacagctcacagcacagtgtcctcccagcaggtgatgagtcttggggtgctggtccggtaatgcttcagtgagtgaccggcagaaaaagggaggctctg

SEQ ID NO: 514312 - DNA, 577 bp, Homo sapiens
ttatgatatatatcagcacggagctggcttatttctacacaacatccagtgagagctttgtgcgtgttgaccctaacatatccgtgcagcgcgctgctcacaggtttcatcattattaacgcaggctccatcgtaacaccatttctgcgctgctgaatgtttatatttagcagctatatcctctatcgtctttggcagcgctcgtcgtggcctgaggttatcttcacaaggaacctcatcttcttggcagtcgtcagcatttgcattagtgagaacgataagtccagctaggtggaactcattgaaattgttcagggcaccacgtgcgcaggctcctccttgagctcgatatacagcactgtcctttggtgctaatgccgcacagaattccattccggttgccatattaagacacacagtgtggcgtgaataatacgcatctgcatcaggagccagatcaacctggagctggtggccacatttttctcaaatatctacctagactgtttcagacactagttcttctgtctgttctcctgtggcgatataatagaccacaagtcgggatgaaggtacc

SEQ ID NO: 514313 - DNA, 511 bp, Homo sapiens
tctgctgtactgatgcggcccctgtgtaacgcacatattggtgatagacttggaaggacctgaacggttcgagaaggcatgcacccctcatgccgagtgcccagtctgggaatggcgtatgaacattactctcagaagaaactgcaagggtgcagagcaatagagcctgcccagggccagctgggatccatagcctcgagcaggatgggtggaagcagaccctccctctattcacgcccagcacagcacagagtgcctgggctcccagtcccagcactgcatctcagccccaagctggtccagtccttcctccctgctggccttgtaggaaatcagccctcaggaggaagcttctggtgacagtcagttgaatgttgaacagaggcagagggaaggagctggatctcagaacagacacatgcacctgcaggcaaaccaccttcacttccagggcaggtacaggctcttcaaagagaggtcaggagcctcctgtgaaacgtcccatgggatg

SEQ ID NO: 514314 - DNA, 213 bp, Homo sapiens
aagagcaccgtatagatacagatgtgccgaaggaaacccagagtgcccagctgtctggaatgaagtgacagaggtagaaaacagtatgaccctcacaggaggtcacctatcgctacgcagggagtgggaaggcttctattccagggaatttgtcgtctccgatactagaaggttctagcgtcctagtttatgtcaattgccctacagacacgg

SEQ ID NO: 514315 - DNA, 162 bp, Homo sapiens
cccaggtagaactaacccgtagggtaatatgcttatacccacttttgtaactggtggggggaggcaagcttagagatcatttcacttgccttaggctggtgcttctcaagtactgtggactcttgttaaaatggcgattttgattcagttaggtctacctgg

SEQ ID NO: 514316 - DNA, 181 bp, Homo sapiens
actttagtcatggccgtggtttatgattcttttgatgattggtggtgtcttttacgcctcaatcaacgccctaggttggttataatcaccactaaaaaaagcagctcacgcttttttttaatgtcatctgttattcacctcctaccaaatatgggtatagtggttgttgcccccatgaatt

SEQ ID NO: 514317 - DNA, 172 bp, Homo sapiens
  misc_feature (80)..(80): n is a, c, g, or t
gttctggcaggtaaggaacgccggctcttcggcctctcagcgcggcttgttccttgtttccggacggccggcttcttaanccttgcggcttccttgggtcggctgcttgaatcccggaacggcttccaccggcttggcaaggacccatggccgaacgccggggacttggact

SEQ ID NO: 514318 - DNA, 401 bp, Homo sapiens
tagcggaccattatcccaacacttcatacttaatggtgaagtattaaatcctgtcccttaatcaagagcaaggaaaagatgtccatcctaaccacttctattcaacatggtaccagaggtccaggccctagccagtgcaataaaacaagaaaggaacaagaaataaaaggcataaagattaaaaagcaaaactactgttattcacatatggtatgattatgtatgtagaaaattgatagaatttacaataaaaaagtcacgtgcagtggctcatgcctgtaatcccagcactttaggaggccgaggtgggaggatcgcttgagcccaggagttcaaggctgcagtgagctatgatcacaacactacactctagcctggacaacagagtgagaccttatctc

SEQ ID NO: 514319 - DNA, 172 bp, Homo sapiens
ccagaggcaccaagcaggtcagatgaacacagccctaagtggctgtcctccccaccagtcaatatagtcttaaccaccttctctcctgagtctgctgctcacctggaccttggctgtccttcggtcactctgcatgtcaggctgactgtcccttcctccttggagcctctgg

SEQ ID NO: 514320 - DNA, 634 bp, Homo sapiens
cgcagtgactcacacctgtaatcccagcactttgggaggctgaggtgggcggatcacaatgtcaagagatcgagaccatcctggctgacaaagtgaaaccctgtctctactaaaaatacaaaaaaattagccgggtgtggtggcgggcgcctgtagtcccagctactcgggaggctgaggcaggagaatggcgtgaacccgggaggcggagcttgcagagagccgagatcacccactgaactccagcctgggcgacagagtgagactccatctcaaaaaaaaaggaaactgggaagatgtatttcaaactgtgacttcagaatcgtgtagtggctcatcactaaatgggaagccttattaaatagaaatactggctggtatttaaaatgtctatagtatatatattggggcaaattttacagtcatagaatagacacagaagaatattaggttaatcagacatgatttagggagatcaaaatatacaaataatcgtgaaaatttagtgaaaggttctaaatatactatccataccaagcacatcaatatatttgagaaaatactgtttggaccaagctggtgaaataagaattggtgtctagagagcactaatgtgtacttatgtcaacttatc

SEQ ID NO: 514321 - DNA, 724 bp, Homo sapiens
tggtgggaaatggggtctcatgacgttgcccaggcgggtctcaaacagctggctcaaacaatcctcccatctgggcctcttaaagcacggggattacatgagtgaggcaccacaccgggccaagaaatttccctttaaagccttattgaaggtggatgagcctttcatttcatgtggtggaaggattctgggtggctgcaggagtggcctgaaagtgagagagcaaggtgatctcctttatagcagcacaagtggtttccccttttatactccagctctgaagctgagtgggggtgaacactcgtggagtgtggcagaagtttaaggcgttggaaaggaggagctaacactcggaggagaaaacttcagcaaggacttgtggctgtgaaaagtggtgtggggattggtccatctcgtttattatacctcagcagaataccacagggagtgtgcctcgctgtggtgttgcttgggcactgggggtcaaggaactgagtatgcacacaaagaaaagagaacacatacagtccttgctctgtgccactcacagttggtgcacaggtccggaaaggaagaggagggcctccaaggtgtgctcaaggttccacggggacagtggtgtcctccccaaaccaatgaccacttagtgcggggtgcagcatgcacgtggcctcaacagcattttactgacagagccgtctgcagcccaggacgaaagggctga

SEQ ID NO: 514322 - DNA, 359 bp, Homo sapiens
aaagaggagggtactcccaaaggagtgtgcataacataaggaaaaaaatgtagaatcagtcactactggaactgcacaaacggccactgacaaaaatgacccccataagtgtgactatcattgagacacataacctgaatgagcaggtgaaagccatcaaagaatagggtgaccacgtgaccaacttgcgcaagatgggagcgcccgaatactaggctaggcggaatatactactattgacaagcacaccctgggagacagtgataatagaaagctaagcctacgggctaatttccccataagccgtggggtagactaccctggtcaccaagggagaacaccatcctactatcagggta

SEQ ID NO: 514323 - DNA, 253 bp, Homo sapiens
tctacctcgcgggtgcctctacctcgcgggtgccttctacctcgcgggtgcctctacgcgggtgcctaagttaagaaattcttgtggttggccaggcgtggtggctcacgcctgtaatcccagcactttgggaggccaaggcagatggatcatgaggtcaggagatcaagaccatcctggccaacacagtgaaaccccgtctccagtaaaaacacaaaaaattagccaggcgtggtggcaggcacccgcgagg

SEQ ID NO: 514324 - DNA, 1257 bp, Homo sapiens
  misc_feature (628)..(628): n is a, c, g, or t
  misc_feature (706)..(709): n is a, c, g, or t
  misc_feature (711)..(711): n is a, c, g, or t
  misc_feature (714)..(714): n is a, c, g, or t
  misc_feature (721)..(721): n is a, c, g, or t
  misc_feature (734)..(734): n is a, c, g, or t
  misc_feature (736)..(737): n is a, c, g, or t
  misc_feature (762)..(762): n is a, c, g, or t
  misc_feature (766)..(766): n is a, c, g, or t
  misc_feature (773)..(774): n is a, c, g, or t
  misc_feature (840)..(840): n is a, c, g, or t
  misc_feature (884)..(884): n is a, c, g, or t
  misc_feature (888)..(888): n is a, c, g, or t
  misc_feature (891)..(891): n is a, c, g, or t
  misc_feature (1018)..(1018): n is a, c, g, or t
  misc_feature (1073)..(1073): n is a, c, g, or t
  misc_feature (1116)..(1116): n is a, c, g, or t
  misc_feature (1118)..(1118): n is a, c, g, or t
  misc_feature (1125)..(1126): n is a, c, g, or t
  misc_feature (1233)..(1233): n is a, c, g, or t
gggctgcatgaatggcacatataggtcaccaaagttcattcacagtgtagaaaaagctgctgcttatctttctccatctaagaaacggaaaggagatcgtttctttagtctcatttacagaagcagcgtacgtattgaaattgaaattgatcgcctgtatattgcttgaccttacaggagattatgcttccagatagatgagtgggcagaaattactttacctgtccgttatagttgggcattagcgtattggcaaaacaatcctcgactagaatccacgatgaagcaggcatgggcaggcagaagacatatcctaaatggaattacgtaaacatcgcaggaaggcagcaaggcagaaactcattcgaaagagtccacaacaggtgttctgtgaacccttcaagtatttatttgaacagacgcaaataacttgacaaagggcaatacatattcaattgttcatgtagtaacattcatgtcacttgttgaatttggttctcatatgtatattgcatacacataaattcaaactataagtcgtcatttttgagccatcatcttacattcatgtaatgaaattatggaagagagtaaaaactagctcttaacttagtaaatataatatggnatttaaaatcaggtcactacagtaaggttctaagtattgccaattgaaaagctagaaatggtattactgttgcaaagnnnngncantaattgnctccaatagcatngnnaatacttgtatcccacaactatttnaaanccaagcnntaaaagggattttctaattcacttcaatcttatttctcttactatctatgtcttggtacataaganaagtgtttccatcactgcattggtagaattatttcagtgttatngttnccncgattccggatgtctacacaaaaatgaattagtttaatttatattgtgatacagttgtttgagaaatatttttaattctgtttcaactttatttctccaagtgtataatataaaaattacttctgtnattgttctctaccaataggggaaaaaattaagacattagatccattgagaaaganatgatgtaataaataattaagattagtaataatattatctggngngattatnnccagttgaataatctctttcccttgaattatttagctaacaaattaactctcccaatatttaaaatatgtaaatcatatttactgccattattaactaaatattttnttgacttgagcacaactggtatac

SEQ ID NO: 514325 - DNA, 147 bp, Homo sapiens
  misc_feature (44)..(44): n is a, c, g, or t
gggatgtgctgatctgtagtactataccaggaagaaacctcttntgttctctttagacatcttctacttgctctggcttgagatcgtgtaacaaaatgaaggagggctctctgtctttcttcctcatcctactcaaaaacttcccga

SEQ ID NO: 514326 - DNA, 202 bp, Homo sapiens
ctaacagtgcggagggatgaagatcatcttctataactcttcaggctgaatagaggtgatgatattcctgcctgactattagggtctcttacattcagagtagagaggagcagagtcagaaagcatcagtatggtaaggtccattcttaaactcttattcatcttccagataccaccctctgtcgaaactcaagagttatga

SEQ ID NO: 514327 - DNA, 98 bp, Homo sapiens
acggccgtgtattactgtgcgagacatctccatacggtgactactttcaattggtacttcgatctctggggccgtggcaccctggtcactgtctcctc

SEQ ID NO: 514328 - DNA, 120 bp, Homo sapiens
  misc_feature (109)..(109): n is a, c, g, or t
cattgctatccagaaaggatgcagctgttagttacagatgtcaaacatctttaaagcattattattaaggggggaggaaaaaaaccctataaaatgaacacatccatantgccccttccc

SEQ ID NO: 514329 - DNA, 106 bp, Homo sapiens
tgatcagctcgccgcgttgccggggagcctgagctggcactgaagctggggctgcagcctgggcttggtttgatccttgtgcttggccttggccttggcctttggc

SEQ ID NO: 514330 - DNA, 737 bp, Homo sapiens
  misc_feature (24)..(24): n is a, c, g, or t
  misc_feature (42)..(42): n is a, c, g, or t
  misc_feature (84)..(84): n is a, c, g, or t
  misc_feature (90)..(90): n is a, c, g, or t
  misc_feature (93)..(94): n is a, c, g, or t
  misc_feature (105)..(105): n is a, c, g, or t
  misc_feature (145)..(145): n is a, c, g, or t
  misc_feature (158)..(158): n is a, c, g, or t
  misc_feature (160)..(161): n is a, c, g, or t
  misc_feature (164)..(164): n is a, c, g, or t
  misc_feature (173)..(173): n is a, c, g, or t
  misc_feature (175)..(178): n is a, c, g, or t
  misc_feature (185)..(185): n is a, c, g, or t
  misc_feature (193)..(194): n is a, c, g, or t
  misc_feature (200)..(200): n is a, c, g, or t
  misc_feature (202)..(202): n is a, c, g, or t
  misc_feature (204)..(204): n is a, c, g, or t
  misc_feature (207)..(212): n is a, c, g, or t
  misc_feature (214)..(214): n is a, c, g, or t
  misc_feature (216)..(216): n is a, c, g, or t
  misc_feature (220)..(220): n is a, c, g, or t
  misc_feature (222)..(223): n is a, c, g, or t
  misc_feature (226)..(226): n is a, c, g, or t
  misc_feature (228)..(229): n is a, c, g, or t
  misc_feature (232)..(232): n is a, c, g, or t
  misc_feature (234)..(234): n is a, c, g, or t
  misc_feature (237)..(238): n is a, c, g, or t
  misc_feature (243)..(243): n is a, c, g, or t
  misc_feature (245)..(245): n is a, c, g, or t
  misc_feature (248)..(249): n is a, c, g, or t
  misc_feature (251)..(255): n is a, c, g, or t
  misc_feature (261)..(265): n is a, c, g, or t
  misc_feature (267)..(269): n is a, c, g, or t
  misc_feature (271)..(271): n is a, c, g, or t
  misc_feature (274)..(274): n is a, c, g, or t
  misc_feature (278)..(278): n is a, c, g, or t
  misc_feature (280)..(280): n is a, c, g, or t
  misc_feature (282)..(284): n is a, c, g, or t
  misc_feature (287)..(287): n is a, c, g, or t
  misc_feature (294)..(294): n is a, c, g, or t
  misc_feature (305)..(305): n is a, c, g, or t
  misc_feature (307)..(309): n is a, c, g, or t
  misc_feature (314)..(315): n is a, c, g, or t
  misc_feature (324)..(324): n is a, c, g, or t
  misc_feature (339)..(339): n is a, c, g, or t
  misc_feature (355)..(355): n is a, c, g, or t
  misc_feature (357)..(357): n is a, c, g, or t
  misc_feature (359)..(362): n is a, c, g, or t
  misc_feature (366)..(366): n is a, c, g, or t
  misc_feature (368)..(369): n is a, c, g, or t
  misc_feature (375)..(375): n is a, c, g, or t
  misc_feature (377)..(377): n is a, c, g, or t
  misc_feature (379)..(379): n is a, c, g, or t
  misc_feature (381)..(381): n is a, c, g, or t
  misc_feature (383)..(383): n is a, c, g, or t
  misc_feature (386)..(386): n is a, c, g, or t
  misc_feature (389)..(390): n is a, c, g, or t
  misc_feature (392)..(393): n is a, c, g, or t
  misc_feature (397)..(398): n is a, c, g, or t
  misc_feature (402)..(402): n is a, c, g, or t
  misc_feature (405)..(406): n is a, c, g, or t
  misc_feature (409)..(409): n is a, c, g, or t
  misc_feature (415)..(416): n is a, c, g, or t
  misc_feature (418)..(418): n is a, c, g, or t
  misc_feature (421)..(421): n is a, c, g, or t
  misc_feature (426)..(426): n is a, c, g, or t
  misc_feature (433)..(435): n is a, c, g, or t
  misc_feature (445)..(445): n is a, c, g, or t
  misc_feature (447)..(449): n is a, c, g, or t
  misc_feature (454)..(454): n is a, c, g, or t
  misc_feature (457)..(457): n is a, c, g, or t
  misc_feature (460)..(461): n is a, c, g, or t
  misc_feature (465)..(465): n is a, c, g, or t
  misc_feature (470)..(470): n is a, c, g, or t
  misc_feature (472)..(472): n is a, c, g, or t
  misc_feature (474)..(474): n is a, c, g, or t
  misc_feature (491)..(492): n is a, c, g, or t
  misc_feature (500)..(500): n is a, c, g, or t
  misc_feature (502)..(502): n is a, c, g, or t
  misc_feature (504)..(506): n is a, c, g, or t
  misc_feature (508)..(508): n is a, c, g, or t
  misc_feature (524)..(524): n is a, c, g, or t
  misc_feature (574)..(574): n is a, c, g, or t
  misc_feature (585)..(586): n is a, c, g, or t
  misc_feature (588)..(588): n is a, c, g, or t
  misc_feature (595)..(595): n is a, c, g, or t
  misc_feature (603)..(603): n is a, c, g, or t
  misc_feature (621)..(621): n is a, c, g, or t
  misc_feature (623)..(623): n is a, c, g, or t
  misc_feature (627)..(627): n is a, c, g, or t
  misc_feature (629)..(629): n is a, c, g, or t
  misc_feature (633)..(633): n is a, c, g, or t
  misc_feature (646)..(646): n is a, c, g, or t
  misc_feature (665)..(665): n is a, c, g, or t
  misc_feature (689)..(689): n is a, c, g, or t
aggctgctgcggacggcctgaggntggaccccaagccctggncctgccgagcgtggcactgaggcagcggctgacgctactgtnaggganagnnggttgtgagcngccccgccggacccctggccagccctggccccagcctctnccggtgccctctntnnagncagagccantnnnncccagtnaggcaggnntgcttngnancannnnnntncnactnanngancnntcncnagnncatgnanagnntnnnnngctgannnnnannntnaancatntnannngcngccccgnagccaagccgnannnaagannctttcatanattctattcacaaanaataaccaccattttncnannnncatnannccactntncntnanatnctnntnnctcnnactnctnnctnccatgnnanctnttgcnggccagnnngacggttttnannncactnagnagnnctcnccaanananttcatttacctcaacanntacaagcngncnnncnagtcccaggacaagtncacctacaccttcattgtgccccagcagcgggtcacgggtgccatctgcntcaactccaannancctgatntgcttctngagaaccgagtgcataancnggancnaganctgctcaacaatnagctgctcaagcagaagcngcagatcgagacgctgcagcagcnggtggaggtggacggcggcattgtgagcgaggtgaagctgctgcgcaa

SEQ ID NO: 514331 - DNA, 321 bp, Homo sapiens
cctgtggtagcacaacctaggtcagttttgcagtgtgtaaagccatttaccaagatagttgtaggtaaagaagggcagatttattagagaaattgtgaaaatatgttgcagtgggcagctcagcagagaaggggctacctgcaaagaggcaagggctggaggaaagttttatagggtcctgctgaagggcgctacgtgtggaatgaggtcattgtgcccgcaggttgtttgtgattagctgtctctaacaattgttcatacaataattgttcattattgttctcaacttggggctctccccaacctggggacccttcctta

SEQ ID NO: 514332 - DNA, 137 bp, Homo sapiens
ctccgccagcccgcatatcagctttcaaaaatctcattcaatcatccagatttagtctggggaaagttatttttaaaagttattttgtaaaatttgtaaattaacaattcattaggacggtcaactggtctggagta

SEQ ID NO: 514333 - DNA, 442 bp, Homo sapiens
agcatagcccagtgtctggcagggagacagacctaatagctggtgaccctggacatgtcagttcatttctctgaatcttagtttttccttctgacgagagagatgggcataagaactcaataccagatctctagtgttaataattaaggagctaattcatgttaagtgcttggcatggaaccaggctcatataaagcacttaatattccttgctgttattaccacatataccactcctcttaaaccaggttgcaaataagacataggaagatatggtctgactgtggctgtcacccatgcccatgacttgtgataataatagtgggcacttacatagaccttatggtgttccatcactttgtatttattgaattatttaatcctgccgaaccctatacgtaactatgagataggttctgtttttatccccattttatgcatg

SEQ ID NO: 514334 - DNA, 1919 bp, Homo sapiens
gagacccgacatcctgcgccgccccttccgaggctaaatcggctgcgattccatcatcggaacgcgccggcagaacggggtcctgagtgacgacgtcccgcgcttcctctcccttgcaatccaactcgccaggcacacgcccgccacctcctgcacagccgccacccatgccacacccccgccacccctcctccatgccgaccaaggcaaactctgacatagcataaccaagccacccaacagcaacataaaccaagtatcacaaccacctcgaaccacccggccaaggcacgcacagcaacgggacgccacgctccatggaacccatcacgacaccccaccagaccacctccgcagcccccaccccggcgccccaccgcgccacaccaagcaccatgccccgccccaccaacgctccccaccctgcgagcacccccacatacgccccacacacacgagccctcgcccaccccccccaatccgccaccaccccgaaaccgcacacccaccccccgacaccgccccacccacccccgccgcacgccccgcgcaccccaccccaggccaccaacgaccccacgccactcgcccgcgaacaccaagccccacgagacaccgcaaccccccgccccgctggccaaacccccgcaacccggccaccccccaggacacacagcagcccggcccccccgccccccatcaccctacaccgccacacaggcaccgacccaccaccgccacaacaaccccggcccacccgcaaccaccacagcgcccgggcacacatgcacacaccacggagccaccgcgaccccccccacgccaccaccgaaccgccaccacaagcgacccccccacccccccccccaactctcccacaccaaaacgcacacagaccccccgcaccactgaccccacccgacacccacgccccaccccacacaccaccacacaccgcaccacacaccaagacaccccacaccaccgcgacacccaccgcgaccacccgggaaccgacagccacacgccccactgcacgacacaacagccccgcgcaacacaccccaagcccacacaccacgcccccccacccacacaccacacacccaccctcccccccccccacccccaccactcaaccaccgcccgccctcaccacacccccaccccagcagcgcacgaaccaccccacccccccaccagacgaccacaccccaccgccaccccctctcacgccaccccccacccgccacacacgcccgccccacaccccccccacgcaccacgccgccccacaccccccgccaaccccccgcccccgcccaccacccacacaccaacagccgacaaccacaaccaccccaacgcgacacacacagaacgacgccacgacgacaccaacaccaacacaccatccccaccacacccacgcgacaacccaccgacacacaccaacacgccgtcccccacacgacgtccaccaacgaaccagccacagacaaacagcaccacagcaaccatacacgacacagcgaacacacgcaacacaccaaacaacactcagccaccgacagccaaccatagcgccatagcacaaccacagcacctacagacacccaggacctagccaaacagcctacccaccgcccacggacgcccacagtcacccgaccgcgcgacgctcccgaaacgcacacccacaggacaccgcacgcacccggaccaccgaaaccacacacgaagacgaagcccccaccaccaccacccctacaacgactggcgcacccgagccgcaacgcagacggatagacgacacactcgccaacagcaccaccgccacgtgacagacaccacccgcgacagcctcaacaacaagacaacagcgcaccacctcccgacccccacgccgaaccatcaac

SEQ ID NO: 514335 - DNA, 419 bp, Homo sapiens
  misc_feature (238)..(238): n is a, c, g, or t
agtataattccatttgtcagtttttcctgtcttgcagctgtcaacatcttgagggttcctccatggtttcccagtggtttcagaacttcatgtcaacttcatgctcaatgactttcatccatgtgctgtaggatgagctgctggtctcagaggacaagctccccactcccccctgacagtgcaaggaggtctatgggttgactcatagccaccctgctgagcccagcgtgggccacangtcgttaccacttttaaaatctgtgaccttgggcatgttccttcacctcacgctgtgcctcagttttcgtttacataattttttgagattataatgtaatatgttactcaatggggattaagccaattgatgtttatagcagatcatagatatttgttgattaaaagcacaatgtgaaagc

SEQ ID NO: 514336 - DNA, 224 bp, Homo sapiens
gaccttgatgtatggatagtaatataattctcatcaaagagtaccttttctcctttagaaaactgtgatgcttggccaggtgtaggtgggtcacgcctgtaatcccagcactttggaggccaaggcgggcggatcgtgaggtcaggagtttaagaccagcctggccaacgtggtgaaaccctatttctactaaaaatacaaaaattagctgggcatggtggcac

SEQ ID NO: 514337 - DNA, 1169 bp, Homo sapiens
  misc_feature (251)..(251): n is a, c, g, or t
ctgaggatccatgcaatacctccctaccatggacccgcaaaggaacgagcttcgggcctttgtgaaaatgtgtaagcaggatccgagcgttctgcacaccgaggaaatgcgcttcctgagggagtgggtggagagcatgggtggtaaagtaccacctgctactcagaaagctaaatcagaagaaaataccaaggaagaaaaacctgatagtaagaaggtggaggaagacttaaaggcagacgaaccatcangtgaggaaagtgatctagaaattgataaagaaggtgtgattgaaccagacactgatgctcctcaagaaatgggagatgaaaatgcggagataacggaggagatgatggatcaggcaaatgataaaaaagtggctgctattgaagccctaaatgatggtgaactccagaaagccattgacttattcacagatgccatcaagctgaatcctcgcttggccattttgtatgccaagagggccagtgtcttcgtcaaattacagaagccaaatgctgccatccgagactgtgacagagccattgaaataaatcctgattcagctcagccttacaagtggcgggggaaagcacacagacttctaggccactgggaagaagcagcccatgatcttgcccttgcctgtaaattggattatgatgaagatgctagtgcaatgctgaaagaagttcaacctagggcacagaaaattgcagaacatcggagaaagtatgagcgaaaacgtgaagagcgagagatcaaagaaagaatagaacgagttaagaaggctcgagaagagcatgagagagcccagagggaggaagaagccagacgacagtcaggagctcagtatggctcttttccaggtggctttcctgggggaatgcctggtaattttcccggaggaatgcctggaatgggagggggcatgcctggaatggctggaatgcctggactcaatgaaattcttagtgatccagaggttcttgcagccatgcaggatccagaagttatggtggctttccaggatgtggctcagaacccagcaaatatgtcaaaataccagagcaacccaaaggttatgaatctcatcagtaaattgtcagccaaatttggaggtcaagcgtaatgtccttctgataaataaagcccttgctgaagga

SEQ ID NO: 514338 - DNA, 607 bp, Homo sapiens
tgcaagggtggggacgtctgttgggcatggcgtcccagaagccccattgcagccctattgtggtgggcaggctgcttttgagaatgtgtatacaccttttcaaccttcctgttctgtcagggcagcaggaccagcattccatgttgcttcttactccagtgttcctctaccccagaggctgccttctctttggtcttttgtgcatactgggcatcctaaagctgtttgtttgcccttcagtgaatgggactgacacagagacccatttttgtttttaaaaattataaaatataggctgggtgtggtggctcacacctgtaatcccagcactttgggaggctgaggctggaggatctcctgagcccaggagtttgagaccagcctaggcaacacagtaagaccttgttgctacaaagaatatttaaaaacttagccaggcgtggcagcacgcacctgtggtcccagctcctcaggaggctgaggcaggaggattgcttgagcctgggaaggtcgaggctgcagtgaggtaagatcacaccactgcactccagcctgggaacaggatttcactctgttgtcgacgcggccgcgaatttagtaatagtaa

SEQ ID NO: 514339 - DNA, 903 bp, Homo sapiens
  misc_feature (109)..(109): n is a, c, g, or t
  misc_feature (149)..(150): n is a, c, g, or t
ttcatgccttttcccaccccaattatcctcccgagtttttttttttgtttacaagaaagaggtttaattggacttcagttccacgtgctggggaaccctcacatcatgncagatggcaaggaggagcaagtcacatcttacatggatgnnagcagcaaagagagagagcttggagcagggaaactcctcttttttgaaaccatcagatctcatgagacttatttcactatcacaagaacagtacagaaaagacttgcccccatcattcaatgacctcccacctgtccctcccacacacacagaaattcaagatgagattcggatggggacacagccaaaccatatcattctgccctggcccctcccaaatctcatgatctcgcatttcaaaaccaatcatgcctttctaacagtcccccaaagtcttaactcatttcagcattaactcaaaagtccacagtctaaagtctcatctgagacaaggcaagtcccttccacctatgagcctgtaaaatcaaaagcaggttagttacttcctggatacaatgggggtataggcattgggtaaatatagccattccaaatgggagaaactggccaaacaaaggggctacaggccccatgcaagtccaaaatccagcagggcagtcaaatcttagagctccaaaatgttctcctttgactccatgtctcacatccaggtcatgctgatacaagaggtaggttcccatggtcttgagcagctctgcccctgtggctttgcagggtacagtctccctcctggttgctttcataggctggcattgagtgtctgtggcttttccaggcacacagtgcaagctgtcagtggatctaccattctgggtctggaggacagtgccccagtagggactctgtgtgggc

SEQ ID NO: 514340 - DNA, 93 bp, Homo sapiens
tgagactcgttgagatctttgttgagaaccactaatatcattcactagctcatatctgccggcagcaattgaaaagatccaatatttgaaaaa

SEQ ID NO: 514341 - DNA, 2193 bp, Homo sapiens
  misc_feature (251)..(251): n is a, c, g, or t
  misc_feature (1604)..(1605): n is a, c, g, or t
  misc_feature (1607)..(1607): n is a, c, g, or t
  misc_feature (1612)..(1612): n is a, c, g, or t
  misc_feature (1614)..(1614): n is a, c, g, or t
  misc_feature (1620)..(1620): n is a, c, g, or t
  misc_feature (1633)..(1633): n is a, c, g, or t
  misc_feature (1796)..(1797): n is a, c, g, or t
  misc_feature (1805)..(1805): n is a, c, g, or t
  misc_feature (1826)..(1827): n is a, c, g, or t
  misc_feature (1834)..(1834): n is a, c, g, or t
  misc_feature (1839)..(1839): n is a, c, g, or t
  misc_feature (1850)..(1850): n is a, c, g, or t
  misc_feature (1852)..(1852): n is a, c, g, or t
  misc_feature (1863)..(1864): n is a, c, g, or t
  misc_feature (1866)..(1866): n is a, c, g, or t
  misc_feature (1875)..(1875): n is a, c, g, or t
ctgaggatccatgcaatacctccctaccatggacccgcaaaggaacgagcttcgggcctttgtgaaaatgtgtaagcaggatccgagcgttctgcacaccgaggaaatgcgcttcctgagggagtgggtggagagcatgggtggtaaagtaccacctgctactcagaaagctaaatcagaagaaaataccaaggaagaaaaacctgatagtaagaaggtggaggaagacttaaaggcagacgaaccatcangtgaggaaagtgatctagaaattgataaagaaggtgtgattgaaccagacactgatgctcctcaagaaatgggagatgaaaatgcggagataacggaggagatgatggatcaggcaaatgataaaaaagtggctgctattgaagccctaaatgatggtgaactccagaaagccattgacttattcacagatgccatcaagctgaatcctcgcttggccattttgtatgccaagagggccagtgtcttcgtcaaattacagaagccaaatgctgccatccgagactgtgacagagccattgaaataaatcctgattcagctcagccttacaagtggcgggggaaagcacacagacttctaggccactgggaagaagcagcccatgatcttgcccttgcctgtaaattggattatgatgaagatgctagtgcaatgctgaaagaagttcaacctagggcacagaaaattgcagaacatcggagaaagtatgagcgaaaacgtgaagagcgagagatcaaagaaagaatagaacgagttaagaaggctcgagaagagcatgagagagcccagagggaggaagaagccagacgacagtcaggagctcagtatggctcttttccaggtggctttcctgggggaatgcctggtaattttcccggaggaatgcctggaatgggagggggcatgcctggaatggctggaatgcctggactcaatgaaattcttagtgatccagaggttcttgcagccatgcaggatccagaagttatggtggctttccaggatgtggctcagaacccagcaaatatgtcaaaataccagagcaacccaaaggttatgaatctcatcagtaaattgtcagccaaatttggaggtcaagcgtaatgtccttctgataaataaagcccttgctgaaggaaaagcaacctagatcaccttatggatgtcgcaataatacaaaccagtgtacctctgaccttctcatcaagagagctggggtgctttgaagataatccctacccctctcccccaaatgcagctgaagcattttacagtggtttgccattagggtattcattcagataatgttttcctactaggaattacaaactttaaacactttttaaatcttcaaaatatttaaaacaaatttaaagggcctgttaattcttatatttttctttactaatcattttggatttttttctttgaattattggcagggaatatacttatgtatggaagattactgctctgagtgaaataaaagttattagtgcgaggcaaacataactcatttgaggataaagttgtgttggatatgtggttcctgatgcatttgacttgtctttgnnantgctnantctggntctttaaagatgnatttcaataaaagctaattgggaccacccgtatttcagtaggacctgggtagggattggaagtactcggcaggacagcagcaatcttgctgtgtttgatataacatgcatccttgggcaggttgcccttaaatcttacactgtggtgaagggatgttttacanngtaatgcngcagtagagttggagtacttnngttctcntagtngtccagtatantntaataagtgtnntncatattatntccacgtaagggaaatacaggtagtacttagctgtcaatagttgcgtagtgctgaaaacagttcagcgtacgcttaagtcgagaaggtggccgcaagatacaggaggagagcctagctggcatctgcggacaattgagggacctcacagcgaacctgtcacctaggaacgcataaaagagaaggggccagacacaaagccgggacgaatcaaatcactggcgtgatcaatcgatgaaacaagacggaaaagataagtaacggaggcagtaatacagcggggctgagatgacagggaacagatagcacgataagaagaa

SEQ ID NO: 514342 - DNA, 1024 bp, Homo sapiens
  misc_feature (704)..(704): n is a, c, g, or t
  misc_feature (967)..(967): n is a, c, g, or t
ttttttttatgggggttcatgtgcgccttaataaggtgacccattatttgaaagggataaagggggaggaggggtggcgccccaagtacggggccggccatgtttaaggggttagtgaatggtatgggaaaagactcgaccacaggataggtggccgattaatttatgcgggcgtgaaatcatccacccgtgtgtgttgaagggttctgggcgcgttgataaaaaggacgcacaccacagtgtcgtgcccacacacacatattctgctgggtatgaggagtgatctacagtgttctcgcgaaaggtgtgccgttcttatcaacacacttattcgcgtgacttgtctcacagtggaggcgggggaggccactcactttattgtagtggggccttgggagcccaggaggtggcgttcatcataatagacgacgaggggagacgaggaagtgcagcgatggttatatacatacgaccggcaacggcgatacaaaggaggcccaccaccgcgtggttttacaacgaaaaccggcaggcgattcgagcatcgacatgttgaagagtcgaccttacatctgatgtggataagcgagagcggtgcccatctacaagaatggtgctctccccgatgaaaggaacacaatgtgtgttttccaccagaccgaagcgtggtgtggtactcccagtgagaaatcatcgacgaacgntgatcacgcaggtggggtagaaaaagacggatggtaggtagacaccacttttgttggcgctagagaaaagaggggtgtcacggcaagagagaatgtcattatataactatatcatagtggaaggacgactcaaaataagatactgttagtgctggccgcaatttgtttgtggggaggcgggagagacatcgtcatcctcttagagagagagaaagagaaacaacctcagggcaagtgtagtggggtacacccgcgacgacggnaacaacagacgcagtcgtggggggatactagaacagacttataggtgaagagaacaa

SEQ ID NO: 514343 - DNA, 291 bp, Homo sapiens
cacatcgttgacttcgcccagaagttcattgaaaatactatggtagttgcttttatttaaaccaggaaagtaaaattacaattaatttggtgtaggcggagcaggtgtccgaacccgggagttgcagctgcagtgaaccatgatagtatcagttcacttctagcctgggtgacagaatgagaccctgttccaaagagagaaagagagagagaaagagaaagggtgagatacagagagagacagggaaagagaaagggagagagagagagaaagcgaaagtcaacgatgtgt

SEQ ID NO: 514344 - DNA, 2080 bp, Homo sapiens
  misc_feature (251)..(251): n is a, c, g, or t
  misc_feature (1604)..(1605): n is a, c, g, or t
  misc_feature (1607)..(1607): n is a, c, g, or t
  misc_feature (1612)..(1612): n is a, c, g, or t
  misc_feature (1614)..(1614): n is a, c, g, or t
  misc_feature (1620)..(1620): n is a, c, g, or t
  misc_feature (1633)..(1633): n is a, c, g, or t
ctgaggatccatgcaatacctccctaccatggacccgcaaaggaacgagcttcgggcctttgtgaaaatgtgtaagcaggatccgagcgttctgcacaccgaggaaatgcgcttcctgagggagtgggtggagagcatgggtggtaaagtaccacctgctactcagaaagctaaatcagaagaaaataccaaggaagaaaaacctgatagtaagaaggtggaggaagacttaaaggcagacgaaccatcangtgaggaaagtgatctagaaattgataaagaaggtgtgattgaaccagacactgatgctcctcaagaaatgggagatgaaaatgcggagataacggaggagatgatggatcaggcaaatgataaaaaagtggctgctattgaagccctaaatgatggtgaactccagaaagccattgacttattcacagatgccatcaagctgaatcctcgcttggccattttgtatgccaagagggccagtgtcttcgtcaaattacagaagccaaatgctgccatccgagactgtgacagagccattgaaataaatcctgattcagctcagccttacaagtggcgggggaaagcacacagacttctaggccactgggaagaagcagcccatgatcttgcccttgcctgtaaattggattatgatgaagatgctagtgcaatgctgaaagaagttcaacctagggcacagaaaattgcagaacatcggagaaagtatgagcgaaaacgtgaagagcgagagatcaaagaaagaatagaacgagttaagaaggctcgagaagagcatgagagagcccagagggaggaagaagccagacgacagtcaggagctcagtatggctcttttccaggtggctttcctgggggaatgcctggtaattttcccggaggaatgcctggaatgggagggggcatgcctggaatggctggaatgcctggactcaatgaaattcttagtgatccagaggttcttgcagccatgcaggatccagaagttatggtggctttccaggatgtggctcagaacccagcaaatatgtcaaaataccagagcaacccaaaggttatgaatctcatcagtaaattgtcagccaaatttggaggtcaagcgtaatgtccttctgataaataaagcccttgctgaaggaaaagcaacctagatcaccttatggatgtcgcaataatacaaaccagtgtacctctgaccttctcatcaagagagctggggtgctttgaagataatccctacccctctcccccaaatgcagctgaagcattttacagtggtttgccattagggtattcattcagataatgttttcctactaggaattacaaactttaaacactttttaaatcttcaaaatatttaaaacaaatttaaagggcctgttaattcttatatttttctttactaatcattttggatttttttctttgaattattggcagggaatatacttatgtatggaagattactgctctgagtgaaataaaagttattagtgcgaggcaaacataactcatttgaggataaagttgtgttggatatgtggttcctgatgcatttgacttgtctttgnnantgctnantctggntctttaaagatgnatttcaataaaagctaattgggaccacccgtatttcagtaggacctgggtagggattggaagtactcggcaggacagcagcaatcttgctgtgtttgatataacatgcatccttgggcaggttgcccttaaatcttacactgtggtgaagggatgttttacacgcaagcgcttctcacatttcaatgcccaagacgccctcaccactatagttatagctcactagtggtctaaaccactctttcccacataaccgcaaaatccgcctacactatatttcacactaatccttaaaactattattcttctttttcgcttcaaatactagcgcctttactttttggagtcgtatgaacaaatatccatctctcctaacgcccgctatttacccccctgcttgcctttttcttccttcttctctacacactttattataagaatgcacaga

SEQ ID NO: 514345 - DNA, 399 bp, Homo sapiens
  misc_feature (172)..(172): n is a, c, g, or t
  misc_feature (185)..(185): n is a, c, g, or t
  misc_feature (215)..(215): n is a, c, g, or t
  misc_feature (270)..(270): n is a, c, g, or t
  misc_feature (305)..(305): n is a, c, g, or t
  misc_feature (328)..(328): n is a, c, g, or t
  misc_feature (357)..(357): n is a, c, g, or t
gcctagccccccacccccccggggacagccagtgattaacctttagcaataaacgaagttttagctaagctatactaaccccagggttggtcaatttcggccaagcccccgcggtcacacgatttacccaagtcaatagaagccggggtaaagagtgttttagatcaccccncccccaataaagntaaaactcccctgagttgtaaaaaactccngttgacccaaaatagactacgaaagtggctttaacatatttgaacccccaatagntaagaccccaactgggattagatacccccctatgnttagccctaaacctccacagttnaatcaacaaaactgctcgccagaaccctncgagccccagcttaaaactcaaagggcctggcggtgcttcca

SEQ ID NO: 514346 - DNA, 157 bp, Homo sapiens
ccttaccctgactggcttcttagtaactatccagtgaccccagtgagagaagacaggactctgaaacaggctccagcattggggctggagaacagaaatggaagcacccaatgacacatgctgacatgtggaatcatgtgcgctggctgggaggcga

SEQ ID NO: 514347 - DNA, 234 bp, Homo sapiens
gaagctccacttaggccctagttcctagggacattccccttcaactgcctgagatgagcatttgtgatttcctgaagcttccccagacactctgcctcttttctgtctggtctctattctctccgtgtcccttaatgattgcagagtagtctctgcagctgacctgtgccctagcacccctcctgcctgcccctacctccctcagagccctgcaagcaaggccctgctttggct

SEQ ID NO: 514348 - DNA, 265 bp, Homo sapiens
ccccacccaagaagagcttcgccatcctcatggctaaagcctcttagcaacgttttgccgtcctttgggcttatttccctttgcccaagaactctttgatgctgcccacgatcgcgtccttgtcgcggatctcgctcatgacgacccgatcgtccttcgcgaagtggtcacgtaagtccttgatgaactgcccggagccgtaggggctctcgacctggccgtacgcgaacatgttcgcgcgcggcaggatcttgttcttcgtgat

SEQ ID NO: 514349 - DNA, 1536 bp, Homo sapiens
  misc_feature (251)..(251): n is a, c, g, or t
ctgaggatccatgcaatacctccctaccatggacccgcaaaggaacgagcttcgggcctttgtgaaaatgtgtaagcaggatccgagcgttctgcacaccgaggaaatgcgcttcctgagggagtgggtggagagcatgggtggtaaagtaccacctgctactcagaaagctaaatcagaagaaaataccaaggaagaaaaacctgatagtaagaaggtggaggaagacttaaaggcagacgaaccatcangtgaggaaagtgatctagaaattgataaagaaggtgtgattgaaccagacactgatgctcctcaagaaatgggagatgaaaatgcggagataacggaggagatgatggatcaggcaaatgataaaaaagtggctgctattgaagccctaaatgatggtgaactccagaaagccattgacttattcacagatgccatcaagctgaatcctcgcttggccattttgtatgccaagagggccagtgtcttcgtcaaattacagaagccaaatgctgccatccgagactgtgacagagccattgaaataaatcctgattcagctcagccttacaagtggcgggggaaagcacacagacttctaggccactgggaagaagcagcccatgatcttgcccttgcctgtaaattggattatgatgaagatgctagtgcaatgctgaaagaagttcaacctagggcacagaaaattgcagaacatcggagaaagtatgagcgaaaacgtgaagagcgagagatcaaagaaagaatagaacgagttaagaaggctcgagaagagcatgagagagcccagagggaggaagaagccagacgacagtcaggagctcagtatggctcttttccaggtggctttcctgggggaatgcctggtaattttcccggaggaatgcctggaatgggagggggcatgcctggaatggctggaatgcctggactcaatgaaattcttagtgatccagaggttcttgcagccatgcaggatccagaagttatggtggctttccaggatgtggctcagaacccagcaaatatgtcaaaataccagagcaacccaaaggttatgaatctcatcagtaaattgtcagccaaatttggaggtcaagcgtaatgtccttctgataaataaagcccttgctgaaggaaaagcaacctagatcaccttatggatgtcgcaataatacaaaccagtgtacctctgaccttctcatcaagagagctggggtgctttgaagataatccctacccctctcccccaaatgcagctgaagcattttacagtggtttgccattagggtattcattcagataatgttttcctactaggaattacaaactttaaacactttttaaatcttcaaaatatttaaaacaaatttaaagggcctgttaattcttatatttttctttactaatcattttggatttttttctttgaattattggcagggaatatacttatgtatggaagattactgctctgagtgaaataaaagttattagtgcgaggca

SEQ ID NO: 514350 - DNA, 1598 bp, Homo sapiens
  misc_feature (109)..(109): n is a, c, g, or t
  misc_feature (149)..(150): n is a, c, g, or t
  misc_feature (1009)..(1010): n is a, c, g, or t
  misc_feature (1012)..(1012): n is a, c, g, or t
  misc_feature (1017)..(1017): n is a, c, g, or t
  misc_feature (1019)..(1019): n is a, c, g, or t
  misc_feature (1025)..(1025): n is a, c, g, or t
  misc_feature (1038)..(1038): n is a, c, g, or t
  misc_feature (1201)..(1202): n is a, c, g, or t
  misc_feature (1210)..(1210): n is a, c, g, or t
  misc_feature (1231)..(1232): n is a, c, g, or t
  misc_feature (1239)..(1239): n is a, c, g, or t
  misc_feature (1244)..(1244): n is a, c, g, or t
  misc_feature (1255)..(1255): n is a, c, g, or t
  misc_feature (1257)..(1257): n is a, c, g, or t
  misc_feature (1268)..(1269): n is a, c, g, or t
  misc_feature (1271)..(1271): n is a, c, g, or t
  misc_feature (1280)..(1280): n is a, c, g, or t
ttcatgccttttcccaccccaattatcctcccgagtttttttttttgtttacaagaaagaggtttaattggacttcagttccacgtgctggggaaccctcacatcatgncagatggcaaggaggagcaagtcacatcttacatggatgnnagcagcaaagagcgagagatcaaagaaagaatagaacgagttaagaaggctcgagaagagcatgagagagcccagagggaggaagaagccagacgacagtcaggagctcagtatggctcttttccaggtggctttcctgggggaatgcctggtaattttcccggaggaatgcctggaatgggagggggcatgcctggaatggctggaatgcctggactcaatgaaattcttagtgatccagaggttcttgcagccatgcaggatccagaagttatggtggctttccaggatgtggctcagaacccagcaaatatgtcaaaataccagagcaacccaaaggttatgaatctcatcagtaaattgtcagccaaatttggaggtcaagcgtaatgtccttctgataaataaagcccttgctgaaggaaaagcaacctagatcaccttatggatgtcgcaataatacaaaccagtgtacctctgaccttctcatcaagagagctggggtgctttgaagataatccctacccctctcccccaaatgcagctgaagcattttacagtggtttgccattagggtattcattcagataatgttttcctactaggaattacaaactttaaacactttttaaatcttcaaaatatttaaaacaaatttaaagggcctgttaattcttatatttttctttactaatcattttggatttttttctttgaattattggcagggaatatacttatgtatggaagattactgctctgagtgaaataaaagttattagtgcgaggcaaacataactcatttgaggataaagttgtgttggatatgtggttcctgatgcatttgacttgtctttgnnantgctnantctggntctttaaagatgnatttcaataaaagctaattgggaccacccgtatttcagtaggacctgggtagggattggaagtactcggcaggacagcagcaatcttgctgtgtttgatataacatgcatccttgggcaggttgcccttaaatcttacactgtggtgaagggatgttttacanngtaatgcngcagtagagttggagtacttnngttctcntagtngtccagtatantntaataagtgtnntncatattatntccacgtaagggaaatacaggtagtacttagctgtcaatagttgcgtagtgctgaaaacagttcagcgtacgcttaagtcgagaaggtggccgcaagatacaggaggagagcctagctggcatctgcggacaattgagggacctcacagcgaacctgtcacctaggaacgcataaaagagaaggggccagacacaaagccgggacgaatcaaatcactggcgtgatcaatcgatgaaacaagacggaaaagataagtaacggaggcagtaatacagcggggctgagatgacagggaacagatagcacgataagaagaa

SEQ ID NO: 514351 - DNA, 108 bp, Homo sapiens
tctcttctgcgccggcctcgtcgctacaccctggcacgtgcggtgcgcgcggagcttctccccaccgcgcgccgggtaggcctttggataccgcgtcctgcagctcag

SEQ ID NO: 514352 - DNA, 494 bp, Homo sapiens
  misc_feature (7)..(7): n is a, c, g, or t
  misc_feature (9)..(9): n is a, c, g, or t
  misc_feature (11)..(11): n is a, c, g, or t
  misc_feature (78)..(78): n is a, c, g, or t
  misc_feature (174)..(174): n is a, c, g, or t
  misc_feature (219)..(219): n is a, c, g, or t
  misc_feature (426)..(426): n is a, c, g, or t
ccaattngncnttggccgggggccttcagagctggatgcctgtcttcgcagacatgaaagcaatattaatctccttgnatatctccattagagctcttgggtgactatgtgcattgtcgatgagcagctaacattttgaaaggaatctttttttttctgagcagtgggtctcancagtaggcataaaaagatttagtaaaccatgctgtaaacagatgngctgtcatcagggctttgctgttccatttctatagcataggcaaagtagatttagcataattcttgaaggtcctaggatttttggaatagcagatgagcattggcttcaccttaaagtcaccagcatcattagttcctagtaagagagtcagcctgtccattaaagccaggcattgacttctctgtagagaaaatctgttgtttagngtagccaccttcaatgatcttagctagatcttccatataacttgccgcagtttctacatcagtacttg

SEQ ID NO: 514353 - DNA, 548 bp, Homo sapiens
  misc_feature (1)..(1): n is a, c, g, or t
  misc_feature (28)..(28): n is a, c, g, or t
  misc_feature (245)..(245): n is a, c, g, or t
  misc_feature (281)..(281): n is a, c, g, or t
  misc_feature (422)..(422): n is a, c, g, or t
  misc_feature (441)..(441): n is a, c, g, or t
  misc_feature (492)..(492): n is a, c, g, or t
  misc_feature (496)..(496): n is a, c, g, or t
naaaacacaaagggatgatcatatagtntttaccatcggactaatctagtgtagaaatccttccttatcatagagatatggtttacattaccgtttgttttcattgtgattgcccctatgtaacaatcatgaatattagattttttaaatgtagaatatcctaatattatagccagcagctgttacttgtttgtaaaattgcaaaaaaaacaaaacctgaagttggtttattgaaagaatataangatagcttctagggatattagtaatagatgccatgntcctgaagcctcttctcagaacactgtgggagataatactgacagtagaatcagtgaaaacagcctaacaaaacctctgacatcgtatatcaacttttaacagcccactcacgggctttctaaactacccaccacctgtanggtactggcattaagtccngcatctccagaaacagtggtgtgagtaactggagtccaaatggtcaagtancttnggatataccataggggtccgggctttagaatgggtatggaattcccgcctgc

SEQ ID NO: 514354 - DNA, 720 bp, Homo sapiens
  misc_feature (330)..(330): n is a, c, g, or t
ggcctctctctccaccccacccctctttctggcgtcatcccctccccaacaccacctctgctgctgcctctggctgtggacctgcacctcttccccatccccgccaggcccggggagcggggtgagcctggatgagagcccccccaacctggggctctcccaggccatggcccgtgtgctcccagggaggagccccggaccctgagcatctgctggaggcttggcagaggccccgcggggaccgtgtcttctgaggacaaaaggcggcggccagcaggcagacggagggggggggtggggggtggggggggtagggggaccggcagccanggcaggccagacgggtagcagggggccagcacctggcccccctcccagcttggcagtggcatgaagatgggagtgggagtgctatagtggcggaagcaccttgccgggacccccaccttgccagctagttggacaccccagggctgtgtgctggcccacctggttgtcccccaggcacccccgaggcctacccaggtgcacccttccggtgcctgctttccctgatgcctgcgatttggaccagctcgggctgtttctccggccactgaaggcgggagtgtccctggccgccgatcacctagggtcccccatgtgccccgggtgtggttacctggggttagccgcttgaccccctcggggtttcaagaatcctgttagagccggtgattc

SEQ ID NO: 514355 - DNA, 326 bp, Homo sapiens
ttctagaggactcgcttcatagtctgagtcacaaagtggcatacagtagccttggttaggttccttcaatgaacattttgcgactcctatgacaacattgaaatccgcagagccctgggaggaacaaatagattttaatcgtgagtccaaccagaatgtatagctatagatataagagtaagctggtctccacatcctctcccaatgccaatgcccacagcaaccccagatgatgtgaaaactctgagttaaaagttcttctaagacttattaggttccaagacactgttttccatgtcctgagagagatcaaacaggaaaggaga

SEQ ID NO: 514356 - DNA, 345 bp, Homo sapiens
  misc_feature (16)..(16): n is a, c, g, or t
  misc_feature (37)..(37): n is a, c, g, or t
actgagcctgccctantttagaagtcaatagcaattngcttgtgggtttagactagcaattctgtgacttgctgccctacttctgtttcagctttattcagtgtaagcagattgtgatatcatttttcagatcacaaagtgcaagtccacctgaagtttgttaataacagccacaaacttattttctgatttctaccaagtcccttcccctccaccgcattcaagcaagtcttctatcagaagtttaaattagtcattggaacaaacatttgagtcccctgaccacaaagaacttaaaataccagagagagatcaattcctgctattgaaacttctaaaactagg

SEQ ID NO: 514357 - DNA, 1324 bp, Homo sapiens
tagtaaaatcttttttattcaaaaaaaaaaaaccccaaaaaacaaaagtttcccaaccacacacgggagggatttgggatagggggagggtctcgtgctccactccagcccggggcccccagcccaggtgtggttgtgggcagcaaataaggggatagtggggataagggcccaaaaaattaaaagtggttgggtctggtgatagtggggaggaaagggtggtgcacaagccgtggggggagaggcggggaagagggggaagagggaacagaagcagaggtctcagatacgtgggaacacgccgcgacagagcggtggggaggcccatttatcataataaacatttcctgtggtggactccaaccccaccggggtggacaccacctatctcttgtgtgcccacattcaagacgagagacatataagcgcgctctgttgcgtcgagctcttgtggtgtgaaaaagaggaacatattgaagaggtgtgggggccccccaacgggtgtgcctcttggggaatcaagaaagaaaactcccggtgggctaaaaatatctcccccatatcgcgtggcaagcccagcgtgagtagctcccgcgggaatactccccgcgacacacatatattctgggtggggcgccccccaaagtgtgttcagaccccccatatccccgcgtgtaaaaaaaaatctgtggacacgcggggtccttggtggcccacaccccgagaggaaaactcccacaacccttacagggcgtgagtgccggtgcatgtgttgtgcagcaaacacggtattatcacccgcggggagatagcggggggcgggcccaaaaaacgggtgagcgggccaaaaattcccctgtgtattagcccccacagaaattgggtccgaggtttaccagaaacaggggtttccccgcgtccgcccatagtgacgtgtttgcaccgactagctgcagggagtgttcacacccgcgggccccttgcggcctttgacaaccgggggggggcatcgcccctccagagccatcgtcttgtttgcactccccgcgacaaccggggggatccaagctttgtccttggattttgctagcgcttagtgtgtaatcgagcaacaaccccctggtgctcactcgcgtcttctgctgtcaggtgccggctcgcatgtagatagtgcatacctcccgcaccgatgtgtacacgggggtttcacagcgctttatcttccctgggtcaaatggcgcgccgtgcggacaatctttctccttgcgttccaactgcgtccttgcacctgcacacgtctgcggtttcacccgttccgcgtgtg

SEQ ID NO: 514358 - DNA, 207 bp, Homo sapiens
gaggctcccccgggtccgctcggatgtggagcagcggctccccatcgctgcattcactgacgtgcatgccggctgcaggagcagctagcgcctgtcattgcgatggaagaagtctcagagtctctctcacactcaaagacggacagattggggacagaggatcctgagaagcttttcgttctcctgatgttcctggcttgcaatact

SEQ ID NO: 514359 - DNA, 887 bp, Homo sapiens
accccccaaggggcgcgtaaaacgacacccacaaggggacccacacggggaaattatggccccaaaagcccggcccccggggtgcaccccgcaagcaggtgcgcccgcccgggcccgggaagtgattacatcgggggcgaccccctcaagccctaagatgggggaaagcaaccccaggcggtgggagactcgcttaacctaatcaacaagtgtgagcgcagcggcccctcacaatcgggtcccccaccaagcgcagatgcgcgcgcaccatgtgggctacgccaatggggaacaggtgctcgaccgcgagtaagagactctctggaggaaaaagacacgcccccccgtgatgttaattagccccagatttggtaccccccccgggagggtttcttgggaggcacacacttgtgaaacccaaccgcctcgtatcctgcccaaaacacggatgtttccgatgttcgtgtccacacaagctgaggcgcctcaggcgcccccccatagacagtagctaccaattatagggactggtgtccccacgcggcagtccaacctgttatgttctgaaggtgctattcttttatgccacggggaaaagaagcaagcgtgtcttttcctggaaaggggcccacggacttctgggcacggcagataggagctctcccccacagtaggtcttctcagaaaacccatttggataacaggcctcctccaggaacgacttcaggcgcaacaaaaattaaacctccagaatgaaaatcagtccagtggacgcataaggctttacggctgcccccaagagaagactcagggttgtgaggagctcacgccactcaaccggccctcgcgcacccgcgcccaaccataggacccccgccagacatgac

SEQ ID NO: 514360 - DNA, 1433 bp, Homo sapiens
  misc_feature (124)..(124): n is a, c, g, or t
  misc_feature (669)..(669): n is a, c, g, or t
taaaaaataaaggccaagaataactaacttttaagatcccgggttttaaacaaggcagctgtagttctctccgatcatcctcgacgtgctccataggactttcttatccgtgggacgagaccancgtggtggcccagttgaaagcttgagaggggaccctgtgtggatttcaagagcgtggatggaaagtggagcctcatcctctcccccaagagaagtctgtgtgaataaccgtgcgtgagaagtcccatgaccaaacgtgaggggcttcaacgtgtgcgtcagaacaggactcctcgttcccgcgtcaggaaggcctattttgtgagggaagagcattatccggcgggtattcatgagaaagtgagggcatagacccaggggacaaaagtgcggtatgtagagggccaaaccacggtacaaccgtggtctcacaaggggagggacatgcctagtcttggggacgcccaaacagaggcccgtgatgttgtgagatatcccacgtgacgagatatcccgtgatgtgaccacccacccacgtttatctgcattacagggagggggggggatgacccacatagaagatagaccaagtcaggtaaaacatgttgacgagctgttccgcaaggccacatgtgtcgcaccataagggagaaatctccaagttcnctcaaaaaagcaaccccgtcaagagagagaaacccttggaagaatgggaagaagtgtgtcggggtgccccaacaatgcgtttcggtgggggtacttacaggggaccaaaaaaccccttagatgtttctgtggaaccaattgtgggggcactacccaaataaaagaggcgagggaaaaagtctccgacctgtaaacatccactttcaatccgtggggggcccatgtggtatttatacgtaaccagtaccgtgtgttctcccctcaacgccctctgtgttaaaagggaacgttaattgtggttaaggaaaccatgatcatgtggacacacgattttaagatgccacaaacttatatacgcgggcacacgcggccccccaagggggaaattacccccaagggaaaaggtttagtatctccttaacacacctggggcgctagaaaaatattcgctgtaactattttaagtaccttggaatacaattccgtgtggagggagaagatttcctttccataagaagcaaggggcatgtgtgtatttgccccccatggtgggatgtggggcggctttatgaaacacactccccatgaaagttggttgtgcatatcataaggggataccaccagtgtattgttgggtcgtgcacgacgaaacattccaagtagtagggagcttgacgtgtggaaacccacctgggtggggagtgtcctcccccacaaggcgttatcactgttgtgacaaaagcaagagacgttcgaaaggacta

SEQ ID NO: 514361 - DNA, 186 bp, Homo sapiens
ttgttgttccagaggatcccgaagcgcacgatggcgcgtcatatgggcaaaaagccggttagcgtgggcaggcctcctagggagaggagggtggatggaattaacgggtgttagtcatgttacgcttgtatcagtgtgcgacgatagtagtagtggtcgtggtgctaggagtttaatgttgcagta

SEQ ID NO: 514362 - DNA, 243 bp, Homo sapiens
cagtttcctggtggatccattgaccttcagacggaagacaatggcattagcattcttactctgaacaatccaatagaatgatgcctttccaggtgttatgggtgctacaacttctggaaaaggtaattgaattggaaaattggccagggggaaaggcctcatgtccgtggggcaaaaattactttctctccaggatctgatctgaatgctgtgaaatcactgggcacttccagaggagggatg

SEQ ID NO: 514363 - DNA, 346 bp, Homo sapiens
gttcactttctacacattgtatggatacagtatcttatctgtcatcagatgatggacatgtgggttgtttacacaacttggctattagcaatacttctgctatgaacatttgtgtatatgtctttgtgtggactgtgtttttgtttctcttgggtatatacataagagtaaaattactaggtcatacagtaagtatatgtttaaccttttgaggaactaccgaactattttccaaagtggctttaccattttccaatcccaccatcagtgtgtgaaggttccagttttccacatcctcactaacacttgttattatctgtctttttggttatagccattctagttg

SEQ ID NO: 514364 - DNA, 218 bp, Homo sapiens
ttaatctggatgatgagtacagggttttcatttaattattattttccaaaatgtagacatatgtttaatgtactctttatatatgagaaatttcacaataagaaatcttcaacattgtaagacacatattcatgtttcttttatttcttatttgatttaggtgagcatagctaccccaaaacagaaaccaaaaacttcattttgctttggtaagtact

SEQ ID NO: 514365 - DNA, 483 bp, Homo sapiens
gtgacctctctgcgcagcctcccgagtagctgtgattacaggtgcctccaccatgcctggctagattttgtatttctagtagagatagggtttcaccggtgttgggcaggctgttcttgaactcctgacctcatgatccgtctgcctcggcctcccaacatgctctgattacaggcatgaaccaccgcacctggccttctatttcttcggaaagtgaaatggttatagctaaacatactgacttttccccttgtgatactgtaatacaataagaaagatatatttgtccttttccccagtttctggcataaagctgctaaaatccttgtagtttcctagtaataagagcatctttggttataatattcagtcttagttcttggcacgtgaacttctgagacccttacaacctccagagtggtgtgtcttttgtatgctaatgagatgactggtagctgaggtccctgagatagcttagggatg

SEQ ID NO: 514366 - DNA, 719 bp, Homo sapiens
ggcacaatgaagacagagtttcagtttgggaaggtgaaaaaattttggagataggccaggtgtggtggctcacgcctgtaatcccagcatggtgagaggctgaggcgtgcagatacctgaggtcaggaggtcaagaccaacctggccaacatggtgaaatcctgtctcttctaaaaatacaaaaattagctggatgtggtgatgcgtgcctatagtcccagctgttcgggaggctgaggcaggagaattgcagtgagccgagatcgcgccactgcactctagcctggatgacagagtgagactccatctaaaaaaaaaaaggaaaaagttctggagataaatggtgatgatagttggagaaaatgaatatacatgaagttatatgtaatgatgcgaagtgtactttataaagggtaaaaaagtaaattaatgtcagagtgcagagcgcaaaaccggaaccccaacccaaaaacaaggccaccaaatggaaccaaagagaagagcacggacaaggcacaccgccagaggaccaacacaagacgacaggcctgggcgaggcccagaggccagacagaacaggaacagggcgcacacccagaaccaccgcgcccaacggcccagacccgaggcaaggacccacaacaaacgcaagacggaggagaaaggaaaaagaagagaacacacacgcaaccagcaacaacaagaaacaacacaaacaa

SEQ ID NO: 514367 - DNA, 445 bp, Homo sapiens
tagaaaatatggggaaaatgtctcaaattcagggagagtattttttattattacttccttctctattaatatcttgtgtctcctttatcactgtctatcttttagctcttttctttttcccacaatctacttaaactagtcttttttctcattcagttatttcaagtaccattggaagaggaaggacaacgtggtggacctatccttgcaccagaggagattaagactatttttggtagcatcccagatatctttgatgtacacactaagataaaggtaaatttgtatatgttagattggtagtaatttttttcagattgtacatatttattatgatctttgaggtacttctggttagctaaataagttttgtacctaaaacttcttattcccttattagttcctttgaatcatttgtctctttgttccactgcctcaaacaatg

SEQ ID NO: 514368 - DNA, 130 bp, Homo sapiens
cagaccggctatcggggatgggtatcggcgatggatatcggtgactggccgacgcgtgcgatatggatcgatatggtggccgggatcgctatgatgaccgaggcagcagagactatgatagcaggctatg

SEQ ID NO: 514369 - DNA, 451 bp, Homo sapiens
tacagattaaatgtaagtttgttaactggatcaggtttgagggaggagcaaggtcggttttgttaggccagtttcatttaataatcagaggaaacgcaattcagatgttctggagtgagaaacttaagtatttaatttccctttttgaaaaaggcagcggccaattttttcttccttaattataaattctagattatttattttacctatcatctggcagggttttttggggggggggggggtgttcctttgggttttttttttgtttttttttttggcaaagtttgtcaccccctgcaatccagcctgggagacataattcaaatcaattttggtcttaaatcttctaaggtttgggttatttcatgtgggccagtttctctttttgtcacaacaatttatcaatttgtggcaataaaaatgatttcccttttaaagtgtttgaatgtcc

SEQ ID NO: 514370 - DNA, 2791 bp, Homo sapiens
  misc_feature (29)..(30): n is a, c, g, or t
  misc_feature (34)..(34): n is a, c, g, or t
  misc_feature (36)..(36): n is a, c, g, or t
  misc_feature (40)..(40): n is a, c, g, or t
  misc_feature (44)..(45): n is a, c, g, or t
  misc_feature (47)..(47): n is a, c, g, or t
  misc_feature (52)..(53): n is a, c, g, or t
ggggccggcgaggaatggcggtatttgtnngagnantccntttnnanagggnnactcctagatatctccaacacaccagagtctagcattaactatggagacaccccaaagtcttgtactaagtcttctaaaagctccactccagttccttcaaagcagtcagcaaggtggcaagttgcaaaagagctttatcaaactgaaagtaattatgttaatatattggcaacaattattcagttatttcaagtaccattggaagaggaaggacaacgtggtggacctatccttgcaccagaggagattaagactatttttggtagcatcccagatatctttgatgtacacactaagataaaggatgatcttgaagaccttatagttaattgggatgagagcaaaagcattggtgacatttttctgaaatattcaaaagatttggtaaaaacctaccctccctttgtaaacttctttgaaatgagcaaggaaacaattattaaatgtgaaaaacagaaaccaagatttcatgcttttctcaagataaaccaagcaaaaccagaatgtggacggcagagccttgttgaacttcttatccgaccagtacagaggttacccagtgttgcattacttttaaatgatcttaagaagcatacagctgatgaaaatccagacaaaagcactttagaaaaagctattggatcactgaaggaagtaatgacgcatattaatgaggataagagaaaaacagaagctcaaaagcaaatttttgatgttgtttatgaagtagatggatgcccagctaatcttttatcttctcaccgaagcttagtacagcgggttgaaacaatttctctaggtgagcacccctgtgacagaggagaacaagtaactctcttcctcttcaatgattgcctagagatagcaagaaaacggcacaaggttattggcacttttaggagtcctcatggccaaacccgacccccagcttctcttaagcatattcacctaatgcctctttctcagattaagaaggtattggacataagagagacagaagattgccataatgcttttgccttgcttgtgaggccaccaacagagcaggcaaatgtgctactcagtttccagatgacatcagatgaacttccaaaagaaaactggctaaagatgctgtgtcgacatgtagctaacaccatttgtaaagcagatgctgagaatcttatttatactgctgatccagaatcctttgaagtaaatacaaaagatatggacagtacattgagtagagcatcaagagcaataaaaaagacttcaaaaaaggttacaagagcattctctttctccaaaactccaaaaagagctcttcgaagggctcttatgacatcccacggctcagtggagggaagaagtccttccagcaatgataagcatgtaatgagtcgtctttctagcacatcatcattagcaggtatcccttctccctcccttgtcagccttccttccttctttgaaaggagaagtcatacgttaagtagatctacaactcatttgatatgaagcgttaccaaaatcttaaattatagaaatgtatagacacctcatactcaaataagaaactgacttaaatggtacttgtaattagcacttggtgaaagctggaaggaagataaataacactaaactatgctatttgatttttcttcttgaaagagtaaggtttacctgttacattttcaagttaattcatgtaaaaaatgatagtgattttgatgtaatttatctcttgtttgaatctgtcattcaaaggccaataatttaagttgctatcagctgatattagtagctttgcaaccctgatagagtaaataaattttatgggcgggtgccaaatactgctgtgaatctatttgtatagtatccatgaatgaatttatggaaatagatatttgtgcagctcaatttatgcagagattaaatgacatcataatactggatgaaaacttgcatagaattctgattaaatagtgggtctgtttcacatgtgcagtttgaagtatttaaataaccactcctttcacagtttattttcttctcaagcgttttcaagatctagcatgtggattttaaaagatttgccctcattaacaagaataacatttaaaggagattgtttcaaaatatttttgcaaattgagataaggacagaaagattgagaaacattgtatattttgcaaaaacaagatgtttgtagctgtttcagagagagtacggtatatttatggtaattttatccactagcaaatcttgatttagtttgatagtgtgtggaattttattttgaaggataagaccatgggaaaattgtggtaaagactgtttgtacccttcatgaaataattctgaagttgccatcagttttactaatcttctgtgaaatgcatagatatgcgcatgttcaactttttattgtggtcttataattaaatgtaaaattgaaaattcatttgctgtttcaaagtgtgatatctttcacaatagcctttttatagtcagtaattcagaataatcaagttcatatggataaatgcatttttatttcctatttctttagggagtgctacaaatgtttgtcacttaaatttcaagtttctgttttaatagttaactgactatagattgttttctatgccatgtatgtgccacttctgagagtagtaaatgactctttgctacattttaaaagcaattgtattagtaagaactttgtaaataaatacctaaaacccaagtgta

SEQ ID NO: 514371 - DNA, 115 bp, Homo sapiens
gtctgcagacacagcacaagactggaggatgtacagaatgggagagccacggggtttctgctgaaggagaacatcaggccctttcagctctatgagatctatctgtgtactccct

SEQ ID NO: 514372 - DNA, 375 bp, Homo sapiens
gtgctggtcactctaaggatccgatgcgaagttcgatagcggcagcagttagcatctcaatttagagatgacattttgtggcagagaagctcagaaagcatcagaagaagtcttcactcatgggtggaagcttgtccttagactcttttggcaggagtgggtttcccatcttaatcctttgacctcttctaatctataatcaggaggaatgtttcttctttttcaccaagcttttcaacggtcttcttctattgggcttctccttgactttatccacatcaccaggtttttccccatctatcttggaatcttgcttcccttttttcccccagggttatcaggcaaaggcttctacaagcatcatctggcacttgt

SEQ ID NO: 514373 - DNA, 2435 bp, Homo sapiens
gctggtactattagttatttttcctgttcctctccttcctccttaccctccaccttccagtaggccccagtcaaaagatttggtaaaaacctaccctccctttgtaaacttctttgaaatgagcaaggaaacaattattaaatgtgaaaaacagaaaccaagatttcatgcttttctcaagataaaccaagcaaaaccagaatgtggacggcagagccttgttgaacttcttatccgaccagtacagaggttacccagtgttgcattacttttaaatgatcttaagaagcatacagctgatgaaaatccagacaaaagcactttagaaaaagctattggatcactgaaggaagtaatgacgcatattaatgaggataagagaaaaacagaagctcaaaagcaaatttttgatgttgtttatgaagtagatggatgcccagctaatcttttatcttctcaccgaagcttagtacagcgggttgaaacaatttctctaggtgagcacccctgtgacagaggagaacaagtaactctcttcctcttcaatgattgcctagagatagcaagaaaacggcacaaggttattggcacttttaggagtcctcatggccaaacccgacccccagcttctcttaagcatattcacctaatgcctctttctcagattaagaaggtattggacataagagagacagaagattgccataatgcttttgccttgcttgtgaggccaccaacagagcaggcaaatgtgctactcagtttccagatgacatcagatgaacttccaaaagaaaactggctaaagatgctgtgtcgacatgtagctaacaccatttgtaaagcagatgctgagaatcttatttatactgctgatccagaatcctttgaagtaaatacaaaagatatggacagtacattgagtagagcatcaagagcaataaaaaagacttcaaaaaaggttacaagagcattctctttctccaaaactccaaaaagagctcttcgaagggctcttatgacatcccacggctcagtggagggaagaagtccttccagcaatgataagcatgtaatgagtcgtctttctagcacatcatcattagcaggtatcccttctccctcccttgtcagccttccttccttctttgaaaggagaagtcatacgttaagtagatctacaactcatttgatatgaagcgttaccaaaatcttaaattatagaaatgtatagacacctcatactcaaataagaaactgacttaaatggtacttgtaattagcacttggtgaaagctggaaggaagataaataacactaaactatgctatttgatttttcttcttgaaagagtaaggtttacctgttacattttcaagttaattcatgtaaaaaatgatagtgattttgatgtaatttatctcttgtttgaatctgtcattcaaaggccaataatttaagttgctatcagctgatattagtagctttgcaaccctgatagagtaaataaattttatgggcgggtgccaaatactgctgtgaatctatttgtatagtatccatgaatgaatttatggaaatagatatttgtgcagctcaatttatgcagagattaaatgacatcataatactggatgaaaacttgcatagaattctgattaaatagtgggtctgtttcacatgtgcagtttgaagtatttaaataaccactcctttcacagtttattttcttctcaagcgttttcaagatctagcatgtggattttaaaagatttgccctcattaacaagaataacatttaaaggagattgtttcaaaatatttttgcaaattgagataaggacagaaagattgagaaacattgtatattttgcaaaaacaagatgtttgtagctgtttcagagagagtacggtatatttatggtaattttatccactagcaaatcttgatttagtttgatagtgtgtggaattttattttgaaggataagaccatgggaaaattgtggtaaagactgtttgtacccttcatgaaataattctgaagttgccatcagttttactaatcttctgtgaaatgcatagatatgcgcatgttcaactttttattgtggtcttataattaaatgtaaaattgaaaattcatttgctgtttcaaagtgtgatatctttcacaatagcctttttatagtcagtaattcagaataatcaagttcatatggataaatgcatttttatttcctatttctttagggagtgctacaaatgtttgtcacttaaatttcaagtttctgttttaatagttaactgactatagattgttttctatgccatgtatgtgccacttctgagagtagtaaatgactctttgctacattttaaaagcaattgtattagtaagaactttgtaaataaatacctaaaacccaagtgta

SEQ ID NO: 514374 - DNA, 142 bp, Homo sapiens
  misc_feature (110)..(110): n is a, c, g, or t
  misc_feature (136)..(136): n is a, c, g, or t
tgtgacggagtctcactctgtcacccaggctggagtgccagtgacgtgatctcagctcaccgcagcctccacctcctggagttcaagcaaccaactttagcccagttttnatttgcaaaacaggaaataaggcttnattctc

SEQ ID NO: 514375 - DNA, 465 bp, Homo sapiens
cgccgacgacagcaccgatgccgcgctggagatcctccgcgacagcggcgttctcctcccggtccagctcgcttagttcgcgcgtaccaccggtccccgcggccgggatcggagcctcctatgccgacgccgtccgtcccggccgcaccgcgcctgcggctcaagccgtcgccgctgccgcccaccggtttcgtggacggcgggtggtggcccgcttccgcggacctggcggccgaagtcccggccctcgccgcggcgctggcggagcggatcggcccggtgtggcgcgtggcgttcgccgtggcggcctggctgcccgcggagcctgccatcgtctcgcagggccggctcgtgcggctggaggggttccgctcgcaggacccgcacgtcgtgcacgtgaccggcggttcgatgcgccggctgacgctgctcgtcgtccccgccgggacacctctcgcggtcgcc

SEQ ID NO: 514376 - DNA, 901 bp, Homo sapiens
  misc_feature (34)..(34): n is a, c, g, or t
  misc_feature (96)..(96): n is a, c, g, or t
  misc_feature (242)..(242): n is a, c, g, or t
  misc_feature (251)..(251): n is a, c, g, or t
  misc_feature (253)..(253): n is a, c, g, or t
  misc_feature (273)..(273): n is a, c, g, or t
  misc_feature (297)..(297): n is a, c, g, or t
  misc_feature (305)..(305): n is a, c, g, or t
  misc_feature (309)..(309): n is a, c, g, or t
  misc_feature (314)..(314): n is a, c, g, or t
  misc_feature (326)..(326): n is a, c, g, or t
  misc_feature (355)..(355): n is a, c, g, or t
  misc_feature (358)..(358): n is a, c, g, or t
  misc_feature (373)..(373): n is a, c, g, or t
  misc_feature (415)..(415): n is a, c, g, or t
  misc_feature (434)..(435): n is a, c, g, or t
  misc_feature (448)..(448): n is a, c, g, or t
  misc_feature (461)..(461): n is a, c, g, or t
  misc_feature (474)..(474): n is a, c, g, or t
  misc_feature (482)..(483): n is a, c, g, or t
  misc_feature (507)..(507): n is a, c, g, or t
  misc_feature (582)..(582): n is a, c, g, or t
  misc_feature (599)..(599): n is a, c, g, or t
  misc_feature (700)..(700): n is a, c, g, or t
  misc_feature (735)..(735): n is a, c, g, or t
  misc_feature (779)..(779): n is a, c, g, or t
  misc_feature (901)..(901): n is a, c, g, or t
atacaggttacatagctgtaaccatcttaaggcnaatgacattaagtttgcaacaaatacttgctggtgaaaacacattactagcatttcaaaaanttacaaaaatgtaacaaaatatcctaaacagctatctttatatttgtaaaggaagtatgaacaactggcttaaccagtttccactgcacatcaaacaggtggcaaagtgatagggatcttctttgatttttaagggaataataaantctaatttntntcccacacattacaattctnggggatttgtgtcaggctaacacntgttgtcntctnctttnacagccttttcntttactcgttttgtcttgatactttacantgntttttttttttcctntaaggtaatcgttttgttgctgtaaaagccgtttttcttttnttttttttaattcccttannggaatcgtgtggnccatttcccattnggtttcataaacncccgtggnncttcgggcacaataggggggtggnggttttctttcggtttctggggtcttctctctgaaacatcagagctgataatagttcggcctatacatgcatgcngccatagataattgggnggtacgtgcacctcctgtttcaaaaacgcaagcgcgaacataggtctggacaagggcaagctgcaactcaatttctgctgcaaccctagctcaggtaagtnatgtttattccttcactttgctgatatagtcagtnagtatgttgatgccttcttcctgctgttctagggcatccagganaatgcccatcggtgtcctcttcaaacctattccttccattttattctccagtttgttcttgaggttccgaagtctcaacgatgcatggataaacatcaacagcaaaggaaaagtaatgccan

SEQ ID NO: 514377 - DNA, 1977 bp, Homo sapiens
  misc_feature (63)..(63): n is a, c, g, or t
aagaaaacggcacaaggttattggcacttttcttgctatctctaggcaatcattgaagaggangagagttacttgttctcctcttcaatgattgcctagagatagcaagaaaacggcacaaggttattggcacttttaggagtcctcatggccaaacccgacccccagcttctcttaagcatattcacctaatgcctctttctcagattaagaaggtattggacataagagagacagaagattgccataatgcttttgccttgcttgtgaggccaccaacagagcaggcaaatgtgctactcagtttccagatgacatcagatgaacttccaaaagaaaactggctaaagatgctgtgtcgacatgtagctaacaccatttgtaaagcagatgctgagaatcttatttatactgctgatccagaatcctttgaagtaaatacaaaagatatggacagtacattgagtagagcatcaagagcaataaaaaagacttcaaaaaaggttacaagagcattctctttctccaaaactccaaaaagagctcttcgaagggctcttatgacatcccacggctcagtggagggaagaagtccttccagcaatgataagcatgtaatgagtcgtctttctagcacatcatcattagcaggtatcccttctccctcccttgtcagccttccttccttctttgaaaggagaagtcatacgttaagtagatctacaactcatttgatatgaagcgttaccaaaatcttaaattatagaaatgtatagacacctcatactcaaataagaaactgacttaaatggtacttgtaattagcacttggtgaaagctggaaggaagataaataacactaaactatgctatttgatttttcttcttgaaagagtaaggtttacctgttacattttcaagttaattcatgtaaaaaatgatagtgattttgatgtaatttatctcttgtttgaatctgtcattcaaaggccaataatttaagttgctatcagctgatattagtagctttgcaaccctgatagagtaaataaattttatgggcgggtgccaaatactgctgtgaatctatttgtatagtatccatgaatgaatttatggaaatagatatttgtgcagctcaatttatgcagagattaaatgacatcataatactggatgaaaacttgcatagaattctgattaaatagtgggtctgtttcacatgtgcagtttgaagtatttaaataaccactcctttcacagtttattttcttctcaagcgttttcaagatctagcatgtggattttaaaagatttgccctcattaacaagaataacatttaaaggagattgtttcaaaatatttttgcaaattgagataaggacagaaagattgagaaacattgtatattttgcaaaaacaagatgtttgtagctgtttcagagagagtacggtatatttatggtaattttatccactagcaaatcttgatttagtttgatagtgtgtggaattttattttgaaggataagaccatgggaaaattgtggtaaagactgtttgtacccttcatgaaataattctgaagttgccatcagttttactaatcttctgtgaaatgcatagatatgcgcatgttcaactttttattgtggtcttataattaaatgtaaaattgaaaattcatttgctgtttcaaagtgtgatatctttcacaatagcctttttatagtcagtaattcagaataatcaagttcatatggataaatgcatttttatttcctatttctttagggagtgctacaaatgtttgtcacttaaatttcaagtttctgttttaatagttaactgactatagattgttttctatgccatgtatgtgccacttctgagagtagtaaatgactctttgctacattttaaaagcaattgtattagtaagaactttgtaaataaatacctaaaacccaagtgta

SEQ ID NO: 514378 - DNA, 2872 bp, Homo sapiens
  misc_feature (29)..(30): n is a, c, g, or t
  misc_feature (34)..(34): n is a, c, g, or t
  misc_feature (36)..(36): n is a, c, g, or t
  misc_feature (40)..(40): n is a, c, g, or t
  misc_feature (44)..(45): n is a, c, g, or t
  misc_feature (47)..(47): n is a, c, g, or t
  misc_feature (52)..(53): n is a, c, g, or t
ggggccggcgaggaatggcggtatttgtnngagnantccntttnnanagggnnactcctagatatctccaacacaccagagtctagcattaactatggagacaccccaaagtcttgtactaagtcttctaaaagctccactccagttccttcaaagcagtcagcaaggtggcaagttgcaaaagagctttatcaaactgaaagtaattatgttaatatattggcaacaattattcagttatttcaagtaccattggaagaggaaggacaacgtggtggacctatccttgcaccagaggagattaagactatttttggtagcatcccagatatctttgatgtacacactaagataaaggatgatcttgaagaccttatagttaattgggatgagagcaaaagcattggtgacatttttctgaaatattcaaaagatttggtaaaaacctaccctccctttgtaaacttctttgaaatgagcaaggaaacaattattaaatgtgaaaaacagaaaccaagatttcatgcttttctcaagataaaccaagcaaaaccagaatgtggacggcagagccttgttgaacttcttatccgaccagtacagaggttacccagtgttgcattacttttaaatgatcttaagaagcatacagctgatgaaaatccagacaaaagcactttagaaaaagctattggatcactgaaggaagtaatgacgcatattaatgaggataagagaaaaacagaagctcaaaagcaaatttttgatgttgtttatgaagtagatggatgcccagctaatcttttatcttctcaccgaagcttagtacagcgggttgaaacaatttctctaggtgagcacccctgtgacagaggagaacaagtaactctcttcctcttcaatgattgcctagagatagcaagaaaacggcacaaggttattggcacttttaggagtcctcatggccaaacccgacccccagcttctcttaagcatattcacctaatgcctctttctcagattaagaaggtattggacataagagagacagaagattgccataatgcttttgccttgcttgtgaggccaccaacagagcaggcaaatgtgctactcagtttccagatgacatcagatgaacttccaaaagaaaactggctaaagatgctgtgtcgacatgtagctaacaccatttgtaaagcagatgctgagaatcttatttatactgctgatccagaatcctttgaagtaaatacaaaagatatggacagtacattgagtagagcatcaagagcaataaaaaagacttcaaaaaaggttacaagagcattctctttctccaaaactccaaaaagagctcttcgaagggctcttatgacatcccacggctcagtggagggaagaagtccttccagcaatgataagcatgtaatgagtcgtctttctagcacatcatcattagcaggtatcccttctccctcccttgtcagccttccttccttctttgaaaggagaagtcatacgttaagtagatctacaactcatttgatatgaagcgttaccaaaatcttaaattatagaaatgtatagacacctcatactcaaataagaaactgacttaaatggtacttgtaattagcacttggtgaaagctggaaggaagataaataacactaaactatgctatttgatttttcttcttgaaagagtaaggtttacctgttacattttcaagttaattcatgtaaaaaatgatagtgattttgatgtaatttatctcttgtttgaatctgtcattcaaaggccaataatttaagttgctatcagctgatattagtagctttgcaaccctgatagagtaaataaattttatgggcgggtgccaaatactgctgtgaatctatttgtatagtatccatgaatgaatttatggaaatagatatttgtgcagctcaatttatgcagagattaaatgacatcataatactggatgaaaacttgcatagaattctgattaaatagtgggtctgtttcacatgtgcagtttgaagtatttaaataaccactcctttcacagtttattttcttctcaagcgttttcaagatctagcatgtggattttaaaagatttgccctcattaacaagaataacatttaaaggagattgtttcaaaatatttttgcaaattgagataaggacagaaagattgagaaacattgtatattttgcaaaaacaagatgtttgtagctgtttcagagagagtacggtatatttatggtaattttatccactagcaaatcttgatttagtttgatagtgtgtggaattttattttgaaggataagaccatgggaaaattgtggtaaagactgtttgtacccttcatgaaataattctgaagttgccatcagttttactaatcttctgtgaaatgcatagatatgcgcatgttcaactttttattgtggtcttataattaaatgtaaaattgaaaattcatttgctgtttcaaagtgtgatatctttcacaatagcctttttatagtcagtaattcagaataatcaagttcatatggataaatgcatttttatttcctatttctttagggagtgctacaaatgtttgtcacttaaatttcaagtttctgttttaatagttaactgactatagattgttttctatgccatgtatgtgccacttctgagagtagtaaatgactctttgctacattttaaaagcaattgtattagtaagaactttgtaaataaatacctaaaacccaagtgtaaaaaaaaaaaaggggggcgtaaagatatccaaggggcaaattgaggtacaagttttttacaagggcccaggggggaataaa

SEQ ID NO: 514379 - DNA, 131 bp, Homo sapiens
  misc_feature (30)..(30): n is a, c, g, or t
  misc_feature (55)..(55): n is a, c, g, or t
cggcggcgggcgtagaacaagcagcttagnaaagcagtgagcaatagaaactgtncctcaatcccacagagaaagaggagggggccaagagccaggacagggagagacaggcagacacccagcccggccgg

SEQ ID NO: 514380 - DNA, 100 bp, Homo sapiens
tggcgtaacttaactcatgcatgtctccaatatgcatgagttacagttacgccagtttatttaaatagtgctggtctctcaacacagttatctacatttc

SEQ ID NO: 514381 - DNA, 3058 bp, Homo sapiens
  misc_feature (29)..(30): n is a, c, g, or t
  misc_feature (34)..(34): n is a, c, g, or t
  misc_feature (36)..(36): n is a, c, g, or t
  misc_feature (40)..(40): n is a, c, g, or t
  misc_feature (44)..(45): n is a, c, g, or t
  misc_feature (47)..(47): n is a, c, g, or t
  misc_feature (52)..(53): n is a, c, g, or t
ggggccggcgaggaatggcggtatttgtnngagnantccntttnnanagggnnactcctagatatctccaacacaccagagtctagcattaactatggagacaccccaaagtcttgtactaagtcttctaaaagctccactccagttccttcaaagcagtcagcaaggtggcaagttgcaaaagagctttatcaaactgaaagtaattatgttaatatattggcaacaattattcagttatttcaagtaccattggaagaggaaggacaacgtggtggacctatccttgcaccagaggagattaagactatttttggtagcatcccagatatctttgatgtacacactaagataaaggatgatcttgaagaccttatagttaattgggatgagagcaaaagcattggtgacatttttctgaaatattcaaaagatttggtaaaaacctaccctccctttgtaaacttctttgaaatgagcaaggaaacaattattaaatgtgaaaaacagaaaccaagatttcatgcttttctcaagataaaccaagcaaaaccagaatgtggacggcagagccttgttgaacttcttatccgaccagtacagaggttacccagtgttgcattacttttaaatgatcttaagaagcatacagctgatgaaaatccagacaaaagcactttagaaaaagctattggatcactgaaggaagtaatgacgcatattaatgaggataagagaaaaacagaagctcaaaagcaaatttttgatgttgtttatgaagtagatggatgcccagctaatcttttatcttctcaccgaagcttagtacagcgggttgaaacaatttctctaggtgagcacccctgtgacagaggagaacaagtaactctcttcctcttcaatgattgcctagagatagcaagaaaacggcacaaggttattggcacttttaggagtcctcatggccaaacccgacccccagcttctcttaagcatattcacctaatgcctctttctcagattaagaaggtattggacataagagagacagaagattgccataatgcttttgccttgcttgtgaggccaccaacagagcaggcaaatgtgctactcagtttccagatgacatcagatgaacttccaaaagaaaactggctaaagatgctgtgtcgacatgtagctaacaccatttgtaaagcagatgctgagaatcttatttatactgctgatccagaatcctttgaagtaaatacaaaagatatggacagtacattgagtagagcatcaagagcaataaaaaagacttcaaaaaaggttacaagagcattctctttctccaaaactccaaaaagagctcttcgaagggctcttatgacatcccacggctcagtggagggaagaagtccttccagcaatgataagcatgtaatgagtcgtctttctagcacatcatcattagcaattacccattctgtttccacaagcaatgtaattggatttactaagcatgtttatgttcagcgcctaaactctactggtgggcgctctcagtactcctggtttcaatctgtacgtcattctgctttccgagctagtttttcagagatactagaaggaaatactgatttttcaaatttcaaaaaagttctttccaagtcatctttgacatttgtgaagaattaggagatttgccaaccactaatggaaacaagcctcatgaagtttaatggtatcccttctccctcccttgtcagccttccttccttctttgaaaggagaagtcatacgttaagtagatctacaactcatttgatatgaagcgttaccaaaatcttaaattatagaaatgtatagacacctcatactcaaataagaaactgacttaaatggtacttgtaattagcacttggtgaaagctggaaggaagataaataacactaaactatgctatttgatttttcttcttgaaagagtaaggtttacctgttacattttcaagttaattcatgtaaaaaatgatagtgattttgatgtaatttatctcttgtttgaatctgtcattcaaaggccaataatttaagttgctatcagctgatattagtagctttgcaaccctgatagagtaaataaattttatgggcgggtgccaaatactgctgtgaatctatttgtatagtatccatgaatgaatttatggaaatagatatttgtgcagctcaatttatgcagagattaaatgacatcataatactggatgaaaacttgcatagaattctgattaaatagtgggtctgtttcacatgtgcagtttgaagtatttaaataaccactcctttcacagtttattttcttctcaagcgttttcaagatctagcatgtggattttaaaagatttgccctcattaacaagaataacatttaaaggagattgtttcaaaatatttttgcaaattgagataaggacagaaagattgagaaacattgtatattttgcaaaaacaagatgtttgtagctgtttcagagagagtacggtatatttatggtaattttatccactagcaaatcttgatttagtttgatagtgtgtggaattttattttgaaggataagaccatgggaaaattgtggtaaagactgtttgtacccttcatgaaataattctgaagttgccatcagttttactaatcttctgtgaaatgcatagatatgcgcatgttcaactttttattgtggtcttataattaaatgtaaaattgaaaattcatttgctgtttcaaagtgtgatatctttcacaatagcctttttatagtcagtaattcagaataatcaagttcatatggataaatgcatttttatttcctatttctttagggagtgctacaaatgtttgtcacttaaatttcaagtttctgttttaatagttaactgactatagattgttttctatgccatgtatgtgccacttctgagagtagtaaatgactctttgctacattttaaaagcaattgtattagtaagaactttgtaaataaatacctaaaacccaagtgta

SEQ ID NO: 514382 - DNA, 444 bp, Homo sapiens
tcgacgcaccgtctgaagagatgtcctccacgccttctaccgctatcgctccagcacgatgcttatcgtgactgtagacgcccgttctgccacgccggcctgccgtggacagagattgggccgtcctgggcaaactggtccttagtcttatgcacttggccaatgaagttgatgaagtgctccccctagtttggcacaccctgttccggccagtctgtgaactggaactggcggacagtccgggactggacatcccgggcatctgtgaccttgaactctcgcaggatatactgaggcatagttgtattctgccatcggatctatcacaaagtactggtagcggggcagagcgctcggccggccagtactggtgacacttcttccgggccatactcccgcaggttggtacagcattaacacgatcgtcgaaatgttctcccccaa

SEQ ID NO: 514383 - DNA, 2736 bp, Homo sapiens
  misc_feature (29)..(30): n is a, c, g, or t
  misc_feature (34)..(34): n is a, c, g, or t
  misc_feature (36)..(36): n is a, c, g, or t
  misc_feature (40)..(40): n is a, c, g, or t
  misc_feature (44)..(45): n is a, c, g, or t
  misc_feature (47)..(47): n is a, c, g, or t
  misc_feature (52)..(53): n is a, c, g, or t
ggggccggcgaggaatggcggtatttgtnngagnantccntttnnanagggnnactcctagatatctccaacacaccagagtctagcattaactatggagacaccccaaagtcttgtactaagtcttctaaaagctccactccagttccttcaaagcagtcagcaaggtggcaagttgcaaaagagctttatcaaactgaaagtaattatgttaatatattggcaacaattattcagttatttcaagtaccattggaagaggaaggacaacgtggtggacctatccttgcaccagaggagattaagactatttttggtagcatcccagatatctttgatgtacacactaagataaaggatgatcttgaagaccttatagttaattgggatgagagcaaaagcattggtgacatttttctgaaatattcaaaagatttggtaaaaacctaccctccctttgtaaacttctttgaaatgagcaaggaaacaattattaaatgtgaaaaacagaaaccaagatttcatgcttttctcaagataaaccaagcaaaaccagaatgtggacggcagagccttgttgaacttcttatccgaccagtacagaggttacccagtgttgcattacttttaaatgatcttaagaagcatacagctgatgaaaatccagacaaaagcactttagaaaaagctattggatcactgaaggaagtaatgacgcatattaatgaggataagagaaaaacagaagctcaaaagcaaatttttgatgttgtttatgaagtagatggatgcccagctaatcttttatcttctcaccgaagcttagtacagcgggttgaaacaatttctctaggtgagcacccctgtgacagaggagaacaagtaactctcttcctcttcaatgattgcctagagatagcaagaaaacggcacaaggttattggcacttttaggagtcctcatggccaaacccgacccccagcttctcttaagcatattcacctaatgcctctttctcagattaagaaggtattggacataagagagacagaagattgccataatgcttttgccttgcttgtgaggccaccaacagagcaggcaaatgtgctactcagtttccagatgacatcagatgaacttccaaaagaaaactggctaaagatgctgtgtcgacatgtagctaacaccatttgtaaagcagatgctgagaatcttatttatactgctgatccagaatcctttgaagtaaatacaaaagatatggacagtacattgagtagagcatcaagagcaataaaaaagacttcaaaaaaggttacaagagcattctctttctccaaaactccaaaaagagctcttcgaagggctcttatgacatcccacggctcagtggagggaagaagtccttccagcaatgataagcatgtaatgagtcgtctttctagcacatcatcattagcaggtatcccttctccctcccttgtcagccttccttccttctttgaaaggagaagtcatacgttaagtagatctacaactcatttgatatgaagcgttaccaaaatcttaaattatagaaatgtatagacacctcatactcaaataagaaactgacttaaatggtacttgtaattagcacttggtgaaagctggaaggaagataaataacactaaactatgctatttgatttttcttcttgaaagagtaaggtttacctgttacattttcaagttaattcatgtaaaaaatgatagtgattttgatgtaatttatctcttgtttgaatctgtcattcaaaggccaataatttaagttgctatcagctgatattagtagctttgcaaccctgatagagtaaataaattttatgggcgggtgccaaatactgctgtgaatctatttgtatagtatccatgaatgaatttatggaaatagatatttgtgcagctcaatttatgcagagattaaatgacatcataatactggatgaaaacttgcatagaattctgattaaatagtgggtctgtttcacatgtgcagtttgaagtatttaaataaccactcctttcacagtttattttcttctcaagcgttttcaagatctagcatgtggattttaaaagatttgccctcattaacaagaataacatttaaaggagattgtttcaaaatatttttgcaaattgagataaggacagaaagattgagaaacattgtatattttgcaaaaacaagatgtttgtagctgtttcagagagagtacggtatatttatggtaattttatccactagcaaatcttgatttagtttgatagtgtgtggaattttattttgaaggataagaccatgggaaaattgtggtaaagactgtttgtacccttcatgaaataattctgaagttgccatcagttttactaatcttctgtgaaatgcatagatatgcgcatgttcaactttttattgtggtcttataattaaatgtaaaattgcagtaattcagaataatcaagttcatatggataaatgcatttttatttcctatttctttagggagtgctacaaatgtttgtcacttaaatttcaagtttctgttttaatagttaactgactatagattgttttctatgccatgtatgtgccacttctgagagtagtaaatgactctttgctacattttaaaagcaattgtattagtaagaactttgtaaataaatacctaaaacccaagtgta

SEQ ID NO: 514384 - DNA, 421 bp, Homo sapiens
  misc_feature (55)..(55): n is a, c, g, or t
atttctcttcacctggtatgatcttttacctgcatctctacttgtagacatcctnggtaccctccgtgcctctgtgaggcgcgggcctgattgcccttgaaggctccctggttctctgagataaactggctgaagcttttgactttgggatttagttggtgggtgagattgacatctcggtctggcttcatttcatagaaacgacacatattggctatttcctttgctgcagggaatcccagcttctcgaaagcttccggggtaatcaaggatagaggcagagccagaatttgcctccttcccgtactgcctctggtttgtcgtgtttattccagaattagccaggccagccttcttgatgcctcctctgtctatacatgggcatgttccctcaaggaccaactcaagcccacgtcttaca

SEQ ID NO: 514385 - DNA, 2807 bp, Homo sapiens
  misc_feature (29)..(30): n is a, c, g, or t
  misc_feature (34)..(34): n is a, c, g, or t
  misc_feature (36)..(36): n is a, c, g, or t
  misc_feature (40)..(40): n is a, c, g, or t
  misc_feature (44)..(45): n is a, c, g, or t
  misc_feature (47)..(47): n is a, c, g, or t
  misc_feature (52)..(53): n is a, c, g, or t
ggggccggcgaggaatggcggtatttgtnngagnantccntttnnanagggnnactcctagatatctccaacacaccagagtctagcattaactatggagacaccccaaagtcttgtactaagtcttctaaaagctccactccagttccttcaaagcagtcagcaaggtggcaagttgcaaaagagctttatcaaactgaaagtaattatgttaatatattggcaacaattattcagttatttcaagtaccattggaagaggaaggacaacgtggtggacctatccttgcaccagaggagattaagactatttttggtagcatcccagatatctttgatgtacacactaagataaaggatgatcttgaagaccttatagttaattgggatgagagcaaaagcattggtgacatttttctgaaatattcaaaagatttggtaaaaacctaccctccctttgtaaacttctttgaaatgagcaaggaaacaattattaaatgtgaaaaacagaaaccaagatttcatgcttttctcaagataaaccaagcaaaaccagaatgtggacggcagagccttgttgaacttcttatccgaccagtacagaggttacccagtgttgcattacttttaaatgatcttaagaagcatacagctgatgaaaatccagacaaaagcactttagaaaaagctattggatcactgaaggaagtaatgacgcatattaatgaggataagagaaaaacagaagctcaaaagcaaatttttgatgttgtttatgaagtagatggatgcccagctaatcttttatcttctcaccgaagcttagtacagcgggttgaaacaatttctctaggtgagcacccctgtgacagaggagaacaagtaactctcttcctcttcaatgattgcctagagatagcaagaaaacggcacaaggttattggcacttttaggagtcctcatggccaaacccgacccccagcttctcttaagcatattcacctaatgcctctttctcagattaagaaggtattggacataagagagacagaagattgccataatgcttttgccttgcttgtgaggccaccaacagagcaggcaaatgtgctactcagtttccagatgacatcagatgaacttccaaaagaaaactggctaaagatgctgtgtcgacatgtagctaacaccatttgtaaagcagatgctgagaatcttatttatactgctgatccagaatcctttgaagtaaatacaaaagatatggacagtacattgagtagagcatcaagagcaataaaaaagacttcaaaaaaggttacaagagcattctctttctccaaaactccaaaaagagctcttcgaagggctcttatgacatcccacggctcagtggagggaagaagtccttccagcaatgataagcatgtaaaagagtacgaataaatagcaaaatacaatcattagacaggatataccaaaataaacatacacattagatagactatcaccttaattctttgaaaggagaagtcatacgttaagtagatctacaactcatttgatatgaagcgttaccaaaatcttaaattatagaaatgtatagacacctcatactcaaataagaaactgacttaaatggtacttgtaattagcacttggtgaaagctggaaggaagataaataacactaaactatgctatttgatttttcttcttgaaagagtaaggtttacctgttacattttcaagttaattcatgtaaaaaatgatagtgattttgatgtaatttatctcttgtttgaatctgtcattcaaaggccaataatttaagttgctatcagctgatattagtagctttgcaaccctgatagagtaaataaattttatgggcgggtgccaaatactgctgtgaatctatttgtatagtatccatgaatgaatttatggaaatagatatttgtgcagctcaatttatgcagagattaaatgacatcataatactggatgaaaacttgcatagaattctgattaaatagtgggtctgtttcacatgtgcagtttgaagtatttaaataaccactcctttcacagtttattttcttctcaagcgttttcaagatctagcatgtggattttaaaagatttgccctcattaacaagaataacatttaaaggagattgtttcaaaatatttttgcaaattgagataaggacagaaagattgagaaacattgtatattttgcaaaaacaagatgtttgtagctgtttcagagagagtacggtatatttatggtaattttatccactagcaaatcttgatttagtttgatagtgtgtggaattttattttgaaggataagaccatgggaaaattgtggtaaagactgtttgtacccttcatgaaataattctgaagttgccatcagttttactaatcttctgtgaaatgcatagatatgcgcatgttcaactttttattgtggtcttataattaaatgtaaaattgaaaattcatttgctgtttcaaagtgtgatatctttcacaatagcctttttatagtcagtaattcagaataatcaagttcatatggataaatgcatttttatttcctatttctttagggagtgctacaaatgtttgtcacttaaatttcaagtttctgttttaatagttaactgactatagattgttttctatgccatgtatgtgccacttctgagagtagtaaatgactctttgctacattttaaaagcaattgtattagtaagaactttgtaaataaatacctaaaacccaagtgta

SEQ ID NO: 514386 - DNA, 206 bp, Homo sapiens
cctcttgggcggatgtgatctcatttctttggtgcttgtggtaaaacttgaagacataaacaagaaagctgatcgaaccattagcagaaagtatcacagacgttctcgtaagggacaaaacgggactggctagttaacacaaagaggctgggatgggctttgtggcagttcttcccatgtagacggaccctagaagtgtggcatca

SEQ ID NO: 514387 - DNA, 188 bp, Homo sapiens
tcttgaggatcccctcagcagctctgctcccgccgccgctcctgcagtgacttcagagcctctgtggggatggctcgtcagcaggagccgccccaccactgccatgcccctcacaggacacaatgtacccaccacccaagcgccaggctcctcttttggaggaagaaggtggggggagcggtggagca

SEQ ID NO: 514388 - DNA, 1415 bp, Homo sapiens
cgagacagatagaatcgagccggaccggaagaggctgccggcacgatgagcatggacggagtcgcgtcgcgagccatcatcgttagcaggtatcccttctccctcccttgtcagccttccttccttctttgaaaggagaagtcatacgttaagtagatctacaactcatttgatatgaagcgttaccaaaatcttaaattatagaaatgtatagacacctcatactcaaataagaaactgacttaaatggtacttgtaattagcacttggtgaaagctggaaggaagataaataacactaaactatgctatttgatttttcttcttgaaagagtaaggtttacctgttacattttcaagttaattcatgtaaaaaatgatagtgattttgatgtaatttatctcttgtttgaatctgtcattcaaaggccaataatttaagttgctatcagctgatattagtagctttgcaaccctgatagagtaaataaattttatgggcgggtgccaaatactgctgtgaatctatttgtatagtatccatgaatgaatttatggaaatagatatttgtgcagctcaatttatgcagagattaaatgacatcataatactggatgaaaacttgcatagaattctgattaaatagtgggtctgtttcacatgtgcagtttgaagtatttaaataaccactcctttcacagtttattttcttctcaagcgttttcaagatctagcatgtggattttaaaagatttgccctcattaacaagaataacatttaaaggagattgtttcaaaatatttttgcaaattgagataaggacagaaagattgagaaacattgtatattttgcaaaaacaagatgtttgtagctgtttcagagagagtacggtatatttatggtaattttatccactagcaaatcttgatttagtttgatagtgtgtggaattttattttgaaggataagaccatgggaaaattgtggtaaagactgtttgtacccttcatgaaataattctgaagttgccatcagttttactaatcttctgtgaaatgcatagatatgcgcatgttcaactttttattgtggtcttataattaaatgtaaaattgaaaattcatttgctgtttcaaagtgtgatatctttcacaatagcctttttatagtcagtaattcagaataatcaagttcatatggataaatgcatttttatttcctatttctttagggagtgctacaaatgtttgtcacttaaatttcaagtttctgttttaatagttaactgactatagattgttttctatgccatgtatgtgccacttctgagagtagtaaatgactctttgctacattttaaaagcaattgtattagtaagaactttgtaaataaatacctaaaacccaagtgta

SEQ ID NO: 514389 - DNA, 705 bp, Homo sapiens
catgcccttattcctaaggagtcttcataaagctctgatttgtgccacgcttgggggcttcacgtttctgcgtagcgcagggtaacaagagtggtgcggacttttaaaaccgtaaagagggtatcattaacagagtgcaccctgggacagagctcacaaggaacacggttcatttgggcacacagacacaagataggatcaagttctgtgctggtcccggtgagctgtgtctgagtacccttcagctggaattgctgcttaggtctgggacgtgtgtgtgactcttagaccattgctgtctgaaaatgagagagaagacttcggaagcacacttgtgttcataaagtactcccccaatggcccgtcccattgctatctatttcttgttatccacgaggcttaattaaatgatcgtggtaaaatcgatgtctgagcacttaagacacacagtcaattctttaattctgggtggaaagatataccggagttaaatttattctgtttaaaaaaatgacccaacagttatcaccccaaaccccctttcccaactcttgcacctgtttgttttggattgggtttgggggaaagaagatagtttttcttagttgtctactttgtttgaacacttttgttgtggttcaagtgctgttttgtgtgttggggcccaaccgttgtcaataactttaccagcgagcattttaaata

SEQ ID NO: 514390 - DNA, 1292 bp, Homo sapiens
  misc_feature (29)..(30): n is a, c, g, or t
  misc_feature (34)..(34): n is a, c, g, or t
  misc_feature (36)..(36): n is a, c, g, or t
  misc_feature (40)..(40): n is a, c, g, or t
  misc_feature (44)..(45): n is a, c, g, or t
  misc_feature (47)..(47): n is a, c, g, or t
  misc_feature (52)..(53): n is a, c, g, or t
  misc_feature (1067)..(1067): n is a, c, g, or t
ggggccggcgaggaatggcggtatttgtnngagnantccntttnnanagggnnactcctagatatctccaacacaccagagtctagcattaactatggagacaccccaaagtcttgtactaagtcttctaaaagctccactccagttccttcaaagcagtcagcaaggtggcaagttgcaaaagagctttatcaaactgaaagtaattatgttaatatattggcaacaattattcagttatttcaagtaccattggaagaggaaggacaacgtggtggacctatccttgcaccagaggagattaagactatttttggtagcatcccagatatctttgatgtacacactaagataaaggatgatcttgaagaccttatagttaattgggatgagagcaaaagcattggtgacatttttctgaaatattcaaaagatttggtaaaaacctaccctccctttgtaaacttctttgaaatgagcaaggaaacaattattaaatgtgaaaaacagaaaccaagatttcatgcttttctcaagataaaccaagcaaaaccagaatgtggacggcagagccttgttgaacttcttatccgaccagtacagaggttacccagtgttgcattacttttaaatgatcttaagaagcatacagctgatgaaaatccagacaaaagcactttagaaaaagctattggatcactgaaggaagtaatgacgcatattaatgaggataagagaaaaacagaagctcaaaagcaaatttttgatgttgtttatgaagtagatggatgcccagctaatcttttatcttctcaccgaagcttagtacagcgggttgaaacaatttctctaggtgagcacccctgtgacagaggagaacaagtaactctcttcctcttcaatgattgcctagagatagcaagaaaacggcacaaggttattggcacttttaggagtcctcatggccaaacccgacccccagcttctcttaagcatattcacctaatgcctctttctcagattaagaaggtattggacataagagagacagaaggtatgccggtcgnatacattcttggttatataaaaatagtttatatccattgtaggtttaatttactccattttggcttttttaaattggtaaattatctttaaatatagttggtcagactgctaaagtaattgttcttgcacctctatcccatctccatctctaggaacagaactgactttttgttttctcaaatgaaagtactatctcaacctataggataccctcatctgttaaa

SEQ ID NO: 514391 - DNA, 729 bp, Homo sapiens
tcatttcaattttaatacacatgtatttcctccttgcacaggattttgataggatgtaggcgaatatcctaagtggtagcctcccatagatagcagtgagttgatcatttgcagtctgcttttacatgcctatgcacgcgctaccttttatatctacaaccttgaaaactagaatctaactgttctagccccacatacagaaagtagtttctttgcatatgtatactaacttttgttactggtacccaatgttcatgaaagagctatgtcggtcgtattgtcataggggatctccattttcatcataagttaggaagtgtccctaaggtacttccacttcgacctcaacttcgttctaaatacaattctagtgatctatgctagttgtgctatcaaggaatctctatcatattttatatcgcttaccttcatcagacatgtcatagttcttcttacgttacatcatatctcttcacacgacatatgaaatacttggtcaacacacacaaggtcagaatctcgtctgtgatcttcacgctaagggcaattcttatgtactggcgttacgctgggttcattactcccgtaaagtgtattggcatcccctttgtgcatctgtctaaagaaaaccctaaacgtttccaattaaccggatagggttcccaaaaaagtctccataatttttttaccttggcgcctctccacaaagcaaatttggaaaagtcggtt

SEQ ID NO: 514392 - DNA, 166 bp, Homo sapiens
  misc_feature (43)..(43): n is a, c, g, or t
gctcggcccaagttacccgatgtttgaagaagactgcagttcnagagctttaaagtcagggaagaaaataagcagcaacccaaatcctgttgtccagatgtcagttgggcacaaggcccaggagagcaagattcgatacaaaaccaatgaacccgtggggtaggag

SEQ ID NO: 514393 - DNA, 325 bp, Homo sapiens
  misc_feature (11)..(11): n is a, c, g, or t
  misc_feature (72)..(72): n is a, c, g, or t
  misc_feature (124)..(124): n is a, c, g, or t
  misc_feature (136)..(136): n is a, c, g, or t
  misc_feature (138)..(138): n is a, c, g, or t
  misc_feature (141)..(141): n is a, c, g, or t
  misc_feature (263)..(263): n is a, c, g, or t
tgcctcagcanttttcttggcagcactgatgacatctgatgtatttttgagtggtcctttacctcgggtatngtctgtcatctccatcataatcaagcacaacagaaagaaaagctgcacaganggccttgtcacngncgncccatttgtacacttcttcatccagcttgctcttttcttcctggaagccccccacctgttccgctctcttcgctttttgctcctggggaagctgagccatgatcgcccgggctctctggccngctatcatctgatcgtcttctgtctggccgctcgccctgcttctgccctccccttcttctgt

SEQ ID NO: 514394 - DNA, 121 bp, Homo sapiens
aattttttaaaaaggttttcaatatggggattttctatttatgtaggtaatattgttccatttgcaaatattcagataatttatttaatatcctttaaataaaggcgactgggcattgtta

SEQ ID NO: 514395 - DNA, 531 bp, Homo sapiens
  misc_feature (296)..(296): n is a, c, g, or t
  misc_feature (395)..(395): n is a, c, g, or t
  misc_feature (526)..(526): n is a, c, g, or t
gtactattggctttgaatcaagcaagctcaaatctagtggaacagtcagtttaactttttaacagatcttatttttttattttgagtgccactaattaatgtaaaaaggggggggctctacagccagtcgtgatgaaatttaatatatattcttgtcctcgagattttagggaagggtgtagggtgagtaggccatttttaatttccgaagtgctaagtgtttctattacagcaaaacaaaaagtcaattttgctttccaccagtgcgagagaggatgtatacttttcaagagacngttcgggatgtcaggaagtgccggtctaatggattgatttatgcactgttatctgtttttgacacagatttccttgtaaaatgtgccctagtttaccanaattaacaaaggggggggaaaaggaccttagaacttttaagggtaaaatcaaatatagctacagcataagagaatcgagaaaatttgatagaagggtaaacttggttttaattgttaaaattcttaatcgnttgaa

SEQ ID NO: 514396 - DNA, 1758 bp, Homo sapiens
acttaagtctagatcgcgagcggccgcaccttttttttattttctttagctttctctcctagggaagtgcgtgcacagatcacctcagatgaaagatgcaatggacatgaagactgagcccccgtgaggccccaccaactatcttatcaggtccgtcgcacacgtaaaggcccgacaaagatcatcacattccaacggtggataatagatgaaaactcgcagcaccaagtaatactattcaaaaacgggctcgagccatacacgggagacataggatagcacaacgagaactgaagataagacacaactacgtcgcacacccagcagcgacacactgacactacaccgcaccagggcaagacccaaaccccaaaagataaacaacatgagccacacccctcccggacacaacctgaacctaggtacacagaccccaaaccgaggtactatacccccccttgaaaaagcgactcttccggcacaaatcaaaccaacaccaacacaaagtcgaatcgctctacacacgagctctggcacacgctagtcagtgtacaccaaacgcgggcacaaccgtcgcgcacttacattccacatctaggcacccacagccaaccatcataagcactaaagaccatagactgaagaccgcgcacaccgccactgccccagaacgatacacgagaaccaactgcaccgcaacgccacgcgcacgagcccatggctagacacaccctcctacaacagctcactaatacctatgcgcaaacaagcccgggaatccttgagcgcccccctgtaccacagggtcgcggatcacgcgcccacccggcgaattccccaacccaggcacaaacaccaacgagacatccaaacacaccatcagcccacagcccctgcgaactcgaaccagcacaatcgaccccgcaaccaccaaactgacacgcggaaaatgaaccaaggacaggaccaattgaacccggacatcagcacagccagctgactctagaccatcgaccctgcacctagccaccacgcacccgcccacgagacaataacacagcaacacacatagacacggcgaacacaccactgcccggcgccgagcgtgagccagcgagtagccaagcgccagcatccaacgggaagaccgcactaccttgccccaaggcgatccgccacagcatagctcgggctagcagccccacaaggacgcccacacaatgcaaagccacgccgggaccacaatcacaaacatacacacaaacaagcgcgccaaccacagtcacagccgcacgccacagcaccacgatgccaccaaacagaacgagcgcactaccaaacactcgacgtgctccaaaagacacacacccaggcaactacactaacactcatcacttccacaaaccaccacatccactatcgacacacacctcactagggagcgaacaacaccaacactaagccggacacctagccctcgggaagaccgcacacacatcctacccgcaccacacgccagtccgccacgcacccacccggaggacgaccgcaacaccgagacacaagcgacacacggacaactaaacatagagtacgagcccagctacgcaggcgcgatcacgacgcacagccaagacagtcgaagagacgaccctaacacgcaaacatcgagagaactccgccacctacaacacaccgaacaaccacgacggcacgcacagcgacatcacgacgaagtccaccaaggcgcaccgaact

SEQ ID NO: 514397 - DNA, 456 bp, Homo sapiens
  misc_feature (249)..(250): n is a, c, g, or t
  misc_feature (277)..(278): n is a, c, g, or t
  misc_feature (327)..(327): n is a, c, g, or t
  misc_feature (346)..(346): n is a, c, g, or t
  misc_feature (349)..(349): n is a, c, g, or t
  misc_feature (365)..(365): n is a, c, g, or t
  misc_feature (396)..(396): n is a, c, g, or t
gtcaagatgagggaatctcgctgggaagctgacaccctggacaaagagggactgtcggaatctgttcgtagctcttgcacccttcagtgaccctagaagaatgattggacagatgtgagccatctggagcagaggggcactaacccaggctgacgccaagaatgaagtggcccactgcagccctggcgagcaggcttctttcatgagacctttgttactcggtggttactgggtcctgtgcctgtccgnntgggggcatgcagccctctatcatttnnggctccgagaagagggcaaggggcccccgcagggtacttctgtgcttgncctcgccctgccagaaggnagntgtgcccctggcctgnccttcccgggaaccccttattccaactcagntcctctttggactggaatggggaatccacaaccctcagggaccaaccctccccacagtat

SEQ ID NO: 514398 - DNA, 360 bp, Homo sapiens
tgtcataaaatcctcctgtttgagctaaatgtggcctgctgaagtcttaaatgcccatatttttcaggctaaggccatggtggacatagctaactccactagaatcctagctgggggtgttggaaaaaacggtacagtgcccctctcagactccaggctcacgtccgtctcccctccccgcacattataatctactacttctctaatgctgctgcgtagtttgtcttaaagccccaagactggccagatgtgcacctgagtaaaggtcagccatttcatctgggggctctttcttgacttttaatgaattttcttctgtgaaaaaatgtatttttaataaaaaattttctgtggccagca

SEQ ID NO: 514399 - DNA, 149 bp, Homo sapiens
  misc_feature (60)..(60): n is a, c, g, or t
ctgctatgtcagcatctgtaggctggagtgtgtagaaactgtgtccagcctcatatgatnctctcataatcaaaatttcactcttaatatcatcacctccatggacacaagacagcctggctctgagttactctagagggaggagtcac

SEQ ID NO: 514400 - DNA, 1079 bp, Homo sapiens
atgacccagcagaatttcatgctgatgaagcagcggggcgtggggggcgaggtctacagccagccgccccacatgctctccccgcagggctcccatcatgggccccccgcgcccagcgagaacgctcatggtgtcccaaccaccttcggcagacgcagtgtgatccactggacagaccagatgggcgtaccatcgccggacaccttgtcggcatggccagacctgcaccttcataggaagctcgcctgccagaggcatggagccggagggcaatgatagcaaaatacgaataacactataaccaaagattcgttccccatcaactgatctggagactggacctggagatcgctgggagtggaggtgagaggcggagatgagagaggaggagctagatgatagagagagatggcatatatagatggaaagccagaatggtgctaggacagacatagaggggaagctggcacgaagtggaggctagggcggacttccgacaacacggaggagcgactacggagatgcgcaaagtagcacaggacacaacccaaagggaaacctggagcacaccatcaccagccaacagtacagaaaccacgcgaagagacgaccacaaacgtgcgcaagcaccagtcagtcaacaacgataagcgagacgccatacaaggagcgcacaaagaaagacaaatcaccccgtgagcacaaccccgaacacaaaaaaacgccacacccactgacacagcgcactaacacgagaactgcacgaaggggaaagaaacgcccctagggaaaattgggcagaacaaactccccggagggaagcgagaaacgaccagcaacgcggcagcaagcggaagacaagcggacacaacacgaccaccatccaccacgacacagagacacccaccgcaacacatagacaatgacgcaagcgaacaagccgacagcaacgaacgcgaacaccacgaggcacacatccagagcaaagcggaacaccgcaagtccccgaacagccaaagccttacaacacacaatgtggacaaaacacacgcacatacgacaccgcaggaacacccacg

SEQ ID NO: 514401 - DNA, 127 bp, Homo sapiens
agtacactgcctgtcactgatcagcatatactgacttgtagccattatgtgaacttgacttcttatgtgtgctctatgagtttgttgtaattgtcttcttgaaattgcgatttttcactgacagtaa

SEQ ID NO: 514402 - DNA, 315 bp, Homo sapiens
tcgagtcgtagaggatcccctgcgggtctcatatctgtctcatctgcctttatactggtgtaaaaaaggccgtacatagtgccatttacaacctgtaaacttacagctgcaaggctactatatcctttaatcacattatatatctgttcttcacaattctaagcctttgaaaagtagttagtaactggatatttcttcgaaacagatgtcctggatgatggccataagaataagtgaagaagtaggtcaaaatgtatggacagtttttccggcgaaattagtagctaatgtcttggctatatagtcgaggggtaa

SEQ ID NO: 514403 - DNA, 203 bp, Homo sapiens
atgcctgcctcccaaagtactggggattacggcatagcactgtgcccagccctgtagcattatgtctaacaacaaacaattagaaaaattaaacactgcctatttttttttttttttttttttttttttttttttttgggggggtttcctaaagggccccggggggggttgaaaggggggcgagggggcggttttaaaaaaac

SEQ ID NO: 514404 - DNA, 88 bp, Homo sapiens
cctgggggggggggggggggggggggcccccggggaaaccccccccaaattttttttttttccccaaaaaagggtttttcccccccca

SEQ ID NO: 514405 - DNA, 214 bp, Homo sapiens
tgtcagagctgacgtgaacgtttctcacttcttctctgtctctctcttttcctttactgtccttcccctcactcctcttccttcccttctctatcccccagctgtctgagtttaattctaattgtaatctattataattgttctgctgttagaattatatataaaatagagtcattctattctcatcattagtctaatggttacatataacggt

SEQ ID NO: 514406 - DNA, 877 bp, Homo sapiens
ccgcgtttggcgtcccatggattcgatgctcggcggtctacagccaaggcggcgtgggttcccttctccactttgcgtccctggcccccctgggacgggtgggggtcaaacctaatgcctctcccgaggcccgttgtcttctgggaccatgcgcggattagacatttcctggactcgagggcctggtcaccccaagagaggtccccaggctaccttgaggattagaaggaatgggcctccctaggggtcaccccatagtgccccggtatcgaggggggcccacaagacctctggcaggtcaaggggccctggccacagcccagatcttggagcttctgctccctgctgcggagtccccggagcgcttctgcgttgacccagttcccgtaagatactggctgatggggcacggaggtccagcgccttgggctcttctgggccctcctagaggcgcccttggagcttcgcagctctagacccccccctttgaattttacattaacttcaaatagtagttggatccttggcacgtctgtcccgtaaataggaaaccccttgcctcaatccaattttcctgatttcaccactcgccaatattttaccccaatgcccttgggagaagctgccatgcaaaggtggacaccattctgccagacttcaggggatatgactcgtcccgggcaccggtggtcagcaacgtgtccttctggactaaggcacacctcggggggacactccaatctggcgtacacaccgagatttcggcaccccctgggtggagtcgtccctcgtgggcgctttgggaaagcatggcaccctcagacccccccgtaccccagattttcggagccaataaaaggcctttgttattttttta

SEQ ID NO: 514407 - DNA, 323 bp, Homo sapiens
tgcaagatagctctaacctaccacatcacgacaggggtctcgaagagaacaggagtaagacatcctccaggatcttaggaaataacactccgaaactcctgctccatggactcatatgagatcgagcagggtgtatcttctccgaggtcaaagtgtgacacttcgatcgcggaacacagaccttatttcggacacatctagtgacttccgcaagctgatggttgccctggcaacagggtaaaaaagcagaggatggctctgtcattaattatgaactgattgaccaagatgctcgggatctctataacgctagagtgaagagg

SEQ ID NO: 514408 - DNA, 130 bp, Homo sapiens
ctctaggaaaacatggctgatatagcagaataccagcgtgcatagcaggagaacgtcgctatggaacctgcatctaccagggaagactctgggccttctgctgctgagcttgcagaaaaagaaacatgag

SEQ ID NO: 514409 - DNA, 206 bp, Homo sapiens
acccccaaccctgtgctctctgaaacatgtgctgtgtccactcatggttaaatggattaagggcggtgcaagatgtgctattctagcgtacagcagaaaggtggagggctcagtgaggtggctcacacctgaaattccaatgctttgggaagccaaggttctaggattacaggcgtgagccacccatgcctggatgatcctcacct

SEQ ID NO: 514410 - DNA, 406 bp, Homo sapiens
ctcaagggcagcagacagatctttgctgtctgctctctgcagcctcagaggagaacagtccacaccccacaaggcagtcctgcctgctctgggtctgctgcagccaagtacaatgctgggctggtgaagaaagaatgaaacttaattacaaccaatgtggtggctgcccatctatctgtctaattccctacaagagagacatcattcatttattctacaagagaggaggtatagagaatgcagctctttgcttttaaaccagttatttcacctctccaagacccatttttctcatcttgatcttgaaaccacctttgcaaaaattataactgaggaaattatgacagtgggagagattagacctaactactccatcttgctctgaccttaagtggtcctgtcatct

SEQ ID NO: 514411 - DNA, 785 bp, Homo sapiens
agcggagggtgtggcccggccgctcggactgagcaggactttccttatcgccagttgattgtgcaccgtactctgcctgtcgcttgtcattctatacaccatggtttcttctgatatccaggtgaagagaagctggtagaagcgctgcgctcagagccacggctgtttgacgctgatgtctcagactcctcggctgaagagatgaagtctgtggcgcatgatatttcgccccgttggcccgctccataaggagagcaagtgatcgttgcgcctggcagtgaatacctgtcagtgcaaggaacactgtagaacgcggtgcagagagcaggacgacgcaaggttcccgatgaagagctgaggggtcttgtaaccagcgagctggcatgcagaacaccgagcacgcacgcagacatacgaaggtgccttctaggagaggcaagtaggagaggagaagctgagtcacacttcatggtatagacattggcagaaagaggaagactgaccactagcagaatactggagatgcttagagtgaacatgatgaactctgacggaggtcagaagattggtgtgccagaagttggtgaacggcttggctgaggagtaaggagtaagctacgctcggaaggatatgtgcgagtaatgagacgtagagaagtccacagagtgacccctggctgaccgaagtaccgtgacacgcgtgacctgagttttgtgactggaggaagcctgaggaagtgttcttactcgttggttcttaaagtgttgggtcttttctaagtgta

SEQ ID NO: 514412 - DNA, 122 bp, Homo sapiens
aaccggcatcgatcactagaagatcaactctaatttctttatgactatgcggttcttggctcaagatgtacagtgagttatcccattgctgttcgtctttgtgtgaggatcctctagagtcg

SEQ ID NO: 514413 - DNA, 101 bp, Homo sapiens
  misc_feature (48)..(48): n is a, c, g, or t
  misc_feature (51)..(51): n is a, c, g, or t
atttcggcacaggggagtgagagaacgagtgagtgagtgagtgagttnctntgtggggggactcggcttgttgttgtcggtgacttccccctccccttcgc

SEQ ID NO: 514414 - DNA, 121 bp, Homo sapiens
tccatatgtgtgccacacacatagtataggcagaatagggtttcgttatgttgcccaggctggtcttaaactcctgatctcaagtgatcttcctgcctcagcctgggcacacattatggag

SEQ ID NO: 514415 - DNA, 406 bp, Homo sapiens
ggctaccgaaagctgtatagtggctgatatatacctttgcccttttacccacagctggtgtggctggtgatgcaggccaccaagtcctgagactgcactaaacaggaaggccctgtggcctggcccagtgaatccatttttgcctcctagtgcctctgggcctgtaatgggatgggctgctatgaaggtctctgagtatgccctgtgagactgtttaccccattgttgtagctgattaacattcagctcctgctgcgtatcagcaatcaccaggctgcacaccttaccaaaccttttacacgctgctcacctcttgaactgcttagctgcttatgaaactttcttctgtccacgatagccctaaattatgctctctcaagattcaaatgttccccatgatctccgg

SEQ ID NO: 514416 - DNA, 682 bp, Homo sapiens
  misc_feature (15)..(15): n is a, c, g, or t
  misc_feature (69)..(69): n is a, c, g, or t
  misc_feature (73)..(73): n is a, c, g, or t
  misc_feature (141)..(141): n is a, c, g, or t
  misc_feature (144)..(144): n is a, c, g, or t
  misc_feature (251)..(251): n is a, c, g, or t
  misc_feature (305)..(305): n is a, c, g, or t
  misc_feature (371)..(372): n is a, c, g, or t
  misc_feature (379)..(379): n is a, c, g, or t
  misc_feature (434)..(434): n is a, c, g, or t
  misc_feature (436)..(436): n is a, c, g, or t
  misc_feature (442)..(442): n is a, c, g, or t
  misc_feature (481)..(481): n is a, c, g, or t
  misc_feature (496)..(496): n is a, c, g, or t
  misc_feature (509)..(509): n is a, c, g, or t
  misc_feature (513)..(513): n is a, c, g, or t
  misc_feature (544)..(544): n is a, c, g, or t
  misc_feature (583)..(583): n is a, c, g, or t
  misc_feature (605)..(605): n is a, c, g, or t
  misc_feature (607)..(607): n is a, c, g, or t
  misc_feature (611)..(611): n is a, c, g, or t
  misc_feature (656)..(656): n is a, c, g, or t
gggcggccgcgcgtncctcccccgcctcccccgtcggtcgccccggcctacctcctctccttccccttntgcngggggcggcgccaagccattctctgtcacagagaggggctgcgggcccccaaaatggaactttattcngtnccagaccctgaccctcccatggccccagatgcgagagcctggggccccgcggtccatccccggtccttggggtggggcggggtagggcgctggccaggggccgtccngtctctggcttccggcctggggcctccgggggcggccgcggtggcctggccgcnccccatgctgggggcttggcttggtgccccccccccttcctggctgggcgctatggggggctctgnnggggatnaaatgggatgcgagcgaggtgcttggggagctgggcggccgccctattcctgctnangggtanaggaagaaggtgaaggcggctaggtgcccataagaaaangctggcacaatcttnattcccgccagtnttanttcagtctcaaaagaagagtatatggctganaaatggaaggatactccaggctccctacggagttgtgcnggggccatgctgagctgccctngnaggnagccctgggtgctgggggcagaaatgcaggacactgggaagagtnagaaccacaggtgggagggaatctca

SEQ ID NO: 514417 - DNA, 404 bp, Homo sapiens
aacaacacaggcgtgagccaccatgcctgacttctgcccgctttttaatgaagttatttgttttttgcttgttgatctgtttaagttccctattgattctggatattagacctttgttggattcatagtttgtgaatattttctctcattctgtagggtgtttactttgtttttttgtttgttttttgagacggagtcttgttctggtcgcccaggctagagtgcaatgatgtgatctcggcttgctgattcacctccacctcctgggttcaagtgattctcctgcctcagctacttgtgaggcggaggcaggagaattgcttgaacctgggaggtggagggtgctgtgagctgagattgttccactgcactccagcctgggtgacagagtgagactccatcag

SEQ ID NO: 514418 - DNA, 394 bp, Homo sapiens
  misc_feature (223)..(223): n is a, c, g, or t
  misc_feature (234)..(235): n is a, c, g, or t
  misc_feature (360)..(360): n is a, c, g, or t
  misc_feature (368)..(369): n is a, c, g, or t
tactttcacatggtacagatacatgatgatttctacatcatgattccttagcctcttggcgttgattctcatgatagacatatagctcatgagcgagaacacaaaaacaaacaaacaagaaaacaatgccattaagagcattgagaaattatacaaaggaaaaagaagaaaactaaacagcacaagcatcttctaggaaagaagaactggaggaggccagacnttattaccatnntggcactcacactcaatttccttgagaaaacctttatatgaagttacagtaccagtctcttcttagagtcttatcttagaagaaccagtagtttggggcagatttagaaagcctttagttgtaangcaaaagnncctgacttgagttaaattggtaagt

SEQ ID NO: 514419 - DNA, 107 bp, Homo sapiens
cgggtctacgataacaagctgtgctctccgaagataattctatccaggaccatgatcagcttttgagcaagggaggaaggtggacgcagcctgacggagacgcctga

SEQ ID NO: 514420 - DNA, 620 bp, Homo sapiens
ggagaacaagggcttcctgcggaatgtggtgtcgggcgagcactaccgctttgtgagcatgtggatggcgcggacgtcctacctggccgccttcgccatcatggtcatcttcacgctgagcgtgtccatgctgctgcggtactcacaccaccagatcttcgtcttcatcgcgcccctgctgaccgtcatcctggccctcgtcggtgaggacccgcactcggtcctcggccgtcgtgcgagaagctggcactcgtgtagaaagccgtggactcagctcgtagctgcatagtgtttgagggaatcatgtcggacttcttcaacgacaccaccatctgccttctacatcatcctcatcgtgtggctcgcggaccagtatgacgccatctgctgacacaccagcaacagcaagcggcattggctgcggttcttctactctctagcacttcgccttctatgcctatcactaccgcttcaatgggcagtatagcagcctaggactggtcacctcctggctcttcatccagcattccatgatctacttcttccaacactacgagctagctgccatcctgcagcaggtcagatccaggagatgctgcttcaggcgacgcactgggacc

SEQ ID NO: 514421 - DNA, 417 bp, Homo sapiens
ctaatgacctctgacttatcgggctaacttctgtctgatctaaggtatcagactcgacaattgacttgcccacttagacgtctcttgaccatccatagctatgtgactgacagaggcctctcgctgctgatgctgtgtgcctgaccatccttgtgattcaagggtctccattgacgagctgtaagtacaacgcactctgcttctatgtaacagcgattcgacgtgatgatgcccgcacatacgctgtcatggtagagcagatgtctagtagcccttcgagcccttcagtcgctactgctgcacaagctcgtgcgacgaaggcctgtgtgctgtccattgatgcactgatgattctgagccaataacgactgagacccatccgtgttcgccttgtgactgccccatgagcactgggct

SEQ ID NO: 514422 - DNA, 303 bp, Homo sapiens
cctgtgctccagatccagctctgcggctgctctgcatgcacttgcacttctgacagtggcatctctgtggcccaaacatgcccatgtgctggacctaccaccaaggggcatccccttggccacaactacccctgatagaaggaaaagagatcagcagcactgcagcaccttttactgccaaagaccccaatatatgcaaatcaatcaatgtgatataacacattaacaaaacgaaagaaaaaaacccagatcatcacaatagatgcagagaaagcatttgacaaagttcagcatccattcatg

SEQ ID NO: 514423 - DNA, 555 bp, Homo sapiens
cctccccgttgtgtatacgtaccatattttatttatccattcatctgctgatggacacttggattgcttccaaatcttggctattgcgagtagtgctacagtgaacatggtgcagatttatcttcaatatactgatttcctttctttggggtatatacctaccagtggaattgctggattgtatggtaactctatttttagtttttgaggtacctacaaactgttctccatagtggttgtactaatatacacttccacagtgcacgagggttcccttttctccacatcctcttcagcatttgttgttacctgtcttttggacagaagatattttaactggggtgagatgatatctcattgtagttttgatttgcatttctctaatggatcaatgatgttgagtacattttcatatgcctgtttgccatttgtatgtcttctttcgagaaatgcctattcagattttggtccagttttcggattaatttttttttctatagaatggttatagttactgatatagttatagttacagctcctgatatagctagtgat

SEQ ID NO: 514424 - DNA, 779 bp, Homo sapiens
agtttttactacttttatataaactttactttccagatgaagagctgagcctgattcaaatggtttttctgctttatacttctttttagttcatggtttttatagtagaggttttctatttttttttttttttttactacatttatatgtctggatacatatacgggcttgggagacaatcaaagtaacaactggaaatatggtggaaagtacaccattatttggacaaaattcccttgaatttttatccttggctggcgaacaatttaagactcaaagtcacgggtatatgggattaagtttttccggtgtaatggcaattatagaaatacactcgggagacacaacaaatggttggccattacaggtttcataaaattacactggactgggctggttactggatcttaggaaacagcacagtttaagatatcgtggaattctggacttatactttattaaaggctataaatctaaatagaaaaaaacaaaaatagaaaaacagcgggcgacaaacgaagcacgaaacaacgagcacaacaactctggtctgggcccgtggagccccaaaagaagcttccaaaaccattcgctgtggggggcgcggcggacccagaggtgagagagaccactggccacagacgttcccagggacctcgggtcagcaacggtctctgctccccaccataataaagcggcgggcacggctgtcgaaccaacccagaggtctggggctcaggctctcacaaggaccacgggacgaaatacagcgcgtgcgt

SEQ ID NO: 514425 - DNA, 720 bp, Homo sapiens
tcggcgtggatgagccgccagtgttctatcaatggtggctggtgtactccagcaatcttccagaacgtgaatgcatctgtccgcgctggtgtgcgaaacgcagcgctactccgccgtgctggatgcctgtgatctccagtcgcctggcctcctcatgtgcgaagaagctgcacgtcgcacctggcctaagggtgctagtgtatgagttgttgggaaggggcctttcgatggtgtgtgggggccaatggaaggctctgttgggacaggcaccagagctgatggtgttgagttggctcgtgcttcaaggttcttcggtagtgtgaggctggtcagtgagggacctgtctggagatgtggtgattccaggcgctgtgtcctagaccttcgccagcgtgcctcgtatttgtgcagtgtgaatcatctctctagaggaccgtgctccggctttatgtagttagtttcaaggagacaagggtttgtcgctatcagggtccgggcttccaatgcgtggattggatgtgcccctggactgcgaatctcgcgttcaccggaatagcctacttgtcctccttggggtttcaacggcggattcgtccttgcgtttcaggccctttcttgagcaggatgggggacttatgcaaggggggttgggcctgcccccttcccaaattctgtggggatatctggatcaggccttgaatgaactttaaaagcccctca

SEQ ID NO: 514426 - DNA, 316 bp, Homo sapiens
  misc_feature (314)..(314): n is a, c, g, or t
aagtggttgtggtaaccagtgaatcaggccgacctattgctcaagcctgccctgcccggcattgcgctgagacgatggcgtctgctgcaccgcgtcaaacaggctcacgccgccgagttgttccacgtcacccagtcgaccatttcccgctgggaaagtggtgtgcaggccatggagcctgcagcgcaccaacaccttgaacagttgctggccgcacgcctggaggccgccgccgatcaagtcctcgcccgactggtcaaggaaagcccgcggcccatgcacctggtccttattcactggtacagcaatccatntg

SEQ ID NO: 514427 - DNA, 402 bp, Homo sapiens
  misc_feature (285)..(285): n is a, c, g, or t
  misc_feature (361)..(361): n is a, c, g, or t
gacagctacctgatagagcagcgaggatcttatacaagcgcgtcgcgtaacactcttagcactggagctaccagcagcagctacatctggaatcccaactctgggaaaataaggagggaggattgcttgaggccaggagttcaagaccagcctggggaacatagtgagatctcatcactccaaaaaattaaaaagcttagctaaggccgggcgcggtggtgagctcctgtagtcccacttactcgggaggctgaggcaggagaattgcttgaacccagtaggtgngaggtgcagtgagccaagatcatgtcactgcactccagcctggttgacagagcaagactctgtctcaagaagaaanaaaaaaagaataaaattaaaatctgtggtcagaaggttaca

SEQ ID NO: 514428 - DNA, 182 bp, Homo sapiens
ctgatatcgagctcggtccggaatttcctttcactaaccctgcagtggaaggcaccattgacaacggttcaaaaatcaccaacttcttagagggacaagtggcgttcagccacccgagtgtcctttcccccctaagctggcacataggagcaaaagttcactaaccctgcagtgaaaggaag

SEQ ID NO: 514429 - DNA, 1154 bp, Homo sapiens
  misc_feature (458)..(458): n is a, c, g, or t
agcggctcttttccgtggcgcctcggaggcgttcagcgtgcttcaaccatgaacgcatgaacatctccttcccagccactggctgccagaatactcattgacacgtggtacgattgcaacgcggaggaacttctgtactttcgtataatcaagcgctatggccacgagaagtctgctgctgacgctctgggtagacgaactgcgacaagggcttatgtcgcgtccgaaatcagtggctgtggccaacgagcgaaaacaagtgttatccccatgtaacgcatggatgctcgttgagccaatggccagtgtcccgtccgtgcccactcgatgtcaagggagtgctagttccctcttgttacacgcaccgagacggtacgagactggggagcaacggggaccacggatcagagaactcaatctctgctggatctcgcaattcgatggactgcagatactcntcgatgccgttcgtcaacctttggttactcgtgggccacaagggagaagaacggaatattcgcgtaggaaccgtgaccttgattgcatatcaggttgccttcgaccggtcgcgttgaagccacacgagacaatcaagcataaggcctgatagtcctggtagatccctttttgtcattttcctcgtctaaacgcaacggactgattgttccggcgcagctactggtgtgtccaggaaggagcgccgttcccgcgtaatccgacaggcgtcaagaaaatccctgaggggaagcaaattaaggcacgacccatggcggatgtcccactgctggtaactttcgctttaccgcccatcgctgtgtccccttgccaaggccacagagaatcgggcaccgggcccgtcttatttgtcttcgtggaaaccgcacatgacagagcggttcaccccacacgtacatcaagagttaccaggcacaacgcagggtggcgtgtcgcggtaacaataattggctgtactagacatattctgggagccataagcgaaggacagttgacacgggaggggcctaaatgggtgatgaaacgcctcctggagatgtacacggaaaccttgtcggaaaggcaagaacggcaacgcaccttatctcctctcgtgggcaagctctaactacagtactgtaatgttctgtacctcccag

SEQ ID NO: 514430 - DNA, 906 bp, Homo sapiens
  misc_feature (351)..(351): n is a, c, g, or t
tatggtggcaagtgcctgtaatatcagctacatgggaggctgaagcacgagaatcacttgaatcagggaggcagaggttgcagcgagccaagatcgtgccactgtactctagcctaggtgacggaggtgagcctccgtctcaaaaaaaaacagggaaacggcacacgaagtataggggacatgggaataaggttaaaaatcaaagggactcacctcatgtgtttctaacatcttttacttctgtgacctttggaaacttccaaaaatagtagtagtataatctatggtcacaatcatactataccagttagaaaaaccttaaagtgaggcctaaaaagatcttgggtgaantcatcctagaattattgtgtataacagtattttcccatgagggaagactttggattccaggcattacaccacgcgcagaaaaaattctccaggcatcacaggagcagggagataactttggactctggttccccgtgttccagcgcagggacagagcacggggacgaaacatttttgtgtcccatgggaaacaatgtactcagtggcccttaaagggacgatttccatcccgaattccaatccaatttccctgtttcacttgccacaaattttcaaaatgatacaggcacccataaaattgtggcgccacactaacagggagaggtcctcaagggagaaatgtgggccttaaggttttacgtggtacaccaaggccttcaaaggctggggggtctcacaacggcgcctcctggagaccgagacacaccttctgtcaaacccggttccggagcatctgtggtgtggtcaaccgcaaagcgtggtgtgccacatttctcaaatgttaatgtggtcgcagggggcacccgtatcacagttgtggagcggaggggaccc

SEQ ID NO: 514431 - DNA, 103 bp, Homo sapiens
caggatggtaaggaacctaaggcctacccagaagcagaagccactatgcttcctgtacagcctgcagaactgtgagccaattaaacctcattgctgtacaaat

SEQ ID NO: 514432 - DNA, 271 bp, Homo sapiens
acccttcctcacgctcagtgaacggtcgggcgtaagtcttcgccgatcgcagagctgctgcaaataggtgacatcagttgtcccaacccgtgaatacctacgggcagtgacagtcattattccctgatggctgcaaggagggtgacataatccttcgcattgtatctttgatttcgcactactcgagcgtactagaatacgtataagtacaagagagacccagcaccgaaccccttcctctaacctctacggtctctaccaaacataggta

SEQ ID NO: 514433 - DNA, 135 bp, Homo sapiens
tatagaggatcccccgccgtactgactatattccagccacttcagggttgactgtgatgaccgttatagagaagggctcgaccggcagaagaaactggggtgtgtttattctcattcaacaaacccaaataaaaa

SEQ ID NO: 514434 - DNA, 212 bp, Homo sapiens
tacgttggagttttcttcttgttgcccgggccggaatgcaatggcgccatctcagctgaccgcaacctctgcctcccaggttcatgtaattcccctgcctcagccttcgcaggcatgcaccattacgccctgctaattttgtatttttagcagaaacttgggttctccattttggttaggctggtcttgaactcccaacctcaagagatctg

SEQ ID NO: 514435 - DNA, 355 bp, Homo sapiens
agtatagccgtggtgctggagtttaagttgagtagtacgaatgcagtaatagttaggataatatacacatagttaaattaagaatggcttatgcttagcggttgtacggtacaactgctattattcatcctatgtgggtaattcaggagtatgctaacattttgcgtacctgggtttggtttactccacctcaactgcctgctatgatggatcggattgacgcacgagtgatgacatggcttacgtttcgtgagggatagattctggtatactaatggagatgggggctagctttttgtcatgtgagaacaagcacggccggatgtcagaggggtgccttgggtgaccgctgcga

SEQ ID NO: 514436 - DNA, 358 bp, Homo sapiens
gctagttgttcttagtagtgtccccctgggagcgtttctcgcaggctatggacattcctggcccccagatcgcgatttccccgcagactttttctcgacagggatgcaacagatgctgttgattctgatgaaggcgctgtcgtttaagaaggtctctcttctgaggtgcctgtgctgggggcataaccgcactcattgctgctgcaaaatatccatcttacatccacaagatggtgatctggggcgccaacgcctacgtcactgacgaagacagcatgatatatgagggcatccgagatgtttccaaatggagtgagagaacaagaaagcctctagaagccctctatgggtatgacta

SEQ ID NO: 514437 - DNA, 670 bp, Homo sapiens
  misc_feature (42)..(42): n is a, c, g, or t
  misc_feature (643)..(644): n is a, c, g, or t
tttctctctgaggtcaggggggggggaacaaactcacctatnccccacagcgctcgcttctgaatcccggcaccctattggctcctgagcggcaccaggctaattgtactaagttttgtggaactgttctaaaatctggcgtgcgatcttcactttccggggtttcatactttttggggggggggggtgccctacccaccggcccactcctagaagaacaaaacgcaaatcttttccacatctgagccggcttttcacgtactttataacttcataaacataagcgatcctcaccactaggccaatactacactcacgggccggggagccgactcactattcctctgctttattttcagatcctgcccttgtagcaaaaggaaaaggtcacaccacccataatctaaccttttccctcactcacttttgaggataatcgccatggcgcccacatatctcatcccccccctcttcgggcccccgggtccctgtacgtaaatatgtactcaacatacctcttgggtggtcctccgtcgtcccgctttttttttggctttggtcctttcttcgagatcacctttttctcctctgtccctccttgcccacacctcgtctctggttttttcctttctgtctcccgccnncaccacccacaacgtaataaagacaa

SEQ ID NO: 514438 - DNA, 1097 bp, Homo sapiens
gcaggctggtaccgcccggagttagggatacgagcaagacgaagccactccgataaggttggctgcccggtgggtctctgtgagagatccgagtgtagatgtgtgaacgtgacccggcaagctgagtggcaggcctaggcccccagacgcatcagaccctgaaggactgcgtggtgggagccctgcacctgttcctggcccctgtggccccctggatccgtctggggcgcctccacccagctgttagcatgatgtcttacctcaaacaaccccatacgtgcatgaacgtggctgtggcctggactgggcccgccatggacctcctgcacccatccgtgggctatccgggtgagcaccagaacctcccgacaccttgcctcagactctcaaactgttggaggacccaccagacatgtaggatttgagtgcaagctattgttgctgagacaagcccagggagccggactgagaacacagggcccaatgtcatgtttaccaactacatgggaccacacaatgccagtgacgccattggaggcaagaggtacgtgaggcgatgtgaggtgggccaatgggcttgaggaaaaacgacggcaagtatgaggcacattccacggggacacggaatcaaccgagaaaacactaaaactcacgggatatgttggtacgcccaagacaggaaacagtgtgaccaagaagccatcaagtattacgctttgcctgtgatttccgcataacccacaagggtggaggtaataggtacttcggtgcctataagtaccgcccgagccaatgggaaagtgtcgagtaagttcttggtgacaactaccgactaagagacccatgaacggaaacaaaaggccaagaacttatacccataatttaccgaagaacgaggacagagactagaatataaaagggaaaatacaatacaatagatacaaaaaataggatctactaaaaatagaatgataagtaaaaactatattaaggcaataggaaagacatatgaacgaagtaggaaaagaaaaaaaaagaatgatataaataaaattaagagaccagaaacgaaataaaagtagagataataaaaaaat

SEQ ID NO: 514439 - DNA, 846 bp, Homo sapiens
  misc_feature (82)..(82): n is a, c, g, or t
gcgacaaatagcggatagtgcagagtacctggatgcgttgataggtactgatggacccatctcctgagcgcacgtccctggncgcgtgcatcgttggcataacacgaggtactgctgggccgagaagggtggtggtctgtacgcatgtgacaggcatccaactgatttcagtggctcaactattctactagaacacgaagcttgaagtacctggcgtttccttccgctaggcggatgaacaccaagctcttctcctgaggcctcttaccagttccgggccccacaagcccgtgatcttcatggacggactcgtgctgaggtatgtcttgcaccctacaaaaatcaagtcgagggcaatgctcgctctggaccgtctcaaggtgtatggacggacgatcccatccgttccttagcgaccaagacatagaaggcggattggtggttcctgcttgccctcaaggtcgtggcgtctgaagcctacaagacaagtatgcctattctgggtgcgacctggcatcacgaagtctggctggagacgtagccaggcagtgacatgccacacctggactgagaagaggaatagaagacacgccaaagtatccaagtagccgagaagggaacgacacaccagcgtcagtgaaggcgtaacggagaaacgggtccgatcacagtaacggttcggagcccgacaaattgaccaaagtaccacacgagacggtccgtcgaagaacccgaaggatgtccgtggatcgtgaggcacgaataaacgagctggtaagtaccctcccttgccgttgtgcttggcctttacctcggatggtttgaccttggaaatgttcggggaac

SEQ ID NO: 514440 - DNA, 337 bp, Homo sapiens
cttaattagatttagttttttgaaacatcttatgtaatgttctttttcagtctaattttgtttaagccaaaatatggacagcaatcaaaaataaatactgttgagcattttctatatggagataatgatgctaggtcaatgggggatgtaaagataaggcttagttcctgcacctaaaattcttctacacagtgatataagatacatataccactctgatgcaaaataccatattttaaaatattttaaaagcagaataaaatgctgtgtgttcaaaaaaaagtggtagttgaacaaactaaagaaagctttatgaagtagtaacatcaaagtgggc

SEQ ID NO: 514441 - DNA, 463 bp, Homo sapiens
  misc_feature (17)..(17): n is a, c, g, or t
  misc_feature (26)..(26): n is a, c, g, or t
  misc_feature (65)..(65): n is a, c, g, or t
  misc_feature (172)..(172): n is a, c, g, or t
  misc_feature (203)..(203): n is a, c, g, or t
  misc_feature (268)..(268): n is a, c, g, or t
  misc_feature (289)..(289): n is a, c, g, or t
  misc_feature (298)..(298): n is a, c, g, or t
  misc_feature (340)..(340): n is a, c, g, or t
  misc_feature (415)..(415): n is a, c, g, or t
  misc_feature (436)..(436): n is a, c, g, or t
  misc_feature (455)..(455): n is a, c, g, or t
ggtttctccatattggncaggctggnctcgaacttccaaagctcaggtgatccgcctgccttggnctcccaaaagtgctgggattacaggcgtgacacctgctcccggccatgcttatatctttaatccaaccatatactatttttgtgaatgatgggaagtaaggctcccnctcaagttaatttttctccaatctgggcttncaggaaaagggggtttctgggggagatttttacccgagcaaacgtagggaaaacggctgcctggntacctaccccttttttgacanccacacgtncttcggcaactttacatacactgcgtgattttatcctaaagncactttttaaaatcttagtgtgtaaacagagaaactggggcgttcacataaggcaagtgacctgtcacagcctgnttcggaggaacccggtaacgnttcccagagacaagcactngaacataa

SEQ ID NO: 514442 - DNA, 851 bp, Homo sapiens
cagcgattgtgtatcttacagcgttttccggcctcaagactgatcagcgcttgctagaagtgaacagctccagagagaggccacaggagactgaagatccggaccatctgctgggctaggggtgtcacttcctagaagggggaagggaaactcttgggtctcacggagtccactcagtgggcccactgtgccgtctcccctcaggtgtcccttcatgacagtgactcctctctctcaagcgctgcctgtttcttccccctcctctaagctactcttccttgagccctcctggactgcttcctctcgctcatccgtcagatgcaatctgtgggccgcccctctccctggccgctaagcagcctccattgatttccgctcgtgtttataggatttccacttagcagtgatcagtagttaagcacaggaaaatcccttgccaccccccctctccttgcgtcgatgccattgattctgaccagcggctcctaaaccgcattacaagctgagctagaaagatgaggagacggcatgtcacggagatttcacctgccttcgggatgtaggtggaaaacatgaacgaaagagtgtgtaggaaatgggttgggaaatcgcagctagaactctagaaattcttatcggactttagccactgtgcccagctcaggctcagagagtagagtgacctcgctgtggaagtttaggcgcaaatttgttccctagacctaggagaggagttaagaaagaaccaacagctgccccctacccacgcccaccgtgattgagacagcttctcaaggctcaaggggaagatgcagacctcatattaaccaccgctggtcccatgctgctac

SEQ ID NO: 514443 - DNA, 937 bp, Homo sapiens
  misc_feature (937)..(937): n is a, c, g, or t
gttcccagatgccacaccgttgacataaggtggatgcaatcacaatgattgggccatagatctccatggttactctgttggagcgcggtaatgactagggtctaggcccctggtatacgtcttacaacagtccgaccaatatagaacacaaaggcagtcagtctggggaagcaggataccactgaatgggagttatttggacgaatccctgagaagctacatccctgggaacaagaagagtgagtctttgtcggcgattaagaagaaggaagtaaagggcagacttaagtagcttatctcgaggaaaagctactaatgagtaataattgtgccactgcctttatttatttaaccagaaaagcaggaaaattgtctcgattgaacttgttttctacttgtgtaccactcactctttacttgaggatttctcagtagcatcccagcacattgtcatgcaatcattgacacttgagctggactaggaaatattctatggtatggcgcggcgacgttccctagaagtctctcagaaaatcgtaatagaactttgagtcttttgtagggttattaagaatggagagtgattgtttccagatttctttgcaaattgctgtacagtcagcttacaactcccatacacttgcgagcttacaaatgggtaatccactggcttttcactcgccgtttttttccccaacgaattattgcattgagaacctctcggtctgaggtaaatgattcgaactctgttccacgaacaggatggtgaagctgcccatcttttaagacactttcacttggcaaggaattggggcttgttaatgatcttgaagaattttgatgatccaaacatggcttttaatcgtccgaatgattcttttaaacctactggggggaaacattgcctctcgacttgatctttaggaaaccgaaagcn

SEQ ID NO: 514444 - DNA, 919 bp, Homo sapiens
  misc_feature (247)..(247): n is a, c, g, or t
  misc_feature (889)..(889): n is a, c, g, or t
acctgatgtgttctctccgactgatgagagattgcctaggtgcatatacccgtcacagagaacaagttgcattagtgtcgaagtgatttacacaacataactccatatagagcacaccgcgagcagttagatacggccacgcatgagcgtgtgcgaatctgagaagactgcatttcgcctgcggcggacgcaaattatatacagctccatgtcccgcacgacaagtatccgcgatgagcacccctanggcctacttgctactcaatctaaccaatcatactctctgcacgggcgctcaccacggtgtcaccatcatcaatcactactgcgtcggggcatatgtaatgtatactctcgcactgacacctgagtaacacccacatcctgctctaacatacgcagagtcccacatgcctaaggggccctactataagtctgagtacctccaaccagatgcttgtgaggggttacaacgtccaagtccacataccttccatgggactcacccgtggcaaaaacttatagccttgctagtacaacctggccctggagttgggaagcccccagtggaggccgcaatcgatggagcacctagagtactcctatcactggaaatggtggggcctaacgctgatccccatttggagttctactgacatgacatcgaaagaatagagtctctgtctcaacgctcccaactcatcctttttgaaatctactgcccgttaccaaggttgtaaccccagtactacgtggacttactatccaacttatgcacctaggcttgtgaggcagaacacgcacgccttcttcgcaacccgaaagcgtgatcatctgtcaggcaaccgagcgtgcgtagtacccgaaaccttggcaaatatgcccgggntaaccggcaagattgcacgatgagcaactg

SEQ ID NO: 514445 - DNA, 432 bp, Homo sapiens
  misc_feature (281)..(281): n is a, c, g, or t
tgggggacctcccttgggagatcaatcccctgtactcctgttctttgctccgtgagaaagatccacctacgacctcaggtcctcagaccgaccagcccaaggaacatctcaccaattttaaatccggagcttgctacacttgctggaaatctggccactgggcaaggaatgcccgcagcccgggattcctcctaagccgcgtcccgtctgtgtgggaccccactgaaaatcggactgttcaactcacctggcagccactcccagagcccctggaactctgnccaaggctctctgactgactccttcccagatcttctcggcttagcggctgaagactcacactgcctgattgcctcggaagccccctagaccatcacgcacgccgagcttcgggtaactctcacagtggaagaaggcaggaatgtcaggcca

SEQ ID NO: 514446 - DNA, 187 bp, Homo sapiens
  misc_feature (182)..(182): n is a, c, g, or t
ctgcttaaaatttgggggaaaatttaaaaaaataattgccaggattattggaaatttgttataatgaatgaaaccttttgtcaaaaaagattcatatttccttcttaaacatttgaaaaagtaaggcatggttgtggttaatctggtttatttttgttccccaagttaaataaatcataaancttga

SEQ ID NO: 514447 - DNA, 399 bp, Homo sapiens
atcccctcgcagcagacacagcaacaacaacggagattccgtctcaggatgatgtatttgtgtgtgaaggaactttcagtgaccattattttaaagaatgtcctttggatctgtgctacattccgtgcgtcagactccatcttcttccctacggcattgagattgtaccgaatgaatgaattagacggaaggtccaggttacctgctggcactcttgtccacttgggtcttttgtcactgaatctgtttccatggaagttctgcctcgcattgctatttgggtaccgatttttctcctggacacagttatcaggtattactgagcttctccctactcgagtgtcctttggttaccgttgctctgcagtatagccaggtggttttgaaattgggagggct

SEQ ID NO: 514448 - DNA, 935 bp, Homo sapiens
  misc_feature (86)..(86): n is a, c, g, or t
  misc_feature (116)..(116): n is a, c, g, or t
  misc_feature (168)..(168): n is a, c, g, or t
  misc_feature (198)..(198): n is a, c, g, or t
  misc_feature (214)..(214): n is a, c, g, or t
  misc_feature (248)..(248): n is a, c, g, or t
  misc_feature (269)..(269): n is a, c, g, or t
  misc_feature (288)..(288): n is a, c, g, or t
  misc_feature (324)..(324): n is a, c, g, or t
  misc_feature (327)..(327): n is a, c, g, or t
  misc_feature (367)..(367): n is a, c, g, or t
  misc_feature (382)..(382): n is a, c, g, or t
  misc_feature (398)..(398): n is a, c, g, or t
  misc_feature (404)..(404): n is a, c, g, or t
  misc_feature (413)..(413): n is a, c, g, or t
  misc_feature (455)..(455): n is a, c, g, or t
  misc_feature (501)..(501): n is a, c, g, or t
  misc_feature (547)..(547): n is a, c, g, or t
  misc_feature (556)..(556): n is a, c, g, or t
  misc_feature (638)..(638): n is a, c, g, or t
  misc_feature (647)..(648): n is a, c, g, or t
  misc_feature (651)..(651): n is a, c, g, or t
  misc_feature (665)..(666): n is a, c, g, or t
  misc_feature (668)..(669): n is a, c, g, or t
  misc_feature (671)..(672): n is a, c, g, or t
  misc_feature (674)..(675): n is a, c, g, or t
  misc_feature (677)..(678): n is a, c, g, or t
  misc_feature (680)..(680): n is a, c, g, or t
  misc_feature (800)..(800): n is a, c, g, or t
  misc_feature (852)..(852): n is a, c, g, or t
  misc_feature (902)..(902): n is a, c, g, or t
ctctttagcgctcagggcgctagaacccactgctcttcctcttaagaaagtgctccattccttccggcgcccgagagctgctggcncaaagggatccggagcgagctagggcaganaccatgaacaccctatgatgataagttgctgggggagaaactgaagtactantatagcagcagtgaggatgaggacagtgancacgaggacaaggacngaggcagatgtgccccagccagcagttctgtgcntgcagaggctgaagactaggnaggcgaaggaatctcagtnaacacaggcccaaaaggtgtgatcaatgactggcgncgnttcaagcagttggagacagagcagagggaggagcagtgcngggagatggaaaggntgatcaagaagctgtnaatganttgcaggtnccatctgagatgaagaggaggagcaacagaaacagaaagacntccaggagaagatcagtgggaagatagactctagaaggagtttgcnataatgaatgaggaccaagatgatgaagagtttctgcagcagtacnggaagcagngaatggaagagatgcggcagcagcttcacaaggggccccaattcaagcaggtttttgagatctccagtggagaagggttttnaaaaaaaannaanaaagaacagaaaannannannannanngntcatatttatgaggatggcattccagggaccgaagccatgaatggttgcatgatctgccttgccgcagagtacccagctgtcaagttctgcaaggtgaagagctcagttattggcgccanaggtcagttcaccaggaatgcccttcctgccctgctgatctataaggggggngattgatcggcaattttgttcgtgtactgacagctgggggatgattcttnctgtggacttgaagctttctcaggaatttggat

SEQ ID NO: 514449 - DNA, 159 bp, Homo sapiens
cctatctccaatctgtcataggagatatatctttgatcttttatgataagggtagaatatagattaagatcatcacaatccaatttcacatgtggcactaggacaaatggaatgctatacaaattaatcccctatcacccgtggttacgggatgcgtgt

SEQ ID NO: 514450 - DNA, 356 bp, Homo sapiens
taccgagggttgcttcacgatcgaaagtatccacagcaccgacatgaatttgctgtggtgccccaggactctacctcactgcacagtgtggaaaccacagctttcagttgtctatctttttttaaaattatttttattttttgagatggagtcttgctctgtcaaccaggctggagtgcagtggcgcgatctccacctgctgggttcaagcaattcttgtgcctcagccttccaagtagctggggttacaggagcccaccgcaacgcctggttaatttttgtatttttagtagagactgggttttgccctgtcggccaggctagtctcgaactcctgtcctcaagtgatccaccca

SEQ ID NO: 514451 - DNA, 249 bp, Homo sapiens
aattccattccagcgtagtggtggcttccaatagttttttcttcatgggccctaacccatggtcacagacaagggaatggaactgtgaagaggaaggaaacacacacagtgggtcagcatgcccattaccttgaatggcttccatatggtcttagagccatcctgggctctgaaagcaaaaactggtaatggaacattctgtgctgtgacatatgcacagagacacacacatacgcgggaatggaatgg

SEQ ID NO: 514452 - DNA, 694 bp, Homo sapiens
agatcgagctggtaccagattcaaacagtgctctcccgccggcgttaggattctctctcatctacctgtgtcggtttgcggtacgggtacatataacacaatagcggcttttcttgacggctccctaaccgacttccctactaattttcggtacgcttaacgttttccccttgtatggtgggttttcctcccatacaggtacttcgcttgccccggtttttgtcctcccgggttcggtttcagtctccgtgtccccacagttctgattatatgtagtacaggaatctgtacctgttatccatcgactacgtctttcgaccttgccttaggccccgacttaccctgagtagatcagctttactcaggaaaccttagatattcggccaagaggattctcacctctttctcgctactcattccggcattctctcttcttattactccaccattccttccggtatggcttctacgcctctaagaatgctcctctaccaatgtatataatacattcctaggcttcggtgttgtgtttagccccggacattttcggcgcaggacctctcgactagtgagctgttacgcactcttttaatgtatggctgcttctaagacaacctcctagctgtcttcgaaatcccacatccttttccacttaacacacactttggggccttagccgtaattctccgggacg

SEQ ID NO: 514453 - DNA, 144 bp, Homo sapiens
gggcaaaagtgtatattttgttaacaccaattccaggctcagtattgtgcccggggacccccaggggcccccccgcccattccgttcccttacccaagggcttgtgacgcggaaaaaaccgattaaacccgtttgagaacctca

SEQ ID NO: 514454 - DNA, 852 bp, Homo sapiens
  misc_feature (207)..(207): n is a, c, g, or t
tataaaatttttagtttaaaaggggaaataggttaggagttagcggtggtaagggcgatgagctgtggggaggcaagtgggggtgggtttgggtatgtctcaacacgtggtccatttctattattaacgctgtgtaagaatatggggcagtaggtgtgcattgagggtggcgtcggattaggcgttaggctagcaaagttagagagngttaagggagggttgaagagggtgggctatgaagtgggtaggggaattgaatgagagggcataatgtgggttctaagggtgaaaattcttcgggacaatacagtgggtcccaatatgtgggcgccaacaaaagacgcccgcgatataccgcggcggggcgcgcagagacccactcccccatagcgcgcagcaaagcgacagcggcttgcgcaagtatgggcacactaacaagaggggggcggaatacacagcacacaacgtgtattacacaccagcgtgagcgattccaccccacggcgcagccccgccacaaacaatgacggtccaccatacagcggcgacaccgaacgagcgagcacgcgaggcaagaccaacaagacgcttgccgaagcacgtcacgagcacacgacgaaacacccgcccgcaggcacagccacagcccaacacagccgggacataccacaagcatcaacaccagctagcggccaaaccacaaaccagtaggccgaaccacgtagaggcacccaacccgggtcaccaacgcggaggagccacggccagacgcgggcgccaaacccacaaccaccgcagaggcgaccaccataacacatacacacacaaccagcccacaccagagagagtgcc

SEQ ID NO: 514455 - DNA, 845 bp, Homo sapiens
gaactaatcatattttatatcttcttcgaaaacagacttatccccaccttggctatcatcacccgagtgaggcaaccagccagaaggcctgaacgcaggcacatgctgcctatgtctacaccctaagtaggctcccgttcccctactcagtcggcactggatttgacccgtcacaacacaacctagggtgcactgaaacaggtctgactgactcactctcactggcccaaagaactataaagactcgctgagccgacaaggtgaatatgactagctgacagcaatagctgacatagtacagataccgtctttagcggactccaattatgactcgcgtaaagcccatgtcgaagcccccgatcgctgggtcaatagtagctgtgacgcagtacttctttaagaactaggcggatagtgggtataatacgccgtcatattcagttctcaagaccctctgacataaatagaataagctctgacccccttccttgtagctatccctgatgaggcgataattgtataacaggctccatctgactatcgagaacagacctaaaaatcgctgcattgcgatagtcttcaagtcagccagataggcctcgttagtaacagccattctcatgcaaaaccccctgaagcgttcaccggcgcagtcattctgataatcgtccacggacttacatcctcattactattctgcctagcataaggcaaactatggaacgcactcacaggcgcatcataatcctctgtcaaggacttcaaaggtctggtcccactaatagctttttgaatgagtctagcaagctcgtaactcgcttacccccatattgaactactgggaa

SEQ ID NO: 514456 - DNA, 421 bp, Homo sapiens
ctggggaatagagcaaaccagtcttttaaatttgacacccaagggtgtgtggaccccccattgtaaaattcgccccctaaaccattggtgggcccgatcaaaaaattggggtgggcggtggcccggtttgctttttataaacccaactctttttgaaatccccccaaaaaaaatttaacccccaagggggtccccttgttttaattttgtccccccgggcaaggggcccccaaaattcccgttttttttttcccaaaagtttgggcaccggataatttgccaaaaaaaaaagaaacttttctttttttggggttccccccaaaaccattccaaagccttttgttttttttttttccccattcccatttccaaatgttcccaagggggtataaaaaaaaaacttccccccccttttttttta

SEQ ID NO: 514457 - DNA, 135 bp, Homo sapiens
  misc_feature (20)..(21): n is a, c, g, or t
actccagaggatcccgtgtnncagccaacaggatacatttctacagctagcaggataacagatgagttaaggggcctctctgaattcgcttcatcagatgcgtgacataacctgctatcctgttggctggcgaca

SEQ ID NO: 514458 - DNA, 209 bp, Homo sapiens
tggagtgatggcgaccggtaagtttactgtggccagtgtactcatggacctacttgtaatcgccacccttacggtatcatccatgagcctgccctctatacttatcatcttcacaatactaatgctactgactatcctagaaatcgcgtggcgcctgattcctaggctacgtttgcacccttctagtaggtctctacctgcgcgcccgc

SEQ ID NO: 514459 - DNA, 194 bp, Homo sapiens
cacacgtaacgcctctttcaacttttatcaggttcagtggtacatgtgcagatttgttatataggtaaactcgtgtcacgaggctgtggtatatagaacatttcatcatccaggtactaagcatagtacccagtatgtattctttctaaatcctctctctcctgacttccaccttctagtaggccccatcattt

SEQ ID NO: 514460 - DNA, 828 bp, Homo sapiens
tccttaacaatatgtggtataacccaacaatgaaatatccttcaatgaaaatgacgctataaaacaataaaatgtggggaatcctaaaaactttgtgagtgaaaaaaaccaaacccttcagactacttagagttatgatacaattttttggaagttcaaaaagaaagaaaatctataaaataagtcacttaagggatactattatgttatttcaaggtctttctactttcgaccaatcttcttttaaaaagagagcgggggggtcggcaaagataggagaagaggctcaatatagtattaacattaccaagccctccctataagggttttatccttaaagataggggtgaagtgagttaattatgcctgggataaattcttttgggctttccccctttttacctctttttataagacttccaatttattcctttttcaatttataggttcccctatttgtatgctttacggtgtcgcctcaccttttatacttctggcgtgggtgttcctaaaaaactaatgctcttttttttatacatggcggacgtcgcctcggtgtttacgtgggccacatctcagggggttcgggtttctacttttaaccgggggaaaaaccactggtgtgctttttctctaagagggtaatttccctcagggatcctcctaagggacggacacggcaccgacaggaattttcaagggtgttaccagggccaggccaccagtggtggtctcaacggctttatataatcccaggccttttggggagaggcgccaagggggggggggatcaacccttggatggtaactaaagttcgggacacgccg

SEQ ID NO: 514461 - DNA, 271 bp, Homo sapiens
tgtaatcccagcatcgggaggtggaggcagagaatgcttgagcccgggaggcggaggtgcagtgagccgagatcgcgccattgcactccagcctgggcaacaagagcaaaactccgtctctaaataaataaataagaaacaggatttgggcactcatccctagatgtttgaatttactgtacattccacttcactctcttatcttagaatgcgttaatgttttttcttttactttttttcccactttccagtcggaaatctacatttctga

SEQ ID NO: 514462 - DNA, 822 bp, Homo sapiens
acgagcccgcgggggtcctaaaagggccccgtgggggcaccccatgcgggaaggtcgtggaacctccacaggatccccccacttggacaaaccgaaggatctcggatcgtccgccccccgtccggatttctcccacacccacgagcacatctgcttctgcccccacaacgaaacaaacacccaggaagggcgagtatacccccacagagagaacacagcggtgtataagcgcctctctcagagaacacccggcatacagcgcgtcaaccgggaccaccttctacgccgcccgtgatgaacaggggagcaccaccagaaaggagggacggccccaaggggctaggaacgaccccagaaggctcccacgagcggaaatcctaatacccccggaggtggaccgcccgcaagcctcccgggggtgacaccatacaaatctggggaggcttactcccacggcgcatctccacgacgggaatgtcggcgttttccccccgggaacatacccacgcagggcgaaaactagtggagaagaacatcaacagcggacctcaggcacgccaccggtctgtccactcgtgtaaccctccttttcttgaatcccgattggcgagtgcaacatcctggcagctgctccttgagccatagcaaagtcgatctggtagaactcggttaccccagacatcgtggagaagacggatgggcagaggttagagacaagtttcattttgtattggtccccacaatgccccaacaacagcggggtaatggccgccccagagcaccccacaattacaaaaggggaaacgggcggcactcataaca

SEQ ID NO: 514463 - DNA, 414 bp, Homo sapiens
tccacaaggtctgaatgcggaaccaggaagaaacccaccaacccaaatgccaggagccaaaccagtatgcacaggagcacatatggctaagttcgctgagggcgcattctcgtgaccactgtgtgggatcaaagccaccaattcattcacttgctctgttgaaatgaagcctgtccctgtggcacgtgagacaggtaatgctatctctcccggtgaattccacatatgggacttgaccaatggcttcttcgtgctctggttcagccagcaaccggtccgtgtcatcttcgcgctttcgctcgcagagaggaggggcgagcaacagcgaatattctgagaccacatgcccgttatatgcctgtggtgtcatgtcgcacagcgcgcgctctccccgcgtgccgtattcctacagcc

SEQ ID NO: 514464 - DNA, 228 bp, Homo sapiens
atctaccggagcttaaattgaggtcgggtgggcggctcctgatatcaggagatcgagacatcctggctaaccagtgaaaccccgtctctactaaaaataaaaaaaaaaaaaaattagccgggcttggctggtaggcacctatagtcccagctactcaggaggctgaggcagggagaatgggcttgaacccgtggacgtggagcttgcagttgagccaagcattgggct

SEQ ID NO: 514465 - DNA, 220 bp, Homo sapiens
accgcctggggcagaacaaagagaagctacaacccccccttaatgcaagaagaaacccccaagaagaagacgaaggcaccaggaggactctctaaagcagtagcaaccaccactttgtaaaaggactcttccatcagagatgggaccaccattggggaggactaggacccatatgggactacttccctctccagggccgcagcagccacagaatggatct

SEQ ID NO: 514466 - DNA, 115 bp, Homo sapiens
tatgactgtgtgaaacaaaatgttagagctaaaatcctgtaagaggaaggtgacaactgaaaatcaaccatcatgacaaaatcaatggaaatgaggagggtacctgagctctgaa

SEQ ID NO: 514467 - DNA, 413 bp, Homo sapiens
  misc_feature (13)..(13): n is a, c, g, or t
  misc_feature (270)..(270): n is a, c, g, or t
ttaggcacatagncccaatagaacagaatagagaaccccagaaataaaggccaaatacagcaaactgatccttcaacaaagcatacaaaaacataaatttggcaaaggacacccctattcaataaatggtgctgggaaaactggaaagccacacgtagaagaataaaactgaatccccggccaggttcagtggctcatgcctgtaattgcagcactttgggaggctgaggcaggtagatcacaaggtcaagagatcgagaccatcctggnaaacattgtgaaaccctgtctttactaaaaatacaacaaaaacgcctgtagtcccagctactctggaggctgaggcaggagaatcgcttgaaccaggatgcaaagattgcagtgagccaagatcacaccactgcactccaacc

SEQ ID NO: 514468 - DNA, 148 bp, Homo sapiens
  misc_feature (67)..(67): n is a, c, g, or t
  misc_feature (134)..(134): n is a, c, g, or t
ctatgtctgttctcgtgtagcagcaactgagtctgtccatcagcagacaggcagggaggtgcactgncgtggttctgccttgctgctggtactgatacttcttgcttcagttcatctacatgatctttcctctnaatccagatcttga

SEQ ID NO: 514469 - DNA, 222 bp, Homo sapiens
ttaaagtaatgtataggcaggatcaaaatgaaacaaatataccttatcctagagagctcatagcaaatagggtacctccactgtataaactcagacctactttttgaaggtaactgctttggacctctccttacaagatttttggggttgatgtatttaattttggcccatgtctcagattctcatggtcaaagaggtcaatatattaatatacctgtggtc

SEQ ID NO: 514470 - DNA, 1901 bp, Homo sapiens
gctctgaactcctgaacgtgcaagtggcgcttcgagaggaacattctgcgcgggagcacgggccagctcgctgacattgatcagctggactcccgaaatgaatcttatacatattcgcgaacgcagtggaagactgtgagtgacgggaggcgcgacaggtcgaattcgcatggagcagctcagagatagcgtgaggcccaggccacagtgcaggagtcactcatcgcgaagacctggttcaaggcctcgaccggtctgggacgatccttgcatgtagcttccagtgaccggggtgccacaaaggatgggcagagctctactcgattggcgcagaaccactcagttggactggcacccgacggtgaatttcaccgaggaccgtgaagagcatgggagaacctagtaagcaaattccattgatggacagatctcacatggcaggatcgcacgcagttcacttcccctagtgtgcaaggaagtgtggaacctgcggggcctccattgcgagacagctttgaggactcggtgtatcaccagtaggagacagggcgctacagtctacgcaaaatgattcactccaggagtatgggcactactcaattacatctggtcgttaaaggcgaacaactccttggggagacactctcgaaacgagggaaggaatacgtccccgattgggggtgcaccgaaggataggccaaaggactaggcgctttgaaagaacgaacgctaaggagcacgaaaaagggtacttcgtacactacaacaatcaccgataccttgagaatacgcgtttccaacaccctctgacaatttggcaccaagatcaggaatcctggtcgggtagcaccattacactcagcacgaccgagggaaaggtagcccttcattatgaaaagagggttagcgctctctgagggaacagccgcagcgaaccccacacgacttagcattaggattggtcagctcatccgttgaaatatactcacacattcgcgaacagtgtgcacattccgcggtgtgacaaagtagaaccgcacaactactagaatctcgtcaggttcgcccctaggaagggcattcaggcggttcacgggcaccagtatgtatcggaacaagtgcgggaaagcgagcccgatgatggagacccgtaggaggctgaggataaaaatcaatagaccatttataatttagcgtgtgttactttcgtaacggtgcacgcagaaacgctatagaagtaccactaacatgcgtggacattagtgcatcaagattcgacggactacacgtgtaacagcatggtatgacggtgaactcgcattggaaactgtgtgccaatgatgaaaggcaatgattgaagactcaccaaagggtaggcgaacaccgtgtgatgcccgaagtaacatcgtatatactcggtgggcgtatacacgctcaaaccgaagcacgaacgacaacaccctaacccgcaagcagtcgtaggccaaatagtgaacacacgaaaggggtgtaacaacatagttaggcaacagcgagctcctcacggagcaacagcgcacggcacaaaatgttgtagacggcggtcttgacacgagagagccacaactctaaaaagtagacaattcacagacacaacacgactcgaagagtaacaccgaacaataagtaagacaacatatacaaaaccgaaacacctaaaatccaacaaacatccaccaactgctatcagacacaaacaacatagaacaaacactaagaagatagaatagaaacactatacacacaccacaaaagaaataatacacaagcataaaacaacataataaaagaagacaacacagaacactaaacaacaacacgaacaaacaactaagcagtactctactctatcctacttgggt
